United States Patent 12,606,847 (ENGINEERED VIRAL CAPSID POLYPEPTIDES AND USES THEREOF) - sequence listing, part 7

SEQ ID NO: 133892 - protein, 33 aa, Artificial Sequence
  Description of Artificial Sequence: Synthetic polypeptide
DEFEIVTTNPVATEQYGTVCSATDGPVDFEGND

SEQ ID NO: 133893 - protein, 36 aa, Artificial Sequence
  Description of Artificial Sequence: Synthetic polypeptide
DEEEIRTTNPVATEQYGSCSSTTPAGPNMRNGMNPV

SEQ ID NO: 133894 - protein, 33 aa, Artificial Sequence
  Description of Artificial Sequence: Synthetic polypeptide
DEFEIVTTNPVATEQYGHVCSATDGPVEFEGND

SEQ ID NO: 133895 - protein, 36 aa, Artificial Sequence
  Description of Artificial Sequence: Synthetic polypeptide
DEEEIRTTNPVATEQYGSCSSTTPAGPNMRMGMNPV

SEQ ID NO: 133896 - protein, 31 aa, Artificial Sequence
  Description of Artificial Sequence: Synthetic polypeptide
QESEIRTTNPVATEQWGSAPEINEQDHEGEG

SEQ ID NO: 133897 - protein, 36 aa, Artificial Sequence
  Description of Artificial Sequence: Synthetic polypeptide
DDEEIRTTNPVATEQYGDVSVTEMNDLGEQGGDGEV

SEQ ID NO: 133898 - protein, 33 aa, Artificial Sequence
  Description of Artificial Sequence: Synthetic polypeptide
DEFEISTVNPVATEQYGCVCSTNHANFGSNNQS

SEQ ID NO: 133899 - protein, 34 aa, Artificial Sequence
  Description of Artificial Sequence: Synthetic polypeptide
DEEEIRATNPVTTEQYGSVATNNNNNNQQGTTTT

SEQ ID NO: 133900 - protein, 33 aa, Artificial Sequence
  Description of Artificial Sequence: Synthetic polypeptide
QESEIRTTNPVGTECWGSVSCINEPQDREGENG

SEQ ID NO: 133901 - protein, 33 aa, Artificial Sequence
  Description of Artificial Sequence: Synthetic polypeptide
DEFEIRTTNPVAYHAWGSVSCTNLSDEPGGPER

SEQ ID NO: 133902 - protein, 33 aa, Artificial Sequence
  Description of Artificial Sequence: Synthetic polypeptide
DEEEIRTTNPVATESYGSVFGVSGEGGGNNGQE

SEQ ID NO: 133903 - protein, 34 aa, Artificial Sequence
  Description of Artificial Sequence: Synthetic polypeptide
DEFEIRTTNPVAYDAWGSVPSCTNELSQEPGPGR

SEQ ID NO: 133904 - protein, 32 aa, Artificial Sequence
  Description of Artificial Sequence: Synthetic polypeptide
DEAEIATTNPVATEQWGSVSQGPGGDSGPSRM

SEQ ID NO: 133905 - protein, 35 aa, Artificial Sequence
  Description of Artificial Sequence: Synthetic polypeptide
DDEEIRTTNPVATEQYGDVTSTTMGDLGQEGGGEG

SEQ ID NO: 133906 - protein, 36 aa, Artificial Sequence
  Description of Artificial Sequence: Synthetic polypeptide
DEFEIRTTNPVATEQYGSVSWTTPAGPNMRNGMNPV

SEQ ID NO: 133907 - protein, 34 aa, Artificial Sequence
  Description of Artificial Sequence: Synthetic polypeptide
DEEEIRTTNPVATESYGSVDDTTMDNGGGEGQGE

SEQ ID NO: 133908 - protein, 35 aa, Artificial Sequence
  Description of Artificial Sequence: Synthetic polypeptide
DEEEIRATNPVAYEQYGSVCATNPQLNPDDQGGEA

SEQ ID NO: 133909 - protein, 34 aa, Artificial Sequence
  Description of Artificial Sequence: Synthetic polypeptide
DEEEIRATNPVAYEQYGSVCATNGEPTGGDLENG

SEQ ID NO: 133910 - protein, 37 aa, Artificial Sequence
  Description of Artificial Sequence: Synthetic polypeptide
AEEEIRTTNPVATEQYGSVSTVTTNQQNGTEAGNEDE

SEQ ID NO: 133911 - protein, 34 aa, Artificial Sequence
  Description of Artificial Sequence: Synthetic polypeptide
DDEEIRTTNPVATEQYGCVCSWGNDHQNFGSEQA

SEQ ID NO: 133912 - protein, 37 aa, Artificial Sequence
  Description of Artificial Sequence: Synthetic polypeptide
DEEEIRATNPVATEQYGVVSTVNQQQLQQGENNQQND

SEQ ID NO: 133913 - protein, 37 aa, Artificial Sequence
  Description of Artificial Sequence: Synthetic polypeptide
DEEEIRATNPVATEQYGVVSTVNQQQLQQGSNQQDED

SEQ ID NO: 133914 - protein, 37 aa, Artificial Sequence
  Description of Artificial Sequence: Synthetic polypeptide
DEEEIRATNPVATEQYGVVSTVNQQQLQQGSTNQQED

SEQ ID NO: 133915 - protein, 36 aa, Artificial Sequence
  Description of Artificial Sequence: Synthetic polypeptide
DEEEIRATNPVATEQYGVVSTVTNNQNDEIGSNNEQ

SEQ ID NO: 133916 - protein, 37 aa, Artificial Sequence
  Description of Artificial Sequence: Synthetic polypeptide
DEEEIRATNPVATEQYGVVSTVTNTNLQAGENNQEQD

SEQ ID NO: 133917 - protein, 37 aa, Artificial Sequence
  Description of Artificial Sequence: Synthetic polypeptide
DEEEIRATNPVATEQYGVVSTVTNTNLQAGTNNQQQA

SEQ ID NO: 133918 - protein, 36 aa, Artificial Sequence
  Description of Artificial Sequence: Synthetic polypeptide
AEEEIRTTNPVATEQYGSVSTVTVNDNQQNTEENNT

SEQ ID NO: 133919 - protein, 31 aa, Artificial Sequence
  Description of Artificial Sequence: Synthetic polypeptide
QESEIRTTNPVATECYGDVSCNEPQDHEEEL

SEQ ID NO: 133920 - protein, 32 aa, Artificial Sequence
  Description of Artificial Sequence: Synthetic polypeptide
QESEIRTTNPVATECYGEAPEINCQDREGENK

SEQ ID NO: 133921 - protein, 33 aa, Artificial Sequence
  Description of Artificial Sequence: Synthetic polypeptide
QESEIRTTNPVATECYGEVPEINCPQDREGENK

SEQ ID NO: 133922 - protein, 36 aa, Artificial Sequence
  Description of Artificial Sequence: Synthetic polypeptide
AEEEIRTTNPVATEQYGSVSTVTTQNMEQGTNNVTE

SEQ ID NO: 133923 - protein, 35 aa, Artificial Sequence
  Description of Artificial Sequence: Synthetic polypeptide
DEEEIRTTNPVATEQYGSCSTLNSIDDRISEEEDI

SEQ ID NO: 133924 - protein, 34 aa, Artificial Sequence
  Description of Artificial Sequence: Synthetic polypeptide
DEEEIRTTNPVATEQYGSCSTGTIEPDDPMDGTH

SEQ ID NO: 133925 - protein, 32 aa, Artificial Sequence
  Description of Artificial Sequence: Synthetic polypeptide
DEEEIRATNPVAYEQWGMVTGDNDDQGGGNNL

SEQ ID NO: 133926 - protein, 32 aa, Artificial Sequence
  Description of Artificial Sequence: Synthetic polypeptide
DEEEIRATNPVAYEQWGMVTGDNDHQGGGGNL

SEQ ID NO: 133927 - protein, 32 aa, Artificial Sequence
  Description of Artificial Sequence: Synthetic polypeptide
DEEEIRATNPVAYEQWGMVTGDNDHQGGGNQS

SEQ ID NO: 133928 - protein, 36 aa, Artificial Sequence
  Description of Artificial Sequence: Synthetic polypeptide
AEEEIRTTNPVATEQYGSVSTVTTNTNTEQGENETD

SEQ ID NO: 133929 - protein, 33 aa, Artificial Sequence
  Description of Artificial Sequence: Synthetic polypeptide
QESEIRTTNPVATECYGSVSCIVEPQDREEENG

SEQ ID NO: 133930 - protein, 32 aa, Artificial Sequence
  Description of Artificial Sequence: Synthetic polypeptide
DEEEIRATNPVAYEQWGMVTGDPNDHQSGGNL

SEQ ID NO: 133931 - protein, 34 aa, Artificial Sequence
  Description of Artificial Sequence: Synthetic polypeptide
DEEEIRTTNPVATEQYGSCSTEGDPQQSISQTFF

SEQ ID NO: 133932 - protein, 37 aa, Artificial Sequence
  Description of Artificial Sequence: Synthetic polypeptide
DEEEIRATNPVATEQYGVVSTVNLQQGNTEQGSTDDD

SEQ ID NO: 133933 - protein, 33 aa, Artificial Sequence
  Description of Artificial Sequence: Synthetic polypeptide
DEAEIATTNPVATEQYGCVAANNLQDMGPGGEI

SEQ ID NO: 133934 - protein, 34 aa, Artificial Sequence
  Description of Artificial Sequence: Synthetic polypeptide
DEEEIRTTNPVATESYGSVVCTRASSNNNGNNED

SEQ ID NO: 133935 - protein, 32 aa, Artificial Sequence
  Description of Artificial Sequence: Synthetic polypeptide
QEVEIRTTNPVATEQYGSVGDDDGNEGGENEI

SEQ ID NO: 133936 - protein, 37 aa, Artificial Sequence
  Description of Artificial Sequence: Synthetic polypeptide
AEEEIRTTNPVATEQYGSVSTVTQGNNQQAIGTNSEY

SEQ ID NO: 133937 - protein, 35 aa, Artificial Sequence
  Description of Artificial Sequence: Synthetic polypeptide
DDEEIRTTNPVATEQYGSVSTDYLTTTEETQNDDN

SEQ ID NO: 133938 - protein, 31 aa, Artificial Sequence
  Description of Artificial Sequence: Synthetic polypeptide
SAEEIATTNPVATAQWGSVSQGNPDNANGNN

SEQ ID NO: 133939 - protein, 38 aa, Artificial Sequence
  Description of Artificial Sequence: Synthetic polypeptide
AEEEIRTTNPVATEQYGSVSTVTQGNLQQGIGTNSEDE

SEQ ID NO: 133940 - protein, 34 aa, Artificial Sequence
  Description of Artificial Sequence: Synthetic polypeptide
DEEEIRCTNPVATEQYGCVCSMTADFQGFNSDQA

SEQ ID NO: 133941 - protein, 30 aa, Artificial Sequence
  Description of Artificial Sequence: Synthetic polypeptide
SAEEIATTNPVATASWGCVAGTGLQHGNQA

SEQ ID NO: 133942 - protein, 33 aa, Artificial Sequence
  Description of Artificial Sequence: Synthetic polypeptide
DEEVIRTTNPVATEQYGCVCSWELNDNFNSEQS

SEQ ID NO: 133943 - protein, 30 aa, Artificial Sequence
  Description of Artificial Sequence: Synthetic polypeptide
SAEEIATTNPVATASWGCVAGTGLQNGNAD

SEQ ID NO: 133944 - protein, 33 aa, Artificial Sequence
  Description of Artificial Sequence: Synthetic polypeptide
SAEEIATTNPVATEQWGAVTSTNHLQTEGGTQD

SEQ ID NO: 133945 - protein, 36 aa, Artificial Sequence
  Description of Artificial Sequence: Synthetic polypeptide
DEEEIRTTNPVATEQYGSCGSPTNNLEEELGEEILD

SEQ ID NO: 133946 - protein, 33 aa, Artificial Sequence
  Description of Artificial Sequence: Synthetic polypeptide
SAEEIATTNPVATEQWGCVAGTGLQDAGDNARM

SEQ ID NO: 133947 - protein, 35 aa, Artificial Sequence
  Description of Artificial Sequence: Synthetic polypeptide
DEEEIRTTNPVATEQYGSCCSPTNSDIELYEDTQE

SEQ ID NO: 133948 - protein, 34 aa, Artificial Sequence
  Description of Artificial Sequence: Synthetic polypeptide
DEEVIRTTNPVATEQYGCVCSTGELNDNFNSNQS

SEQ ID NO: 133949 - protein, 33 aa, Artificial Sequence
  Description of Artificial Sequence: Synthetic polypeptide
SAEEIATTNPVATEQWGCVAGTNLQAEMGGERN

SEQ ID NO: 133950 - protein, 33 aa, Artificial Sequence
  Description of Artificial Sequence: Synthetic polypeptide
SAEEIATTNPVATEQWGCVAGTNLQAEMTNNRN

SEQ ID NO: 133951 - protein, 34 aa, Artificial Sequence
  Description of Artificial Sequence: Synthetic polypeptide
DEEVIRTTNPVATEQYGCVCSTENHNDNFGSDQS

SEQ ID NO: 133952 - protein, 38 aa, Artificial Sequence
  Description of Artificial Sequence: Synthetic polypeptide
AEEEIRTTNPVATEQYGSVSTVTNTNLQAGTTEENTDQ

SEQ ID NO: 133953 - protein, 33 aa, Artificial Sequence
  Description of Artificial Sequence: Synthetic polypeptide
DEEVIRTTNPVATEQYGCVCSSEHNDNFGSQQS

SEQ ID NO: 133954 - protein, 34 aa, Artificial Sequence
  Description of Artificial Sequence: Synthetic polypeptide
DDEEIRTTNPVATEQYGSVSTMDGEGGGGEEEQG

SEQ ID NO: 133955 - protein, 35 aa, Artificial Sequence
  Description of Artificial Sequence: Synthetic polypeptide
DDEEIRTTNPVATEQYGSVSTMDIANEGGGEEEGG

SEQ ID NO: 133956 - protein, 32 aa, Artificial Sequence
  Description of Artificial Sequence: Synthetic polypeptide
SAEEIATTNPVATEQWGCVAGTGLQDEGDNQH

SEQ ID NO: 133957 - protein, 33 aa, Artificial Sequence
  Description of Artificial Sequence: Synthetic polypeptide
SAEEIATTNPVATAQWGSVSGTGNPDTADGNTR

SEQ ID NO: 133958 - protein, 32 aa, Artificial Sequence
  Description of Artificial Sequence: Synthetic polypeptide
SAEEIATTNPVATAQWGSVSGTGNPDNANGND

SEQ ID NO: 133959 - protein, 35 aa, Artificial Sequence
  Description of Artificial Sequence: Synthetic polypeptide
DDEEIRTTNPVATEQYGSVSSTTPTGPNMRNGQPV

SEQ ID NO: 133960 - protein, 36 aa, Artificial Sequence
  Description of Artificial Sequence: Synthetic polypeptide
DEEEIRTTNPVATEQYGSCISTNNLTETGHISMQEM

SEQ ID NO: 133961 - protein, 37 aa, Artificial Sequence
  Description of Artificial Sequence: Synthetic polypeptide
AEEEIRTTNPVATEQYGSVSTVTQGNQQQIGTNSEYG

SEQ ID NO: 133962 - protein, 36 aa, Artificial Sequence
  Description of Artificial Sequence: Synthetic polypeptide
DDEEIRTTNPVATEQYGSVSNTTPDGPNMGNGENDQ

SEQ ID NO: 133963 - protein, 31 aa, Artificial Sequence
  Description of Artificial Sequence: Synthetic polypeptide
SAEEIATTNPVATAQWGCNVAGNGLQNGDNA

SEQ ID NO: 133964 - protein, 31 aa, Artificial Sequence
  Description of Artificial Sequence: Synthetic polypeptide
SAEEIATTNPVATAQWGCVAGNGLQNGNHAA

SEQ ID NO: 133965 - protein, 34 aa, Artificial Sequence
  Description of Artificial Sequence: Synthetic polypeptide
DEEEIRCTNPVATEQYGCVCSDTEHQENFNSDQS

SEQ ID NO: 133966 - protein, 35 aa, Artificial Sequence
  Description of Artificial Sequence: Synthetic polypeptide
DDEEIRTTNPVATEQYGSVSSDDLDQNNEGQGGDE

SEQ ID NO: 133967 - protein, 30 aa, Artificial Sequence
  Description of Artificial Sequence: Synthetic polypeptide
SAEEIATTNPVATAQWGCVAGTGLMNGNAL

SEQ ID NO: 133968 - protein, 31 aa, Artificial Sequence
  Description of Artificial Sequence: Synthetic polypeptide
SAEEIATTNPVATAQWGCVAGTGLQNNGNAE

SEQ ID NO: 133969 - protein, 30 aa, Artificial Sequence
  Description of Artificial Sequence: Synthetic polypeptide
SAEEIATTNPVATAQWGCVATGLAAGMNDH

SEQ ID NO: 133970 - protein, 31 aa, Artificial Sequence
  Description of Artificial Sequence: Synthetic polypeptide
SAEEIATTNPVATAQWGCVATGLADRGGNDF

SEQ ID NO: 133971 - protein, 33 aa, Artificial Sequence
  Description of Artificial Sequence: Synthetic polypeptide
DEEEIRTTNPVATEQYGSCIAPDSQQENIVNDI

SEQ ID NO: 133972 - protein, 36 aa, Artificial Sequence
  Description of Artificial Sequence: Synthetic polypeptide
DDEEIRTTNPVATEQYGSVSSTTMDGPNNGNGDNDD

SEQ ID NO: 133973 - protein, 36 aa, Artificial Sequence
  Description of Artificial Sequence: Synthetic polypeptide
DDEEIRTTNPVATEQYGSVSSTTPAGPNMRNGMNPE

SEQ ID NO: 133974 - protein, 36 aa, Artificial Sequence
  Description of Artificial Sequence: Synthetic polypeptide
DDEEIRTTNPVATEQYGSVSSTTPAGPNMRNGMNPV

SEQ ID NO: 133975 - protein, 34 aa, Artificial Sequence
  Description of Artificial Sequence: Synthetic polypeptide
DEEEIRTTNPVATEQYGSCIAPDSQQENIVLANG

SEQ ID NO: 133976 - protein, 34 aa, Artificial Sequence
  Description of Artificial Sequence: Synthetic polypeptide
DEEVIRTTNPVATEQYGQCVCSTEDNDNFGSDQS

SEQ ID NO: 133977 - protein, 36 aa, Artificial Sequence
  Description of Artificial Sequence: Synthetic polypeptide
DDEEIRTTNPVATEQYGSVSSTTPAGPWMRNGMNPV

SEQ ID NO: 133978 - protein, 36 aa, Artificial Sequence
  Description of Artificial Sequence: Synthetic polypeptide
DDEEIRTTNPVATEQYGSVSSTTPAIPNMRNGMNPV

SEQ ID NO: 133979 - protein, 35 aa, Artificial Sequence
  Description of Artificial Sequence: Synthetic polypeptide
DEEVIRTTNPVATEQYGHTASQTGPLQNSGEIARL

SEQ ID NO: 133980 - protein, 36 aa, Artificial Sequence
  Description of Artificial Sequence: Synthetic polypeptide
DDEEIRTTNPVATEQYGSVSSTTPCGPNMRNGMNPV

SEQ ID NO: 133981 - protein, 36 aa, Artificial Sequence
  Description of Artificial Sequence: Synthetic polypeptide
DEEVIRTTNPVATEQYGCSVVSTEAHSDNTGQNNRS

SEQ ID NO: 133982 - protein, 34 aa, Artificial Sequence
  Description of Artificial Sequence: Synthetic polypeptide
RESEIRTTNPVATECWGSVSCINEPQDREGENGD

SEQ ID NO: 133983 - protein, 36 aa, Artificial Sequence
  Description of Artificial Sequence: Synthetic polypeptide
DEEEIRCTNPVATEQYGCVCSMTGNDFQEGFNSDQA

SEQ ID NO: 133984 - protein, 35 aa, Artificial Sequence
  Description of Artificial Sequence: Synthetic polypeptide
DDEEIRTTNPVATEQYGSVSTMDIEEGNGGGEEEQ

SEQ ID NO: 133985 - protein, 34 aa, Artificial Sequence
  Description of Artificial Sequence: Synthetic polypeptide
DDEEIRTTNPVATEQYGSVSTMGIVEGGGGEEEQ

SEQ ID NO: 133986 - protein, 33 aa, Artificial Sequence
  Description of Artificial Sequence: Synthetic polypeptide
DEEEIRTTNPVATEQYGSCAAGDALGQHPDAQA

SEQ ID NO: 133987 - protein, 33 aa, Artificial Sequence
  Description of Artificial Sequence: Synthetic polypeptide
DEEVIQTTNPYATEIYGSVSTNGLDDGGHGQIC

SEQ ID NO: 133988 - protein, 31 aa, Artificial Sequence
  Description of Artificial Sequence: Synthetic polypeptide
SDECISTTNPVATEQWGKVCSTNDHQQVNDL

SEQ ID NO: 133989 - protein, 34 aa, Artificial Sequence
  Description of Artificial Sequence: Synthetic polypeptide
DEEVIQTTNPVATEIYGSVPSTYGLDDGGHGQIR

SEQ ID NO: 133990 - protein, 35 aa, Artificial Sequence
  Description of Artificial Sequence: Synthetic polypeptide
DEEVIQTTNPVATEIYGSFVSVTNGLDDGGHGQIR

SEQ ID NO: 133991 - protein, 31 aa, Artificial Sequence
  Description of Artificial Sequence: Synthetic polypeptide
SDECISTTNPVATEQWGKVSHTNDHQQKNDL

SEQ ID NO: 133992 - protein, 37 aa, Artificial Sequence
  Description of Artificial Sequence: Synthetic polypeptide
AEEEIRTTNPVATEQYGSVSTVTNQQQGNQQGNDEGD

SEQ ID NO: 133993 - protein, 38 aa, Artificial Sequence
  Description of Artificial Sequence: Synthetic polypeptide
AEEEIRTTNPVATEQYGSVSTVTNQQLGNQQQGNNETD

SEQ ID NO: 133994 - protein, 35 aa, Artificial Sequence
  Description of Artificial Sequence: Synthetic polypeptide
DDEEIRTTNPVATEQYGSVSTMGIEGQGGGEEEDT

SEQ ID NO: 133995 - protein, 34 aa, Artificial Sequence
  Description of Artificial Sequence: Synthetic polypeptide
DEEVIQTTNPVATEIYGISVCDTNLDDGGHGQIR

SEQ ID NO: 133996 - protein, 37 aa, Artificial Sequence
  Description of Artificial Sequence: Synthetic polypeptide
AEEEIRTTNPVATEQYGSVSTVTNQQGNNQLAGNEEE

SEQ ID NO: 133997 - protein, 38 aa, Artificial Sequence
  Description of Artificial Sequence: Synthetic polypeptide
AEEEIRTTNPVATEQYGSVSTVTNQQAGNLQQGNNEGD

SEQ ID NO: 133998 - protein, 36 aa, Artificial Sequence
  Description of Artificial Sequence: Synthetic polypeptide
AEEEIRTTNPVATEQYGSVSTVTNQNQNQQNNNDEE

SEQ ID NO: 133999 - protein, 33 aa, Artificial Sequence
  Description of Artificial Sequence: Synthetic polypeptide
DEEVICCTNPTAYAQYGSVATNLQHRDGTEGRM

SEQ ID NO: 134000 - protein, 32 aa, Artificial Sequence
  Description of Artificial Sequence: Synthetic polypeptide
SDEEIRTTNPVATHQYGCVCSTEDQNFGSDQS

SEQ ID NO: 134001 - protein, 31 aa, Artificial Sequence
  Description of Artificial Sequence: Synthetic polypeptide
DEEVIATVNPVAYEPYGSVANAGNLDMNGNN

SEQ ID NO: 134002 - protein, 30 aa, Artificial Sequence
  Description of Artificial Sequence: Synthetic polypeptide
DEEVIATVNPVAYEPYGNVSNAGNLEMMNN

SEQ ID NO: 134003 - protein, 30 aa, Artificial Sequence
  Description of Artificial Sequence: Synthetic polypeptide
SDEEVACTNPVATEGYGNVAANTIQSRGQR

SEQ ID NO: 134004 - protein, 36 aa, Artificial Sequence
  Description of Artificial Sequence: Synthetic polypeptide
DEEEIRTTNPVATEQYGSAYSPTTNEITSVGEENIF

SEQ ID NO: 134005 - protein, 37 aa, Artificial Sequence
  Description of Artificial Sequence: Synthetic polypeptide
AEEEIRTTNPVATEQYGSVSTVTNQQLGNQQGTEEGD

SEQ ID NO: 134006 - protein, 34 aa, Artificial Sequence
  Description of Artificial Sequence: Synthetic polypeptide
DDEEIRTTNPVATEQYGSVSTMGIEGEGGEEEDI

SEQ ID NO: 134007 - protein, 37 aa, Artificial Sequence
  Description of Artificial Sequence: Synthetic polypeptide
AEEEIRTTNPVATEQYGSVSTVTNQQQGQEQGNNAND

SEQ ID NO: 134008 - protein, 38 aa, Artificial Sequence
  Description of Artificial Sequence: Synthetic polypeptide
AEEEIRTTNPVATEQYGSVSTVTNQQQLQQIGTNSEEI

SEQ ID NO: 134009 - protein, 37 aa, Artificial Sequence
  Description of Artificial Sequence: Synthetic polypeptide
AEEEIRTTNPVATEQYGSVSTVTNSQLGNTEAGTNLT

SEQ ID NO: 134010 - protein, 37 aa, Artificial Sequence
  Description of Artificial Sequence: Synthetic polypeptide
AEEEIRTTNPVATEQYGSVSTVTNSQLGNGEQGNNTD

SEQ ID NO: 134011 - protein, 37 aa, Artificial Sequence
  Description of Artificial Sequence: Synthetic polypeptide
AEEEIRTTNPVATEQYGSVSTVTNSQAGNNEAGNNDE

SEQ ID NO: 134012 - protein, 35 aa, Artificial Sequence
  Description of Artificial Sequence: Synthetic polypeptide
DEEEIRCTNPVATEQYGCVCSMTGNDFQGFGSEQN

SEQ ID NO: 134013 - protein, 38 aa, Artificial Sequence
  Description of Artificial Sequence: Synthetic polypeptide
DEEEIRTTNPVATEQYGSVISPTMNAVHQAFMQMPNRD

SEQ ID NO: 134014 - protein, 37 aa, Artificial Sequence
  Description of Artificial Sequence: Synthetic polypeptide
AEEEIRTTNPVATEQYGSVSTVTNSNLNNNEQATNVA

SEQ ID NO: 134015 - protein, 37 aa, Artificial Sequence
  Description of Artificial Sequence: Synthetic polypeptide
AEEEIRTTNPVATEQYGSVSTVTNSNLNNNEQANNVE

SEQ ID NO: 134016 - protein, 35 aa, Artificial Sequence
  Description of Artificial Sequence: Synthetic polypeptide
SAEEIATTNPVATEQYGSVCAANNLQEAPGENARE

SEQ ID NO: 134017 - protein, 35 aa, Artificial Sequence
  Description of Artificial Sequence: Synthetic polypeptide
DEEVIRTTNPVATEPYGSVCFTNAPSTRTGGNPPF

SEQ ID NO: 134018 - protein, 35 aa, Artificial Sequence
  Description of Artificial Sequence: Synthetic polypeptide
DDEEIRTTNPVATEQYGSVSTMDIQNGGGGGEEQD

SEQ ID NO: 134019 - protein, 36 aa, Artificial Sequence
  Description of Artificial Sequence: Synthetic polypeptide
DDEEIRTTNPVATEQYGSVSTMDIQNGLGGGEEEQM

SEQ ID NO: 134020 - protein, 38 aa, Artificial Sequence
  Description of Artificial Sequence: Synthetic polypeptide
AEEEIRTTNPVATEQYGSVSTVTNSNLGNNEQAGNNVT

SEQ ID NO: 134021 - protein, 35 aa, Artificial Sequence
  Description of Artificial Sequence: Synthetic polypeptide
DDEEIRTTNPVATEQYGSVSTMDIQNGTGGGEEGG

SEQ ID NO: 134022 - protein, 30 aa, Artificial Sequence
  Description of Artificial Sequence: Synthetic polypeptide
SAEEIATTNPVGTEQWGGCCATNLQMPGRN

SEQ ID NO: 134023 - protein, 37 aa, Artificial Sequence
  Description of Artificial Sequence: Synthetic polypeptide
AEEEIRTTNPVATEQYGSVSTVTNSELGNTEAGNTED

SEQ ID NO: 134024 - protein, 33 aa, Artificial Sequence
  Description of Artificial Sequence: Synthetic polypeptide
DEEVIRTTNPVATECYGKHSTGISELQPPSNEF

SEQ ID NO: 134025 - protein, 37 aa, Artificial Sequence
  Description of Artificial Sequence: Synthetic polypeptide
AEEEIRTTNPVATEQYGSVSTVTNSELGNTEAGNQMG

SEQ ID NO: 134026 - protein, 37 aa, Artificial Sequence
  Description of Artificial Sequence: Synthetic polypeptide
AEEEIRTTNPVATEQYGSVSTVTNQQSSTESGVNNIS

SEQ ID NO: 134027 - protein, 32 aa, Artificial Sequence
  Description of Artificial Sequence: Synthetic polypeptide
DEEVIRTTNPVATECYGKHITWFELQPPSNEF

SEQ ID NO: 134028 - protein, 34 aa, Artificial Sequence
  Description of Artificial Sequence: Synthetic polypeptide
DEEEIRCTNPVATEQYGCVCSMTNDFIGFGSEQA

SEQ ID NO: 134029 - protein, 34 aa, Artificial Sequence
  Description of Artificial Sequence: Synthetic polypeptide
DEEVIRTTNPVACEQYGSVVCSASLNIQDHGYLA

SEQ ID NO: 134030 - protein, 37 aa, Artificial Sequence
  Description of Artificial Sequence: Synthetic polypeptide
AEEEIRTTNPVATEQYGSVSTVTNSQSGNLEAGNNME

SEQ ID NO: 134031 - protein, 34 aa, Artificial Sequence
  Description of Artificial Sequence: Synthetic polypeptide
QEVEIRTTNPVATEQYGSVDNTNDEGEGQGENQT

SEQ ID NO: 134032 - protein, 36 aa, Artificial Sequence
  Description of Artificial Sequence: Synthetic polypeptide
DDEEIRTTNPVATEQYGSVSITNGINDQGQGGGEGE

SEQ ID NO: 134033 - protein, 33 aa, Artificial Sequence
  Description of Artificial Sequence: Synthetic polypeptide
RESEIRTTNPVATECWGHVSCINEPQDREGENG

SEQ ID NO: 134034 - protein, 28 aa, Artificial Sequence
  Description of Artificial Sequence: Synthetic peptide
QMEEIATTNPVATEQYGEAPEVCQHEEK

SEQ ID NO: 134035 - protein, 28 aa, Artificial Sequence
  Description of Artificial Sequence: Synthetic peptide
QMEEIATTNPVATEQYGEAPEVVQPEEK

SEQ ID NO: 134036 - protein, 28 aa, Artificial Sequence
  Description of Artificial Sequence: Synthetic peptide
QMGEIAPTNPCSSEQYGIVSCNLQSMTR

SEQ ID NO: 134037 - protein, 28 aa, Artificial Sequence
  Description of Artificial Sequence: Synthetic peptide
QNEEIATTNPVATEQYGEAPEVCQHEEC

SEQ ID NO: 134038 - protein, 28 aa, Artificial Sequence
  Description of Artificial Sequence: Synthetic peptide
QNEEIATTNPVATEQYGEAPEVCQHEEK

SEQ ID NO: 134039 - protein, 36 aa, Artificial Sequence
  Description of Artificial Sequence: Synthetic polypeptide
DEEEIRTTNPVATEQYGSCNSLTNEMWQVLDPEGQS

SEQ ID NO: 134040 - protein, 28 aa, Artificial Sequence
  Description of Artificial Sequence: Synthetic peptide
QNGEIAPTNPCSSEQYGIVSCNVQSGTR

SEQ ID NO: 134041 - protein, 36 aa, Artificial Sequence
  Description of Artificial Sequence: Synthetic polypeptide
DDEEIRTTNPVATEQYGSVIMGNLNGGNGQTGNGGQ

SEQ ID NO: 134042 - protein, 35 aa, Artificial Sequence
  Description of Artificial Sequence: Synthetic polypeptide
DDEEIRTTNPVATEQYGSVISDTLGSGLTTGDGED

SEQ ID NO: 134043 - protein, 34 aa, Artificial Sequence
  Description of Artificial Sequence: Synthetic polypeptide
DEEEIRCTNPVATEPYGSTVNVTGNEHSQHVNMN

SEQ ID NO: 134044 - protein, 35 aa, Artificial Sequence
  Description of Artificial Sequence: Synthetic polypeptide
DDEEIRTTNPVATEQYGSVISGLQGDQGGGNGNGD

SEQ ID NO: 134045 - protein, 34 aa, Artificial Sequence
  Description of Artificial Sequence: Synthetic polypeptide
DEEVIRTTNPVAYEPYGSTVNTTGNGSVQRSNNE

SEQ ID NO: 134046 - protein, 28 aa, Artificial Sequence
  Description of Artificial Sequence: Synthetic peptide
QQEEIATTNPVATEQYGEAPEVCQHCEK

SEQ ID NO: 134047 - protein, 28 aa, Artificial Sequence
  Description of Artificial Sequence: Synthetic peptide
QQEEIATTNPVATEQYGEAPEVCQHEEK

SEQ ID NO: 134048 - protein, 28 aa, Artificial Sequence
  Description of Artificial Sequence: Synthetic peptide
QQEEIATTNPVATEQYGEAPEVCQVEEK

SEQ ID NO: 134049 - protein, 36 aa, Artificial Sequence
  Description of Artificial Sequence: Synthetic polypeptide
AEEEIRTTNPVATEQYGSVSTVTTNNNNTDEGTNVE

SEQ ID NO: 134050 - protein, 28 aa, Artificial Sequence
  Description of Artificial Sequence: Synthetic peptide
QQGEIAPTNPCSSEQYGIVSCNLQSGTN

SEQ ID NO: 134051 - protein, 36 aa, Artificial Sequence
  Description of Artificial Sequence: Synthetic polypeptide
DEEEIRTTNPVATEQYGSCNNLTNHNDTGGNSEIRP

SEQ ID NO: 134052 - protein, 35 aa, Artificial Sequence
  Description of Artificial Sequence: Synthetic polypeptide
DEEEIRTTNPVATEQYGSCNGQMNLLTGGNEGFED

SEQ ID NO: 134053 - protein, 36 aa, Artificial Sequence
  Description of Artificial Sequence: Synthetic polypeptide
DDEEIRTTNPVATEQYGSVISTTTDGFQDEGNNNED

SEQ ID NO: 134054 - protein, 28 aa, Artificial Sequence
  Description of Artificial Sequence: Synthetic peptide
QQEEIATTNPVATEQYGEAIHVCQHEEK

SEQ ID NO: 134055 - protein, 28 aa, Artificial Sequence
  Description of Artificial Sequence: Synthetic peptide
QLGEIAPTNPCSSEQYGIVSCNLQSGTM

SEQ ID NO: 134056 - protein, 28 aa, Artificial Sequence
  Description of Artificial Sequence: Synthetic peptide
QLEEIATTNPVATEQYGEAPEVFQHEEK

SEQ ID NO: 134057 - protein, 28 aa, Artificial Sequence
  Description of Artificial Sequence: Synthetic peptide
QLEEIATTNPVATEQYGEAPEVCQHEEK

SEQ ID NO: 134058 - protein, 33 aa, Artificial Sequence
  Description of Artificial Sequence: Synthetic polypeptide
QEVEIRTTNPVATEQYGSVGTDTMDNGGNGGFG

SEQ ID NO: 134059 - protein, 35 aa, Artificial Sequence
  Description of Artificial Sequence: Synthetic polypeptide
QEVEIRTTNPVATEQYGSVNTGDNDQNGEGEEGNI

SEQ ID NO: 134060 - protein, 35 aa, Artificial Sequence
  Description of Artificial Sequence: Synthetic polypeptide
DDEEIRTTNPVATEQYGSVDSTMDIPTGGGGNEEQ

SEQ ID NO: 134061 - protein, 34 aa, Artificial Sequence
  Description of Artificial Sequence: Synthetic polypeptide
QEVEIRTTNPVATEQYGSVSIDGLGDEGGGENDT

SEQ ID NO: 134062 - protein, 35 aa, Artificial Sequence
  Description of Artificial Sequence: Synthetic polypeptide
DDEEIRTTNPVATEQYGSVDTGVNVTGQGEGGGET

SEQ ID NO: 134063 - protein, 34 aa, Artificial Sequence
  Description of Artificial Sequence: Synthetic polypeptide
QEVEIRTTNPVATEQYGSVTTGDDEQGNGEEGNI

SEQ ID NO: 134064 - protein, 35 aa, Artificial Sequence
  Description of Artificial Sequence: Synthetic polypeptide
DDEEIRTTNPVATEQYGSVGDDGDTVGNNGGGNDG

SEQ ID NO: 134065 - protein, 32 aa, Artificial Sequence
  Description of Artificial Sequence: Synthetic polypeptide
DEAEIATTNPVATEQWGAVSVGWNDDVGGQNH

SEQ ID NO: 134066 - protein, 28 aa, Artificial Sequence
  Description of Artificial Sequence: Synthetic peptide
QEWEIATTNPVATEQYGEAPECCQHEEK

SEQ ID NO: 134067 - protein, 28 aa, Artificial Sequence
  Description of Artificial Sequence: Synthetic peptide
QEWEIATTNPVATEQYGEAPEVCIHGEK

SEQ ID NO: 134068 - protein, 28 aa, Artificial Sequence
  Description of Artificial Sequence: Synthetic peptide
QEWEIATTNPVATEQYGEAPEVCQHEEK

SEQ ID NO: 134069 - protein, 28 aa, Artificial Sequence
  Description of Artificial Sequence: Synthetic peptide
QEYEIASTNPVGTEGYGVMASTLQHGDI

SEQ ID NO: 134070 - protein, 28 aa, Artificial Sequence
  Description of Artificial Sequence: Synthetic peptide
QEYEIATTNPVATEQYGEAPEVCQDEEK

SEQ ID NO: 134071 - protein, 28 aa, Artificial Sequence
  Description of Artificial Sequence: Synthetic peptide
QEYEIATTNPVATEQYGEAPEVCQHEEK

SEQ ID NO: 134072 - protein, 33 aa, Artificial Sequence
  Description of Artificial Sequence: Synthetic polypeptide
DEEVISTTNPVAYEQYGSVPFCTNAESFGGGKR

SEQ ID NO: 134073 - protein, 28 aa, Artificial Sequence
  Description of Artificial Sequence: Synthetic peptide
QEYEIATTNPVATEQYGEAPHVCQHEEP

SEQ ID NO: 134074 - protein, 34 aa, Artificial Sequence
  Description of Artificial Sequence: Synthetic polypeptide
DDEEIRTTNPVATEQYGSVGSGMGGQNNGGEETP

SEQ ID NO: 134075 - protein, 28 aa, Artificial Sequence
  Description of Artificial Sequence: Synthetic peptide
QGEEIATTNPVATEQYGEAPEVCQHEEK

SEQ ID NO: 134076 - protein, 28 aa, Artificial Sequence
  Description of Artificial Sequence: Synthetic peptide
QGEEIATTNPVATEQYGEAPEVCQHEEY

SEQ ID NO: 134077 - protein, 28 aa, Artificial Sequence
  Description of Artificial Sequence: Synthetic peptide
QHGEIAPTNPCSSEQYGIVSCNLQSGTA

SEQ ID NO: 134078 - protein, 28 aa, Artificial Sequence
  Description of Artificial Sequence: Synthetic peptide
QLEEIATTNPVATEQYGEAPEVCQHEAK

SEQ ID NO: 134079 - protein, 37 aa, Artificial Sequence
  Description of Artificial Sequence: Synthetic polypeptide
DDEEIRTTNPVATEQYGSVISTTVNGLGDEFGNNDDD

SEQ ID NO: 134080 - protein, 36 aa, Artificial Sequence
  Description of Artificial Sequence: Synthetic polypeptide
DEEVIRTTNPVATEQYGSVSSTTPAGPNMRNGMNPV

SEQ ID NO: 134081 - protein, 28 aa, Artificial Sequence
  Description of Artificial Sequence: Synthetic peptide
QSEEIATTNPVATEQYGEAPEVCQHEEK

SEQ ID NO: 134082 - protein, 34 aa, Artificial Sequence
  Description of Artificial Sequence: Synthetic polypeptide
DEEEIRTTNPVATEQYGSCNGELEDDQGWNNIQG

SEQ ID NO: 134083 - protein, 34 aa, Artificial Sequence
  Description of Artificial Sequence: Synthetic polypeptide
DDEEIRTTNPVATEQYGSVNYTTIHNQEGQEVKE

SEQ ID NO: 134084 - protein, 36 aa, Artificial Sequence
  Description of Artificial Sequence: Synthetic polypeptide
AEEEIRTTNPVATEQYGSVSTVTQNQATTEQGTNNE

SEQ ID NO: 134085 - protein, 36 aa, Artificial Sequence
  Description of Artificial Sequence: Synthetic polypeptide
REEEIRTTNPVATEQYGSVSSTTPACPNMRNGMNPV

SEQ ID NO: 134086 - protein, 36 aa, Artificial Sequence
  Description of Artificial Sequence: Synthetic polypeptide
REEEIRTTNPVATEQYGSVSSTTPAGPNMRNGMNPV

SEQ ID NO: 134087 - protein, 37 aa, Artificial Sequence
  Description of Artificial Sequence: Synthetic polypeptide
AEEEIRTTNPVATEQYGSVSTVTQNNQNGTEAGNEDM

SEQ ID NO: 134088 - protein, 33 aa, Artificial Sequence
  Description of Artificial Sequence: Synthetic polypeptide
DDEEIRTTNPVATEQYGSVSAPVGLIETMVQTG

SEQ ID NO: 134089 - protein, 37 aa, Artificial Sequence
  Description of Artificial Sequence: Synthetic polypeptide
AEEEIRTTNPVATEQYGSVSTVTQNNNQDEIGTNTEQ

SEQ ID NO: 134090 - protein, 36 aa, Artificial Sequence
  Description of Artificial Sequence: Synthetic polypeptide
DDEEIRTTNPVATEQYGSVSATTPAIPNMRNGMNPV

SEQ ID NO: 134091 - protein, 34 aa, Artificial Sequence
  Description of Artificial Sequence: Synthetic polypeptide
DDEEIRTTNPVATEQYGSVSATWDTEELMELVEA

SEQ ID NO: 134092 - protein, 35 aa, Artificial Sequence
  Description of Artificial Sequence: Synthetic polypeptide
DDEEIRTTNPVATEQYGSVNTDTGNLTGENDNEDN

SEQ ID NO: 134093 - protein, 36 aa, Artificial Sequence
  Description of Artificial Sequence: Synthetic polypeptide
AEEEIRTTNPVATEQYGSVSTVTQNNNLEQGEQETD

SEQ ID NO: 134094 - protein, 35 aa, Artificial Sequence
  Description of Artificial Sequence: Synthetic polypeptide
DEEEIRTTNPVATEQYGSCNAVLDANEQLQPNETF

SEQ ID NO: 134095 - protein, 35 aa, Artificial Sequence
  Description of Artificial Sequence: Synthetic polypeptide
DDEEIRTTNPVATEQYGSVSGTDNVGFTEEGIGGQ

SEQ ID NO: 134096 - protein, 36 aa, Artificial Sequence
  Description of Artificial Sequence: Synthetic polypeptide
AEEEIRTTNPVATEQYGSVSTVTQNGNEQIGEDETD

SEQ ID NO: 134097 - protein, 36 aa, Artificial Sequence
  Description of Artificial Sequence: Synthetic polypeptide
AEEEIRTTNPVATEQYGSVSTVTQGSNVEQGENETD

SEQ ID NO: 134098 - protein, 32 aa, Artificial Sequence
  Description of Artificial Sequence: Synthetic polypeptide
REQEIATTNPVATEQYGSVHATDLEDHEGEDL

SEQ ID NO: 134099 - protein, 33 aa, Artificial Sequence
  Description of Artificial Sequence: Synthetic polypeptide
REQEIATTNPVATEQYGSVSALDLEDHEGEDLR

SEQ ID NO: 134100 - protein, 35 aa, Artificial Sequence
  Description of Artificial Sequence: Synthetic polypeptide
DDEEIRTTNPVATEQYGSVSISNGQDQINEGGQGG

SEQ ID NO: 134101 - protein, 33 aa, Artificial Sequence
  Description of Artificial Sequence: Synthetic polypeptide
REQEIATTNPVATEQYGSVSATDLEDHEGEDLI

SEQ ID NO: 134102 - protein, 37 aa, Artificial Sequence
  Description of Artificial Sequence: Synthetic polypeptide
DEEEIRTTNPVATEQYGSCISTPFNELEQHQGDETQI

SEQ ID NO: 134103 - protein, 38 aa, Artificial Sequence
  Description of Artificial Sequence: Synthetic polypeptide
AEEEIRTTNPVATEQYGSVSTVTQNLQNGNEEQGNNVE

SEQ ID NO: 134104 - protein, 36 aa, Artificial Sequence
  Description of Artificial Sequence: Synthetic polypeptide
AEEEIRTTNPVATEQYGSVSTVTQQNNTEQGENETD

SEQ ID NO: 134105 - protein, 36 aa, Artificial Sequence
  Description of Artificial Sequence: Synthetic polypeptide
AEEEIRTTNPVATEQYGSVSTVTSQSGNTEAGNNNQ

SEQ ID NO: 134106 - protein, 34 aa, Artificial Sequence
  Description of Artificial Sequence: Synthetic polypeptide
DDEEIRTTNPVATEQYGSVNSPTTIHNDESQEVK

SEQ ID NO: 134107 - protein, 35 aa, Artificial Sequence
  Description of Artificial Sequence: Synthetic polypeptide
QSEEIRTTNPVATEQWGQSVPSCTTELSGTGTNRD

SEQ ID NO: 134108 - protein, 29 aa, Artificial Sequence
  Description of Artificial Sequence: Synthetic peptide
QSGEIAPTNPCSSEQYGIVSCNLQSSGTR

SEQ ID NO: 134109 - protein, 29 aa, Artificial Sequence
  Description of Artificial Sequence: Synthetic peptide
QSNEIATTNPVATECYGDVSECLQHEEAL

SEQ ID NO: 134110 - protein, 29 aa, Artificial Sequence
  Description of Artificial Sequence: Synthetic peptide
QSNEIATTNPVATECYGDVSECLQHEEEL

SEQ ID NO: 134111 - protein, 28 aa, Artificial Sequence
  Description of Artificial Sequence: Synthetic peptide
QTEEIATTNPVATEQYGEAPEVCQHEEK

SEQ ID NO: 134112 - protein, 28 aa, Artificial Sequence
  Description of Artificial Sequence: Synthetic peptide
QTEEIATTNPVATEQYGEAPEVCQHEEQ

SEQ ID NO: 134113 - protein, 34 aa, Artificial Sequence
  Description of Artificial Sequence: Synthetic polypeptide
DDEEIRTTNPVATEQYGSVMGNNNNMDEGGNNQG

SEQ ID NO: 134114 - protein, 28 aa, Artificial Sequence
  Description of Artificial Sequence: Synthetic peptide
QTGEIAPTNPCSSEQYGIVSCNLQSGTE

SEQ ID NO: 134115 - protein, 29 aa, Artificial Sequence
  Description of Artificial Sequence: Synthetic peptide
QTNEIATTNPVATECYGDVSECLQHEEYL

SEQ ID NO: 134116 - protein, 29 aa, Artificial Sequence
  Description of Artificial Sequence: Synthetic peptide
QTNEIATTNPVATECYGDVSECLQHEPEL

SEQ ID NO: 134117 - protein, 28 aa, Artificial Sequence
  Description of Artificial Sequence: Synthetic peptide
QTNEIATTNPVATECYGDVSECTQHEEL

SEQ ID NO: 134118 - protein, 28 aa, Artificial Sequence
  Description of Artificial Sequence: Synthetic peptide
QVGEIAPTNPCSSEQYGIVSCNNQSGTR

SEQ ID NO: 134119 - protein, 37 aa, Artificial Sequence
  Description of Artificial Sequence: Synthetic polypeptide
AEEEIRTTNPVATEQYGSVSTVTTNNLGGTEQGTNNQ

SEQ ID NO: 134120 - protein, 37 aa, Artificial Sequence
  Description of Artificial Sequence: Synthetic polypeptide
AEEEIRTTNPVATEQYGSVSTVTTNLQQIGTTTEQED

SEQ ID NO: 134121 - protein, 29 aa, Artificial Sequence
  Description of Artificial Sequence: Synthetic peptide
REEEIATTNPVATEQYGEAPEVCQCHEEK

SEQ ID NO: 134122 - protein, 35 aa, Artificial Sequence
  Description of Artificial Sequence: Synthetic polypeptide
DDEEIRTTNPVATEQYGSVNDVTDEGNDEGQGGEG

SEQ ID NO: 134123 - protein, 29 aa, Artificial Sequence
  Description of Artificial Sequence: Synthetic peptide
REEEIATTNPVATEQYGEAPEVTCQHEEK

SEQ ID NO: 134124 - protein, 35 aa, Artificial Sequence
  Description of Artificial Sequence: Synthetic polypeptide
DDEEIRTTNPVATEQYGSVNQGSGMDNLDEEFNES

SEQ ID NO: 134125 - protein, 36 aa, Artificial Sequence
  Description of Artificial Sequence: Synthetic polypeptide
DDEEIRTTNPVATEQYGSVNSDDNTLIQNEGQGEGT

SEQ ID NO: 134126 - protein, 36 aa, Artificial Sequence
  Description of Artificial Sequence: Synthetic polypeptide
AEEEIRTTNPVATEQYGSVSTVTTGNGNLQGTEDEE

SEQ ID NO: 134127 - protein, 36 aa, Artificial Sequence
  Description of Artificial Sequence: Synthetic polypeptide
DDEEIRTTNPVATEQYGSVNSGGNFNIQGETGNEDD

SEQ ID NO: 134128 - protein, 35 aa, Artificial Sequence
  Description of Artificial Sequence: Synthetic polypeptide
DEEEIRTTNPVATEQYGSCNGELEDDQIGSNNIQY

SEQ ID NO: 134129 - protein, 28 aa, Artificial Sequence
  Description of Artificial Sequence: Synthetic peptide
QESEIASTNPVGTEGYGVVAETLQHGDI

SEQ ID NO: 134130 - protein, 32 aa, Artificial Sequence
  Description of Artificial Sequence: Synthetic polypeptide
DEGAIATTNPVAYEQWGCSFSTNLDIDGNNTN

SEQ ID NO: 134131 - protein, 28 aa, Artificial Sequence
  Description of Artificial Sequence: Synthetic peptide
QESEIRSTNPVGTEGWGVMASTLQHGDI

SEQ ID NO: 134132 - protein, 28 aa, Artificial Sequence
  Description of Artificial Sequence: Synthetic peptide
QESEIASTNPVSTEGYGVMSSTLQHGDI

SEQ ID NO: 134133 - protein, 36 aa, Artificial Sequence
  Description of Artificial Sequence: Synthetic polypeptide
DEEEIRTTNPVATEQYGSFSDTPTNHHGLTPEQENE

SEQ ID NO: 134134 - protein, 28 aa, Artificial Sequence
  Description of Artificial Sequence: Synthetic peptide
QESEIASTNPVSTEQYGIMACTLQHGTI

SEQ ID NO: 134135 - protein, 33 aa, Artificial Sequence
  Description of Artificial Sequence: Synthetic polypeptide
DEEEIRTTNPVATEQYGSFSDPVGLIETMVQTD

SEQ ID NO: 134136 - protein, 36 aa, Artificial Sequence
  Description of Artificial Sequence: Synthetic polypeptide
DDEEIRTTNPVATEQYGAVSTTGNVDQTGEGGNQGE

SEQ ID NO: 134137 - protein, 28 aa, Artificial Sequence
  Description of Artificial Sequence: Synthetic peptide
QESEIASTNPVSTEQYGNVPNVIQREQK

SEQ ID NO: 134138 - protein, 28 aa, Artificial Sequence
  Description of Artificial Sequence: Synthetic peptide
QESEIASTNPVSTEQYGVMACTLQHGDI

SEQ ID NO: 134139 - protein, 28 aa, Artificial Sequence
  Description of Artificial Sequence: Synthetic peptide
QESEIASTNPVSTEQYGVMACTLQHGTI

SEQ ID NO: 134140 - protein, 28 aa, Artificial Sequence
  Description of Artificial Sequence: Synthetic peptide
QESEIASTNPVTTEPYGVCASTLQHGDI

SEQ ID NO: 134141 - protein, 28 aa, Artificial Sequence
  Description of Artificial Sequence: Synthetic peptide
QESEIASTNPVSTEGYGVMASTLQHGDI

SEQ ID NO: 134142 - protein, 28 aa, Artificial Sequence
  Description of Artificial Sequence: Synthetic peptide
QESEIASTNPVVTEAYGVTASTLQHGDI

SEQ ID NO: 134143 - protein, 28 aa, Artificial Sequence
  Description of Artificial Sequence: Synthetic peptide
QESEIASVNPVCTEGYGVMASNLQHGNQ

SEQ ID NO: 134144 - protein, 28 aa, Artificial Sequence
  Description of Artificial Sequence: Synthetic peptide
QESEIASVNPVCTEQYGVMADNLQSGDQ

SEQ ID NO: 134145 - protein, 33 aa, Artificial Sequence
  Description of Artificial Sequence: Synthetic polypeptide
DEGEIATTNPCSSEQYGTVCSATDNLVQSEGTR

SEQ ID NO: 134146 - protein, 28 aa, Artificial Sequence
  Description of Artificial Sequence: Synthetic peptide
QESEIASVNPVCTEQYGVMASNLQHGDI

SEQ ID NO: 134147 - protein, 33 aa, Artificial Sequence
  Description of Artificial Sequence: Synthetic polypeptide
DEGEIATTNPCSSEQYGTVCSATDGLVQFEGNR

SEQ ID NO: 134148 - protein, 28 aa, Artificial Sequence
  Description of Artificial Sequence: Synthetic peptide
QESEIASVNPVGTEQYGVMASTLQHGDI

SEQ ID NO: 134149 - protein, 28 aa, Artificial Sequence
  Description of Artificial Sequence: Synthetic peptide
QESEIASVNPVGTEQYGVMASTLQHGDQ

SEQ ID NO: 134150 - protein, 33 aa, Artificial Sequence
  Description of Artificial Sequence: Synthetic polypeptide
QESEIATTNPCASECWGSVSCINLPQDREGENR

SEQ ID NO: 134151 - protein, 31 aa, Artificial Sequence
  Description of Artificial Sequence: Synthetic polypeptide
DEGEIATTNPCSSECYGIVSCINEQDREGTR

SEQ ID NO: 134152 - protein, 28 aa, Artificial Sequence
  Description of Artificial Sequence: Synthetic peptide
QESEIASVNPVCTEGYGVMADNLQSGNQ

SEQ ID NO: 134153 - protein, 28 aa, Artificial Sequence
  Description of Artificial Sequence: Synthetic peptide
QESEIASTNPVSTEGYGNVASTIQHGQI

SEQ ID NO: 134154 - protein, 28 aa, Artificial Sequence
  Description of Artificial Sequence: Synthetic peptide
QESEIASTNPVSTEGYGNVASTIQHGDI

SEQ ID NO: 134155 - protein, 28 aa, Artificial Sequence
  Description of Artificial Sequence: Synthetic peptide
QESEIASTNPVSTEGYGIVACTLQSGTI

SEQ ID NO: 134156 - protein, 29 aa, Artificial Sequence
  Description of Artificial Sequence: Synthetic peptide
QESEIASTNPVGTEQYGVVASTLNHGMDI

SEQ ID NO: 134157 - protein, 30 aa, Artificial Sequence
  Description of Artificial Sequence: Synthetic polypeptide
QESEIASTNPVGTEQYGYVMESTLSQHGDI

SEQ ID NO: 134158 - protein, 28 aa, Artificial Sequence
  Description of Artificial Sequence: Synthetic peptide
QESEIASTNPVGTERYGVMASTLQHGDI

SEQ ID NO: 134159 - protein, 28 aa, Artificial Sequence
  Description of Artificial Sequence: Synthetic peptide
QESEIASTNPVGTESYGVMASTLQHGDI

SEQ ID NO: 134160 - protein, 28 aa, Artificial Sequence
  Description of Artificial Sequence: Synthetic peptide
QESEIASTNPVGTETYGVMASTLQHGDI

SEQ ID NO: 134161 - protein, 28 aa, Artificial Sequence
  Description of Artificial Sequence: Synthetic peptide
QESEIASTNPVGTEVYGVIASTLQHGDI

SEQ ID NO: 134162 - protein, 28 aa, Artificial Sequence
  Description of Artificial Sequence: Synthetic peptide
QESEIASTNPVGTEVYGVMASTLQHGDI

SEQ ID NO: 134163 - protein, 28 aa, Artificial Sequence
  Description of Artificial Sequence: Synthetic peptide
QESEIASTNPVGTEVYGVMASTLQHGTI

SEQ ID NO: 134164 - protein, 28 aa, Artificial Sequence
  Description of Artificial Sequence: Synthetic peptide
QESEIASTNPVGTEWYGVMASTLQHGDI

SEQ ID NO: 134165 - protein, 34 aa, Artificial Sequence
  Description of Artificial Sequence: Synthetic polypeptide
DEEEIRATNPVATEQYGSCSAGNALGQHPDAQAQ

SEQ ID NO: 134166 - protein, 28 aa, Artificial Sequence
  Description of Artificial Sequence: Synthetic peptide
QESEIASTNPVGTEYYGAMASTLQHGDI

SEQ ID NO: 134167 - protein, 28 aa, Artificial Sequence
  Description of Artificial Sequence: Synthetic peptide
QESEIASTNPVGTEYYGVAYSTLQHGDM

SEQ ID NO: 134168 - protein, 28 aa, Artificial Sequence
  Description of Artificial Sequence: Synthetic peptide
QESEIASTNPVGTEYYGVMASTLQHGDI

SEQ ID NO: 134169 - protein, 32 aa, Artificial Sequence
  Description of Artificial Sequence: Synthetic polypeptide
DEGEIATTNPVATAQWGCVATNALTQDQGGEM

SEQ ID NO: 134170 - protein, 33 aa, Artificial Sequence
  Description of Artificial Sequence: Synthetic polypeptide
DEGEIATTNPVATAQWGCVATNALTQADQGNDM

SEQ ID NO: 134171 - protein, 31 aa, Artificial Sequence
  Description of Artificial Sequence: Synthetic polypeptide
DEGEIATTNPVATAQWGCVATNALTADIGDM

SEQ ID NO: 134172 - protein, 28 aa, Artificial Sequence
  Description of Artificial Sequence: Synthetic peptide
QESEIASTNPVSSEGYGIVACTLQSGTR

SEQ ID NO: 134173 - protein, 31 aa, Artificial Sequence
  Description of Artificial Sequence: Synthetic polypeptide
DEGEIATTNPVATAQWGCVASALTQDGGNDM

SEQ ID NO: 134174 - protein, 36 aa, Artificial Sequence
  Description of Artificial Sequence: Synthetic polypeptide
DEEEIRTTNPVATEQYGSFSSTTPAGPNMRNGMNPV

SEQ ID NO: 134175 - protein, 30 aa, Artificial Sequence
  Description of Artificial Sequence: Synthetic polypeptide
QESEIASTNPVSTEGYGIVACNIQSRVGQR

SEQ ID NO: 134176 - protein, 28 aa, Artificial Sequence
  Description of Artificial Sequence: Synthetic peptide
QESEIASTNPVSTEGYGIVACTLQHGTI

SEQ ID NO: 134177 - protein, 30 aa, Artificial Sequence
  Description of Artificial Sequence: Synthetic polypeptide
QESEIATTNPCASECWGSVSCNEPQDSGTR

SEQ ID NO: 134178 - protein, 30 aa, Artificial Sequence
  Description of Artificial Sequence: Synthetic polypeptide
QESEIASTNPVGTEQYGVVASTGNHNGMNI

SEQ ID NO: 134179 - protein, 34 aa, Artificial Sequence
  Description of Artificial Sequence: Synthetic polypeptide
DEEEIRTTNPVATEQYGSFGSDTNGGNIEDETII

SEQ ID NO: 134180 - protein, 30 aa, Artificial Sequence
  Description of Artificial Sequence: Synthetic polypeptide
DEGEIATTNPCATEQYGIVSENEMNAAEDA

SEQ ID NO: 134181 - protein, 31 aa, Artificial Sequence
  Description of Artificial Sequence: Synthetic polypeptide
QESEIATTNPVATECYGKVSCEGLSQTEENL

SEQ ID NO: 134182 - protein, 30 aa, Artificial Sequence
  Description of Artificial Sequence: Synthetic polypeptide
QESEIATTNPVATECYGKVSEGGLSQHEEL

SEQ ID NO: 134183 - protein, 30 aa, Artificial Sequence
  Description of Artificial Sequence: Synthetic polypeptide
QESEIATTNPVATECYGNVSAECLQHVEQL

SEQ ID NO: 134184 - protein, 33 aa, Artificial Sequence
  Description of Artificial Sequence: Synthetic polypeptide
DEEEIRTTNPVATEQYGYTINPSFEEFERGEQT

SEQ ID NO: 134185 - protein, 28 aa, Artificial Sequence
  Description of Artificial Sequence: Synthetic peptide
DEGEIAPTNPISSECYGAVSCDLASGTR

SEQ ID NO: 134186 - protein, 31 aa, Artificial Sequence
  Description of Artificial Sequence: Synthetic polypeptide
QESEIATTNPVATECYGQTVSEPLSQHEGEL

SEQ ID NO: 134187 - protein, 31 aa, Artificial Sequence
  Description of Artificial Sequence: Synthetic polypeptide
QESEIATTNPVATECYGQVSCEHLSQHEGEL

SEQ ID NO: 134188 - protein, 28 aa, Artificial Sequence
  Description of Artificial Sequence: Synthetic peptide
QESEIATTNPVATECYGSAPCVCQHEEK

SEQ ID NO: 134189 - protein, 30 aa, Artificial Sequence
  Description of Artificial Sequence: Synthetic polypeptide
QESEIATTNPVATECYGSASCVCPQHEENK

SEQ ID NO: 134190 - protein, 30 aa, Artificial Sequence
  Description of Artificial Sequence: Synthetic polypeptide
QESEIATTNPVATECYGEVSCECLSQHEEL

SEQ ID NO: 134191 - protein, 29 aa, Artificial Sequence
  Description of Artificial Sequence: Synthetic peptide
DEGEIAPTNPIASECYGAVSCDLASKGPR

SEQ ID NO: 134192 - protein, 31 aa, Artificial Sequence
  Description of Artificial Sequence: Synthetic polypeptide
DEGEIAPTNPCSTEQYGSVSTDLEDHEGEDL

SEQ ID NO: 134193 - protein, 35 aa, Artificial Sequence
  Description of Artificial Sequence: Synthetic polypeptide
DEEEIRATNPVATEQYGSVCAATAQLAATAEGDNG

SEQ ID NO: 134194 - protein, 31 aa, Artificial Sequence
  Description of Artificial Sequence: Synthetic polypeptide
DEGEIAPTNPCSTEQYGIVSCNLQQQQNGTH

SEQ ID NO: 134195 - protein, 35 aa, Artificial Sequence
  Description of Artificial Sequence: Synthetic polypeptide
DEEEIRATNPVATEQYGSVCAATENLEAPEQEEAD

SEQ ID NO: 134196 - protein, 35 aa, Artificial Sequence
  Description of Artificial Sequence: Synthetic polypeptide
DEEEIRTTNPVATEQYGYTISPSFVLEENRDGEHQ

SEQ ID NO: 134197 - protein, 31 aa, Artificial Sequence
  Description of Artificial Sequence: Synthetic polypeptide
DEGEIAPTNPCSTEQYGIVSATDLEDHEGER

SEQ ID NO: 134198 - protein, 34 aa, Artificial Sequence
  Description of Artificial Sequence: Synthetic polypeptide
DEEEIRTTNPVATEQYGYTISPSFVTEVRDGEEP

SEQ ID NO: 134199 - protein, 30 aa, Artificial Sequence
  Description of Artificial Sequence: Synthetic polypeptide
DEGEIAPTNPCSSEQYGTVCSTNPVEFGTR

SEQ ID NO: 134200 - protein, 35 aa, Artificial Sequence
  Description of Artificial Sequence: Synthetic polypeptide
DEEEIRTTNPVATEQYGSCYPTNEMPITQMMMQND

SEQ ID NO: 134201 - protein, 33 aa, Artificial Sequence
  Description of Artificial Sequence: Synthetic polypeptide
QESEIATTNPVATECYGSVSCINEPQDHEGENK

SEQ ID NO: 134202 - protein, 30 aa, Artificial Sequence
  Description of Artificial Sequence: Synthetic polypeptide
QESEIATTNPVATECYGDVSCNEPQHEEEL

SEQ ID NO: 134203 - protein, 32 aa, Artificial Sequence
  Description of Artificial Sequence: Synthetic polypeptide
QESEIATTNPVATECYGDVSCEGLSQHEGENL

SEQ ID NO: 134204 - protein, 31 aa, Artificial Sequence
  Description of Artificial Sequence: Synthetic polypeptide
DEGEIAPTNPVSTEQYGIVSCDLQQQQNGTH

SEQ ID NO: 134205 - protein, 31 aa, Artificial Sequence
  Description of Artificial Sequence: Synthetic polypeptide
QESEIATTNPVASECWGSVSCNEPQDSGETR

SEQ ID NO: 134206 - protein, 30 aa, Artificial Sequence
  Description of Artificial Sequence: Synthetic polypeptide
DEGEIATTNPCATEQYGDVSENEMNAAEDA

SEQ ID NO: 134207 - protein, 29 aa, Artificial Sequence
  Description of Artificial Sequence: Synthetic peptide
QESEIATTNPVATECWGDVSCCLQHEEEL

SEQ ID NO: 134208 - protein, 34 aa, Artificial Sequence
  Description of Artificial Sequence: Synthetic polypeptide
DDEEIRTTNPVATEQYGCVCSMTEHQNFGSEQQS

SEQ ID NO: 134209 - protein, 35 aa, Artificial Sequence
  Description of Artificial Sequence: Synthetic polypeptide
DEEEIRTTNPVATEQYGSFGSDTNGGNIDTDNQIG

SEQ ID NO: 134210 - protein, 35 aa, Artificial Sequence
  Description of Artificial Sequence: Synthetic polypeptide
DEEEIRTTNPVATEQYGSFGSDNNEGGNIEEDNTI

SEQ ID NO: 134211 - protein, 33 aa, Artificial Sequence
  Description of Artificial Sequence: Synthetic polypeptide
DEAEIATTNPVATEQYGSVAGTGDQTPDDTDRE

SEQ ID NO: 134212 - protein, 33 aa, Artificial Sequence
  Description of Artificial Sequence: Synthetic polypeptide
DEGEIATTNPCASEQYGTVCSATDGLVEFEGNR

SEQ ID NO: 134213 - protein, 37 aa, Artificial Sequence
  Description of Artificial Sequence: Synthetic polypeptide
DEEEIRTTNPVATEQYGYSVSSTIPAGPNMRNGMNPV

SEQ ID NO: 134214 - protein, 37 aa, Artificial Sequence
  Description of Artificial Sequence: Synthetic polypeptide
DEEEIRTTNPVATEQYGYSVSSTTPAGPNMRNGMNPV

SEQ ID NO: 134215 - protein, 29 aa, Artificial Sequence
  Description of Artificial Sequence: Synthetic peptide
QESEIATTNPVATECWGSVPEVCQREEEK

SEQ ID NO: 134216 - protein, 33 aa, Artificial Sequence
  Description of Artificial Sequence: Synthetic polypeptide
QESEIATTNPVATECWGSVSCINEPQDREGENG

SEQ ID NO: 134217 - protein, 31 aa, Artificial Sequence
  Description of Artificial Sequence: Synthetic polypeptide
DEGEIASTNPVSTEQYGNVAANTIQSSVGTR

SEQ ID NO: 134218 - protein, 36 aa, Artificial Sequence
  Description of Artificial Sequence: Synthetic polypeptide
AEEEIRTTNPVATEQYGSVSTVVNEGNNDEGTTNSD

SEQ ID NO: 134219 - protein, 37 aa, Artificial Sequence
  Description of Artificial Sequence: Synthetic polypeptide
DEEEIRTTNPVATEQYGYSVSSTTPAGPNMVNGMNPV

SEQ ID NO: 134220 - protein, 32 aa, Artificial Sequence
  Description of Artificial Sequence: Synthetic polypeptide
DEAEIATTNPVATEQYGSVAGTGDQGTDTDQE

SEQ ID NO: 134221 - protein, 36 aa, Artificial Sequence
  Description of Artificial Sequence: Synthetic polypeptide
DEAEIATTNPVATEQYGSVAATTNSNQTPDGDNNRD

SEQ ID NO: 134222 - protein, 35 aa, Artificial Sequence
  Description of Artificial Sequence: Synthetic polypeptide
DDEEIRTTNPVATEQYGCVCSMTMEHQESFGSNQS

SEQ ID NO: 134223 - protein, 35 aa, Artificial Sequence
  Description of Artificial Sequence: Synthetic polypeptide
DDEEIRTTNPVATEQYGCVCSMTMNHQENFNSDQA

SEQ ID NO: 134224 - protein, 30 aa, Artificial Sequence
  Description of Artificial Sequence: Synthetic polypeptide
QESEIATTNPVATECYGCTVSEHLSQHEEL

SEQ ID NO: 134225 - protein, 31 aa, Artificial Sequence
  Description of Artificial Sequence: Synthetic polypeptide
DEGEIAPTNPVSTEQYGNVAANTIQSSVGTR

SEQ ID NO: 134226 - protein, 30 aa, Artificial Sequence
  Description of Artificial Sequence: Synthetic polypeptide
QESEIATTNPCSSEQWGSVSCNEPQDSGTR

SEQ ID NO: 134227 - protein, 35 aa, Artificial Sequence
  Description of Artificial Sequence: Synthetic polypeptide
DEEEIRTTNPVATEQYGYTISPSLVLEKNRDGESQ

SEQ ID NO: 134228 - protein, 35 aa, Artificial Sequence
  Description of Artificial Sequence: Synthetic polypeptide
DEEEIRTTNPVATEQYGSFSWTGTNTQGTQEQEEE

SEQ ID NO: 134229 - protein, 28 aa, Artificial Sequence
  Description of Artificial Sequence: Synthetic peptide
QESEIASTNPVGTEQYGVMATGLEHGDI

SEQ ID NO: 134230 - protein, 29 aa, Artificial Sequence
  Description of Artificial Sequence: Synthetic peptide
QESEIASTNPVGTEGYGWVMASTLQHGDI

SEQ ID NO: 134231 - protein, 28 aa, Artificial Sequence
  Description of Artificial Sequence: Synthetic peptide
QESEIASTNPVGTEGYGYMASTLQHGDI

SEQ ID NO: 134232 - protein, 29 aa, Artificial Sequence
  Description of Artificial Sequence: Synthetic peptide
QESEIASTNPVGTEGYGYVMASTLQHGDI

SEQ ID NO: 134233 - protein, 29 aa, Artificial Sequence
  Description of Artificial Sequence: Synthetic peptide
QESEIASTNPVGTEHYGQVAYSTLQHGDA

SEQ ID NO: 134234 - protein, 28 aa, Artificial Sequence
  Description of Artificial Sequence: Synthetic peptide
QESEIASTNPVGTEHYGVMASTLQHGDI

SEQ ID NO: 134235 - protein, 28 aa, Artificial Sequence
  Description of Artificial Sequence: Synthetic peptide
QESEIASTNPVGTEHYGVMASTLQHGDK

SEQ ID NO: 134236 - protein, 34 aa, Artificial Sequence
  Description of Artificial Sequence: Synthetic polypeptide
DEGEIATTNPVATEQWGSVSGEGPPQNTDGNPRN

SEQ ID NO: 134237 - protein, 28 aa, Artificial Sequence
  Description of Artificial Sequence: Synthetic peptide
QESEIASTNPVGTEIYGVMASTLQHGDI

SEQ ID NO: 134238 - protein, 28 aa, Artificial Sequence
  Description of Artificial Sequence: Synthetic peptide
QESEIASTNPVGTEKYGVMASTLQHGDI

SEQ ID NO: 134239 - protein, 32 aa, Artificial Sequence
  Description of Artificial Sequence: Synthetic polypeptide
DEGEIATTNPVATEQWGSVSVPAITNNDGDDI

SEQ ID NO: 134240 - protein, 37 aa, Artificial Sequence
  Description of Artificial Sequence: Synthetic polypeptide
DEEEIRTTNPVATEQYGWSVSSTTPAGPNMRNGMNPV

SEQ ID NO: 134241 - protein, 35 aa, Artificial Sequence
  Description of Artificial Sequence: Synthetic polypeptide
DDEEIRTTNPVATEQWGSVVTSGLRLQREGQGDGQ

SEQ ID NO: 134242 - protein, 38 aa, Artificial Sequence
  Description of Artificial Sequence: Synthetic polypeptide
DEEEIRTTNPVATEQYGWSVSSTTPALGPNMRNGMNPV

SEQ ID NO: 134243 - protein, 36 aa, Artificial Sequence
  Description of Artificial Sequence: Synthetic polypeptide
DEEEIRTTNPVATEQYGWVSSTTPAGPNMRNGANPV

SEQ ID NO: 134244 - protein, 36 aa, Artificial Sequence
  Description of Artificial Sequence: Synthetic polypeptide
DEEEIRTTNPVATEQYGWVSSTTPAGPNMRNGMNPV

SEQ ID NO: 134245 - protein, 36 aa, Artificial Sequence
  Description of Artificial Sequence: Synthetic polypeptide
DEEEIRTTNPVATEQYGWVSSTTPAGPNWRNGMNPV

SEQ ID NO: 134246 - protein, 34 aa, Artificial Sequence
  Description of Artificial Sequence: Synthetic polypeptide
DEGEIATTNPVATEQWGSVAITNPEQQGQDNSDA

SEQ ID NO: 134247 - protein, 28 aa, Artificial Sequence
  Description of Artificial Sequence: Synthetic peptide
QESEIASTNPVGTELYGVMASTLQHGDI

SEQ ID NO: 134248 - protein, 28 aa, Artificial Sequence
  Description of Artificial Sequence: Synthetic peptide
QESEIASTNPVGTEMYGVMASTLQHGDI

SEQ ID NO: 134249 - protein, 28 aa, Artificial Sequence
  Description of Artificial Sequence: Synthetic peptide
QESEIASTNPVGTENYGVMASTLQHGDI

SEQ ID NO: 134250 - protein, 28 aa, Artificial Sequence
  Description of Artificial Sequence: Synthetic peptide
QESEIASTNPVGTEKYGVMTSTLQHGDI

SEQ ID NO: 134251 - protein, 29 aa, Artificial Sequence
  Description of Artificial Sequence: Synthetic peptide
QESEIASTNPVGTEGYGWMASTSLQHGDI

SEQ ID NO: 134252 - protein, 28 aa, Artificial Sequence
  Description of Artificial Sequence: Synthetic peptide
QESEIASTNPVGTEGYGVYASTLQHGDI

SEQ ID NO: 134253 - protein, 28 aa, Artificial Sequence
  Description of Artificial Sequence: Synthetic peptide
QESEIASTNPVGTEGYGVWASTLQHGDI

SEQ ID NO: 134254 - protein, 28 aa, Artificial Sequence
  Description of Artificial Sequence: Synthetic peptide
QESEIASTNPVGTEGYGVVASDLQHGDI

SEQ ID NO: 134255 - protein, 33 aa, Artificial Sequence
  Description of Artificial Sequence: Synthetic polypeptide
DEGEIATTNPVATEQYGCVAATAGLTATNQDRE

SEQ ID NO: 134256 - protein, 28 aa, Artificial Sequence
  Description of Artificial Sequence: Synthetic peptide
QESEIASTNPVGTEGYGVVASDLQHGEI

SEQ ID NO: 134257 - protein, 33 aa, Artificial Sequence
  Description of Artificial Sequence: Synthetic polypeptide
DEGEIATTNPVATEQYGCVAATAGLTAMNNDRH

SEQ ID NO: 134258 - protein, 29 aa, Artificial Sequence
  Description of Artificial Sequence: Synthetic peptide
QESEIASTNPVGTEGYGVVASSTLQHGDI

SEQ ID NO: 134259 - protein, 29 aa, Artificial Sequence
  Description of Artificial Sequence: Synthetic peptide
QESEIASTNPVGTEGYGVVASTIQSHGDR

SEQ ID NO: 134260 - protein, 33 aa, Artificial Sequence
  Description of Artificial Sequence: Synthetic polypeptide
DEGEIATTNPVATEQYGCVAANNLTEAEGGNVE

SEQ ID NO: 134261 - protein, 32 aa, Artificial Sequence
  Description of Artificial Sequence: Synthetic polypeptide
DEGEIATTNPVATEQYGCVAANNLADPGGGHV

SEQ ID NO: 134262 - protein, 28 aa, Artificial Sequence
  Description of Artificial Sequence: Synthetic peptide
QESEIASTNPVGTEGYGVVASTKQHGDI

SEQ ID NO: 134263 - protein, 28 aa, Artificial Sequence
  Description of Artificial Sequence: Synthetic peptide
QESEIASTNPVGTEGYGVVASTLQHEDI

SEQ ID NO: 134264 - protein, 29 aa, Artificial Sequence
  Description of Artificial Sequence: Synthetic peptide
QESEIASTNPVGTEGYGVVASTLQHGEDI

SEQ ID NO: 134265 - protein, 29 aa, Artificial Sequence
  Description of Artificial Sequence: Synthetic peptide
QESEIASTNPVGTEGYGVVASTLQHGMDI

SEQ ID NO: 134266 - protein, 34 aa, Artificial Sequence
  Description of Artificial Sequence: Synthetic polypeptide
DEEEIRTTNPVATEQYGSFVWPEVELENITENTI

SEQ ID NO: 134267 - protein, 34 aa, Artificial Sequence
  Description of Artificial Sequence: Synthetic polypeptide
DEEEIRTTNPVATEQYGSFVWPEVELENITDNQD

SEQ ID NO: 134268 - protein, 29 aa, Artificial Sequence
  Description of Artificial Sequence: Synthetic peptide
QESEIASTNPVGTEGYGVVASVTLQHGDI

SEQ ID NO: 134269 - protein, 34 aa, Artificial Sequence
  Description of Artificial Sequence: Synthetic polypeptide
DEGEIATTNPVATEQYGCVAANGLADAPLGDNRN

SEQ ID NO: 134270 - protein, 29 aa, Artificial Sequence
  Description of Artificial Sequence: Synthetic peptide
QESEIASTNPVGTEGYGVVMASTLQHGDI

SEQ ID NO: 134271 - protein, 34 aa, Artificial Sequence
  Description of Artificial Sequence: Synthetic polypeptide
DEGEIATTNPVATEQYGCTAATENLTAGNGMERH

SEQ ID NO: 134272 - protein, 29 aa, Artificial Sequence
  Description of Artificial Sequence: Synthetic peptide
QESEIASTNPVGTEGYGVVSASTLQHGDI

SEQ ID NO: 134273 - protein, 28 aa, Artificial Sequence
  Description of Artificial Sequence: Synthetic peptide
QESEIASTNPVGTEGYGVVSSTLEHGDI

SEQ ID NO: 134274 - protein, 29 aa, Artificial Sequence
  Description of Artificial Sequence: Synthetic peptide
QESEIASTNPVGTEGYGVVSSTLQHNGDV

SEQ ID NO: 134275 - protein, 29 aa, Artificial Sequence
  Description of Artificial Sequence: Synthetic peptide
QESEIASTNPVGTEPWGVMASTNLQHGDI

SEQ ID NO: 134276 - protein, 29 aa, Artificial Sequence
  Description of Artificial Sequence: Synthetic peptide
QESEIASTNPVGTEQYGVMSSTLQHEGDI

SEQ ID NO: 134277 - protein, 29 aa, Artificial Sequence
  Description of Artificial Sequence: Synthetic peptide
QESEIASTNPVGTEPYGCVMASTLQHGDI

SEQ ID NO: 134278 - protein, 37 aa, Artificial Sequence
  Description of Artificial Sequence: Synthetic polypeptide
DEEEIRTTNPVATEQYGSFVSSTTPAGPNMRNGSNPV

SEQ ID NO: 134279 - protein, 32 aa, Artificial Sequence
  Description of Artificial Sequence: Synthetic polypeptide
QESEIASTNPVGTEQYGSVSSTTTLPQHGMDV

SEQ ID NO: 134280 - protein, 28 aa, Artificial Sequence
  Description of Artificial Sequence: Synthetic peptide
QESEIASTNPVGTEQYGVMADTLQHGDI

SEQ ID NO: 134281 - protein, 28 aa, Artificial Sequence
  Description of Artificial Sequence: Synthetic peptide
QESEIASTNPVGTEQYGVMADTLQHGDQ

SEQ ID NO: 134282 - protein, 31 aa, Artificial Sequence
  Description of Artificial Sequence: Synthetic polypeptide
DEGEIATTNPVATEQWGAVASGAPGSADNRN

SEQ ID NO: 134283 - protein, 28 aa, Artificial Sequence
  Description of Artificial Sequence: Synthetic peptide
QESEIASTNPVGTEQYGVMAETLQHGDI

SEQ ID NO: 134284 - protein, 29 aa, Artificial Sequence
  Description of Artificial Sequence: Synthetic peptide
QESEIASTNPVGTEQYGVMASDTLQHGDI

SEQ ID NO: 134285 - protein, 35 aa, Artificial Sequence
  Description of Artificial Sequence: Synthetic polypeptide
DEEEIRTTNPVATEQYGYAISPSFVTEMVRDGEFE

SEQ ID NO: 134286 - protein, 33 aa, Artificial Sequence
  Description of Artificial Sequence: Synthetic polypeptide
DEGEIATTNPVATEPYGSVCAGNNLTDAGGNNF

SEQ ID NO: 134287 - protein, 28 aa, Artificial Sequence
  Description of Artificial Sequence: Synthetic peptide
QESEIASTNPVGTEQYGVMASTCQHGDI

SEQ ID NO: 134288 - protein, 32 aa, Artificial Sequence
  Description of Artificial Sequence: Synthetic polypeptide
QESEIASTNPVGTEQYGSVSASPTLQRNGDPV

SEQ ID NO: 134289 - protein, 28 aa, Artificial Sequence
  Description of Artificial Sequence: Synthetic peptide
QESEIASTNPVGTEQYGVMASTLEHGDI

SEQ ID NO: 134290 - protein, 29 aa, Artificial Sequence
  Description of Artificial Sequence: Synthetic peptide
QESEIASTNPVGTEQYGVMASTLPQHGDI

SEQ ID NO: 134291 - protein, 33 aa, Artificial Sequence
  Description of Artificial Sequence: Synthetic polypeptide
DDEEIRTTNPVATEQYGAVSGDLIGGDTEEGED

SEQ ID NO: 134292 - protein, 35 aa, Artificial Sequence
  Description of Artificial Sequence: Synthetic polypeptide
DDEEIRTTNPVATEQYGAVSGGTDQNDGEGEGNEG

SEQ ID NO: 134293 - protein, 29 aa, Artificial Sequence
  Description of Artificial Sequence: Synthetic peptide
QESEIASTNPVGTEQYGVMASTLQDHGDI

SEQ ID NO: 134294 - protein, 29 aa, Artificial Sequence
  Description of Artificial Sequence: Synthetic peptide
QESEIASTNPVGTEQYGVMASTLQHEGDI

SEQ ID NO: 134295 - protein, 35 aa, Artificial Sequence
  Description of Artificial Sequence: Synthetic polypeptide
DEGEIATTNPVATECYGSVCSTNPAEQNHGNAQQD

SEQ ID NO: 134296 - protein, 33 aa, Artificial Sequence
  Description of Artificial Sequence: Synthetic polypeptide
DEGEIATTNPVATECYGSVCAGNNLTDAGGNEH

SEQ ID NO: 134297 - protein, 38 aa, Artificial Sequence
  Description of Artificial Sequence: Synthetic polypeptide
DEEEIRTTNPVATEQYGSFVASPTFSNYELQIVEVNVE

SEQ ID NO: 134298 - protein, 29 aa, Artificial Sequence
  Description of Artificial Sequence: Synthetic peptide
QESEIASTNPVGTEQYGVMASTLQHGKIK

SEQ ID NO: 134299 - protein, 28 aa, Artificial Sequence
  Description of Artificial Sequence: Synthetic peptide
QESEIASTNPVGTEQYGVMASTLMHGDI

SEQ ID NO: 134300 - protein, 34 aa, Artificial Sequence
  Description of Artificial Sequence: Synthetic polypeptide
DEEEIRTTNPVATEQYGSFVNGELEDDQGSEQIN

SEQ ID NO: 134301 - protein, 30 aa, Artificial Sequence
  Description of Artificial Sequence: Synthetic polypeptide
QESEIASTNPVGTEQYGSMASTLPQMHGDI

SEQ ID NO: 134302 - protein, 36 aa, Artificial Sequence
  Description of Artificial Sequence: Synthetic polypeptide
DEEEIRTTNPVATEQYGSFVNGETLDDQTGSENEQI

SEQ ID NO: 134303 - protein, 29 aa, Artificial Sequence
  Description of Artificial Sequence: Synthetic peptide
QESEIASTNPVGTEPYGVISMTLQQQGNI

SEQ ID NO: 134304 - protein, 29 aa, Artificial Sequence
  Description of Artificial Sequence: Synthetic peptide
QESEIASTNPVGTEPYGVISSTLQQQGNI

SEQ ID NO: 134305 - protein, 28 aa, Artificial Sequence
  Description of Artificial Sequence: Synthetic peptide
QESEIASTNPVGTEPYGVMASTLQHGDI

SEQ ID NO: 134306 - protein, 32 aa, Artificial Sequence
  Description of Artificial Sequence: Synthetic polypeptide
DEGEIATTNPVATEQWGCVATNGLEAVAGGEF

SEQ ID NO: 134307 - protein, 29 aa, Artificial Sequence
  Description of Artificial Sequence: Synthetic peptide
QESEIASTNPVGTEPYGVMASTTLQHGDI

SEQ ID NO: 134308 - protein, 34 aa, Artificial Sequence
  Description of Artificial Sequence: Synthetic polypeptide
DEGEIATTNPVATEQWGCVAMTNLTNPDDQMGDR

SEQ ID NO: 134309 - protein, 28 aa, Artificial Sequence
  Description of Artificial Sequence: Synthetic peptide
QESEIASTNPVGTEPYGVMSSTLQHGDH

SEQ ID NO: 134310 - protein, 28 aa, Artificial Sequence
  Description of Artificial Sequence: Synthetic peptide
QESEIASTNPVGTEPYGVMSSTLQHGDI

SEQ ID NO: 134311 - protein, 33 aa, Artificial Sequence
  Description of Artificial Sequence: Synthetic polypeptide
DEGEIATTNPVATEQWGCVAGTGQLQNRMGPGL

SEQ ID NO: 134312 - protein, 37 aa, Artificial Sequence
  Description of Artificial Sequence: Synthetic polypeptide
DEEEIRTTNPVATEQYGSFVSSTTPAGPNMRNGMNQV

SEQ ID NO: 134313 - protein, 29 aa, Artificial Sequence
  Description of Artificial Sequence: Synthetic peptide
QESEIASTNPVGTEPYGVMSSTLQQHGNI

SEQ ID NO: 134314 - protein, 29 aa, Artificial Sequence
  Description of Artificial Sequence: Synthetic peptide
QESEIASTNPVGTEPYGVMSSTLQQQGNI

SEQ ID NO: 134315 - protein, 28 aa, Artificial Sequence
  Description of Artificial Sequence: Synthetic peptide
QESEIASTNPVGTEQWGVMASTLQAGDI

SEQ ID NO: 134316 - protein, 37 aa, Artificial Sequence
  Description of Artificial Sequence: Synthetic polypeptide
DEEEIRTTNPVATEQYGSFVSSTTPAGPNMRNGMNPV

SEQ ID NO: 134317 - protein, 37 aa, Artificial Sequence
  Description of Artificial Sequence: Synthetic polypeptide
DEEEIRTTNPVATEQYGSFVSSTTPAGPNMRNGMNPP

SEQ ID NO: 134318 - protein, 37 aa, Artificial Sequence
  Description of Artificial Sequence: Synthetic polypeptide
DEEEIRTTNPVATEQYGSFVSSTTPAGFNMRNGMNPV

SEQ ID NO: 134319 - protein, 37 aa, Artificial Sequence
  Description of Artificial Sequence: Synthetic polypeptide
DEEEIRTTNPVATEQYGSFVSSTTIAGPNCRNGMNPV

SEQ ID NO: 134320 - protein, 37 aa, Artificial Sequence
  Description of Artificial Sequence: Synthetic polypeptide
DEEEIRTTNPVATEQYGSFVSSTTFAGPNMRNGMNPV

SEQ ID NO: 134321 - protein, 28 aa, Artificial Sequence
  Description of Artificial Sequence: Synthetic peptide
QESEIASTNPVGTEQYGEMASVLQHGDI

SEQ ID NO: 134322 - protein, 28 aa, Artificial Sequence
  Description of Artificial Sequence: Synthetic peptide
QESEIASTNPVGTEQYGEMPSVLQHGDI

SEQ ID NO: 134323 - protein, 28 aa, Artificial Sequence
  Description of Artificial Sequence: Synthetic peptide
QESEIASTNPVGTEQYGIMACTLQHGDI

SEQ ID NO: 134324 - protein, 30 aa, Artificial Sequence
  Description of Artificial Sequence: Synthetic polypeptide
DEGEIATTNPVATEQWGDVSEGEMNAAEDN

SEQ ID NO: 134325 - protein, 36 aa, Artificial Sequence
  Description of Artificial Sequence: Synthetic polypeptide
DEEEIRTTNPVATERYGSVASTTPAGPNMRNGMNPV

SEQ ID NO: 134326 - protein, 33 aa, Artificial Sequence
  Description of Artificial Sequence: Synthetic polypeptide
DEEEIRATNPVATEQYGSVCAATGEEADMPGAG

SEQ ID NO: 134327 - protein, 33 aa, Artificial Sequence
  Description of Artificial Sequence: Synthetic polypeptide
DEAEIATTNPVATEQYGSVAATNETANPGVDQM

SEQ ID NO: 134328 - protein, 29 aa, Artificial Sequence
  Description of Artificial Sequence: Synthetic peptide
QESEIATTNPVSTECYGDVSNCLQSHEEL

SEQ ID NO: 134329 - protein, 29 aa, Artificial Sequence
  Description of Artificial Sequence: Synthetic peptide
QESEIATTNPVSTEGYGEVAEVCQRVEER

SEQ ID NO: 134330 - protein, 29 aa, Artificial Sequence
  Description of Artificial Sequence: Synthetic peptide
QESEIATTNPVSTEGYGEVAEVCQRVEQR

SEQ ID NO: 134331 - protein, 34 aa, Artificial Sequence
  Description of Artificial Sequence: Synthetic polypeptide
DEEEIRATNPVATEQYGSVITLVGMGEDGGNDGG

SEQ ID NO: 134332 - protein, 29 aa, Artificial Sequence
  Description of Artificial Sequence: Synthetic peptide
QESEIATTNPVSTEQYGEVAEVCQHVEER

SEQ ID NO: 134333 - protein, 36 aa, Artificial Sequence
  Description of Artificial Sequence: Synthetic polypeptide
DEEEIRATNPVATEQYGSVKSTTPAGPNMRNGMNPV

SEQ ID NO: 134334 - protein, 29 aa, Artificial Sequence
  Description of Artificial Sequence: Synthetic peptide
QESEICSTNPVCTEIYGVVNVSTLQFGDI

SEQ ID NO: 134335 - protein, 28 aa, Artificial Sequence
  Description of Artificial Sequence: Synthetic peptide
QESEICSTNPVGTEGYGVMASTLQGGDI

SEQ ID NO: 134336 - protein, 28 aa, Artificial Sequence
  Description of Artificial Sequence: Synthetic peptide
QESEICSTNPVGTEGYGVMASTLQHGDI

SEQ ID NO: 134337 - protein, 36 aa, Artificial Sequence
  Description of Artificial Sequence: Synthetic polypeptide
DEEEIRTTNPVATEQYGSCSVTPNILITRQLETQDG

SEQ ID NO: 134338 - protein, 29 aa, Artificial Sequence
  Description of Artificial Sequence: Synthetic peptide
QESEICSTNPVSTEIYGVVNTSTLQNGDI

SEQ ID NO: 134339 - protein, 29 aa, Artificial Sequence
  Description of Artificial Sequence: Synthetic peptide
QESEIGSTNPVGTEGYGVVMASTLQHGDI

SEQ ID NO: 134340 - protein, 28 aa, Artificial Sequence
  Description of Artificial Sequence: Synthetic peptide
QESEIISTNPVGTEPYGVMASTLQHGDI

SEQ ID NO: 134341 - protein, 28 aa, Artificial Sequence
  Description of Artificial Sequence: Synthetic peptide
QESEINSTNPVGTEGYGEMASTLQHGDI

SEQ ID NO: 134342 - protein, 28 aa, Artificial Sequence
  Description of Artificial Sequence: Synthetic peptide
QESEINSTNPVGTEGYGVLASTLQHGDI

SEQ ID NO: 134343 - protein, 28 aa, Artificial Sequence
  Description of Artificial Sequence: Synthetic peptide
QESEINSTNPVGTEGYGVMASTLQHGDI

SEQ ID NO: 134344 - protein, 29 aa, Artificial Sequence
  Description of Artificial Sequence: Synthetic peptide
QESEIQSTNPVGTEGYGCVMASTLQHGDI

SEQ ID NO: 134345 - protein, 28 aa, Artificial Sequence
  Description of Artificial Sequence: Synthetic peptide
QESEIQSTNPVGTEGYGVMASTLQHGDI

SEQ ID NO: 134346 - protein, 28 aa, Artificial Sequence
  Description of Artificial Sequence: Synthetic peptide
QESEIQSTNPVGTEGYGVMASTLQHGDN

SEQ ID NO: 134347 - protein, 37 aa, Artificial Sequence
  Description of Artificial Sequence: Synthetic polypeptide
DEEEIRTTNPVATEQYWGSVSSTTPAGPNMRNGMNPI

SEQ ID NO: 134348 - protein, 28 aa, Artificial Sequence
  Description of Artificial Sequence: Synthetic peptide
QESEIGSTNPVGTEGYGVMASTLQHGDI

SEQ ID NO: 134349 - protein, 35 aa, Artificial Sequence
  Description of Artificial Sequence: Synthetic polypeptide
DEEEIRATNPVATEQYGSVCSTGPGDPESEMNGRF

SEQ ID NO: 134350 - protein, 34 aa, Artificial Sequence
  Description of Artificial Sequence: Synthetic polypeptide
DEGEAEIATTNPVAYEQWGSVSGGNDLQDAGDSS

SEQ ID NO: 134351 - protein, 29 aa, Artificial Sequence
  Description of Artificial Sequence: Synthetic peptide
QESEIATTNPVGTEQYGVMASTLEHGEDI

SEQ ID NO: 134352 - protein, 28 aa, Artificial Sequence
  Description of Artificial Sequence: Synthetic peptide
QESEIATTNPVGTEGYGVMAETLQHGDI

SEQ ID NO: 134353 - protein, 28 aa, Artificial Sequence
  Description of Artificial Sequence: Synthetic peptide
QESEIATTNPVGTEGYGVMASDLQHGDI

SEQ ID NO: 134354 - protein, 28 aa, Artificial Sequence
  Description of Artificial Sequence: Synthetic peptide
QESEIATTNPVGTEGYGVMASDLQPGDI

SEQ ID NO: 134355 - protein, 29 aa, Artificial Sequence
  Description of Artificial Sequence: Synthetic peptide
QESEIATTNPVGTEGYGVMASDTLQHGDD

SEQ ID NO: 134356 - protein, 29 aa, Artificial Sequence
  Description of Artificial Sequence: Synthetic peptide
QESEIATTNPVGTEGYGVMASPTLQHGDV

SEQ ID NO: 134357 - protein, 28 aa, Artificial Sequence
  Description of Artificial Sequence: Synthetic peptide
QESEIATTNPVGTEGYGVMASTLNHGDI

SEQ ID NO: 134358 - protein, 29 aa, Artificial Sequence
  Description of Artificial Sequence: Synthetic peptide
QESEIATTNPVGTEGYGVMASTLQDHGDI

SEQ ID NO: 134359 - protein, 29 aa, Artificial Sequence
  Description of Artificial Sequence: Synthetic peptide
QESEIATTNPVGTEGYGVMASTLQHEGDI

SEQ ID NO: 134360 - protein, 29 aa, Artificial Sequence
  Description of Artificial Sequence: Synthetic peptide
QESEIATTNPVGTEGYGVMASTLQHEGDL

SEQ ID NO: 134361 - protein, 32 aa, Artificial Sequence
  Description of Artificial Sequence: Synthetic polypeptide
DEEEIRTTNPVATEQYGSCTPWPGTEEGMEED

SEQ ID NO: 134362 - protein, 29 aa, Artificial Sequence
  Description of Artificial Sequence: Synthetic peptide
QESEIATTNPVGTEGYGVMASTLQHGEDI

SEQ ID NO: 134363 - protein, 29 aa, Artificial Sequence
  Description of Artificial Sequence: Synthetic peptide
QESEIATTNPVGTEGYGVMASTLQQNGDH

SEQ ID NO: 134364 - protein, 28 aa, Artificial Sequence
  Description of Artificial Sequence: Synthetic peptide
QESEIATTNPVGTEGYGVMSSTLQHEDI

SEQ ID NO: 134365 - protein, 28 aa, Artificial Sequence
  Description of Artificial Sequence: Synthetic peptide
QESEIATTNPVGTEGYGVMSSTLQHEDL

SEQ ID NO: 134366 - protein, 29 aa, Artificial Sequence
  Description of Artificial Sequence: Synthetic peptide
QESEIATTNPVGTEGYGVMSSTLQQHGDI

SEQ ID NO: 134367 - protein, 34 aa, Artificial Sequence
  Description of Artificial Sequence: Synthetic polypeptide
DEEEIRTTNPVATEQYGSCTHTGEDHNPENGEEQ

SEQ ID NO: 134368 - protein, 36 aa, Artificial Sequence
  Description of Artificial Sequence: Synthetic polypeptide
DEEEIRATNPVATEQYGSVCATNPQLNLDMGDENNH

SEQ ID NO: 134369 - protein, 29 aa, Artificial Sequence
  Description of Artificial Sequence: Synthetic peptide
QESEIATTNPVGTEPYGVMAMTLQQNGNH

SEQ ID NO: 134370 - protein, 28 aa, Artificial Sequence
  Description of Artificial Sequence: Synthetic peptide
QESEIATTNPVGTEQYGEAASTCQHEEI

SEQ ID NO: 134371 - protein, 30 aa, Artificial Sequence
  Description of Artificial Sequence: Synthetic polypeptide
QESEIATTNPVGTEQYGTVSSTLVEFEGDD

SEQ ID NO: 134372 - protein, 28 aa, Artificial Sequence
  Description of Artificial Sequence: Synthetic peptide
QESEIATTNPVGTEQYGVMASTCQHEEI

SEQ ID NO: 134373 - protein, 33 aa, Artificial Sequence
  Description of Artificial Sequence: Synthetic polypeptide
DEGATIATTNPVAYEQWGCSFSTNLDIDGGNNR

SEQ ID NO: 134374 - protein, 28 aa, Artificial Sequence
  Description of Artificial Sequence: Synthetic peptide
QESEIATTNPVGTEGYGVMAATLQHGDI

SEQ ID NO: 134375 - protein, 35 aa, Artificial Sequence
  Description of Artificial Sequence: Synthetic polypeptide
DEEEIRATNPVATEQYGSVQTDNMQNENIDEQGGE

SEQ ID NO: 134376 - protein, 37 aa, Artificial Sequence
  Description of Artificial Sequence: Synthetic polypeptide
DEEEIRTTNPVATEQYWGSVSSTTPAGPNMRNGMNPV

SEQ ID NO: 134377 - protein, 36 aa, Artificial Sequence
  Description of Artificial Sequence: Synthetic polypeptide
DEEEIRATNPVATEQYGSVSTVVNQQGTEQGSTEDE

SEQ ID NO: 134378 - protein, 33 aa, Artificial Sequence
  Description of Artificial Sequence: Synthetic polypeptide
QESEIRSTNPVATECWGSVSCINEPQDREGENG

SEQ ID NO: 134379 - protein, 33 aa, Artificial Sequence
  Description of Artificial Sequence: Synthetic polypeptide
DDEEIRTTNPVATEQYGCVCSSGEHQNFGSQQD

SEQ ID NO: 134380 - protein, 29 aa, Artificial Sequence
  Description of Artificial Sequence: Synthetic peptide
QESEIRSTNPVATECWGVMACTLQRGEDG

SEQ ID NO: 134381 - protein, 34 aa, Artificial Sequence
  Description of Artificial Sequence: Synthetic polypeptide
DDEEIRTTNPVATEQYGCVCSTEEDDQNFGSEQA

SEQ ID NO: 134382 - protein, 32 aa, Artificial Sequence
  Description of Artificial Sequence: Synthetic polypeptide
DEGAIRTTNPVATEQYGSFSTLTYIEGGQISP

SEQ ID NO: 134383 - protein, 35 aa, Artificial Sequence
  Description of Artificial Sequence: Synthetic polypeptide
DDEEIRTTNPVATEQYGCVCSTEEHNQEFFGSNQA

SEQ ID NO: 134384 - protein, 35 aa, Artificial Sequence
  Description of Artificial Sequence: Synthetic polypeptide
DEEEIRATNPVATEQYGSVSVANNHDEASPSGSRN

SEQ ID NO: 134385 - protein, 34 aa, Artificial Sequence
  Description of Artificial Sequence: Synthetic polypeptide
DDEEIRTTNPVATEQYGCVCSTEEHQEFFNSNQN

SEQ ID NO: 134386 - protein, 37 aa, Artificial Sequence
  Description of Artificial Sequence: Synthetic polypeptide
DEEEIRATNPVATEQYGSVSTVVNQQGTDEQGNNQDE

SEQ ID NO: 134387 - protein, 35 aa, Artificial Sequence
  Description of Artificial Sequence: Synthetic polypeptide
DDEEIRTTNPVATEQYGCVCSTEEHQEYFGSDNQG

SEQ ID NO: 134388 - protein, 34 aa, Artificial Sequence
  Description of Artificial Sequence: Synthetic polypeptide
DDEEIRTTNPVATEQYGCVCSTEHNQFFGSETQA

SEQ ID NO: 134389 - protein, 33 aa, Artificial Sequence
  Description of Artificial Sequence: Synthetic polypeptide
DDEEIRTTNPVATEQYGCVCSTEHQENFISDQA

SEQ ID NO: 134390 - protein, 35 aa, Artificial Sequence
  Description of Artificial Sequence: Synthetic polypeptide
DEEEIRTTNPVATERWGQSVVFYTNALSHRPGGTF

SEQ ID NO: 134391 - protein, 36 aa, Artificial Sequence
  Description of Artificial Sequence: Synthetic polypeptide
AEEEIRTTNPVATEQYGSVSTVTVNNQQQNEENEED

SEQ ID NO: 134392 - protein, 36 aa, Artificial Sequence
  Description of Artificial Sequence: Synthetic polypeptide
DEEEIRTTNPVATERYGNTVPSDPNEESQSGGNQRW

SEQ ID NO: 134393 - protein, 33 aa, Artificial Sequence
  Description of Artificial Sequence: Synthetic polypeptide
DEAEIATTNPVATEQYGCVAATNDADRSPMENG

SEQ ID NO: 134394 - protein, 31 aa, Artificial Sequence
  Description of Artificial Sequence: Synthetic polypeptide
QESEIRSTNPVGTECYGVVACINLQREGEDG

SEQ ID NO: 134395 - protein, 31 aa, Artificial Sequence
  Description of Artificial Sequence: Synthetic polypeptide
QESEIRSTNPVGTECYGVVSCINEQREGEDG

SEQ ID NO: 134396 - protein, 34 aa, Artificial Sequence
  Description of Artificial Sequence: Synthetic polypeptide
DEAEIATTNPVATEQYGCVAANPNDIQNQEGNRN

SEQ ID NO: 134397 - protein, 34 aa, Artificial Sequence
  Description of Artificial Sequence: Synthetic polypeptide
DDEEIRTTNPVATEQYGCVCSTEHNENFGSDTQS

SEQ ID NO: 134398 - protein, 28 aa, Artificial Sequence
  Description of Artificial Sequence: Synthetic peptide
QESEIRSTNPIGTEGYGVVAETLMHGNI

SEQ ID NO: 134399 - protein, 37 aa, Artificial Sequence
  Description of Artificial Sequence: Synthetic polypeptide
DEEEIRATNPVATEQYGSVSTVVNNQNDTEAGTNLDG

SEQ ID NO: 134400 - protein, 32 aa, Artificial Sequence
  Description of Artificial Sequence: Synthetic polypeptide
QESEIRPTNPVATECYGIVSCNEPQDREGETG

SEQ ID NO: 134401 - protein, 36 aa, Artificial Sequence
  Description of Artificial Sequence: Synthetic polypeptide
DEEEIRATNPVATEQYGSVSATTPAGMNMRNGMENV

SEQ ID NO: 134402 - protein, 35 aa, Artificial Sequence
  Description of Artificial Sequence: Synthetic polypeptide
DEEEIRATNPVATEQYGSVSDDVTEGLGNGGQTTI

SEQ ID NO: 134403 - protein, 36 aa, Artificial Sequence
  Description of Artificial Sequence: Synthetic polypeptide
AEEEIRTTNPVATEQYGSVSTVVDNGNSEEGNNQID

SEQ ID NO: 134404 - protein, 28 aa, Artificial Sequence
  Description of Artificial Sequence: Synthetic peptide
QESEIRCTNPIGTEGYGVVAETLMHGNI

SEQ ID NO: 134405 - protein, 34 aa, Artificial Sequence
  Description of Artificial Sequence: Synthetic polypeptide
DEEEIRATNPVATEQYGSVSEANNHDASPSGSDD

SEQ ID NO: 134406 - protein, 34 aa, Artificial Sequence
  Description of Artificial Sequence: Synthetic polypeptide
DEGAIRTTNPVAYEAYGSIPSTNELVIITSGNNR

SEQ ID NO: 134407 - protein, 33 aa, Artificial Sequence
  Description of Artificial Sequence: Synthetic polypeptide
DEGAIRTTNPVAYEAYGSIPSTNEFIDTGGNNR

SEQ ID NO: 134408 - protein, 34 aa, Artificial Sequence
  Description of Artificial Sequence: Synthetic polypeptide
DEEEIRATNPVATEQYGSVSNDDNMTMEFDTENG

SEQ ID NO: 134409 - protein, 34 aa, Artificial Sequence
  Description of Artificial Sequence: Synthetic polypeptide
DEGAIRTTNPVAYEAYGISIPSTNEHVIQGGENR

SEQ ID NO: 134410 - protein, 33 aa, Artificial Sequence
  Description of Artificial Sequence: Synthetic polypeptide
DEGAIRTTNPVAYEAYGISIPSTNEEIIGGDNR

SEQ ID NO: 134411 - protein, 36 aa, Artificial Sequence
  Description of Artificial Sequence: Synthetic polypeptide
DEEEIRTTNPVATEQYWSVSSETPAGPNMRNGMNPV

SEQ ID NO: 134412 - protein, 36 aa, Artificial Sequence
  Description of Artificial Sequence: Synthetic polypeptide
DEEEIRTTNPVATEQYWSVSSTTPAGPNMRNGMNPL

SEQ ID NO: 134413 - protein, 38 aa, Artificial Sequence
  Description of Artificial Sequence: Synthetic polypeptide
AEEEIRTTNPVATEQYGSVSTVVANLQNATEQGTNDVE

SEQ ID NO: 134414 - protein, 35 aa, Artificial Sequence
  Description of Artificial Sequence: Synthetic polypeptide
DEEEIRATNPVATEQYGSVSNTDNMNIVEGEFEDE

SEQ ID NO: 134415 - protein, 37 aa, Artificial Sequence
  Description of Artificial Sequence: Synthetic polypeptide
AEEEIRTTNPVATEQYGSVSTVVANLGNADEQGTNVE

SEQ ID NO: 134416 - protein, 36 aa, Artificial Sequence
  Description of Artificial Sequence: Synthetic polypeptide
DEEEIRATNPVATEQYGSVSSTTPAGPNMMNGMNPV

SEQ ID NO: 134417 - protein, 31 aa, Artificial Sequence
  Description of Artificial Sequence: Synthetic polypeptide
QESEIRGTNPVATDAYGSVSINGQGTGEGDG

SEQ ID NO: 134418 - protein, 36 aa, Artificial Sequence
  Description of Artificial Sequence: Synthetic polypeptide
DEEEIRATNPVATEQYGSVSSTTPAGPNMRNGMNPV

SEQ ID NO: 134419 - protein, 36 aa, Artificial Sequence
  Description of Artificial Sequence: Synthetic polypeptide
DEEEIRTTNPVATEQYWSVSSTTPAGPNMRNGMNPV

SEQ ID NO: 134420 - protein, 35 aa, Artificial Sequence
  Description of Artificial Sequence: Synthetic polypeptide
DEEEIRATNPVATEQYGSVSTMGFGQEDNDNDGQE

SEQ ID NO: 134421 - protein, 34 aa, Artificial Sequence
  Description of Artificial Sequence: Synthetic polypeptide
DEGAIRTTNPVATEQYGSTCSCTNALSIITGGSP

SEQ ID NO: 134422 - protein, 37 aa, Artificial Sequence
  Description of Artificial Sequence: Synthetic polypeptide
AEEEIRTTNPVATEQYGSVSTVVGNNNNQEQGNNQSD

SEQ ID NO: 134423 - protein, 33 aa, Artificial Sequence
  Description of Artificial Sequence: Synthetic polypeptide
QESEIATTNPVATECYGVVSCITEPQDREGENG

SEQ ID NO: 134424 - protein, 29 aa, Artificial Sequence
  Description of Artificial Sequence: Synthetic peptide
QESEIATTNPVGTEGYGVMAASTLQHGDI

SEQ ID NO: 134425 - protein, 30 aa, Artificial Sequence
  Description of Artificial Sequence: Synthetic polypeptide
DEGEIACTNPVATEQYGCVATADIGNMNGM

SEQ ID NO: 134426 - protein, 34 aa, Artificial Sequence
  Description of Artificial Sequence: Synthetic polypeptide
DEAEIATTNPVATEQYGSTCAMTEHLEARDGDRD

SEQ ID NO: 134427 - protein, 31 aa, Artificial Sequence
  Description of Artificial Sequence: Synthetic polypeptide
QESEIATTNPVATEGYGVVCASDTLVEFGND

SEQ ID NO: 134428 - protein, 29 aa, Artificial Sequence
  Description of Artificial Sequence: Synthetic peptide
DEGEIAPTNPCATECYGAVWACDLQPGPI

SEQ ID NO: 134429 - protein, 31 aa, Artificial Sequence
  Description of Artificial Sequence: Synthetic polypeptide
QESEIATTNPVATEGYGVVCASDTLVEHGND

SEQ ID NO: 134430 - protein, 33 aa, Artificial Sequence
  Description of Artificial Sequence: Synthetic polypeptide
DEEEIRATNPVATEQYGSVCAATGEEPADNMNN

SEQ ID NO: 134431 - protein, 33 aa, Artificial Sequence
  Description of Artificial Sequence: Synthetic polypeptide
DEAEIATTNPVATEQYGSCSATPVDQNQVVDRF

SEQ ID NO: 134432 - protein, 29 aa, Artificial Sequence
  Description of Artificial Sequence: Synthetic peptide
DEGEIAPTNPCASEQYGIVACNWQEPGPI

SEQ ID NO: 134433 - protein, 37 aa, Artificial Sequence
  Description of Artificial Sequence: Synthetic polypeptide
AEEEIRTTNPVATEQYGSVSTVVNDNSGNQQGNNVAE

SEQ ID NO: 134434 - protein, 29 aa, Artificial Sequence
  Description of Artificial Sequence: Synthetic peptide
QESEIATTNPVATEQWGEASCIVCQHENK

SEQ ID NO: 134435 - protein, 30 aa, Artificial Sequence
  Description of Artificial Sequence: Synthetic polypeptide
QESEIATTNPVATEGYGVMCASDTLQHGDD

SEQ ID NO: 134436 - protein, 33 aa, Artificial Sequence
  Description of Artificial Sequence: Synthetic polypeptide
QESEIATTNPVATEQWGSVSCINEPQDREGETG

SEQ ID NO: 134437 - protein, 30 aa, Artificial Sequence
  Description of Artificial Sequence: Synthetic polypeptide
QESEIATTNPVATEQYGDVAEILQNAAEDA

SEQ ID NO: 134438 - protein, 33 aa, Artificial Sequence
  Description of Artificial Sequence: Synthetic polypeptide
DEEEIRATNPVATEQYGSVCAATPEEAGMMEAP

SEQ ID NO: 134439 - protein, 31 aa, Artificial Sequence
  Description of Artificial Sequence: Synthetic polypeptide
QESEIATTNPVATEQYGEAPEINCQDREENK

SEQ ID NO: 134440 - protein, 28 aa, Artificial Sequence
  Description of Artificial Sequence: Synthetic peptide
QESEIATTNPVATEQYGEAPETCQHEEI

SEQ ID NO: 134441 - protein, 28 aa, Artificial Sequence
  Description of Artificial Sequence: Synthetic peptide
QESEIATTNPVATEQYGEAPETCQHEEK

SEQ ID NO: 134442 - protein, 28 aa, Artificial Sequence
  Description of Artificial Sequence: Synthetic peptide
QESEIATTNPVATEQYGEAPEVCQHCEK

SEQ ID NO: 134443 - protein, 28 aa, Artificial Sequence
  Description of Artificial Sequence: Synthetic peptide
QESEIATTNPVATEQYGEAPEVCQHEEK

SEQ ID NO: 134444 - protein, 35 aa, Artificial Sequence
  Description of Artificial Sequence: Synthetic polypeptide
DEEEIRATNPVATEQYGSVCAGTGPQPDDQMGGRA

SEQ ID NO: 134445 - protein, 37 aa, Artificial Sequence
  Description of Artificial Sequence: Synthetic polypeptide
DEEEIRTTNPVATEQYGSCVSSTTQAGPNMRNGMNPV

SEQ ID NO: 134446 - protein, 29 aa, Artificial Sequence
  Description of Artificial Sequence: Synthetic peptide
QESEIATTNPVATEQYGDMAETLQNHEDA

SEQ ID NO: 134447 - protein, 36 aa, Artificial Sequence
  Description of Artificial Sequence: Synthetic polypeptide
DEEEIRTTNPVATEQYGYVSSTTPAGPNMRNGMNPV

SEQ ID NO: 134448 - protein, 36 aa, Artificial Sequence
  Description of Artificial Sequence: Synthetic polypeptide
DEAEIATTNPVATEQYGSTVSCTLALSEDQEGGENF

SEQ ID NO: 134449 - protein, 31 aa, Artificial Sequence
  Description of Artificial Sequence: Synthetic polypeptide
DEGEIAPTNPCATEQYGTVSATDNPEFEGTD

SEQ ID NO: 134450 - protein, 32 aa, Artificial Sequence
  Description of Artificial Sequence: Synthetic polypeptide
QESEIATTNPVATECYGVVSCITEQDREGENG

SEQ ID NO: 134451 - protein, 34 aa, Artificial Sequence
  Description of Artificial Sequence: Synthetic polypeptide
DEAEIATTNPVATEQYGSVAATNEQANPGGVDAV

SEQ ID NO: 134452 - protein, 36 aa, Artificial Sequence
  Description of Artificial Sequence: Synthetic polypeptide
DEEEIRTTNPVATEQYGSCWSTTPAGPNMRNGMNPV

SEQ ID NO: 134453 - protein, 34 aa, Artificial Sequence
  Description of Artificial Sequence: Synthetic polypeptide
DEAEIATTNPVATEQYGSVAANNLQDTQDDNSDG

SEQ ID NO: 134454 - protein, 32 aa, Artificial Sequence
  Description of Artificial Sequence: Synthetic polypeptide
QESEIATTNPVATECYGVVSSITEQDREGENG

SEQ ID NO: 134455 - protein, 34 aa, Artificial Sequence
  Description of Artificial Sequence: Synthetic polypeptide
DEAEIATTNPVATEQYGSVAAAVNNQENGGPQRQ

SEQ ID NO: 134456 - protein, 34 aa, Artificial Sequence
  Description of Artificial Sequence: Synthetic polypeptide
DEEEIRATNPVATEQYGSVCAATGEEAGMMENED

SEQ ID NO: 134457 - protein, 28 aa, Artificial Sequence
  Description of Artificial Sequence: Synthetic peptide
QESEIATTNPVATEGYGEAAEVIQHGEK

SEQ ID NO: 134458 - protein, 28 aa, Artificial Sequence
  Description of Artificial Sequence: Synthetic peptide
QESEIATTNPVATEGYGEAPEVIQHGEK

SEQ ID NO: 134459 - protein, 28 aa, Artificial Sequence
  Description of Artificial Sequence: Synthetic peptide
QESEIATTNPVATEGYGEAPSVCQHGEI

SEQ ID NO: 134460 - protein, 28 aa, Artificial Sequence
  Description of Artificial Sequence: Synthetic peptide
QESEIATTNPVATEGYGEAPSVCQHGEK

SEQ ID NO: 134461 - protein, 28 aa, Artificial Sequence
  Description of Artificial Sequence: Synthetic peptide
QESEIATTNPVATEGYGNAPNVCQHGQK

SEQ ID NO: 134462 - protein, 30 aa, Artificial Sequence
  Description of Artificial Sequence: Synthetic polypeptide
DEGEIAPTNPCSSEQWGIVSCNLQNSAGTR

SEQ ID NO: 134463 - protein, 28 aa, Artificial Sequence
  Description of Artificial Sequence: Synthetic peptide
QESEIATTNPVATEGYGVAPETCQHGEI

SEQ ID NO: 134464 - protein, 30 aa, Artificial Sequence
  Description of Artificial Sequence: Synthetic polypeptide
DEGEIAPTNPCSSEPYGTVSCENLQQQGNH

SEQ ID NO: 134465 - protein, 29 aa, Artificial Sequence
  Description of Artificial Sequence: Synthetic peptide
DEGEIAPTNPCSSEPYGTVSCENLQQGTH

SEQ ID NO: 134466 - protein, 29 aa, Artificial Sequence
  Description of Artificial Sequence: Synthetic peptide
DEGEIAPTNPCSSEGYGIVAANNLQSGTR

SEQ ID NO: 134467 - protein, 28 aa, Artificial Sequence
  Description of Artificial Sequence: Synthetic peptide
QESEIATTNPVATEGYGVMAETCQHGEI

SEQ ID NO: 134468 - protein, 28 aa, Artificial Sequence
  Description of Artificial Sequence: Synthetic peptide
QESEIATTNPVATEGYGVMAETCQHGEK

SEQ ID NO: 134469 - protein, 34 aa, Artificial Sequence
  Description of Artificial Sequence: Synthetic polypeptide
DEAEIATTNPVATEQYGSVAAAGNLEPDMNPNDR

SEQ ID NO: 134470 - protein, 35 aa, Artificial Sequence
  Description of Artificial Sequence: Synthetic polypeptide
DEAEIATTNPVATEQYGSTVSCTLLSEDHEGGSNF

SEQ ID NO: 134471 - protein, 34 aa, Artificial Sequence
  Description of Artificial Sequence: Synthetic polypeptide
DEGEIACTNPVATEQYGSVCATNLQPDNQTEGAD

SEQ ID NO: 134472 - protein, 28 aa, Artificial Sequence
  Description of Artificial Sequence: Synthetic peptide
QESEIATTNPVGTEGYGVIAMTLQQGDI

SEQ ID NO: 134473 - protein, 33 aa, Artificial Sequence
  Description of Artificial Sequence: Synthetic polypeptide
DEGEIACTNPVATEQYGSVCATNLADDLMGDQH

SEQ ID NO: 134474 - protein, 28 aa, Artificial Sequence
  Description of Artificial Sequence: Synthetic peptide
QESEIATTNPVATEQYGEMPEVCQHEEK

SEQ ID NO: 134475 - protein, 28 aa, Artificial Sequence
  Description of Artificial Sequence: Synthetic peptide
QESEIATTNPVGTDGYGVMASTLQHGDI

SEQ ID NO: 134476 - protein, 28 aa, Artificial Sequence
  Description of Artificial Sequence: Synthetic peptide
QESEIATTNPVGTECYGDVAETLQHEDL

SEQ ID NO: 134477 - protein, 28 aa, Artificial Sequence
  Description of Artificial Sequence: Synthetic peptide
QESEIATTNPVGTECYGDVAETLQHEEL

SEQ ID NO: 134478 - protein, 28 aa, Artificial Sequence
  Description of Artificial Sequence: Synthetic peptide
QESEIATTNPVGTECYGVMAETLQHGDI

SEQ ID NO: 134479 - protein, 28 aa, Artificial Sequence
  Description of Artificial Sequence: Synthetic peptide
QESEIATTNPVGTEGYGEMASVLQHGDI

SEQ ID NO: 134480 - protein, 28 aa, Artificial Sequence
  Description of Artificial Sequence: Synthetic peptide
QESEIATTNPVGTEGYGEMPSVLQHGDK

SEQ ID NO: 134481 - protein, 30 aa, Artificial Sequence
  Description of Artificial Sequence: Synthetic polypeptide
QESEIATTNPVGTEGYGIVMASTLQHGDLI

SEQ ID NO: 134482 - protein, 33 aa, Artificial Sequence
  Description of Artificial Sequence: Synthetic polypeptide
DEAEIATTNPVATEQYGCVSYTDLEDHFGEDLA

SEQ ID NO: 134483 - protein, 33 aa, Artificial Sequence
  Description of Artificial Sequence: Synthetic polypeptide
DEAEIATTNPVATEQYGCVSVTDLEDHEGSETL

SEQ ID NO: 134484 - protein, 34 aa, Artificial Sequence
  Description of Artificial Sequence: Synthetic polypeptide
QESEIATTNPVAYMHYGSIVSYTNELSQRVGNMK

SEQ ID NO: 134485 - protein, 35 aa, Artificial Sequence
  Description of Artificial Sequence: Synthetic polypeptide
DEEEIRTTNPVATEQYGSCTTPTNNLALVGLEIID

SEQ ID NO: 134486 - protein, 33 aa, Artificial Sequence
  Description of Artificial Sequence: Synthetic polypeptide
DEGEIACTNPVATEQYGCVATNLQMRPLEEDAM

SEQ ID NO: 134487 - protein, 32 aa, Artificial Sequence
  Description of Artificial Sequence: Synthetic polypeptide
DEAEIATTNPVATEQYGCVSNTDPEEHEGEDL

SEQ ID NO: 134488 - protein, 33 aa, Artificial Sequence
  Description of Artificial Sequence: Synthetic polypeptide
DEAEIATTNPVATEQYGCVSNTDLEDHEGEDLV

SEQ ID NO: 134489 - protein, 33 aa, Artificial Sequence
  Description of Artificial Sequence: Synthetic polypeptide
DEGEIACTNPVATEQYGCVATNLQEAGDGMAQN

SEQ ID NO: 134490 - protein, 28 aa, Artificial Sequence
  Description of Artificial Sequence: Synthetic peptide
QESEIATTNPVGTEGYGTMSSTLEHGDI

SEQ ID NO: 134491 - protein, 33 aa, Artificial Sequence
  Description of Artificial Sequence: Synthetic polypeptide
DEGEIACTNPVATEQYGCVATNLQAAPSEGDDE

SEQ ID NO: 134492 - protein, 33 aa, Artificial Sequence
  Description of Artificial Sequence: Synthetic polypeptide
DEGEIACTNPVATEQYGCVATNLQAAPLEEGVE

SEQ ID NO: 134493 - protein, 32 aa, Artificial Sequence
  Description of Artificial Sequence: Synthetic polypeptide
DEGEIACTNPVATEQYGCVATNLAEAPIGDTM

SEQ ID NO: 134494 - protein, 31 aa, Artificial Sequence
  Description of Artificial Sequence: Synthetic polypeptide
DEGEIACTNPVATEQYGCVATALIGRMQEGM

SEQ ID NO: 134495 - protein, 30 aa, Artificial Sequence
  Description of Artificial Sequence: Synthetic polypeptide
QESEIATTNPVGTEGYGSMATTALPNHGNV

SEQ ID NO: 134496 - protein, 30 aa, Artificial Sequence
  Description of Artificial Sequence: Synthetic polypeptide
QESEIATTNPVAYECYGQVSEGLSQHEGEL

SEQ ID NO: 134497 - protein, 30 aa, Artificial Sequence
  Description of Artificial Sequence: Synthetic polypeptide
QESEIATTNPVAYECYGKVSCEGLQHEGEL

SEQ ID NO: 134498 - protein, 32 aa, Artificial Sequence
  Description of Artificial Sequence: Synthetic polypeptide
QESEIATTNPVAYDHYGTVSYTNELSQRVLNH

SEQ ID NO: 134499 - protein, 37 aa, Artificial Sequence
  Description of Artificial Sequence: Synthetic polypeptide
DEEEIRTTNPVATEQYGSCVSSTTPAGPNMRNGMNPV

SEQ ID NO: 134500 - protein, 30 aa, Artificial Sequence
  Description of Artificial Sequence: Synthetic polypeptide
QESEIATTNPVATEQYGNAPANVCQRVEEK

SEQ ID NO: 134501 - protein, 34 aa, Artificial Sequence
  Description of Artificial Sequence: Synthetic polypeptide
DEGEIACTNPVATEQYGSVCAANPLQEADENQRQ

SEQ ID NO: 134502 - protein, 30 aa, Artificial Sequence
  Description of Artificial Sequence: Synthetic polypeptide
QESEIATTNPVATEQYGNAPANVCQRVEQK

SEQ ID NO: 134503 - protein, 29 aa, Artificial Sequence
  Description of Artificial Sequence: Synthetic peptide
QESEIATTNPVATEQYGNAPNVCQRVEEK

SEQ ID NO: 134504 - protein, 37 aa, Artificial Sequence
  Description of Artificial Sequence: Synthetic polypeptide
DEEEIRTTNPVATEQYGSCVSSTTPAGPNMRCGMNPV

SEQ ID NO: 134505 - protein, 36 aa, Artificial Sequence
  Description of Artificial Sequence: Synthetic polypeptide
DEEEIRTTNPVATEQYGSCVSPAPNLLPEVDTTERD

SEQ ID NO: 134506 - protein, 32 aa, Artificial Sequence
  Description of Artificial Sequence: Synthetic polypeptide
DEAEIATTNPVATEQYGSACAMHGQDQGGGDR

SEQ ID NO: 134507 - protein, 35 aa, Artificial Sequence
  Description of Artificial Sequence: Synthetic polypeptide
DEEEIRATNPVATEQYGSVCAMTNGEPTGGNGENG

SEQ ID NO: 134508 - protein, 34 aa, Artificial Sequence
  Description of Artificial Sequence: Synthetic polypeptide
DDEEIRTTNPVATEQYGCVCSNTETNQNFGSEQS

SEQ ID NO: 134509 - protein, 28 aa, Artificial Sequence
  Description of Artificial Sequence: Synthetic peptide
QESEIATTNPVATEQYGVAPEVCQHEEI

SEQ ID NO: 134510 - protein, 28 aa, Artificial Sequence
  Description of Artificial Sequence: Synthetic peptide
QESEIATTNPVATEQYGVAPEVCQHEEK

SEQ ID NO: 134511 - protein, 33 aa, Artificial Sequence
  Description of Artificial Sequence: Synthetic polypeptide
DEEEIRATNPVATEQYGSVCATDPTPTDDMNDI

SEQ ID NO: 134512 - protein, 28 aa, Artificial Sequence
  Description of Artificial Sequence: Synthetic peptide
QESEIATTNPVATEQYGWAPEVCQHEEK

SEQ ID NO: 134513 - protein, 34 aa, Artificial Sequence
  Description of Artificial Sequence: Synthetic polypeptide
DEAEIATTNPVATEQYGNTIATNPLENGMMGNRE

SEQ ID NO: 134514 - protein, 33 aa, Artificial Sequence
  Description of Artificial Sequence: Synthetic polypeptide
QESEIATTNPVAYDGYGSIVSYTNELSQRVTNK

SEQ ID NO: 134515 - protein, 33 aa, Artificial Sequence
  Description of Artificial Sequence: Synthetic polypeptide
DEAEIATTNPVATEQYGCVVAANNGLETVPGNN

SEQ ID NO: 134516 - protein, 32 aa, Artificial Sequence
  Description of Artificial Sequence: Synthetic polypeptide
QESEIATTNPVAYDHYGSVSTGNELSQNVNMI

SEQ ID NO: 134517 - protein, 35 aa, Artificial Sequence
  Description of Artificial Sequence: Synthetic polypeptide
DEAEIATTNPVATEQYGCVTAATANLQPRDANPNN

SEQ ID NO: 134518 - protein, 33 aa, Artificial Sequence
  Description of Artificial Sequence: Synthetic polypeptide
DEGEIACTNPVATEQYGSCATNLQESPNDSAEN

SEQ ID NO: 134519 - protein, 33 aa, Artificial Sequence
  Description of Artificial Sequence: Synthetic polypeptide
QESEIATTNPVAYDHYGSVVSYTNELSQRVLNT

SEQ ID NO: 134520 - protein, 37 aa, Artificial Sequence
  Description of Artificial Sequence: Synthetic polypeptide
DEEEIRTTNPVATEQYGSCVSSTTPAGPNYRNGMNPV

SEQ ID NO: 134521 - protein, 32 aa, Artificial Sequence
  Description of Artificial Sequence: Synthetic polypeptide
QEQEIASTNPVATEQYGSVSATDLEDHEGEDL

SEQ ID NO: 134522 - protein, 33 aa, Artificial Sequence
  Description of Artificial Sequence: Synthetic polypeptide
SEEEIRTTNPVATEQYGCVCSWETANFNSDFQA

SEQ ID NO: 134523 - protein, 33 aa, Artificial Sequence
  Description of Artificial Sequence: Synthetic polypeptide
DEEEIRTTNPVATEQYGCYSLGVDERSGQEESL

SEQ ID NO: 134524 - protein, 34 aa, Artificial Sequence
  Description of Artificial Sequence: Synthetic polypeptide
DEEEIRTTNPVATEQYGCVCENTENHENFNSDQS

SEQ ID NO: 134525 - protein, 35 aa, Artificial Sequence
  Description of Artificial Sequence: Synthetic polypeptide
DEEEIRTTNPVATEQYGCVCCNTGNHIERFGSEQA

SEQ ID NO: 134526 - protein, 33 aa, Artificial Sequence
  Description of Artificial Sequence: Synthetic polypeptide
VEDEIATTNPVATEQYGSVCAANPLQEADNQEQ

SEQ ID NO: 134527 - protein, 29 aa, Artificial Sequence
  Description of Artificial Sequence: Synthetic peptide
VEDEIATTNPVATESYGCIAGANDQAPNF

SEQ ID NO: 134528 - protein, 30 aa, Artificial Sequence
  Description of Artificial Sequence: Synthetic polypeptide
VEDEIATTNPVATESYGCIAGANDQRADNF

SEQ ID NO: 134529 - protein, 30 aa, Artificial Sequence
  Description of Artificial Sequence: Synthetic polypeptide
VEDEIATTNPVAYEPYGSVAATNDTATGMD

SEQ ID NO: 134530 - protein, 34 aa, Artificial Sequence
  Description of Artificial Sequence: Synthetic polypeptide
VEDEIATTNPVAYEQYGQSVAITNDLTQDGMGDR

SEQ ID NO: 134531 - protein, 35 aa, Artificial Sequence
  Description of Artificial Sequence: Synthetic polypeptide
DEEEIRTTNPVATEAYGTVVTVTVNNLQDEEENED

SEQ ID NO: 134532 - protein, 33 aa, Artificial Sequence
  Description of Artificial Sequence: Synthetic polypeptide
VEDEIATTNPVAYEQYGQSVATNDLTQDGMGTK

SEQ ID NO: 134533 - protein, 34 aa, Artificial Sequence
  Description of Artificial Sequence: Synthetic polypeptide
DEEEIRTTNPVATEQYGCVCENTMELIENFGSDQ

SEQ ID NO: 134534 - protein, 31 aa, Artificial Sequence
  Description of Artificial Sequence: Synthetic polypeptide
VEDEIATTNPVAYEQYGSVAAAGDQSGNPVV

SEQ ID NO: 134535 - protein, 32 aa, Artificial Sequence
  Description of Artificial Sequence: Synthetic polypeptide
VEDEIATTNPVAYEQYGSVAAANNDDRQGNDL

SEQ ID NO: 134536 - protein, 32 aa, Artificial Sequence
  Description of Artificial Sequence: Synthetic polypeptide
VEDEIATTNPVAYEQYGSVAATNDTATAGNDV

SEQ ID NO: 134537 - protein, 32 aa, Artificial Sequence
  Description of Artificial Sequence: Synthetic polypeptide
VEDEIATTNPVAYEQYGSVAATNDTATATGNH

SEQ ID NO: 134538 - protein, 32 aa, Artificial Sequence
  Description of Artificial Sequence: Synthetic polypeptide
VEDEIATTNPVAYEQYGSVAATNDTATDGNQH

SEQ ID NO: 134539 - protein, 31 aa, Artificial Sequence
  Description of Artificial Sequence: Synthetic polypeptide
VEDEIATTNPVAYEQYGSVAATNDTATDNDD

SEQ ID NO: 134540 - protein, 32 aa, Artificial Sequence
  Description of Artificial Sequence: Synthetic polypeptide
VEDEIATTNPVAYEQYGSVAATNDTATGDDNT

SEQ ID NO: 134541 - protein, 29 aa, Artificial Sequence
  Description of Artificial Sequence: Synthetic peptide
DDSEVASTNPVSTECYGDVANTLQSRGQR

SEQ ID NO: 134542 - protein, 32 aa, Artificial Sequence
  Description of Artificial Sequence: Synthetic polypeptide
VEDEIATTNPVAYEQYGSVAATNDTATGDNDH

SEQ ID NO: 134543 - protein, 32 aa, Artificial Sequence
  Description of Artificial Sequence: Synthetic polypeptide
VEDEIATTNPVAYEQYGSVAATNDTATGGNEH

SEQ ID NO: 134544 - protein, 31 aa, Artificial Sequence
  Description of Artificial Sequence: Synthetic polypeptide
VEDEIATTNPVAYEQYGSVAAANDTATGNDK

SEQ ID NO: 134545 - protein, 32 aa, Artificial Sequence
  Description of Artificial Sequence: Synthetic polypeptide
VEDEIATTNPVATEQYGCVAGTMLQHSDDNPV

SEQ ID NO: 134546 - protein, 29 aa, Artificial Sequence
  Description of Artificial Sequence: Synthetic peptide
DDSEVASTNPVGTEGYGNVASTLQSRGDI

SEQ ID NO: 134547 - protein, 33 aa, Artificial Sequence
  Description of Artificial Sequence: Synthetic polypeptide
DEEEIRTTNPVATEQYGCVCETEEHENFNSDTQ

SEQ ID NO: 134548 - protein, 32 aa, Artificial Sequence
  Description of Artificial Sequence: Synthetic polypeptide
VEDEIACTNPVATEQYGCVATNLQAENPGMTV

SEQ ID NO: 134549 - protein, 31 aa, Artificial Sequence
  Description of Artificial Sequence: Synthetic polypeptide
DEEEIRTVNPVCTEPYGTISMEDIQQQNGNH

SEQ ID NO: 134550 - protein, 34 aa, Artificial Sequence
  Description of Artificial Sequence: Synthetic polypeptide
DEEEIRTTNPVATEAYGTVVNGQTDIQTGGGNQT

SEQ ID NO: 134551 - protein, 32 aa, Artificial Sequence
  Description of Artificial Sequence: Synthetic polypeptide
VEDEIACTNPVATEQYGCVATNLQANNPNEEG

SEQ ID NO: 134552 - protein, 33 aa, Artificial Sequence
  Description of Artificial Sequence: Synthetic polypeptide
VEDEIACTNPVATEQYGCVATNLQATAGNNEAP

SEQ ID NO: 134553 - protein, 32 aa, Artificial Sequence
  Description of Artificial Sequence: Synthetic polypeptide
VEDEIACTNPVATEQYGCVATNLQATEEGGEE

SEQ ID NO: 134554 - protein, 32 aa, Artificial Sequence
  Description of Artificial Sequence: Synthetic polypeptide
VEDEIACTNPVATEQYGCVATNLQATEEGTHN

SEQ ID NO: 134555 - protein, 32 aa, Artificial Sequence
  Description of Artificial Sequence: Synthetic polypeptide
VEDEIACTNPVATEQYGCVATNLQDNPSNENH

SEQ ID NO: 134556 - protein, 32 aa, Artificial Sequence
  Description of Artificial Sequence: Synthetic polypeptide
DDSEVASTNPVATEQYGNVAANTIQSRVGNPR

SEQ ID NO: 134557 - protein, 31 aa, Artificial Sequence
  Description of Artificial Sequence: Synthetic polypeptide
DDSEVASTNPVATEQYGNVAANTIQSRVGQR

SEQ ID NO: 134558 - protein, 33 aa, Artificial Sequence
  Description of Artificial Sequence: Synthetic polypeptide
VEDEIACTNPVATEQYGCVATNLQEADGNNDNM

SEQ ID NO: 134559 - protein, 33 aa, Artificial Sequence
  Description of Artificial Sequence: Synthetic polypeptide
VEDEIACTNPVATEQYGCVATNLQEANEEGTRS

SEQ ID NO: 134560 - protein, 33 aa, Artificial Sequence
  Description of Artificial Sequence: Synthetic polypeptide
VEDEIACTNPVATEQYGCVATNLQMAPGENAEE

SEQ ID NO: 134561 - protein, 34 aa, Artificial Sequence
  Description of Artificial Sequence: Synthetic polypeptide
DEEEIRTTNPVATEQYGCVCGNTPHNQNFNSEQA

SEQ ID NO: 134562 - protein, 34 aa, Artificial Sequence
  Description of Artificial Sequence: Synthetic polypeptide
DEEEIRTTNPVATEQYGCVCGNTGNDIENFGSQQ

SEQ ID NO: 134563 - protein, 35 aa, Artificial Sequence
  Description of Artificial Sequence: Synthetic polypeptide
DEEEIRTTNPVATEQYGCVCGNTGEPQNFGSDNQA

SEQ ID NO: 134564 - protein, 33 aa, Artificial Sequence
  Description of Artificial Sequence: Synthetic polypeptide
VEDEIACTNPVATEQYGSVATNLQENPHENAEE

SEQ ID NO: 134565 - protein, 31 aa, Artificial Sequence
  Description of Artificial Sequence: Synthetic polypeptide
VEDEIATTNPVATAQWGCVAGNNGLERDGNN

SEQ ID NO: 134566 - protein, 33 aa, Artificial Sequence
  Description of Artificial Sequence: Synthetic polypeptide
VEDEIATTNPVATEQWGSVSAGNPLDDNNMNRN

SEQ ID NO: 134567 - protein, 33 aa, Artificial Sequence
  Description of Artificial Sequence: Synthetic polypeptide
DEEEIRTTNPVATEQYGCVCEWEELENFNSEQS

SEQ ID NO: 134568 - protein, 34 aa, Artificial Sequence
  Description of Artificial Sequence: Synthetic polypeptide
DEEEIRTTNPVATEQYGCVCETGEHQNFNSDTQS

SEQ ID NO: 134569 - protein, 32 aa, Artificial Sequence
  Description of Artificial Sequence: Synthetic polypeptide
VEDEIATTNPVAYEQYGSVAATNDTATGGNPE

SEQ ID NO: 134570 - protein, 32 aa, Artificial Sequence
  Description of Artificial Sequence: Synthetic polypeptide
VEDEIACTNPVATEQYGCVATNLQAENANMHN

SEQ ID NO: 134571 - protein, 31 aa, Artificial Sequence
  Description of Artificial Sequence: Synthetic polypeptide
VEDEIATTNPVAYEQYGSVAATNDTATGMQH

SEQ ID NO: 134572 - protein, 32 aa, Artificial Sequence
  Description of Artificial Sequence: Synthetic polypeptide
VEDEIATTNPVAYEQYGSVAATNDTATGNMDQ

SEQ ID NO: 134573 - protein, 36 aa, Artificial Sequence
  Description of Artificial Sequence: Synthetic polypeptide
DEEEIRTTNPVATEAYGVVSTTLNLQQNTNATEQGQ

SEQ ID NO: 134574 - protein, 36 aa, Artificial Sequence
  Description of Artificial Sequence: Synthetic polypeptide
DEEEIRTTNPVAYEQYGQCVCSNWENDLNQRGSQQS

SEQ ID NO: 134575 - protein, 37 aa, Artificial Sequence
  Description of Artificial Sequence: Synthetic polypeptide
DEEEIRTTNPVATEAYGVVSTTNLQAGNTEQGNTNEQ

SEQ ID NO: 134576 - protein, 33 aa, Artificial Sequence
  Description of Artificial Sequence: Synthetic polypeptide
DEEEIRTVNPVATEQYGCVCSWEHNQNFNSQAA

SEQ ID NO: 134577 - protein, 32 aa, Artificial Sequence
  Description of Artificial Sequence: Synthetic polypeptide
VEEEIATTNPVATEQWGCVAATWLAQNSQNHQ

SEQ ID NO: 134578 - protein, 31 aa, Artificial Sequence
  Description of Artificial Sequence: Synthetic polypeptide
VEEEIATTNPVATEQWGCVAGTGLSINMMNN

SEQ ID NO: 134579 - protein, 37 aa, Artificial Sequence
  Description of Artificial Sequence: Synthetic polypeptide
DEEEIRTTNPVATEAYGVVSTTNLQAGNTESGTTQEQ

SEQ ID NO: 134580 - protein, 35 aa, Artificial Sequence
  Description of Artificial Sequence: Synthetic polypeptide
DEEEIRTVNPVATEQYGCVCSTGELNQENFNSQQG

SEQ ID NO: 134581 - protein, 30 aa, Artificial Sequence
  Description of Artificial Sequence: Synthetic polypeptide
VEEEIATTNPVATEQYGCAPEHGQDSEGEA

SEQ ID NO: 134582 - protein, 33 aa, Artificial Sequence
  Description of Artificial Sequence: Synthetic polypeptide
DEEEIRTTNPVATEQYGCVAGTNSHPEPDMIFQ

SEQ ID NO: 134583 - protein, 35 aa, Artificial Sequence
  Description of Artificial Sequence: Synthetic polypeptide
VEEEIATTNPVATEQYGCNVATNNLENGMPGENDR

SEQ ID NO: 134584 - protein, 34 aa, Artificial Sequence
  Description of Artificial Sequence: Synthetic polypeptide
DEEEIRTVNPVATEQYGCVCSTEHQEHFNSQTQA

SEQ ID NO: 134585 - protein, 29 aa, Artificial Sequence
  Description of Artificial Sequence: Synthetic peptide
VEEEIATTNPVATEQYGEAPEVCQHEIEK

SEQ ID NO: 134586 - protein, 34 aa, Artificial Sequence
  Description of Artificial Sequence: Synthetic polypeptide
DEEEIRTVNPVATEQYGCVCSTEEHNQYFNSQQF

SEQ ID NO: 134587 - protein, 29 aa, Artificial Sequence
  Description of Artificial Sequence: Synthetic peptide
VEEEIATTNPVATEQYGEAPEVYCQHEEK

SEQ ID NO: 134588 - protein, 37 aa, Artificial Sequence
  Description of Artificial Sequence: Synthetic polypeptide
DEEEIRTTNPVATEAYGVVSTTNLQQGNNQQGTEQGS

SEQ ID NO: 134589 - protein, 37 aa, Artificial Sequence
  Description of Artificial Sequence: Synthetic polypeptide
DEEEIRTTNPVATEAYGVVSTTNLQQGNQQGSTEQGS

SEQ ID NO: 134590 - protein, 36 aa, Artificial Sequence
  Description of Artificial Sequence: Synthetic polypeptide
DEEEIRTTNPVATEAYGVVSTTNNEQQGNNQNDEED

SEQ ID NO: 134591 - protein, 37 aa, Artificial Sequence
  Description of Artificial Sequence: Synthetic polypeptide
DEEEIRTTNPVATEAYGVVSTTNNLNQQGNNQEAEED

SEQ ID NO: 134592 - protein, 37 aa, Artificial Sequence
  Description of Artificial Sequence: Synthetic polypeptide
DEEEIRTTNPVATEAYGVVSTTNNLQQGNNAEDEEDG

SEQ ID NO: 134593 - protein, 33 aa, Artificial Sequence
  Description of Artificial Sequence: Synthetic polypeptide
DEEEIRTTNPVATEQYGCVAAAAGPDLEMNNGE

SEQ ID NO: 134594 - protein, 35 aa, Artificial Sequence
  Description of Artificial Sequence: Synthetic polypeptide
DEEEIRTTNPVATEQYGCVAITNGDPARLHTNEND

SEQ ID NO: 134595 - protein, 32 aa, Artificial Sequence
  Description of Artificial Sequence: Synthetic polypeptide
VEEEIACTNPVATEQYGCVADTWLAQDSENGN

SEQ ID NO: 134596 - protein, 37 aa, Artificial Sequence
  Description of Artificial Sequence: Synthetic polypeptide
DEEEIRTTNPVATEAYGVVSTSVTNQQQLQQGTTNTD

SEQ ID NO: 134597 - protein, 32 aa, Artificial Sequence
  Description of Artificial Sequence: Synthetic polypeptide
VEDEIATTNPVAYEQYGSVAATNDTATGNNDT

SEQ ID NO: 134598 - protein, 32 aa, Artificial Sequence
  Description of Artificial Sequence: Synthetic polypeptide
VEDEIATTNPVAYEQYGSVAATNDTATGNSTV

SEQ ID NO: 134599 - protein, 32 aa, Artificial Sequence
  Description of Artificial Sequence: Synthetic polypeptide
VEDEIATTNPVAYEQYGSVAATNDTATGNTVH

SEQ ID NO: 134600 - protein, 31 aa, Artificial Sequence
  Description of Artificial Sequence: Synthetic polypeptide
VEDEIATTNPVAYEQYGSVAATNDTATGTDI

SEQ ID NO: 134601 - protein, 32 aa, Artificial Sequence
  Description of Artificial Sequence: Synthetic polypeptide
VEDEIATTNPVAYEQYGSVAATNDTATNGNTP

SEQ ID NO: 134602 - protein, 31 aa, Artificial Sequence
  Description of Artificial Sequence: Synthetic polypeptide
VEDEIATTNPVAYEQYGSVAATNDTATNNVT

SEQ ID NO: 134603 - protein, 36 aa, Artificial Sequence
  Description of Artificial Sequence: Synthetic polypeptide
DEEEIRTVNPVATEQYGSVSSTTPAGPNMRNGMNPV

SEQ ID NO: 134604 - protein, 32 aa, Artificial Sequence
  Description of Artificial Sequence: Synthetic polypeptide
VEDEIATTNPVAYEQYGSVAATNNDTATGNDP

SEQ ID NO: 134605 - protein, 32 aa, Artificial Sequence
  Description of Artificial Sequence: Synthetic polypeptide
VEDEIATTNPVAYEQYGSVATHLQDSPGSQEH

SEQ ID NO: 134606 - protein, 34 aa, Artificial Sequence
  Description of Artificial Sequence: Synthetic polypeptide
DEEEIRTTNPVATEAYGVVDGNNMTQGEGGNQDI

SEQ ID NO: 134607 - protein, 36 aa, Artificial Sequence
  Description of Artificial Sequence: Synthetic polypeptide
DEEEIRTVNPVATEQYGSVSSSTPAGPNMRNGMNPV

SEQ ID NO: 134608 - protein, 36 aa, Artificial Sequence
  Description of Artificial Sequence: Synthetic polypeptide
DEEEIRTTNPVATEAYGVVSTNNNLEQGNNQEDEED

SEQ ID NO: 134609 - protein, 32 aa, Artificial Sequence
  Description of Artificial Sequence: Synthetic polypeptide
VEDEIATVNPVATEQYGSVATNLFAEPGGSDH

SEQ ID NO: 134610 - protein, 36 aa, Artificial Sequence
  Description of Artificial Sequence: Synthetic polypeptide
DEEEIRTVNPVATEQYGSVSPTLLELDSVRNAQNDH

SEQ ID NO: 134611 - protein, 36 aa, Artificial Sequence
  Description of Artificial Sequence: Synthetic polypeptide
VEDEIRTTNPVATEQYGSVMSGMFNSDLQEEGFNTI

SEQ ID NO: 134612 - protein, 36 aa, Artificial Sequence
  Description of Artificial Sequence: Synthetic polypeptide
DEEEIRTTNPVATEAYGVVSTNTQQAGNQAGTDEQQ

SEQ ID NO: 134613 - protein, 36 aa, Artificial Sequence
  Description of Artificial Sequence: Synthetic polypeptide
DEEEIRTVNPVATEQYGSVPSPTLLLDSRINAQNDQ

SEQ ID NO: 134614 - protein, 33 aa, Artificial Sequence
  Description of Artificial Sequence: Synthetic polypeptide
VEDEVATTNPVAYEQWGSTCSTWEVNDQRDGNR

SEQ ID NO: 134615 - protein, 37 aa, Artificial Sequence
  Description of Artificial Sequence: Synthetic polypeptide
DEEEIRTTNPVATEAYGVVSTSNNLQQGNNQEDEEDS

SEQ ID NO: 134616 - protein, 35 aa, Artificial Sequence
  Description of Artificial Sequence: Synthetic polypeptide
VEDEVRTTNPVAYEQWGSVCSTWNHLDQQIGHNVR

SEQ ID NO: 134617 - protein, 37 aa, Artificial Sequence
  Description of Artificial Sequence: Synthetic polypeptide
DEEEIRTTNPVATEAYGVVSTSNNNQLQLQQGTTNTD

SEQ ID NO: 134618 - protein, 32 aa, Artificial Sequence
  Description of Artificial Sequence: Synthetic polypeptide
VEDEIATTNPVAYEQYGSVAATNDTATGNDFP

SEQ ID NO: 134619 - protein, 34 aa, Artificial Sequence
  Description of Artificial Sequence: Synthetic polypeptide
DEEEIRTTNPVATEQYGCTCSWMEHQNFGSDNQS

SEQ ID NO: 134620 - protein, 32 aa, Artificial Sequence
  Description of Artificial Sequence: Synthetic polypeptide
VEDEIACTNPVATEQYGCVATNLQAEAEAEGN

SEQ ID NO: 134621 - protein, 30 aa, Artificial Sequence
  Description of Artificial Sequence: Synthetic polypeptide
DDSEVASTNPVATEQYGEVAETIQSRVGQR

SEQ ID NO: 134622 - protein, 35 aa, Artificial Sequence
  Description of Artificial Sequence: Synthetic polypeptide
DEEEIRTTNPVATEQYGCVCSDTGPHNQNFNSDQS

SEQ ID NO: 134623 - protein, 31 aa, Artificial Sequence
  Description of Artificial Sequence: Synthetic polypeptide
TTAEIRTTNPVATEQYGTATSTVDQHGMEGG

SEQ ID NO: 134624 - protein, 35 aa, Artificial Sequence
  Description of Artificial Sequence: Synthetic polypeptide
DEEEIRTTNPVATEQYGCVCSDTGEHQYFNSDNQS

SEQ ID NO: 134625 - protein, 35 aa, Artificial Sequence
  Description of Artificial Sequence: Synthetic polypeptide
DEEEIRTTNPVATEQYGCVCSDTGEHQENFGSDQM

SEQ ID NO: 134626 - protein, 31 aa, Artificial Sequence
  Description of Artificial Sequence: Synthetic polypeptide
TTDEIATTNPVAYEHWGMVSTNLQGDAGNMP

SEQ ID NO: 134627 - protein, 34 aa, Artificial Sequence
  Description of Artificial Sequence: Synthetic polypeptide
DEEEISCTNPVATEQYGCVCSMWNDFQGFGSNQS

SEQ ID NO: 134628 - protein, 33 aa, Artificial Sequence
  Description of Artificial Sequence: Synthetic polypeptide
TTEEIRGTNPVATEQYGSVSNGINGQEDGEGQE

SEQ ID NO: 134629 - protein, 34 aa, Artificial Sequence
  Description of Artificial Sequence: Synthetic polypeptide
TTEEIRGTNPVATEQYGSVSNGINGQENGEGQTR

SEQ ID NO: 134630 - protein, 33 aa, Artificial Sequence
  Description of Artificial Sequence: Synthetic polypeptide
TTEEIRGTNPVATEQYGSVSNGVNGQENGEGQG

SEQ ID NO: 134631 - protein, 32 aa, Artificial Sequence
  Description of Artificial Sequence: Synthetic polypeptide
TTAEIATTNPVATECYGSVSGGLDRGEQNNDM

SEQ ID NO: 134632 - protein, 33 aa, Artificial Sequence
  Description of Artificial Sequence: Synthetic polypeptide
TTEEIRGTNPVATEQYGSVVDQTNEGQNGETTQ

SEQ ID NO: 134633 - protein, 34 aa, Artificial Sequence
  Description of Artificial Sequence: Synthetic polypeptide
DEEEISCTNPVATEQYGCVCSMTADFQGFGSNQA

SEQ ID NO: 134634 - protein, 33 aa, Artificial Sequence
  Description of Artificial Sequence: Synthetic polypeptide
TTEEIRGTNPVATEQYGSVVGNTNGQNNGGEGD

SEQ ID NO: 134635 - protein, 33 aa, Artificial Sequence
  Description of Artificial Sequence: Synthetic polypeptide
TTEEIRGTNPVATEQYGSVVGTNNNGQNNGGGD

SEQ ID NO: 134636 - protein, 35 aa, Artificial Sequence
  Description of Artificial Sequence: Synthetic polypeptide
DEEEIRTTNPVATEQYGCVCSDTEHNQNFSSNNQA

SEQ ID NO: 134637 - protein, 35 aa, Artificial Sequence
  Description of Artificial Sequence: Synthetic polypeptide
DEEEIRTTNPVATEQYGCVCSDTEHNQNFGSETQA

SEQ ID NO: 134638 - protein, 35 aa, Artificial Sequence
  Description of Artificial Sequence: Synthetic polypeptide
DEEEIRTTNPVATEQYGCVCSDTEHNQHFSSNTQS

SEQ ID NO: 134639 - protein, 33 aa, Artificial Sequence
  Description of Artificial Sequence: Synthetic polypeptide
TTEEIRGTNPVATEQYGSVVSGDENGQNGEGQG

SEQ ID NO: 134640 - protein, 34 aa, Artificial Sequence
  Description of Artificial Sequence: Synthetic polypeptide
DEEEIRTTNPVATEQYGCVCSDTEHNINFSSDQS

SEQ ID NO: 134641 - protein, 35 aa, Artificial Sequence
  Description of Artificial Sequence: Synthetic polypeptide
DEEEIRTTNPVATEQYGCVCSDTEEHQNFNSDTQS

SEQ ID NO: 134642 - protein, 33 aa, Artificial Sequence
  Description of Artificial Sequence: Synthetic polypeptide
DEEEISCTNPVATEQYGCVCSMTEDFQGGSDQS

SEQ ID NO: 134643 - protein, 33 aa, Artificial Sequence
  Description of Artificial Sequence: Synthetic polypeptide
TSTEIRSTNPVAYEQYGSLISTNDSQRPGGNNN

SEQ ID NO: 134644 - protein, 32 aa, Artificial Sequence
  Description of Artificial Sequence: Synthetic polypeptide
TSHEIATTNPVGYEQYGSVSCTTLSTRGTNFV

SEQ ID NO: 134645 - protein, 32 aa, Artificial Sequence
  Description of Artificial Sequence: Synthetic polypeptide
TSEEISTTNPVAYTQWGSTVSTNPSMRGGNVI

SEQ ID NO: 134646 - protein, 34 aa, Artificial Sequence
  Description of Artificial Sequence: Synthetic polypeptide
TQEEVIRTTNPVAYEQWGTTVSCTNLSQNEGNQH

SEQ ID NO: 134647 - protein, 32 aa, Artificial Sequence
  Description of Artificial Sequence: Synthetic polypeptide
TQFEIRTTNPVATEAYGKISTNLSDVDGGNNE

SEQ ID NO: 134648 - protein, 34 aa, Artificial Sequence
  Description of Artificial Sequence: Synthetic polypeptide
TSECIRTTNPVATEQYGCVSCTLNETSQFGGNPD

SEQ ID NO: 134649 - protein, 34 aa, Artificial Sequence
  Description of Artificial Sequence: Synthetic polypeptide
DEEEIRTTNPVATEQYGCVCSMTEHTENFPSNQP

SEQ ID NO: 134650 - protein, 33 aa, Artificial Sequence
  Description of Artificial Sequence: Synthetic polypeptide
TSEEIRATNPLATEHYGSVSCINMLSIGEGNRE

SEQ ID NO: 134651 - protein, 34 aa, Artificial Sequence
  Description of Artificial Sequence: Synthetic polypeptide
TSEEIRTTNPLATEHYGSVSCINEESQGEGNYRE

SEQ ID NO: 134652 - protein, 34 aa, Artificial Sequence
  Description of Artificial Sequence: Synthetic polypeptide
DEEEIRTTNPVATEQYGCVCSMTEHQENFSSEQS

SEQ ID NO: 134653 - protein, 34 aa, Artificial Sequence
  Description of Artificial Sequence: Synthetic polypeptide
TSEEIRTTNPTATEHYGSVSCINNMLSQGDGNEE

SEQ ID NO: 134654 - protein, 34 aa, Artificial Sequence
  Description of Artificial Sequence: Synthetic polypeptide
DEEEIRTTNPVATEQYGCVCSMTEHNANFNSDQA

SEQ ID NO: 134655 - protein, 35 aa, Artificial Sequence
  Description of Artificial Sequence: Synthetic polypeptide
DEEEIRTTNPVATEQYGCVCSMTEDHQEGFGSEQA

SEQ ID NO: 134656 - protein, 33 aa, Artificial Sequence
  Description of Artificial Sequence: Synthetic polypeptide
AEEEIACTNPVATEQYGSVSTTAGPNRNGMGPV

SEQ ID NO: 134657 - protein, 35 aa, Artificial Sequence
  Description of Artificial Sequence: Synthetic polypeptide
DEEEIRTTNPVATEQYGCVCSMTEDHNQNFGSDQA

SEQ ID NO: 134658 - protein, 36 aa, Artificial Sequence
  Description of Artificial Sequence: Synthetic polypeptide
DEEEIRTTNPVATEQYGCVCSMTEDHNQNFGSDNQP

SEQ ID NO: 134659 - protein, 34 aa, Artificial Sequence
  Description of Artificial Sequence: Synthetic polypeptide
DEEEIRTTNPVATEQYGCVCSMTAHQENFPSEQP

SEQ ID NO: 134660 - protein, 35 aa, Artificial Sequence
  Description of Artificial Sequence: Synthetic polypeptide
DEEEIRTTNPVATEQYGCVCSMSGELNQNFNSNIA

SEQ ID NO: 134661 - protein, 34 aa, Artificial Sequence
  Description of Artificial Sequence: Synthetic polypeptide
DEEEIRTTNPVATEQYGCVCSMSGEHQNFGSDQP

SEQ ID NO: 134662 - protein, 34 aa, Artificial Sequence
  Description of Artificial Sequence: Synthetic polypeptide
DEEEIRTTNPVATEQYGCVCSMSELENFGSETQP

SEQ ID NO: 134663 - protein, 34 aa, Artificial Sequence
  Description of Artificial Sequence: Synthetic polypeptide
DEEEIRTTNPVATEQYGCVCSMSEHQENGGSDQP

SEQ ID NO: 134664 - protein, 33 aa, Artificial Sequence
  Description of Artificial Sequence: Synthetic polypeptide
TSEEIRTTNPVAYHQYGSVVSCVHSQRGGVNVQ

SEQ ID NO: 134665 - protein, 34 aa, Artificial Sequence
  Description of Artificial Sequence: Synthetic polypeptide
DEEEIRTTNPVATEQYGCVCSDWGEHQSFNSDQS

SEQ ID NO: 134666 - protein, 34 aa, Artificial Sequence
  Description of Artificial Sequence: Synthetic polypeptide
TSEEISTTNPVAYEQYGSVSVTENLSDEKVGTRL

SEQ ID NO: 134667 - protein, 34 aa, Artificial Sequence
  Description of Artificial Sequence: Synthetic polypeptide
DEEEIRTTNPVATEQYGCVCSDTEEDEHFGSEQA

SEQ ID NO: 134668 - protein, 30 aa, Artificial Sequence
  Description of Artificial Sequence: Synthetic polypeptide
DDSEVASTNPVATEQYGNAAANTIQRVGQR

SEQ ID NO: 134669 - protein, 34 aa, Artificial Sequence
  Description of Artificial Sequence: Synthetic polypeptide
DEEEIRTTNPVATEQYGCVCSDTEDNQNFSSDQF

SEQ ID NO: 134670 - protein, 35 aa, Artificial Sequence
  Description of Artificial Sequence: Synthetic polypeptide
DEEEIRTTNPVATEQYGCVCSDTEDEENFGSENQS

SEQ ID NO: 134671 - protein, 31 aa, Artificial Sequence
  Description of Artificial Sequence: Synthetic polypeptide
DDSEVASTNPVATEGYGNVATNTIQMRVGNV

SEQ ID NO: 134672 - protein, 31 aa, Artificial Sequence
  Description of Artificial Sequence: Synthetic polypeptide
DDSEVASTNPVATEGYGNVATNTIQSRVGQR

SEQ ID NO: 134673 - protein, 32 aa, Artificial Sequence
  Description of Artificial Sequence: Synthetic polypeptide
VEDEIACTNPVATEQYGCASANLQAHPMGQRN

SEQ ID NO: 134674 - protein, 31 aa, Artificial Sequence
  Description of Artificial Sequence: Synthetic polypeptide
VEDEIACTNPVATEQYGCASANLQAPQGQDD

SEQ ID NO: 134675 - protein, 31 aa, Artificial Sequence
  Description of Artificial Sequence: Synthetic polypeptide
DDSEVASTNPVATEGYGNVSANTIQSRVGQR

SEQ ID NO: 134676 - protein, 31 aa, Artificial Sequence
  Description of Artificial Sequence: Synthetic polypeptide
VEDEIACTNPVATEQYGCASANLQEAHGGQD

SEQ ID NO: 134677 - protein, 32 aa, Artificial Sequence
  Description of Artificial Sequence: Synthetic polypeptide
VEDEIACTNPVATEQYGCASANLQEAVGGQRP

SEQ ID NO: 134678 - protein, 31 aa, Artificial Sequence
  Description of Artificial Sequence: Synthetic polypeptide
VEDEIACTNPVATEQYGCASANLQEAVPGQL

SEQ ID NO: 134679 - protein, 34 aa, Artificial Sequence
  Description of Artificial Sequence: Synthetic polypeptide
DEEEIRVTNPVATEQYGSVSVTMIGVELIMQEHA

SEQ ID NO: 134680 - protein, 32 aa, Artificial Sequence
  Description of Artificial Sequence: Synthetic polypeptide
VEDEIACTNPVATEQYGCAASANLQEAGGQRA

SEQ ID NO: 134681 - protein, 34 aa, Artificial Sequence
  Description of Artificial Sequence: Synthetic polypeptide
DEEEIRVTNPVATEQYGSVSVTMIGPELEMQEHV

SEQ ID NO: 134682 - protein, 34 aa, Artificial Sequence
  Description of Artificial Sequence: Synthetic polypeptide
DEEEIRTTNPVATEQYGCVCQNTGELIENFGSEQ

SEQ ID NO: 134683 - protein, 31 aa, Artificial Sequence
  Description of Artificial Sequence: Synthetic polypeptide
DDSEVASTNPVATEGYGSVAANTIQSRVGQR

SEQ ID NO: 134684 - protein, 30 aa, Artificial Sequence
  Description of Artificial Sequence: Synthetic polypeptide
VEDEIACTNPVATEQYGCTATNLQGEDQSP

SEQ ID NO: 134685 - protein, 35 aa, Artificial Sequence
  Description of Artificial Sequence: Synthetic polypeptide
DEEEIRTTNPVATEAYGTVTVVVTTNEQAGNTNND

SEQ ID NO: 134686 - protein, 31 aa, Artificial Sequence
  Description of Artificial Sequence: Synthetic polypeptide
DDSEVASTNPVATEGYGSVSATTIEDRVGQR

SEQ ID NO: 134687 - protein, 32 aa, Artificial Sequence
  Description of Artificial Sequence: Synthetic polypeptide
VEDEIACTNPVATEQYGCVAITNSLFQVDGEF

SEQ ID NO: 134688 - protein, 31 aa, Artificial Sequence
  Description of Artificial Sequence: Synthetic polypeptide
VEDEIACTNPVATEQYGCVATNLADNTDNEV

SEQ ID NO: 134689 - protein, 31 aa, Artificial Sequence
  Description of Artificial Sequence: Synthetic polypeptide
DEEEIRTVNPVSTEPYGTISMEDIQQQNGNH

SEQ ID NO: 134690 - protein, 32 aa, Artificial Sequence
  Description of Artificial Sequence: Synthetic polypeptide
VEDEIACTNPVATEQYGCVATNLQAAAEEGEN

SEQ ID NO: 134691 - protein, 31 aa, Artificial Sequence
  Description of Artificial Sequence: Synthetic polypeptide
VEDEIACTNPVATEQYGCASANNLQEAGGQV

SEQ ID NO: 134692 - protein, 30 aa, Artificial Sequence
  Description of Artificial Sequence: Synthetic polypeptide
VEDEIACTNPVATEQWGCASANLQAHPGQF

SEQ ID NO: 134693 - protein, 31 aa, Artificial Sequence
  Description of Artificial Sequence: Synthetic polypeptide
DDSEVASTNPVATEGYGNVAANTIQSRVGNR

SEQ ID NO: 134694 - protein, 34 aa, Artificial Sequence
  Description of Artificial Sequence: Synthetic polypeptide
DEEEIRTTNPVATEQYGCVCQTEHNQENFNSDQS

SEQ ID NO: 134695 - protein, 33 aa, Artificial Sequence
  Description of Artificial Sequence: Synthetic polypeptide
TTEEIRTTNPVATEAYGKISTLNLSDVDGGNNE

SEQ ID NO: 134696 - protein, 35 aa, Artificial Sequence
  Description of Artificial Sequence: Synthetic polypeptide
DEEEIRTTNPVATEQYGCVCSCWEHNQHFGSDNQS

SEQ ID NO: 134697 - protein, 36 aa, Artificial Sequence
  Description of Artificial Sequence: Synthetic polypeptide
DEEEIRTTNPVAYEQYGQAVSQMNDLLQPDGQIARF

SEQ ID NO: 134698 - protein, 34 aa, Artificial Sequence
  Description of Artificial Sequence: Synthetic polypeptide
DEEEIRTTNPVATEQYGCVCQTWEHQENFGSEQT

SEQ ID NO: 134699 - protein, 34 aa, Artificial Sequence
  Description of Artificial Sequence: Synthetic polypeptide
DEEEIRTTNPVATEQYGCVCQTTEHQENFGSEQS

SEQ ID NO: 134700 - protein, 34 aa, Artificial Sequence
  Description of Artificial Sequence: Synthetic polypeptide
DEEEIRTTNPVATEQYGCVCQTGEPQENFGSEQT

SEQ ID NO: 134701 - protein, 35 aa, Artificial Sequence
  Description of Artificial Sequence: Synthetic polypeptide
DEEEIRTTNPVATEQYGCVCQTGEHQENFGSNTQS

SEQ ID NO: 134702 - protein, 32 aa, Artificial Sequence
  Description of Artificial Sequence: Synthetic polypeptide
TTEEIRTTNPVATEQWGVVVTNGQEEGGQDEG

SEQ ID NO: 134703 - protein, 35 aa, Artificial Sequence
  Description of Artificial Sequence: Synthetic polypeptide
AEEEIACTNPVATEQYGEASSTTPNGPQMRNGMNR

SEQ ID NO: 134704 - protein, 29 aa, Artificial Sequence
  Description of Artificial Sequence: Synthetic peptide
DDSEVASTNPVATEGYGNASNTIQRVGGR

SEQ ID NO: 134705 - protein, 33 aa, Artificial Sequence
  Description of Artificial Sequence: Synthetic polypeptide
TTEEIRTTNPVATERYGKICSTNLSDVDGGNNE

SEQ ID NO: 134706 - protein, 35 aa, Artificial Sequence
  Description of Artificial Sequence: Synthetic polypeptide
DEEEIRTTNPVATEAYGTVTVVVTNGEQAGNQNTD

SEQ ID NO: 134707 - protein, 32 aa, Artificial Sequence
  Description of Artificial Sequence: Synthetic polypeptide
TTEHEIATTNPVAYEQWGSVSTNLNGDSGGET

SEQ ID NO: 134708 - protein, 35 aa, Artificial Sequence
  Description of Artificial Sequence: Synthetic polypeptide
DEEEIRTTNPVATEAYGTVTVVVTNGEQAGNTNEF

SEQ ID NO: 134709 - protein, 34 aa, Artificial Sequence
  Description of Artificial Sequence: Synthetic polypeptide
TTTEIATTNPVATEQYGSVSWTDNQEQDRGHGDA

SEQ ID NO: 134710 - protein, 30 aa, Artificial Sequence
  Description of Artificial Sequence: Synthetic polypeptide
DDSEVASTNPVATEGYGNVAANTIQRVGQR

SEQ ID NO: 134711 - protein, 31 aa, Artificial Sequence
  Description of Artificial Sequence: Synthetic polypeptide
DDSEVASTNPVATEGYGNVAANTIQSREGNR

SEQ ID NO: 134712 - protein, 33 aa, Artificial Sequence
  Description of Artificial Sequence: Synthetic polypeptide
DEEEIRTTNPVATEQYGCVCQTEHQENFISEQT

SEQ ID NO: 134713 - protein, 30 aa, Artificial Sequence
  Description of Artificial Sequence: Synthetic polypeptide
DDSEVASTNPVATEGYGNVAANTIQSRGQR

SEQ ID NO: 134714 - protein, 36 aa, Artificial Sequence
  Description of Artificial Sequence: Synthetic polypeptide
DEEEIRYTNPVATEQYGSVSSTTPAGPNMRNGMNPV

SEQ ID NO: 134715 - protein, 36 aa, Artificial Sequence
  Description of Artificial Sequence: Synthetic polypeptide
DEEEIRYTNPVATEQYGSVSSTTPAGPNMRNGMNPK

SEQ ID NO: 134716 - protein, 34 aa, Artificial Sequence
  Description of Artificial Sequence: Synthetic polypeptide
DEEEIRTTNPVATEQYGCVCSDTEDHNQHFSSDQ

SEQ ID NO: 134717 - protein, 34 aa, Artificial Sequence
  Description of Artificial Sequence: Synthetic polypeptide
TQEEISTTNPVAYEQYGSVSVTMNLSDGKVGTRC

SEQ ID NO: 134718 - protein, 33 aa, Artificial Sequence
  Description of Artificial Sequence: Synthetic polypeptide
VEEEIATTNPVAYEQYGSVAMNDTQTGNGDEHP

SEQ ID NO: 134719 - protein, 34 aa, Artificial Sequence
  Description of Artificial Sequence: Synthetic polypeptide
VEEEIATTNPVAYEQYGSVCATNTQDQDSDNARQ

SEQ ID NO: 134720 - protein, 34 aa, Artificial Sequence
  Description of Artificial Sequence: Synthetic polypeptide
DEEEIRTTNPVATEQYGCICSWPNMLANFDSNQS

SEQ ID NO: 134721 - protein, 34 aa, Artificial Sequence
  Description of Artificial Sequence: Synthetic polypeptide
DEEEIRTTNPVATEQYGCICSTGEHQENFNSDQS

SEQ ID NO: 134722 - protein, 35 aa, Artificial Sequence
  Description of Artificial Sequence: Synthetic polypeptide
DEEEIRTTNPVATEQYGCICSNTNEHQENFGSEQP

SEQ ID NO: 134723 - protein, 32 aa, Artificial Sequence
  Description of Artificial Sequence: Synthetic polypeptide
AEECISTTNPVATEQYGCVCSSEDQNFGSNNQ

SEQ ID NO: 134724 - protein, 31 aa, Artificial Sequence
  Description of Artificial Sequence: Synthetic polypeptide
AEECISTTNPVATEQYGCVCSSEDQHFGSDQ

SEQ ID NO: 134725 - protein, 32 aa, Artificial Sequence
  Description of Artificial Sequence: Synthetic polypeptide
AEECISTTNPVATEQYGCVCSSEDQGFGSNQA

SEQ ID NO: 134726 - protein, 35 aa, Artificial Sequence
  Description of Artificial Sequence: Synthetic polypeptide
VEEEIRTTNPVATEQYGSVSTQGMGQTGGGEGEII

SEQ ID NO: 134727 - protein, 35 aa, Artificial Sequence
  Description of Artificial Sequence: Synthetic polypeptide
VEEEIRTTNPVATEQYGSVSTSNMMWQESQEEEVE

SEQ ID NO: 134728 - protein, 36 aa, Artificial Sequence
  Description of Artificial Sequence: Synthetic polypeptide
VEEEIRTTNPVATEQYGSVSTTGDPDQIGEGGNVGE

SEQ ID NO: 134729 - protein, 37 aa, Artificial Sequence
  Description of Artificial Sequence: Synthetic polypeptide
DEEEIRTTNPVATEAYGVVSTTVTNLQAGTNQEEEDE

SEQ ID NO: 134730 - protein, 34 aa, Artificial Sequence
  Description of Artificial Sequence: Synthetic polypeptide
DEEEIRTTNPVATEQYGCFCSWPEDLQYFDSNQS

SEQ ID NO: 134731 - protein, 35 aa, Artificial Sequence
  Description of Artificial Sequence: Synthetic polypeptide
VEEEIRTTNPVATEQYGSVTDGEGNLTQENGGEIQ

SEQ ID NO: 134732 - protein, 36 aa, Artificial Sequence
  Description of Artificial Sequence: Synthetic polypeptide
VEEEIRTTNPVATEQYGSVTDTGDNGQNEGNGNGDT

SEQ ID NO: 134733 - protein, 34 aa, Artificial Sequence
  Description of Artificial Sequence: Synthetic polypeptide
VEEEIRTTNPVATEQYGSVTPSVTTEEEMGQSDA

SEQ ID NO: 134734 - protein, 35 aa, Artificial Sequence
  Description of Artificial Sequence: Synthetic polypeptide
VEEEIRTTNPVATEQYGSVTVFDGNNGQGEGGNGQ

SEQ ID NO: 134735 - protein, 37 aa, Artificial Sequence
  Description of Artificial Sequence: Synthetic polypeptide
DEEEIRTTNPVATEAYGVVSTVNLQAGNQNNQEEEED

SEQ ID NO: 134736 - protein, 35 aa, Artificial Sequence
  Description of Artificial Sequence: Synthetic polypeptide
VEEEIRTTNPVATEQYGSVVGFGNNLEDGEDDNNI

SEQ ID NO: 134737 - protein, 37 aa, Artificial Sequence
  Description of Artificial Sequence: Synthetic polypeptide
DEEEIRTTNPVATEAYGVVSTVNLQAGNQQGNDEEDE

SEQ ID NO: 134738 - protein, 36 aa, Artificial Sequence
  Description of Artificial Sequence: Synthetic polypeptide
VEEEIRTTNPVATEQYGSVVSTTPDGPNMGNGENGQ

SEQ ID NO: 134739 - protein, 33 aa, Artificial Sequence
  Description of Artificial Sequence: Synthetic polypeptide
VEEEIRTTNPVATEQYGSVVTLVSHFENSGEDK

SEQ ID NO: 134740 - protein, 35 aa, Artificial Sequence
  Description of Artificial Sequence: Synthetic polypeptide
VEEEIRTTNPVATEQYGSVTDGEGNLNGENGGNIQ

SEQ ID NO: 134741 - protein, 37 aa, Artificial Sequence
  Description of Artificial Sequence: Synthetic polypeptide
DEEEIRTTNPVATEAYGVVSTTVNTNLQAGNNDEQSE

SEQ ID NO: 134742 - protein, 35 aa, Artificial Sequence
  Description of Artificial Sequence: Synthetic polypeptide
VEEEIRTTNPVATEQYGSVSTGMGDQGINDGDEFN

SEQ ID NO: 134743 - protein, 37 aa, Artificial Sequence
  Description of Artificial Sequence: Synthetic polypeptide
DEEEIRTTNPVATEAYGVVSTTVNLQQGNNQEDEEDT

SEQ ID NO: 134744 - protein, 34 aa, Artificial Sequence
  Description of Artificial Sequence: Synthetic polypeptide
VEEEIRTTNPVATEQYGSVSINDGPNEDEGQGGD

SEQ ID NO: 134745 - protein, 35 aa, Artificial Sequence
  Description of Artificial Sequence: Synthetic polypeptide
VEEEIRTTNPVATEQYGSVSINMQADQFGEDDDET

SEQ ID NO: 134746 - protein, 33 aa, Artificial Sequence
  Description of Artificial Sequence: Synthetic polypeptide
DEEEIRTTNPVATEQYGCQVCSWEHQNFISEQS

SEQ ID NO: 134747 - protein, 35 aa, Artificial Sequence
  Description of Artificial Sequence: Synthetic polypeptide
DEEEIRTTNPVATEQYGCQVCSTWEHQENFGSEQS

SEQ ID NO: 134748 - protein, 35 aa, Artificial Sequence
  Description of Artificial Sequence: Synthetic polypeptide
DEEEIRTTNPVATEQYGCQVCSTGETNQNFNSEQS

SEQ ID NO: 134749 - protein, 35 aa, Artificial Sequence
  Description of Artificial Sequence: Synthetic polypeptide
VEEEIRTTNPVATEQYGSVSLTPWLIPSQPEEQLL

SEQ ID NO: 134750 - protein, 36 aa, Artificial Sequence
  Description of Artificial Sequence: Synthetic polypeptide
VEEEIRTTNPVATEQYGSVSMGDGNEQTEGGGENGD

SEQ ID NO: 134751 - protein, 36 aa, Artificial Sequence
  Description of Artificial Sequence: Synthetic polypeptide
VEEEIRTTNPVATEQYGSVSNADNMDGQGGGQTNQS

SEQ ID NO: 134752 - protein, 34 aa, Artificial Sequence
  Description of Artificial Sequence: Synthetic polypeptide
DEEEIRTTNPVAYEQYGQCVCSTNDHNQNNSEQA

SEQ ID NO: 134753 - protein, 35 aa, Artificial Sequence
  Description of Artificial Sequence: Synthetic polypeptide
DEEEIRTTNPVATEQYGCQVCSSGEHQNFGSENQA

SEQ ID NO: 134754 - protein, 35 aa, Artificial Sequence
  Description of Artificial Sequence: Synthetic polypeptide
VEEEIRTTNPVATEQYGSVSNNDNMDQGGGQTITD

SEQ ID NO: 134755 - protein, 35 aa, Artificial Sequence
  Description of Artificial Sequence: Synthetic polypeptide
VEEEIRTTNPVATEQYGSVSNNDNMDTGGGQTGQD

SEQ ID NO: 134756 - protein, 36 aa, Artificial Sequence
  Description of Artificial Sequence: Synthetic polypeptide
VEEEIRTTNPVATEQYGSVSNTQGGDQDQEEGGQNG

SEQ ID NO: 134757 - protein, 34 aa, Artificial Sequence
  Description of Artificial Sequence: Synthetic polypeptide
VEEEIRTTNPVATEQYGSVSPLNVEQNEVTSVFL

SEQ ID NO: 134758 - protein, 36 aa, Artificial Sequence
  Description of Artificial Sequence: Synthetic polypeptide
DEEEIRTTNPVAYEQYGQCVCSTTNDHNQRFGSEQA

SEQ ID NO: 134759 - protein, 34 aa, Artificial Sequence
  Description of Artificial Sequence: Synthetic polypeptide
VEEEIRTTNPVATEQYGSVSPPAVEQNVVLIPNE

SEQ ID NO: 134760 - protein, 36 aa, Artificial Sequence
  Description of Artificial Sequence: Synthetic polypeptide
VEEEIRTTNPVATEQYGSVSPVPNHLMARDGVVQEI

SEQ ID NO: 134761 - protein, 34 aa, Artificial Sequence
  Description of Artificial Sequence: Synthetic polypeptide
DEEEIRTTNPVATEQYGCNSLQNTHELDNQENIE

SEQ ID NO: 134762 - protein, 36 aa, Artificial Sequence
  Description of Artificial Sequence: Synthetic polypeptide
VEEEIRTTNPVATEQYGSVSSQTPAGPNMRNGMNPV

SEQ ID NO: 134763 - protein, 37 aa, Artificial Sequence
  Description of Artificial Sequence: Synthetic polypeptide
DEEEIRTTNPVATEAYGVVSTTNQQQQLLQQGTTNTD

SEQ ID NO: 134764 - protein, 36 aa, Artificial Sequence
  Description of Artificial Sequence: Synthetic polypeptide
VEEEIRTTNPVATEQYGSVSSTTPAGPNMRNGMNPV

SEQ ID NO: 134765 - protein, 35 aa, Artificial Sequence
  Description of Artificial Sequence: Synthetic polypeptide
DEEEIRTTNPVAYEQYGQCVCSWENDHNQRGSQQA

SEQ ID NO: 134766 - protein, 37 aa, Artificial Sequence
  Description of Artificial Sequence: Synthetic polypeptide
DEEEIRTTNPVATEAYGVVSTTNQQLQGEQQGTTNTD

SEQ ID NO: 134767 - protein, 35 aa, Artificial Sequence
  Description of Artificial Sequence: Synthetic polypeptide
DEEEIRTTNPVAYEQYGQCVCSWENDLNQNGSQQM

SEQ ID NO: 134768 - protein, 36 aa, Artificial Sequence
  Description of Artificial Sequence: Synthetic polypeptide
DEEEIRTTNPVSTEQYGSVSSTTPAGPNSRNGMNPV

SEQ ID NO: 134769 - protein, 32 aa, Artificial Sequence
  Description of Artificial Sequence: Synthetic polypeptide
VEQEIATTNPVATELYGSVSATDLEDHEGEDL

SEQ ID NO: 134770 - protein, 32 aa, Artificial Sequence
  Description of Artificial Sequence: Synthetic polypeptide
VEQEIATTNPVATEQYGRVSATDLEDHEGEDL

SEQ ID NO: 134771 - protein, 33 aa, Artificial Sequence
  Description of Artificial Sequence: Synthetic polypeptide
VESDIRTTNPVATECWGSVSCINEPQKREGENG

SEQ ID NO: 134772 - protein, 29 aa, Artificial Sequence
  Description of Artificial Sequence: Synthetic peptide
VESEIASTNPVGTEGYGQVMASTLQHGEI

SEQ ID NO: 134773 - protein, 28 aa, Artificial Sequence
  Description of Artificial Sequence: Synthetic peptide
VESEIASTNPVGTEGYGVMASTLQHGDI

SEQ ID NO: 134774 - protein, 28 aa, Artificial Sequence
  Description of Artificial Sequence: Synthetic peptide
VESEIASTNPVGTEGYGVTASTLQHGDH

SEQ ID NO: 134775 - protein, 29 aa, Artificial Sequence
  Description of Artificial Sequence: Synthetic peptide
VESEIASTNPVGTEGYGVVMASTLQHGDI

SEQ ID NO: 134776 - protein, 28 aa, Artificial Sequence
  Description of Artificial Sequence: Synthetic peptide
VESEIASTNPVGTEGYGVYASTLQHGDI

SEQ ID NO: 134777 - protein, 33 aa, Artificial Sequence
  Description of Artificial Sequence: Synthetic polypeptide
VESEIRTTNPVATECWGSVSCINEPGDRIGENG

SEQ ID NO: 134778 - protein, 32 aa, Artificial Sequence
  Description of Artificial Sequence: Synthetic polypeptide
VENEICTTNPVATECYGSVSDTELEIHNGEEH

SEQ ID NO: 134779 - protein, 33 aa, Artificial Sequence
  Description of Artificial Sequence: Synthetic polypeptide
VESEIRTTNPVATECWGSVSCQNEDQGREPENG

SEQ ID NO: 134780 - protein, 31 aa, Artificial Sequence
  Description of Artificial Sequence: Synthetic polypeptide
WEEEIACTNPVATEQWGCVAGTGELQNMPNA

SEQ ID NO: 134781 - protein, 33 aa, Artificial Sequence
  Description of Artificial Sequence: Synthetic polypeptide
DEEEIRTTNPVATEQYGAVVNGFGNGQEQTTTI

SEQ ID NO: 134782 - protein, 34 aa, Artificial Sequence
  Description of Artificial Sequence: Synthetic polypeptide
DEEEIRTTNPVATEQYGAVVNDVGNMTGGGGNEG

SEQ ID NO: 134783 - protein, 35 aa, Artificial Sequence
  Description of Artificial Sequence: Synthetic polypeptide
WEEEIATTNPVATEQYGSVANANNLPQEAAGENDE

SEQ ID NO: 134784 - protein, 35 aa, Artificial Sequence
  Description of Artificial Sequence: Synthetic polypeptide
DEEEIRTTNPVATEQYGAVVGDTTNDGDEQGEGDE

SEQ ID NO: 134785 - protein, 35 aa, Artificial Sequence
  Description of Artificial Sequence: Synthetic polypeptide
DEEEIRTTNPVATEQYGAVVGDTNFNDGTEQGGGI

SEQ ID NO: 134786 - protein, 35 aa, Artificial Sequence
  Description of Artificial Sequence: Synthetic polypeptide
DEEEIRTTNPVATEQYGAVVGDTNDGTEQTGGGEE

SEQ ID NO: 134787 - protein, 35 aa, Artificial Sequence
  Description of Artificial Sequence: Synthetic polypeptide
DEEEIRTTNPVATEQYGAVVGDTNDGTEQTGEGEG

SEQ ID NO: 134788 - protein, 36 aa, Artificial Sequence
  Description of Artificial Sequence: Synthetic polypeptide
DEEEIRTTNPVSTEQYGNVSSTTPAGPNMRNGMNPR

SEQ ID NO: 134789 - protein, 34 aa, Artificial Sequence
  Description of Artificial Sequence: Synthetic polypeptide
DEEEIRTTNPVATEQYGAVVNGFGNGQTVQTGGE

SEQ ID NO: 134790 - protein, 36 aa, Artificial Sequence
  Description of Artificial Sequence: Synthetic polypeptide
DEEEIRTTNPVATEQYGAVVSITDNGDEFNGGGGND

SEQ ID NO: 134791 - protein, 35 aa, Artificial Sequence
  Description of Artificial Sequence: Synthetic polypeptide
DEEEIRTTNPVATEQYGAVVSNGFGNGQTDQTGGF

SEQ ID NO: 134792 - protein, 34 aa, Artificial Sequence
  Description of Artificial Sequence: Synthetic polypeptide
DEEEIRTTNPVATEQYGAVVSNGFGNGQTQTTGL

SEQ ID NO: 134793 - protein, 36 aa, Artificial Sequence
  Description of Artificial Sequence: Synthetic polypeptide
DEEEIRTTNPVSTEQYGSVSSTTPAGPNMRNGMNPV

SEQ ID NO: 134794 - protein, 36 aa, Artificial Sequence
  Description of Artificial Sequence: Synthetic polypeptide
DEEEIRTTNPVSTEQYGSVSSTTIAGPNMRNGMNPV

SEQ ID NO: 134795 - protein, 37 aa, Artificial Sequence
  Description of Artificial Sequence: Synthetic polypeptide
DEEEIRTTNPVATEAYGVVSTVNLQQGNQQSTNVATE

SEQ ID NO: 134796 - protein, 34 aa, Artificial Sequence
  Description of Artificial Sequence: Synthetic polypeptide
DEEEIRTTNPVATEQYGCAVCSTEHNTNFNSEQF

SEQ ID NO: 134797 - protein, 34 aa, Artificial Sequence
  Description of Artificial Sequence: Synthetic polypeptide
VEEEIRTTNPVATEQYGVVDNTDNGGQNGEGEEN

SEQ ID NO: 134798 - protein, 34 aa, Artificial Sequence
  Description of Artificial Sequence: Synthetic polypeptide
VEEEIRTTNPVATEQYGVVSSGFGNEEGQGGGTS

SEQ ID NO: 134799 - protein, 35 aa, Artificial Sequence
  Description of Artificial Sequence: Synthetic polypeptide
VEEEIRTTNPVATEQYGVVSTMTNGFEGGGENEIF

SEQ ID NO: 134800 - protein, 34 aa, Artificial Sequence
  Description of Artificial Sequence: Synthetic polypeptide
VEEEIRTTNPVATEQYGYVSNMGQFEGQGGNIGD

SEQ ID NO: 134801 - protein, 34 aa, Artificial Sequence
  Description of Artificial Sequence: Synthetic polypeptide
VEEEIRTTNPVATESYGSVYDNFNLVREGGDGQE

SEQ ID NO: 134802 - protein, 37 aa, Artificial Sequence
  Description of Artificial Sequence: Synthetic polypeptide
DEEEIRTTNPVATEAYGVVSTVNNQLGQQGNNGDEDE

SEQ ID NO: 134803 - protein, 34 aa, Artificial Sequence
  Description of Artificial Sequence: Synthetic polypeptide
VEEEIVTTNPVATEQYGNVSVTGGGQGDGGNGEA

SEQ ID NO: 134804 - protein, 35 aa, Artificial Sequence
  Description of Artificial Sequence: Synthetic polypeptide
VEEELRTTNPVAYEQWGSVCSTWEHLDQDIGGNRS

SEQ ID NO: 134805 - protein, 34 aa, Artificial Sequence
  Description of Artificial Sequence: Synthetic polypeptide
VEEELRTTNPVAYEQWGSVCSTWEHLDQQIGGNP

SEQ ID NO: 134806 - protein, 34 aa, Artificial Sequence
  Description of Artificial Sequence: Synthetic polypeptide
VEEELSTTNPVAYEQWGSVCSTWEHLDQPIGGNR

SEQ ID NO: 134807 - protein, 36 aa, Artificial Sequence
  Description of Artificial Sequence: Synthetic polypeptide
DEEEIRTTNPVATEAYGVVSTVNNQQQGNNQETEED

SEQ ID NO: 134808 - protein, 34 aa, Artificial Sequence
  Description of Artificial Sequence: Synthetic polypeptide
VEEEVRTTNPVATEQYGCVSSTWPLDETRIENNQ

SEQ ID NO: 134809 - protein, 37 aa, Artificial Sequence
  Description of Artificial Sequence: Synthetic polypeptide
DEEEIRTTNPVATEAYGVVSTVNQQLQLTQQGTTNTD

SEQ ID NO: 134810 - protein, 34 aa, Artificial Sequence
  Description of Artificial Sequence: Synthetic polypeptide
AEECIRCTNPVAYEQYGSVVSVNEFSQRTGGNLM

SEQ ID NO: 134811 - protein, 34 aa, Artificial Sequence
  Description of Artificial Sequence: Synthetic polypeptide
VEEGIRTTNPVATEQYGSVPPVTIPLQVSPVVNQ

SEQ ID NO: 134812 - protein, 34 aa, Artificial Sequence
  Description of Artificial Sequence: Synthetic polypeptide
DEEEIRTTNPVATEQYGAVVVGDTFNDGTEQGGI

SEQ ID NO: 134813 - protein, 34 aa, Artificial Sequence
  Description of Artificial Sequence: Synthetic polypeptide
VEEGIVTTNPVATEQYGSVPSVTPNLVSPVVNQP

SEQ ID NO: 134814 - protein, 35 aa, Artificial Sequence
  Description of Artificial Sequence: Synthetic polypeptide
DEEEIRTTNPVAYEQYGQCVCSWENDLNQSSGSQQ

SEQ ID NO: 134815 - protein, 33 aa, Artificial Sequence
  Description of Artificial Sequence: Synthetic polypeptide
AEEEIACTNPVATEQYGCVATNLQAMPGGEPPN

SEQ ID NO: 134816 - protein, 35 aa, Artificial Sequence
  Description of Artificial Sequence: Synthetic polypeptide
VEEEIRTTNPVATEQYGSVSGTLELDVNDDGGGGT

SEQ ID NO: 134817 - protein, 35 aa, Artificial Sequence
  Description of Artificial Sequence: Synthetic polypeptide
DEEEIRTTNPVAYEQYGQCVCSTGEDLLQNFGSEQ

SEQ ID NO: 134818 - protein, 37 aa, Artificial Sequence
  Description of Artificial Sequence: Synthetic polypeptide
DEEEIRTTNPVATEAYGVVSTTNNNLQLEQQGTTNTD

SEQ ID NO: 134819 - protein, 34 aa, Artificial Sequence
  Description of Artificial Sequence: Synthetic polypeptide
DEEEIRTTNPVTTEHWGSVYCMDNLQDDQRQGDL

SEQ ID NO: 134820 - protein, 33 aa, Artificial Sequence
  Description of Artificial Sequence: Synthetic polypeptide
VEEEIRTTNPVATEQYGDVVGVGNMTDGGNGGI

SEQ ID NO: 134821 - protein, 36 aa, Artificial Sequence
  Description of Artificial Sequence: Synthetic polypeptide
DEEEIRTTNPVATEAYGVVSTTNNQQGNNNQEDEED

SEQ ID NO: 134822 - protein, 35 aa, Artificial Sequence
  Description of Artificial Sequence: Synthetic polypeptide
VEEEIRTTNPVATEQYGDVVTGIQNDGQEGDGNLE

SEQ ID NO: 134823 - protein, 35 aa, Artificial Sequence
  Description of Artificial Sequence: Synthetic polypeptide
VEEEIRTTNPVATEQYGDVVTGIQNDGQEGIGNEE

SEQ ID NO: 134824 - protein, 34 aa, Artificial Sequence
  Description of Artificial Sequence: Synthetic polypeptide
VEEEIRTTNPVATEQYGDVVTGIQNDGQQEGGQE

SEQ ID NO: 134825 - protein, 34 aa, Artificial Sequence
  Description of Artificial Sequence: Synthetic polypeptide
VEEEIRTTNPVATEQYGDVVTGQQNDGQEGIGGE

SEQ ID NO: 134826 - protein, 33 aa, Artificial Sequence
  Description of Artificial Sequence: Synthetic polypeptide
VEEEIRTTNPVATEQYGMVNIMGGMGQNGENEI

SEQ ID NO: 134827 - protein, 37 aa, Artificial Sequence
  Description of Artificial Sequence: Synthetic polypeptide
DEEEIRTTNPVATEAYGVVSTTNNLQYGNNQEDEEDA

SEQ ID NO: 134828 - protein, 35 aa, Artificial Sequence
  Description of Artificial Sequence: Synthetic polypeptide
VEEEIRTTNPVATEQYGMVSTDDTGEQGGNGNDDE

SEQ ID NO: 134829 - protein, 36 aa, Artificial Sequence
  Description of Artificial Sequence: Synthetic polypeptide
DEEEIRTTNPVATEAYGVVSTTNNQQQGNGQEDEED

SEQ ID NO: 134830 - protein, 33 aa, Artificial Sequence
  Description of Artificial Sequence: Synthetic polypeptide
DEEEIRTTNPVSYEHYGSTVPCFNLSQGGGQTT

SEQ ID NO: 134831 - protein, 37 aa, Artificial Sequence
  Description of Artificial Sequence: Synthetic polypeptide
DEEEIRTTNPVATEQYGCSVSSTTPAGPNMRNGMNPV

SEQ ID NO: 134832 - protein, 34 aa, Artificial Sequence
  Description of Artificial Sequence: Synthetic polypeptide
VEEEIRTTNPVATEQYGSVCGNNDEGQEGEGQEE

SEQ ID NO: 134833 - protein, 37 aa, Artificial Sequence
  Description of Artificial Sequence: Synthetic polypeptide
DEEEIRTTNPVATEQYGCSVSSTTPAGPNMRNGMNIV

SEQ ID NO: 134834 - protein, 37 aa, Artificial Sequence
  Description of Artificial Sequence: Synthetic polypeptide
DEEEIRTTNPVATEQYGCSVSSTTPAGPNMANGMNPV

SEQ ID NO: 134835 - protein, 35 aa, Artificial Sequence
  Description of Artificial Sequence: Synthetic polypeptide
VEEEIRTTNPVATEQYGSVDDTDNTDQGNGQGEQE

SEQ ID NO: 134836 - protein, 34 aa, Artificial Sequence
  Description of Artificial Sequence: Synthetic polypeptide
VEEEIRTTNPVATEQYGSVDGTNMDENGGEGQET

SEQ ID NO: 134837 - protein, 34 aa, Artificial Sequence
  Description of Artificial Sequence: Synthetic polypeptide
DEEEIRTTNPVSTETYGSVSMVNTVQSTEEVNLN

SEQ ID NO: 134838 - protein, 34 aa, Artificial Sequence
  Description of Artificial Sequence: Synthetic polypeptide
VEEEIRTTNPVATEQYGNVVDDDNNEQEDGGNEG

SEQ ID NO: 134839 - protein, 36 aa, Artificial Sequence
  Description of Artificial Sequence: Synthetic polypeptide
DEEEIRTTNPVATEAYGVVSTTNNLQQQNTATEQGQ

SEQ ID NO: 134840 - protein, 36 aa, Artificial Sequence
  Description of Artificial Sequence: Synthetic polypeptide
DEEEIRTTNPVATEAYGVVSTTNNLQQQNATTEQGQ

SEQ ID NO: 134841 - protein, 35 aa, Artificial Sequence
  Description of Artificial Sequence: Synthetic polypeptide
VEEEIRTTNPVATEQYGAVVSGTQNDGQEGGGGQG

SEQ ID NO: 134842 - protein, 37 aa, Artificial Sequence
  Description of Artificial Sequence: Synthetic polypeptide
DEEEIRTTNPVATEAYGVVSTTNNLQQGNNQEDEEMN

SEQ ID NO: 134843 - protein, 37 aa, Artificial Sequence
  Description of Artificial Sequence: Synthetic polypeptide
DEEEIRTTNPVATEAYGVVSTTNNLQQGNNQEEEEDD

SEQ ID NO: 134844 - protein, 33 aa, Artificial Sequence
  Description of Artificial Sequence: Synthetic polypeptide
VEEEIGTTNPVATEQYGQSAHCHINLQPHNYDQ

SEQ ID NO: 134845 - protein, 37 aa, Artificial Sequence
  Description of Artificial Sequence: Synthetic polypeptide
DEEEIRTTNPVATEAYGVVSTTNNLQQGNNQQDEEDE

SEQ ID NO: 134846 - protein, 34 aa, Artificial Sequence
  Description of Artificial Sequence: Synthetic polypeptide
DEEEIRTTNPVATEQYGCTCSNWNEHQNFGSDQS

SEQ ID NO: 134847 - protein, 37 aa, Artificial Sequence
  Description of Artificial Sequence: Synthetic polypeptide
DEEEIRTTNPVATEAYGVVSTTNNLQQGNQQGTNTTE

SEQ ID NO: 134848 - protein, 35 aa, Artificial Sequence
  Description of Artificial Sequence: Synthetic polypeptide
VEEEIRTTNCVATEQYGSVSDQGQNDQNAEGGNIG

SEQ ID NO: 134849 - protein, 36 aa, Artificial Sequence
  Description of Artificial Sequence: Synthetic polypeptide
VEEEIRTTNPAATEQYGSVVIDQDNGLQRNGDNGQT

SEQ ID NO: 134850 - protein, 33 aa, Artificial Sequence
  Description of Artificial Sequence: Synthetic polypeptide
VEEEIRTTNPVATEGYGCTSIMNDEGQGGGGNI

SEQ ID NO: 134851 - protein, 34 aa, Artificial Sequence
  Description of Artificial Sequence: Synthetic polypeptide
VEEEIRTTNPVATEGYGSVNMSDLDQPTGENGDT

SEQ ID NO: 134852 - protein, 33 aa, Artificial Sequence
  Description of Artificial Sequence: Synthetic polypeptide
VEEEIRTTNPVATEGYGSVSIDDPGQEEGQGED

SEQ ID NO: 134853 - protein, 34 aa, Artificial Sequence
  Description of Artificial Sequence: Synthetic polypeptide
VEEEIRTTNPVATEGYGSVSINMDTGFGGGNGEE

SEQ ID NO: 134854 - protein, 35 aa, Artificial Sequence
  Description of Artificial Sequence: Synthetic polypeptide
DEEEIRTTNPVATEQYGCTCSMTENHNQSIGSQQM

SEQ ID NO: 134855 - protein, 33 aa, Artificial Sequence
  Description of Artificial Sequence: Synthetic polypeptide
AEEEIACTNPVATEAYGSVATNLTGAPGNQDNN

SEQ ID NO: 134856 - protein, 34 aa, Artificial Sequence
  Description of Artificial Sequence: Synthetic polypeptide
VEEEIRTTNPVATEGYGSVSVGMGQTDNGGDGEG

SEQ ID NO: 134857 - protein, 35 aa, Artificial Sequence
  Description of Artificial Sequence: Synthetic polypeptide
DEEEIRTTNPVATEQYGCTCSMTENDHNQSIGSDQ

SEQ ID NO: 134858 - protein, 35 aa, Artificial Sequence
  Description of Artificial Sequence: Synthetic polypeptide
VEEEIRTTNPVATEQYGAVISGTGQGTGQGGENGQ

SEQ ID NO: 134859 - protein, 34 aa, Artificial Sequence
  Description of Artificial Sequence: Synthetic polypeptide
VEEEIRTTNPVATEQYGAVNDTVGLGEIEGNEGT

SEQ ID NO: 134860 - protein, 36 aa, Artificial Sequence
  Description of Artificial Sequence: Synthetic polypeptide
DEEEIRTTNPVATEQYGCTCSMTEELNQESIGSNTQ

SEQ ID NO: 134861 - protein, 35 aa, Artificial Sequence
  Description of Artificial Sequence: Synthetic polypeptide
VEEEIRTTNPVATEQYGAVTVTGIQNDGQTGGGNE

SEQ ID NO: 134862 - protein, 35 aa, Artificial Sequence
  Description of Artificial Sequence: Synthetic polypeptide
VEEEIRTTNPVATEQYGAVVGNSGNNLTIGGGNIG

SEQ ID NO: 134863 - protein, 33 aa, Artificial Sequence
  Description of Artificial Sequence: Synthetic polypeptide
DEEEIRTTNPVSTETYGSVSMVNTVQNEEVSEN

SEQ ID NO: 134864 - protein, 35 aa, Artificial Sequence
  Description of Artificial Sequence: Synthetic polypeptide
DEEEIRTTNPVATEQYGCSCSMWEEHNQSIGSNQA

SEQ ID NO: 134865 - protein, 34 aa, Artificial Sequence
  Description of Artificial Sequence: Synthetic polypeptide
DEEEIRTTNPVSTETYGSVSMVNTVIQTEEVNLA

SEQ ID NO: 134866 - protein, 34 aa, Artificial Sequence
  Description of Artificial Sequence: Synthetic polypeptide
DEEEIRTTNPVSTETYGSVSMVNQLQITDEVELQ

SEQ ID NO: 134867 - protein, 35 aa, Artificial Sequence
  Description of Artificial Sequence: Synthetic polypeptide
VEEEIRTTNPVATEQYGSVNGTGDEQDEGQGNNQT

SEQ ID NO: 134868 - protein, 35 aa, Artificial Sequence
  Description of Artificial Sequence: Synthetic polypeptide
VEEEIRTTNPVATEQYGSVNMDGNEQTEGGGENDD

SEQ ID NO: 134869 - protein, 34 aa, Artificial Sequence
  Description of Artificial Sequence: Synthetic polypeptide
VEEEIRTTNPVATEQYGSVNMSDLEQDTGEDGDT

SEQ ID NO: 134870 - protein, 33 aa, Artificial Sequence
  Description of Artificial Sequence: Synthetic polypeptide
DEEEIRTTNPVSTEQYGSVTPWHNEGIQQVMQQ

SEQ ID NO: 134871 - protein, 35 aa, Artificial Sequence
  Description of Artificial Sequence: Synthetic polypeptide
DEEEIRTTNPVATEQYGCSCSTGEDLNQNFISDQS

SEQ ID NO: 134872 - protein, 36 aa, Artificial Sequence
  Description of Artificial Sequence: Synthetic polypeptide
DEEEIRTTNPVATEQYGCSCSTGEDLNQENFNSDQA

SEQ ID NO: 134873 - protein, 34 aa, Artificial Sequence
  Description of Artificial Sequence: Synthetic polypeptide
DEEEIRTTNPVATEQYGCSCSSPEMLQNFDSDQG

SEQ ID NO: 134874 - protein, 35 aa, Artificial Sequence
  Description of Artificial Sequence: Synthetic polypeptide
DEEEIRTTNPVAYEQYGQCVCSSNDHNQRFGSQAN

SEQ ID NO: 134875 - protein, 35 aa, Artificial Sequence
  Description of Artificial Sequence: Synthetic polypeptide
DEEEIRTTNPVATEQYGCSCSSPEMLQENFDSNQA

SEQ ID NO: 134876 - protein, 35 aa, Artificial Sequence
  Description of Artificial Sequence: Synthetic polypeptide
DEEEIRTTNPVATEQYGCSCSTTGEPHQYFNSDQS

SEQ ID NO: 134877 - protein, 34 aa, Artificial Sequence
  Description of Artificial Sequence: Synthetic polypeptide
DEEEIRTTNPVATEQYGCSCSSPEMHQYFDSNQS

SEQ ID NO: 134878 - protein, 34 aa, Artificial Sequence
  Description of Artificial Sequence: Synthetic polypeptide
DEEEIRTTNPVSTEQYGSVTPFNNLGEQQVMQVV

SEQ ID NO: 134879 - protein, 35 aa, Artificial Sequence
  Description of Artificial Sequence: Synthetic polypeptide
VEEEIRTTNPVATEQYGSVQAPTNLEPTVQPVELH

SEQ ID NO: 134880 - protein, 35 aa, Artificial Sequence
  Description of Artificial Sequence: Synthetic polypeptide
VEEEIRTTNPVATEQYGSVQTGIGDEENGGNGNGQ

SEQ ID NO: 134881 - protein, 35 aa, Artificial Sequence
  Description of Artificial Sequence: Synthetic polypeptide
VEEEIRTTNPVATEQYGSVSDDEGQGNEDGGNGDN

SEQ ID NO: 134882 - protein, 36 aa, Artificial Sequence
  Description of Artificial Sequence: Synthetic polypeptide
DEEEIRTTNPVAYEQYGQCVCSTENDLNQYFGSEQG

SEQ ID NO: 134883 - protein, 36 aa, Artificial Sequence
  Description of Artificial Sequence: Synthetic polypeptide
VEEEIRTTNPVATEQYGSVSDNDNMDQGGGQTNGDN

SEQ ID NO: 134884 - protein, 36 aa, Artificial Sequence
  Description of Artificial Sequence: Synthetic polypeptide
VEEEIRTTNPVATEQYGSVSDNDNMDQGGGQTNQTT

SEQ ID NO: 134885 - protein, 35 aa, Artificial Sequence
  Description of Artificial Sequence: Synthetic polypeptide
VEEEIRTTNPVATEQYGSVSDNDNMDTGGGQTNQG

SEQ ID NO: 134886 - protein, 35 aa, Artificial Sequence
  Description of Artificial Sequence: Synthetic polypeptide
VEEEIRTTNPVATEQYGSVSGDEMQGDEDGGNQDN

SEQ ID NO: 134887 - protein, 34 aa, Artificial Sequence
  Description of Artificial Sequence: Synthetic polypeptide
DEEEIRTTNPVAYEQYGQCVCSTEHQHFNSDNQS

SEQ ID NO: 134888 - protein, 34 aa, Artificial Sequence
  Description of Artificial Sequence: Synthetic polypeptide
VEEEIRTTNPVATEQYGSVNAGTMGQGTGEFTEG

SEQ ID NO: 134889 - protein, 35 aa, Artificial Sequence
  Description of Artificial Sequence: Synthetic polypeptide
VEEEIRTTNPVATEQYGSVMTGMQNDDQEEGFGII

SEQ ID NO: 134890 - protein, 33 aa, Artificial Sequence
  Description of Artificial Sequence: Synthetic polypeptide
DEEEIRTTNPVSTEQYGSVTVDTGQGEGGQSGG

SEQ ID NO: 134891 - protein, 35 aa, Artificial Sequence
  Description of Artificial Sequence: Synthetic polypeptide
VEEEIRTTNPVATEQYGSVDSGMNNQEQTGGGQEQ

SEQ ID NO: 134892 - protein, 36 aa, Artificial Sequence
  Description of Artificial Sequence: Synthetic polypeptide
DEEEIRTTNPVATEAYGVVSTTNNQQQLQQATTNVD

SEQ ID NO: 134893 - protein, 36 aa, Artificial Sequence
  Description of Artificial Sequence: Synthetic polypeptide
DEEEIRTTNPVATEAYGVVSTTNNQQQLQQGTTDTQ

SEQ ID NO: 134894 - protein, 33 aa, Artificial Sequence
  Description of Artificial Sequence: Synthetic polypeptide
DEEEIRTTNPVSTETYGSVSMVITALDTEVVLN

SEQ ID NO: 134895 - protein, 37 aa, Artificial Sequence
  Description of Artificial Sequence: Synthetic polypeptide
DEEEIRTTNPVATEAYGVVSTTNQLQQGNNQEDEEDQ

SEQ ID NO: 134896 - protein, 35 aa, Artificial Sequence
  Description of Artificial Sequence: Synthetic polypeptide
VEEEIRTTNPVATEQYGSVGPPTSSQQTQNFNIRL

SEQ ID NO: 134897 - protein, 34 aa, Artificial Sequence
  Description of Artificial Sequence: Synthetic polypeptide
VEEEIRTTNPVATEQYGSVGSGMGGQGNETEEDE

SEQ ID NO: 134898 - protein, 35 aa, Artificial Sequence
  Description of Artificial Sequence: Synthetic polypeptide
DEEEIRTTNPVATEQYGCSCSWPEDNNQNFDSNQS

SEQ ID NO: 134899 - protein, 35 aa, Artificial Sequence
  Description of Artificial Sequence: Synthetic polypeptide
DEEEIRTTNPVSTEQYGTVSSTPAGQQMQNGMNPV

SEQ ID NO: 134900 - protein, 34 aa, Artificial Sequence
  Description of Artificial Sequence: Synthetic polypeptide
DEEEIRTTNPVSTEQYGTISTMPAIPQQQNGMNH

SEQ ID NO: 134901 - protein, 34 aa, Artificial Sequence
  Description of Artificial Sequence: Synthetic polypeptide
DEEEIRTTNPVSTEQYGTISTMPAIPQMQNGMNH

SEQ ID NO: 134902 - protein, 34 aa, Artificial Sequence
  Description of Artificial Sequence: Synthetic polypeptide
DEEEIRTTNPVAYEQYGQCVCSSEDLNQNFGSQA

SEQ ID NO: 134903 - protein, 35 aa, Artificial Sequence
  Description of Artificial Sequence: Synthetic polypeptide
VEEEIRTTNPVATEQYGSVINDTNMQEGGGQTEVE

SEQ ID NO: 134904 - protein, 36 aa, Artificial Sequence
  Description of Artificial Sequence: Synthetic polypeptide
VEEEIRTTNPVATEQYGSVISNLNAGEGQEFGENGE

SEQ ID NO: 134905 - protein, 35 aa, Artificial Sequence
  Description of Artificial Sequence: Synthetic polypeptide
DEEEIRTTNPVATEQYGCSCSWGNPHNQNFNSEQA

SEQ ID NO: 134906 - protein, 33 aa, Artificial Sequence
  Description of Artificial Sequence: Synthetic polypeptide
DEEEIRTTNPVSTEQYGSVVNGFNGEGQGEQTY

SEQ ID NO: 134907 - protein, 34 aa, Artificial Sequence
  Description of Artificial Sequence: Synthetic polypeptide
DEEEIRTTNPVAYEQYGQCVCSSGEDLNQSGSQQ

SEQ ID NO: 134908 - protein, 35 aa, Artificial Sequence
  Description of Artificial Sequence: Synthetic polypeptide
VEEEIRTTNPVATEQYGSVMNDDNDGEGQGGNIEI

SEQ ID NO: 134909 - protein, 35 aa, Artificial Sequence
  Description of Artificial Sequence: Synthetic polypeptide
VEEEIRTTNPVATEQYGSVMSGEFNDDQEEGFEII

SEQ ID NO: 134910 - protein, 36 aa, Artificial Sequence
  Description of Artificial Sequence: Synthetic polypeptide
VEEEIRTTNPVATEQYGSVMSGMQNDDDQEEGMNII

SEQ ID NO: 134911 - protein, 36 aa, Artificial Sequence
  Description of Artificial Sequence: Synthetic polypeptide
VEEEIRTTNPVATEQYGSVMSGMQNDDQEEGFENII

SEQ ID NO: 134912 - protein, 35 aa, Artificial Sequence
  Description of Artificial Sequence: Synthetic polypeptide
VEEEIRTTNPVATEQYGSVDNTQNNDQEEGGQEGG

SEQ ID NO: 134913 - protein, 36 aa, Artificial Sequence
  Description of Artificial Sequence: Synthetic polypeptide
DEEEIRTTNPVSTEQYGNVSATTPAIPNMRNGMNPR

SEQ ID NO: 134914 - protein, 34 aa, Artificial Sequence
  Description of Artificial Sequence: Synthetic polypeptide
TQEEISTTNPVAYEQYGSVSVTENLSEGDVGTRL

SEQ ID NO: 134915 - protein, 33 aa, Artificial Sequence
  Description of Artificial Sequence: Synthetic polypeptide
TQEEISTTNPVAYEQWGTTVSCTNLSQNEINRQ

SEQ ID NO: 134916 - protein, 36 aa, Artificial Sequence
  Description of Artificial Sequence: Synthetic polypeptide
DEEEIRTTNPVATEQYGCVCSNTGEDHEQYFGSNQS

SEQ ID NO: 134917 - protein, 33 aa, Artificial Sequence
  Description of Artificial Sequence: Synthetic polypeptide
TEEEIRTTNPVAYERYGSVVATALDQENGGSPG

SEQ ID NO: 134918 - protein, 35 aa, Artificial Sequence
  Description of Artificial Sequence: Synthetic polypeptide
DEEEIRTTNPVATEQYGCVCSNTGEDDQNFGSDQE

SEQ ID NO: 134919 - protein, 35 aa, Artificial Sequence
  Description of Artificial Sequence: Synthetic polypeptide
DEEEIRTTNPVATEQYGCVCSNTGAHQENFGSQQS

SEQ ID NO: 134920 - protein, 34 aa, Artificial Sequence
  Description of Artificial Sequence: Synthetic polypeptide
DEEEIRTTNPVATEQYGCVCSNTETQNFTSETQS

SEQ ID NO: 134921 - protein, 35 aa, Artificial Sequence
  Description of Artificial Sequence: Synthetic polypeptide
DEEEIRTTNPVATEQYGCVCSNTETNQHFNSENQS

SEQ ID NO: 134922 - protein, 35 aa, Artificial Sequence
  Description of Artificial Sequence: Synthetic polypeptide
DEEEIRTTNPVATEQYGCVCSNTEPHQEHSNSNQS

SEQ ID NO: 134923 - protein, 30 aa, Artificial Sequence
  Description of Artificial Sequence: Synthetic polypeptide
AEEEIATTNPVATEQYGVVAVEVVEQSEET

SEQ ID NO: 134924 - protein, 32 aa, Artificial Sequence
  Description of Artificial Sequence: Synthetic polypeptide
DEAAIRTCNPVAVEGYGCVSTARLVRGNEQEE

SEQ ID NO: 134925 - protein, 36 aa, Artificial Sequence
  Description of Artificial Sequence: Synthetic polypeptide
DEEEIRTTNPVATEQYGCVCSNTGEDHQEFFGSNQS

SEQ ID NO: 134926 - protein, 33 aa, Artificial Sequence
  Description of Artificial Sequence: Synthetic polypeptide
TEEEIRTTNPVCYEHYGTTVSMPNEGSQRGGNL

SEQ ID NO: 134927 - protein, 31 aa, Artificial Sequence
  Description of Artificial Sequence: Synthetic polypeptide
AEEEIATTNPVATEQYGVVAVEVQEQGEEET

SEQ ID NO: 134928 - protein, 35 aa, Artificial Sequence
  Description of Artificial Sequence: Synthetic polypeptide
DEEEIRTTNPVATEQYGCVCSNTENHQESFISDQS

SEQ ID NO: 134929 - protein, 36 aa, Artificial Sequence
  Description of Artificial Sequence: Synthetic polypeptide
DEEEIRTTNPVATEQYGCVCSNTENHQENFGSDTQA

SEQ ID NO: 134930 - protein, 30 aa, Artificial Sequence
  Description of Artificial Sequence: Synthetic polypeptide
AEEEIATTNPVATEQYGVVAVEVEQQDEET

SEQ ID NO: 134931 - protein, 30 aa, Artificial Sequence
  Description of Artificial Sequence: Synthetic polypeptide
AEEEIATTNPVATEQYGVVAVEVEQQAEET

SEQ ID NO: 134932 - protein, 30 aa, Artificial Sequence
  Description of Artificial Sequence: Synthetic polypeptide
AEEEIATTNPVATEQYGVVAVEVEQLEQEE

SEQ ID NO: 134933 - protein, 30 aa, Artificial Sequence
  Description of Artificial Sequence: Synthetic polypeptide
AEEEIATTNPVATEQYGVVAVEVEQISEEE

SEQ ID NO: 134934 - protein, 30 aa, Artificial Sequence
  Description of Artificial Sequence: Synthetic polypeptide
AEEEIATTNPVATEQYGVVAVEVEQGEEQE

SEQ ID NO: 134935 - protein, 30 aa, Artificial Sequence
  Description of Artificial Sequence: Synthetic polypeptide
AEEEIATTNPVATEQYGVVAVEVEQDEETQ

SEQ ID NO: 134936 - protein, 30 aa, Artificial Sequence
  Description of Artificial Sequence: Synthetic polypeptide
AEEEIATTNPVATEQYGVVAVEVTEQAEEE

SEQ ID NO: 134937 - protein, 36 aa, Artificial Sequence
  Description of Artificial Sequence: Synthetic polypeptide
DEEEIRTTNPVATEQYGCVCSNTGEDHQHFGSNNQG

SEQ ID NO: 134938 - protein, 37 aa, Artificial Sequence
  Description of Artificial Sequence: Synthetic polypeptide
DEEEIRTTNPVATEQYGCVCSNTGEDLDQNFGSENQP

SEQ ID NO: 134939 - protein, 35 aa, Artificial Sequence
  Description of Artificial Sequence: Synthetic polypeptide
DEEEIRTTNPVATEQYGCVCSNTGEDNQFFNSDQA

SEQ ID NO: 134940 - protein, 36 aa, Artificial Sequence
  Description of Artificial Sequence: Synthetic polypeptide
TEEEIRTTNPVAYEQYGSVPSTTLAGSNLRNGGNPV

SEQ ID NO: 134941 - protein, 34 aa, Artificial Sequence
  Description of Artificial Sequence: Synthetic polypeptide
AEEEIATTNPVAYEQYGSTVAGAGNDQDTGNDRQ

SEQ ID NO: 134942 - protein, 35 aa, Artificial Sequence
  Description of Artificial Sequence: Synthetic polypeptide
DEEEIRTTNPVATEQYGCVCSNTGEHEQYGGSEQS

SEQ ID NO: 134943 - protein, 35 aa, Artificial Sequence
  Description of Artificial Sequence: Synthetic polypeptide
DEEEIRTTNPVATEQYGCVCSNTGEHEQYFGSDDS

SEQ ID NO: 134944 - protein, 36 aa, Artificial Sequence
  Description of Artificial Sequence: Synthetic polypeptide
DEEEIRTTNPVATEQYGCVCSNTGEHEQHFGSDNQQ

SEQ ID NO: 134945 - protein, 31 aa, Artificial Sequence
  Description of Artificial Sequence: Synthetic polypeptide
AEEEIATTNPVAYEQWGSVAKTLEQTNGDVE

SEQ ID NO: 134946 - protein, 35 aa, Artificial Sequence
  Description of Artificial Sequence: Synthetic polypeptide
DEEEIRTTNPVATEQYGCVCSNTGEHANFGSNTQL

SEQ ID NO: 134947 - protein, 32 aa, Artificial Sequence
  Description of Artificial Sequence: Synthetic polypeptide
AEEEIATTNPVAYEQWGSLSCFEHDQRREGER

SEQ ID NO: 134948 - protein, 32 aa, Artificial Sequence
  Description of Artificial Sequence: Synthetic polypeptide
AEEEIATTNPVAYEQWGSLSCFEHDQRQGERK

SEQ ID NO: 134949 - protein, 31 aa, Artificial Sequence
  Description of Artificial Sequence: Synthetic polypeptide
AEEEIATTNPVAYEQWGSLSCFEHDQRQGDN

SEQ ID NO: 134950 - protein, 35 aa, Artificial Sequence
  Description of Artificial Sequence: Synthetic polypeptide
DEEEIRTTNPVATEQYGCVCSNTGEDTQNFGSEQY

SEQ ID NO: 134951 - protein, 34 aa, Artificial Sequence
  Description of Artificial Sequence: Synthetic polypeptide
DEEEIRTTNPVATEQYGCVCSNTGEDTNFGSDQP

SEQ ID NO: 134952 - protein, 35 aa, Artificial Sequence
  Description of Artificial Sequence: Synthetic polypeptide
DEEEIRTTNPVATEQYGCVCSNTGEDQGFNSDTQS

SEQ ID NO: 134953 - protein, 35 aa, Artificial Sequence
  Description of Artificial Sequence: Synthetic polypeptide
DEEEISTTNPVATEQYGCQVCSTGELQENFNSDQS

SEQ ID NO: 134954 - protein, 35 aa, Artificial Sequence
  Description of Artificial Sequence: Synthetic polypeptide
DEEEIRTTNPVATEQYGCVCSNTGEDQEHFNSEQG

SEQ ID NO: 134955 - protein, 35 aa, Artificial Sequence
  Description of Artificial Sequence: Synthetic polypeptide
DEEEIRTTNPVATEQYGCVCSNTGEDQEHFGSDQE

SEQ ID NO: 134956 - protein, 33 aa, Artificial Sequence
  Description of Artificial Sequence: Synthetic polypeptide
TEEEIRTTNPVAYEQYGTISCHQNEFSHRTENR

SEQ ID NO: 134957 - protein, 35 aa, Artificial Sequence
  Description of Artificial Sequence: Synthetic polypeptide
DEEEIRTTNPVATEQYGCVCSNTGEDQEFFGSDQS

SEQ ID NO: 134958 - protein, 35 aa, Artificial Sequence
  Description of Artificial Sequence: Synthetic polypeptide
DEEEIRTTNPVATEQYGCVCSNTGEDQEFFGSDQA

SEQ ID NO: 134959 - protein, 32 aa, Artificial Sequence
  Description of Artificial Sequence: Synthetic polypeptide
AEEEIATTNPVATESYGCIIAGNNLQDDGGNH

SEQ ID NO: 134960 - protein, 36 aa, Artificial Sequence
  Description of Artificial Sequence: Synthetic polypeptide
DEEEIRTTNPVATEQYGCVCSNTGEDNQNFGSENQS

SEQ ID NO: 134961 - protein, 30 aa, Artificial Sequence
  Description of Artificial Sequence: Synthetic polypeptide
AEEEIATTNPVATEQYGVVAVEVEEQGEET

SEQ ID NO: 134962 - protein, 32 aa, Artificial Sequence
  Description of Artificial Sequence: Synthetic polypeptide
AEEEIATTNPVAYEQYGTVSANLEERIIIEEA

SEQ ID NO: 134963 - protein, 30 aa, Artificial Sequence
  Description of Artificial Sequence: Synthetic polypeptide
AEEEIATTNPVATEQYGVVAVEAVEQNEEE

SEQ ID NO: 134964 - protein, 31 aa, Artificial Sequence
  Description of Artificial Sequence: Synthetic polypeptide
AEEEIATTNPVATEQYGVVATVEVEQQEEDT

SEQ ID NO: 134965 - protein, 34 aa, Artificial Sequence
  Description of Artificial Sequence: Synthetic polypeptide
DEEEIRTTNPVATEQYGCVCSNTEHEHFGSETQP

SEQ ID NO: 134966 - protein, 34 aa, Artificial Sequence
  Description of Artificial Sequence: Synthetic polypeptide
DEEEIRTTNPVATEQYGCVCSNTEHAFFNSDTQM

SEQ ID NO: 134967 - protein, 33 aa, Artificial Sequence
  Description of Artificial Sequence: Synthetic polypeptide
DEEEIRTTNPVATEQYGCVCSNTEHAFFISEQP

SEQ ID NO: 134968 - protein, 34 aa, Artificial Sequence
  Description of Artificial Sequence: Synthetic polypeptide
DEEEIRTTNPVATEQYGCVCSNTEHAENFGSDQS

SEQ ID NO: 134969 - protein, 35 aa, Artificial Sequence
  Description of Artificial Sequence: Synthetic polypeptide
DEEEIRTTNPVATEQYGCVCSNTEEPNQNFNSNQS

SEQ ID NO: 134970 - protein, 35 aa, Artificial Sequence
  Description of Artificial Sequence: Synthetic polypeptide
DEEEIRTTNPVATEQYGCVCSNTEEHSQNFGSDQA

SEQ ID NO: 134971 - protein, 35 aa, Artificial Sequence
  Description of Artificial Sequence: Synthetic polypeptide
DEEEIRTTNPVATEQYGCVCSNTEEHQEYFGSDQV

SEQ ID NO: 134972 - protein, 32 aa, Artificial Sequence
  Description of Artificial Sequence: Synthetic polypeptide
TEEGICTTNPVAYEQWGSVSCMNMSQDGGLNS

SEQ ID NO: 134973 - protein, 35 aa, Artificial Sequence
  Description of Artificial Sequence: Synthetic polypeptide
DEEEIRTTNPVATEQYGCVCSNTEEHQENFGSDQS

SEQ ID NO: 134974 - protein, 33 aa, Artificial Sequence
  Description of Artificial Sequence: Synthetic polypeptide
TEEGIATTNPVAYEQYGSVSCDNMSNRGGNNAP

SEQ ID NO: 134975 - protein, 33 aa, Artificial Sequence
  Description of Artificial Sequence: Synthetic polypeptide
TEEGICTTNPVAYEQYGSVSCLNMSNRGGANAF

SEQ ID NO: 134976 - protein, 31 aa, Artificial Sequence
  Description of Artificial Sequence: Synthetic polypeptide
TEEGIRTTNPCATEQYGSVPLVPMPLSVVNQ

SEQ ID NO: 134977 - protein, 32 aa, Artificial Sequence
  Description of Artificial Sequence: Synthetic polypeptide
TEEGIRTTNPCATEQYGSVPSVPPLMSVVNNQ

SEQ ID NO: 134978 - protein, 35 aa, Artificial Sequence
  Description of Artificial Sequence: Synthetic polypeptide
DEEEIRTTNPVATEQYGCVCSNTEEHNQSFGSEQG

SEQ ID NO: 134979 - protein, 36 aa, Artificial Sequence
  Description of Artificial Sequence: Synthetic polypeptide
DEEEIRTTNPVATEQYGCVCSNTEEHNQNFGSNFQP

SEQ ID NO: 134980 - protein, 35 aa, Artificial Sequence
  Description of Artificial Sequence: Synthetic polypeptide
DEEEIRTTNPVATEQYGCVCSNTEEHNQHFNSQQY

SEQ ID NO: 134981 - protein, 29 aa, Artificial Sequence
  Description of Artificial Sequence: Synthetic peptide
AEEEIATTNPVATEQYGEYPWVDQHNEQA

SEQ ID NO: 134982 - protein, 36 aa, Artificial Sequence
  Description of Artificial Sequence: Synthetic polypeptide
DEEEIRTTNPVATEQYGCVCSNTEEHNENFGSQNQS

SEQ ID NO: 134983 - protein, 35 aa, Artificial Sequence
  Description of Artificial Sequence: Synthetic polypeptide
DEEEIRTTNPVATEQYGCVCSNTEEHNAFFGSEQP

SEQ ID NO: 134984 - protein, 34 aa, Artificial Sequence
  Description of Artificial Sequence: Synthetic polypeptide
DEEEISTTNPVATEGYGQCVCSNTELQNFGSEQA

SEQ ID NO: 134985 - protein, 35 aa, Artificial Sequence
  Description of Artificial Sequence: Synthetic polypeptide
DEEEIRTTNPVATEQYGCVCSNTEEHNQYFGSDQA

SEQ ID NO: 134986 - protein, 35 aa, Artificial Sequence
  Description of Artificial Sequence: Synthetic polypeptide
DEEEIRTTNPVATEQYGCVCSNTEHIENFGSDNQS

SEQ ID NO: 134987 - protein, 35 aa, Artificial Sequence
  Description of Artificial Sequence: Synthetic polypeptide
DEEEIRTTNPVATEQYGCVCSNTEHNAEFFNSEQP

SEQ ID NO: 134988 - protein, 34 aa, Artificial Sequence
  Description of Artificial Sequence: Synthetic polypeptide
DEEEIRTTNPVATEQYGCVCSNTEHNINFNSEQF

SEQ ID NO: 134989 - protein, 35 aa, Artificial Sequence
  Description of Artificial Sequence: Synthetic polypeptide
DEEEIRTTNPVATEQYGCVCSNTENDHAFFNSNQP

SEQ ID NO: 134990 - protein, 34 aa, Artificial Sequence
  Description of Artificial Sequence: Synthetic polypeptide
DEEEIRTTNPVATEQYGCVCSNTEHQNFISDTQL

SEQ ID NO: 134991 - protein, 34 aa, Artificial Sequence
  Description of Artificial Sequence: Synthetic polypeptide
DEEEIRTTNPVATEQYGCVCSNTEHQNFISDFQP

SEQ ID NO: 134992 - protein, 35 aa, Artificial Sequence
  Description of Artificial Sequence: Synthetic polypeptide
DEEEIRTTNPVATEQYGCVCSNTEHQENFGSQFIP

SEQ ID NO: 134993 - protein, 35 aa, Artificial Sequence
  Description of Artificial Sequence: Synthetic polypeptide
DEEEIRTTNPVATEQYGCVCSNTEHNQNFLSENQS

SEQ ID NO: 134994 - protein, 33 aa, Artificial Sequence
  Description of Artificial Sequence: Synthetic polypeptide
TEEEIVTTNPVAYEAYGSVVNTAMVQRGGNNLQ

SEQ ID NO: 134995 - protein, 31 aa, Artificial Sequence
  Description of Artificial Sequence: Synthetic polypeptide
TEEEIWTTNPVATSRYGCVYATVLLDQGGQG

SEQ ID NO: 134996 - protein, 35 aa, Artificial Sequence
  Description of Artificial Sequence: Synthetic polypeptide
DEEEIRTTNPVATEQYGCVCSNTEHNQNFGSDTQP

SEQ ID NO: 134997 - protein, 33 aa, Artificial Sequence
  Description of Artificial Sequence: Synthetic polypeptide
TEEELRTTNPVATSMYGSVYATVNPLDQGGRGQ

SEQ ID NO: 134998 - protein, 32 aa, Artificial Sequence
  Description of Artificial Sequence: Synthetic polypeptide
TEEETNRTTNTVATESQGSSVSEWNLTQANNV

SEQ ID NO: 134999 - protein, 32 aa, Artificial Sequence
  Description of Artificial Sequence: Synthetic polypeptide
TEEETRTTNPMATEFYNYGAVEFTNLQQNNKS

SEQ ID NO: 135000 - protein, 32 aa, Artificial Sequence
  Description of Artificial Sequence: Synthetic polypeptide
TEEETRTTNPQATEFYWYGAVMFTNLQQNNNW

SEQ ID NO: 135001 - protein, 34 aa, Artificial Sequence
  Description of Artificial Sequence: Synthetic polypeptide
TEEETRTTNPVATREWYGYAVGSTTNEGQRMERE

SEQ ID NO: 135002 - protein, 35 aa, Artificial Sequence
  Description of Artificial Sequence: Synthetic polypeptide
AEEEIATTNPVATEQYGSVCSGQIDHNQMNGDNDR

SEQ ID NO: 135003 - protein, 35 aa, Artificial Sequence
  Description of Artificial Sequence: Synthetic polypeptide
DEEEIRTTNPVATEQYGCVCSNTEHNQGFGSEPQG

SEQ ID NO: 135004 - protein, 35 aa, Artificial Sequence
  Description of Artificial Sequence: Synthetic polypeptide
DEEEIRTTNPVATEQYGCVCSNTEHNQFFNSDTQG

SEQ ID NO: 135005 - protein, 35 aa, Artificial Sequence
  Description of Artificial Sequence: Synthetic polypeptide
DEEEIRTTNPVATEQYGCVCSNTEHNQEYFNSEQT

SEQ ID NO: 135006 - protein, 35 aa, Artificial Sequence
  Description of Artificial Sequence: Synthetic polypeptide
DEEEIRTTNPVATEQYGCVCSNTEHNQEYFGSEQT

SEQ ID NO: 135007 - protein, 35 aa, Artificial Sequence
  Description of Artificial Sequence: Synthetic polypeptide
DEEEIRTTNPVATEQYGCVCSNTEHNQEYFGSEQP

SEQ ID NO: 135008 - protein, 35 aa, Artificial Sequence
  Description of Artificial Sequence: Synthetic polypeptide
DEEEIRTTNPVATEQYGCVCSNTEHNQENFGSQQS

SEQ ID NO: 135009 - protein, 35 aa, Artificial Sequence
  Description of Artificial Sequence: Synthetic polypeptide
DEEEIRTTNPVATEQYGCVCSNTEHNQENFGSDQE

SEQ ID NO: 135010 - protein, 31 aa, Artificial Sequence
  Description of Artificial Sequence: Synthetic polypeptide
AEEEIATTNPVATEQYGVVATVEVQEQDEET

SEQ ID NO: 135011 - protein, 35 aa, Artificial Sequence
  Description of Artificial Sequence: Synthetic polypeptide
DEEEIRTTNPVATEQYGCVCSNTEEHAFFGSNNQP

SEQ ID NO: 135012 - protein, 36 aa, Artificial Sequence
  Description of Artificial Sequence: Synthetic polypeptide
DEEEIRTTNPVATEQYGCVCSNTGEHNQENGNSNQS

SEQ ID NO: 135013 - protein, 35 aa, Artificial Sequence
  Description of Artificial Sequence: Synthetic polypeptide
DEEEIRTTNPVATEQYGCVCSNTGEHNQGFNSDQG

SEQ ID NO: 135014 - protein, 31 aa, Artificial Sequence
  Description of Artificial Sequence: Synthetic polypeptide
TEEEIRTTNPVATSRYGCVGATMAFDQGGQG

SEQ ID NO: 135015 - protein, 32 aa, Artificial Sequence
  Description of Artificial Sequence: Synthetic polypeptide
TEEEIRTTNPVATSRYGCVGATVALDQGGATG

SEQ ID NO: 135016 - protein, 31 aa, Artificial Sequence
  Description of Artificial Sequence: Synthetic polypeptide
TEEEIRTTNPVATSRYGCVGNTVALDQGVQG

SEQ ID NO: 135017 - protein, 31 aa, Artificial Sequence
  Description of Artificial Sequence: Synthetic polypeptide
TEEEIRTTNPVATSRYGCVGPTVALDLGGQG

SEQ ID NO: 135018 - protein, 34 aa, Artificial Sequence
  Description of Artificial Sequence: Synthetic polypeptide
DEEEISTTNPVATEQYGCVCSMSEALQNFGSEQS

SEQ ID NO: 135019 - protein, 32 aa, Artificial Sequence
  Description of Artificial Sequence: Synthetic polypeptide
TEEEIRTTNPVATSRYGCVVATVALDQGGGQE

SEQ ID NO: 135020 - protein, 31 aa, Artificial Sequence
  Description of Artificial Sequence: Synthetic polypeptide
TEEEIRTTNPVATSRYGCVVATWAHDQGGQG

SEQ ID NO: 135021 - protein, 31 aa, Artificial Sequence
  Description of Artificial Sequence: Synthetic polypeptide
TEEEIRTTNPVATSRYGCVYATVALDALGQG

SEQ ID NO: 135022 - protein, 32 aa, Artificial Sequence
  Description of Artificial Sequence: Synthetic polypeptide
TEEEIRTTNPVATSRYGCVYATVALDQGGQEV

SEQ ID NO: 135023 - protein, 32 aa, Artificial Sequence
  Description of Artificial Sequence: Synthetic polypeptide
TEEEIRTTNPVATSRYGCVDATVALDQNGGQG

SEQ ID NO: 135024 - protein, 32 aa, Artificial Sequence
  Description of Artificial Sequence: Synthetic polypeptide
TEEEIRTTNPVATSRYGCVYATVFLDQGGEQG

SEQ ID NO: 135025 - protein, 32 aa, Artificial Sequence
  Description of Artificial Sequence: Synthetic polypeptide
TEEEIRTTNPVATSRYGKCVYPTVALDQGGQG

SEQ ID NO: 135026 - protein, 32 aa, Artificial Sequence
  Description of Artificial Sequence: Synthetic polypeptide
TEEEIRTTNPVATSRYGYVVATVALDQHGGQG

SEQ ID NO: 135027 - protein, 35 aa, Artificial Sequence
  Description of Artificial Sequence: Synthetic polypeptide
TEEEIRTTNPVAWEQYGKVPSCINELSTLNGANRA

SEQ ID NO: 135028 - protein, 32 aa, Artificial Sequence
  Description of Artificial Sequence: Synthetic polypeptide
TEEEIRTTNPVAYEAWGSVVNTAMVQRLNNLK

SEQ ID NO: 135029 - protein, 34 aa, Artificial Sequence
  Description of Artificial Sequence: Synthetic polypeptide
DEEEISTTNPVATEQYGCVCSDTNHAENFGSEQA

SEQ ID NO: 135030 - protein, 36 aa, Artificial Sequence
  Description of Artificial Sequence: Synthetic polypeptide
DEEEIRTTNPVATEQYGCVCSNTGNHNQENFGSEQS

SEQ ID NO: 135031 - protein, 34 aa, Artificial Sequence
  Description of Artificial Sequence: Synthetic polypeptide
DEEEISTTNPVATEQYGCVCSDTEHANFISDNQS

SEQ ID NO: 135032 - protein, 34 aa, Artificial Sequence
  Description of Artificial Sequence: Synthetic polypeptide
DEEEIRTTNPVATEQYGCVCSNTGETQNFISDQD

SEQ ID NO: 135033 - protein, 35 aa, Artificial Sequence
  Description of Artificial Sequence: Synthetic polypeptide
DEEEIRTTNPVATEQYGCVCSNTGETQEYFGSDQA

SEQ ID NO: 135034 - protein, 31 aa, Artificial Sequence
  Description of Artificial Sequence: Synthetic polypeptide
TEEEIRTTNPVATSRYGDVGATVALDQGMQG

SEQ ID NO: 135035 - protein, 32 aa, Artificial Sequence
  Description of Artificial Sequence: Synthetic polypeptide
TEEEIRTTNPVATSRYGACVGATVSLDQGGQG

SEQ ID NO: 135036 - protein, 34 aa, Artificial Sequence
  Description of Artificial Sequence: Synthetic polypeptide
DEEEIRTTNPVATEQYGCVCSNTGYHAFFNSDQP

SEQ ID NO: 135037 - protein, 35 aa, Artificial Sequence
  Description of Artificial Sequence: Synthetic polypeptide
DEEEIRTTNPVATEQYGCVCSNTGYHNQGFGSEQA

SEQ ID NO: 135038 - protein, 32 aa, Artificial Sequence
  Description of Artificial Sequence: Synthetic polypeptide
TEEEIRTTNPVATSMWGKVYATVNLDQGGDGQ

SEQ ID NO: 135039 - protein, 33 aa, Artificial Sequence
  Description of Artificial Sequence: Synthetic polypeptide
TEEEIRTTNPVATSMWGSVCATVNPLDQGGRGQ

SEQ ID NO: 135040 - protein, 33 aa, Artificial Sequence
  Description of Artificial Sequence: Synthetic polypeptide
TEEEIRTTNPVATSMWGSVYATVNLDQGMGRGQ

SEQ ID NO: 135041 - protein, 32 aa, Artificial Sequence
  Description of Artificial Sequence: Synthetic polypeptide
TEEEIRTTNPVATSMYGCVCEATVALDQGGRG

SEQ ID NO: 135042 - protein, 32 aa, Artificial Sequence
  Description of Artificial Sequence: Synthetic polypeptide
TEEEIRTTNPVATSMYGCVMATVALDQGGRAG

SEQ ID NO: 135043 - protein, 35 aa, Artificial Sequence
  Description of Artificial Sequence: Synthetic polypeptide
DEEEIRTTNPVATEQYGCVCSNTMEDQENFNSEQS

SEQ ID NO: 135044 - protein, 32 aa, Artificial Sequence
  Description of Artificial Sequence: Synthetic polypeptide
TEEEIRTTNPVATSMYGCVYAGVNLDQGGRDG

SEQ ID NO: 135045 - protein, 32 aa, Artificial Sequence
  Description of Artificial Sequence: Synthetic polypeptide
DEAAIRTTNPVATEQYGCFCSTEHNIGGSNQS

SEQ ID NO: 135046 - protein, 32 aa, Artificial Sequence
  Description of Artificial Sequence: Synthetic polypeptide
TEEEIRTTNPVATSMYGCVYATCALDQGGQPG

SEQ ID NO: 135047 - protein, 32 aa, Artificial Sequence
  Description of Artificial Sequence: Synthetic polypeptide
TEEEIRTTNPVATSMYGCVYATPALDQGGRGY

SEQ ID NO: 135048 - protein, 35 aa, Artificial Sequence
  Description of Artificial Sequence: Synthetic polypeptide
DEEEISTTNPVATEQYGCVCSMTEHNTNFGSDNQS

SEQ ID NO: 135049 - protein, 32 aa, Artificial Sequence
  Description of Artificial Sequence: Synthetic polypeptide
TEEEIRTTNPVATSMYGCVYATVALLDQGGWG

SEQ ID NO: 135050 - protein, 32 aa, Artificial Sequence
  Description of Artificial Sequence: Synthetic polypeptide
TEEEIRTTNPVATSMYGCVYATVALSQGGRGT

SEQ ID NO: 135051 - protein, 31 aa, Artificial Sequence
  Description of Artificial Sequence: Synthetic polypeptide
TEEEIRTTNPVATSMYGCVYATVAWDQGGQC

SEQ ID NO: 135052 - protein, 33 aa, Artificial Sequence
  Description of Artificial Sequence: Synthetic polypeptide
TEEEIRTTNPVATSMYGCVYATVNLDQGAGRGV

SEQ ID NO: 135053 - protein, 32 aa, Artificial Sequence
  Description of Artificial Sequence: Synthetic polypeptide
TEEEIRTTNPVATSMYGEVYATVAGLDQGGRG

SEQ ID NO: 135054 - protein, 34 aa, Artificial Sequence
  Description of Artificial Sequence: Synthetic polypeptide
DEEEISTTNPVATEQYGCVCSMTEDQGFNSDTQM

SEQ ID NO: 135055 - protein, 32 aa, Artificial Sequence
  Description of Artificial Sequence: Synthetic polypeptide
TEEEIRTTNPVATSMYGGCVIATVALDQGGRG

SEQ ID NO: 135056 - protein, 35 aa, Artificial Sequence
  Description of Artificial Sequence: Synthetic polypeptide
DEEEIRTTNPVATEQYGCVCSNTGYHQHFNSDTQY

SEQ ID NO: 135057 - protein, 34 aa, Artificial Sequence
  Description of Artificial Sequence: Synthetic polypeptide
DEEEISTTNPVATEQYGCVCSMSGNHQNFNSDTQ

SEQ ID NO: 135058 - protein, 35 aa, Artificial Sequence
  Description of Artificial Sequence: Synthetic polypeptide
DEEEIRTTNPVATEQYGCVCSNTGYHQENFNSDQN

SEQ ID NO: 135059 - protein, 36 aa, Artificial Sequence
  Description of Artificial Sequence: Synthetic polypeptide
DEEEIRTTNPVATEQYGCVCSNTGETQENFGSNNQL

SEQ ID NO: 135060 - protein, 36 aa, Artificial Sequence
  Description of Artificial Sequence: Synthetic polypeptide
DEEEIRTTNPVATEQYGCVCSNTGEHNQGFGSDNQG

SEQ ID NO: 135061 - protein, 34 aa, Artificial Sequence
  Description of Artificial Sequence: Synthetic polypeptide
TEEEIRTTNPVAYEAYGSVVCNTAPVQRGGNNLD

SEQ ID NO: 135062 - protein, 33 aa, Artificial Sequence
  Description of Artificial Sequence: Synthetic polypeptide
TEEEIRTTNPVAYEAYGSVVNTAMVARGGNNVD

SEQ ID NO: 135063 - protein, 31 aa, Artificial Sequence
  Description of Artificial Sequence: Synthetic polypeptide
AEEEICTTNPVATEQYGVVATTEVEQEEEDG

SEQ ID NO: 135064 - protein, 32 aa, Artificial Sequence
  Description of Artificial Sequence: Synthetic polypeptide
AEEEICTTNPVATEQYGVVATEVQEQNEQEED

SEQ ID NO: 135065 - protein, 35 aa, Artificial Sequence
  Description of Artificial Sequence: Synthetic polypeptide
DEEEIRTTNPVAYEQYGICVAGCTNLSGKGGDSRY

SEQ ID NO: 135066 - protein, 32 aa, Artificial Sequence
  Description of Artificial Sequence: Synthetic polypeptide
AEEEICTTNPVATEQYGVVATEVQEQGEETED

SEQ ID NO: 135067 - protein, 35 aa, Artificial Sequence
  Description of Artificial Sequence: Synthetic polypeptide
DEEEIRTTNPVATEQYGCVCSNTGEHQNFNSNFIP

SEQ ID NO: 135068 - protein, 34 aa, Artificial Sequence
  Description of Artificial Sequence: Synthetic polypeptide
TEEEIRTTNPVAYEQWGCYVWSQIDDHLQRGHDR

SEQ ID NO: 135069 - protein, 33 aa, Artificial Sequence
  Description of Artificial Sequence: Synthetic polypeptide
DEEEISTTNPVATEQYGCVCGTEDQNFNSETQP

SEQ ID NO: 135070 - protein, 32 aa, Artificial Sequence
  Description of Artificial Sequence: Synthetic polypeptide
DEEEISTTNPVATEQYGCVCGSEHQNFGSDQA

SEQ ID NO: 135071 - protein, 35 aa, Artificial Sequence
  Description of Artificial Sequence: Synthetic polypeptide
DEEEIRTTNPVATEQYGCVCSNTGEHQHFISENQS

SEQ ID NO: 135072 - protein, 31 aa, Artificial Sequence
  Description of Artificial Sequence: Synthetic polypeptide
AEEEICTTNPVATEQYGVVATTEVEQEEEED

SEQ ID NO: 135073 - protein, 31 aa, Artificial Sequence
  Description of Artificial Sequence: Synthetic polypeptide
AEEEICTTNPVATEQYGVVATEVENQTEEED

SEQ ID NO: 135074 - protein, 35 aa, Artificial Sequence
  Description of Artificial Sequence: Synthetic polypeptide
DEEEIRTTNPVATEQYGCVCSNTGEHQEFFNSDQE

SEQ ID NO: 135075 - protein, 32 aa, Artificial Sequence
  Description of Artificial Sequence: Synthetic polypeptide
AEEEICTTNPVATEQYGVVATEQQNEQEEEED

SEQ ID NO: 135076 - protein, 35 aa, Artificial Sequence
  Description of Artificial Sequence: Synthetic polypeptide
DEEEIRTTNPVATEQYGCVCSNTGEHNQYFGSDQS

SEQ ID NO: 135077 - protein, 34 aa, Artificial Sequence
  Description of Artificial Sequence: Synthetic polypeptide
TEEEIRTTNPVAYEQYGIQVVNTAMVSQRTGNLK

SEQ ID NO: 135078 - protein, 31 aa, Artificial Sequence
  Description of Artificial Sequence: Synthetic polypeptide
AEEEICTTNPVATEQYGVVATDEVEEQEEED

SEQ ID NO: 135079 - protein, 31 aa, Artificial Sequence
  Description of Artificial Sequence: Synthetic polypeptide
AEEEICTTNPVATEQYGVVATAEVEQEEEED

SEQ ID NO: 135080 - protein, 35 aa, Artificial Sequence
  Description of Artificial Sequence: Synthetic polypeptide
DEEEIRTTNPVATEQYGCVCSNTGEHNQNFGSIQS

SEQ ID NO: 135081 - protein, 35 aa, Artificial Sequence
  Description of Artificial Sequence: Synthetic polypeptide
DEEEIRTTNPVATEQYGCVCSNTGEHNQNFGSDQA

SEQ ID NO: 135082 - protein, 35 aa, Artificial Sequence
  Description of Artificial Sequence: Synthetic polypeptide
DEEEIRTTNPVATEQYGCVCSNTGEHNQHFGSDQG

SEQ ID NO: 135083 - protein, 31 aa, Artificial Sequence
  Description of Artificial Sequence: Synthetic polypeptide
AEEEICTTNPVATEQYGVVATEQVEQEEEDT

SEQ ID NO: 135084 - protein, 35 aa, Artificial Sequence
  Description of Artificial Sequence: Synthetic polypeptide
DEEEIRTTNPVATEQYGCVCSNTGEHQNSISDNQS

SEQ ID NO: 135085 - protein, 32 aa, Artificial Sequence
  Description of Artificial Sequence: Synthetic polypeptide
AEEEICTTNPVATEQYGVVATVENVEQDEEEE

SEQ ID NO: 135086 - protein, 35 aa, Artificial Sequence
  Description of Artificial Sequence: Synthetic polypeptide
DEEEIRTTNPVATEQYGCVCSNTGEHQYFGSETQS

SEQ ID NO: 135087 - protein, 34 aa, Artificial Sequence
  Description of Artificial Sequence: Synthetic polypeptide
TEEEIRTTNPVAYEAYGSVVNTAMVDQRGGNNLI

SEQ ID NO: 135088 - protein, 32 aa, Artificial Sequence
  Description of Artificial Sequence: Synthetic polypeptide
TEEEIRTTNPVAYEAYGSVVNTAMVDTGNNLK

SEQ ID NO: 135089 - protein, 33 aa, Artificial Sequence
  Description of Artificial Sequence: Synthetic polypeptide
TEEEIRTTNPVAYEAYGSVVNTAMVNRGTNNLD

SEQ ID NO: 135090 - protein, 33 aa, Artificial Sequence
  Description of Artificial Sequence: Synthetic polypeptide
DEEEISTTNPVATEQYGCVCQWELQNFNSENQP

SEQ ID NO: 135091 - protein, 33 aa, Artificial Sequence
  Description of Artificial Sequence: Synthetic polypeptide
TEEEIRTTNPVAYEAYGSVVNTAMVQERSNNLK

SEQ ID NO: 135092 - protein, 34 aa, Artificial Sequence
  Description of Artificial Sequence: Synthetic polypeptide
TEEEIRTTNPVAYEAYGSVVNTAWVAQRGGNNLD

SEQ ID NO: 135093 - protein, 34 aa, Artificial Sequence
  Description of Artificial Sequence: Synthetic polypeptide
TEEEIRTTNPVAYEAYGSVVNTFAMVQRGGNNLT

SEQ ID NO: 135094 - protein, 34 aa, Artificial Sequence
  Description of Artificial Sequence: Synthetic polypeptide
TEEEIRTTNPVAYEAYGSVVNTPAMDAQRGNNLK

SEQ ID NO: 135095 - protein, 34 aa, Artificial Sequence
  Description of Artificial Sequence: Synthetic polypeptide
TEEEIRTTNPVAYEAYGSVVNYTPAMVQRGNNQK

SEQ ID NO: 135096 - protein, 34 aa, Artificial Sequence
  Description of Artificial Sequence: Synthetic polypeptide
TEEEIRTTNPVAYEAYGSVVPNTPAMVQRGNNDK

SEQ ID NO: 135097 - protein, 36 aa, Artificial Sequence
  Description of Artificial Sequence: Synthetic polypeptide
DEEEIRTTNPVATEQYGCVCSNTGEPNQNFGSDNQS

SEQ ID NO: 135098 - protein, 34 aa, Artificial Sequence
  Description of Artificial Sequence: Synthetic polypeptide
DEEEIRTTNPVATEQYGCVCSNTGENQNFPSEQL

SEQ ID NO: 135099 - protein, 35 aa, Artificial Sequence
  Description of Artificial Sequence: Synthetic polypeptide
DEEEIRTTNPVATEQYGCVCSNTGELQESFISEQE

SEQ ID NO: 135100 - protein, 36 aa, Artificial Sequence
  Description of Artificial Sequence: Synthetic polypeptide
DEEEIRTTNPVATEQYGCVCSNTGELQENFNSEPQS

SEQ ID NO: 135101 - protein, 31 aa, Artificial Sequence
  Description of Artificial Sequence: Synthetic polypeptide
AEEEICTTNPVATEQYGVVATVEVEQEETED

SEQ ID NO: 135102 - protein, 31 aa, Artificial Sequence
  Description of Artificial Sequence: Synthetic polypeptide
AEEEICTTNPVATEQYGVVATVEVEQEEEAE

SEQ ID NO: 135103 - protein, 36 aa, Artificial Sequence
  Description of Artificial Sequence: Synthetic polypeptide
DEEEIRTTNPVATEQYGCVCSNTGELNQNFNSDNQA

SEQ ID NO: 135104 - protein, 36 aa, Artificial Sequence
  Description of Artificial Sequence: Synthetic polypeptide
DEEEIRTTNPVATEQYGCVCSNTGELNQNFGSETQP

SEQ ID NO: 135105 - protein, 32 aa, Artificial Sequence
  Description of Artificial Sequence: Synthetic polypeptide
AEEEICTTNPVATEQYGVVATVEQVEQGEEDE

SEQ ID NO: 135106 - protein, 34 aa, Artificial Sequence
  Description of Artificial Sequence: Synthetic polypeptide
DEEEISTTNPVATEQYGCVCPNWGELQNFGSDQS

SEQ ID NO: 135107 - protein, 35 aa, Artificial Sequence
  Description of Artificial Sequence: Synthetic polypeptide
DEEEIRTTNPVATEQYGCVCSNTGELAEFFGSDQE

SEQ ID NO: 135108 - protein, 35 aa, Artificial Sequence
  Description of Artificial Sequence: Synthetic polypeptide
DEEEIRTTNPVATEQYGCVCSNTGEPQEYFGSDQS

SEQ ID NO: 135109 - protein, 34 aa, Artificial Sequence
  Description of Artificial Sequence: Synthetic polypeptide
TQEEISTTNPVAYEQYGSTVACTNLEQYHPGMTR

SEQ ID NO: 135110 - protein, 35 aa, Artificial Sequence
  Description of Artificial Sequence: Synthetic polypeptide
DEEEIRTTNPVATEQYGCVCSNTEEDTSFGSENQE

SEQ ID NO: 135111 - protein, 36 aa, Artificial Sequence
  Description of Artificial Sequence: Synthetic polypeptide
DEEEIRTTNPVATEQYGCVCSNTEEDQESFGSNNQS

SEQ ID NO: 135112 - protein, 31 aa, Artificial Sequence
  Description of Artificial Sequence: Synthetic polypeptide
TESEIATTNPVATECYGKVPSECLSQHEGES

SEQ ID NO: 135113 - protein, 30 aa, Artificial Sequence
  Description of Artificial Sequence: Synthetic polypeptide
TESEIATTNPVATECYGKVSECMLSQHEEL

SEQ ID NO: 135114 - protein, 28 aa, Artificial Sequence
  Description of Artificial Sequence: Synthetic peptide
DDSEVAPTNPCSTEQYGNVANTIQRGTR

SEQ ID NO: 135115 - protein, 33 aa, Artificial Sequence
  Description of Artificial Sequence: Synthetic polypeptide
TESEIATTNPVAYDHYGSIVSYTNELSQRVLNK

SEQ ID NO: 135116 - protein, 34 aa, Artificial Sequence
  Description of Artificial Sequence: Synthetic polypeptide
DEEEIRTTNPVATEQYGCVCSNSEHNQNFNSDQA

SEQ ID NO: 135117 - protein, 34 aa, Artificial Sequence
  Description of Artificial Sequence: Synthetic polypeptide
DEEEIRTTNPVATEQYGCVCSNSEHNQHFNSNQS

SEQ ID NO: 135118 - protein, 32 aa, Artificial Sequence
  Description of Artificial Sequence: Synthetic polypeptide
TESEIRCTNPIAYEQYGSVVSENAHSMRGGNK

SEQ ID NO: 135119 - protein, 34 aa, Artificial Sequence
  Description of Artificial Sequence: Synthetic polypeptide
AEEEIATTNPVATECYGSVCAGTNPLQDSNPQDN

SEQ ID NO: 135120 - protein, 33 aa, Artificial Sequence
  Description of Artificial Sequence: Synthetic polypeptide
TESEIRTTNAVATECWGSVSCINEPQDREGENG

SEQ ID NO: 135121 - protein, 31 aa, Artificial Sequence
  Description of Artificial Sequence: Synthetic polypeptide
TESEIATTNPVATECYGKVASEGLSQHEGEL

SEQ ID NO: 135122 - protein, 33 aa, Artificial Sequence
  Description of Artificial Sequence: Synthetic polypeptide
TESEIRTTNPGATECWGSVSCINEPQDREGPNG

SEQ ID NO: 135123 - protein, 34 aa, Artificial Sequence
  Description of Artificial Sequence: Synthetic polypeptide
DEEEIRTTNPVATEQYGCVCSNSEHAEFFGSNQS

SEQ ID NO: 135124 - protein, 34 aa, Artificial Sequence
  Description of Artificial Sequence: Synthetic polypeptide
TESEIRTTNPVATEEYGSTVSETNLSDHVTNNDS

SEQ ID NO: 135125 - protein, 34 aa, Artificial Sequence
  Description of Artificial Sequence: Synthetic polypeptide
DEEEIRTTNPVATEQYGCVCSNSEEPQNFGSDQG

SEQ ID NO: 135126 - protein, 34 aa, Artificial Sequence
  Description of Artificial Sequence: Synthetic polypeptide
DEEEIRTTNPVATEQYGCVCSNSEEHQHFGSDQT

SEQ ID NO: 135127 - protein, 34 aa, Artificial Sequence
  Description of Artificial Sequence: Synthetic polypeptide
DEEEIRTTNPVATEQYGCVCSNSEEDQFFGSDQA

SEQ ID NO: 135128 - protein, 34 aa, Artificial Sequence
  Description of Artificial Sequence: Synthetic polypeptide
TESEIRTTNPVATEQYGSTVMSTNISDHVTNNDS

SEQ ID NO: 135129 - protein, 34 aa, Artificial Sequence
  Description of Artificial Sequence: Synthetic polypeptide
DEEEIRTTNPVATEQYGCVCSNSEDHNQNFGSEQ

SEQ ID NO: 135130 - protein, 33 aa, Artificial Sequence
  Description of Artificial Sequence: Synthetic polypeptide
DEEEIRTTNPVATEQYGCVCSNSEDENFGSDQS

SEQ ID NO: 135131 - protein, 35 aa, Artificial Sequence
  Description of Artificial Sequence: Synthetic polypeptide
DEEEIRTTNPVATEQYGCVCSMWGELQFFNSDTQS

SEQ ID NO: 135132 - protein, 33 aa, Artificial Sequence
  Description of Artificial Sequence: Synthetic polypeptide
AEEEIATTNPVATECYGCISCINLSTRPGGNTV

SEQ ID NO: 135133 - protein, 31 aa, Artificial Sequence
  Description of Artificial Sequence: Synthetic polypeptide
TESEIATTNPVATECYGDVSEGELSQHEGEL

SEQ ID NO: 135134 - protein, 35 aa, Artificial Sequence
  Description of Artificial Sequence: Synthetic polypeptide
DEEEIRTTNPVATEQYGCVCSNSEHQEFFGSENQD

SEQ ID NO: 135135 - protein, 30 aa, Artificial Sequence
  Description of Artificial Sequence: Synthetic polypeptide
TESEIASVNPVCYEQYGVVSINLSQSTGNQ

SEQ ID NO: 135136 - protein, 33 aa, Artificial Sequence
  Description of Artificial Sequence: Synthetic polypeptide
DEEEISTTNPVATEEYGCVCSMWEHQNFGSENQ

SEQ ID NO: 135137 - protein, 35 aa, Artificial Sequence
  Description of Artificial Sequence: Synthetic polypeptide
DEEEIRTTNPVATEQYGCVCSNSETNQENFGSEQT

SEQ ID NO: 135138 - protein, 34 aa, Artificial Sequence
  Description of Artificial Sequence: Synthetic polypeptide
DEEEIRTTNPVATEQYGCVCSNSEPQNFNSDNQS

SEQ ID NO: 135139 - protein, 30 aa, Artificial Sequence
  Description of Artificial Sequence: Synthetic polypeptide
DDSEVACTNPVSTEQYGNVAAETIQSRGNR

SEQ ID NO: 135140 - protein, 34 aa, Artificial Sequence
  Description of Artificial Sequence: Synthetic polypeptide
TEQEIATTNPVATEQYGSVSATLDLEQHEGEDTV

SEQ ID NO: 135141 - protein, 33 aa, Artificial Sequence
  Description of Artificial Sequence: Synthetic polypeptide
TEQEIATTNPVATEQYGSVSCTDLSEDHEGEDS

SEQ ID NO: 135142 - protein, 32 aa, Artificial Sequence
  Description of Artificial Sequence: Synthetic polypeptide
TEQEIATTNPVATEQYGYVSATDLEDHEGEDL

SEQ ID NO: 135143 - protein, 36 aa, Artificial Sequence
  Description of Artificial Sequence: Synthetic polypeptide
DEEEIRTTNPVAYEQYGKTVSCTNMFTQRTQDNELF

SEQ ID NO: 135144 - protein, 32 aa, Artificial Sequence
  Description of Artificial Sequence: Synthetic polypeptide
TEQEIATTNPVATNQYGSVSATDLEDHEGEDL

SEQ ID NO: 135145 - protein, 34 aa, Artificial Sequence
  Description of Artificial Sequence: Synthetic polypeptide
DEEEISTTNPVATEAYGSVCFITNASSFATGGKR

SEQ ID NO: 135146 - protein, 28 aa, Artificial Sequence
  Description of Artificial Sequence: Synthetic peptide
TEQEIATTNPVAYECWGDVSECLQHEET

SEQ ID NO: 135147 - protein, 34 aa, Artificial Sequence
  Description of Artificial Sequence: Synthetic polypeptide
TEQEIRTTNPVATEQYGSVASCTHMPSQGGGSDI

SEQ ID NO: 135148 - protein, 33 aa, Artificial Sequence
  Description of Artificial Sequence: Synthetic polypeptide
AEEEIATTNPVATEEYGEISCINLSTRPGGNNK

SEQ ID NO: 135149 - protein, 33 aa, Artificial Sequence
  Description of Artificial Sequence: Synthetic polypeptide
TESEIACTNPVATEQYGEASCENALSQRGGGQR

SEQ ID NO: 135150 - protein, 28 aa, Artificial Sequence
  Description of Artificial Sequence: Synthetic peptide
TESEIASTNPVGTECYGVATSTLQHGDI

SEQ ID NO: 135151 - protein, 30 aa, Artificial Sequence
  Description of Artificial Sequence: Synthetic polypeptide
TESEIASTNPVGTEGYGVIASTELQHGDNI

SEQ ID NO: 135152 - protein, 28 aa, Artificial Sequence
  Description of Artificial Sequence: Synthetic peptide
TESEIASTNPVGTEGYGVMASTLQHGDI

SEQ ID NO: 135153 - protein, 28 aa, Artificial Sequence
  Description of Artificial Sequence: Synthetic peptide
TESEIASTNPVGTEGYGVMASTLQHGDK

SEQ ID NO: 135154 - protein, 33 aa, Artificial Sequence
  Description of Artificial Sequence: Synthetic polypeptide
DEEEISTTNPVATCQYGCVCSTEEHQNFNSNQA

SEQ ID NO: 135155 - protein, 28 aa, Artificial Sequence
  Description of Artificial Sequence: Synthetic peptide
TESEIASTNPVGTEGYGVNASTLQHGDI

SEQ ID NO: 135156 - protein, 29 aa, Artificial Sequence
  Description of Artificial Sequence: Synthetic peptide
TESEIASTNPVGTEPYGVMASTALQHGDI

SEQ ID NO: 135157 - protein, 31 aa, Artificial Sequence
  Description of Artificial Sequence: Synthetic polypeptide
AEEEIASVNPVSTEQYGCVVCIDNLHQSGNQ

SEQ ID NO: 135158 - protein, 30 aa, Artificial Sequence
  Description of Artificial Sequence: Synthetic polypeptide
TEQEIACTNPVATEQYGCVATNPNANENGE

SEQ ID NO: 135159 - protein, 30 aa, Artificial Sequence
  Description of Artificial Sequence: Synthetic polypeptide
AEEEIASVNPVCTEQYGVVSWNHQSGSQQI

SEQ ID NO: 135160 - protein, 30 aa, Artificial Sequence
  Description of Artificial Sequence: Synthetic polypeptide
AEEEIASVNPVCTEQYGVVSWEHQESGSNQ

SEQ ID NO: 135161 - protein, 34 aa, Artificial Sequence
  Description of Artificial Sequence: Synthetic polypeptide
DEEEISTTNPCATEQYGCVCPTEDLQENFGSDNQ

SEQ ID NO: 135162 - protein, 31 aa, Artificial Sequence
  Description of Artificial Sequence: Synthetic polypeptide
AEEEIASVNPVCTEQYGCVVCSDNGHQSGNQ

SEQ ID NO: 135163 - protein, 35 aa, Artificial Sequence
  Description of Artificial Sequence: Synthetic polypeptide
DEEEIRTTNPVATEQYGCVCSMTGEPHQNFNSEQS

SEQ ID NO: 135164 - protein, 36 aa, Artificial Sequence
  Description of Artificial Sequence: Synthetic polypeptide
DEEEIRTTNPVATEQYGCVCSMTGELHNQNFGSEQS

SEQ ID NO: 135165 - protein, 33 aa, Artificial Sequence
  Description of Artificial Sequence: Synthetic polypeptide
TNNEIATTNPVAYEQWGSVSTTNLQGEMGGNED

SEQ ID NO: 135166 - protein, 35 aa, Artificial Sequence
  Description of Artificial Sequence: Synthetic polypeptide
DEEEIRTTNPVATEQYGCVCSMTGEHQYFISENQS

SEQ ID NO: 135167 - protein, 31 aa, Artificial Sequence
  Description of Artificial Sequence: Synthetic polypeptide
TQAEIRTTNPVAYEPYGCCASTVLSQHGGND

SEQ ID NO: 135168 - protein, 35 aa, Artificial Sequence
  Description of Artificial Sequence: Synthetic polypeptide
DEEEIRTTNPVATEQYGCVCSMTGEHQFFNSNFQS

SEQ ID NO: 135169 - protein, 33 aa, Artificial Sequence
  Description of Artificial Sequence: Synthetic polypeptide
TQEEICTTNPVAYEQYGSVCCTNESQYHPGMTR

SEQ ID NO: 135170 - protein, 34 aa, Artificial Sequence
  Description of Artificial Sequence: Synthetic polypeptide
TNEEISTTNPVATTQWGSVSKTWNPMEQQGGNGR

SEQ ID NO: 135171 - protein, 36 aa, Artificial Sequence
  Description of Artificial Sequence: Synthetic polypeptide
DEEEIRTTNPVATEQYGCVCSMTGEHQEYFGSDNQA

SEQ ID NO: 135172 - protein, 33 aa, Artificial Sequence
  Description of Artificial Sequence: Synthetic polypeptide
TQEEICTTNPVAYEQYGSVICTNLSQFHPGMTE

SEQ ID NO: 135173 - protein, 34 aa, Artificial Sequence
  Description of Artificial Sequence: Synthetic polypeptide
TQEEICTTNPVAYEQYGSVSVTTNLSDGKVGTRL

SEQ ID NO: 135174 - protein, 33 aa, Artificial Sequence
  Description of Artificial Sequence: Synthetic polypeptide
TQEEINTTNPVAYEPYGSTVACTNLSQYHPINR

SEQ ID NO: 135175 - protein, 36 aa, Artificial Sequence
  Description of Artificial Sequence: Synthetic polypeptide
DEEEIRTTNPVATEQYGCVCSMTGEHNQNFGSNTQS

SEQ ID NO: 135176 - protein, 33 aa, Artificial Sequence
  Description of Artificial Sequence: Synthetic polypeptide
TQEEINTTNPVAYEQWGSVICTNLSQSHPGMTR

SEQ ID NO: 135177 - protein, 35 aa, Artificial Sequence
  Description of Artificial Sequence: Synthetic polypeptide
DEEEIRTTNPVATEQYGCVCSMTGEHNQGFQSEQA

SEQ ID NO: 135178 - protein, 34 aa, Artificial Sequence
  Description of Artificial Sequence: Synthetic polypeptide
DEAAEIATTNPVAYEQWGSVSTNLNQGAMGGDMS

SEQ ID NO: 135179 - protein, 34 aa, Artificial Sequence
  Description of Artificial Sequence: Synthetic polypeptide
TQEEIRTTNPVAYEQYGSVSVLENLSDGKVGTRN

SEQ ID NO: 135180 - protein, 35 aa, Artificial Sequence
  Description of Artificial Sequence: Synthetic polypeptide
TQEEIRTTNPVAYEQYGSVSVTENSLSDHKVGTRL

SEQ ID NO: 135181 - protein, 33 aa, Artificial Sequence
  Description of Artificial Sequence: Synthetic polypeptide
TQEEICTTNPVAYEQYGSVICTALSQDHPGMTR

SEQ ID NO: 135182 - protein, 32 aa, Artificial Sequence
  Description of Artificial Sequence: Synthetic polypeptide
AEEEIASVNPVCTEQYGVVCSANLQSFGSNQS

SEQ ID NO: 135183 - protein, 33 aa, Artificial Sequence
  Description of Artificial Sequence: Synthetic polypeptide
DEEEISTTNPCATEQYGCVCPTELQENFISNNQ

SEQ ID NO: 135184 - protein, 34 aa, Artificial Sequence
  Description of Artificial Sequence: Synthetic polypeptide
DEEEISTTNPCATEQYGCVCPTELQEYFGSNTQM

SEQ ID NO: 135185 - protein, 32 aa, Artificial Sequence
  Description of Artificial Sequence: Synthetic polypeptide
TESGICTTNPVATEQYGSISTLTLSPELQNER

SEQ ID NO: 135186 - protein, 31 aa, Artificial Sequence
  Description of Artificial Sequence: Synthetic polypeptide
AEEEIASVNPVCTEQYGVVSSNLQSFGSQQF

SEQ ID NO: 135187 - protein, 33 aa, Artificial Sequence
  Description of Artificial Sequence: Synthetic polypeptide
TESYIRTTNPVATECWGSVSCINQPQDREGENG

SEQ ID NO: 135188 - protein, 36 aa, Artificial Sequence
  Description of Artificial Sequence: Synthetic polypeptide
TETEIRTTNPVATEQYGITVSTVNELSEDDPGTNRW

SEQ ID NO: 135189 - protein, 36 aa, Artificial Sequence
  Description of Artificial Sequence: Synthetic polypeptide
TETEIRTTNPVATEQYGITVSTVNELSPDAPGPNRW

SEQ ID NO: 135190 - protein, 35 aa, Artificial Sequence
  Description of Artificial Sequence: Synthetic polypeptide
TETEIRTTNPVATEQYGTVFTVNEASQDRPGDNES

SEQ ID NO: 135191 - protein, 35 aa, Artificial Sequence
  Description of Artificial Sequence: Synthetic polypeptide
TETEIRTTNPVATEQYGTVSTVAELSQDPPGDNES

SEQ ID NO: 135192 - protein, 36 aa, Artificial Sequence
  Description of Artificial Sequence: Synthetic polypeptide
DEEEIRTTNPVATEQYGCVCSMWGEDLQNFGSENQS

SEQ ID NO: 135193 - protein, 31 aa, Artificial Sequence
  Description of Artificial Sequence: Synthetic polypeptide
TEVEIATTNPVAYDQYGKVPSCTAASQRGVQ

SEQ ID NO: 135194 - protein, 34 aa, Artificial Sequence
  Description of Artificial Sequence: Synthetic polypeptide
TEWEISTTNPVATEGWGCSVFTDNMLQSSNGNNR

SEQ ID NO: 135195 - protein, 34 aa, Artificial Sequence
  Description of Artificial Sequence: Synthetic polypeptide
DEEEIRTTNPVATEQYGCVCSMWEHQEHFNSNAS

SEQ ID NO: 135196 - protein, 28 aa, Artificial Sequence
  Description of Artificial Sequence: Synthetic peptide
TGEEIATTNPVATEQYGEAPEVCQHEEK

SEQ ID NO: 135197 - protein, 34 aa, Artificial Sequence
  Description of Artificial Sequence: Synthetic polypeptide
DEEEIRTTNPVATEQYGCVCSMWEETQFFGSDQS

SEQ ID NO: 135198 - protein, 32 aa, Artificial Sequence
  Description of Artificial Sequence: Synthetic polypeptide
TGEEIATTNPVAYEQWGSVTHTLDQERGGTGR

SEQ ID NO: 135199 - protein, 31 aa, Artificial Sequence
  Description of Artificial Sequence: Synthetic polypeptide
AEEEIASVNPVCTEQYGVVCSWNHQESGNQA

SEQ ID NO: 135200 - protein, 33 aa, Artificial Sequence
  Description of Artificial Sequence: Synthetic polypeptide
TNEEIATTNPVAYEQWGGTVYTNLQGEHGENDR

SEQ ID NO: 135201 - protein, 34 aa, Artificial Sequence
  Description of Artificial Sequence: Synthetic polypeptide
DEEEISTTNPCATEQYGCVCPTNLQENFGSEGQA

SEQ ID NO: 135202 - protein, 32 aa, Artificial Sequence
  Description of Artificial Sequence: Synthetic polypeptide
TNEEIATTNPVAYEQWGTVYTNLQGEHGNDSG

SEQ ID NO: 135203 - protein, 35 aa, Artificial Sequence
  Description of Artificial Sequence: Synthetic polypeptide
DEEEIRTTNPVAYEQYGKVVSCWTGEWSNKGTNRM

SEQ ID NO: 135204 - protein, 34 aa, Artificial Sequence
  Description of Artificial Sequence: Synthetic polypeptide
DEEEISTTNPCATEQYGCVCPTNHQEHFGSNNQA

SEQ ID NO: 135205 - protein, 35 aa, Artificial Sequence
  Description of Artificial Sequence: Synthetic polypeptide
DEEEIRTTNPVAYEQYGKVVSCWTNEWSNKGTNEI

SEQ ID NO: 135206 - protein, 31 aa, Artificial Sequence
  Description of Artificial Sequence: Synthetic polypeptide
AEEEIASVNPVCTEQYGVVSWGELQSGSNQS

SEQ ID NO: 135207 - protein, 35 aa, Artificial Sequence
  Description of Artificial Sequence: Synthetic polypeptide
DEEEIRTTNPVATEQYGCVCSNTEEDQNFGSDFQP

SEQ ID NO: 135208 - protein, 31 aa, Artificial Sequence
  Description of Artificial Sequence: Synthetic polypeptide
TEPEIRTTNPVATSRYGNVYATVALDQGGQG

SEQ ID NO: 135209 - protein, 35 aa, Artificial Sequence
  Description of Artificial Sequence: Synthetic polypeptide
DEEEIRTTNPVAYEQYGKTVSCLTNAFTRTMDNEL

SEQ ID NO: 135210 - protein, 35 aa, Artificial Sequence
  Description of Artificial Sequence: Synthetic polypeptide
DEEEIRTTNPVATEQYGCVCSNTEDHNQFFGSDQA

SEQ ID NO: 135211 - protein, 33 aa, Artificial Sequence
  Description of Artificial Sequence: Synthetic polypeptide
TEEQIRTTNPVATEAYGKISTNLSDEEDGGNNE

SEQ ID NO: 135212 - protein, 34 aa, Artificial Sequence
  Description of Artificial Sequence: Synthetic polypeptide
AEEEIATTNPVATEQYGCVCSVTGELQGFGSDQA

SEQ ID NO: 135213 - protein, 33 aa, Artificial Sequence
  Description of Artificial Sequence: Synthetic polypeptide
TEEQIRTTNPVAYEAYGSVVNTAMVQRGGNNLN

SEQ ID NO: 135214 - protein, 32 aa, Artificial Sequence
  Description of Artificial Sequence: Synthetic polypeptide
TEEQIRTTNPVAYEQYGKTVATASVMVGNDRT

SEQ ID NO: 135215 - protein, 32 aa, Artificial Sequence
  Description of Artificial Sequence: Synthetic polypeptide
TEEQIRTTNPVAYEQYGTTVSCTQYVSQSGEN

SEQ ID NO: 135216 - protein, 34 aa, Artificial Sequence
  Description of Artificial Sequence: Synthetic polypeptide
DEEEIRTTNPVATEQYGCVCSNTEDHAFFNSQQP

SEQ ID NO: 135217 - protein, 33 aa, Artificial Sequence
  Description of Artificial Sequence: Synthetic polypeptide
AEEEIATTNPVATEQYGCVATNMGEAENPGNQV

SEQ ID NO: 135218 - protein, 35 aa, Artificial Sequence
  Description of Artificial Sequence: Synthetic polypeptide
DEEEIRTTNPVATEQYGCVCSNTEDHAEFFGSNQP

SEQ ID NO: 135219 - protein, 35 aa, Artificial Sequence
  Description of Artificial Sequence: Synthetic polypeptide
DEEEIRTTNPVATEQYGCVCSNTEDHNQYFGSDFA

SEQ ID NO: 135220 - protein, 35 aa, Artificial Sequence
  Description of Artificial Sequence: Synthetic polypeptide
DEEEIRTTNPVATEQYGCVCSNTEDDQSFGSETQS

SEQ ID NO: 135221 - protein, 33 aa, Artificial Sequence
  Description of Artificial Sequence: Synthetic polypeptide
DEEEISTTNPVATEGYGCVCSWEEHQNFGSNQS

SEQ ID NO: 135222 - protein, 33 aa, Artificial Sequence
  Description of Artificial Sequence: Synthetic polypeptide
TEESIATTNPVATEAYGSVSWNEGIDRQGGNMS

SEQ ID NO: 135223 - protein, 33 aa, Artificial Sequence
  Description of Artificial Sequence: Synthetic polypeptide
TEESIATTNPVATEQYGSVSWNEGDDRQGHTSD

SEQ ID NO: 135224 - protein, 34 aa, Artificial Sequence
  Description of Artificial Sequence: Synthetic polypeptide
TEESIATTNPVATEQYGSVSWNEGEDRQGHNNSK

SEQ ID NO: 135225 - protein, 30 aa, Artificial Sequence
  Description of Artificial Sequence: Synthetic polypeptide
DDSEVACTNPVSTEGYGNVSANTIQSRGGR

SEQ ID NO: 135226 - protein, 33 aa, Artificial Sequence
  Description of Artificial Sequence: Synthetic polypeptide
DEEEISTTNPVATEGYGCVCSTEHTEGFNSDQS

SEQ ID NO: 135227 - protein, 33 aa, Artificial Sequence
  Description of Artificial Sequence: Synthetic polypeptide
DEEEISTTNPVATEGYGCVCSTEHQNFNSNTQS

SEQ ID NO: 135228 - protein, 33 aa, Artificial Sequence
  Description of Artificial Sequence: Synthetic polypeptide
DEEEISTTNPVATEGYGCVCSTEHQENFGSDQA

SEQ ID NO: 135229 - protein, 33 aa, Artificial Sequence
  Description of Artificial Sequence: Synthetic polypeptide
DEEEISTTNPVATEGYGCVCSTEHNQNFGSDQS

SEQ ID NO: 135230 - protein, 34 aa, Artificial Sequence
  Description of Artificial Sequence: Synthetic polypeptide
DEEEISTTNPVATEGYGCVCSWEELQNFGSENQS

SEQ ID NO: 135231 - protein, 32 aa, Artificial Sequence
  Description of Artificial Sequence: Synthetic polypeptide
TEENIRTTNPVATCMWGSVYATVNLDQGGRGQ

SEQ ID NO: 135232 - protein, 35 aa, Artificial Sequence
  Description of Artificial Sequence: Synthetic polypeptide
DEEEIRTTNPVATEQYGCVCSNTEDHNQYFNSEQT

SEQ ID NO: 135233 - protein, 34 aa, Artificial Sequence
  Description of Artificial Sequence: Synthetic polypeptide
TEENIATTNPVATEQYGSVSWNEGQDRQRTTGGE

SEQ ID NO: 135234 - protein, 37 aa, Artificial Sequence
  Description of Artificial Sequence: Synthetic polypeptide
DEEEIRTTNPVATEQYGCVCSNTEEDLQEGFGSNNQS

SEQ ID NO: 135235 - protein, 34 aa, Artificial Sequence
  Description of Artificial Sequence: Synthetic polypeptide
DEEEIRTTNPVATEQYGCVCSNTEEDINFGSDQG

SEQ ID NO: 135236 - protein, 29 aa, Artificial Sequence
  Description of Artificial Sequence: Synthetic peptide
AEEEIATTNPVATEQYGEAPEVCQQHEEK

SEQ ID NO: 135237 - protein, 36 aa, Artificial Sequence
  Description of Artificial Sequence: Synthetic polypeptide
DEEEIRTTNPVATEQYGCVCSNTEEDDQEGFNSQQS

SEQ ID NO: 135238 - protein, 35 aa, Artificial Sequence
  Description of Artificial Sequence: Synthetic polypeptide
DEEEIRTTNPVATEQYGCVCSNTEEAHQHFGSDQE

SEQ ID NO: 135239 - protein, 31 aa, Artificial Sequence
  Description of Artificial Sequence: Synthetic polypeptide
TEEGIRTTNPVATSVYGCVGATVALDQGGQG

SEQ ID NO: 135240 - protein, 32 aa, Artificial Sequence
  Description of Artificial Sequence: Synthetic polypeptide
TEEGIRTTNPVAYEPYGKTVALNLLEVGNDRY

SEQ ID NO: 135241 - protein, 32 aa, Artificial Sequence
  Description of Artificial Sequence: Synthetic polypeptide
TEEGIRTTNPVAYEQWGKTVAYLNLLEVGNDR

SEQ ID NO: 135242 - protein, 35 aa, Artificial Sequence
  Description of Artificial Sequence: Synthetic polypeptide
DEEEIRTTNPVATEQYGCVCSNTEDQENFGSDTQS

SEQ ID NO: 135243 - protein, 32 aa, Artificial Sequence
  Description of Artificial Sequence: Synthetic polypeptide
TEEGIRTTNPVAYEQYGKTVALNQLEPVGNDE

SEQ ID NO: 135244 - protein, 32 aa, Artificial Sequence
  Description of Artificial Sequence: Synthetic polypeptide
TEEGIRTTNPVAYEQYGKTVATSSGLVGNDRT

SEQ ID NO: 135245 - protein, 35 aa, Artificial Sequence
  Description of Artificial Sequence: Synthetic polypeptide
DEEEIRTTNPVATEQYGCVCSNTEDNQEFFGSEQS

SEQ ID NO: 135246 - protein, 32 aa, Artificial Sequence
  Description of Artificial Sequence: Synthetic polypeptide
TEEHICTTNPVAYECYGSVSCMNMSGRGGNNA

SEQ ID NO: 135247 - protein, 36 aa, Artificial Sequence
  Description of Artificial Sequence: Synthetic polypeptide
DEEEIRTTNPVATEQYGCVCSNTEDLQENFGSDTQS

SEQ ID NO: 135248 - protein, 34 aa, Artificial Sequence
  Description of Artificial Sequence: Synthetic polypeptide
TEEIAEIATTNPVAYERWGSVSTNLQLGDTGDNS

SEQ ID NO: 135249 - protein, 31 aa, Artificial Sequence
  Description of Artificial Sequence: Synthetic polypeptide
TEEIIRTTNPVATSRYGCVMATVALDQGGQG

SEQ ID NO: 135250 - protein, 33 aa, Artificial Sequence
  Description of Artificial Sequence: Synthetic polypeptide
TEENIATTNPVATEIWGQVATGNMQDRQGSNNR

SEQ ID NO: 135251 - protein, 35 aa, Artificial Sequence
  Description of Artificial Sequence: Synthetic polypeptide
DEEEISTTNPVATEGYGICVCSTVNLNQENISNQA

SEQ ID NO: 135252 - protein, 34 aa, Artificial Sequence
  Description of Artificial Sequence: Synthetic polypeptide
DEEEIRTTNPVATEQYGCVCSNTEDIENFNSNQS

SEQ ID NO: 135253 - protein, 33 aa, Artificial Sequence
  Description of Artificial Sequence: Synthetic polypeptide
TEENIATTNPVATEIYGQVATGNMQDRQGSGER

SEQ ID NO: 135254 - protein, 34 aa, Artificial Sequence
  Description of Artificial Sequence: Synthetic polypeptide
TEENIATTNPVATEQYGEVSWNEGQDRQRQTGNQ

SEQ ID NO: 135255 - protein, 32 aa, Artificial Sequence
  Description of Artificial Sequence: Synthetic polypeptide
TEEVIACTNPVATEQYGCVATNLATMNPNMRQ

SEQ ID NO: 135256 - protein, 31 aa, Artificial Sequence
  Description of Artificial Sequence: Synthetic polypeptide
TENEIRTTNPVATSRYGCVYATVALDQGGQT

SEQ ID NO: 135257 - protein, 33 aa, Artificial Sequence
  Description of Artificial Sequence: Synthetic polypeptide
DEEEISTTNPVATEGYGCVCSSEHQGFGSDNQS

SEQ ID NO: 135258 - protein, 34 aa, Artificial Sequence
  Description of Artificial Sequence: Synthetic polypeptide
DEEEIRTTNPVATEQYGCVCSNSGETQNFGSEQG

SEQ ID NO: 135259 - protein, 33 aa, Artificial Sequence
  Description of Artificial Sequence: Synthetic polypeptide
TENEIACTNPVATEQYGEASCENALSQFGGGNR

SEQ ID NO: 135260 - protein, 30 aa, Artificial Sequence
  Description of Artificial Sequence: Synthetic polypeptide
AEEEIATTNPVATEQWGAVASNDAAITNEA

SEQ ID NO: 135261 - protein, 33 aa, Artificial Sequence
  Description of Artificial Sequence: Synthetic polypeptide
TENEIACTNPVATEQYGETASCENALSQRGGGR

SEQ ID NO: 135262 - protein, 31 aa, Artificial Sequence
  Description of Artificial Sequence: Synthetic polypeptide
TENEIACTNPVAYEPYGTASENALSQRGGGR

SEQ ID NO: 135263 - protein, 32 aa, Artificial Sequence
  Description of Artificial Sequence: Synthetic polypeptide
TENEIACTNPVAYEQYGEAPSCENLQRGGGYR

SEQ ID NO: 135264 - protein, 31 aa, Artificial Sequence
  Description of Artificial Sequence: Synthetic polypeptide
TENEIACTNPVAYEQYGEASCENHSQRVGGR

SEQ ID NO: 135265 - protein, 31 aa, Artificial Sequence
  Description of Artificial Sequence: Synthetic polypeptide
TENEIACTNPVAYEQYGEASENALSQGGGGR

SEQ ID NO: 135266 - protein, 33 aa, Artificial Sequence
  Description of Artificial Sequence: Synthetic polypeptide
TENEIACTNPVAYEQYGEVASENALSQRGGGRI

SEQ ID NO: 135267 - protein, 34 aa, Artificial Sequence
  Description of Artificial Sequence: Synthetic polypeptide
DEEEIRTTNPVATEQYGCVCSNSGEDQSFGSEQE

SEQ ID NO: 135268 - protein, 29 aa, Artificial Sequence
  Description of Artificial Sequence: Synthetic peptide
TEMEIACTNPCSYEQYGCVSWELQSGSTR

SEQ ID NO: 135269 - protein, 30 aa, Artificial Sequence
  Description of Artificial Sequence: Synthetic polypeptide
TENEIATTNPVATECYGKVSCESLSQHEEL

SEQ ID NO: 135270 - protein, 30 aa, Artificial Sequence
  Description of Artificial Sequence: Synthetic polypeptide
TENEIATTNPVATECYGVVVSECLSQHEEL

SEQ ID NO: 135271 - protein, 29 aa, Artificial Sequence
  Description of Artificial Sequence: Synthetic peptide
TENEIATTNPVAYECYGDVSESLSQHEEL

SEQ ID NO: 135272 - protein, 29 aa, Artificial Sequence
  Description of Artificial Sequence: Synthetic peptide
TENEIATTNPVAYECYGVVSECELQHEEL

SEQ ID NO: 135273 - protein, 30 aa, Artificial Sequence
  Description of Artificial Sequence: Synthetic polypeptide
TENEIATTNPVAYECYGVVSEGLSQHEENL

SEQ ID NO: 135274 - protein, 29 aa, Artificial Sequence
  Description of Artificial Sequence: Synthetic peptide
TENEIATTNPVAYEPYGKVSEHLSQHEES

SEQ ID NO: 135275 - protein, 33 aa, Artificial Sequence
  Description of Artificial Sequence: Synthetic polypeptide
TENEIRTTNPVATEAYGKISTNLSDVDGGNNEN

SEQ ID NO: 135276 - protein, 35 aa, Artificial Sequence
  Description of Artificial Sequence: Synthetic polypeptide
TENEIRTTNPVATEPYGCSVVSNNQSQNTGGNTRC

SEQ ID NO: 135277 - protein, 35 aa, Artificial Sequence
  Description of Artificial Sequence: Synthetic polypeptide
TENEIRTTNPVATEPYGCSVVSVGNQSQLTGGNRC

SEQ ID NO: 135278 - protein, 34 aa, Artificial Sequence
  Description of Artificial Sequence: Synthetic polypeptide
TENEIRTTNPVATEPYGCSVVSVNQSDKTGGNRC

SEQ ID NO: 135279 - protein, 30 aa, Artificial Sequence
  Description of Artificial Sequence: Synthetic polypeptide
TENEIATTNPVATECYGKVSEDELSQHEEL

SEQ ID NO: 135280 - protein, 33 aa, Artificial Sequence
  Description of Artificial Sequence: Synthetic polypeptide
TEHELRTTNPVATEAYGEISTNALSDRDGGNNE

SEQ ID NO: 135281 - protein, 34 aa, Artificial Sequence
  Description of Artificial Sequence: Synthetic polypeptide
TEHEIRTTNPVATEQWGSVSCWNISQTTGGMNPF

SEQ ID NO: 135282 - protein, 34 aa, Artificial Sequence
  Description of Artificial Sequence: Synthetic polypeptide
TEHEIRTTNPVATEAYGVISTNELSDRDGGNNEN

SEQ ID NO: 135283 - protein, 32 aa, Artificial Sequence
  Description of Artificial Sequence: Synthetic polypeptide
TEFEICTVNPVAYEAYGSVSTNELSTNEGGNH

SEQ ID NO: 135284 - protein, 35 aa, Artificial Sequence
  Description of Artificial Sequence: Synthetic polypeptide
DEEEIRTTNPVATEQYGCVCSNSGETQENFGSNQD

SEQ ID NO: 135285 - protein, 33 aa, Artificial Sequence
  Description of Artificial Sequence: Synthetic polypeptide
TEFEIRTTNPVATEAYGEISTNLSDPDGGNNEN

SEQ ID NO: 135286 - protein, 35 aa, Artificial Sequence
  Description of Artificial Sequence: Synthetic polypeptide
DEEEIRTTNPVATEQYGCVCSNSGEPQENFGSNQG

SEQ ID NO: 135287 - protein, 29 aa, Artificial Sequence
  Description of Artificial Sequence: Synthetic peptide
TEGEIAPTNPCSYEQWGQVSCNLQSGDTR

SEQ ID NO: 135288 - protein, 34 aa, Artificial Sequence
  Description of Artificial Sequence: Synthetic polypeptide
DEEEIRTTNPVATEQYGCVCSNSGEHQNFNSDQA

SEQ ID NO: 135289 - protein, 31 aa, Artificial Sequence
  Description of Artificial Sequence: Synthetic polypeptide
TEGEIAPTNPCSYEQYGIVSCGNLQSGGTNR

SEQ ID NO: 135290 - protein, 30 aa, Artificial Sequence
  Description of Artificial Sequence: Synthetic polypeptide
TEGEIAPTNPCSYEQYGKVPSCCNLQSGTR

SEQ ID NO: 135291 - protein, 31 aa, Artificial Sequence
  Description of Artificial Sequence: Synthetic polypeptide
TEGEIASVNPVSTEQYGVVSDNLSQSGGNNQ

SEQ ID NO: 135292 - protein, 33 aa, Artificial Sequence
  Description of Artificial Sequence: Synthetic polypeptide
TEGEIGTTNPVATEPYGSVVHVNQSQKTGGNRC

SEQ ID NO: 135293 - protein, 34 aa, Artificial Sequence
  Description of Artificial Sequence: Synthetic polypeptide
TEGEIQTTNPVATEPYGSVVSVQNQSQKTGGNRC

SEQ ID NO: 135294 - protein, 34 aa, Artificial Sequence
  Description of Artificial Sequence: Synthetic polypeptide
TEGEIRTTNPVATEPYGSVVSVESQSQKTGGNRC

SEQ ID NO: 135295 - protein, 34 aa, Artificial Sequence
  Description of Artificial Sequence: Synthetic polypeptide
TEGEIRTTNPVATEPYGSVVSVLNQSQKTGGNTD

SEQ ID NO: 135296 - protein, 34 aa, Artificial Sequence
  Description of Artificial Sequence: Synthetic polypeptide
TEGEIRTTNPVATEPYGSVVSVNNQSQKTGGNDC

SEQ ID NO: 135297 - protein, 34 aa, Artificial Sequence
  Description of Artificial Sequence: Synthetic polypeptide
TEGEIRTTNPVATEQYGSVISCGVAVSQGTGGSR

SEQ ID NO: 135298 - protein, 34 aa, Artificial Sequence
  Description of Artificial Sequence: Synthetic polypeptide
TEHEIRTTNPVATDCYGSVNCTQELSQRTGGNND

SEQ ID NO: 135299 - protein, 33 aa, Artificial Sequence
  Description of Artificial Sequence: Synthetic polypeptide
TEHEIRTTNPVATDPYGSVNCTQELSQGTGGND

SEQ ID NO: 135300 - protein, 34 aa, Artificial Sequence
  Description of Artificial Sequence: Synthetic polypeptide
TEHEIRTTNPVATEAYGEISCTNLSNRDGGNNEN

SEQ ID NO: 135301 - protein, 33 aa, Artificial Sequence
  Description of Artificial Sequence: Synthetic polypeptide
TEHEIRTTNPVATEAYGEISTNASDRDGGNNEC

SEQ ID NO: 135302 - protein, 33 aa, Artificial Sequence
  Description of Artificial Sequence: Synthetic polypeptide
TEHEIRTTNPVATEAYGEISTNVSDRDGGNNDN

SEQ ID NO: 135303 - protein, 29 aa, Artificial Sequence
  Description of Artificial Sequence: Synthetic peptide
AEEEIATTNPVATEQYGCACPWVEQHEEQ

SEQ ID NO: 135304 - protein, 32 aa, Artificial Sequence
  Description of Artificial Sequence: Synthetic polypeptide
TEEVIRTTNPVAYEHYGKTVATASLMVGNDRT

SEQ ID NO: 135305 - protein, 31 aa, Artificial Sequence
  Description of Artificial Sequence: Synthetic polypeptide
TEEEIRTTNPVATSLYGCVGATVALDPGGQG

SEQ ID NO: 135306 - protein, 33 aa, Artificial Sequence
  Description of Artificial Sequence: Synthetic polypeptide
AEDEVRTTNPVAYEQWGSTCSTWEHLDQRDGNK

SEQ ID NO: 135307 - protein, 36 aa, Artificial Sequence
  Description of Artificial Sequence: Synthetic polypeptide
WEEEIRTTNPVATEQYGSVSSTTPAGPNMRNGMNPV

SEQ ID NO: 135308 - protein, 34 aa, Artificial Sequence
  Description of Artificial Sequence: Synthetic polypeptide
DEEEIRTTNPVATEFYGSVTSNDDGQNDTGESGQ

SEQ ID NO: 135309 - protein, 35 aa, Artificial Sequence
  Description of Artificial Sequence: Synthetic polypeptide
DEEEIRTTNPVATEFYGSVVDSDNNFTGGNGQGQG

SEQ ID NO: 135310 - protein, 33 aa, Artificial Sequence
  Description of Artificial Sequence: Synthetic polypeptide
DEEEIRTTNPVATEFYGSVVGDGFNGGNDTNDP

SEQ ID NO: 135311 - protein, 36 aa, Artificial Sequence
  Description of Artificial Sequence: Synthetic polypeptide
DEEEIRTTNPVATEFYGSVVMDTDNQDQQRIITGDG

SEQ ID NO: 135312 - protein, 36 aa, Artificial Sequence
  Description of Artificial Sequence: Synthetic polypeptide
DEEEIRTTNPVATEFYGSVVMDTDNQDQQRIVDGDD

SEQ ID NO: 135313 - protein, 29 aa, Artificial Sequence
  Description of Artificial Sequence: Synthetic peptide
AEDEIAATNPVAYEQWGEACENLQPGGER

SEQ ID NO: 135314 - protein, 34 aa, Artificial Sequence
  Description of Artificial Sequence: Synthetic polypeptide
YEEEIRTTNPIAYEQYGSLVVPCTGLSARGGSNE

SEQ ID NO: 135315 - protein, 36 aa, Artificial Sequence
  Description of Artificial Sequence: Synthetic polypeptide
DEEEIRTTNPVATEFYGSVVMTTDNANQQRIINGDD

SEQ ID NO: 135316 - protein, 34 aa, Artificial Sequence
  Description of Artificial Sequence: Synthetic polypeptide
DEEEIRTTNPVATEFYGSVVTDGFNGGNEDTNDE

SEQ ID NO: 135317 - protein, 36 aa, Artificial Sequence
  Description of Artificial Sequence: Synthetic polypeptide
DEEEIRTTNPVATEFYGSVTDGEGNLNQNVGGNIQE

SEQ ID NO: 135318 - protein, 36 aa, Artificial Sequence
  Description of Artificial Sequence: Synthetic polypeptide
DEEEIRTTNPVATEFYGSVYSDDGENEQGGEENTGN

SEQ ID NO: 135319 - protein, 34 aa, Artificial Sequence
  Description of Artificial Sequence: Synthetic polypeptide
DEEEIRTTNPVATEFYGSVYTTNMGVNEEGEDGG

SEQ ID NO: 135320 - protein, 35 aa, Artificial Sequence
  Description of Artificial Sequence: Synthetic polypeptide
DEEEIRTTNPVATEFYGTVMSDDDNEQDGQGENIN

SEQ ID NO: 135321 - protein, 35 aa, Artificial Sequence
  Description of Artificial Sequence: Synthetic polypeptide
YEEEIRTTNPVATEGYGSVSTGDNGQNNGGEGEQE

SEQ ID NO: 135322 - protein, 28 aa, Artificial Sequence
  Description of Artificial Sequence: Synthetic peptide
AECEIATTNPVATEQYGEAPEVCQHEEK

SEQ ID NO: 135323 - protein, 36 aa, Artificial Sequence
  Description of Artificial Sequence: Synthetic polypeptide
DEEEIRTTNPVATEPYGSVSSTTPAIPNMRNGMNPV

SEQ ID NO: 135324 - protein, 36 aa, Artificial Sequence
  Description of Artificial Sequence: Synthetic polypeptide
DEEEIRTTNPVATEPYGSVSSTTPAIPNMRNGMNPH

SEQ ID NO: 135325 - protein, 36 aa, Artificial Sequence
  Description of Artificial Sequence: Synthetic polypeptide
DEEEIRTTNPVATEPYGSVSSTTPAGPNMRNGMNVV

SEQ ID NO: 135326 - protein, 36 aa, Artificial Sequence
  Description of Artificial Sequence: Synthetic polypeptide
DEEEIRTTNPVATEPYGSVSSTTPAGPNMRNGMNPV

SEQ ID NO: 135327 - protein, 36 aa, Artificial Sequence
  Description of Artificial Sequence: Synthetic polypeptide
DEEEIRTTNPVATEPYGSVSSTTEAGPQQQNGMNPV

SEQ ID NO: 135328 - protein, 35 aa, Artificial Sequence
  Description of Artificial Sequence: Synthetic polypeptide
DEEEIRTTNPVATEFYGSVYTGNMNVNEEGENGGN

SEQ ID NO: 135329 - protein, 33 aa, Artificial Sequence
  Description of Artificial Sequence: Synthetic polypeptide
DEEEIRTTNPVATEPYGSVVFLEESSQNGGSYI

SEQ ID NO: 135330 - protein, 30 aa, Artificial Sequence
  Description of Artificial Sequence: Synthetic polypeptide
AEDEIACTNPVAYEQWGCAAENLQRGDGER

SEQ ID NO: 135331 - protein, 31 aa, Artificial Sequence
  Description of Artificial Sequence: Synthetic polypeptide
AEDEIACTNPVAYEQWGCAFSENLQRGEGDR

SEQ ID NO: 135332 - protein, 36 aa, Artificial Sequence
  Description of Artificial Sequence: Synthetic polypeptide
DEEEIRTTNPVAYEQYGSVVSTTPAGSNNRNGTNPV

SEQ ID NO: 135333 - protein, 34 aa, Artificial Sequence
  Description of Artificial Sequence: Synthetic polypeptide
DEEEIRTTNPVATEPYGTVSSMEAIPQQQNGNPH

SEQ ID NO: 135334 - protein, 30 aa, Artificial Sequence
  Description of Artificial Sequence: Synthetic polypeptide
DDSEVASTNPVSTEGYGNVAASTLQRVGDR

SEQ ID NO: 135335 - protein, 30 aa, Artificial Sequence
  Description of Artificial Sequence: Synthetic polypeptide
DDSEVASTNPVSTEGYGNVAASTLQRVGQR

SEQ ID NO: 135336 - protein, 32 aa, Artificial Sequence
  Description of Artificial Sequence: Synthetic polypeptide
YEEEIRSTNPVCTEQYGVVSMEDIQQQSNGNH

SEQ ID NO: 135337 - protein, 34 aa, Artificial Sequence
  Description of Artificial Sequence: Synthetic polypeptide
DEEEIRTTNPVATEPYGTVSSMEAGPQQQNGNPH

SEQ ID NO: 135338 - protein, 34 aa, Artificial Sequence
  Description of Artificial Sequence: Synthetic polypeptide
YEEEIRSTNPVCTEQYGVVSSTPNGPNMRNGMNQ

SEQ ID NO: 135339 - protein, 36 aa, Artificial Sequence
  Description of Artificial Sequence: Synthetic polypeptide
DEEEIRTTNPVATEFYGSVSSTTPAGPNMRNGMNAV

SEQ ID NO: 135340 - protein, 32 aa, Artificial Sequence
  Description of Artificial Sequence: Synthetic polypeptide
YEEEIRSTNPVSTEQYGVVSMEDIQQQSNGNH

SEQ ID NO: 135341 - protein, 34 aa, Artificial Sequence
  Description of Artificial Sequence: Synthetic polypeptide
YEEEIRSVNPVATEQYGSVSSTDAGPNMRGMNPV

SEQ ID NO: 135342 - protein, 36 aa, Artificial Sequence
  Description of Artificial Sequence: Synthetic polypeptide
DEEEIRTTNPVATEFYGSVSSTTPAGPNMRNGMNPV

SEQ ID NO: 135343 - protein, 34 aa, Artificial Sequence
  Description of Artificial Sequence: Synthetic polypeptide
YEEEIRSVNPVATEQYGSVSSTDAGPQMSGMNPV

SEQ ID NO: 135344 - protein, 36 aa, Artificial Sequence
  Description of Artificial Sequence: Synthetic polypeptide
DEEEIRTTNPVATEFYGSVSSTTPAGPNMWNGMNPV

SEQ ID NO: 135345 - protein, 35 aa, Artificial Sequence
  Description of Artificial Sequence: Synthetic polypeptide
DEEEIRTTNPVAYEQYGSVVPVTNSHIQELTEGKL

SEQ ID NO: 135346 - protein, 30 aa, Artificial Sequence
  Description of Artificial Sequence: Synthetic polypeptide
AEDEIACTNPVAYEQWGEASENLQRGMGDH

SEQ ID NO: 135347 - protein, 31 aa, Artificial Sequence
  Description of Artificial Sequence: Synthetic polypeptide
AEDEIACTNPVAYEQWGEASCENLQRQGGER

SEQ ID NO: 135348 - protein, 31 aa, Artificial Sequence
  Description of Artificial Sequence: Synthetic polypeptide
AEDEIACTNPVAYEQWGEAFSENLQRGDGER

SEQ ID NO: 135349 - protein, 33 aa, Artificial Sequence
  Description of Artificial Sequence: Synthetic polypeptide
YEEEIRSVNPVATEQYGVVSSTDAGQMSGMNPV

SEQ ID NO: 135350 - protein, 36 aa, Artificial Sequence
  Description of Artificial Sequence: Synthetic polypeptide
DEEEIRTTNPVATEFYGSVSSTTPRGPNMRNGMNPV

SEQ ID NO: 135351 - protein, 29 aa, Artificial Sequence
  Description of Artificial Sequence: Synthetic peptide
AEDEIACTNPVAYEQWGEACENLQLGGDR

SEQ ID NO: 135352 - protein, 30 aa, Artificial Sequence
  Description of Artificial Sequence: Synthetic polypeptide
AEDEIACTNPVAYEQWGEACENLQHGNGER

SEQ ID NO: 135353 - protein, 35 aa, Artificial Sequence
  Description of Artificial Sequence: Synthetic polypeptide
DEEEIRTTNPVATEFYGVATSMTGEGLGQGDEGNE

SEQ ID NO: 135354 - protein, 35 aa, Artificial Sequence
  Description of Artificial Sequence: Synthetic polypeptide
DEEEIRTTNPVATEPYGTVSSTTPAGPNMRNGNPV

SEQ ID NO: 135355 - protein, 35 aa, Artificial Sequence
  Description of Artificial Sequence: Synthetic polypeptide
DEEEIRTTNPVATEFYGVATSMTGNGLGQDEGGQE

SEQ ID NO: 135356 - protein, 34 aa, Artificial Sequence
  Description of Artificial Sequence: Synthetic polypeptide
DEEEIRTTNPVATEFYGVVDLDENGQDDEEDGNG

SEQ ID NO: 135357 - protein, 36 aa, Artificial Sequence
  Description of Artificial Sequence: Synthetic polypeptide
DEEEIRTTNPVATEPYGSVCFFTAGLETQRENQNEG

SEQ ID NO: 135358 - protein, 36 aa, Artificial Sequence
  Description of Artificial Sequence: Synthetic polypeptide
DEEEIRTTNPVATEPYGSVCFFPAYLDIQRGVQNEG

SEQ ID NO: 135359 - protein, 34 aa, Artificial Sequence
  Description of Artificial Sequence: Synthetic polypeptide
DEEEIRTTNPVATEGYGCVCFTEHNTEYFGSNQA

SEQ ID NO: 135360 - protein, 34 aa, Artificial Sequence
  Description of Artificial Sequence: Synthetic polypeptide
DEEEIRTTNPVATEGYGCVCFTELNTNFGSDNQS

SEQ ID NO: 135361 - protein, 35 aa, Artificial Sequence
  Description of Artificial Sequence: Synthetic polypeptide
DEEEIRTTNPVATEPYGSVAFTNAGSTDTGGNPTY

SEQ ID NO: 135362 - protein, 33 aa, Artificial Sequence
  Description of Artificial Sequence: Synthetic polypeptide
DEEEIRTTNPVATEGYGCVCFTETNTNGGSDQS

SEQ ID NO: 135363 - protein, 33 aa, Artificial Sequence
  Description of Artificial Sequence: Synthetic polypeptide
DEEEIRTTNPVATEGYGCVCFTGEHTYGGSNQS

SEQ ID NO: 135364 - protein, 33 aa, Artificial Sequence
  Description of Artificial Sequence: Synthetic polypeptide
DEEEIRTTNPVATEGYGCVCFTGNDTYFGSDQS

SEQ ID NO: 135365 - protein, 33 aa, Artificial Sequence
  Description of Artificial Sequence: Synthetic polypeptide
DEEEIRTTNPVATEGYGCVCFTNHTHGGSDTQS

SEQ ID NO: 135366 - protein, 34 aa, Artificial Sequence
  Description of Artificial Sequence: Synthetic polypeptide
YEEEIRTTNPVATEQYGSVVNTDNMITGGGQEQT

SEQ ID NO: 135367 - protein, 30 aa, Artificial Sequence
  Description of Artificial Sequence: Synthetic polypeptide
YEEEIRTTNPVCTEQWGVVSENEMNAAEDA

SEQ ID NO: 135368 - protein, 34 aa, Artificial Sequence
  Description of Artificial Sequence: Synthetic polypeptide
YEEEIRTTNPVCTEQYGSVSDPNGPNMSNGMNPQ

SEQ ID NO: 135369 - protein, 35 aa, Artificial Sequence
  Description of Artificial Sequence: Synthetic polypeptide
YEEEIRTTNPVCTEQYGSVSSTTPAGNMRNGMNPV

SEQ ID NO: 135370 - protein, 34 aa, Artificial Sequence
  Description of Artificial Sequence: Synthetic polypeptide
DEEEIRTTNPVATEPYGNVCFTNAPSTVTGGNPT

SEQ ID NO: 135371 - protein, 33 aa, Artificial Sequence
  Description of Artificial Sequence: Synthetic polypeptide
AEAEISTTNPVATEQYGCVCSTNLNAYFGSDQS

SEQ ID NO: 135372 - protein, 32 aa, Artificial Sequence
  Description of Artificial Sequence: Synthetic polypeptide
DEEEIRTTNPVATEGYGCVCFWNPTNGGSDQS

SEQ ID NO: 135373 - protein, 35 aa, Artificial Sequence
  Description of Artificial Sequence: Synthetic polypeptide
YEEEIRTVNPVATEQYGSVSSTPAGPNMSNGMNPV

SEQ ID NO: 135374 - protein, 30 aa, Artificial Sequence
  Description of Artificial Sequence: Synthetic polypeptide
DDSEVASTNPVSTEGYGNVSAETIQRVGNR

SEQ ID NO: 135375 - protein, 35 aa, Artificial Sequence
  Description of Artificial Sequence: Synthetic polypeptide
YEEEIRTVNPVATEQYGSVSSTTPAGPNMRGMNPV

SEQ ID NO: 135376 - protein, 33 aa, Artificial Sequence
  Description of Artificial Sequence: Synthetic polypeptide
YEEEIRTVNPVCTEQYGSVSDPNGPNMSNGMNQ

SEQ ID NO: 135377 - protein, 35 aa, Artificial Sequence
  Description of Artificial Sequence: Synthetic polypeptide
DEEEIRTTNPVATEPYGSISSMPDIQNMQNGMNPV

SEQ ID NO: 135378 - protein, 36 aa, Artificial Sequence
  Description of Artificial Sequence: Synthetic polypeptide
DEEEIRTTNPVAYEQYGSVSSCTPAGSNERNGTNPV

SEQ ID NO: 135379 - protein, 36 aa, Artificial Sequence
  Description of Artificial Sequence: Synthetic polypeptide
YEEEIRTTNPVATEQYGSVSSTTPAGPNMRNGMNPV

SEQ ID NO: 135380 - protein, 36 aa, Artificial Sequence
  Description of Artificial Sequence: Synthetic polypeptide
DEEEIRTTNPVAYEQYGSVSSTMPAGPNMRNGMNPV

SEQ ID NO: 135381 - protein, 29 aa, Artificial Sequence
  Description of Artificial Sequence: Synthetic peptide
DDSEVASTNPVSTEGYGNVANTIQSRGNR

SEQ ID NO: 135382 - protein, 36 aa, Artificial Sequence
  Description of Artificial Sequence: Synthetic polypeptide
DEEEIRTTNPVATEPYGSVEVFTNYLETPRIGQEVV

SEQ ID NO: 135383 - protein, 37 aa, Artificial Sequence
  Description of Artificial Sequence: Synthetic polypeptide
DEEEIRTTNPVATEPYGSVCVMTNYLATQRAGQEQEV

SEQ ID NO: 135384 - protein, 36 aa, Artificial Sequence
  Description of Artificial Sequence: Synthetic polypeptide
DEEEIRTTNPVATEPYGSVCVMTNYLATERAGQEVV

SEQ ID NO: 135385 - protein, 36 aa, Artificial Sequence
  Description of Artificial Sequence: Synthetic polypeptide
DEEEIRTTNPVATEPYGSVCVFPNYLVTQRIGQEVV

SEQ ID NO: 135386 - protein, 32 aa, Artificial Sequence
  Description of Artificial Sequence: Synthetic polypeptide
DEEEIRTTNPVATEFYGVVVGDTGQSEDGGEG

SEQ ID NO: 135387 - protein, 36 aa, Artificial Sequence
  Description of Artificial Sequence: Synthetic polypeptide
DEEEIRTTNPVATEPYGSVCNFTNYLAYNRIGQEPL

SEQ ID NO: 135388 - protein, 34 aa, Artificial Sequence
  Description of Artificial Sequence: Synthetic polypeptide
DEEEIRTTNPVATEFYGVVYTQGLDQDENGQGGG

SEQ ID NO: 135389 - protein, 33 aa, Artificial Sequence
  Description of Artificial Sequence: Synthetic polypeptide
DEEEIRTTNPVATEFYGYVDDNQMNIGNGQENE

SEQ ID NO: 135390 - protein, 35 aa, Artificial Sequence
  Description of Artificial Sequence: Synthetic polypeptide
DEEEIRTTNPVATEPYGSVCFTPNAGSTDTGGNMT

SEQ ID NO: 135391 - protein, 32 aa, Artificial Sequence
  Description of Artificial Sequence: Synthetic polypeptide
DEEEIRTTNPVATEGYGCICSTEEQHFSSDFS

SEQ ID NO: 135392 - protein, 33 aa, Artificial Sequence
  Description of Artificial Sequence: Synthetic polypeptide
DEEEIRTTNPVATEGYGCSCSSGEEQYFNSDQA

SEQ ID NO: 135393 - protein, 34 aa, Artificial Sequence
  Description of Artificial Sequence: Synthetic polypeptide
DEEEIRTTNPVATEGYGCSCSTEHNQYFNSDNFA

SEQ ID NO: 135394 - protein, 34 aa, Artificial Sequence
  Description of Artificial Sequence: Synthetic polypeptide
DEEEIRTTNPVATEGYGCSCSTGEHQYFNSDTFA

SEQ ID NO: 135395 - protein, 35 aa, Artificial Sequence
  Description of Artificial Sequence: Synthetic polypeptide
YEEEIRTTNPVATEQYGSVNTDNMGETTGGGQNQG

SEQ ID NO: 135396 - protein, 36 aa, Artificial Sequence
  Description of Artificial Sequence: Synthetic polypeptide
YEEEIRTTNPVATEQYGSVSSTDPAGPNMRNGMNPV

SEQ ID NO: 135397 - protein, 34 aa, Artificial Sequence
  Description of Artificial Sequence: Synthetic polypeptide
DEEEIRTTNPVATEGYGCSCSWNHNQEHFNSDQA

SEQ ID NO: 135398 - protein, 35 aa, Artificial Sequence
  Description of Artificial Sequence: Synthetic polypeptide
DEEEIRTTNPVATEPYGSVCFNNAWSTEDTGGNQT

SEQ ID NO: 135399 - protein, 36 aa, Artificial Sequence
  Description of Artificial Sequence: Synthetic polypeptide
DEEEIRTTNPVAYEQYGSVSSTTPAGSNTRNGTNNV

SEQ ID NO: 135400 - protein, 36 aa, Artificial Sequence
  Description of Artificial Sequence: Synthetic polypeptide
DEEEIRTTNPVAYEQYGSVSSTTPAGPTTRTGGNPV

SEQ ID NO: 135401 - protein, 36 aa, Artificial Sequence
  Description of Artificial Sequence: Synthetic polypeptide
DEEEIRTTNPVAYEQYGSVSSTTPAGPNMRNGMNPV

SEQ ID NO: 135402 - protein, 28 aa, Artificial Sequence
  Description of Artificial Sequence: Synthetic peptide
DDSEVASTNPVSTEGYGNVANTIQRGQR

SEQ ID NO: 135403 - protein, 31 aa, Artificial Sequence
  Description of Artificial Sequence: Synthetic polypeptide
AEAEIASTNPVAYEQYGEASCENLSQRVGDS

SEQ ID NO: 135404 - protein, 31 aa, Artificial Sequence
  Description of Artificial Sequence: Synthetic polypeptide
DDSEVATTNPVSTEGYGNVAANTIQSRVGNR

SEQ ID NO: 135405 - protein, 36 aa, Artificial Sequence
  Description of Artificial Sequence: Synthetic polypeptide
YEEEIRSTNPVATEQYGSVSSTTPNGPNMRNGMNPQ

SEQ ID NO: 135406 - protein, 33 aa, Artificial Sequence
  Description of Artificial Sequence: Synthetic polypeptide
YEEEIATVNPVCTEQYGSVSSDNLPNMSNGMNV

SEQ ID NO: 135407 - protein, 33 aa, Artificial Sequence
  Description of Artificial Sequence: Synthetic polypeptide
AEDEIATTNPVAYERWGSVSTTNLPQQDGNLGQ

SEQ ID NO: 135408 - protein, 33 aa, Artificial Sequence
  Description of Artificial Sequence: Synthetic polypeptide
AEDEIATTNPVAYEQWGSVCSTENDGHQGGQRS

SEQ ID NO: 135409 - protein, 36 aa, Artificial Sequence
  Description of Artificial Sequence: Synthetic polypeptide
DEEEIRTTNPVATEEYGSVSDTTPAGPNMRNGMNPV

SEQ ID NO: 135410 - protein, 31 aa, Artificial Sequence
  Description of Artificial Sequence: Synthetic polypeptide
AEDEIATTNPVAYEPWGTVSTTNLGDGNLEQ

SEQ ID NO: 135411 - protein, 33 aa, Artificial Sequence
  Description of Artificial Sequence: Synthetic polypeptide
AEDEIATTNPVAYEPWGSVSTTNQLGQDGNLGQ

SEQ ID NO: 135412 - protein, 36 aa, Artificial Sequence
  Description of Artificial Sequence: Synthetic polypeptide
DEEEIRTTNPVATEEYGSVSSTTPAGPNMRNGMNPV

SEQ ID NO: 135413 - protein, 36 aa, Artificial Sequence
  Description of Artificial Sequence: Synthetic polypeptide
DEEEIRTTNPVATEEYGSVSSTTPAGPNMRNGQNPV

SEQ ID NO: 135414 - protein, 35 aa, Artificial Sequence
  Description of Artificial Sequence: Synthetic polypeptide
DEEEIRTTNPVATEFYGATVMTENGMGQDEGNNEG

SEQ ID NO: 135415 - protein, 33 aa, Artificial Sequence
  Description of Artificial Sequence: Synthetic polypeptide
AEDEICATNPVATEQYGSVATSENLLQSGTGDT

SEQ ID NO: 135416 - protein, 32 aa, Artificial Sequence
  Description of Artificial Sequence: Synthetic polypeptide
AEDEIATTNPVAYEPWGSVSTTNLPGDGNLNQ

SEQ ID NO: 135417 - protein, 35 aa, Artificial Sequence
  Description of Artificial Sequence: Synthetic polypeptide
YEEEICTTNPVAYEQYGQSVVPSTNSHQELTEGKR

SEQ ID NO: 135418 - protein, 32 aa, Artificial Sequence
  Description of Artificial Sequence: Synthetic polypeptide
YEEEIDTTNPAATEQYLAVSSNLSKTGFGERA

SEQ ID NO: 135419 - protein, 32 aa, Artificial Sequence
  Description of Artificial Sequence: Synthetic polypeptide
AEDEIATTNPVAYEPWGEVSTTNLGDHGNLRQ

SEQ ID NO: 135420 - protein, 37 aa, Artificial Sequence
  Description of Artificial Sequence: Synthetic polypeptide
DEEEIRTTNPVAYEQYGVVPSTTLAGSNQRNGGNPVY

SEQ ID NO: 135421 - protein, 32 aa, Artificial Sequence
  Description of Artificial Sequence: Synthetic polypeptide
AEDEIATTNPVAYEKWGSVSTTNTLGDGNLDQ

SEQ ID NO: 135422 - protein, 34 aa, Artificial Sequence
  Description of Artificial Sequence: Synthetic polypeptide
DEEEIRTTNPVATEFYGCVSNTTDGFQEEGGGEG

SEQ ID NO: 135423 - protein, 31 aa, Artificial Sequence
  Description of Artificial Sequence: Synthetic polypeptide
AEDEIATTNPVAYEKWGSVATTNLGDGNLGQ

SEQ ID NO: 135424 - protein, 32 aa, Artificial Sequence
  Description of Artificial Sequence: Synthetic polypeptide
AEDEIATTNPVAYEKWGCVSTTNLQGDGNLGQ

SEQ ID NO: 135425 - protein, 35 aa, Artificial Sequence
  Description of Artificial Sequence: Synthetic polypeptide
DEEEIRTTNPVATEFYGMVGSGNMNNQDEFGNNEE

SEQ ID NO: 135426 - protein, 33 aa, Artificial Sequence
  Description of Artificial Sequence: Synthetic polypeptide
AEDEIATTNPVAYEPWGSVSTTNLLQGDGNLGQ

SEQ ID NO: 135427 - protein, 34 aa, Artificial Sequence
  Description of Artificial Sequence: Synthetic polypeptide
DEEEIRTTNPVATEQWGATWSNTPDGNMPKGNYI

SEQ ID NO: 135428 - protein, 34 aa, Artificial Sequence
  Description of Artificial Sequence: Synthetic polypeptide
DEEEIRTTNPVATEQWGATWSTTPDGNMPKGNYI

SEQ ID NO: 135429 - protein, 35 aa, Artificial Sequence
  Description of Artificial Sequence: Synthetic polypeptide
DEEEIRTTNPVATEQWGAVSATTEAGPNMRKGNPV

SEQ ID NO: 135430 - protein, 33 aa, Artificial Sequence
  Description of Artificial Sequence: Synthetic polypeptide
AEDEICATNPVATEQYGVVATSEGNLQLGNGTD

SEQ ID NO: 135431 - protein, 34 aa, Artificial Sequence
  Description of Artificial Sequence: Synthetic polypeptide
DEEEIRTTNPVAYESYGSVCCLGNHSTQAEGTRM

SEQ ID NO: 135432 - protein, 34 aa, Artificial Sequence
  Description of Artificial Sequence: Synthetic polypeptide
DEEEIRTTNPVAYESYGSVCCLGNHSNTREGTRD

SEQ ID NO: 135433 - protein, 35 aa, Artificial Sequence
  Description of Artificial Sequence: Synthetic polypeptide
DEEEIRTTNPVATEQWGDVSSTTPAGPMMRNGMNV

SEQ ID NO: 135434 - protein, 32 aa, Artificial Sequence
  Description of Artificial Sequence: Synthetic polypeptide
YEEEIATTNPVCTEQYGVTWSNDENLAEPGNQ

SEQ ID NO: 135435 - protein, 35 aa, Artificial Sequence
  Description of Artificial Sequence: Synthetic polypeptide
DEEEIRTTNPVATEQWGDVSSTTPAGPMMRAGMNV

SEQ ID NO: 135436 - protein, 34 aa, Artificial Sequence
  Description of Artificial Sequence: Synthetic polypeptide
DEEEIRTTNPVATEQWGDVSSTEPIEMNAAGNPA

SEQ ID NO: 135437 - protein, 34 aa, Artificial Sequence
  Description of Artificial Sequence: Synthetic polypeptide
DEEEIRTTNPVATEQWGDVSSTEIEPMNRNENPV

SEQ ID NO: 135438 - protein, 32 aa, Artificial Sequence
  Description of Artificial Sequence: Synthetic polypeptide
DEEEIRTTNPVATEQWGDVSSEIEMNAAENPA

SEQ ID NO: 135439 - protein, 31 aa, Artificial Sequence
  Description of Artificial Sequence: Synthetic polypeptide
DEEEIRTTNPVATEQWGDVSEPAEMNAAEDA

SEQ ID NO: 135440 - protein, 32 aa, Artificial Sequence
  Description of Artificial Sequence: Synthetic polypeptide
DEEEIRTTNPVATEQWGDVSEIEPMNANENPV

SEQ ID NO: 135441 - protein, 35 aa, Artificial Sequence
  Description of Artificial Sequence: Synthetic polypeptide
DEEEIRTTNPVAYERYGSIVATGNEDPQSMVGNNA

SEQ ID NO: 135442 - protein, 30 aa, Artificial Sequence
  Description of Artificial Sequence: Synthetic polypeptide
DDSEVATTNPVSTEPYGNVANTIQSRVGNR

SEQ ID NO: 135443 - protein, 30 aa, Artificial Sequence
  Description of Artificial Sequence: Synthetic polypeptide
DEEEIRTTNPVATEQWGDASEICMNHAEDA

SEQ ID NO: 135444 - protein, 32 aa, Artificial Sequence
  Description of Artificial Sequence: Synthetic polypeptide
AEDEICATNPVATEQYGVVANSNENLQQGDGD

SEQ ID NO: 135445 - protein, 33 aa, Artificial Sequence
  Description of Artificial Sequence: Synthetic polypeptide
DEEEIRTTNPVATEQWGCVATGHLENTPDGSAE

SEQ ID NO: 135446 - protein, 33 aa, Artificial Sequence
  Description of Artificial Sequence: Synthetic polypeptide
AEDEICATNPVATEQYGSVATSNENQLQSGTGD

SEQ ID NO: 135447 - protein, 33 aa, Artificial Sequence
  Description of Artificial Sequence: Synthetic polypeptide
AEDEICATNPVATEQYGSVATSEQNLQSGTGDQ

SEQ ID NO: 135448 - protein, 33 aa, Artificial Sequence
  Description of Artificial Sequence: Synthetic polypeptide
AEDEICATNPVATEQYGSVATSENLQSGTGTDD

SEQ ID NO: 135449 - protein, 35 aa, Artificial Sequence
  Description of Artificial Sequence: Synthetic polypeptide
DEEEIRTTNPVATEQWGAVSSTTPAGPNMRKGNPV

SEQ ID NO: 135450 - protein, 35 aa, Artificial Sequence
  Description of Artificial Sequence: Synthetic polypeptide
DEEEIRTTNPVATEQWGAVSSTTEAGPNMRKGNPV

SEQ ID NO: 135451 - protein, 35 aa, Artificial Sequence
  Description of Artificial Sequence: Synthetic polypeptide
DEEEIRTTNPVATEFYGMVSTGMGQFGQEGGENEG

SEQ ID NO: 135452 - protein, 36 aa, Artificial Sequence
  Description of Artificial Sequence: Synthetic polypeptide
YEEEIRSTNPVATEQYGSVSSTTPNGPNMRNGMNPV

SEQ ID NO: 135453 - protein, 34 aa, Artificial Sequence
  Description of Artificial Sequence: Synthetic polypeptide
DEEEIRTTNPVATEFYGNVMTTDFNGQEGGEQEG

SEQ ID NO: 135454 - protein, 34 aa, Artificial Sequence
  Description of Artificial Sequence: Synthetic polypeptide
DEEEIRTTNPVATEFYGNVVDTVNMFDRIENEGA

SEQ ID NO: 135455 - protein, 34 aa, Artificial Sequence
  Description of Artificial Sequence: Synthetic polypeptide
DEEEIRTTNPVATEFYGSVMGQMNEGEEGEGNQV

SEQ ID NO: 135456 - protein, 35 aa, Artificial Sequence
  Description of Artificial Sequence: Synthetic polypeptide
DEEEIRTTNPVATEFYGSVMGQTNLISNGGGGETT

SEQ ID NO: 135457 - protein, 34 aa, Artificial Sequence
  Description of Artificial Sequence: Synthetic polypeptide
DEEEIRTTNPVATEFYGSVMGQTVGFGGEDGGNQ

SEQ ID NO: 135458 - protein, 35 aa, Artificial Sequence
  Description of Artificial Sequence: Synthetic polypeptide
DEEEIRTTNPVATEFYGSVMGTVDQGGGEDTNEGG

SEQ ID NO: 135459 - protein, 35 aa, Artificial Sequence
  Description of Artificial Sequence: Synthetic polypeptide
DEEEIRTTNPVATEFYGSVMGTVNDQSGEFDTGEE

SEQ ID NO: 135460 - protein, 28 aa, Artificial Sequence
  Description of Artificial Sequence: Synthetic peptide
DDSEVATTNPVSTEGYGNVANTIQHGQR

SEQ ID NO: 135461 - protein, 33 aa, Artificial Sequence
  Description of Artificial Sequence: Synthetic polypeptide
DEEEIRTTNPVATEFYGSVNDDNMTMEFDNENG

SEQ ID NO: 135462 - protein, 36 aa, Artificial Sequence
  Description of Artificial Sequence: Synthetic polypeptide
DEEEIRTTNPVAYEQYGSVYHCTNAISQNKTNSPRV

SEQ ID NO: 135463 - protein, 36 aa, Artificial Sequence
  Description of Artificial Sequence: Synthetic polypeptide
DEEEIRTTNPVAYEQYGSVYFCTNAISQNKGGSPRV

SEQ ID NO: 135464 - protein, 34 aa, Artificial Sequence
  Description of Artificial Sequence: Synthetic polypeptide
DEEEIRTTNPVATEFYGSVMGQFNEGEGGEDNQV

SEQ ID NO: 135465 - protein, 35 aa, Artificial Sequence
  Description of Artificial Sequence: Synthetic polypeptide
DEEEIRTTNPVAYEQYGSVYACTNAVSQNKGSPEV

SEQ ID NO: 135466 - protein, 32 aa, Artificial Sequence
  Description of Artificial Sequence: Synthetic polypeptide
YEEEIRCTNPAATEQYGSVVSEGGMGGENNGG

SEQ ID NO: 135467 - protein, 36 aa, Artificial Sequence
  Description of Artificial Sequence: Synthetic polypeptide
DEEEIRTTNPVATEFYGSVNSNGLNGLEQEIGGEGN

SEQ ID NO: 135468 - protein, 31 aa, Artificial Sequence
  Description of Artificial Sequence: Synthetic polypeptide
YEEEIRCTNPAATEQYGSVVSEGGMGGQGGT

SEQ ID NO: 135469 - protein, 31 aa, Artificial Sequence
  Description of Artificial Sequence: Synthetic polypeptide
AEDEIACTNPVAYEQWGEVWSIENDQRGGER

SEQ ID NO: 135470 - protein, 31 aa, Artificial Sequence
  Description of Artificial Sequence: Synthetic polypeptide
AEDEIACTNPVAYEQWGESYSQENDQRGGER

SEQ ID NO: 135471 - protein, 36 aa, Artificial Sequence
  Description of Artificial Sequence: Synthetic polypeptide
DEEEIRTTNPVATEFYGSVNVDTDNQDQQRIINGDE

SEQ ID NO: 135472 - protein, 35 aa, Artificial Sequence
  Description of Artificial Sequence: Synthetic polypeptide
DEEEIRTTNPVATEFYGSVNVMGNNEGQGGQENIS

SEQ ID NO: 135473 - protein, 34 aa, Artificial Sequence
  Description of Artificial Sequence: Synthetic polypeptide
DEEEIRTTNPVATEFYGSVSATMGFGGDEGDEEQ

SEQ ID NO: 135474 - protein, 30 aa, Artificial Sequence
  Description of Artificial Sequence: Synthetic polypeptide
AEDEIACTNPVAYEQWGEAYSEELQRGGER

SEQ ID NO: 135475 - protein, 32 aa, Artificial Sequence
  Description of Artificial Sequence: Synthetic polypeptide
YEEEIRCTNPAATEQYGSVSSEGGMGGQNGGT

SEQ ID NO: 135476 - protein, 34 aa, Artificial Sequence
  Description of Artificial Sequence: Synthetic polypeptide
DEEEIRTTNPVATEFYGSVMGNGFGGGEDGNINA

SEQ ID NO: 135477 - protein, 33 aa, Artificial Sequence
  Description of Artificial Sequence: Synthetic polypeptide
DEEEIRTTNPVATEQFGQCVCSSGYLLHFGSDQ

SEQ ID NO: 135478 - protein, 34 aa, Artificial Sequence
  Description of Artificial Sequence: Synthetic polypeptide
DEEEIRTTNPVATEQFGQCVCSTGYHLHFGSDQA

SEQ ID NO: 135479 - protein, 34 aa, Artificial Sequence
  Description of Artificial Sequence: Synthetic polypeptide
DEEEIRTTNPVATEFYGNVVDTVNMFDRISNGGF

SEQ ID NO: 135480 - protein, 34 aa, Artificial Sequence
  Description of Artificial Sequence: Synthetic polypeptide
DEEEIRTTNPVATEFYGNVVVGFNNNGQGGNNGD

SEQ ID NO: 135481 - protein, 34 aa, Artificial Sequence
  Description of Artificial Sequence: Synthetic polypeptide
DEEEIRTTNPVATEQFGTCVCSTYLLEHFGSEQG

SEQ ID NO: 135482 - protein, 35 aa, Artificial Sequence
  Description of Artificial Sequence: Synthetic polypeptide
DEEEIRTTNPVATEQFGTCVCSTGEDNAHFGSNQS

SEQ ID NO: 135483 - protein, 35 aa, Artificial Sequence
  Description of Artificial Sequence: Synthetic polypeptide
DEEEIRTTNPVATEFYGSVISGNFNGGQGEDNEQN

SEQ ID NO: 135484 - protein, 36 aa, Artificial Sequence
  Description of Artificial Sequence: Synthetic polypeptide
DEEEIRTTNPVATEFYGSVIVMTDNPDQQRIINGDD

SEQ ID NO: 135485 - protein, 30 aa, Artificial Sequence
  Description of Artificial Sequence: Synthetic polypeptide
DDSEVASTNPVSTEGYGNVAANTLQRVGQR

SEQ ID NO: 135486 - protein, 34 aa, Artificial Sequence
  Description of Artificial Sequence: Synthetic polypeptide
DEEEIRTTNPVATEFYGSVMGFDSGQGGEINGGT

SEQ ID NO: 135487 - protein, 31 aa, Artificial Sequence
  Description of Artificial Sequence: Synthetic polypeptide
DDSEVASTNPVSTEGYGNVAANTLQSRVGNR

SEQ ID NO: 135488 - protein, 36 aa, Artificial Sequence
  Description of Artificial Sequence: Synthetic polypeptide
DEEEIRTTNPVATEQFGSVSSWTPAGPNMRNGMNPV

SEQ ID NO: 135489 - protein, 36 aa, Artificial Sequence
  Description of Artificial Sequence: Synthetic polypeptide
DEEEIRTTNPVATEQFGSVSSTTPAGPNMRNGMNPV

SEQ ID NO: 135490 - protein, 36 aa, Artificial Sequence
  Description of Artificial Sequence: Synthetic polypeptide
DEEEIRTTNPVATEQFGSVSSTTPAGPEMRNGMNPV

SEQ ID NO: 135491 - protein, 36 aa, Artificial Sequence
  Description of Artificial Sequence: Synthetic polypeptide
DEEEIRTTNPVATEQFGSVSSDTPAGPNMRNGMNPV

SEQ ID NO: 135492 - protein, 35 aa, Artificial Sequence
  Description of Artificial Sequence: Synthetic polypeptide
DEEEIRTTNPVATEQFGSVISCGVAVSQGTGGSPR

SEQ ID NO: 135493 - protein, 35 aa, Artificial Sequence
  Description of Artificial Sequence: Synthetic polypeptide
DEEEIRTTNPVATEFYGSVMGFTDNEGEGDEGNTL

SEQ ID NO: 135494 - protein, 35 aa, Artificial Sequence
  Description of Artificial Sequence: Synthetic polypeptide
DEEEIRTTNPVATEFYGSVMGFTDNEGEGGEGQTR

SEQ ID NO: 135495 - protein, 35 aa, Artificial Sequence
  Description of Artificial Sequence: Synthetic polypeptide
DEEEIRTTNPVATEFYGSVMGINDQIGGEDTNEGG

SEQ ID NO: 135496 - protein, 35 aa, Artificial Sequence
  Description of Artificial Sequence: Synthetic polypeptide
DEEEIRTTNPVATEFYGSVMGLTQNIEGQGENNEL

SEQ ID NO: 135497 - protein, 31 aa, Artificial Sequence
  Description of Artificial Sequence: Synthetic polypeptide
AEDEIACTNPVAYEQWGWASIENLQDRGGER

SEQ ID NO: 135498 - protein, 34 aa, Artificial Sequence
  Description of Artificial Sequence: Synthetic polypeptide
DEEEIRTTNPVATEQFGQCVCSTYDLHFGSDTQA

SEQ ID NO: 135499 - protein, 35 aa, Artificial Sequence
  Description of Artificial Sequence: Synthetic polypeptide
DEEEIRTTNPVATEQFGQCVCSTGYLLHFGSDNQS

SEQ ID NO: 135500 - protein, 34 aa, Artificial Sequence
  Description of Artificial Sequence: Synthetic polypeptide
DEEEIRTTNPVATEFYGNVVDTVNMFDLFDNGGI

SEQ ID NO: 135501 - protein, 33 aa, Artificial Sequence
  Description of Artificial Sequence: Synthetic polypeptide
DEEEIRTTNPVATEQWGDVSTEIEPMNANENPV

SEQ ID NO: 135502 - protein, 30 aa, Artificial Sequence
  Description of Artificial Sequence: Synthetic polypeptide
DDSEVASTNPVSTEGYGNVSANTIQRVGQR

SEQ ID NO: 135503 - protein, 32 aa, Artificial Sequence
  Description of Artificial Sequence: Synthetic polypeptide
AEAEIACTNPVAYEQYGQASCENLSQRVGGRE

SEQ ID NO: 135504 - protein, 35 aa, Artificial Sequence
  Description of Artificial Sequence: Synthetic polypeptide
DEEEIRTTNPVAYEQYGSTVYACTGNALQVVTDSQ

SEQ ID NO: 135505 - protein, 30 aa, Artificial Sequence
  Description of Artificial Sequence: Synthetic polypeptide
YENEIRTVNPVATEQYGVVSDIEMNSAGDA

SEQ ID NO: 135506 - protein, 31 aa, Artificial Sequence
  Description of Artificial Sequence: Synthetic polypeptide
YENEIRTVNPVSTEPYGTVSMEDLQQSNGNH

SEQ ID NO: 135507 - protein, 30 aa, Artificial Sequence
  Description of Artificial Sequence: Synthetic polypeptide
DDSEVATTNPVATEGYGNVAANTIQRVEQR

SEQ ID NO: 135508 - protein, 30 aa, Artificial Sequence
  Description of Artificial Sequence: Synthetic polypeptide
YENVVEATNPVATEQYGEVASELNLQEGGQ

SEQ ID NO: 135509 - protein, 30 aa, Artificial Sequence
  Description of Artificial Sequence: Synthetic polypeptide
DDSEVATTNPVATEGYGNVAANTCQRVEQR

SEQ ID NO: 135510 - protein, 36 aa, Artificial Sequence
  Description of Artificial Sequence: Synthetic polypeptide
DEEEIRTTNPVAYEQYGSTVVACTGNWLAQVVTDSR

SEQ ID NO: 135511 - protein, 36 aa, Artificial Sequence
  Description of Artificial Sequence: Synthetic polypeptide
DEEEIRTTNPVAYEQYGQSVTANTNDLLQPPSIEKR

SEQ ID NO: 135512 - protein, 31 aa, Artificial Sequence
  Description of Artificial Sequence: Synthetic polypeptide
DDSEVASTNPVSTEQYGNVSTNTGNSRVGNV

SEQ ID NO: 135513 - protein, 31 aa, Artificial Sequence
  Description of Artificial Sequence: Synthetic polypeptide
DDSEVATTNPVATEGYGNVAANTLQSRVGQL

SEQ ID NO: 135514 - protein, 37 aa, Artificial Sequence
  Description of Artificial Sequence: Synthetic polypeptide
DEEEIRTTNPVAYEQYGQSVTSNCNDLLQPRSIEKRR

SEQ ID NO: 135515 - protein, 31 aa, Artificial Sequence
  Description of Artificial Sequence: Synthetic polypeptide
DDSEVASTNPVSTEQYGSVAATTIQSRVGQR

SEQ ID NO: 135516 - protein, 36 aa, Artificial Sequence
  Description of Artificial Sequence: Synthetic polypeptide
DEEEIRTTNPVAYEQYGQSVTSNIQDLLQPRSIEKR

SEQ ID NO: 135517 - protein, 36 aa, Artificial Sequence
  Description of Artificial Sequence: Synthetic polypeptide
DEEEIRTTNPVATEHYGSVASTTPAGPNMRNGMNPV

SEQ ID NO: 135518 - protein, 30 aa, Artificial Sequence
  Description of Artificial Sequence: Synthetic polypeptide
YEQEIASTNPVATEQYGVVSDDLEDSGEDL

SEQ ID NO: 135519 - protein, 37 aa, Artificial Sequence
  Description of Artificial Sequence: Synthetic polypeptide
DEEEIRTTNPVATEHYGSTVPSTPNEESQEMGGTQRA

SEQ ID NO: 135520 - protein, 31 aa, Artificial Sequence
  Description of Artificial Sequence: Synthetic polypeptide
YEQEIASVNPVATEQYGSVSATDLEDHGEDL

SEQ ID NO: 135521 - protein, 33 aa, Artificial Sequence
  Description of Artificial Sequence: Synthetic polypeptide
DEEEIRTTNPVATEGYGQCVCSTEHQNFISDQA

SEQ ID NO: 135522 - protein, 37 aa, Artificial Sequence
  Description of Artificial Sequence: Synthetic polypeptide
DEEEIRTTNPVAYEQYGQSVTSNTENDLLQPESAEKR

SEQ ID NO: 135523 - protein, 36 aa, Artificial Sequence
  Description of Artificial Sequence: Synthetic polypeptide
DEEEIRTTNPVAYEQYGQSVTSNTNDLLQPASIEKA

SEQ ID NO: 135524 - protein, 31 aa, Artificial Sequence
  Description of Artificial Sequence: Synthetic polypeptide
DDSEVASTNPVSTEQYGSVAANTIQSRVGQR

SEQ ID NO: 135525 - protein, 30 aa, Artificial Sequence
  Description of Artificial Sequence: Synthetic polypeptide
YENEIRTTNPVSTEPYGVISMEDIQQQGNH

SEQ ID NO: 135526 - protein, 30 aa, Artificial Sequence
  Description of Artificial Sequence: Synthetic polypeptide
DDSEVASTNPVSTEQYGNVAANTPQRVGQR

SEQ ID NO: 135527 - protein, 30 aa, Artificial Sequence
  Description of Artificial Sequence: Synthetic polypeptide
DDSEVASTNPVSTEQYGNVAANTPQREGQR

SEQ ID NO: 135528 - protein, 28 aa, Artificial Sequence
  Description of Artificial Sequence: Synthetic peptide
YENEIASVNPVCTEQYGVVSDCLQSEEL

SEQ ID NO: 135529 - protein, 34 aa, Artificial Sequence
  Description of Artificial Sequence: Synthetic polypeptide
DEEEIRTTNPVATEGYGMVTGIGNGNLNGGENGI

SEQ ID NO: 135530 - protein, 34 aa, Artificial Sequence
  Description of Artificial Sequence: Synthetic polypeptide
DEEEIRTTNPVATEHYGVVCSTDFDEINAQHYSF

SEQ ID NO: 135531 - protein, 35 aa, Artificial Sequence
  Description of Artificial Sequence: Synthetic polypeptide
DEEEIRTTNPVATEHYGSVVPSENMSSQHGGSPDF

SEQ ID NO: 135532 - protein, 31 aa, Artificial Sequence
  Description of Artificial Sequence: Synthetic polypeptide
DDSEVATTNPVATEGYGNVSATDLQDHVGEL

SEQ ID NO: 135533 - protein, 35 aa, Artificial Sequence
  Description of Artificial Sequence: Synthetic polypeptide
DEEEIRTTNPVATEHYGSVVGNIGNMSSQHGGSPR

SEQ ID NO: 135534 - protein, 30 aa, Artificial Sequence
  Description of Artificial Sequence: Synthetic polypeptide
YENEIATTNPVATEQYGVVSEILMNAAEDA

SEQ ID NO: 135535 - protein, 35 aa, Artificial Sequence
  Description of Artificial Sequence: Synthetic polypeptide
DEEEIRTTNPVATEGYGQCSCSTNENQENFNSNFA

SEQ ID NO: 135536 - protein, 29 aa, Artificial Sequence
  Description of Artificial Sequence: Synthetic peptide
YENEIATVNPVCTEPYGVISMDLQQQGNQ

SEQ ID NO: 135537 - protein, 30 aa, Artificial Sequence
  Description of Artificial Sequence: Synthetic polypeptide
YENEIATVNPVSTEPYGTVSMEDLQQSGNH

SEQ ID NO: 135538 - protein, 31 aa, Artificial Sequence
  Description of Artificial Sequence: Synthetic polypeptide
YENEIATVNPVSTEQYGTVSMEDLQQSNGNH

SEQ ID NO: 135539 - protein, 30 aa, Artificial Sequence
  Description of Artificial Sequence: Synthetic polypeptide
YENEIRSTNPVSTEPYGVISDDLQQSNGNH

SEQ ID NO: 135540 - protein, 30 aa, Artificial Sequence
  Description of Artificial Sequence: Synthetic polypeptide
YENEIRTTNPVATEQWGDVSEIEQNAAEDA

SEQ ID NO: 135541 - protein, 36 aa, Artificial Sequence
  Description of Artificial Sequence: Synthetic polypeptide
DEEEIRTTNPVATEHYGSVSSTTPPGPNHRNGMNEV

SEQ ID NO: 135542 - protein, 36 aa, Artificial Sequence
  Description of Artificial Sequence: Synthetic polypeptide
DEEEIRTTNPVATEHYGSVSSTTPAGPNMRNGMNPV

SEQ ID NO: 135543 - protein, 36 aa, Artificial Sequence
  Description of Artificial Sequence: Synthetic polypeptide
DEEEIRTTNPVATEHYGSVSSTTFAGPNMRNGMNPV

SEQ ID NO: 135544 - protein, 30 aa, Artificial Sequence
  Description of Artificial Sequence: Synthetic polypeptide
DDSEVASTNPVSTEQYGNVAANTIQSRGQR

SEQ ID NO: 135545 - protein, 36 aa, Artificial Sequence
  Description of Artificial Sequence: Synthetic polypeptide
DEEEIRTTNPVATEHYGSVSSTTEAGPNMRNGMNPV

SEQ ID NO: 135546 - protein, 34 aa, Artificial Sequence
  Description of Artificial Sequence: Synthetic polypeptide
ADEEIRTTNPVATEQWGATVSTNLEQQEGVPEGP

SEQ ID NO: 135547 - protein, 30 aa, Artificial Sequence
  Description of Artificial Sequence: Synthetic polypeptide
YENEIRTTNPVSTEPYGTISMEDIQQQGNH

SEQ ID NO: 135548 - protein, 31 aa, Artificial Sequence
  Description of Artificial Sequence: Synthetic polypeptide
DDSEVASTNPVSTEQYGNVAANTLQSRVGQR

SEQ ID NO: 135549 - protein, 33 aa, Artificial Sequence
  Description of Artificial Sequence: Synthetic polypeptide
YEQEIATTNPVATEQYGSVSATRDLEDHEGEDL

SEQ ID NO: 135550 - protein, 33 aa, Artificial Sequence
  Description of Artificial Sequence: Synthetic polypeptide
DEEEIRTTNPVATEIYGCVCSTGEHQNFISDQS

SEQ ID NO: 135551 - protein, 30 aa, Artificial Sequence
  Description of Artificial Sequence: Synthetic polypeptide
YESEIASTNPVCTEGYGVVADNIQSRVGQR

SEQ ID NO: 135552 - protein, 31 aa, Artificial Sequence
  Description of Artificial Sequence: Synthetic polypeptide
YESEIASTNPVCTEQWGVVSDINLQDSGENQ

SEQ ID NO: 135553 - protein, 30 aa, Artificial Sequence
  Description of Artificial Sequence: Synthetic polypeptide
YETEIASVNPVCTEQYGVVSNDNLQESGPQ

SEQ ID NO: 135554 - protein, 35 aa, Artificial Sequence
  Description of Artificial Sequence: Synthetic polypeptide
DEEEIRTTNPVATEGYGSVMGQNMEDEQGGENEGI

SEQ ID NO: 135555 - protein, 30 aa, Artificial Sequence
  Description of Artificial Sequence: Synthetic polypeptide
YETEIATTNPICTEQYGVVSNDDLQESGPQ

SEQ ID NO: 135556 - protein, 36 aa, Artificial Sequence
  Description of Artificial Sequence: Synthetic polypeptide
DEEEIRTTNPVATEGYGSVMGSGNLNNMNGGENGIS

SEQ ID NO: 135557 - protein, 34 aa, Artificial Sequence
  Description of Artificial Sequence: Synthetic polypeptide
DEEEIRTTNPVATEGYGSVMGTDPQEIADGGGGI

SEQ ID NO: 135558 - protein, 35 aa, Artificial Sequence
  Description of Artificial Sequence: Synthetic polypeptide
DEEEIRTTNPVATEGYGSVMGTNLISEGGGGQGTT

SEQ ID NO: 135559 - protein, 33 aa, Artificial Sequence
  Description of Artificial Sequence: Synthetic polypeptide
YETEIRTTNPVATEAYGSVSTAGVGEDEFGNGT

SEQ ID NO: 135560 - protein, 35 aa, Artificial Sequence
  Description of Artificial Sequence: Synthetic polypeptide
DEEEIRTTNPVATEGYGSVMGTNLISNGGGGEQTD

SEQ ID NO: 135561 - protein, 35 aa, Artificial Sequence
  Description of Artificial Sequence: Synthetic polypeptide
DEEEIRTTNPVATEGYGSVMNDLEGGGGQGTGNGE

SEQ ID NO: 135562 - protein, 34 aa, Artificial Sequence
  Description of Artificial Sequence: Synthetic polypeptide
DEEEIRTTNPVATEGYGSVMGQFTVGGQNNGGGE

SEQ ID NO: 135563 - protein, 36 aa, Artificial Sequence
  Description of Artificial Sequence: Synthetic polypeptide
DEEEIRTTNPVATEGYGSVMSGINNNDLGEGEGNGD

SEQ ID NO: 135564 - protein, 35 aa, Artificial Sequence
  Description of Artificial Sequence: Synthetic polypeptide
DEEEIRTTNPVATEGYGSVNMNGELQNEGMGEGTT

SEQ ID NO: 135565 - protein, 36 aa, Artificial Sequence
  Description of Artificial Sequence: Synthetic polypeptide
DEEEIRTTNPVAYEQYGQVVSFQMNDLLQPRTQIDR

SEQ ID NO: 135566 - protein, 36 aa, Artificial Sequence
  Description of Artificial Sequence: Synthetic polypeptide
DEEEIRTTNPVAYEQYGQVVSFQMNDLLQPNGQIAR

SEQ ID NO: 135567 - protein, 35 aa, Artificial Sequence
  Description of Artificial Sequence: Synthetic polypeptide
DEEEIRTTNPVATEGYGSVQSDFNNGQGEEQGEDE

SEQ ID NO: 135568 - protein, 36 aa, Artificial Sequence
  Description of Artificial Sequence: Synthetic polypeptide
DEEEIRTTNPVATEGYGSVSSTTPYGPNMRNGMNPV

SEQ ID NO: 135569 - protein, 35 aa, Artificial Sequence
  Description of Artificial Sequence: Synthetic polypeptide
DEEEIRTTNPVAYEQYGQVTTAATNDLLQRSQIEE

SEQ ID NO: 135570 - protein, 37 aa, Artificial Sequence
  Description of Artificial Sequence: Synthetic polypeptide
DEEEIRTTNPVATEGYGSVSSTTPANGPNMRNGMNPV

SEQ ID NO: 135571 - protein, 36 aa, Artificial Sequence
  Description of Artificial Sequence: Synthetic polypeptide
DEEEIRTTNPVATEGYGSVSSTTPAGPNMRNGMNPV

SEQ ID NO: 135572 - protein, 36 aa, Artificial Sequence
  Description of Artificial Sequence: Synthetic polypeptide
DEEEIRTTNPVATEGYGSVSSTTPAGPNMRFGMNIV

SEQ ID NO: 135573 - protein, 34 aa, Artificial Sequence
  Description of Artificial Sequence: Synthetic polypeptide
DEEEIRTTNPVATEGYGSVMTDVGMGNEGQENEQ

SEQ ID NO: 135574 - protein, 34 aa, Artificial Sequence
  Description of Artificial Sequence: Synthetic polypeptide
DEEEIRTTNPVATEGYGSVMGQFNGEQVNAGGGQ

SEQ ID NO: 135575 - protein, 29 aa, Artificial Sequence
  Description of Artificial Sequence: Synthetic peptide
YESEVASVNPVCTEQYGVVANNLQRVGQQ

SEQ ID NO: 135576 - protein, 35 aa, Artificial Sequence
  Description of Artificial Sequence: Synthetic polypeptide
DEEEIRTTNPVAYEQYGSSVSNTVGSLEINEGQFQ

SEQ ID NO: 135577 - protein, 34 aa, Artificial Sequence
  Description of Artificial Sequence: Synthetic polypeptide
DEEEIRTTNPVATEGYGVVDIGGNGEQTTGGNIT

SEQ ID NO: 135578 - protein, 31 aa, Artificial Sequence
  Description of Artificial Sequence: Synthetic polypeptide
YESEIASVNPVATECYGVVSCINEQDRGENG

SEQ ID NO: 135579 - protein, 35 aa, Artificial Sequence
  Description of Artificial Sequence: Synthetic polypeptide
DEEEIRTTNPVATEGYGSVDNSANGQENGGEDGED

SEQ ID NO: 135580 - protein, 35 aa, Artificial Sequence
  Description of Artificial Sequence: Synthetic polypeptide
DEEEIRTTNPVATEGYGSVDNSANGQENTGGEDDE

SEQ ID NO: 135581 - protein, 34 aa, Artificial Sequence
  Description of Artificial Sequence: Synthetic polypeptide
DEEEIRTTNPVATEGYGSVDNSDIGQQTGQEDGD

SEQ ID NO: 135582 - protein, 29 aa, Artificial Sequence
  Description of Artificial Sequence: Synthetic peptide
YESEIASVNPVSTEGYGNVSNNLQSVGQQ

SEQ ID NO: 135583 - protein, 35 aa, Artificial Sequence
  Description of Artificial Sequence: Synthetic polypeptide
DEEEIRTTNPVATEGYGSVTMTNGIGQEDDGEEEG

SEQ ID NO: 135584 - protein, 37 aa, Artificial Sequence
  Description of Artificial Sequence: Synthetic polypeptide
DEEEIRTTNPVAYEQYGQVAASFQMNDLLQPRGQIRN

SEQ ID NO: 135585 - protein, 35 aa, Artificial Sequence
  Description of Artificial Sequence: Synthetic polypeptide
DEEEIRTTNPVATEGYGSVDTTANNMTGTGGNGGT

SEQ ID NO: 135586 - protein, 36 aa, Artificial Sequence
  Description of Artificial Sequence: Synthetic polypeptide
DEEEIRTTNPVATEGYGSVDTVNNMNQGGEFENGDE

SEQ ID NO: 135587 - protein, 35 aa, Artificial Sequence
  Description of Artificial Sequence: Synthetic polypeptide
DEEEIRTTNPVATEGYGSVMDDEGTGGGQTTGNGE

SEQ ID NO: 135588 - protein, 34 aa, Artificial Sequence
  Description of Artificial Sequence: Synthetic polypeptide
YESEIRTTNPVATECWGSVSCINEPQDREGENGT

SEQ ID NO: 135589 - protein, 36 aa, Artificial Sequence
  Description of Artificial Sequence: Synthetic polypeptide
DEEEIRTTNPVATEGYGSVMDDNLGDGGGQTTGNIG

SEQ ID NO: 135590 - protein, 35 aa, Artificial Sequence
  Description of Artificial Sequence: Synthetic polypeptide
DEEEIRTTNPVATEGYGSVMDLGMEGGNLGEGGNT

SEQ ID NO: 135591 - protein, 35 aa, Artificial Sequence
  Description of Artificial Sequence: Synthetic polypeptide
DEEEIRTTNPVAYEQYGQVAHCTPNLSGKGGDSRY

SEQ ID NO: 135592 - protein, 33 aa, Artificial Sequence
  Description of Artificial Sequence: Synthetic polypeptide
YESEIRTTNPVCTEQWGVVSDINLPQDSEGENG

SEQ ID NO: 135593 - protein, 35 aa, Artificial Sequence
  Description of Artificial Sequence: Synthetic polypeptide
DEEEIRTTNPVATEGYGSVMGDNSGQGGGGENIQN

SEQ ID NO: 135594 - protein, 35 aa, Artificial Sequence
  Description of Artificial Sequence: Synthetic polypeptide
DEEEIRTTNPVATEGYGSVMGIGNLNDNGDENGQT

SEQ ID NO: 135595 - protein, 32 aa, Artificial Sequence
  Description of Artificial Sequence: Synthetic polypeptide
YESEIRTVNPVATECWGVVSCINEQDREGENG

SEQ ID NO: 135596 - protein, 31 aa, Artificial Sequence
  Description of Artificial Sequence: Synthetic polypeptide
YESEIRTVNPVATECWGVVSDINEPQSEGNQ

SEQ ID NO: 135597 - protein, 34 aa, Artificial Sequence
  Description of Artificial Sequence: Synthetic polypeptide
DEEEIRTTNPVATEGYGSVMGNFNMGQGGEQEEA

SEQ ID NO: 135598 - protein, 31 aa, Artificial Sequence
  Description of Artificial Sequence: Synthetic polypeptide
YESEIASTNPVCTEQWGVVSDINLQDSGENG

SEQ ID NO: 135599 - protein, 30 aa, Artificial Sequence
  Description of Artificial Sequence: Synthetic polypeptide
DDSEVASTNPVSTEGYGNVSANTIQSRGQR

SEQ ID NO: 135600 - protein, 34 aa, Artificial Sequence
  Description of Artificial Sequence: Synthetic polypeptide
DEEEIRTTNPVATEGYGMVSNMQDTGEFTGGGNE

SEQ ID NO: 135601 - protein, 35 aa, Artificial Sequence
  Description of Artificial Sequence: Synthetic polypeptide
DEEEIRTTNPVATEGYGMVSNMDTGGQQIGGNGEG

SEQ ID NO: 135602 - protein, 34 aa, Artificial Sequence
  Description of Artificial Sequence: Synthetic polypeptide
DEEEIRTTNPVATEGYGCVCSTGEHQFFNSEFQS

SEQ ID NO: 135603 - protein, 34 aa, Artificial Sequence
  Description of Artificial Sequence: Synthetic polypeptide
DEEEIRTTNPVATEGYGCVCSTPEPQENFNSEQS

SEQ ID NO: 135604 - protein, 34 aa, Artificial Sequence
  Description of Artificial Sequence: Synthetic polypeptide
DEEEIRTTNPVATEGYGCVCSTTGEHTGFNSEQA

SEQ ID NO: 135605 - protein, 36 aa, Artificial Sequence
  Description of Artificial Sequence: Synthetic polypeptide
DEEEIRTTNPVATEPWGTVISCTINPLSQVRVQNNN

SEQ ID NO: 135606 - protein, 34 aa, Artificial Sequence
  Description of Artificial Sequence: Synthetic polypeptide
DEEEIRTTNPVATEGYGCVCSWEDHQNFGSENQD

SEQ ID NO: 135607 - protein, 33 aa, Artificial Sequence
  Description of Artificial Sequence: Synthetic polypeptide
DEEEIRTTNPVATEGYGCVCSWEEHQNFNSQQS

SEQ ID NO: 135608 - protein, 30 aa, Artificial Sequence
  Description of Artificial Sequence: Synthetic polypeptide
YEEEVASTNPVCTEGYGVVANTLQSRVGNQ

SEQ ID NO: 135609 - protein, 33 aa, Artificial Sequence
  Description of Artificial Sequence: Synthetic polypeptide
DEEEIRTTNPVATEGYGCVCSWGEHQNFNSDQM

SEQ ID NO: 135610 - protein, 32 aa, Artificial Sequence
  Description of Artificial Sequence: Synthetic polypeptide
DEEEIRTTNPVATEGYGDVGVGNMTDGGGGQG

SEQ ID NO: 135611 - protein, 28 aa, Artificial Sequence
  Description of Artificial Sequence: Synthetic peptide
DDSEVATTNPVSTEGYGDVANTIQHGQR

SEQ ID NO: 135612 - protein, 35 aa, Artificial Sequence
  Description of Artificial Sequence: Synthetic polypeptide
DEEEIRTTNPVATEGYGICVCSSVNDQERFISNQA

SEQ ID NO: 135613 - protein, 36 aa, Artificial Sequence
  Description of Artificial Sequence: Synthetic polypeptide
DEEEIRTTNPVATENYGSVSSTTPAGPNMRNGMNPV

SEQ ID NO: 135614 - protein, 37 aa, Artificial Sequence
  Description of Artificial Sequence: Synthetic polypeptide
DEEEIRTTNPVAYEQYGSVPNTTLASGSNQRNGGNPV

SEQ ID NO: 135615 - protein, 30 aa, Artificial Sequence
  Description of Artificial Sequence: Synthetic polypeptide
DDSEVATTNPVSTECYGNVAANTIQSRGQR

SEQ ID NO: 135616 - protein, 36 aa, Artificial Sequence
  Description of Artificial Sequence: Synthetic polypeptide
DEEEIRTTNPVATENYGSVSSTTPAGPNMRNGHNPV

SEQ ID NO: 135617 - protein, 36 aa, Artificial Sequence
  Description of Artificial Sequence: Synthetic polypeptide
DEEEIRTTNPVATENYGSVSSTTPAFPNMRNGMNPV

SEQ ID NO: 135618 - protein, 36 aa, Artificial Sequence
  Description of Artificial Sequence: Synthetic polypeptide
DEEEIRTTNPVATENYGSVSPTTPAGPNMRNGMNPV

SEQ ID NO: 135619 - protein, 32 aa, Artificial Sequence
  Description of Artificial Sequence: Synthetic polypeptide
DDSEVATTNPVATEQYGNVSANTIQSHVGQDR

SEQ ID NO: 135620 - protein, 32 aa, Artificial Sequence
  Description of Artificial Sequence: Synthetic polypeptide
DDSEVATTNPVATEQYGNVSANTIQSHEGQDR

SEQ ID NO: 135621 - protein, 34 aa, Artificial Sequence
  Description of Artificial Sequence: Synthetic polypeptide
DEEEIRTTNPVATEGYGICVCSTVEDQENISNQS

SEQ ID NO: 135622 - protein, 36 aa, Artificial Sequence
  Description of Artificial Sequence: Synthetic polypeptide
DEEEIRTTNPVATENYGSVSSTTPAGPNMRNGMNTV

SEQ ID NO: 135623 - protein, 34 aa, Artificial Sequence
  Description of Artificial Sequence: Synthetic polypeptide
DEEEIRTTNPVATEGYGCVCSTGEHNQNFNSEQS

SEQ ID NO: 135624 - protein, 33 aa, Artificial Sequence
  Description of Artificial Sequence: Synthetic polypeptide
DEEEIRTTNPVATEGYGCVCSTEHQNFPSETQS

SEQ ID NO: 135625 - protein, 34 aa, Artificial Sequence
  Description of Artificial Sequence: Synthetic polypeptide
DEEEIRTTNPVATEGYGCVCSTEHQENFGSDFQS

SEQ ID NO: 135626 - protein, 32 aa, Artificial Sequence
  Description of Artificial Sequence: Synthetic polypeptide
AEAEIACTNPVAYEQYGIEASCENLSQRVGGR

SEQ ID NO: 135627 - protein, 32 aa, Artificial Sequence
  Description of Artificial Sequence: Synthetic polypeptide
AEAEIACTNPVAYEQYGETSCENLSQRVGGRS

SEQ ID NO: 135628 - protein, 32 aa, Artificial Sequence
  Description of Artificial Sequence: Synthetic polypeptide
AEAEIACTNPVAYEQYGEASCENLSQRPGGNS

SEQ ID NO: 135629 - protein, 34 aa, Artificial Sequence
  Description of Artificial Sequence: Synthetic polypeptide
DEEEIRTTNPVATEGYGCVCSNTGYHQNFNSDQY

SEQ ID NO: 135630 - protein, 32 aa, Artificial Sequence
  Description of Artificial Sequence: Synthetic polypeptide
AEAEIACTNPVAYEQYGEAQSCQNLSQRVGGR

SEQ ID NO: 135631 - protein, 31 aa, Artificial Sequence
  Description of Artificial Sequence: Synthetic polypeptide
DDSEVASTNPVSTEGYGNVSANTLQSRVGQR

SEQ ID NO: 135632 - protein, 31 aa, Artificial Sequence
  Description of Artificial Sequence: Synthetic polypeptide
AEAEIACTNPVAYEQYGEAFCENLSQRVGDR

SEQ ID NO: 135633 - protein, 30 aa, Artificial Sequence
  Description of Artificial Sequence: Synthetic polypeptide
AEAEIACTNPCSYEQYGCVSWNLQSGNEQA

SEQ ID NO: 135634 - protein, 31 aa, Artificial Sequence
  Description of Artificial Sequence: Synthetic polypeptide
AEAEIAATNPVAYEQYGEASCENISQRVGGR

SEQ ID NO: 135635 - protein, 33 aa, Artificial Sequence
  Description of Artificial Sequence: Synthetic polypeptide
AEADEIATTNPVAYEPWGSVSTTNLQQDGNLGQ

SEQ ID NO: 135636 - protein, 29 aa, Artificial Sequence
  Description of Artificial Sequence: Synthetic peptide
ADSEIASTNPVATEGYGNVANTIQSRGQR

SEQ ID NO: 135637 - protein, 36 aa, Artificial Sequence
  Description of Artificial Sequence: Synthetic polypeptide
DEEEIRTTNPVAYEQYGSVPSTTPRGSTTRNGGNPW

SEQ ID NO: 135638 - protein, 36 aa, Artificial Sequence
  Description of Artificial Sequence: Synthetic polypeptide
DEEEIRTTNPVAYEQYGSVPSTTPAGSNTRTGTNPV

SEQ ID NO: 135639 - protein, 36 aa, Artificial Sequence
  Description of Artificial Sequence: Synthetic polypeptide
DEEEIRTTNPVAYEQYGSVPSTTPAGSNTANGGNPV

SEQ ID NO: 135640 - protein, 37 aa, Artificial Sequence
  Description of Artificial Sequence: Synthetic polypeptide
DEEEIRTTNPVAYEQYGSVPSTTPAGSNQRNGGNPVD

SEQ ID NO: 135641 - protein, 36 aa, Artificial Sequence
  Description of Artificial Sequence: Synthetic polypeptide
DEEEIRTTNPVAYEQYGSVPSTTPAGSFTRNGGNPD

SEQ ID NO: 135642 - protein, 36 aa, Artificial Sequence
  Description of Artificial Sequence: Synthetic polypeptide
DEEEIRTTNPVAYEQYGSVPSTTPAGPTMRNGGNNV

SEQ ID NO: 135643 - protein, 36 aa, Artificial Sequence
  Description of Artificial Sequence: Synthetic polypeptide
DEEEIRTTNPVAYEQYGSVPSTTPAGPTARTGGNPL

SEQ ID NO: 135644 - protein, 31 aa, Artificial Sequence
  Description of Artificial Sequence: Synthetic polypeptide
ADSEIACTNPVATEGYGEVSAETLQSRVGGR

SEQ ID NO: 135645 - protein, 31 aa, Artificial Sequence
  Description of Artificial Sequence: Synthetic polypeptide
DDSEVASTNPVSTEGYGNVSATDLQSRVGQR

SEQ ID NO: 135646 - protein, 32 aa, Artificial Sequence
  Description of Artificial Sequence: Synthetic polypeptide
DEEEIRTTNPVATEGYGCVCSSEHTGFNSEQA

SEQ ID NO: 135647 - protein, 29 aa, Artificial Sequence
  Description of Artificial Sequence: Synthetic peptide
ADNEIACTNPVATEGYGNAAAENIQRGGR

SEQ ID NO: 135648 - protein, 30 aa, Artificial Sequence
  Description of Artificial Sequence: Synthetic polypeptide
YENEIASTNPVCTEQWGVVSDILQNAAGNQ

SEQ ID NO: 135649 - protein, 31 aa, Artificial Sequence
  Description of Artificial Sequence: Synthetic polypeptide
DDSEVATTNPVATEQYGNVCAANTPQREGQD

SEQ ID NO: 135650 - protein, 31 aa, Artificial Sequence
  Description of Artificial Sequence: Synthetic polypeptide
DDSEVASTNPVSTEGYGSVAANTLQSRVGQR

SEQ ID NO: 135651 - protein, 34 aa, Artificial Sequence
  Description of Artificial Sequence: Synthetic polypeptide
DEEEIRTTNPVAYEQYGSVCAAANGLQSEHQPDS

SEQ ID NO: 135652 - protein, 33 aa, Artificial Sequence
  Description of Artificial Sequence: Synthetic polypeptide
DEEEIRTTNPVAYEQYGSVCAAANGLDSETPDS

SEQ ID NO: 135653 - protein, 36 aa, Artificial Sequence
  Description of Artificial Sequence: Synthetic polypeptide
DEEEIRTTNPVATEKYGSVSSTTPAGPNMRNGMNPV

SEQ ID NO: 135654 - protein, 33 aa, Artificial Sequence
  Description of Artificial Sequence: Synthetic polypeptide
DEEEIRTTNPVAYEQYGSVCAAANGDQSEVPHS

SEQ ID NO: 135655 - protein, 33 aa, Artificial Sequence
  Description of Artificial Sequence: Synthetic polypeptide
DEEEIRTTNPVAYEQYGSVCAAANGDQSEVDDD

SEQ ID NO: 135656 - protein, 36 aa, Artificial Sequence
  Description of Artificial Sequence: Synthetic polypeptide
DEEEIRTTNPVATEKYGSVSSTTPAGPNMRNGMNPC

SEQ ID NO: 135657 - protein, 36 aa, Artificial Sequence
  Description of Artificial Sequence: Synthetic polypeptide
DEEEIRTTNPVATEKYGSVSSTTPAGPNMANGMNPV

SEQ ID NO: 135658 - protein, 35 aa, Artificial Sequence
  Description of Artificial Sequence: Synthetic polypeptide
DEEEIRTTNPVATEGYGMVNNIGNGNLQENNGGNQ

SEQ ID NO: 135659 - protein, 34 aa, Artificial Sequence
  Description of Artificial Sequence: Synthetic polypeptide
DEEEIRTTNPVATEGYGMVNNIGTNDDENNGGNQ

SEQ ID NO: 135660 - protein, 34 aa, Artificial Sequence
  Description of Artificial Sequence: Synthetic polypeptide
DEEEIRTTNPVAYEQYGSVCAAANVDQQAEANDS

SEQ ID NO: 135661 - protein, 35 aa, Artificial Sequence
  Description of Artificial Sequence: Synthetic polypeptide
DEEEIRTTNPVATEGYGMVNNSDTNDEMNGGENQG

SEQ ID NO: 135662 - protein, 30 aa, Artificial Sequence
  Description of Artificial Sequence: Synthetic polypeptide
DDSEVASTNPVSTEGYGVVAANTLQRVGQR

SEQ ID NO: 135663 - protein, 31 aa, Artificial Sequence
  Description of Artificial Sequence: Synthetic polypeptide
YEMEIASTNPVCTEQYGVVSADDGLVQSGNQ

SEQ ID NO: 135664 - protein, 36 aa, Artificial Sequence
  Description of Artificial Sequence: Synthetic polypeptide
DEEEIRTTNPVATEGYGMVNNSGMGNNLQENNGQNN

SEQ ID NO: 135665 - protein, 28 aa, Artificial Sequence
  Description of Artificial Sequence: Synthetic peptide
DDSEVASTNPVSTEGYGVVANTIQRGQR

SEQ ID NO: 135666 - protein, 31 aa, Artificial Sequence
  Description of Artificial Sequence: Synthetic polypeptide
YEMEIASTNPVCTEQYGVVSADDNLVESGNQ

SEQ ID NO: 135667 - protein, 31 aa, Artificial Sequence
  Description of Artificial Sequence: Synthetic polypeptide
YEMEIASVNPVATEQYGTVSATDGPVQFGND

SEQ ID NO: 135668 - protein, 36 aa, Artificial Sequence
  Description of Artificial Sequence: Synthetic polypeptide
DEEEIRTTNPVATEIYGSVSSTTPAGPNTRNGMNPV

SEQ ID NO: 135669 - protein, 36 aa, Artificial Sequence
  Description of Artificial Sequence: Synthetic polypeptide
DEEEIRTTNPVATEIYGSVSSTTPAGPNMRNGMNPV

SEQ ID NO: 135670 - protein, 36 aa, Artificial Sequence
  Description of Artificial Sequence: Synthetic polypeptide
DEEEIRTTNPVATEIYGSVSSTTPAGPNMRNGDNPV

SEQ ID NO: 135671 - protein, 30 aa, Artificial Sequence
  Description of Artificial Sequence: Synthetic polypeptide
DDSEVASTNPVSTEGYGVVAANTLQRVGDR

SEQ ID NO: 135672 - protein, 34 aa, Artificial Sequence
  Description of Artificial Sequence: Synthetic polypeptide
DEEEIRTTNPVATEGYGMVNGQGTNQEGGGINGT

SEQ ID NO: 135673 - protein, 35 aa, Artificial Sequence
  Description of Artificial Sequence: Synthetic polypeptide
DEEEIRTTNPVATEGYGMVNGQGTNIQTGGGNNGQ

SEQ ID NO: 135674 - protein, 36 aa, Artificial Sequence
  Description of Artificial Sequence: Synthetic polypeptide
DEEEIRTTNPVATEKYGSVSWTTPAGPNMRNGMNPV

SEQ ID NO: 135675 - protein, 31 aa, Artificial Sequence
  Description of Artificial Sequence: Synthetic polypeptide
DDSEVATTNPVATEGYGNVSCTIQSRVGEQR

SEQ ID NO: 135676 - protein, 35 aa, Artificial Sequence
  Description of Artificial Sequence: Synthetic polypeptide
DEEEIRTTNPVATEGYGICVCSTVNLQENFISQTQ

SEQ ID NO: 135677 - protein, 31 aa, Artificial Sequence
  Description of Artificial Sequence: Synthetic polypeptide
DDSEVASTNPVSTEGYGSVSANTINSRNGNR

SEQ ID NO: 135678 - protein, 36 aa, Artificial Sequence
  Description of Artificial Sequence: Synthetic polypeptide
DEEEIRTTNPVATEMYGSVSSTTPATPNMRNGMNPV

SEQ ID NO: 135679 - protein, 36 aa, Artificial Sequence
  Description of Artificial Sequence: Synthetic polypeptide
DEEEIRTTNPVATEMYGSVSSTTPAGPNMRNGMNPV

SEQ ID NO: 135680 - protein, 36 aa, Artificial Sequence
  Description of Artificial Sequence: Synthetic polypeptide
DEEEIRTTNPVATEMYGSVSSTRPAGPNMRNGMNPV

SEQ ID NO: 135681 - protein, 35 aa, Artificial Sequence
  Description of Artificial Sequence: Synthetic polypeptide
DEEEIRTTNPVATEMYGSAASCLQNLTLRFGEPLQ

SEQ ID NO: 135682 - protein, 34 aa, Artificial Sequence
  Description of Artificial Sequence: Synthetic polypeptide
DEEEIRTTNPVATELYGYVYSNVSDCIQKCLDRN

SEQ ID NO: 135683 - protein, 34 aa, Artificial Sequence
  Description of Artificial Sequence: Synthetic polypeptide
YEETICTTNPVATEQYGSVSIMNGFQGGNGNDSG

SEQ ID NO: 135684 - protein, 33 aa, Artificial Sequence
  Description of Artificial Sequence: Synthetic polypeptide
DEEEIRTTNPVATELYGSVYSVSDCIQKCLDSF

SEQ ID NO: 135685 - protein, 33 aa, Artificial Sequence
  Description of Artificial Sequence: Synthetic polypeptide
DEEEIRTTNPVATELYGSVYSVSDCIPKCLDGR

SEQ ID NO: 135686 - protein, 31 aa, Artificial Sequence
  Description of Artificial Sequence: Synthetic polypeptide
YEEVIRCTNPVATDWSGYNPSPTPQQRGGNR

SEQ ID NO: 135687 - protein, 28 aa, Artificial Sequence
  Description of Artificial Sequence: Synthetic peptide
YEGEIAPTNPCSSEQYGIVCCNLQSTTR

SEQ ID NO: 135688 - protein, 34 aa, Artificial Sequence
  Description of Artificial Sequence: Synthetic polypeptide
DEEEIRTTNPVATEGYGMVDIGNQGQEGGEGNIE

SEQ ID NO: 135689 - protein, 34 aa, Artificial Sequence
  Description of Artificial Sequence: Synthetic polypeptide
DEEEIRTTNPVATEGYGMVDIGNVGQEGGEDNDE

SEQ ID NO: 135690 - protein, 29 aa, Artificial Sequence
  Description of Artificial Sequence: Synthetic peptide
DDSEVASTNPVSTEGYGVMAASTLQRGQR

SEQ ID NO: 135691 - protein, 36 aa, Artificial Sequence
  Description of Artificial Sequence: Synthetic polypeptide
DEEEIRTTNPVATELYGSVSSTTPAGPNMRNGMNPV

SEQ ID NO: 135692 - protein, 36 aa, Artificial Sequence
  Description of Artificial Sequence: Synthetic polypeptide
DEEEIRTTNPVATELYGSVSSTQPAGPNMRNGMNPV

SEQ ID NO: 135693 - protein, 35 aa, Artificial Sequence
  Description of Artificial Sequence: Synthetic polypeptide
DEEEIRTTNPVAYEQYGSVCSATLALQNHPDAEAN

SEQ ID NO: 135694 - protein, 35 aa, Artificial Sequence
  Description of Artificial Sequence: Synthetic polypeptide
DEEEIRTTNPVAYEQYGSVCQAANPLQAAEHANDQ

SEQ ID NO: 135695 - protein, 35 aa, Artificial Sequence
  Description of Artificial Sequence: Synthetic polypeptide
DEEEIRTTNPVATEGYGMVNGQGTNIQGEGGGNGQ

SEQ ID NO: 135696 - protein, 34 aa, Artificial Sequence
  Description of Artificial Sequence: Synthetic polypeptide
DEEEIRTTNPVATEGYGICVCSTVNDQENFISEQ

SEQ ID NO: 135697 - protein, 36 aa, Artificial Sequence
  Description of Artificial Sequence: Synthetic polypeptide
WEEEIRTTNPVATEQYGSVSSTTPAGPNMRNGMNPM

SEQ ID NO: 135698 - protein, 33 aa, Artificial Sequence
  Description of Artificial Sequence: Synthetic polypeptide
AEDEICATNPVATEQYGVVATSEGNNLQSGNGD

SEQ ID NO: 135699 - protein, 31 aa, Artificial Sequence
  Description of Artificial Sequence: Synthetic polypeptide
DDSEVATTNPVSTEQYGNVAANGIQSREGQR

SEQ ID NO: 135700 - protein, 34 aa, Artificial Sequence
  Description of Artificial Sequence: Synthetic polypeptide
DEEEIRTTNPVGYEQWGSVVSCTGQPSARGNNDN

SEQ ID NO: 135701 - protein, 34 aa, Artificial Sequence
  Description of Artificial Sequence: Synthetic polypeptide
DEEEIRTTNPVGYEQWGSVVSCTGMEPSARGNND

SEQ ID NO: 135702 - protein, 33 aa, Artificial Sequence
  Description of Artificial Sequence: Synthetic polypeptide
DEEEIRTTNPVGYEQWGSVVSCTGEPSATGNND

SEQ ID NO: 135703 - protein, 33 aa, Artificial Sequence
  Description of Artificial Sequence: Synthetic polypeptide
DEEEIRTTNPVGYEQWGCVVSCTGEPSARGNNI

SEQ ID NO: 135704 - protein, 36 aa, Artificial Sequence
  Description of Artificial Sequence: Synthetic polypeptide
DEEEIRTTNPVAYEQYGQSVCSSNDLNQENFGSQQN

SEQ ID NO: 135705 - protein, 36 aa, Artificial Sequence
  Description of Artificial Sequence: Synthetic polypeptide
DEEEIRTTNPVATEQYGAVNNLTNHNDEEGNTEIRP

SEQ ID NO: 135706 - protein, 31 aa, Artificial Sequence
  Description of Artificial Sequence: Synthetic polypeptide
YEEEIASTNPVSTEPYGVVSMEDLQQSNGNH

SEQ ID NO: 135707 - protein, 34 aa, Artificial Sequence
  Description of Artificial Sequence: Synthetic polypeptide
DEEEIRTTNPVGTEQYGVVVSCLGHEPARGGNNE

SEQ ID NO: 135708 - protein, 34 aa, Artificial Sequence
  Description of Artificial Sequence: Synthetic polypeptide
DEEEIRTTNPVATEQYGAVMSDNNMGEGEGTETG

SEQ ID NO: 135709 - protein, 34 aa, Artificial Sequence
  Description of Artificial Sequence: Synthetic polypeptide
DEEEIRTTNPVGYEQWGSVVVSCTGMPSPRGNND

SEQ ID NO: 135710 - protein, 34 aa, Artificial Sequence
  Description of Artificial Sequence: Synthetic polypeptide
DEEEIRTTNPVATEQYGAVMSDNNFGEGGTEGTT

SEQ ID NO: 135711 - protein, 36 aa, Artificial Sequence
  Description of Artificial Sequence: Synthetic polypeptide
DEEEIRTTNPVATEQYGAVMSDMNFNEEGGGQRGIP

SEQ ID NO: 135712 - protein, 36 aa, Artificial Sequence
  Description of Artificial Sequence: Synthetic polypeptide
DEEEIRTTNPVATEQYGAVMSDGVNDQLEGGQENGQ

SEQ ID NO: 135713 - protein, 35 aa, Artificial Sequence
  Description of Artificial Sequence: Synthetic polypeptide
DEEEIRTTNPVATEQYGAVMSDGNFGQEDTGEGTD

SEQ ID NO: 135714 - protein, 34 aa, Artificial Sequence
  Description of Artificial Sequence: Synthetic polypeptide
DEEEIRTTNPVATEQYGAVMGVNMEQEGGGEGGI

SEQ ID NO: 135715 - protein, 35 aa, Artificial Sequence
  Description of Artificial Sequence: Synthetic polypeptide
DEEEIRTTNPVATEQYGAVMGNLVGGNGQTTNQGS

SEQ ID NO: 135716 - protein, 33 aa, Artificial Sequence
  Description of Artificial Sequence: Synthetic polypeptide
DEEEIRTTNPVATEQYGAVMGNEMGGGGEGGTG

SEQ ID NO: 135717 - protein, 35 aa, Artificial Sequence
  Description of Artificial Sequence: Synthetic polypeptide
DEEEIRTTNPVATEQYGAVMGGLEMEQENGGNGGI

SEQ ID NO: 135718 - protein, 31 aa, Artificial Sequence
  Description of Artificial Sequence: Synthetic polypeptide
YEEEIASVNPIATEQWGVTVSNDENLQSGNI

SEQ ID NO: 135719 - protein, 30 aa, Artificial Sequence
  Description of Artificial Sequence: Synthetic polypeptide
YEEEIASVNPIATEQYGAVSDENLAESGPQ

SEQ ID NO: 135720 - protein, 36 aa, Artificial Sequence
  Description of Artificial Sequence: Synthetic polypeptide
DEEEIRTTNPVATEQYGAVMSDMNLNQQGEGQEITG

SEQ ID NO: 135721 - protein, 33 aa, Artificial Sequence
  Description of Artificial Sequence: Synthetic polypeptide
DEEEIRTTNPVGYEQYGAVVCCDNELGRNVGSP

SEQ ID NO: 135722 - protein, 34 aa, Artificial Sequence
  Description of Artificial Sequence: Synthetic polypeptide
DEEEIRTTNPVATEQYGAVNNSDDLEFEEGGEDT

SEQ ID NO: 135723 - protein, 32 aa, Artificial Sequence
  Description of Artificial Sequence: Synthetic polypeptide
YEEEIASTNPVCTEQYGVVWSNDENLAEPGNQ

SEQ ID NO: 135724 - protein, 35 aa, Artificial Sequence
  Description of Artificial Sequence: Synthetic polypeptide
DEEEIRTTNPVATEQYGAVSGDGNIQDEGGQEDTF

SEQ ID NO: 135725 - protein, 36 aa, Artificial Sequence
  Description of Artificial Sequence: Synthetic polypeptide
AEDEIRATNPVATEQYGSVSTTNQNLQNSNGTNQQD

SEQ ID NO: 135726 - protein, 36 aa, Artificial Sequence
  Description of Artificial Sequence: Synthetic polypeptide
AEDEIRATNPVATEQYGSVSTTNQNLQEQQGTNQQD

SEQ ID NO: 135727 - protein, 35 aa, Artificial Sequence
  Description of Artificial Sequence: Synthetic polypeptide
DEEEIRTTNPVATEQYGAVQTDNMNQNNIGGEQGT

SEQ ID NO: 135728 - protein, 36 aa, Artificial Sequence
  Description of Artificial Sequence: Synthetic polypeptide
AEDEIRATNPVATEQYGSVSTTNQNLGQNIGTNQDD

SEQ ID NO: 135729 - protein, 36 aa, Artificial Sequence
  Description of Artificial Sequence: Synthetic polypeptide
AEDEIRATNPVATEQYGSVSTTNQNLENQNGTNQQD

SEQ ID NO: 135730 - protein, 36 aa, Artificial Sequence
  Description of Artificial Sequence: Synthetic polypeptide
AEDEIRATNPVATEQYGSVSTTNNQQQLQQGTNQDE

SEQ ID NO: 135731 - protein, 35 aa, Artificial Sequence
  Description of Artificial Sequence: Synthetic polypeptide
DEEEIRTTNPVATEQYGAVQTDNMNLIDDEGEGFT

SEQ ID NO: 135732 - protein, 37 aa, Artificial Sequence
  Description of Artificial Sequence: Synthetic polypeptide
DEEEIRTTNPVATEAYGVVSTVVNTNLQAGNNAEESD

SEQ ID NO: 135733 - protein, 33 aa, Artificial Sequence
  Description of Artificial Sequence: Synthetic polypeptide
DEEEIRTTNPVATEQYGAVQDGNNGEQGEQTGT

SEQ ID NO: 135734 - protein, 34 aa, Artificial Sequence
  Description of Artificial Sequence: Synthetic polypeptide
DEEEIRTTNPVATEQYGAVQDGDNGQGDGEGTTT

SEQ ID NO: 135735 - protein, 34 aa, Artificial Sequence
  Description of Artificial Sequence: Synthetic polypeptide
DEEEIRTTNPVATEQYGAVQDGDNGDQGEGEGTT

SEQ ID NO: 135736 - protein, 35 aa, Artificial Sequence
  Description of Artificial Sequence: Synthetic polypeptide
DEEEIRTTNPVATEQYGAVPSTVNDFDPNNQDEDG

SEQ ID NO: 135737 - protein, 36 aa, Artificial Sequence
  Description of Artificial Sequence: Synthetic polypeptide
DEEEIRTTNPVATEQYGAVNSTTSDFDFRNNEDERR

SEQ ID NO: 135738 - protein, 31 aa, Artificial Sequence
  Description of Artificial Sequence: Synthetic polypeptide
YEEEIASTNPVCTEQYGVVSMDIQQQSNGNH

SEQ ID NO: 135739 - protein, 35 aa, Artificial Sequence
  Description of Artificial Sequence: Synthetic polypeptide
DEEEIRTTNPVGYEQYGSVVSCTGYEPSARTGNGD

SEQ ID NO: 135740 - protein, 36 aa, Artificial Sequence
  Description of Artificial Sequence: Synthetic polypeptide
DEEEIRTTNPVAYEQYGQSVCSSGNDHNQRFGSQQS

SEQ ID NO: 135741 - protein, 35 aa, Artificial Sequence
  Description of Artificial Sequence: Synthetic polypeptide
DEEEIRTTNPVATEQYGAVNSTTDFDSRNNEDEAE

SEQ ID NO: 135742 - protein, 35 aa, Artificial Sequence
  Description of Artificial Sequence: Synthetic polypeptide
DEEEIRTTNPVATEQYGAVNSDLDSEQGQGDGNQS

SEQ ID NO: 135743 - protein, 34 aa, Artificial Sequence
  Description of Artificial Sequence: Synthetic polypeptide
DEEEIRTTNPVATEQYGAVNSDGMTGQGEGEDEG

SEQ ID NO: 135744 - protein, 35 aa, Artificial Sequence
  Description of Artificial Sequence: Synthetic polypeptide
DEEEIRTTNPVGYEQYGSTVVACTGNALQQVTDSR

SEQ ID NO: 135745 - protein, 33 aa, Artificial Sequence
  Description of Artificial Sequence: Synthetic polypeptide
DEEEIRTTNPVATEQYGAVMGDVVEGGGGQNGG

SEQ ID NO: 135746 - protein, 33 aa, Artificial Sequence
  Description of Artificial Sequence: Synthetic polypeptide
DEEEIRTTNPVSTEAYGSVNTNYHLTATEQQTK

SEQ ID NO: 135747 - protein, 33 aa, Artificial Sequence
  Description of Artificial Sequence: Synthetic polypeptide
DEEEIRTTNPVATEQYGAVMGDNVEGGGGQESG

SEQ ID NO: 135748 - protein, 28 aa, Artificial Sequence
  Description of Artificial Sequence: Synthetic peptide
YEEEIASVNPQCDNQYGVVSDTLQSGNQ

SEQ ID NO: 135749 - protein, 37 aa, Artificial Sequence
  Description of Artificial Sequence: Synthetic polypeptide
DEEEIRTTNPVATEQYGASVSSTTPAGPNMRNGMNPV

SEQ ID NO: 135750 - protein, 37 aa, Artificial Sequence
  Description of Artificial Sequence: Synthetic polypeptide
DEEEIRTTNPVATEQYGASVSSTTPAGPNMENGMNPV

SEQ ID NO: 135751 - protein, 37 aa, Artificial Sequence
  Description of Artificial Sequence: Synthetic polypeptide
DEEEIRTTNPVATEQYGASVSSTTPAGPGMRNGMNPV

SEQ ID NO: 135752 - protein, 37 aa, Artificial Sequence
  Description of Artificial Sequence: Synthetic polypeptide
DEEEIRTTNPVATEAYGVVSTVVSNLQAGNNNTEDEE

SEQ ID NO: 135753 - protein, 37 aa, Artificial Sequence
  Description of Artificial Sequence: Synthetic polypeptide
DEEEIRTTNPVATEQYGASVSSCTPAGPNMRNGMNPV

SEQ ID NO: 135754 - protein, 37 aa, Artificial Sequence
  Description of Artificial Sequence: Synthetic polypeptide
DEEEIRTTNPVATEAYGVVSTVVSNLQQGNNDTETEE

SEQ ID NO: 135755 - protein, 37 aa, Artificial Sequence
  Description of Artificial Sequence: Synthetic polypeptide
DEEEIRTTNPVATEQYGASVESTTPAGPNMRNGMNPV

SEQ ID NO: 135756 - protein, 37 aa, Artificial Sequence
  Description of Artificial Sequence: Synthetic polypeptide
DEEEIRTTNPVATEQYGAMTGNMTENGLSQQRITNRE

SEQ ID NO: 135757 - protein, 35 aa, Artificial Sequence
  Description of Artificial Sequence: Synthetic polypeptide
DEEEIRTTNPVATEQYGAIWSLTINHGQGEGDQEL

SEQ ID NO: 135758 - protein, 36 aa, Artificial Sequence
  Description of Artificial Sequence: Synthetic polypeptide
DEEEIRTTNPVGTEQYGSVSSTTPAGPNMRNGMNPV

SEQ ID NO: 135759 - protein, 38 aa, Artificial Sequence
  Description of Artificial Sequence: Synthetic polypeptide
DEEEIRTTNPVATEAYGVVSTVVSTNLQAGNGQGNDET

SEQ ID NO: 135760 - protein, 36 aa, Artificial Sequence
  Description of Artificial Sequence: Synthetic polypeptide
DEEEIRTTNPVGTEQYGSVHSTTPAGPNMRNGMNPV

SEQ ID NO: 135761 - protein, 38 aa, Artificial Sequence
  Description of Artificial Sequence: Synthetic polypeptide
DEEEIRTTNPVATEAYGVVSTVVSTNLQAGNLQGNVDG

SEQ ID NO: 135762 - protein, 38 aa, Artificial Sequence
  Description of Artificial Sequence: Synthetic polypeptide
DEEEIRTTNPVATEAYGVVSTVVSTNLQAGNNNDEQDE

SEQ ID NO: 135763 - protein, 38 aa, Artificial Sequence
  Description of Artificial Sequence: Synthetic polypeptide
DEEEIRTTNPVATEAYGVVSTVVSTNLQAGNNQGNDDG

SEQ ID NO: 135764 - protein, 38 aa, Artificial Sequence
  Description of Artificial Sequence: Synthetic polypeptide
DEEEIRTTNPVATEAYGVVSTVVSTNLQAGNNQGTDDG

SEQ ID NO: 135765 - protein, 38 aa, Artificial Sequence
  Description of Artificial Sequence: Synthetic polypeptide
DEEEIRTTNPVATEAYGVVSTVVSTNLQAGNNQNNDDT

SEQ ID NO: 135766 - protein, 38 aa, Artificial Sequence
  Description of Artificial Sequence: Synthetic polypeptide
DEEEIRTTNPVATEAYGVVSTVVSTNLQAGNTNDEQED

SEQ ID NO: 135767 - protein, 31 aa, Artificial Sequence
  Description of Artificial Sequence: Synthetic polypeptide
YEEEIASVNPVCTEQYGNVVSQDNLDSGNAQ

SEQ ID NO: 135768 - protein, 31 aa, Artificial Sequence
  Description of Artificial Sequence: Synthetic polypeptide
DDSEVRTTNPVSTEQYGNVSAETIMNAAGDR

SEQ ID NO: 135769 - protein, 34 aa, Artificial Sequence
  Description of Artificial Sequence: Synthetic polypeptide
DEEEIRTTNPVGTEQYGSVITTMGLMGEGGFGET

SEQ ID NO: 135770 - protein, 36 aa, Artificial Sequence
  Description of Artificial Sequence: Synthetic polypeptide
DEEEIRTTNPVGTEQYGSVSSTTPAGPNMRNGNNPV

SEQ ID NO: 135771 - protein, 36 aa, Artificial Sequence
  Description of Artificial Sequence: Synthetic polypeptide
DEEEIRTTNPVGTEQYGSVSSTTPAGPRMRNGMNPV

SEQ ID NO: 135772 - protein, 37 aa, Artificial Sequence
  Description of Artificial Sequence: Synthetic polypeptide
DEEEIRTTNPVATEQYGASVSSTTPAGPNTRNGMNPV

SEQ ID NO: 135773 - protein, 33 aa, Artificial Sequence
  Description of Artificial Sequence: Synthetic polypeptide
DEEEIRTTNPVATEQYGAVFGDTEQDEMGGGQT

SEQ ID NO: 135774 - protein, 34 aa, Artificial Sequence
  Description of Artificial Sequence: Synthetic polypeptide
DEEEIRTTNPVATEQYGAVFGDNMEGGNQGQNGN

SEQ ID NO: 135775 - protein, 33 aa, Artificial Sequence
  Description of Artificial Sequence: Synthetic polypeptide
DEEEIRTTNPVATEQYGAVFGDGEQDEGGGGQG

SEQ ID NO: 135776 - protein, 33 aa, Artificial Sequence
  Description of Artificial Sequence: Synthetic polypeptide
DEEEIRTTNPVATEQYGAVFGDFEQDEMTGEQG

SEQ ID NO: 135777 - protein, 33 aa, Artificial Sequence
  Description of Artificial Sequence: Synthetic polypeptide
DEEEIRTTNPVATEQYGAVFGDDEQDEGQGGQG

SEQ ID NO: 135778 - protein, 32 aa, Artificial Sequence
  Description of Artificial Sequence: Synthetic polypeptide
YEEEIASVNPVATEQYGAVSDENLQESKGPYQ

SEQ ID NO: 135779 - protein, 33 aa, Artificial Sequence
  Description of Artificial Sequence: Synthetic polypeptide
YEEEIASVNPVATEQYGSVSSDPNGQMSGMNPV

SEQ ID NO: 135780 - protein, 35 aa, Artificial Sequence
  Description of Artificial Sequence: Synthetic polypeptide
DEEEIRTTNPVATEQYGAVDSGMGNDDEQQGFEEQ

SEQ ID NO: 135781 - protein, 35 aa, Artificial Sequence
  Description of Artificial Sequence: Synthetic polypeptide
DEEEIRTTNPVATEQYGAVDSGMGNDDEQQGDEGG

SEQ ID NO: 135782 - protein, 34 aa, Artificial Sequence
  Description of Artificial Sequence: Synthetic polypeptide
DEEEIRTTNPVATEQYGAVDSGMGDNEQGFDEDD

SEQ ID NO: 135783 - protein, 31 aa, Artificial Sequence
  Description of Artificial Sequence: Synthetic polypeptide
YEEEIASVNPVATEQYGVVSSDAGQSGMNPV

SEQ ID NO: 135784 - protein, 37 aa, Artificial Sequence
  Description of Artificial Sequence: Synthetic polypeptide
DEEEIRTTNPVATEAYGVVSTVVNTNLQAGTNDEQND

SEQ ID NO: 135785 - protein, 32 aa, Artificial Sequence
  Description of Artificial Sequence: Synthetic polypeptide
YEEEIASVNPVATEQYGVVSSTDAGQSGMNPV

SEQ ID NO: 135786 - protein, 37 aa, Artificial Sequence
  Description of Artificial Sequence: Synthetic polypeptide
DEEEIRTTNPVATEAYGVVSTVVNTNLQLGNNVEQGS

SEQ ID NO: 135787 - protein, 35 aa, Artificial Sequence
  Description of Artificial Sequence: Synthetic polypeptide
DEEEIRTTNPVATEQYGAVDIENGDEFNQGGNDGD

SEQ ID NO: 135788 - protein, 36 aa, Artificial Sequence
  Description of Artificial Sequence: Synthetic polypeptide
DEEEIRTTNPVATEQYGAVDIDTNMNLETGGGQINQ

SEQ ID NO: 135789 - protein, 35 aa, Artificial Sequence
  Description of Artificial Sequence: Synthetic polypeptide
DEEEIRTTNPVATEQYGATSATTPDWPNMRNGNPV

SEQ ID NO: 135790 - protein, 35 aa, Artificial Sequence
  Description of Artificial Sequence: Synthetic polypeptide
DEEEIRTTNPVATEQYGATSATTPAWPNMRNGNPV

SEQ ID NO: 135791 - protein, 37 aa, Artificial Sequence
  Description of Artificial Sequence: Synthetic polypeptide
DEEEIRTTNPVATEAYGVVSTVVNTNLQSGNNDEQGN

SEQ ID NO: 135792 - protein, 37 aa, Artificial Sequence
  Description of Artificial Sequence: Synthetic polypeptide
DEEEIRTTNPVATEAYGVVSTVVNTNLQYGNNDEEED

SEQ ID NO: 135793 - protein, 37 aa, Artificial Sequence
  Description of Artificial Sequence: Synthetic polypeptide
DEEEIRTTNPVATEAYGVVSTVVNTNLQYGNNDETGE

SEQ ID NO: 135794 - protein, 35 aa, Artificial Sequence
  Description of Artificial Sequence: Synthetic polypeptide
DEEEIRTTNPVATEQYGAVINTTGDGNQEGEGNQQ

SEQ ID NO: 135795 - protein, 38 aa, Artificial Sequence
  Description of Artificial Sequence: Synthetic polypeptide
DEEEIRTTNPVATEAYGVVSTVVSTNLQAGNTQGNDTN

SEQ ID NO: 135796 - protein, 37 aa, Artificial Sequence
  Description of Artificial Sequence: Synthetic polypeptide
DEEEIRTTNPVATEAYGVVSTVVNQQQLQQGEENNTD

SEQ ID NO: 135797 - protein, 33 aa, Artificial Sequence
  Description of Artificial Sequence: Synthetic polypeptide
DEEEIRTTNPVSTEAYGSVTFMNHLTQGTEQQT

SEQ ID NO: 135798 - protein, 34 aa, Artificial Sequence
  Description of Artificial Sequence: Synthetic polypeptide
DEEEIRTTNPVATEQYGAVVDGMTNQGNFDNNIT

SEQ ID NO: 135799 - protein, 34 aa, Artificial Sequence
  Description of Artificial Sequence: Synthetic polypeptide
DEEEIRTTNPVATEQYGAVVDGMTNQGNFDENDI

SEQ ID NO: 135800 - protein, 33 aa, Artificial Sequence
  Description of Artificial Sequence: Synthetic polypeptide
DEEEIRTTNPVSTEQWGSCYTVDNHQNGGKQDM

SEQ ID NO: 135801 - protein, 33 aa, Artificial Sequence
  Description of Artificial Sequence: Synthetic polypeptide
DEEEIRTTNPVSTEQWGSCYTIDNHQNGGKQTT

SEQ ID NO: 135802 - protein, 36 aa, Artificial Sequence
  Description of Artificial Sequence: Synthetic polypeptide
DEEEIRTTNPVATEQYGAVVDGGTMNLDQGEEINEG

SEQ ID NO: 135803 - protein, 29 aa, Artificial Sequence
  Description of Artificial Sequence: Synthetic peptide
YDSEIASTNPVSTEGYGVVADNLQSSGQR

SEQ ID NO: 135804 - protein, 33 aa, Artificial Sequence
  Description of Artificial Sequence: Synthetic polypeptide
DEEEIRTTNPVSTEPYGTVSSMEDIQQQQNGNH

SEQ ID NO: 135805 - protein, 28 aa, Artificial Sequence
  Description of Artificial Sequence: Synthetic peptide
YDSEIASVNPVSTEGYGVVSNNIQSGNQ

SEQ ID NO: 135806 - protein, 29 aa, Artificial Sequence
  Description of Artificial Sequence: Synthetic peptide
YDSEVASTNPVCTEGYGVVAADNLQSGNR

SEQ ID NO: 135807 - protein, 35 aa, Artificial Sequence
  Description of Artificial Sequence: Synthetic polypeptide
DEEEIRTTNPVSTEQWGSVPTFDNDLRQDGKGGQT

SEQ ID NO: 135808 - protein, 36 aa, Artificial Sequence
  Description of Artificial Sequence: Synthetic polypeptide
DEEEIRTTNPVATEQYGAVVDGFTNLMTNQGGGGQD

SEQ ID NO: 135809 - protein, 33 aa, Artificial Sequence
  Description of Artificial Sequence: Synthetic polypeptide
DEEEIRTTNPVATEQYGAVVDDNFNAGEMTDGQ

SEQ ID NO: 135810 - protein, 35 aa, Artificial Sequence
  Description of Artificial Sequence: Synthetic polypeptide
DEEEIRTTNPVATEQYGAVVDDLQINEQGEGNEFT

SEQ ID NO: 135811 - protein, 35 aa, Artificial Sequence
  Description of Artificial Sequence: Synthetic polypeptide
DEEEIRTTNPVAYEQYGQSASVANDALEVRTVENG

SEQ ID NO: 135812 - protein, 34 aa, Artificial Sequence
  Description of Artificial Sequence: Synthetic polypeptide
DEEEIRTTNPVAYEQYGQSASVANDALQVATVEA

SEQ ID NO: 135813 - protein, 32 aa, Artificial Sequence
  Description of Artificial Sequence: Synthetic polypeptide
DEEEIRTTNPVSTEPYGTISMEDIQQQSNGNH

SEQ ID NO: 135814 - protein, 33 aa, Artificial Sequence
  Description of Artificial Sequence: Synthetic polypeptide
DEEEIRTTNPVSTEPYGTISMEDIQQQRNGMNV

SEQ ID NO: 135815 - protein, 32 aa, Artificial Sequence
  Description of Artificial Sequence: Synthetic polypeptide
DEEEIRTTNPVSTEPYGTISMEDIQQQQNGNH

SEQ ID NO: 135816 - protein, 33 aa, Artificial Sequence
  Description of Artificial Sequence: Synthetic polypeptide
DEEEIRTTNPVATEQYGAVVDDLNGPEDNNGDD

SEQ ID NO: 135817 - protein, 32 aa, Artificial Sequence
  Description of Artificial Sequence: Synthetic polypeptide
DEEEIRTTNPVSTEPYGTISMEDIQQQQGGNH

SEQ ID NO: 135818 - protein, 33 aa, Artificial Sequence
  Description of Artificial Sequence: Synthetic polypeptide
DEEEIRTTNPVATEQYGAVVDDNMTMEFDGEGF

SEQ ID NO: 135819 - protein, 34 aa, Artificial Sequence
  Description of Artificial Sequence: Synthetic polypeptide
DEEEIRTTNPVAYEQYGQCVSSEDLNQHFGSQQG

SEQ ID NO: 135820 - protein, 34 aa, Artificial Sequence
  Description of Artificial Sequence: Synthetic polypeptide
DEEEIRTTNPVATEQYGAVVDGMTNQGNFDSEGI

SEQ ID NO: 135821 - protein, 35 aa, Artificial Sequence
  Description of Artificial Sequence: Synthetic polypeptide
DEEEIRTTNPVATEQYGAVVDGMTNQGNQTDITNI

SEQ ID NO: 135822 - protein, 36 aa, Artificial Sequence
  Description of Artificial Sequence: Synthetic polypeptide
WEEEIRTTNPVATEQYGSVSSTTPAGPNRRNGMNPV

SEQ ID NO: 135823 - protein, 36 aa, Artificial Sequence
  Description of Artificial Sequence: Synthetic polypeptide
WEEEIRTTNPVATEQYGSVSSTWPAGPNMRNGMNPV

SEQ ID NO: 135824 - protein, 36 aa, Artificial Sequence
  Description of Artificial Sequence: Synthetic polypeptide
WEEEIRTTNPVATEQYGSVSSYTPAGPNMRNGMNPV

SEQ ID NO: 135825 - protein, 34 aa, Artificial Sequence
  Description of Artificial Sequence: Synthetic polypeptide
AEDEISTTNPVAYEQWGSVNKTDNLDQRGGGNIH

SEQ ID NO: 135826 - protein, 35 aa, Artificial Sequence
  Description of Artificial Sequence: Synthetic polypeptide
DEEEIRTTNPVATEQYGAVVGDTFNDGTEQGEGGI

SEQ ID NO: 135827 - protein, 34 aa, Artificial Sequence
  Description of Artificial Sequence: Synthetic polypeptide
AEDEIRTTNPVAYEQWGSVNKTDNLDQRGGGGDY

SEQ ID NO: 135828 - protein, 32 aa, Artificial Sequence
  Description of Artificial Sequence: Synthetic polypeptide
AEDEIRTTNPVAYEQWGSVCYTDNDNHGHNNV

SEQ ID NO: 135829 - protein, 33 aa, Artificial Sequence
  Description of Artificial Sequence: Synthetic polypeptide
AEDEIRTTNPVAYEQWGSVCVTNDQGEGMNGEP

SEQ ID NO: 135830 - protein, 32 aa, Artificial Sequence
  Description of Artificial Sequence: Synthetic polypeptide
DEEEIRTTNPVSTEQYGCVCQWEHQEGGSQQS

SEQ ID NO: 135831 - protein, 36 aa, Artificial Sequence
  Description of Artificial Sequence: Synthetic polypeptide
WEEEIRTTNPVATEQYGSVSWTTPAGPNMRNGMNPV

SEQ ID NO: 135832 - protein, 32 aa, Artificial Sequence
  Description of Artificial Sequence: Synthetic polypeptide
DEEEIRTTNPVSTEQYGCVCQSEDQGFGSQQL

SEQ ID NO: 135833 - protein, 33 aa, Artificial Sequence
  Description of Artificial Sequence: Synthetic polypeptide
DEEEIRTTNPVSTEQYGCVCGSGEDQGFGSQQS

SEQ ID NO: 135834 - protein, 33 aa, Artificial Sequence
  Description of Artificial Sequence: Synthetic polypeptide
DEEEIRTTNPVSTEQYGCVCGSELQGFGSQTQA

SEQ ID NO: 135835 - protein, 32 aa, Artificial Sequence
  Description of Artificial Sequence: Synthetic polypeptide
DEEEIRTTNPVSTEQYGCVCGSELIGFGSQQS

SEQ ID NO: 135836 - protein, 34 aa, Artificial Sequence
  Description of Artificial Sequence: Synthetic polypeptide
DEEEIRTTNPVSTEQYGCVCGSEELNQGFGSQQS

SEQ ID NO: 135837 - protein, 32 aa, Artificial Sequence
  Description of Artificial Sequence: Synthetic polypeptide
DEEEIRTTNPVSTEQYGCVCGSEDQEGFGSQQ

SEQ ID NO: 135838 - protein, 33 aa, Artificial Sequence
  Description of Artificial Sequence: Synthetic polypeptide
WESEIRTTNPVATECWGSVSCINEPQDREFENG

SEQ ID NO: 135839 - protein, 34 aa, Artificial Sequence
  Description of Artificial Sequence: Synthetic polypeptide
DEEEIRTTNPVATEQYGAVVDPDNFNNGEMTNGQ

SEQ ID NO: 135840 - protein, 36 aa, Artificial Sequence
  Description of Artificial Sequence: Synthetic polypeptide
DEEEIRTTNPVATEQYGAVVDLDTMNNNEQAEGNTT

SEQ ID NO: 135841 - protein, 34 aa, Artificial Sequence
  Description of Artificial Sequence: Synthetic polypeptide
DEEEIRTTNPVATEQYGAVVDITNMDNGEFGGGG

SEQ ID NO: 135842 - protein, 34 aa, Artificial Sequence
  Description of Artificial Sequence: Synthetic polypeptide
DEEEIRTTNPVSTEQYGCVCGNSGELQGFGSQQA

SEQ ID NO: 135843 - protein, 32 aa, Artificial Sequence
  Description of Artificial Sequence: Synthetic polypeptide
DEEEIRTTNPVSTEPYGTISMEDIQQIQNGNH

SEQ ID NO: 135844 - protein, 34 aa, Artificial Sequence
  Description of Artificial Sequence: Synthetic polypeptide
DEEEIRTTNPVSTEAYGSVSTSFYHLTQTEQQTD

SEQ ID NO: 135845 - protein, 32 aa, Artificial Sequence
  Description of Artificial Sequence: Synthetic polypeptide
DEEEIRTTNPVSTEPYGTISMEDIQCQQNGNH

SEQ ID NO: 135846 - protein, 36 aa, Artificial Sequence
  Description of Artificial Sequence: Synthetic polypeptide
AEDEIRTTNPVATEQYGVVSTTTTNLQQQIGTTNVE

SEQ ID NO: 135847 - protein, 33 aa, Artificial Sequence
  Description of Artificial Sequence: Synthetic polypeptide
DEEEIRTTNPVSTEHWGCVYCMPNQDQRHGNQD

SEQ ID NO: 135848 - protein, 33 aa, Artificial Sequence
  Description of Artificial Sequence: Synthetic polypeptide
DEEEIRTTNPVSTEHWGCVYCMPNQDQRHGNAK

SEQ ID NO: 135849 - protein, 36 aa, Artificial Sequence
  Description of Artificial Sequence: Synthetic polypeptide
DEEEIRTTNPVATEQYGAVSSTTPAGPNMRNGMNPV

SEQ ID NO: 135850 - protein, 33 aa, Artificial Sequence
  Description of Artificial Sequence: Synthetic polypeptide
DEEEIRTTNPVSTEHWGCVYCMPNQDQRHGGNP

SEQ ID NO: 135851 - protein, 36 aa, Artificial Sequence
  Description of Artificial Sequence: Synthetic polypeptide
DEEEIRTTNPVATEQYGAVSSTTMDGPNVGNGDNDD

SEQ ID NO: 135852 - protein, 36 aa, Artificial Sequence
  Description of Artificial Sequence: Synthetic polypeptide
AEDEIRATNPVATEQYGSVSTTNQQQQLQQGTNTQD

SEQ ID NO: 135853 - protein, 36 aa, Artificial Sequence
  Description of Artificial Sequence: Synthetic polypeptide
DEEEIRTTNPVATEQYGAVSSTAPAGPNMPNGMNPV

SEQ ID NO: 135854 - protein, 32 aa, Artificial Sequence
  Description of Artificial Sequence: Synthetic polypeptide
DEEEIRTTNPVSTEGYGSVSREAFLETVTFEP

SEQ ID NO: 135855 - protein, 34 aa, Artificial Sequence
  Description of Artificial Sequence: Synthetic polypeptide
DEEEIRTTNPVSTEGYGSVSREAFLERVTNFEPQ

SEQ ID NO: 135856 - protein, 36 aa, Artificial Sequence
  Description of Artificial Sequence: Synthetic polypeptide
DEEEIRTTNPVATEQYGAVSSTTPAWPNMRNGMNPV

SEQ ID NO: 135857 - protein, 37 aa, Artificial Sequence
  Description of Artificial Sequence: Synthetic polypeptide
DEEEIRTTNPVATEAYGVVSTVVNNLQSGNNEDEEDT

SEQ ID NO: 135858 - protein, 37 aa, Artificial Sequence
  Description of Artificial Sequence: Synthetic polypeptide
DEEEIRTTNPVAYEQYGQSVCHSLNDVLQARGQITKN

SEQ ID NO: 135859 - protein, 30 aa, Artificial Sequence
  Description of Artificial Sequence: Synthetic polypeptide
YEEEIASTNPVCTEPYGTVSDEDIQQQGNH

SEQ ID NO: 135860 - protein, 30 aa, Artificial Sequence
  Description of Artificial Sequence: Synthetic polypeptide
YEEEIASTNPVCTEPYGTVSMEDIQQQGNH

SEQ ID NO: 135861 - protein, 35 aa, Artificial Sequence
  Description of Artificial Sequence: Synthetic polypeptide
DEEEIRTTNPVAYEQYGQSVCPTNDELVIAIPDRV

SEQ ID NO: 135862 - protein, 33 aa, Artificial Sequence
  Description of Artificial Sequence: Synthetic polypeptide
DEEEIRTTNPVSTEAYGSVTSFFHLTQTEQQTK

SEQ ID NO: 135863 - protein, 33 aa, Artificial Sequence
  Description of Artificial Sequence: Synthetic polypeptide
DEEEIRTTNPVSTEAYGSVTFTNHETQTEQQTK

SEQ ID NO: 135864 - protein, 36 aa, Artificial Sequence
  Description of Artificial Sequence: Synthetic polypeptide
AEDEIRATNPVATEQYGSVSTTNQQLQLQQGNNTTD

SEQ ID NO: 135865 - protein, 36 aa, Artificial Sequence
  Description of Artificial Sequence: Synthetic polypeptide
AEDEIRATNPVATEQYGSVSTTNQNQQLQNGTNQQD

SEQ ID NO: 135866 - protein, 33 aa, Artificial Sequence
  Description of Artificial Sequence: Synthetic polypeptide
DEEEIRTTNPVSTEAYGSVTFNHLTQTLEVQQT

SEQ ID NO: 135867 - protein, 36 aa, Artificial Sequence
  Description of Artificial Sequence: Synthetic polypeptide
DEEEIRTTNPVATEQYGAVSNMTDNTDQTGEGGQGT

SEQ ID NO: 135868 - protein, 36 aa, Artificial Sequence
  Description of Artificial Sequence: Synthetic polypeptide
DEEEIRTTNPVATEQYGAVSSTTPAWPNMRNGMNYV

SEQ ID NO: 135869 - protein, 36 aa, Artificial Sequence
  Description of Artificial Sequence: Synthetic polypeptide
AEDEIRATNPVATEQYGSVSTVNQNQLEQQGTNQQD

SEQ ID NO: 135870 - protein, 32 aa, Artificial Sequence
  Description of Artificial Sequence: Synthetic polypeptide
AEDEIRTTNPVATEEYGCCWNIVTLQRGDNQE

SEQ ID NO: 135871 - protein, 34 aa, Artificial Sequence
  Description of Artificial Sequence: Synthetic polypeptide
DEEEIRTTNPVATEQYGAVSVVGFGNGQTQTTGI

SEQ ID NO: 135872 - protein, 37 aa, Artificial Sequence
  Description of Artificial Sequence: Synthetic polypeptide
DEEEIRTTNPVATEQYGAVSVDQGTMNLDQGPEINEG

SEQ ID NO: 135873 - protein, 36 aa, Artificial Sequence
  Description of Artificial Sequence: Synthetic polypeptide
AEDEIRTTNPVATEQYGSVSTVTQNQQQNQIGTNVE

SEQ ID NO: 135874 - protein, 36 aa, Artificial Sequence
  Description of Artificial Sequence: Synthetic polypeptide
DEEEIRTTNPVSTEPYGSVSSTTPDGQQQRNGMNPV

SEQ ID NO: 135875 - protein, 36 aa, Artificial Sequence
  Description of Artificial Sequence: Synthetic polypeptide
DEEEIRTTNPVSTEPYGSVSSTTPAGQQQRNGMNPV

SEQ ID NO: 135876 - protein, 36 aa, Artificial Sequence
  Description of Artificial Sequence: Synthetic polypeptide
AEDEIRTTNPVATEQYGSVSTVTNNQQGQEQGTNVD

SEQ ID NO: 135877 - protein, 36 aa, Artificial Sequence
  Description of Artificial Sequence: Synthetic polypeptide
AEDEIRTTNPVATEQYGSVSTVTNNQNQQQQGTNTD

SEQ ID NO: 135878 - protein, 34 aa, Artificial Sequence
  Description of Artificial Sequence: Synthetic polypeptide
DEEEIRTTNPVSTEPYGSVSSMPDIPQQQNGNPH

SEQ ID NO: 135879 - protein, 34 aa, Artificial Sequence
  Description of Artificial Sequence: Synthetic polypeptide
DEEEIRTTNPVSTEPYGSVSSMPAIPQQQNGNPH

SEQ ID NO: 135880 - protein, 34 aa, Artificial Sequence
  Description of Artificial Sequence: Synthetic polypeptide
DEEEIRTTNPVSTEPYGSVSSMEDIQQQQNGNPH

SEQ ID NO: 135881 - protein, 34 aa, Artificial Sequence
  Description of Artificial Sequence: Synthetic polypeptide
DEEEIRTTNPVSTEPYGSVSSMEDIPQQQNGNPH

SEQ ID NO: 135882 - protein, 36 aa, Artificial Sequence
  Description of Artificial Sequence: Synthetic polypeptide
AEDEIRTTNPVATEQYGSVSTVTNDQQGTEQGSNDD

SEQ ID NO: 135883 - protein, 35 aa, Artificial Sequence
  Description of Artificial Sequence: Synthetic polypeptide
DEEEIRTTNPVSTEPYGSISTTPAGQQMRNGMNPV

SEQ ID NO: 135884 - protein, 35 aa, Artificial Sequence
  Description of Artificial Sequence: Synthetic polypeptide
DEEEIRTTNPVSTEPYGSISTTPAGPQMRNGMNPV

SEQ ID NO: 135885 - protein, 37 aa, Artificial Sequence
  Description of Artificial Sequence: Synthetic polypeptide
AEDEIRTTNPVATEQYGSVSTVNNNQLQQQIGTSNVD

SEQ ID NO: 135886 - protein, 34 aa, Artificial Sequence
  Description of Artificial Sequence: Synthetic polypeptide
DEEEIRTTNPVSTEPYGSISMPAIPQQRNGMNPV

SEQ ID NO: 135887 - protein, 37 aa, Artificial Sequence
  Description of Artificial Sequence: Synthetic polypeptide
AEDEIRTTNPVATEQYGSVSTVNNNQLQLQQGNTNVD

SEQ ID NO: 135888 - protein, 36 aa, Artificial Sequence
  Description of Artificial Sequence: Synthetic polypeptide
DEEEIRTTNPVATEAYGVVSTVTNQANTEQGGNNTD

SEQ ID NO: 135889 - protein, 28 aa, Artificial Sequence
  Description of Artificial Sequence: Synthetic peptide
YEEEIAATNPVATEQYGEAPEVCQHEEK

SEQ ID NO: 135890 - protein, 37 aa, Artificial Sequence
  Description of Artificial Sequence: Synthetic polypeptide
AEDEIRTTNPVATEQYGSVSTTTNNQLQQQIGTTNVE

SEQ ID NO: 135891 - protein, 36 aa, Artificial Sequence
  Description of Artificial Sequence: Synthetic polypeptide
DEEEIRTTNPVAYEQYGQSDSCTQDQLQRQGIGFYN

SEQ ID NO: 135892 - protein, 35 aa, Artificial Sequence
  Description of Artificial Sequence: Synthetic polypeptide
DEEEIRTTNPVATEQYGAVSWMEAYANSQMQMGVQ

SEQ ID NO: 135893 - protein, 32 aa, Artificial Sequence
  Description of Artificial Sequence: Synthetic polypeptide
YEEEIATTNPVCTEQYGATWSNDENLAEPGNQ

SEQ ID NO: 135894 - protein, 38 aa, Artificial Sequence
  Description of Artificial Sequence: Synthetic polypeptide
DEEEIRTTNPVATEAYGVVSTVVSTNLQAGNTQGNEDS

SEQ ID NO: 135895 - protein, 33 aa, Artificial Sequence
  Description of Artificial Sequence: Synthetic polypeptide
DEEEIRTTNPVGTEQYGCVCSWPDHNANFGSQQ

SEQ ID NO: 135896 - protein, 35 aa, Artificial Sequence
  Description of Artificial Sequence: Synthetic polypeptide
DEEEIRTTNPVATECYGAVSSTAEDGPNMPNGNPV

SEQ ID NO: 135897 - protein, 35 aa, Artificial Sequence
  Description of Artificial Sequence: Synthetic polypeptide
DEEEIRTTNPVATECYGAVSSTAPDGPNMPNGNPV

SEQ ID NO: 135898 - protein, 33 aa, Artificial Sequence
  Description of Artificial Sequence: Synthetic polypeptide
DEEEIRTTNPVATECYGDVSTEPAGPNHNEMEL

SEQ ID NO: 135899 - protein, 36 aa, Artificial Sequence
  Description of Artificial Sequence: Synthetic polypeptide
DEEEIRTTNPVATEQWGSVSCAGEGLQPRDEMNNNN

SEQ ID NO: 135900 - protein, 36 aa, Artificial Sequence
  Description of Artificial Sequence: Synthetic polypeptide
DEEEIRTTNPVATEQWGSVSATTPDGPNERNGMNPV

SEQ ID NO: 135901 - protein, 36 aa, Artificial Sequence
  Description of Artificial Sequence: Synthetic polypeptide
DEEEIRTTNPVATEQWGSVSATTPDGPAERNGMNPV

SEQ ID NO: 135902 - protein, 32 aa, Artificial Sequence
  Description of Artificial Sequence: Synthetic polypeptide
DEEEIRTTNPVATECYGETSAEVGMQRMTVAF

SEQ ID NO: 135903 - protein, 34 aa, Artificial Sequence
  Description of Artificial Sequence: Synthetic polypeptide
DEEEIRTTNPVATECYGKHSTWNVELQPPSSEEF

SEQ ID NO: 135904 - protein, 33 aa, Artificial Sequence
  Description of Artificial Sequence: Synthetic polypeptide
AEDEICATNPVATEQYGVVATTENLQLAGNGDD

SEQ ID NO: 135905 - protein, 35 aa, Artificial Sequence
  Description of Artificial Sequence: Synthetic polypeptide
DEEEIRTTNPVATECYGAVSSTAEDGPNMPNGNPI

SEQ ID NO: 135906 - protein, 35 aa, Artificial Sequence
  Description of Artificial Sequence: Synthetic polypeptide
DEEEIRTTNPVATECYGSVACTEESSNNHGGNNED

SEQ ID NO: 135907 - protein, 35 aa, Artificial Sequence
  Description of Artificial Sequence: Synthetic polypeptide
DEEEIRTTNPVATEQWGSVAGEGDTINHQDDNAAP

SEQ ID NO: 135908 - protein, 34 aa, Artificial Sequence
  Description of Artificial Sequence: Synthetic polypeptide
DEEEIRTTNPVATEQWGSVAGEGDQNHQDDNQAN

SEQ ID NO: 135909 - protein, 34 aa, Artificial Sequence
  Description of Artificial Sequence: Synthetic polypeptide
DEEEIRTTNPVATEQWGSVAGEGAPPQPGGTPRM

SEQ ID NO: 135910 - protein, 32 aa, Artificial Sequence
  Description of Artificial Sequence: Synthetic polypeptide
DEEEIRTTNPVATECYGSVMGGMGGNEGGETS

SEQ ID NO: 135911 - protein, 34 aa, Artificial Sequence
  Description of Artificial Sequence: Synthetic polypeptide
DEEEIRTTNPVATECYGSVPCTEESSFNGGPNED

SEQ ID NO: 135912 - protein, 35 aa, Artificial Sequence
  Description of Artificial Sequence: Synthetic polypeptide
DEEEIRTTNPVATECYGSVSANTEAWPAERNGPYV

SEQ ID NO: 135913 - protein, 33 aa, Artificial Sequence
  Description of Artificial Sequence: Synthetic polypeptide
AEDEICATNPVATEQYGVVATSQNLEQLGGNDD

SEQ ID NO: 135914 - protein, 32 aa, Artificial Sequence
  Description of Artificial Sequence: Synthetic polypeptide
AEDEICATNPVATEQYGVVATSQENLQELGGD

SEQ ID NO: 135915 - protein, 33 aa, Artificial Sequence
  Description of Artificial Sequence: Synthetic polypeptide
AEDEICATNPVATEQYGVVATSNENNLQSGNGD

SEQ ID NO: 135916 - protein, 36 aa, Artificial Sequence
  Description of Artificial Sequence: Synthetic polypeptide
DEEEIRTTNPVATECYGSVCSTTPAGPNMRNGMNPV

SEQ ID NO: 135917 - protein, 34 aa, Artificial Sequence
  Description of Artificial Sequence: Synthetic polypeptide
DEEEIRTTNPVATECYGAMSTGNGGQGGDTDIFI

SEQ ID NO: 135918 - protein, 33 aa, Artificial Sequence
  Description of Artificial Sequence: Synthetic polypeptide
DEEEIRTTNPVATECYGAMSTGNGEDDGDTEEF

SEQ ID NO: 135919 - protein, 33 aa, Artificial Sequence
  Description of Artificial Sequence: Synthetic polypeptide
AEDEICATNPVATEQYGVVATVENLQAGNGMDE

SEQ ID NO: 135920 - protein, 36 aa, Artificial Sequence
  Description of Artificial Sequence: Synthetic polypeptide
DEEEIRTTNPVATEQWGSVSSNAPAWPNMRNGMNPV

SEQ ID NO: 135921 - protein, 36 aa, Artificial Sequence
  Description of Artificial Sequence: Synthetic polypeptide
DEEEIRTTNPVATEQWGSVSSNAPAGPNMRNGMNPV

SEQ ID NO: 135922 - protein, 34 aa, Artificial Sequence
  Description of Artificial Sequence: Synthetic polypeptide
DEEEIRTTNPVATEQWGSVSSEPAGPMMRAGMDV

SEQ ID NO: 135923 - protein, 33 aa, Artificial Sequence
  Description of Artificial Sequence: Synthetic polypeptide
DEEEIRTTNPVATEQWGSVSSEAGPMMRAEMDV

SEQ ID NO: 135924 - protein, 35 aa, Artificial Sequence
  Description of Artificial Sequence: Synthetic polypeptide
DEEEIRTTNPVATEQWGSVSSCPAGPNMRNGMNPV

SEQ ID NO: 135925 - protein, 35 aa, Artificial Sequence
  Description of Artificial Sequence: Synthetic polypeptide
DEEEIRTTNPVATEQWGSVSSCPAGPNMRNGMNPG

SEQ ID NO: 135926 - protein, 35 aa, Artificial Sequence
  Description of Artificial Sequence: Synthetic polypeptide
DEEEIRTTNPVATEQWGSVSSCPAGPNMRNGENPV

SEQ ID NO: 135927 - protein, 35 aa, Artificial Sequence
  Description of Artificial Sequence: Synthetic polypeptide
DEEEIRTTNPVATEQWGSVSSCPAGPNMRNGENPG

SEQ ID NO: 135928 - protein, 36 aa, Artificial Sequence
  Description of Artificial Sequence: Synthetic polypeptide
DEEEIRTTNPVCTEQYGSVSSTTPNGPNMSNGMNPV

SEQ ID NO: 135929 - protein, 34 aa, Artificial Sequence
  Description of Artificial Sequence: Synthetic polypeptide
DEEEIRTTNPVATECWGSDPCINEPQDREGENLG

SEQ ID NO: 135930 - protein, 36 aa, Artificial Sequence
  Description of Artificial Sequence: Synthetic polypeptide
DEEEIRTTNPVCTEQYGSVSSTTPAGPNMRNGMNPV

SEQ ID NO: 135931 - protein, 31 aa, Artificial Sequence
  Description of Artificial Sequence: Synthetic polypeptide
DDSEVRSTNPVSTEGYGNVATNTIQSRNGQR

SEQ ID NO: 135932 - protein, 36 aa, Artificial Sequence
  Description of Artificial Sequence: Synthetic polypeptide
DEEEIRTTNPVCTEQYGSVSNTTPAGPNMRNGMNPV

SEQ ID NO: 135933 - protein, 33 aa, Artificial Sequence
  Description of Artificial Sequence: Synthetic polypeptide
DEEEIRTTNPVATEQWGSVSMSGEGGQPPPQFA

SEQ ID NO: 135934 - protein, 30 aa, Artificial Sequence
  Description of Artificial Sequence: Synthetic polypeptide
DDSEVRSTNPVATEQYGNVANTEQNRAEDR

SEQ ID NO: 135935 - protein, 36 aa, Artificial Sequence
  Description of Artificial Sequence: Synthetic polypeptide
DEEEIRTTNPVATEQWGSVSGNPPAGPNMRNGMNTD

SEQ ID NO: 135936 - protein, 36 aa, Artificial Sequence
  Description of Artificial Sequence: Synthetic polypeptide
DEEEIRTTNPVATECWGSVASKTDNDMQDVIRMFRI

SEQ ID NO: 135937 - protein, 32 aa, Artificial Sequence
  Description of Artificial Sequence: Synthetic polypeptide
DDSEVRSTNPVATEGYGNVSANTEPQSRVGQR

SEQ ID NO: 135938 - protein, 34 aa, Artificial Sequence
  Description of Artificial Sequence: Synthetic polypeptide
DEEEIRTTNPVATECWGSVSSCPAGPNDRNGENG

SEQ ID NO: 135939 - protein, 36 aa, Artificial Sequence
  Description of Artificial Sequence: Synthetic polypeptide
DEEEIRTTNPVATECWGSVSSTCPNGPNDRNGMNPV

SEQ ID NO: 135940 - protein, 34 aa, Artificial Sequence
  Description of Artificial Sequence: Synthetic polypeptide
DEEEIRTTNPVATECYGAMSTGNFEGQGDTENFQ

SEQ ID NO: 135941 - protein, 36 aa, Artificial Sequence
  Description of Artificial Sequence: Synthetic polypeptide
DEEEIRTTNPVATECYGSVSPTTMASPNMRNGMNPV

SEQ ID NO: 135942 - protein, 36 aa, Artificial Sequence
  Description of Artificial Sequence: Synthetic polypeptide
DEEEIRTTNPVATEQWGSVSSNTPAGPNMRNGMNPV

SEQ ID NO: 135943 - protein, 33 aa, Artificial Sequence
  Description of Artificial Sequence: Synthetic polypeptide
AEDEICATNPVATEQYGVVATSNENLQLGGNDD

SEQ ID NO: 135944 - protein, 35 aa, Artificial Sequence
  Description of Artificial Sequence: Synthetic polypeptide
DEEEIRTTNPVAYEQYGQSVSQNDLLTPLGQISMG

SEQ ID NO: 135945 - protein, 36 aa, Artificial Sequence
  Description of Artificial Sequence: Synthetic polypeptide
DEEEIRTTNPVATEDYGSVSSTTPAGPNMRNGMNPV

SEQ ID NO: 135946 - protein, 32 aa, Artificial Sequence
  Description of Artificial Sequence: Synthetic polypeptide
AEDEICATNPVATEQYGVVATSENLQQLGGDG

SEQ ID NO: 135947 - protein, 29 aa, Artificial Sequence
  Description of Artificial Sequence: Synthetic peptide
YEEEIATTNPVATEQYGEAPEVCQHDEEK

SEQ ID NO: 135948 - protein, 35 aa, Artificial Sequence
  Description of Artificial Sequence: Synthetic polypeptide
DEEEIRTTNPVATEQWGHKNVSYTDNYLSEGPGEF

SEQ ID NO: 135949 - protein, 35 aa, Artificial Sequence
  Description of Artificial Sequence: Synthetic polypeptide
DEEEIRTTNPVATEQWGHINVPYPNELQHRPGGDF

SEQ ID NO: 135950 - protein, 32 aa, Artificial Sequence
  Description of Artificial Sequence: Synthetic polypeptide
AEDEICATNPVATEQYGVVATSENLQNLGQGD

SEQ ID NO: 135951 - protein, 32 aa, Artificial Sequence
  Description of Artificial Sequence: Synthetic polypeptide
AEDEICATNPVATEQYGVVATSENLQLGLGDD

SEQ ID NO: 135952 - protein, 32 aa, Artificial Sequence
  Description of Artificial Sequence: Synthetic polypeptide
AEDEICATNPVATEQYGVVATSENLQLEGGDD

SEQ ID NO: 135953 - protein, 30 aa, Artificial Sequence
  Description of Artificial Sequence: Synthetic polypeptide
DEEEIRTTNPVATEQWGEASEICMNHAEDA

SEQ ID NO: 135954 - protein, 36 aa, Artificial Sequence
  Description of Artificial Sequence: Synthetic polypeptide
DEEEIRTTNPVATEQWGHSNVSYTANELEHIPEGQF

SEQ ID NO: 135955 - protein, 29 aa, Artificial Sequence
  Description of Artificial Sequence: Synthetic peptide
DEEEIRTTNPVATEQWGEAPEICMNAEDK

SEQ ID NO: 135956 - protein, 36 aa, Artificial Sequence
  Description of Artificial Sequence: Synthetic polypeptide
DEEEIRTTNPVAYEVYGSTVYSCTNATSQNRAPNNG

SEQ ID NO: 135957 - protein, 36 aa, Artificial Sequence
  Description of Artificial Sequence: Synthetic polypeptide
DEEEIRTTNPVAYEVYGSTVYSCTNATSQNHGENNG

SEQ ID NO: 135958 - protein, 30 aa, Artificial Sequence
  Description of Artificial Sequence: Synthetic polypeptide
DDSEVATTNPVSTEQYGNVAANTPQREGQD

SEQ ID NO: 135959 - protein, 35 aa, Artificial Sequence
  Description of Artificial Sequence: Synthetic polypeptide
DEEEIRTTNPVAYEVYGSTVSCTANADSNASGNNG

SEQ ID NO: 135960 - protein, 34 aa, Artificial Sequence
  Description of Artificial Sequence: Synthetic polypeptide
DEEEIRTTNPVAYEVYGSTVPCCNTSQNSGNNAI

SEQ ID NO: 135961 - protein, 35 aa, Artificial Sequence
  Description of Artificial Sequence: Synthetic polypeptide
DEEEIRTTNPVAYEVYGSTVFCTNATSNNRDGNNG

SEQ ID NO: 135962 - protein, 36 aa, Artificial Sequence
  Description of Artificial Sequence: Synthetic polypeptide
DEEEIRTTNPVAYEVYGSTVASCTQNATSENRGNNG

SEQ ID NO: 135963 - protein, 30 aa, Artificial Sequence
  Description of Artificial Sequence: Synthetic polypeptide
YEEEIATTNPVCTEQWGVVSDIEQNSAENQ

SEQ ID NO: 135964 - protein, 32 aa, Artificial Sequence
  Description of Artificial Sequence: Synthetic polypeptide
YEEEIATTNPVCTEQYGATWSNAENLAEPGNQ

SEQ ID NO: 135965 - protein, 33 aa, Artificial Sequence
  Description of Artificial Sequence: Synthetic polypeptide
AEDEICATNPVATEQYGVVATSENLNQELGNGD

SEQ ID NO: 135966 - protein, 33 aa, Artificial Sequence
  Description of Artificial Sequence: Synthetic polypeptide
AEDEICATNPVATEQYGVVATSENLQQSGNGDD

SEQ ID NO: 135967 - protein, 34 aa, Artificial Sequence
  Description of Artificial Sequence: Synthetic polypeptide
DEEEIRTTNPVCTEGYGCVCSWPELQENFGSNLS

SEQ ID NO: 135968 - protein, 33 aa, Artificial Sequence
  Description of Artificial Sequence: Synthetic polypeptide
DEEEIRTTNPVCTEGYGCVCSWPNDQNFGSDQS

SEQ ID NO: 135969 - protein, 36 aa, Artificial Sequence
  Description of Artificial Sequence: Synthetic polypeptide
DEEEIRTTNPVATECYGSVSSTTPAGPNMRNGMNPV

SEQ ID NO: 135970 - protein, 36 aa, Artificial Sequence
  Description of Artificial Sequence: Synthetic polypeptide
DEEEIRTTNPVATECYGSVSSTTPAGPNMRNGMNYV

SEQ ID NO: 135971 - protein, 31 aa, Artificial Sequence
  Description of Artificial Sequence: Synthetic polypeptide
YEEEIASVNPVCTEQYGVVWSDENLAEPGNQ

SEQ ID NO: 135972 - protein, 35 aa, Artificial Sequence
  Description of Artificial Sequence: Synthetic polypeptide
DEEEIRTTNPVATECYGSVSSTTPAGPQHNEMNPV

SEQ ID NO: 135973 - protein, 37 aa, Artificial Sequence
  Description of Artificial Sequence: Synthetic polypeptide
DEEEIRTTNPVATEQWGQCNVCSYTNALQARFGSDQA

SEQ ID NO: 135974 - protein, 36 aa, Artificial Sequence
  Description of Artificial Sequence: Synthetic polypeptide
DEEEIRTTNPVATECYGSVSSTTPCGPNMRNGMNPL

SEQ ID NO: 135975 - protein, 29 aa, Artificial Sequence
  Description of Artificial Sequence: Synthetic peptide
YEEEIASVNPVCTEYYGVESDNLQSGAQH

SEQ ID NO: 135976 - protein, 34 aa, Artificial Sequence
  Description of Artificial Sequence: Synthetic polypeptide
DEEEIRTTNPVCTEHYGCVCSWPNHQNFGSDNQS

SEQ ID NO: 135977 - protein, 32 aa, Artificial Sequence
  Description of Artificial Sequence: Synthetic polypeptide
DDSEVATTNPVSTEQYGSVSATDLQSHEGQDL

SEQ ID NO: 135978 - protein, 35 aa, Artificial Sequence
  Description of Artificial Sequence: Synthetic polypeptide
DEEEIRTTNPVATEQWGKVSCQPAMASQEGGNTRK

SEQ ID NO: 135979 - protein, 31 aa, Artificial Sequence
  Description of Artificial Sequence: Synthetic polypeptide
YEEEIASVNPVCYEQYGVVSINELSQSGGNE

SEQ ID NO: 135980 - protein, 32 aa, Artificial Sequence
  Description of Artificial Sequence: Synthetic polypeptide
AEDEICATNPVATEQYGVVATSEQNLQLGTGD

SEQ ID NO: 135981 - protein, 36 aa, Artificial Sequence
  Description of Artificial Sequence: Synthetic polypeptide
DEEEIRTTNPVATEQWGICNVCSYTNDLNARFGSGA

SEQ ID NO: 135982 - protein, 32 aa, Artificial Sequence
  Description of Artificial Sequence: Synthetic polypeptide
DDSEVATTNPVSTEQYGSVSANDLQSHEGQDL

SEQ ID NO: 135983 - protein, 35 aa, Artificial Sequence
  Description of Artificial Sequence: Synthetic polypeptide
DEEEIRTTNPVATEQWGHVNVSYPNELDHRPGMGF

SEQ ID NO: 135984 - protein, 35 aa, Artificial Sequence
  Description of Artificial Sequence: Synthetic polypeptide
DEEEIRTTNPVATECYGSVVGFGNNLTDGQENGQG

SEQ ID NO: 135985 - protein, 31 aa, Artificial Sequence
  Description of Artificial Sequence: Synthetic polypeptide
DDSEVATTNPVSTEQYGNVSANTIQSRVEDR

SEQ ID NO: 135986 - protein, 31 aa, Artificial Sequence
  Description of Artificial Sequence: Synthetic polypeptide
DDSEVATTNPVSTEQYGNVAATGIQSREGQR

SEQ ID NO: 135987 - protein, 37 aa, Artificial Sequence
  Description of Artificial Sequence: Synthetic polypeptide
DEEEIRTTNPVATEQWGHSNVSYTNNLQHIRPDDQFM

SEQ ID NO: 135988 - protein, 34 aa, Artificial Sequence
  Description of Artificial Sequence: Synthetic polypeptide
DEEEIRTTNPVATECYGSVVSGMDQETGGEDGGI

SEQ ID NO: 135989 - protein, 33 aa, Artificial Sequence
  Description of Artificial Sequence: Synthetic polypeptide
AEDEICATNPVATEQYGVVATSENLQSGNGEDT

SEQ ID NO: 135990 - protein, 36 aa, Artificial Sequence
  Description of Artificial Sequence: Synthetic polypeptide
DEEEIRTTNPVATECYGSVSSTTPAGPNMRKGMNYV

SEQ ID NO: 135991 - protein, 32 aa, Artificial Sequence
  Description of Artificial Sequence: Synthetic polypeptide
YEEEIASVNPVCTEQYGSVSDPNGQMSGMNPV

SEQ ID NO: 135992 - protein, 36 aa, Artificial Sequence
  Description of Artificial Sequence: Synthetic polypeptide
DEEEIRTTNPVATEQWGSVSSTCPAGPNMRNGMNPV

SEQ ID NO: 135993 - protein, 35 aa, Artificial Sequence
  Description of Artificial Sequence: Synthetic polypeptide
DEEEIRTTNPVCTEQYGVVSSTDNGPNMSNGMNPV

SEQ ID NO: 135994 - protein, 37 aa, Artificial Sequence
  Description of Artificial Sequence: Synthetic polypeptide
DEEEIRTTNPVATEQWGTVISCTINPLSQRTVQNNNL

SEQ ID NO: 135995 - protein, 33 aa, Artificial Sequence
  Description of Artificial Sequence: Synthetic polypeptide
AEDEICATNPVATEQYGVVAVSNENQLQQGNGD

SEQ ID NO: 135996 - protein, 34 aa, Artificial Sequence
  Description of Artificial Sequence: Synthetic polypeptide
DEEEIRTTNPVGTEQWGSVSTDGLGGRPIDFTAM

SEQ ID NO: 135997 - protein, 35 aa, Artificial Sequence
  Description of Artificial Sequence: Synthetic polypeptide
DEEEIRTTNPVGTEQWGSVSTANEPGERAGDQDAQ

SEQ ID NO: 135998 - protein, 32 aa, Artificial Sequence
  Description of Artificial Sequence: Synthetic polypeptide
AEDEICATNPVATEQYGVVAVSNENLQQQGGD

SEQ ID NO: 135999 - protein, 35 aa, Artificial Sequence
  Description of Artificial Sequence: Synthetic polypeptide
DEEEIRTTNPVGTEQWGSVSTANELGERLIDFAAM

SEQ ID NO: 136000 - protein, 32 aa, Artificial Sequence
  Description of Artificial Sequence: Synthetic polypeptide
DDSEVRTTNPVSTEGWGSVSCTIPQSRVGEQR

SEQ ID NO: 136001 - protein, 32 aa, Artificial Sequence
  Description of Artificial Sequence: Synthetic polypeptide
DDSEVRTTNPVSTEGWGSVSCTEPQSRVGEQR

SEQ ID NO: 136002 - protein, 34 aa, Artificial Sequence
  Description of Artificial Sequence: Synthetic polypeptide
DEEEIRTTNPVATEQWGTNVCAGTMDLNHGNESQ

SEQ ID NO: 136003 - protein, 32 aa, Artificial Sequence
  Description of Artificial Sequence: Synthetic polypeptide
DDSEVRTTNPVSTEGWGSVSNTIPQSRVGEQR

SEQ ID NO: 136004 - protein, 36 aa, Artificial Sequence
  Description of Artificial Sequence: Synthetic polypeptide
DEEEIRTTNPVGTEQWGSVSGTANELGGERGMDIAA

SEQ ID NO: 136005 - protein, 33 aa, Artificial Sequence
  Description of Artificial Sequence: Synthetic polypeptide
DEEEIRTTNPVATEQWGTNCSAALLGNGQNDSK

SEQ ID NO: 136006 - protein, 33 aa, Artificial Sequence
  Description of Artificial Sequence: Synthetic polypeptide
DEEEIRTTNPVATEQWGTNCAGTMNLEHMDNES

SEQ ID NO: 136007 - protein, 32 aa, Artificial Sequence
  Description of Artificial Sequence: Synthetic polypeptide
DEEEIRTTNPVATEQWGTNCAGPMNLLHMNEF

SEQ ID NO: 136008 - protein, 35 aa, Artificial Sequence
  Description of Artificial Sequence: Synthetic polypeptide
DEEEIRTTNPVATEQWGSVYHWTNDHQKTDGHEGK

SEQ ID NO: 136009 - protein, 34 aa, Artificial Sequence
  Description of Artificial Sequence: Synthetic polypeptide
DEEEIRTTNPVGTEQWGNVSTANEPGERGDQTAQ

SEQ ID NO: 136010 - protein, 35 aa, Artificial Sequence
  Description of Artificial Sequence: Synthetic polypeptide
DEEEIRTTNPVATEQWGSVYHWTNDHQKTDGHDSG

SEQ ID NO: 136011 - protein, 35 aa, Artificial Sequence
  Description of Artificial Sequence: Synthetic polypeptide
DEEEIRTTNPVATEQWGSVYHWTNDHQKTDGDHEN

SEQ ID NO: 136012 - protein, 38 aa, Artificial Sequence
  Description of Artificial Sequence: Synthetic polypeptide
DEEEIRTTNPVATEAYGVVSVVVSTNLQSGNVNDEQSE

SEQ ID NO: 136013 - protein, 33 aa, Artificial Sequence
  Description of Artificial Sequence: Synthetic polypeptide
AEDEICATNPVATEQYGVVAVSNENLQLGTGND

SEQ ID NO: 136014 - protein, 34 aa, Artificial Sequence
  Description of Artificial Sequence: Synthetic polypeptide
DEEEIRTTNPVATEQWGTNCSVANALMNRSNDSW

SEQ ID NO: 136015 - protein, 37 aa, Artificial Sequence
  Description of Artificial Sequence: Synthetic polypeptide
DEEEIRTTNPVATEAYGVVSTVVTNLQSGNNQDEDEE

SEQ ID NO: 136016 - protein, 37 aa, Artificial Sequence
  Description of Artificial Sequence: Synthetic polypeptide
DEEEIRTTNPVATEAYGVVSTVVTNLQAGSNDDEDEE

SEQ ID NO: 136017 - protein, 37 aa, Artificial Sequence
  Description of Artificial Sequence: Synthetic polypeptide
DEEEIRTTNPVATEAYGVVSTVVTNLQAGNQEEEEED

SEQ ID NO: 136018 - protein, 38 aa, Artificial Sequence
  Description of Artificial Sequence: Synthetic polypeptide
DEEEIRTTNPVATEAYGVVSTVVSTNLQAGSNEQQGDD

SEQ ID NO: 136019 - protein, 37 aa, Artificial Sequence
  Description of Artificial Sequence: Synthetic polypeptide
DEEEIRTTNPVATEQWGYSNVTATNELQHQRPGQGFA

SEQ ID NO: 136020 - protein, 31 aa, Artificial Sequence
  Description of Artificial Sequence: Synthetic polypeptide
YEEEIASVNPVCTEQYGTVSADDGLQFEGND

SEQ ID NO: 136021 - protein, 34 aa, Artificial Sequence
  Description of Artificial Sequence: Synthetic polypeptide
DEEEIRTTNPVGTEQYGCVCSTNDPAEYFGSDQS

SEQ ID NO: 136022 - protein, 37 aa, Artificial Sequence
  Description of Artificial Sequence: Synthetic polypeptide
DEEEIRTTNPVATEQWGYSNVSATNELQHQAPIQGFD

SEQ ID NO: 136023 - protein, 35 aa, Artificial Sequence
  Description of Artificial Sequence: Synthetic polypeptide
DEEEIRTTNPVGTEQYGCVCSTNDHGENFGSDNQA

SEQ ID NO: 136024 - protein, 34 aa, Artificial Sequence
  Description of Artificial Sequence: Synthetic polypeptide
DEEEIRTTNPVGTEQYGCVCSTNAHNANFGSQQA

SEQ ID NO: 136025 - protein, 37 aa, Artificial Sequence
  Description of Artificial Sequence: Synthetic polypeptide
DEEEIRTTNPVATEQWGYSNVAATNELQHQRPGQSFQ

SEQ ID NO: 136026 - protein, 31 aa, Artificial Sequence
  Description of Artificial Sequence: Synthetic polypeptide
DDSEVRTTNPVSTEGYGNVAANTIQSRAGDR

SEQ ID NO: 136027 - protein, 37 aa, Artificial Sequence
  Description of Artificial Sequence: Synthetic polypeptide
DEEEIRTTNPVATEQWGYENVSATVNELQHRPGQGGL

SEQ ID NO: 136028 - protein, 35 aa, Artificial Sequence
  Description of Artificial Sequence: Synthetic polypeptide
DEEEIRTTNPVGTEQYGCVCSTEDHNINFGSDNQA

SEQ ID NO: 136029 - protein, 33 aa, Artificial Sequence
  Description of Artificial Sequence: Synthetic polypeptide
DEEEIRTTNPVGTEQYGCVCSTADHANFGSDQA

SEQ ID NO: 136030 - protein, 36 aa, Artificial Sequence
  Description of Artificial Sequence: Synthetic polypeptide
DEEEIRTTNPVATEQWGVVSSTNPEGPNMRNGMNPE

SEQ ID NO: 136031 - protein, 36 aa, Artificial Sequence
  Description of Artificial Sequence: Synthetic polypeptide
DEEEIRTTNPVATEQWGVVNVVTTNLQQSATTGGNF

SEQ ID NO: 136032 - protein, 35 aa, Artificial Sequence
  Description of Artificial Sequence: Synthetic polypeptide
DEEEIRTTNPVATEQWGVVNVVTTNLEQSTTTGGF

SEQ ID NO: 136033 - protein, 34 aa, Artificial Sequence
  Description of Artificial Sequence: Synthetic polypeptide
DEEEIRTTNPVATEQWGTVVVVTTTELLQGTNSD

SEQ ID NO: 136034 - protein, 38 aa, Artificial Sequence
  Description of Artificial Sequence: Synthetic polypeptide
DEEEIRTTNPVATEAYGVVSTVVSTNLQAGTNVQGTDD

SEQ ID NO: 136035 - protein, 38 aa, Artificial Sequence
  Description of Artificial Sequence: Synthetic polypeptide
DEEEIRTTNPVATEAYGVVSTVVSTNLQSGNANDEQQE

SEQ ID NO: 136036 - protein, 38 aa, Artificial Sequence
  Description of Artificial Sequence: Synthetic polypeptide
DEEEIRTTNPVATEAYGVVSTVVSTNLQSGNENEEQDE

SEQ ID NO: 136037 - protein, 38 aa, Artificial Sequence
  Description of Artificial Sequence: Synthetic polypeptide
DEEEIRTTNPVATEAYGVVSTVVSTNLQYGNTNDEQGE

SEQ ID NO: 136038 - protein, 37 aa, Artificial Sequence
  Description of Artificial Sequence: Synthetic polypeptide
DEEEIRTTNPVATEAYGVVSTVVTNLQAGNNNDEENE

SEQ ID NO: 136039 - protein, 32 aa, Artificial Sequence
  Description of Artificial Sequence: Synthetic polypeptide
AEDEICATNPVATEQYGVVAVSENQLQLGGGD

SEQ ID NO: 136040 - protein, 36 aa, Artificial Sequence
  Description of Artificial Sequence: Synthetic polypeptide
DEEEIRTTNPVATEQWGSVSSTGPAGPNMRNGMNPG

SEQ ID NO: 136041 - protein, 35 aa, Artificial Sequence
  Description of Artificial Sequence: Synthetic polypeptide
DEEEIRTTNPVGTEIYGSVNIMDNILQREGGQDGD

SEQ ID NO: 136042 - protein, 32 aa, Artificial Sequence
  Description of Artificial Sequence: Synthetic polypeptide
AEDEICATNPVATEQYGVVAVSENLQQQGEGD

SEQ ID NO: 136043 - protein, 36 aa, Artificial Sequence
  Description of Artificial Sequence: Synthetic polypeptide
DEEEIRTTNPVATEQWGSVSSTTPAGSNTRNGGNNV

SEQ ID NO: 136044 - protein, 31 aa, Artificial Sequence
  Description of Artificial Sequence: Synthetic polypeptide
DDSEVRTTNPVATEQWGNVSANTEMNRAEDR

SEQ ID NO: 136045 - protein, 36 aa, Artificial Sequence
  Description of Artificial Sequence: Synthetic polypeptide
DEEEIRTTNPVATEQWGSVSSTTPAGPNMYNGMNPV

SEQ ID NO: 136046 - protein, 30 aa, Artificial Sequence
  Description of Artificial Sequence: Synthetic polypeptide
DDSEVRTTNPVATEQWGDVSNIEMNRAEDR

SEQ ID NO: 136047 - protein, 31 aa, Artificial Sequence
  Description of Artificial Sequence: Synthetic polypeptide
DDSEVRTTNPVATEQWGDVSANTEMNRAEDR

SEQ ID NO: 136048 - protein, 31 aa, Artificial Sequence
  Description of Artificial Sequence: Synthetic polypeptide
DDSEVRTTNPVATEQWGDVSANIEMNRAEDR

SEQ ID NO: 136049 - protein, 37 aa, Artificial Sequence
  Description of Artificial Sequence: Synthetic polypeptide
DEEEIRTTNPVAYEQYGQSVSPVTNGLLQIRTVEQTT

SEQ ID NO: 136050 - protein, 36 aa, Artificial Sequence
  Description of Artificial Sequence: Synthetic polypeptide
DEEEIRTTNPVATEQWGSVSSTTPAGPNMRNGMNYV

SEQ ID NO: 136051 - protein, 36 aa, Artificial Sequence
  Description of Artificial Sequence: Synthetic polypeptide
DEEEIRTTNPVATEQWGSVSSTTPAGPNMRNGMNPV

SEQ ID NO: 136052 - protein, 36 aa, Artificial Sequence
  Description of Artificial Sequence: Synthetic polypeptide
DEEEIRTTNPVATEQWGSVSSTTPDGPNERNGMNPV

SEQ ID NO: 136053 - protein, 36 aa, Artificial Sequence
  Description of Artificial Sequence: Synthetic polypeptide
DEEEIRTTNPVATEQWGSVSSTTPAGPNMREGMNPV

SEQ ID NO: 136054 - protein, 37 aa, Artificial Sequence
  Description of Artificial Sequence: Synthetic polypeptide
DEEEIRTTNPVAYEQYGQSVSPVTNGYLQMRETVDQT

SEQ ID NO: 136055 - protein, 36 aa, Artificial Sequence
  Description of Artificial Sequence: Synthetic polypeptide
DEEEIRTTNPVATEQWGSVSSTTPAGPNMPNGMNYV

SEQ ID NO: 136056 - protein, 34 aa, Artificial Sequence
  Description of Artificial Sequence: Synthetic polypeptide
DEEEIRTTNPVCYEHYGSVSMPEALPQATPGNQL

SEQ ID NO: 136057 - protein, 34 aa, Artificial Sequence
  Description of Artificial Sequence: Synthetic polypeptide
DEEEIRTTNPVCYEHYGSVHMPNELSQSTGGNNL

SEQ ID NO: 136058 - protein, 36 aa, Artificial Sequence
  Description of Artificial Sequence: Synthetic polypeptide
DEEEIRTTNPVATEQWGSVSSTTPAGPNERNGMNPV

SEQ ID NO: 136059 - protein, 35 aa, Artificial Sequence
  Description of Artificial Sequence: Synthetic polypeptide
DEEEIRTTNPVATEQWGSVSSTTPAGPMMRAGMDV

SEQ ID NO: 136060 - protein, 36 aa, Artificial Sequence
  Description of Artificial Sequence: Synthetic polypeptide
DEEEIRTTNPVATEQWGSVSSTTPAGMNMRNGMNPV

SEQ ID NO: 136061 - protein, 36 aa, Artificial Sequence
  Description of Artificial Sequence: Synthetic polypeptide
DEEEIRTTNPVATEQWGSVSSTTIAGPNMRNGMNPV

SEQ ID NO: 136062 - protein, 36 aa, Artificial Sequence
  Description of Artificial Sequence: Synthetic polypeptide
DEEEIRTTNPVATEQWGSVSSTTGQGPNMRNGMGEE

SEQ ID NO: 136063 - protein, 34 aa, Artificial Sequence
  Description of Artificial Sequence: Synthetic polypeptide
DEEEIRTTNPVCYEHYGSVSMPNAPPQWTPGNQL

SEQ ID NO: 136064 - protein, 34 aa, Artificial Sequence
  Description of Artificial Sequence: Synthetic polypeptide
DEEEIRTTNPVATEQWGSVSSTTPIENNAAEMDA

SEQ ID NO: 136065 - protein, 37 aa, Artificial Sequence
  Description of Artificial Sequence: Synthetic polypeptide
DEEEIRTTNPVATEQWGSVSSTTPQDGPNMRNGGNAV

SEQ ID NO: 136066 - protein, 36 aa, Artificial Sequence
  Description of Artificial Sequence: Synthetic polypeptide
DEEEIRTTNPVATEQWGSVSSTTPQGPNMHNGMNPV

SEQ ID NO: 136067 - protein, 32 aa, Artificial Sequence
  Description of Artificial Sequence: Synthetic polypeptide
AEDEICATNPVATEQYGVVAVSENLQLQGGTD

SEQ ID NO: 136068 - protein, 31 aa, Artificial Sequence
  Description of Artificial Sequence: Synthetic polypeptide
DEEEIRTTNPVATECWGEAPCVCPQDRGEEK

SEQ ID NO: 136069 - protein, 34 aa, Artificial Sequence
  Description of Artificial Sequence: Synthetic polypeptide
DEEEIRTTNPVGTEHWGSVYCMPNMQDDQRQGNL

SEQ ID NO: 136070 - protein, 32 aa, Artificial Sequence
  Description of Artificial Sequence: Synthetic polypeptide
DEEEIRTTNPVATECWGEVPCINEPQDREEEG

SEQ ID NO: 136071 - protein, 34 aa, Artificial Sequence
  Description of Artificial Sequence: Synthetic polypeptide
DEEEIRTTNPVGTEGYGVVSSTPAGPNMRGMNPV

SEQ ID NO: 136072 - protein, 33 aa, Artificial Sequence
  Description of Artificial Sequence: Synthetic polypeptide
DEEEIRTTNPVGTEGYGVVSSTPAGPNMHGMNV

SEQ ID NO: 136073 - protein, 36 aa, Artificial Sequence
  Description of Artificial Sequence: Synthetic polypeptide
DEEEIRTTNPVAYEQYGQSVSNTVGLLGHIGIEQRQ

SEQ ID NO: 136074 - protein, 34 aa, Artificial Sequence
  Description of Artificial Sequence: Synthetic polypeptide
DEEEIRTTNPVGTEGYGSVNIMDNGQGEGGNDGD

SEQ ID NO: 136075 - protein, 31 aa, Artificial Sequence
  Description of Artificial Sequence: Synthetic polypeptide
DEEEIRTTNPVATECWGEVPCIVEPQDREEG

SEQ ID NO: 136076 - protein, 31 aa, Artificial Sequence
  Description of Artificial Sequence: Synthetic polypeptide
DEEEIRTTNPVATECWGEVPEIVEPQDREEG

SEQ ID NO: 136077 - protein, 36 aa, Artificial Sequence
  Description of Artificial Sequence: Synthetic polypeptide
DEEEIRTTNPVAYEQYGQSVSNTVGLLQAIDIEQRQ

SEQ ID NO: 136078 - protein, 34 aa, Artificial Sequence
  Description of Artificial Sequence: Synthetic polypeptide
DEEEIRTTNPVATECWGMHCWTMNEQDRGRNGDT

SEQ ID NO: 136079 - protein, 32 aa, Artificial Sequence
  Description of Artificial Sequence: Synthetic polypeptide
DEEEIRTTNPVATECWGMHCWTMNEQDRNDFG

SEQ ID NO: 136080 - protein, 36 aa, Artificial Sequence
  Description of Artificial Sequence: Synthetic polypeptide
DEEEIRTTNPVAYEQYGQSVSNTVGLLQQITVSQNE

SEQ ID NO: 136081 - protein, 29 aa, Artificial Sequence
  Description of Artificial Sequence: Synthetic peptide
DDSEVASTNPVSTEGYGNVAANTIQRGTR

SEQ ID NO: 136082 - protein, 35 aa, Artificial Sequence
  Description of Artificial Sequence: Synthetic polypeptide
DEEEIRTTNPVGTEFYGSVNISDNIGQLEGGNDGD

SEQ ID NO: 136083 - protein, 33 aa, Artificial Sequence
  Description of Artificial Sequence: Synthetic polypeptide
DEEEIRTTNPVATECWGMHCWTMNEQDRRMNDT

SEQ ID NO: 136084 - protein, 34 aa, Artificial Sequence
  Description of Artificial Sequence: Synthetic polypeptide
DEEEIRTTNPVGTECWGSVYCMDNDQDERQGMNE

SEQ ID NO: 136085 - protein, 34 aa, Artificial Sequence
  Description of Artificial Sequence: Synthetic polypeptide
DEEEIRTTNPVATECWGMHCWTMNEQQERRGNED

SEQ ID NO: 136086 - protein, 36 aa, Artificial Sequence
  Description of Artificial Sequence: Synthetic polypeptide
DEEEIRTTNPVATEQWGSVSSTTPRGPNMRNGMNPV

SEQ ID NO: 136087 - protein, 31 aa, Artificial Sequence
  Description of Artificial Sequence: Synthetic polypeptide
DDSEVRTTNPVATEQWGNVSANTEMNRVEDR

SEQ ID NO: 136088 - protein, 33 aa, Artificial Sequence
  Description of Artificial Sequence: Synthetic polypeptide
DEEEIRTTNPVGTEIYGSVIDGTNGEGTGGEED

SEQ ID NO: 136089 - protein, 35 aa, Artificial Sequence
  Description of Artificial Sequence: Synthetic polypeptide
SEEEIRTTNPVATEQYGCVCSWGNLDQNFNSNTQS

SEQ ID NO: 136090 - protein, 35 aa, Artificial Sequence
  Description of Artificial Sequence: Synthetic polypeptide
DEEEIRTTNPVATEQYGCVCSNTMEHQEHFGSEQF

SEQ ID NO: 136091 - protein, 35 aa, Artificial Sequence
  Description of Artificial Sequence: Synthetic polypeptide
AEEEICTTNPVATEQYGVVATVNLQVGEEQNEEEE

SEQ ID NO: 136092 - protein, 35 aa, Artificial Sequence
  Description of Artificial Sequence: Synthetic polypeptide
DEEEIRTTNPVATEQYGCVCSTWEHNENFNSDNQA

SEQ ID NO: 136093 - protein, 38 aa, Artificial Sequence
  Description of Artificial Sequence: Synthetic polypeptide
AEEEIRTTNPVATEQYGSVSTNANLQNNNTEQGTNTEE

SEQ ID NO: 136094 - protein, 38 aa, Artificial Sequence
  Description of Artificial Sequence: Synthetic polypeptide
AEEEIRTTNPVATEQYGSVSTNANLQNNNSEQGNNTDE

SEQ ID NO: 136095 - protein, 38 aa, Artificial Sequence
  Description of Artificial Sequence: Synthetic polypeptide
AEEEIRTTNPVATEQYGSVSTNANLQNNNNEQGNNNVE

SEQ ID NO: 136096 - protein, 38 aa, Artificial Sequence
  Description of Artificial Sequence: Synthetic polypeptide
AEEEIRTTNPVATEQYGSVSTNANLQNLNSEQGNNNEE

SEQ ID NO: 136097 - protein, 38 aa, Artificial Sequence
  Description of Artificial Sequence: Synthetic polypeptide
AEEEIRTTNPVATEQYGSVSTNANLQNGNQEQGNNTTE

SEQ ID NO: 136098 - protein, 38 aa, Artificial Sequence
  Description of Artificial Sequence: Synthetic polypeptide
AEEEIRTTNPVATEQYGSVSTNANLQNATTEQGNNNVE

SEQ ID NO: 136099 - protein, 38 aa, Artificial Sequence
  Description of Artificial Sequence: Synthetic polypeptide
AEEEIRTTNPVATEQYGSVSTNANLQNANTEQGVNTQE

SEQ ID NO: 136100 - protein, 38 aa, Artificial Sequence
  Description of Artificial Sequence: Synthetic polypeptide
AEEEIRTTNPVATEQYGSVSTNANLQGANSEQGNNNVE

SEQ ID NO: 136101 - protein, 35 aa, Artificial Sequence
  Description of Artificial Sequence: Synthetic polypeptide
DEEEIRTTNPVATEQYGCVCSTWGEHDQNFNSDQA

SEQ ID NO: 136102 - protein, 38 aa, Artificial Sequence
  Description of Artificial Sequence: Synthetic polypeptide
AEEEIRTTNPVATEQYGSVSTNANLQAGNLEQGNNAVE

SEQ ID NO: 136103 - protein, 36 aa, Artificial Sequence
  Description of Artificial Sequence: Synthetic polypeptide
DEEEIRTTNPVATEQYGCVCSTTPAHNTERSGSDPV

SEQ ID NO: 136104 - protein, 36 aa, Artificial Sequence
  Description of Artificial Sequence: Synthetic polypeptide
DEEEIRTTNPVATEQYGCVCSTTPAGFNNRFGSNPV

SEQ ID NO: 136105 - protein, 35 aa, Artificial Sequence
  Description of Artificial Sequence: Synthetic polypeptide
DEEEISTTNPVATEQYGQCVCSNTNHQYFGSETQA

SEQ ID NO: 136106 - protein, 35 aa, Artificial Sequence
  Description of Artificial Sequence: Synthetic polypeptide
DEEEISTTNPVATEQYGQCVCSNTNDQNFGSETQA

SEQ ID NO: 136107 - protein, 37 aa, Artificial Sequence
  Description of Artificial Sequence: Synthetic polypeptide
DEEEIRTTNPVATEQYGCVCSTTPADNTERFGFNPVA

SEQ ID NO: 136108 - protein, 36 aa, Artificial Sequence
  Description of Artificial Sequence: Synthetic polypeptide
DEEEIRTTNPVATEQYGCVCSTTPADFNENFGSNPV

SEQ ID NO: 136109 - protein, 36 aa, Artificial Sequence
  Description of Artificial Sequence: Synthetic polypeptide
DEEEIRTTNPVATEQYGCVCSTTPADDNERSGSNPV

SEQ ID NO: 136110 - protein, 31 aa, Artificial Sequence
  Description of Artificial Sequence: Synthetic polypeptide
SENEIRCTNPVSTEQYGTVSMEDIMQQNGNH

SEQ ID NO: 136111 - protein, 35 aa, Artificial Sequence
  Description of Artificial Sequence: Synthetic polypeptide
AEEEIRTTNPVATEQYGSVSTIGNNNNQQNDEQGS

SEQ ID NO: 136112 - protein, 38 aa, Artificial Sequence
  Description of Artificial Sequence: Synthetic polypeptide
AEEEIRTTNPVATEQYGSVSTNAANLQNNNEQGTNNVE

SEQ ID NO: 136113 - protein, 30 aa, Artificial Sequence
  Description of Artificial Sequence: Synthetic polypeptide
SENEIATTNPVATEGYGCVSWELNQHSSEL

SEQ ID NO: 136114 - protein, 35 aa, Artificial Sequence
  Description of Artificial Sequence: Synthetic polypeptide
DEEEIRTTNPVATEQYGCVCSTWGEHNQNFGSEQA

SEQ ID NO: 136115 - protein, 30 aa, Artificial Sequence
  Description of Artificial Sequence: Synthetic polypeptide
SENEIATTNPVATECYGCVSWELQHFESEQ

SEQ ID NO: 136116 - protein, 34 aa, Artificial Sequence
  Description of Artificial Sequence: Synthetic polypeptide
SEMEIRTTNPVATEQYGCVSTVNYNDERDEDNQE

SEQ ID NO: 136117 - protein, 33 aa, Artificial Sequence
  Description of Artificial Sequence: Synthetic polypeptide
SEMEIRTTNPVATEQYGSVASPALQQEHQFDQF

SEQ ID NO: 136118 - protein, 36 aa, Artificial Sequence
  Description of Artificial Sequence: Synthetic polypeptide
AEEEIRTTNPVATEQYGSVSTNGNNENDETGTNTTE

SEQ ID NO: 136119 - protein, 35 aa, Artificial Sequence
  Description of Artificial Sequence: Synthetic polypeptide
DEEEIRTTNPVATEQYGCVCSVSGEPNQNFISNQA

SEQ ID NO: 136120 - protein, 36 aa, Artificial Sequence
  Description of Artificial Sequence: Synthetic polypeptide
DEEEIRTTNPVATEQYGCVCSVSGELNQNFISNNQS

SEQ ID NO: 136121 - protein, 31 aa, Artificial Sequence
  Description of Artificial Sequence: Synthetic polypeptide
SEMEIVCTNPVATEQYGTVSEDNPVEFEGND

SEQ ID NO: 136122 - protein, 35 aa, Artificial Sequence
  Description of Artificial Sequence: Synthetic polypeptide
DEEEIRTTNPVATEQYGCVCSVSGEDNQNFNSDAA

SEQ ID NO: 136123 - protein, 38 aa, Artificial Sequence
  Description of Artificial Sequence: Synthetic polypeptide
AEEEIRTTNPVATEQYGSVSTNGANLQQNTEQGNNNVE

SEQ ID NO: 136124 - protein, 33 aa, Artificial Sequence
  Description of Artificial Sequence: Synthetic polypeptide
DEEEIRTTNPLAYEQYGCVSCCSIAFRTVGNND

SEQ ID NO: 136125 - protein, 37 aa, Artificial Sequence
  Description of Artificial Sequence: Synthetic polypeptide
AEEEIRTTNPVATEQYGSVSTNDQSGTNQQNQDEEAV

SEQ ID NO: 136126 - protein, 36 aa, Artificial Sequence
  Description of Artificial Sequence: Synthetic polypeptide
AEEEIRTTNPVATEQYGSVSTNANQQNSTEQGTEAN

SEQ ID NO: 136127 - protein, 36 aa, Artificial Sequence
  Description of Artificial Sequence: Synthetic polypeptide
AEEEIRTTNPVATEQYGSVSTNANQQNQEQGTEGEN

SEQ ID NO: 136128 - protein, 36 aa, Artificial Sequence
  Description of Artificial Sequence: Synthetic polypeptide
AEEEIRTTNPVATEQYGSVSTNANQQNDEQGTEMEE

SEQ ID NO: 136129 - protein, 37 aa, Artificial Sequence
  Description of Artificial Sequence: Synthetic polypeptide
DEEEIRTTNPLAYEQYGQSVQSPTGNSLSQLRVGDYF

SEQ ID NO: 136130 - protein, 38 aa, Artificial Sequence
  Description of Artificial Sequence: Synthetic polypeptide
AEEEIRTTNPVATEQYGSVSTNANLQQQNGEQGNNNVE

SEQ ID NO: 136131 - protein, 38 aa, Artificial Sequence
  Description of Artificial Sequence: Synthetic polypeptide
AEEEIRTTNPVATEQYGSVSTNANLQQGNQEQGTNTVE

SEQ ID NO: 136132 - protein, 38 aa, Artificial Sequence
  Description of Artificial Sequence: Synthetic polypeptide
AEEEIRTTNPVATEQYGSVSTNANLQQGNEEQGNNQVE

SEQ ID NO: 136133 - protein, 32 aa, Artificial Sequence
  Description of Artificial Sequence: Synthetic polypeptide
SENEIACTNPVAYEQYGETISENELSQRVGGR

SEQ ID NO: 136134 - protein, 30 aa, Artificial Sequence
  Description of Artificial Sequence: Synthetic polypeptide
SENEIATTNPVATEAYGCVSWELQHFSSEL

SEQ ID NO: 136135 - protein, 35 aa, Artificial Sequence
  Description of Artificial Sequence: Synthetic polypeptide
DEEEIRTTNPVATEQYGCVCSTWGEHQENFNSNQA

SEQ ID NO: 136136 - protein, 30 aa, Artificial Sequence
  Description of Artificial Sequence: Synthetic polypeptide
SENEIATTNPVATECYGCVSWELNQHFIEL

SEQ ID NO: 136137 - protein, 35 aa, Artificial Sequence
  Description of Artificial Sequence: Synthetic polypeptide
DEEEISTTNPVATEQYGQCVCSNTELQENGSEFQG

SEQ ID NO: 136138 - protein, 34 aa, Artificial Sequence
  Description of Artificial Sequence: Synthetic polypeptide
SEMEIRTTNPVATEQYGCVSTVNYLDELRDEDQE

SEQ ID NO: 136139 - protein, 30 aa, Artificial Sequence
  Description of Artificial Sequence: Synthetic polypeptide
SENEIRTTNPIATEQWGDVSEILMNAAGDA

SEQ ID NO: 136140 - protein, 35 aa, Artificial Sequence
  Description of Artificial Sequence: Synthetic polypeptide
DEEEIRTTNPVATEQYGCVCSTTGEHQHFGSETQS

SEQ ID NO: 136141 - protein, 34 aa, Artificial Sequence
  Description of Artificial Sequence: Synthetic polypeptide
DEEEIRTTNPVATEQYGCVCSTTEHIHFNSDTQS

SEQ ID NO: 136142 - protein, 34 aa, Artificial Sequence
  Description of Artificial Sequence: Synthetic polypeptide
DEEEIRTTNPVATEQYGCVCSTTEHAEGFGSEQA

SEQ ID NO: 136143 - protein, 33 aa, Artificial Sequence
  Description of Artificial Sequence: Synthetic polypeptide
SENSEIRTTNPVAYECWGSVSTNHQGNEGGDSR

SEQ ID NO: 136144 - protein, 35 aa, Artificial Sequence
  Description of Artificial Sequence: Synthetic polypeptide
DEEEIRTTNPVATEQYGCVCSTTEGNQYFGSDTQS

SEQ ID NO: 136145 - protein, 36 aa, Artificial Sequence
  Description of Artificial Sequence: Synthetic polypeptide
DEEEIRTTNPVATEQYGCVCSTTEEPHQENFGSNQL

SEQ ID NO: 136146 - protein, 35 aa, Artificial Sequence
  Description of Artificial Sequence: Synthetic polypeptide
DEEEIRTTNPVATEQYGCVCSTTEDHQEHFGSEQA

SEQ ID NO: 136147 - protein, 34 aa, Artificial Sequence
  Description of Artificial Sequence: Synthetic polypeptide
DEEEISTTNPVATEQYGQCVCSDTGELQNNSDQP

SEQ ID NO: 136148 - protein, 32 aa, Artificial Sequence
  Description of Artificial Sequence: Synthetic polypeptide
SEQEIATTNPVATEQYGSVQATDLEDHEGEDL

SEQ ID NO: 136149 - protein, 32 aa, Artificial Sequence
  Description of Artificial Sequence: Synthetic polypeptide
SEQEIATTNPVATEQYGSVRATDLEDHEGEDL

SEQ ID NO: 136150 - protein, 30 aa, Artificial Sequence
  Description of Artificial Sequence: Synthetic polypeptide
SENEIRTTNPVSTEPYGTISEDIQQQNGNH

SEQ ID NO: 136151 - protein, 35 aa, Artificial Sequence
  Description of Artificial Sequence: Synthetic polypeptide
AEEEIRTTNPVATEQYGSVSTEGNNNNQNNTEQGS

SEQ ID NO: 136152 - protein, 35 aa, Artificial Sequence
  Description of Artificial Sequence: Synthetic polypeptide
DEEEIRTTNPVATEQYGCVCSTSGEDQNFGSETQS

SEQ ID NO: 136153 - protein, 35 aa, Artificial Sequence
  Description of Artificial Sequence: Synthetic polypeptide
DEEEIRTTNPVATEQYGCVCSTSGEDQENFNSDQS

SEQ ID NO: 136154 - protein, 34 aa, Artificial Sequence
  Description of Artificial Sequence: Synthetic polypeptide
SEQEIATTNPVATEQYGSVSVTPLQEDYEGEDEG

SEQ ID NO: 136155 - protein, 35 aa, Artificial Sequence
  Description of Artificial Sequence: Synthetic polypeptide
AEEEIRTTNPVATEQYGSVSTEGNNNNLNNDEQGS

SEQ ID NO: 136156 - protein, 35 aa, Artificial Sequence
  Description of Artificial Sequence: Synthetic polypeptide
DEEEIRTTNPVATEQYGCVCSTSEEHNQFFGSDQS

SEQ ID NO: 136157 - protein, 36 aa, Artificial Sequence
  Description of Artificial Sequence: Synthetic polypeptide
DEEEIRTTNPMATEQYGSVSSTLPAGPNMRNGMNPV

SEQ ID NO: 136158 - protein, 36 aa, Artificial Sequence
  Description of Artificial Sequence: Synthetic polypeptide
DEEEIRTTNPMATEQYGSVSSTTPAGPNMRNGMNPD

SEQ ID NO: 136159 - protein, 36 aa, Artificial Sequence
  Description of Artificial Sequence: Synthetic polypeptide
DEEEIRTTNPMATEQYGSVSSTTPAGPNMRNGMNPV

SEQ ID NO: 136160 - protein, 36 aa, Artificial Sequence
  Description of Artificial Sequence: Synthetic polypeptide
DEEEIRTTNPMATEQYGSVSSTTPAGTNMRNGMNPV

SEQ ID NO: 136161 - protein, 34 aa, Artificial Sequence
  Description of Artificial Sequence: Synthetic polypeptide
DEEEISTTNPVATEQYGQCVCSDSEHQRFGSDQP

SEQ ID NO: 136162 - protein, 30 aa, Artificial Sequence
  Description of Artificial Sequence: Synthetic polypeptide
SENEIRTTNPVSTEPYGTISEDIMQQNGNH

SEQ ID NO: 136163 - protein, 35 aa, Artificial Sequence
  Description of Artificial Sequence: Synthetic polypeptide
DEEEISTTNPVATEQYGQCVCSMTEELQGFGSDQV

SEQ ID NO: 136164 - protein, 35 aa, Artificial Sequence
  Description of Artificial Sequence: Synthetic polypeptide
DEEEISTTNPVATEQYGQCVCSMTEHQNFGSNDQN

SEQ ID NO: 136165 - protein, 36 aa, Artificial Sequence
  Description of Artificial Sequence: Synthetic polypeptide
DEEEIRTTNPVATEQYGCVCSTTGEHNQNFGSDNQA

SEQ ID NO: 136166 - protein, 35 aa, Artificial Sequence
  Description of Artificial Sequence: Synthetic polypeptide
DEEEIRTTNPVATEQYGCVCSTTGEHNQHFNSEQA

SEQ ID NO: 136167 - protein, 37 aa, Artificial Sequence
  Description of Artificial Sequence: Synthetic polypeptide
AEEEIRTTNPVATEQYGSVSTGNNNQQGTEQGTNQED

SEQ ID NO: 136168 - protein, 31 aa, Artificial Sequence
  Description of Artificial Sequence: Synthetic polypeptide
SENEIRTTNPVATEPYGTISEEDIQQQNGNH

SEQ ID NO: 136169 - protein, 35 aa, Artificial Sequence
  Description of Artificial Sequence: Synthetic polypeptide
DEEEIRTTNPVATEQYGCVCSTTGEHNQFFNSDQE

SEQ ID NO: 136170 - protein, 31 aa, Artificial Sequence
  Description of Artificial Sequence: Synthetic polypeptide
SENEIRTTNPVATEPYGTISMEDIQMQNGNH

SEQ ID NO: 136171 - protein, 30 aa, Artificial Sequence
  Description of Artificial Sequence: Synthetic polypeptide
SENEIRTTNPVATEQWGDVSEIEMNAAEDR

SEQ ID NO: 136172 - protein, 34 aa, Artificial Sequence
  Description of Artificial Sequence: Synthetic polypeptide
SENEIRTTNPVATEQYGCVSVLFNLEDTRGQGEN

SEQ ID NO: 136173 - protein, 35 aa, Artificial Sequence
  Description of Artificial Sequence: Synthetic polypeptide
DEEEIRTTNPVATEQYGCVCSTTGEHDQSFNSDQA

SEQ ID NO: 136174 - protein, 35 aa, Artificial Sequence
  Description of Artificial Sequence: Synthetic polypeptide
DEEEIRTTNPVATEQYGCVCSTTGEHDQNFGSDQS

SEQ ID NO: 136175 - protein, 35 aa, Artificial Sequence
  Description of Artificial Sequence: Synthetic polypeptide
DEEEIRTTNPVATEQYGCVCSTTGEHAHFGSENQS

SEQ ID NO: 136176 - protein, 34 aa, Artificial Sequence
  Description of Artificial Sequence: Synthetic polypeptide
SENEIRTTNPVATEQYGSCYNANDLIHTQEGNQE

SEQ ID NO: 136177 - protein, 34 aa, Artificial Sequence
  Description of Artificial Sequence: Synthetic polypeptide
SENEIRTTNPVATEQYGSVNSTNDDENSGQEEKS

SEQ ID NO: 136178 - protein, 34 aa, Artificial Sequence
  Description of Artificial Sequence: Synthetic polypeptide
DEEEIRTTNPVATEQYGCVCSTTGEDENFGSDQS

SEQ ID NO: 136179 - protein, 36 aa, Artificial Sequence
  Description of Artificial Sequence: Synthetic polypeptide
DEEEIRTTNPVATEQYGCVCSTTGADNNEGFGMNPV

SEQ ID NO: 136180 - protein, 35 aa, Artificial Sequence
  Description of Artificial Sequence: Synthetic polypeptide
DEEEIRTTNPVATEQYGCVCSTTEYHQNFNSDTQY

SEQ ID NO: 136181 - protein, 33 aa, Artificial Sequence
  Description of Artificial Sequence: Synthetic polypeptide
SENEIRTTNPVATEQYGSVSVPADNDRSGQEVK

SEQ ID NO: 136182 - protein, 35 aa, Artificial Sequence
  Description of Artificial Sequence: Synthetic polypeptide
DEEEIRTTNPVATEQYGCVCSTTEYHQENFNSNQY

SEQ ID NO: 136183 - protein, 32 aa, Artificial Sequence
  Description of Artificial Sequence: Synthetic polypeptide
SENEIRTTNPVATEQYGSVTYDDMTREGGFEE

SEQ ID NO: 136184 - protein, 36 aa, Artificial Sequence
  Description of Artificial Sequence: Synthetic polypeptide
DEEEIRTTNPMATEPYGQSVSCATMHSGQTGTNYRH

SEQ ID NO: 136185 - protein, 35 aa, Artificial Sequence
  Description of Artificial Sequence: Synthetic polypeptide
DEEEIRTTNPVATEQYGCVCSTTEHQENFPSENQP

SEQ ID NO: 136186 - protein, 30 aa, Artificial Sequence
  Description of Artificial Sequence: Synthetic polypeptide
SENEIRTTNPIATEQWGSVSENEMNAAEDA

SEQ ID NO: 136187 - protein, 34 aa, Artificial Sequence
  Description of Artificial Sequence: Synthetic polypeptide
SEQEIRGTNPVATEQYGSVVDTNLTQDGGGQDDG

SEQ ID NO: 136188 - protein, 34 aa, Artificial Sequence
  Description of Artificial Sequence: Synthetic polypeptide
DEEEIRTTNPLAYEPYGSVVPSYLNIFRTGGNND

SEQ ID NO: 136189 - protein, 34 aa, Artificial Sequence
  Description of Artificial Sequence: Synthetic polypeptide
DEEEIRTTNPVATEQYGCVCSWEAHNANFGSQQS

SEQ ID NO: 136190 - protein, 34 aa, Artificial Sequence
  Description of Artificial Sequence: Synthetic polypeptide
DEEEIRTTNPVATEQYGCVCSWGAHQENFNSDQS

SEQ ID NO: 136191 - protein, 34 aa, Artificial Sequence
  Description of Artificial Sequence: Synthetic polypeptide
DEEEIRTTNPVATEQYGCVCSWEYHQENFGSEQI

SEQ ID NO: 136192 - protein, 33 aa, Artificial Sequence
  Description of Artificial Sequence: Synthetic polypeptide
DEEEIRTTNPVATEQYGCVCSWEPHAHFGSQQS

SEQ ID NO: 136193 - protein, 36 aa, Artificial Sequence
  Description of Artificial Sequence: Synthetic polypeptide
DEEEIRTTNPLATEQYGSVSSTTPAGPNMRNGMNPV

SEQ ID NO: 136194 - protein, 37 aa, Artificial Sequence
  Description of Artificial Sequence: Synthetic polypeptide
AEEEIRTTNPVATEQYGSVSTNNEQLGNAEQGTNQSN

SEQ ID NO: 136195 - protein, 37 aa, Artificial Sequence
  Description of Artificial Sequence: Synthetic polypeptide
AEEEIRTTNPVATEQYGSVSTNNDQYGNTQQGTNQNA

SEQ ID NO: 136196 - protein, 37 aa, Artificial Sequence
  Description of Artificial Sequence: Synthetic polypeptide
AEEEIRTTNPVATEQYGSVSTNNDQQGNTQQGTNSNE

SEQ ID NO: 136197 - protein, 35 aa, Artificial Sequence
  Description of Artificial Sequence: Synthetic polypeptide
DEEEIRTTNPVATEQYGCVCSWENDHQENFGSDQG

SEQ ID NO: 136198 - protein, 34 aa, Artificial Sequence
  Description of Artificial Sequence: Synthetic polypeptide
DEEEIRTTNPLAYEAYGSVPSYCVNISRTGGNND

SEQ ID NO: 136199 - protein, 34 aa, Artificial Sequence
  Description of Artificial Sequence: Synthetic polypeptide
DEEEIRTTNPVATEQYGCVCSWGAHQENFNSNQS

SEQ ID NO: 136200 - protein, 33 aa, Artificial Sequence
  Description of Artificial Sequence: Synthetic polypeptide
DEEEIRTTNPLAYEPWGSVSCATQGQTGTNYMA

SEQ ID NO: 136201 - protein, 33 aa, Artificial Sequence
  Description of Artificial Sequence: Synthetic polypeptide
DEEEIRTTNPVATEQYGCVCSWEHQNFTSETQA

SEQ ID NO: 136202 - protein, 33 aa, Artificial Sequence
  Description of Artificial Sequence: Synthetic polypeptide
DEEEIRTTNPVATEQYGCVCSWEHQNFISETQL

SEQ ID NO: 136203 - protein, 33 aa, Artificial Sequence
  Description of Artificial Sequence: Synthetic polypeptide
DEEEIRTTNPVATEQYGCVCSWEHQHFISETQS

SEQ ID NO: 136204 - protein, 35 aa, Artificial Sequence
  Description of Artificial Sequence: Synthetic polypeptide
SEESIRTTNPVATEQYGSVNETSNDIDQQIGENYQ

SEQ ID NO: 136205 - protein, 34 aa, Artificial Sequence
  Description of Artificial Sequence: Synthetic polypeptide
DEEEIRTTNPVATEQYGCVCSWEHQENFNSDTQM

SEQ ID NO: 136206 - protein, 34 aa, Artificial Sequence
  Description of Artificial Sequence: Synthetic polypeptide
DEEEIRTTNPVATEQYGCVCSWEHQENFISDNQI

SEQ ID NO: 136207 - protein, 31 aa, Artificial Sequence
  Description of Artificial Sequence: Synthetic polypeptide
SEEVIACTNPVATEQYGCVATNLPDNEQNNT

SEQ ID NO: 136208 - protein, 34 aa, Artificial Sequence
  Description of Artificial Sequence: Synthetic polypeptide
DEEEIRTTNPVATEQYGCVCSWEHQEHFNSNTQT

SEQ ID NO: 136209 - protein, 34 aa, Artificial Sequence
  Description of Artificial Sequence: Synthetic polypeptide
DEEEIRTTNPVATEQYGCVCSWEHNQNFNSDTQS

SEQ ID NO: 136210 - protein, 33 aa, Artificial Sequence
  Description of Artificial Sequence: Synthetic polypeptide
DEEEIRTTNPLAYEPYGSVACATQGQTGTDYRA

SEQ ID NO: 136211 - protein, 35 aa, Artificial Sequence
  Description of Artificial Sequence: Synthetic polypeptide
DEEEISTTNPVATEQYGQCVCSNWGNLQNFGSEQA

SEQ ID NO: 136212 - protein, 35 aa, Artificial Sequence
  Description of Artificial Sequence: Synthetic polypeptide
SEEEVRTTNPVATEQYGQCVCSTGNLDQNIGSDQL

SEQ ID NO: 136213 - protein, 34 aa, Artificial Sequence
  Description of Artificial Sequence: Synthetic polypeptide
SEEEVRTTNPVATEQYGCVCSWGNHDQYFGSNQM

SEQ ID NO: 136214 - protein, 36 aa, Artificial Sequence
  Description of Artificial Sequence: Synthetic polypeptide
AEEEIRTTNPVATEQYGSVSTNNNQLGSETGTTTAE

SEQ ID NO: 136215 - protein, 37 aa, Artificial Sequence
  Description of Artificial Sequence: Synthetic polypeptide
AEEEIRTTNPVATEQYGSVSTNNNQLGSEEGGTNNAE

SEQ ID NO: 136216 - protein, 35 aa, Artificial Sequence
  Description of Artificial Sequence: Synthetic polypeptide
DEEEIRTTNPVATEQYGCVCSWGEHNQEGFNSEQS

SEQ ID NO: 136217 - protein, 37 aa, Artificial Sequence
  Description of Artificial Sequence: Synthetic polypeptide
AEEEIRTTNPVATEQYGSVSTNNNQLGNTEQGTNSNE

SEQ ID NO: 136218 - protein, 37 aa, Artificial Sequence
  Description of Artificial Sequence: Synthetic polypeptide
AEEEIRTTNPVATEQYGSVSTNNNQLGNSEQGTNQSE

SEQ ID NO: 136219 - protein, 33 aa, Artificial Sequence
  Description of Artificial Sequence: Synthetic polypeptide
DEEEIRTTNPVATEQYGCVCSWGEHINFGSDQG

SEQ ID NO: 136220 - protein, 33 aa, Artificial Sequence
  Description of Artificial Sequence: Synthetic polypeptide
DEEEIRTTNPVATEQYGCVCSWGEHEYFNSDQS

SEQ ID NO: 136221 - protein, 34 aa, Artificial Sequence
  Description of Artificial Sequence: Synthetic polypeptide
DEEEIRTTNPVATEQYGCVCSWGEHEGFGSDNQS

SEQ ID NO: 136222 - protein, 32 aa, Artificial Sequence
  Description of Artificial Sequence: Synthetic polypeptide
SEEEIVCTNPVATEQYGTVSAEDNPVMFEGND

SEQ ID NO: 136223 - protein, 33 aa, Artificial Sequence
  Description of Artificial Sequence: Synthetic polypeptide
DEEEIRTTNPVATEQYGCVCSWGEHANFNSNQA

SEQ ID NO: 136224 - protein, 37 aa, Artificial Sequence
  Description of Artificial Sequence: Synthetic polypeptide
AEEEIRTTNPVATEQYGSVSTNNNQAGNQQQGTNANE

SEQ ID NO: 136225 - protein, 33 aa, Artificial Sequence
  Description of Artificial Sequence: Synthetic polypeptide
DEEEIRTTNPVATEQYGCVCSWGEHANFGSQQS

SEQ ID NO: 136226 - protein, 34 aa, Artificial Sequence
  Description of Artificial Sequence: Synthetic polypeptide
DEEEIRTTNPVATEQYGCVCSWGEDTQNFGSEQF

SEQ ID NO: 136227 - protein, 35 aa, Artificial Sequence
  Description of Artificial Sequence: Synthetic polypeptide
DEEEIRTTNPVATEQYGCVCSWGEDQENFGSDNQS

SEQ ID NO: 136228 - protein, 38 aa, Artificial Sequence
  Description of Artificial Sequence: Synthetic polypeptide
AEEEIRTTNPVATEQYGSVSTNNNNLQNGNEEQGNNVE

SEQ ID NO: 136229 - protein, 34 aa, Artificial Sequence
  Description of Artificial Sequence: Synthetic polypeptide
DEEEIRTTNPVATEQYGCVCSWGEDHQNFNSDQA

SEQ ID NO: 136230 - protein, 34 aa, Artificial Sequence
  Description of Artificial Sequence: Synthetic polypeptide
DEEEIRTTNPVATEQYGCVCSWGEDHQHFNSDQT

SEQ ID NO: 136231 - protein, 37 aa, Artificial Sequence
  Description of Artificial Sequence: Synthetic polypeptide
AEEEIRTTNPVATEQYGSVSTNNNNLNQDEIGETEED

SEQ ID NO: 136232 - protein, 34 aa, Artificial Sequence
  Description of Artificial Sequence: Synthetic polypeptide
DEEEIRTTNPVATEQYGCVCSWGEDHQGFGSDDA

SEQ ID NO: 136233 - protein, 35 aa, Artificial Sequence
  Description of Artificial Sequence: Synthetic polypeptide
SEEEVRTTNPVATEQYGCVCSNTGNHDQNIGSNQN

SEQ ID NO: 136234 - protein, 33 aa, Artificial Sequence
  Description of Artificial Sequence: Synthetic polypeptide
SEEEVRTTNPVATEQYGCVCSTGEHNQNIGSDQ

SEQ ID NO: 136235 - protein, 34 aa, Artificial Sequence
  Description of Artificial Sequence: Synthetic polypeptide
DEEEIRTTNPVATEQYGCVCSWEHNQNFNSDTQA

SEQ ID NO: 136236 - protein, 35 aa, Artificial Sequence
  Description of Artificial Sequence: Synthetic polypeptide
DEEEIRTTNPLAYEPYGSVSCATGSGQQVGTNYRA

SEQ ID NO: 136237 - protein, 34 aa, Artificial Sequence
  Description of Artificial Sequence: Synthetic polypeptide
DEEEIRTTNPVATEQYGCVCSWEHNQNFNSDNQS

SEQ ID NO: 136238 - protein, 34 aa, Artificial Sequence
  Description of Artificial Sequence: Synthetic polypeptide
DEEEIRTTNPVATEQYGCVCSWEHNQFFNSDNQG

SEQ ID NO: 136239 - protein, 33 aa, Artificial Sequence
  Description of Artificial Sequence: Synthetic polypeptide
SEGEIRTTNPVAYERYGSTVSEAALSGRDNNRW

SEQ ID NO: 136240 - protein, 33 aa, Artificial Sequence
  Description of Artificial Sequence: Synthetic polypeptide
SEGEIRTTNPVAYERYGSTVSQAALSQLPNNRW

SEQ ID NO: 136241 - protein, 37 aa, Artificial Sequence
  Description of Artificial Sequence: Synthetic polypeptide
AEEEIRTTNPVATEQYGSVSTNLNGENAGEQGTNVEE

SEQ ID NO: 136242 - protein, 35 aa, Artificial Sequence
  Description of Artificial Sequence: Synthetic polypeptide
DEEEIRTTNPVATEQYGCVCSWEEDLQENFGSEQG

SEQ ID NO: 136243 - protein, 28 aa, Artificial Sequence
  Description of Artificial Sequence: Synthetic peptide
SELEIASTNPVGTEGYGVMASTLQHGDI

SEQ ID NO: 136244 - protein, 30 aa, Artificial Sequence
  Description of Artificial Sequence: Synthetic polypeptide
SEMEIACTNPCSYEQYGCVSWNLQSFGSER

SEQ ID NO: 136245 - protein, 34 aa, Artificial Sequence
  Description of Artificial Sequence: Synthetic polypeptide
DEEEIRTTNPVATEQYGCVCSWEDPQENFGSDQA

SEQ ID NO: 136246 - protein, 35 aa, Artificial Sequence
  Description of Artificial Sequence: Synthetic polypeptide
DEEEIRTTNPVATEQYGCVCSWEDHQEYFGSENQS

SEQ ID NO: 136247 - protein, 35 aa, Artificial Sequence
  Description of Artificial Sequence: Synthetic polypeptide
DEEEIRTTNPVATEQYGCVCSWEDHQENFGSNNQS

SEQ ID NO: 136248 - protein, 34 aa, Artificial Sequence
  Description of Artificial Sequence: Synthetic polypeptide
SEGEIRTTNPVAYERYGSTVSEAALSDRGTNNRL

SEQ ID NO: 136249 - protein, 37 aa, Artificial Sequence
  Description of Artificial Sequence: Synthetic polypeptide
AEEEIRTTNPVATEQYGSVSTNGTQNQEQGTTEAGND

SEQ ID NO: 136250 - protein, 34 aa, Artificial Sequence
  Description of Artificial Sequence: Synthetic polypeptide
DEEEIRTTNPVATEQYGCVCSWEDHQEFFISNQS

SEQ ID NO: 136251 - protein, 36 aa, Artificial Sequence
  Description of Artificial Sequence: Synthetic polypeptide
AEEEIRTTNPVATEQYGSVSTNGNQQNNNIGTEQGQ

SEQ ID NO: 136252 - protein, 34 aa, Artificial Sequence
  Description of Artificial Sequence: Synthetic polypeptide
DEEEIRTTNPVATEQYGCVCSWEDHNQNFNSQQS

SEQ ID NO: 136253 - protein, 34 aa, Artificial Sequence
  Description of Artificial Sequence: Synthetic polypeptide
DEEEIRTTNPVATEQYGCVCSWEDHNQNFNSEQS

SEQ ID NO: 136254 - protein, 34 aa, Artificial Sequence
  Description of Artificial Sequence: Synthetic polypeptide
DEEEIRTTNPVATEQYGCVCSWEDHNQHFNSEQS

SEQ ID NO: 136255 - protein, 35 aa, Artificial Sequence
  Description of Artificial Sequence: Synthetic polypeptide
DEEEIRTTNPVATEQYGCVCSWEDHNQEGFNSDQS

SEQ ID NO: 136256 - protein, 36 aa, Artificial Sequence
  Description of Artificial Sequence: Synthetic polypeptide
AEEEIRTTNPVATEQYGSVSTNGNNNNSETGTNSTQ

SEQ ID NO: 136257 - protein, 37 aa, Artificial Sequence
  Description of Artificial Sequence: Synthetic polypeptide
AEEEIRTTNPVATEQYGSVSTNGNNENQGEQGTNTTE

SEQ ID NO: 136258 - protein, 34 aa, Artificial Sequence
  Description of Artificial Sequence: Synthetic polypeptide
DEEEIRTTNPVATEQYGCVCSWEAHQEYFGSDQA

SEQ ID NO: 136259 - protein, 34 aa, Artificial Sequence
  Description of Artificial Sequence: Synthetic polypeptide
DEEEIRTTNPVATEQYGCVCSWEDHQEHFNSQQT

SEQ ID NO: 136260 - protein, 33 aa, Artificial Sequence
  Description of Artificial Sequence: Synthetic polypeptide
SEGEIRTTNPVAYERYGSTVFEAALSQSGNNRW

SEQ ID NO: 136261 - protein, 35 aa, Artificial Sequence
  Description of Artificial Sequence: Synthetic polypeptide
SEGEIRTTNPVAYERYGSTVCSYEAALSQRGNNRW

SEQ ID NO: 136262 - protein, 33 aa, Artificial Sequence
  Description of Artificial Sequence: Synthetic polypeptide
DEEEIRTTNPVATEQYGCVCSWEEHANFISQQA

SEQ ID NO: 136263 - protein, 35 aa, Artificial Sequence
  Description of Artificial Sequence: Synthetic polypeptide
DEEEIRTTNPVATEQYGCVCSWEHNQEGFNSENQA

SEQ ID NO: 136264 - protein, 33 aa, Artificial Sequence
  Description of Artificial Sequence: Synthetic polypeptide
DEEEIRTTNPVATEQYGCVCSWEHAENFGSEQA

SEQ ID NO: 136265 - protein, 34 aa, Artificial Sequence
  Description of Artificial Sequence: Synthetic polypeptide
DEEEIRTTNPVATEQYGCVCSWEGHQERFMSDQA

SEQ ID NO: 136266 - protein, 35 aa, Artificial Sequence
  Description of Artificial Sequence: Synthetic polypeptide
DEEEIRTTNPVATEQYGCVCSWEETQEHFGSENQL

SEQ ID NO: 136267 - protein, 34 aa, Artificial Sequence
  Description of Artificial Sequence: Synthetic polypeptide
DEEEIRTTNPVATEQYGCVCSWEETIENFNSQQS

SEQ ID NO: 136268 - protein, 34 aa, Artificial Sequence
  Description of Artificial Sequence: Synthetic polypeptide
DEEEIRTTNPVATEQYGCVCSWEEHTENFGSQQA

SEQ ID NO: 136269 - protein, 33 aa, Artificial Sequence
  Description of Artificial Sequence: Synthetic polypeptide
DEEEIRTTNPVATEQYGCVCSWEEHQNFLSDQA

SEQ ID NO: 136270 - protein, 34 aa, Artificial Sequence
  Description of Artificial Sequence: Synthetic polypeptide
DEEEIRTTNPVATEQYGCVCSWEEHQFFGSQTQA

SEQ ID NO: 136271 - protein, 34 aa, Artificial Sequence
  Description of Artificial Sequence: Synthetic polypeptide
DEEEIRTTNPVATEQYGCVCSWEEHQENFSSNQS

SEQ ID NO: 136272 - protein, 35 aa, Artificial Sequence
  Description of Artificial Sequence: Synthetic polypeptide
DEEEIRTTNPVATEQYGCVCSWEEHQENFGSDNQG

SEQ ID NO: 136273 - protein, 34 aa, Artificial Sequence
  Description of Artificial Sequence: Synthetic polypeptide
DEEEIRTTNPVATEQYGCVCSWEEHQEHFNSDQS

SEQ ID NO: 136274 - protein, 34 aa, Artificial Sequence
  Description of Artificial Sequence: Synthetic polypeptide
DEEEIRTTNPVATEQYGCVCSWEEHQEHFGSQQS

SEQ ID NO: 136275 - protein, 34 aa, Artificial Sequence
  Description of Artificial Sequence: Synthetic polypeptide
DEEEIRTTNPVATEQYGCVCSWEEHNQNFNSEQA

SEQ ID NO: 136276 - protein, 38 aa, Artificial Sequence
  Description of Artificial Sequence: Synthetic polypeptide
AEEEIRTTNPVATEQYGSVSTNLNLQNQNSEQGNNNVE

SEQ ID NO: 136277 - protein, 34 aa, Artificial Sequence
  Description of Artificial Sequence: Synthetic polypeptide
DEEEIRTTNPVATEQYGCVCSWEEHNQFFGSDQA

SEQ ID NO: 136278 - protein, 35 aa, Artificial Sequence
  Description of Artificial Sequence: Synthetic polypeptide
DEEEIRTTNPVATEQYGCVCSWEEHNQFFGSDNQA

SEQ ID NO: 136279 - protein, 38 aa, Artificial Sequence
  Description of Artificial Sequence: Synthetic polypeptide
AEEEIRTTNPVATEQYGSVSTNLNLQNANTEQGNNTEE

SEQ ID NO: 136280 - protein, 37 aa, Artificial Sequence
  Description of Artificial Sequence: Synthetic polypeptide
AEEEIRTTNPVATEQYGSVSTNLNLENSTETGTNQET

SEQ ID NO: 136281 - protein, 33 aa, Artificial Sequence
  Description of Artificial Sequence: Synthetic polypeptide
SEGEIRTTNPVATEQYGCVSTDLIPENGEEMMH

SEQ ID NO: 136282 - protein, 33 aa, Artificial Sequence
  Description of Artificial Sequence: Synthetic polypeptide
SEGEIRTTNPVATEQYGSVSWTWPTQIDTTESQ

SEQ ID NO: 136283 - protein, 33 aa, Artificial Sequence
  Description of Artificial Sequence: Synthetic polypeptide
SEGEIRTTNPVAYEAYGSTVSEAALSDRGNNHW

SEQ ID NO: 136284 - protein, 34 aa, Artificial Sequence
  Description of Artificial Sequence: Synthetic polypeptide
DEEEIRTTNPVATEQYGCVCSWEHNQGFGSEFQS

SEQ ID NO: 136285 - protein, 34 aa, Artificial Sequence
  Description of Artificial Sequence: Synthetic polypeptide
SEEEISTTNPVAYEQWGQVSNCTNMQSADGGNRA

SEQ ID NO: 136286 - protein, 34 aa, Artificial Sequence
  Description of Artificial Sequence: Synthetic polypeptide
DEEEIRTTNPVATEQYGCVCSTPEHEEGFISDQA

SEQ ID NO: 136287 - protein, 35 aa, Artificial Sequence
  Description of Artificial Sequence: Synthetic polypeptide
SEQEIRTTNPVATEQYGSVSAMSLDTQEGGIENFG

SEQ ID NO: 136288 - protein, 34 aa, Artificial Sequence
  Description of Artificial Sequence: Synthetic polypeptide
DEEEISTTNPVATEQYGCVCSWMEHQFFGSDNQE

SEQ ID NO: 136289 - protein, 32 aa, Artificial Sequence
  Description of Artificial Sequence: Synthetic polypeptide
SEYEIRCTNPVATEQYGCVCETGELQHFGSEQ

SEQ ID NO: 136290 - protein, 36 aa, Artificial Sequence
  Description of Artificial Sequence: Synthetic polypeptide
DEEEIRTTNPVATEAWGISVRTWNDGDQDRRRMNDR

SEQ ID NO: 136291 - protein, 34 aa, Artificial Sequence
  Description of Artificial Sequence: Synthetic polypeptide
DEEEISTTNPVATEQYGCVCSWGPHQGFGSDNQA

SEQ ID NO: 136292 - protein, 34 aa, Artificial Sequence
  Description of Artificial Sequence: Synthetic polypeptide
DEEEISTTNPVATEQYGCVCSWGNHQNFGSDTQY

SEQ ID NO: 136293 - protein, 33 aa, Artificial Sequence
  Description of Artificial Sequence: Synthetic polypeptide
DEEEISTTNPVATEQYGCVCSWGNHQGFQSEQA

SEQ ID NO: 136294 - protein, 36 aa, Artificial Sequence
  Description of Artificial Sequence: Synthetic polypeptide
DEEEIRTTNPVATEAWGVSVRTWNDDDQDRREKNDR

SEQ ID NO: 136295 - protein, 36 aa, Artificial Sequence
  Description of Artificial Sequence: Synthetic polypeptide
AEEEIRTTNPVATEQYGSVSNQQGNNNNQQGTNVEV

SEQ ID NO: 136296 - protein, 33 aa, Artificial Sequence
  Description of Artificial Sequence: Synthetic polypeptide
SEYEIRMTNPVATEQYGSVELVNLDEEHGSNQQ

SEQ ID NO: 136297 - protein, 33 aa, Artificial Sequence
  Description of Artificial Sequence: Synthetic polypeptide
SEYEIRCTNPVATEQYGCVCETELLQHFGSNQA

SEQ ID NO: 136298 - protein, 34 aa, Artificial Sequence
  Description of Artificial Sequence: Synthetic polypeptide
DEEEISTTNPVATEQYGCVCSWGELQNFNSNNQS

SEQ ID NO: 136299 - protein, 35 aa, Artificial Sequence
  Description of Artificial Sequence: Synthetic polypeptide
DEEEISTTNPVATEQYGCVCSWGELQEGFGSDNQV

SEQ ID NO: 136300 - protein, 34 aa, Artificial Sequence
  Description of Artificial Sequence: Synthetic polypeptide
SEYEIRMTNPVATEQYGSVETVNLEEEHGSNQQA

SEQ ID NO: 136301 - protein, 33 aa, Artificial Sequence
  Description of Artificial Sequence: Synthetic polypeptide
DEEEISTTNPVATEQYGCVCSWGEHQYFNSDQA

SEQ ID NO: 136302 - protein, 33 aa, Artificial Sequence
  Description of Artificial Sequence: Synthetic polypeptide
DEEEISTTNPVATEQYGCVCSWGEHQHFNSQQT

SEQ ID NO: 136303 - protein, 34 aa, Artificial Sequence
  Description of Artificial Sequence: Synthetic polypeptide
SEYEIRMTNPVATEQYGSVETVNLTGEHTGSNQQ

SEQ ID NO: 136304 - protein, 33 aa, Artificial Sequence
  Description of Artificial Sequence: Synthetic polypeptide
DEEEISTTNPVATEQYGCVCSWGEHQENGSDQG

SEQ ID NO: 136305 - protein, 35 aa, Artificial Sequence
  Description of Artificial Sequence: Synthetic polypeptide
SEYEIRTTNPVATEQYGSVISVTHDLQTGGSEQQH

SEQ ID NO: 136306 - protein, 34 aa, Artificial Sequence
  Description of Artificial Sequence: Synthetic polypeptide
SEYEIRTTNPVATEQYGSVQWTTNSENGSDEDRT

SEQ ID NO: 136307 - protein, 36 aa, Artificial Sequence
  Description of Artificial Sequence: Synthetic polypeptide
DEEEIRTTNPVATEQYGCVCSTGNDHNQERFMSEQS

SEQ ID NO: 136308 - protein, 33 aa, Artificial Sequence
  Description of Artificial Sequence: Synthetic polypeptide
DEEEISTTNPVATEQYGCVCSWGELQENFFSEQ

SEQ ID NO: 136309 - protein, 36 aa, Artificial Sequence
  Description of Artificial Sequence: Synthetic polypeptide
DEEEIRTTNPVATEAWGISVRTWNDDQQDRREKNER

SEQ ID NO: 136310 - protein, 33 aa, Artificial Sequence
  Description of Artificial Sequence: Synthetic polypeptide
SEYEIRCTNPVATEQYGCVCENTNLQHFGSQQS

SEQ ID NO: 136311 - protein, 34 aa, Artificial Sequence
  Description of Artificial Sequence: Synthetic polypeptide
DEEEISTTNPVATEQYGCVCSWNDHQESFGSEQS

SEQ ID NO: 136312 - protein, 32 aa, Artificial Sequence
  Description of Artificial Sequence: Synthetic polypeptide
DEACIRTTNPLATEQFGCVCSSELQSFGSNQS

SEQ ID NO: 136313 - protein, 36 aa, Artificial Sequence
  Description of Artificial Sequence: Synthetic polypeptide
DEEEIRTTNPVAYEQWGSVPSTTLAISNQWNGGNPV

SEQ ID NO: 136314 - protein, 28 aa, Artificial Sequence
  Description of Artificial Sequence: Synthetic peptide
SEVEIASTNPVGTEGWGVSASTLQHGDI

SEQ ID NO: 136315 - protein, 28 aa, Artificial Sequence
  Description of Artificial Sequence: Synthetic peptide
SEVEIATTNPTATEQYGEVSELECQEDF

SEQ ID NO: 136316 - protein, 32 aa, Artificial Sequence
  Description of Artificial Sequence: Synthetic polypeptide
SEVEIATTNPVATEPYGSVAGNGLADDPGDNE

SEQ ID NO: 136317 - protein, 32 aa, Artificial Sequence
  Description of Artificial Sequence: Synthetic polypeptide
SEVEIATTNPVATEQYGCVAANNNLQENPGDP

SEQ ID NO: 136318 - protein, 36 aa, Artificial Sequence
  Description of Artificial Sequence: Synthetic polypeptide
DEEEIRTTNPVATEAWGESVRTWNDDDQDRREKDNR

SEQ ID NO: 136319 - protein, 33 aa, Artificial Sequence
  Description of Artificial Sequence: Synthetic polypeptide
DEEEISTTNPVATEQYGCVCSYEHQEGFGSDQS

SEQ ID NO: 136320 - protein, 32 aa, Artificial Sequence
  Description of Artificial Sequence: Synthetic polypeptide
SEVEIATTNPVAYEGWGSVATNLQGDTGGNPE

SEQ ID NO: 136321 - protein, 33 aa, Artificial Sequence
  Description of Artificial Sequence: Synthetic polypeptide
SEVEIATTNPVAYEQYGSVAGANLVQDDGTGNS

SEQ ID NO: 136322 - protein, 35 aa, Artificial Sequence
  Description of Artificial Sequence: Synthetic polypeptide
DEEEIRTTNPVATEQYGCVCSTMEHQENFNSETQS

SEQ ID NO: 136323 - protein, 34 aa, Artificial Sequence
  Description of Artificial Sequence: Synthetic polypeptide
DEEEIRTTNPVATEQYGCVCSTMEHQENFISDQT

SEQ ID NO: 136324 - protein, 35 aa, Artificial Sequence
  Description of Artificial Sequence: Synthetic polypeptide
DEEEISTTNPVATEQYGCVCSWNSLNQEHFGSEQA

SEQ ID NO: 136325 - protein, 30 aa, Artificial Sequence
  Description of Artificial Sequence: Synthetic polypeptide
DDSEIRTTNPVSTEPYGTVANTIQQQVGQH

SEQ ID NO: 136326 - protein, 36 aa, Artificial Sequence
  Description of Artificial Sequence: Synthetic polypeptide
DEEEIRTTNPVATEQYGCVCSTMEHNQENFGSDNQS

SEQ ID NO: 136327 - protein, 32 aa, Artificial Sequence
  Description of Artificial Sequence: Synthetic polypeptide
DDSEIRTTNPVSTEPYGTVSMEDIQQQQNGNR

SEQ ID NO: 136328 - protein, 36 aa, Artificial Sequence
  Description of Artificial Sequence: Synthetic polypeptide
DEEEIRTTNPVATEQYGCVCSTMEHNEENFGSDNQS

SEQ ID NO: 136329 - protein, 35 aa, Artificial Sequence
  Description of Artificial Sequence: Synthetic polypeptide
DEEEIRTTNPVATEQYGCVCSTMEDDNQENFGSDQ

SEQ ID NO: 136330 - protein, 34 aa, Artificial Sequence
  Description of Artificial Sequence: Synthetic polypeptide
SEYEIRCTNPCATEQYGSVRTNEENWLERENQRT

SEQ ID NO: 136331 - protein, 34 aa, Artificial Sequence
  Description of Artificial Sequence: Synthetic polypeptide
SEYEIRCTNPCATEQYGSVRTNEQNWLENRENQR

SEQ ID NO: 136332 - protein, 33 aa, Artificial Sequence
  Description of Artificial Sequence: Synthetic polypeptide
SEYEIRCTNPVATEQYGCVCENTELQEHFGSNQ

SEQ ID NO: 136333 - protein, 30 aa, Artificial Sequence
  Description of Artificial Sequence: Synthetic polypeptide
SMDEIRSTNPVATEQYGSSIVPNSMQEGQG

SEQ ID NO: 136334 - protein, 31 aa, Artificial Sequence
  Description of Artificial Sequence: Synthetic polypeptide
DEEEIRTTNPVAYEQWGSVGWIEDNQAMDAP

SEQ ID NO: 136335 - protein, 34 aa, Artificial Sequence
  Description of Artificial Sequence: Synthetic polypeptide
AEEEIRTTNPVATEQYGSVSFTTADEQMESFEQN

SEQ ID NO: 136336 - protein, 36 aa, Artificial Sequence
  Description of Artificial Sequence: Synthetic polypeptide
DEEEIRTTNPVATEQYGCVCSTGETNQENFGSENQS

SEQ ID NO: 136337 - protein, 34 aa, Artificial Sequence
  Description of Artificial Sequence: Synthetic polypeptide
DEEEIRTTNPVATEQYGCVCSTGEHQHFISEFQF

SEQ ID NO: 136338 - protein, 34 aa, Artificial Sequence
  Description of Artificial Sequence: Synthetic polypeptide
SQEEIRTTNPVATEQWGICVCSTGNLQNFGSDQA

SEQ ID NO: 136339 - protein, 36 aa, Artificial Sequence
  Description of Artificial Sequence: Synthetic polypeptide
AEEEIRTTNPVATEQYGSVATVNNNLQAGDETETED

SEQ ID NO: 136340 - protein, 35 aa, Artificial Sequence
  Description of Artificial Sequence: Synthetic polypeptide
DEEEIRTTNPVATEQYGCVCSTGEHQENSGSEFQF

SEQ ID NO: 136341 - protein, 34 aa, Artificial Sequence
  Description of Artificial Sequence: Synthetic polypeptide
DEEEIRTTNPVATEQYGCVCSTGEHQENFPSDQA

SEQ ID NO: 136342 - protein, 35 aa, Artificial Sequence
  Description of Artificial Sequence: Synthetic polypeptide
DEEEIRTTNPVATEQYGCVCSTGEHQENFGSQTQS

SEQ ID NO: 136343 - protein, 36 aa, Artificial Sequence
  Description of Artificial Sequence: Synthetic polypeptide
AEEEIRTTNPVATEQYGSVATTNQQQGNQQGNNDEA

SEQ ID NO: 136344 - protein, 33 aa, Artificial Sequence
  Description of Artificial Sequence: Synthetic polypeptide
SQEEIRTTNPVATEQWGTVCSTGALQNFGSDQS

SEQ ID NO: 136345 - protein, 33 aa, Artificial Sequence
  Description of Artificial Sequence: Synthetic polypeptide
SQEEIRTTNPVATEQWGTVCSTGNHINFGSNQA

SEQ ID NO: 136346 - protein, 35 aa, Artificial Sequence
  Description of Artificial Sequence: Synthetic polypeptide
AEEEIRTTNPVATEQYGSVATVNTNDESGTVNNNT

SEQ ID NO: 136347 - protein, 36 aa, Artificial Sequence
  Description of Artificial Sequence: Synthetic polypeptide
AEEEIRTTNPVATEQYGSVATTNQQQGNNQTGNNAA

SEQ ID NO: 136348 - protein, 35 aa, Artificial Sequence
  Description of Artificial Sequence: Synthetic polypeptide
DEEEIRTTNPVATEQYGCVCSTGEHNQYFNSDTQT

SEQ ID NO: 136349 - protein, 36 aa, Artificial Sequence
  Description of Artificial Sequence: Synthetic polypeptide
AEEEIRTTNPVATEQYGSVATTNQQQGNNQQGNNNA

SEQ ID NO: 136350 - protein, 35 aa, Artificial Sequence
  Description of Artificial Sequence: Synthetic polypeptide
DEEEIRTTNPVATEQYGCVCSTGEHNQNFNSDNQS

SEQ ID NO: 136351 - protein, 36 aa, Artificial Sequence
  Description of Artificial Sequence: Synthetic polypeptide
AEEEIRTTNPVATEQYGSVATTNQQQGNNQIGNNES

SEQ ID NO: 136352 - protein, 34 aa, Artificial Sequence
  Description of Artificial Sequence: Synthetic polypeptide
DEEEIRTTNPVATEQYGCVCSTGEHNQNFISDQI

SEQ ID NO: 136353 - protein, 36 aa, Artificial Sequence
  Description of Artificial Sequence: Synthetic polypeptide
AEEEIRTTNPVATEQYGSVATTNQQQGNNQDENNAN

SEQ ID NO: 136354 - protein, 33 aa, Artificial Sequence
  Description of Artificial Sequence: Synthetic polypeptide
DEEEISTTNPVATEQYGCVCSWEPQENFGSDQS

SEQ ID NO: 136355 - protein, 36 aa, Artificial Sequence
  Description of Artificial Sequence: Synthetic polypeptide
AEEEIRTTNPVATEQYGSVATTNQQQGNNQAGNQGA

SEQ ID NO: 136356 - protein, 34 aa, Artificial Sequence
  Description of Artificial Sequence: Synthetic polypeptide
DEEEIRTTNPVATEQYGCVCSTGEHNQNFISDQA

SEQ ID NO: 136357 - protein, 35 aa, Artificial Sequence
  Description of Artificial Sequence: Synthetic polypeptide
DEEEIRTTNPVATEQYGCVCSTGEHNQYFNSNFQS

SEQ ID NO: 136358 - protein, 34 aa, Artificial Sequence
  Description of Artificial Sequence: Synthetic polypeptide
DEEEIRTTNPVATEAYGSCNMTEAWLSQTIGSQS

SEQ ID NO: 136359 - protein, 35 aa, Artificial Sequence
  Description of Artificial Sequence: Synthetic polypeptide
AEEEIRTTNPVATEQYGSVATVTNVNNTNTEDGNA

SEQ ID NO: 136360 - protein, 32 aa, Artificial Sequence
  Description of Artificial Sequence: Synthetic polypeptide
SQEEIRTTNPVATEQWGCVNTSVLEQRPEQKE

SEQ ID NO: 136361 - protein, 33 aa, Artificial Sequence
  Description of Artificial Sequence: Synthetic polypeptide
SNEEIRTTNPVATEQWGCVSLLNTYQEGVNMPS

SEQ ID NO: 136362 - protein, 33 aa, Artificial Sequence
  Description of Artificial Sequence: Synthetic polypeptide
SNEEIRTTNPVATEQWGCVSLLNTYQEGVQNEF

SEQ ID NO: 136363 - protein, 32 aa, Artificial Sequence
  Description of Artificial Sequence: Synthetic polypeptide
SNEEIRTTNPVATEQWGCVSLMNTYQEGVQDP

SEQ ID NO: 136364 - protein, 35 aa, Artificial Sequence
  Description of Artificial Sequence: Synthetic polypeptide
AEEEIRTTNPVATEQYGSVQTNNNNQQGTEGGTDS

SEQ ID NO: 136365 - protein, 35 aa, Artificial Sequence
  Description of Artificial Sequence: Synthetic polypeptide
DEEEIRTTNPVATEQYGCVCSTGEPNQNFNSDTQS

SEQ ID NO: 136366 - protein, 31 aa, Artificial Sequence
  Description of Artificial Sequence: Synthetic polypeptide
SNNEIRTTNPVATEQWGCCSLNTEQEEGQNP

SEQ ID NO: 136367 - protein, 31 aa, Artificial Sequence
  Description of Artificial Sequence: Synthetic polypeptide
SQAEIRTTNPVATEQYGCCSAVLQHGDFSKQ

SEQ ID NO: 136368 - protein, 31 aa, Artificial Sequence
  Description of Artificial Sequence: Synthetic polypeptide
SQAEIRTTNPVATEQYGCCSAVLQHHGGSKQ

SEQ ID NO: 136369 - protein, 31 aa, Artificial Sequence
  Description of Artificial Sequence: Synthetic polypeptide
SQAEIRTTNPVATEQYGCCSNVLQYGQDSKQ

SEQ ID NO: 136370 - protein, 35 aa, Artificial Sequence
  Description of Artificial Sequence: Synthetic polypeptide
DEEEIRTTNPVATEQYGCVCSTGEPNIENFNSEQS

SEQ ID NO: 136371 - protein, 35 aa, Artificial Sequence
  Description of Artificial Sequence: Synthetic polypeptide
DEEEIRTTNPVATEQYGCVCSTGEPIENFGSENQS

SEQ ID NO: 136372 - protein, 35 aa, Artificial Sequence
  Description of Artificial Sequence: Synthetic polypeptide
DEEEIRTTNPVATEQYGCVCSTGEPHQNFISDNQA

SEQ ID NO: 136373 - protein, 35 aa, Artificial Sequence
  Description of Artificial Sequence: Synthetic polypeptide
DEEEIRTTNPVATEQYGCVCSTGEPHNQNFGSEQS

SEQ ID NO: 136374 - protein, 33 aa, Artificial Sequence
  Description of Artificial Sequence: Synthetic polypeptide
SQEEIATTNPVAYEQWGTVSTNLNQGEHGQDRE

SEQ ID NO: 136375 - protein, 35 aa, Artificial Sequence
  Description of Artificial Sequence: Synthetic polypeptide
AEEEIRTTNPVATEQYGSVETNNNQQGTEGGTDES

SEQ ID NO: 136376 - protein, 34 aa, Artificial Sequence
  Description of Artificial Sequence: Synthetic polypeptide
DEEEIRTTNPVATEQYGCVCSTGEHTYFGSETQS

SEQ ID NO: 136377 - protein, 33 aa, Artificial Sequence
  Description of Artificial Sequence: Synthetic polypeptide
DEEEISTTNPVATEQYGCVCSWGEHANFQSDQS

SEQ ID NO: 136378 - protein, 35 aa, Artificial Sequence
  Description of Artificial Sequence: Synthetic polypeptide
SQEEIRTTNPVATEQWGCVCSTGNLNQNFGSNTQA

SEQ ID NO: 136379 - protein, 32 aa, Artificial Sequence
  Description of Artificial Sequence: Synthetic polypeptide
SQEEIRTTNPVATEQWGCVCSWNDQNFGSQQA

SEQ ID NO: 136380 - protein, 32 aa, Artificial Sequence
  Description of Artificial Sequence: Synthetic polypeptide
SQEEIRTTNPVATEQWGCVETNHLQEIFDTSN

SEQ ID NO: 136381 - protein, 31 aa, Artificial Sequence
  Description of Artificial Sequence: Synthetic polypeptide
SQEEIRTTNPVATEQWGCVEWNHLQTEIFDS

SEQ ID NO: 136382 - protein, 34 aa, Artificial Sequence
  Description of Artificial Sequence: Synthetic polypeptide
SNAEIRTTNPVATEQYGSVSESPEQDRIGSNGQE

SEQ ID NO: 136383 - protein, 36 aa, Artificial Sequence
  Description of Artificial Sequence: Synthetic polypeptide
DEEEIRTTNPQATEQYGSVSSTTPAGPNMNNGMNPV

SEQ ID NO: 136384 - protein, 31 aa, Artificial Sequence
  Description of Artificial Sequence: Synthetic polypeptide
DDSEIRTTNPVSTEPYGNISMETIQSRNGQR

SEQ ID NO: 136385 - protein, 33 aa, Artificial Sequence
  Description of Artificial Sequence: Synthetic polypeptide
DEEEIRTTNPVAYEQWGSVCVNWEPQEMDMHQR

SEQ ID NO: 136386 - protein, 37 aa, Artificial Sequence
  Description of Artificial Sequence: Synthetic polypeptide
DEEEIRTTNPVAFEQYGAVVVGGQTNDGLQQRGIRGG

SEQ ID NO: 136387 - protein, 33 aa, Artificial Sequence
  Description of Artificial Sequence: Synthetic polypeptide
SESEIRCTNPCAYEQYGSVVSENAHSHIRGGNR

SEQ ID NO: 136388 - protein, 36 aa, Artificial Sequence
  Description of Artificial Sequence: Synthetic polypeptide
DEEEIRTTNPVAFEQYGQTVNSGQINDLLQRDIRGQ

SEQ ID NO: 136389 - protein, 36 aa, Artificial Sequence
  Description of Artificial Sequence: Synthetic polypeptide
DEEEIRTTNPVAFEQYGQVVGGQTNDGLQQRGISGG

SEQ ID NO: 136390 - protein, 36 aa, Artificial Sequence
  Description of Artificial Sequence: Synthetic polypeptide
DEEEIRTTNPVAFEQYGQVVGNDQNDLDQRTGQRGD

SEQ ID NO: 136391 - protein, 34 aa, Artificial Sequence
  Description of Artificial Sequence: Synthetic polypeptide
DEEEIRTTNPVAFEQYGQVVITGDLGQGEGDTGE

SEQ ID NO: 136392 - protein, 37 aa, Artificial Sequence
  Description of Artificial Sequence: Synthetic polypeptide
DEEEIRTTNPVAFEQYGQVVNGGQTNDGLQQRGIRGG

SEQ ID NO: 136393 - protein, 35 aa, Artificial Sequence
  Description of Artificial Sequence: Synthetic polypeptide
DEEEIRTTNPVAFEQYGQVVSTGGDLGQEEGEGGI

SEQ ID NO: 136394 - protein, 35 aa, Artificial Sequence
  Description of Artificial Sequence: Synthetic polypeptide
DEEEIRTTNPVAFEQYGQVVSTGGDLGQSEGEGEI

SEQ ID NO: 136395 - protein, 35 aa, Artificial Sequence
  Description of Artificial Sequence: Synthetic polypeptide
DEEEIRTTNPVAFEQYGAVVNGQNDLDQRNQRGDT

SEQ ID NO: 136396 - protein, 36 aa, Artificial Sequence
  Description of Artificial Sequence: Synthetic polypeptide
DEEEIRTTNPVAFEQYGSVSSTTPAGPAMRNGMNCV

SEQ ID NO: 136397 - protein, 36 aa, Artificial Sequence
  Description of Artificial Sequence: Synthetic polypeptide
DEEEIRTTNPVAFEQYGSVSSTTPAGPNMRNGMNPV

SEQ ID NO: 136398 - protein, 32 aa, Artificial Sequence
  Description of Artificial Sequence: Synthetic polypeptide
SESEIRCTNPIAYEQYGSVVSLNAHSMIGGNR

SEQ ID NO: 136399 - protein, 32 aa, Artificial Sequence
  Description of Artificial Sequence: Synthetic polypeptide
SESEIRCTNPIAYESYGSVVSENAHSERGGNR

SEQ ID NO: 136400 - protein, 36 aa, Artificial Sequence
  Description of Artificial Sequence: Synthetic polypeptide
DEEEIRTTNPVAFEQYGSVVDGLNDLGQQIGQRFFQ

SEQ ID NO: 136401 - protein, 36 aa, Artificial Sequence
  Description of Artificial Sequence: Synthetic polypeptide
DEEEIRTTNPVAFEQYGSVVGGQTNDNDQQRGIMGG

SEQ ID NO: 136402 - protein, 37 aa, Artificial Sequence
  Description of Artificial Sequence: Synthetic polypeptide
DEEEIRTTNPVAFEQYGSVVNGQSNDLGQRGQQRGGQ

SEQ ID NO: 136403 - protein, 36 aa, Artificial Sequence
  Description of Artificial Sequence: Synthetic polypeptide
DEEEIRTTNPVAFEQYGSVVSTGGDLGQEDQGEGGF

SEQ ID NO: 136404 - protein, 36 aa, Artificial Sequence
  Description of Artificial Sequence: Synthetic polypeptide
DEEEIRTTNPVAFEQYGSVVSTGGDLGQEEQGLGGE

SEQ ID NO: 136405 - protein, 31 aa, Artificial Sequence
  Description of Artificial Sequence: Synthetic polypeptide
SESEIRCTNPVAYEQYGSVFCLNELSAHGEQ

SEQ ID NO: 136406 - protein, 36 aa, Artificial Sequence
  Description of Artificial Sequence: Synthetic polypeptide
DEEEIRTTNPVAFEQYGSVSSTTPAGPNMINGMNPV

SEQ ID NO: 136407 - protein, 36 aa, Artificial Sequence
  Description of Artificial Sequence: Synthetic polypeptide
DEEEIRTTNPVAFEQYGAVVGGQTNDLLQQRNIRGG

SEQ ID NO: 136408 - protein, 28 aa, Artificial Sequence
  Description of Artificial Sequence: Synthetic peptide
SESEIASTNPVGTEGYGVMASTLQHGDI

SEQ ID NO: 136409 - protein, 28 aa, Artificial Sequence
  Description of Artificial Sequence: Synthetic peptide
SESEIASTNPVGTEGYGTMASTLQHGDI

SEQ ID NO: 136410 - protein, 36 aa, Artificial Sequence
  Description of Artificial Sequence: Synthetic polypeptide
DEEEIRTTNPSATEQYGSVSSTTPAGENMRNGMNPV

SEQ ID NO: 136411 - protein, 36 aa, Artificial Sequence
  Description of Artificial Sequence: Synthetic polypeptide
DEEEIRTTNPSATEQYGSVSSTTPAGPNMRNGMNAV

SEQ ID NO: 136412 - protein, 32 aa, Artificial Sequence
  Description of Artificial Sequence: Synthetic polypeptide
SEQIIATTNPVATEQYGSVSATDLEDHEGEDL

SEQ ID NO: 136413 - protein, 29 aa, Artificial Sequence
  Description of Artificial Sequence: Synthetic peptide
SEREIACTNPCSYEQYGCVCSSNLQSGTQ

SEQ ID NO: 136414 - protein, 29 aa, Artificial Sequence
  Description of Artificial Sequence: Synthetic peptide
SEREIACTNPCSYEQYGCVSCNLQSGSTQ

SEQ ID NO: 136415 - protein, 36 aa, Artificial Sequence
  Description of Artificial Sequence: Synthetic polypeptide
DEEEIRTTNPSATEQYGSVSSTTPAGPNMRNGMNPV

SEQ ID NO: 136416 - protein, 36 aa, Artificial Sequence
  Description of Artificial Sequence: Synthetic polypeptide
DEEEIRTTNPSATEQYGSVSSTTPAGPNMRNGYNPV

SEQ ID NO: 136417 - protein, 35 aa, Artificial Sequence
  Description of Artificial Sequence: Synthetic polypeptide
DEEEIRTTNPTATEAYGCVCLTNELSGKTGGNNRG

SEQ ID NO: 136418 - protein, 36 aa, Artificial Sequence
  Description of Artificial Sequence: Synthetic polypeptide
DEEEIRTTNPTATEQYGSVLSTTPAGPNMRNGMNPV

SEQ ID NO: 136419 - protein, 36 aa, Artificial Sequence
  Description of Artificial Sequence: Synthetic polypeptide
DEEEIRTTNPTATEQYGSVSSTTPAGPNMRDGMNPV

SEQ ID NO: 136420 - protein, 28 aa, Artificial Sequence
  Description of Artificial Sequence: Synthetic peptide
SESEIACTNPIATEQYGVMSSTLMHGDI

SEQ ID NO: 136421 - protein, 36 aa, Artificial Sequence
  Description of Artificial Sequence: Synthetic polypeptide
DEEEIRTTNPTATEQYGSVSSTTPAGPNMRNGMNAV

SEQ ID NO: 136422 - protein, 36 aa, Artificial Sequence
  Description of Artificial Sequence: Synthetic polypeptide
DEEEIRTTNPTATEQYGSVSSTTPAGPNMRNGMNPV

SEQ ID NO: 136423 - protein, 34 aa, Artificial Sequence
  Description of Artificial Sequence: Synthetic polypeptide
DEEEIRTTNPTATEQYGSVVCIRASSNNGGNNED

SEQ ID NO: 136424 - protein, 36 aa, Artificial Sequence
  Description of Artificial Sequence: Synthetic polypeptide
DEEEIRTTNPVACEQYGSVSSTTPAGPNMRNGMNPV

SEQ ID NO: 136425 - protein, 28 aa, Artificial Sequence
  Description of Artificial Sequence: Synthetic peptide
SESEIACTNPVGTEGYGVMASTLMHGDR

SEQ ID NO: 136426 - protein, 28 aa, Artificial Sequence
  Description of Artificial Sequence: Synthetic peptide
SESEIACTNPVGTEGYGVMASTLQHGDI

SEQ ID NO: 136427 - protein, 36 aa, Artificial Sequence
  Description of Artificial Sequence: Synthetic polypeptide
DEEEIRTTNPVADEQYGSVSSTTDAGPNMRNGMNPV

SEQ ID NO: 136428 - protein, 36 aa, Artificial Sequence
  Description of Artificial Sequence: Synthetic polypeptide
DEEEIRTTNPVADEQYGSVSSTTPAGPNMRNGMNPV

SEQ ID NO: 136429 - protein, 36 aa, Artificial Sequence
  Description of Artificial Sequence: Synthetic polypeptide
DEEEIRTTNPVADEQYGSVSSTTPAGPNSRNGMNPV

SEQ ID NO: 136430 - protein, 36 aa, Artificial Sequence
  Description of Artificial Sequence: Synthetic polypeptide
DEEEIRTTNPVADEQYGSVSSTTQAGPNMRNGMNPV

SEQ ID NO: 136431 - protein, 37 aa, Artificial Sequence
  Description of Artificial Sequence: Synthetic polypeptide
DEEEIRTTNPVAFEQYGSVVVTNGENELGQRGQTDEQ

SEQ ID NO: 136432 - protein, 31 aa, Artificial Sequence
  Description of Artificial Sequence: Synthetic polypeptide
DDSEIRTTNPVSTEPYGNISMEDIQSRNGQR

SEQ ID NO: 136433 - protein, 35 aa, Artificial Sequence
  Description of Artificial Sequence: Synthetic polypeptide
DEEEIRTTNPVAFEQYGVVVNGQNDLGQRGQEEDV

SEQ ID NO: 136434 - protein, 36 aa, Artificial Sequence
  Description of Artificial Sequence: Synthetic polypeptide
DEEEIRTTNPVAGEQYGSVSSTTPAVPNMRNGMNPV

SEQ ID NO: 136435 - protein, 34 aa, Artificial Sequence
  Description of Artificial Sequence: Synthetic polypeptide
DDSEIRTTNPVATEGWGSVSACINIPQDREGENG

SEQ ID NO: 136436 - protein, 35 aa, Artificial Sequence
  Description of Artificial Sequence: Synthetic polypeptide
DEEEIRTTNPVAYEQWGSCVYSDEWNDGQRSQGDN

SEQ ID NO: 136437 - protein, 30 aa, Artificial Sequence
  Description of Artificial Sequence: Synthetic polypeptide
SESEVACTNPVSTEGYGNVSANTIQRVGQR

SEQ ID NO: 136438 - protein, 33 aa, Artificial Sequence
  Description of Artificial Sequence: Synthetic polypeptide
DDSEIRTTNPVATEQYGCVVPELNQEFGQDDNA

SEQ ID NO: 136439 - protein, 34 aa, Artificial Sequence
  Description of Artificial Sequence: Synthetic polypeptide
DEEEIRTTNPVAYEQWGSSYSLPNMLDQAQDNMN

SEQ ID NO: 136440 - protein, 30 aa, Artificial Sequence
  Description of Artificial Sequence: Synthetic polypeptide
SESEVRSTNPVATEQYGNVAAETIMRVGQR

SEQ ID NO: 136441 - protein, 32 aa, Artificial Sequence
  Description of Artificial Sequence: Synthetic polypeptide
SETAEIACTNPVAYEQYGSVATNLQAPPPENV

SEQ ID NO: 136442 - protein, 33 aa, Artificial Sequence
  Description of Artificial Sequence: Synthetic polypeptide
SETEIACTNPVATEQYGSVYCTWNDQHHPGQNQ

SEQ ID NO: 136443 - protein, 35 aa, Artificial Sequence
  Description of Artificial Sequence: Synthetic polypeptide
DEEEIRTTNPVATDQYGSVSDGVTGLGGNGGIQGG

SEQ ID NO: 136444 - protein, 33 aa, Artificial Sequence
  Description of Artificial Sequence: Synthetic polypeptide
DDSEIRTTNPVATECWGSVSCINSPQDRQGEMG

SEQ ID NO: 136445 - protein, 36 aa, Artificial Sequence
  Description of Artificial Sequence: Synthetic polypeptide
DEEEIRTTNPVATDQYGSVSSTTPAGPNMRNGMNPV

SEQ ID NO: 136446 - protein, 33 aa, Artificial Sequence
  Description of Artificial Sequence: Synthetic polypeptide
DDSEIRTTNPVATEQYGSVWTNHTETEGLEDDQ

SEQ ID NO: 136447 - protein, 33 aa, Artificial Sequence
  Description of Artificial Sequence: Synthetic polypeptide
SETEIRCTNPVATEQYGSVYCTWNDQHQNQNQS

SEQ ID NO: 136448 - protein, 33 aa, Artificial Sequence
  Description of Artificial Sequence: Synthetic polypeptide
DEEEIRTTNPVAYEQWGSVCSNWEMQTQDMHSR

SEQ ID NO: 136449 - protein, 36 aa, Artificial Sequence
  Description of Artificial Sequence: Synthetic polypeptide
DEEEIRTTNPVATEQYGCVCSTMNDHNQENFGSQQA

SEQ ID NO: 136450 - protein, 35 aa, Artificial Sequence
  Description of Artificial Sequence: Synthetic polypeptide
DEEEIRTTNPVATEQYGCVCSTMNAHQENFMSEQA

SEQ ID NO: 136451 - protein, 33 aa, Artificial Sequence
  Description of Artificial Sequence: Synthetic polypeptide
DDSEIRTTNPVSTEGYGSVSSATAGNSRNGQPR

SEQ ID NO: 136452 - protein, 30 aa, Artificial Sequence
  Description of Artificial Sequence: Synthetic polypeptide
DDSEIRTTNPVSTEGYGTVANTIQQQVGQH

SEQ ID NO: 136453 - protein, 33 aa, Artificial Sequence
  Description of Artificial Sequence: Synthetic polypeptide
SETEIRTTNPIATECYGSTTWSEENLARKGNYI

SEQ ID NO: 136454 - protein, 31 aa, Artificial Sequence
  Description of Artificial Sequence: Synthetic polypeptide
DDSEIRTTNPVSTEPYGNISMEDIQSQNGNR

SEQ ID NO: 136455 - protein, 35 aa, Artificial Sequence
  Description of Artificial Sequence: Synthetic polypeptide
DEEEIRTTNPVATDQYGVVMSDNNMQIREGEGGGN

SEQ ID NO: 136456 - protein, 36 aa, Artificial Sequence
  Description of Artificial Sequence: Synthetic polypeptide
DEEEIRTTNPVATCQYGSVSSTTPAGPNMRNGMNPV

SEQ ID NO: 136457 - protein, 34 aa, Artificial Sequence
  Description of Artificial Sequence: Synthetic polypeptide
DEEEIRTTNPVATCQYGCVCSNTGEHQNFGSEQS

SEQ ID NO: 136458 - protein, 36 aa, Artificial Sequence
  Description of Artificial Sequence: Synthetic polypeptide
DEEEIRTTNPVATAQYGSVSSTTPAGPNMRNGMNPV

SEQ ID NO: 136459 - protein, 36 aa, Artificial Sequence
  Description of Artificial Sequence: Synthetic polypeptide
DEEEIRTTNPVAHEQYGSVSSTTPAGPNMRNGMNPV

SEQ ID NO: 136460 - protein, 36 aa, Artificial Sequence
  Description of Artificial Sequence: Synthetic polypeptide
DEEEIRTTNPVAHEQYGSVSSTTPAGPNMRNGPNPV

SEQ ID NO: 136461 - protein, 34 aa, Artificial Sequence
  Description of Artificial Sequence: Synthetic polypeptide
DEEEIRTTNPVAHEQYGSVWPTNETQPVFDVSSQ

SEQ ID NO: 136462 - protein, 36 aa, Artificial Sequence
  Description of Artificial Sequence: Synthetic polypeptide
DEEEIRTTNPVAIEQYGSVSSTTPAEPNMRNGMNPV

SEQ ID NO: 136463 - protein, 36 aa, Artificial Sequence
  Description of Artificial Sequence: Synthetic polypeptide
DEEEIRTTNPVAIEQYGSVSSTTPAGPNMRNGMNPV

SEQ ID NO: 136464 - protein, 36 aa, Artificial Sequence
  Description of Artificial Sequence: Synthetic polypeptide
DEEEIRTTNPVAMEQYGSVSSTTPAGPNMRNGMNPV

SEQ ID NO: 136465 - protein, 36 aa, Artificial Sequence
  Description of Artificial Sequence: Synthetic polypeptide
AEEEIRTTNPVATEQYGSVSSTTPAGPNMRNGMNPV

SEQ ID NO: 136466 - protein, 34 aa, Artificial Sequence
  Description of Artificial Sequence: Synthetic polypeptide
SESEIRTTNPVATECWGHSVSCINEPQDREGENG

SEQ ID NO: 136467 - protein, 33 aa, Artificial Sequence
  Description of Artificial Sequence: Synthetic polypeptide
SESEIRTTNPVATECWGSVDCINEPQDREGENG

SEQ ID NO: 136468 - protein, 30 aa, Artificial Sequence
  Description of Artificial Sequence: Synthetic polypeptide
DDSEIRSTNPVSTEQYGNVANTIMSRAEDR

SEQ ID NO: 136469 - protein, 33 aa, Artificial Sequence
  Description of Artificial Sequence: Synthetic polypeptide
SESEIRTTNPVATECWGSVSCINEPQDRWGEKG

SEQ ID NO: 136470 - protein, 36 aa, Artificial Sequence
  Description of Artificial Sequence: Synthetic polypeptide
DEEEIRTTNPVANEQYGSVSSTTPAGPNMRNGMNPV

SEQ ID NO: 136471 - protein, 36 aa, Artificial Sequence
  Description of Artificial Sequence: Synthetic polypeptide
DEEEIRTTNPVASEQYGSVSSTTAAGPNMRNGMNPV

SEQ ID NO: 136472 - protein, 33 aa, Artificial Sequence
  Description of Artificial Sequence: Synthetic polypeptide
SESEIRTTNPVATECWGSVSLIWEPQDRKGENG

SEQ ID NO: 136473 - protein, 33 aa, Artificial Sequence
  Description of Artificial Sequence: Synthetic polypeptide
DDSEIRTTNPVASECWGSVSCINEPQDREGENG

SEQ ID NO: 136474 - protein, 36 aa, Artificial Sequence
  Description of Artificial Sequence: Synthetic polypeptide
DEEEIRTTNPVASEQYGSVSSTTPAGPNMRNGMNPV

SEQ ID NO: 136475 - protein, 33 aa, Artificial Sequence
  Description of Artificial Sequence: Synthetic polypeptide
DDSEIRTTNPVATECWGSVACINEPQDRVGENG

SEQ ID NO: 136476 - protein, 36 aa, Artificial Sequence
  Description of Artificial Sequence: Synthetic polypeptide
DEEEIRTTNPVAYEQWGQKTVSYTNALSHRPGGNFP

SEQ ID NO: 136477 - protein, 33 aa, Artificial Sequence
  Description of Artificial Sequence: Synthetic polypeptide
SESEIRTTNPVATEKWGSVSCIQEPQDREGENG

SEQ ID NO: 136478 - protein, 34 aa, Artificial Sequence
  Description of Artificial Sequence: Synthetic polypeptide
DDSEIRTTNPVATECWGSVSANITEPQDREGEQR

SEQ ID NO: 136479 - protein, 35 aa, Artificial Sequence
  Description of Artificial Sequence: Synthetic polypeptide
DEEEIRTTNPVATAHYGCSVVSEGNMSSQHGGSPR

SEQ ID NO: 136480 - protein, 36 aa, Artificial Sequence
  Description of Artificial Sequence: Synthetic polypeptide
DEEEIRTTNPVAGEQYGSVSSTTPAGPNMRNGMNPV

SEQ ID NO: 136481 - protein, 33 aa, Artificial Sequence
  Description of Artificial Sequence: Synthetic polypeptide
DEEEISTTNPVATEQYGCVCSWELTENFGSEQV

SEQ ID NO: 136482 - protein, 35 aa, Artificial Sequence
  Description of Artificial Sequence: Synthetic polypeptide
DEEEISTTNPVATEQYGQCVCSTEDHQNFGSDNQS

SEQ ID NO: 136483 - protein, 34 aa, Artificial Sequence
  Description of Artificial Sequence: Synthetic polypeptide
DEEEISTTNPVATEQYGQCVCSTEDQNFNSNNQS

SEQ ID NO: 136484 - protein, 33 aa, Artificial Sequence
  Description of Artificial Sequence: Synthetic polypeptide
DEEEISTTNPVATEQYGVVCSWEHQEYFGSEQS

SEQ ID NO: 136485 - protein, 36 aa, Artificial Sequence
  Description of Artificial Sequence: Synthetic polypeptide
SEEEIRTTNPVATEQYGSVSPTNDINETQMEDNYME

SEQ ID NO: 136486 - protein, 34 aa, Artificial Sequence
  Description of Artificial Sequence: Synthetic polypeptide
DEEEISTTNPVATEQYGVVCSTGELAENFNSDQL

SEQ ID NO: 136487 - protein, 32 aa, Artificial Sequence
  Description of Artificial Sequence: Synthetic polypeptide
DEEEIRTTNPCATESYGSVALTENNHPAQVVA

SEQ ID NO: 136488 - protein, 33 aa, Artificial Sequence
  Description of Artificial Sequence: Synthetic polypeptide
DEEEISTTNPVATEQYGVVCSTEDHANFGSDQL

SEQ ID NO: 136489 - protein, 33 aa, Artificial Sequence
  Description of Artificial Sequence: Synthetic polypeptide
DEEEISTTNPVATEQYGVVCSNWEHQNFGSDQS

SEQ ID NO: 136490 - protein, 32 aa, Artificial Sequence
  Description of Artificial Sequence: Synthetic polypeptide
DDSEIASTNPVATEQYGNVAANDTIQSRVGQR

SEQ ID NO: 136491 - protein, 35 aa, Artificial Sequence
  Description of Artificial Sequence: Synthetic polypeptide
AEEEIRTTNPVATEQYGSVSTTEGNNNNQNEEQGS

SEQ ID NO: 136492 - protein, 35 aa, Artificial Sequence
  Description of Artificial Sequence: Synthetic polypeptide
AEEEIRTTNPVATEQYGSVSTTEGNNNNQNDEQGS

SEQ ID NO: 136493 - protein, 31 aa, Artificial Sequence
  Description of Artificial Sequence: Synthetic polypeptide
DDSEIASTNPVATEGYGSVSNTIQDRVGEQG

SEQ ID NO: 136494 - protein, 35 aa, Artificial Sequence
  Description of Artificial Sequence: Synthetic polypeptide
AEEEIRTTNPVATEQYGSVSTTEGNNNNQGDEQGS

SEQ ID NO: 136495 - protein, 32 aa, Artificial Sequence
  Description of Artificial Sequence: Synthetic polypeptide
DEEEIRTTNPCATTQYGTVATEQYGSTTNLVE

SEQ ID NO: 136496 - protein, 35 aa, Artificial Sequence
  Description of Artificial Sequence: Synthetic polypeptide
AEEEIRTTNPVATEQYGSVSTTDQQQQIATNVATE

SEQ ID NO: 136497 - protein, 36 aa, Artificial Sequence
  Description of Artificial Sequence: Synthetic polypeptide
AEEEIRTTNPVATEQYGSVSTTDQQQNSEQGTNISE

SEQ ID NO: 136498 - protein, 34 aa, Artificial Sequence
  Description of Artificial Sequence: Synthetic polypeptide
DEEEISTTNPVATEQYGSVVALGEMSSQHGGQYR

SEQ ID NO: 136499 - protein, 32 aa, Artificial Sequence
  Description of Artificial Sequence: Synthetic polypeptide
DEEEIRTTNPCATTQYGTVATEQYGTTTDAND

SEQ ID NO: 136500 - protein, 36 aa, Artificial Sequence
  Description of Artificial Sequence: Synthetic polypeptide
AEEEIRTTNPVATEQYGSVSTTDQQGNQEGTEQGSD

SEQ ID NO: 136501 - protein, 31 aa, Artificial Sequence
  Description of Artificial Sequence: Synthetic polypeptide
DDSEIASTNPVCTEGYGVVAADTLQSRVGNR

SEQ ID NO: 136502 - protein, 32 aa, Artificial Sequence
  Description of Artificial Sequence: Synthetic polypeptide
DEEEIRTTNPCATTQYGTVATEQYGTTTNVNT

SEQ ID NO: 136503 - protein, 32 aa, Artificial Sequence
  Description of Artificial Sequence: Synthetic polypeptide
DEEEIRTTNPCATTQYGTVATEQYGTTTQGNE

SEQ ID NO: 136504 - protein, 32 aa, Artificial Sequence
  Description of Artificial Sequence: Synthetic polypeptide
DDSEIASTNPVATEQYGTVAANDTIQSRVGQR

SEQ ID NO: 136505 - protein, 36 aa, Artificial Sequence
  Description of Artificial Sequence: Synthetic polypeptide
AEEEIRTTNPVATEQYGSVSTTEQNGGTEQGTNTNA

SEQ ID NO: 136506 - protein, 36 aa, Artificial Sequence
  Description of Artificial Sequence: Synthetic polypeptide
AEEEIRTTNPVATEQYGSVSTTEQNGGTESGTNQNG

SEQ ID NO: 136507 - protein, 36 aa, Artificial Sequence
  Description of Artificial Sequence: Synthetic polypeptide
AEEEIRTTNPVATEQYGSVSTTEQNGNNEQGTNTNA

SEQ ID NO: 136508 - protein, 37 aa, Artificial Sequence
  Description of Artificial Sequence: Synthetic polypeptide
AEEEIRTTNPVATEQYGSVSTTLNQQQTNQQGTNVTE

SEQ ID NO: 136509 - protein, 37 aa, Artificial Sequence
  Description of Artificial Sequence: Synthetic polypeptide
DEEEIRTTNPCATEQYGVVSTVNTNQQQLQQGTNSAE

SEQ ID NO: 136510 - protein, 36 aa, Artificial Sequence
  Description of Artificial Sequence: Synthetic polypeptide
AEEEIRTTNPVATEQYGSVSTTLNQQQANENNNNVE

SEQ ID NO: 136511 - protein, 37 aa, Artificial Sequence
  Description of Artificial Sequence: Synthetic polypeptide
AEEEIRTTNPVATEQYGSVSTTLNQGDEIGTTNTDEQ

SEQ ID NO: 136512 - protein, 37 aa, Artificial Sequence
  Description of Artificial Sequence: Synthetic polypeptide
DEEEIRTTNPCATEQYGVVSTVVNNLQQLQQGTNPTE

SEQ ID NO: 136513 - protein, 37 aa, Artificial Sequence
  Description of Artificial Sequence: Synthetic polypeptide
DEEEIRTTNPCATEQYGVVSTVVVNNQQLQQGTNVAE

SEQ ID NO: 136514 - protein, 37 aa, Artificial Sequence
  Description of Artificial Sequence: Synthetic polypeptide
DEEEIRTTNPCATEQYGVVSVTTNQQLQLQQGTNVAE

SEQ ID NO: 136515 - protein, 36 aa, Artificial Sequence
  Description of Artificial Sequence: Synthetic polypeptide
SEEEIRTTNPVATEQYGSVSENLYHNQFESTQDIRN

SEQ ID NO: 136516 - protein, 37 aa, Artificial Sequence
  Description of Artificial Sequence: Synthetic polypeptide
DEEEIRTTNPCATEQYGVVSVVTNNLNQLQQGTNNAE

SEQ ID NO: 136517 - protein, 37 aa, Artificial Sequence
  Description of Artificial Sequence: Synthetic polypeptide
DEEEIRTTNPCATEQYGVVSVVTNNLNQLQQGTNSAE

SEQ ID NO: 136518 - protein, 37 aa, Artificial Sequence
  Description of Artificial Sequence: Synthetic polypeptide
DEEEIRTTNPCATEQYGVVSVVTTNLEQLQQGTNPAE

SEQ ID NO: 136519 - protein, 31 aa, Artificial Sequence
  Description of Artificial Sequence: Synthetic polypeptide
DDSEIASTNPVATEGYGNVAANTIQSRVGQR

SEQ ID NO: 136520 - protein, 36 aa, Artificial Sequence
  Description of Artificial Sequence: Synthetic polypeptide
DEEEIRTTNPCATEQYGVVSVVVNNLQLQQGTNSTE

SEQ ID NO: 136521 - protein, 38 aa, Artificial Sequence
  Description of Artificial Sequence: Synthetic polypeptide
DEEEIRTTNPCATEQYGVVSVVVSTNLQQLQQGTNVAE

SEQ ID NO: 136522 - protein, 37 aa, Artificial Sequence
  Description of Artificial Sequence: Synthetic polypeptide
DEEEIRTTNPCATEQYGVVSVVVTNLQQLQQGTNTAE

SEQ ID NO: 136523 - protein, 34 aa, Artificial Sequence
  Description of Artificial Sequence: Synthetic polypeptide
DEEEISTTNPVAWEQYGCVCSTEEHQESFGSNQY

SEQ ID NO: 136524 - protein, 36 aa, Artificial Sequence
  Description of Artificial Sequence: Synthetic polypeptide
AEEEIRTTNPVATEQYGSVSTTGNNNQQLQNATEYG

SEQ ID NO: 136525 - protein, 34 aa, Artificial Sequence
  Description of Artificial Sequence: Synthetic polypeptide
SEEEIRTTNPVATEQYGSVSITVLNENPESDQQY

SEQ ID NO: 136526 - protein, 37 aa, Artificial Sequence
  Description of Artificial Sequence: Synthetic polypeptide
AEEEIRTTNPVATEQYGSVSTTGNNGNLQQGTEQGQE

SEQ ID NO: 136527 - protein, 35 aa, Artificial Sequence
  Description of Artificial Sequence: Synthetic polypeptide
DEEEIRTTNPCATEQYGVVVTTVNSNLQAGTDEED

SEQ ID NO: 136528 - protein, 35 aa, Artificial Sequence
  Description of Artificial Sequence: Synthetic polypeptide
DEEEIRTTNPCATEQYGVVVVTVNTNLQAGTDEED

SEQ ID NO: 136529 - protein, 36 aa, Artificial Sequence
  Description of Artificial Sequence: Synthetic polypeptide
AEEEIRTTNPVATEQYGSVSTTDQNQQGIANNVATE

SEQ ID NO: 136530 - protein, 37 aa, Artificial Sequence
  Description of Artificial Sequence: Synthetic polypeptide
AEEEIRTTNPVATEQYGSVSTTLNYGTQIGTTNSAEQ

SEQ ID NO: 136531 - protein, 29 aa, Artificial Sequence
  Description of Artificial Sequence: Synthetic peptide
DDSEIASTNPVGTEGYGVMASTLQSRGDI

SEQ ID NO: 136532 - protein, 37 aa, Artificial Sequence
  Description of Artificial Sequence: Synthetic polypeptide
AEEEIRTTNPVATEQYGSVSTTDQLGNQGISTENGNE

SEQ ID NO: 136533 - protein, 32 aa, Artificial Sequence
  Description of Artificial Sequence: Synthetic polypeptide
DEEEIRTTNPCAYEQWGCVPTWDLADRQGEGE

SEQ ID NO: 136534 - protein, 36 aa, Artificial Sequence
  Description of Artificial Sequence: Synthetic polypeptide
AEEEIRTTNPVATEQYGSVSTSTNNTNDESGTNTDQ

SEQ ID NO: 136535 - protein, 37 aa, Artificial Sequence
  Description of Artificial Sequence: Synthetic polypeptide
AEEEIRTTNPVATEQYGSVSTSTNNQQGSEQGTTNSD

SEQ ID NO: 136536 - protein, 30 aa, Artificial Sequence
  Description of Artificial Sequence: Synthetic polypeptide
DDSEIASTNPVSTEGYGNVANNIQSRVGTR

SEQ ID NO: 136537 - protein, 28 aa, Artificial Sequence
  Description of Artificial Sequence: Synthetic peptide
DDSEIASTNPVSTEGYGNVANTIQREQR

SEQ ID NO: 136538 - protein, 36 aa, Artificial Sequence
  Description of Artificial Sequence: Synthetic polypeptide
AEEEIRTTNPVATEQYGSVSTSTNNNNDESGTNNDD

SEQ ID NO: 136539 - protein, 33 aa, Artificial Sequence
  Description of Artificial Sequence: Synthetic polypeptide
DEEEIRTTNPCAYEQWGSVCYNIEEVRDGSNDS

SEQ ID NO: 136540 - protein, 32 aa, Artificial Sequence
  Description of Artificial Sequence: Synthetic polypeptide
DEEEIRTTNPCAYEQWGSVCYNIEKEDGNTDS

SEQ ID NO: 136541 - protein, 36 aa, Artificial Sequence
  Description of Artificial Sequence: Synthetic polypeptide
AEEEIRTTNPVATEQYGSVSTSTNNNNDEAGNNNDN

SEQ ID NO: 136542 - protein, 35 aa, Artificial Sequence
  Description of Artificial Sequence: Synthetic polypeptide
DEEEIRTTNPVATEQYGCVSTMEFGDTGEGGNQGE

SEQ ID NO: 136543 - protein, 37 aa, Artificial Sequence
  Description of Artificial Sequence: Synthetic polypeptide
AEEEIRTTNPVATEQYGSVSTSTNNNLQQGTTGQEDE

SEQ ID NO: 136544 - protein, 31 aa, Artificial Sequence
  Description of Artificial Sequence: Synthetic polypeptide
DDSEIASTNPVSTEGYGNVSANTIQSRVGQR

SEQ ID NO: 136545 - protein, 32 aa, Artificial Sequence
  Description of Artificial Sequence: Synthetic polypeptide
DEEEIRTTNPCAYEQWGSVPTWDLDDHKGKEA

SEQ ID NO: 136546 - protein, 31 aa, Artificial Sequence
  Description of Artificial Sequence: Synthetic polypeptide
DDSEIASTNPVSTEGYGNVSMTIQQSRVGQR

SEQ ID NO: 136547 - protein, 30 aa, Artificial Sequence
  Description of Artificial Sequence: Synthetic polypeptide
DDSEIASTNPVSTEGYGNVSNTIQSRVGQR

SEQ ID NO: 136548 - protein, 32 aa, Artificial Sequence
  Description of Artificial Sequence: Synthetic polypeptide
DEEEIRTTNPCAYEQWGSVPTWENDHMNGGEG

SEQ ID NO: 136549 - protein, 31 aa, Artificial Sequence
  Description of Artificial Sequence: Synthetic polypeptide
DDSEIASTNPVSTEGYGSVAANNIQDRVGQR

SEQ ID NO: 136550 - protein, 33 aa, Artificial Sequence
  Description of Artificial Sequence: Synthetic polypeptide
DEEEIRTTNPCAYEQWGSVPTWENDQAMGGSEG

SEQ ID NO: 136551 - protein, 33 aa, Artificial Sequence
  Description of Artificial Sequence: Synthetic polypeptide
DEEEIRTTNPCAYEQWGSVPTWENDQHNGGDEG

SEQ ID NO: 136552 - protein, 33 aa, Artificial Sequence
  Description of Artificial Sequence: Synthetic polypeptide
DEEEIRTTNPCAYEQWGSVYCTDNDQHEGHDVK

SEQ ID NO: 136553 - protein, 32 aa, Artificial Sequence
  Description of Artificial Sequence: Synthetic polypeptide
DEEEIRTTNPCAYEQWGSVCYNIEMRDQQNDV

SEQ ID NO: 136554 - protein, 32 aa, Artificial Sequence
  Description of Artificial Sequence: Synthetic polypeptide
DEEEIRTTNPCAYEPYGSCATNLATAHGDEMA

SEQ ID NO: 136555 - protein, 30 aa, Artificial Sequence
  Description of Artificial Sequence: Synthetic polypeptide
DDSEIASTNPVSTEGYGNVAANTIQSRGGR

SEQ ID NO: 136556 - protein, 33 aa, Artificial Sequence
  Description of Artificial Sequence: Synthetic polypeptide
DEEEIRTTNPCAYEPYGSCAGTNHMNRGMNEAM

SEQ ID NO: 136557 - protein, 36 aa, Artificial Sequence
  Description of Artificial Sequence: Synthetic polypeptide
SEEEIRTTNPVATEQYGSVSSTTAAGPNMRNGMNPV

SEQ ID NO: 136558 - protein, 32 aa, Artificial Sequence
  Description of Artificial Sequence: Synthetic polypeptide
DEEEIRTTNPCATTQYGTVATEQYGTTTTNVE

SEQ ID NO: 136559 - protein, 36 aa, Artificial Sequence
  Description of Artificial Sequence: Synthetic polypeptide
SEEEIRTTNPVATEQYGSVSSTTPAGPNMRNGMNPV

SEQ ID NO: 136560 - protein, 32 aa, Artificial Sequence
  Description of Artificial Sequence: Synthetic polypeptide
DEEEIRTTNPCATTQYGTVATEQYGTVNNADE

SEQ ID NO: 136561 - protein, 31 aa, Artificial Sequence
  Description of Artificial Sequence: Synthetic polypeptide
DDSEIASTNPVSTEGWGSVAACNEQDRVGNR

SEQ ID NO: 136562 - protein, 31 aa, Artificial Sequence
  Description of Artificial Sequence: Synthetic polypeptide
DDSEIASTNPVSTEGWGSVAANNEQDRVGNR

SEQ ID NO: 136563 - protein, 36 aa, Artificial Sequence
  Description of Artificial Sequence: Synthetic polypeptide
SEEEIRTTNPVATEQYGSVSSTTPDGTNMGNGENDV

SEQ ID NO: 136564 - protein, 32 aa, Artificial Sequence
  Description of Artificial Sequence: Synthetic polypeptide
DEEEIRTTNPCATTQYGTVATEQYGTVTNENE

SEQ ID NO: 136565 - protein, 32 aa, Artificial Sequence
  Description of Artificial Sequence: Synthetic polypeptide
DEEEIRTTNPCATTQYGTVATEQYGVTTTANE

SEQ ID NO: 136566 - protein, 37 aa, Artificial Sequence
  Description of Artificial Sequence: Synthetic polypeptide
AEEEIRTTNPVATEQYGSVSTTDGNNNNLLQGTNDEQ

SEQ ID NO: 136567 - protein, 36 aa, Artificial Sequence
  Description of Artificial Sequence: Synthetic polypeptide
AEEEIRTTNPVATEQYGSVSTTANQQGSTTNPNTTD

SEQ ID NO: 136568 - protein, 30 aa, Artificial Sequence
  Description of Artificial Sequence: Synthetic polypeptide
DDSEIASTNPVSTEGYGNVAAENIQSRGQR

SEQ ID NO: 136569 - protein, 32 aa, Artificial Sequence
  Description of Artificial Sequence: Synthetic polypeptide
DEEEIRTTNPCAYEEWGSVAMGLNDHGGRGNA

SEQ ID NO: 136570 - protein, 37 aa, Artificial Sequence
  Description of Artificial Sequence: Synthetic polypeptide
AEEEIRTTNPVATEQYGSVSTTANNNQEQGNNNNNQD

SEQ ID NO: 136571 - protein, 33 aa, Artificial Sequence
  Description of Artificial Sequence: Synthetic polypeptide
DEEEIRTTNPCAYEEWGSVAMTNDHGGRGNNGA

SEQ ID NO: 136572 - protein, 33 aa, Artificial Sequence
  Description of Artificial Sequence: Synthetic polypeptide
DEEEIRTTNPCAYEEWGSVATENDHDDGRGNAD

SEQ ID NO: 136573 - protein, 32 aa, Artificial Sequence
  Description of Artificial Sequence: Synthetic polypeptide
DEEEIRTTNPCAYEEYGHVAYINEHSGRGGNG

SEQ ID NO: 136574 - protein, 34 aa, Artificial Sequence
  Description of Artificial Sequence: Synthetic polypeptide
DEEEIRTTNPCAYEEYGSVQAYTNEHSGRGGNTA

SEQ ID NO: 136575 - protein, 29 aa, Artificial Sequence
  Description of Artificial Sequence: Synthetic peptide
DDSEIASTNPVSTEGYGNVAANNIQSGTR

SEQ ID NO: 136576 - protein, 36 aa, Artificial Sequence
  Description of Artificial Sequence: Synthetic polypeptide
DEEEIRTTNPVATEQYGCVSTMTDGGQGEQEGGENE

SEQ ID NO: 136577 - protein, 31 aa, Artificial Sequence
  Description of Artificial Sequence: Synthetic polypeptide
DDSEIASTNPVSTEGYGNVAANTIQDRVGNR

SEQ ID NO: 136578 - protein, 36 aa, Artificial Sequence
  Description of Artificial Sequence: Synthetic polypeptide
AEEEIRTTNPVATEQYGSVSTTDQLQGNIATNVATE

SEQ ID NO: 136579 - protein, 36 aa, Artificial Sequence
  Description of Artificial Sequence: Synthetic polypeptide
AEEEIRTTNPVATEQYGSVSTSTNGTNDESGTNVDG

SEQ ID NO: 136580 - protein, 36 aa, Artificial Sequence
  Description of Artificial Sequence: Synthetic polypeptide
AEEEIRTTNPVATEQYGSVSTTLQLNDEEEIGTTTD

SEQ ID NO: 136581 - protein, 36 aa, Artificial Sequence
  Description of Artificial Sequence: Synthetic polypeptide
AEEEIRTTNPVATEQYGSVSTTLQLNDNLEIGTTDV

SEQ ID NO: 136582 - protein, 37 aa, Artificial Sequence
  Description of Artificial Sequence: Synthetic polypeptide
DEEEIRTTNPVATEQYGCVTSTTPADNAERFGSNNVM

SEQ ID NO: 136583 - protein, 37 aa, Artificial Sequence
  Description of Artificial Sequence: Synthetic polypeptide
AEEEIRTTNPVATEQYGSVSTTNGQGQNNNIGTNQMN

SEQ ID NO: 136584 - protein, 37 aa, Artificial Sequence
  Description of Artificial Sequence: Synthetic polypeptide
AEEEIRTTNPVATEQYGSVSTTNGQGQNGNIGTEGGD

SEQ ID NO: 136585 - protein, 37 aa, Artificial Sequence
  Description of Artificial Sequence: Synthetic polypeptide
AEEEIRTTNPVATEQYGSVSTTNGQDQNNNIGTNTME

SEQ ID NO: 136586 - protein, 36 aa, Artificial Sequence
  Description of Artificial Sequence: Synthetic polypeptide
DEEEIRTTNPCATEQYGSVIEPTNPHQQITGVNFPP

SEQ ID NO: 136587 - protein, 33 aa, Artificial Sequence
  Description of Artificial Sequence: Synthetic polypeptide
SEEEIRTTNPVATEQYGSVAPSALQQEHQFDQF

SEQ ID NO: 136588 - protein, 36 aa, Artificial Sequence
  Description of Artificial Sequence: Synthetic polypeptide
DEEEIRTTNPCATEQYGSVIEPTNQHSQITGVNPEF

SEQ ID NO: 136589 - protein, 37 aa, Artificial Sequence
  Description of Artificial Sequence: Synthetic polypeptide
AEEEIRTTNPVATEQYGSVSTTNGQAGNNNQGTNQTM

SEQ ID NO: 136590 - protein, 37 aa, Artificial Sequence
  Description of Artificial Sequence: Synthetic polypeptide
AEEEIRTTNPVATEQYGSVSTTNGQAGNNNIGTNQMG

SEQ ID NO: 136591 - protein, 37 aa, Artificial Sequence
  Description of Artificial Sequence: Synthetic polypeptide
DEEEIRTTNPVATEQYGCVTSTTPADNIERFGSNPVN

SEQ ID NO: 136592 - protein, 35 aa, Artificial Sequence
  Description of Artificial Sequence: Synthetic polypeptide
DEEEIRTTNPCATEQYGSVIEPTPNHQITGVQPAF

SEQ ID NO: 136593 - protein, 37 aa, Artificial Sequence
  Description of Artificial Sequence: Synthetic polypeptide
AEEEIRTTNPVATEQYGSVSTTNGNQQNGNIGTNDMN

SEQ ID NO: 136594 - protein, 35 aa, Artificial Sequence
  Description of Artificial Sequence: Synthetic polypeptide
DEEEIRTTNPVATEQYGCVSYCGSSTARNGGNNSI

SEQ ID NO: 136595 - protein, 34 aa, Artificial Sequence
  Description of Artificial Sequence: Synthetic polypeptide
DEEEIRTTNPVATEQYGCVSWYPPEQLQSMEDFY

SEQ ID NO: 136596 - protein, 36 aa, Artificial Sequence
  Description of Artificial Sequence: Synthetic polypeptide
AEEEIRTTNPVATEQYGSVSTTNGNQNQQQGEIATE

SEQ ID NO: 136597 - protein, 33 aa, Artificial Sequence
  Description of Artificial Sequence: Synthetic polypeptide
DEEEISTTNPVAYEQWGSVCSNWEHQEQDNHRG

SEQ ID NO: 136598 - protein, 34 aa, Artificial Sequence
  Description of Artificial Sequence: Synthetic polypeptide
DEEEIRTTNPCATEQYGSVNQEDGQQEGQGNENG

SEQ ID NO: 136599 - protein, 34 aa, Artificial Sequence
  Description of Artificial Sequence: Synthetic polypeptide
DEEEIRTTNPCATEQYGSVPEADLQANTGPVGVN

SEQ ID NO: 136600 - protein, 36 aa, Artificial Sequence
  Description of Artificial Sequence: Synthetic polypeptide
AEEEIRTTNPVATEQYGSVSTTNGNNNNNQNDENGS

SEQ ID NO: 136601 - protein, 34 aa, Artificial Sequence
  Description of Artificial Sequence: Synthetic polypeptide
DEEEIRTTNPCATEQYGSVPEALQANEDWPVGVN

SEQ ID NO: 136602 - protein, 35 aa, Artificial Sequence
  Description of Artificial Sequence: Synthetic polypeptide
DEEEIRTTNPVATEQYGCVSYTGPSTAHNGGNNDI

SEQ ID NO: 136603 - protein, 32 aa, Artificial Sequence
  Description of Artificial Sequence: Synthetic polypeptide
SEEEIRTTNPVATEQYGSSAPAHLQEHQFDQT

SEQ ID NO: 136604 - protein, 36 aa, Artificial Sequence
  Description of Artificial Sequence: Synthetic polypeptide
AEEEIRTTNPVATEQYGSVSTTNGQQQNATEEGTDE

SEQ ID NO: 136605 - protein, 37 aa, Artificial Sequence
  Description of Artificial Sequence: Synthetic polypeptide
AEEEIRTTNPVATEQYGSVSTTNGQQQNGNIGTNDGD

SEQ ID NO: 136606 - protein, 34 aa, Artificial Sequence
  Description of Artificial Sequence: Synthetic polypeptide
DEEEIRTTNPVATEQYGCYCSWPNPLQNFDSDQS

SEQ ID NO: 136607 - protein, 33 aa, Artificial Sequence
  Description of Artificial Sequence: Synthetic polypeptide
SEEEIRTTNPVATEQYGCVSPDTLPESMEETRL

SEQ ID NO: 136608 - protein, 35 aa, Artificial Sequence
  Description of Artificial Sequence: Synthetic polypeptide
DEEEIRTTNPVATEQYGCWCSWPNDLQNFDSNNQS

SEQ ID NO: 136609 - protein, 33 aa, Artificial Sequence
  Description of Artificial Sequence: Synthetic polypeptide
DEEEIRTTNPVATEQYGCVYAYVNQEFFEGSQQ

SEQ ID NO: 136610 - protein, 36 aa, Artificial Sequence
  Description of Artificial Sequence: Synthetic polypeptide
DEEEIRTTNPVATEQYGCVVSYTGQSTARNGGNNSI

SEQ ID NO: 136611 - protein, 35 aa, Artificial Sequence
  Description of Artificial Sequence: Synthetic polypeptide
DEEEIRTTNPCATEQYGSVIEPHPNHQITGVNPAY

SEQ ID NO: 136612 - protein, 34 aa, Artificial Sequence
  Description of Artificial Sequence: Synthetic polypeptide
SEEEIRTTNPVATEQYGCVSVCNLVTENQFEVIN

SEQ ID NO: 136613 - protein, 33 aa, Artificial Sequence
  Description of Artificial Sequence: Synthetic polypeptide
SEEEIRTTNPVATEQYGCVWWTDDMNNGFENNM

SEQ ID NO: 136614 - protein, 32 aa, Artificial Sequence
  Description of Artificial Sequence: Synthetic polypeptide
SEEEIRTTNPVATEQYGCYSASVDEILNEESI

SEQ ID NO: 136615 - protein, 33 aa, Artificial Sequence
  Description of Artificial Sequence: Synthetic polypeptide
SEEEIRTTNPVATEQYGCYSESVDEENLNEKSI

SEQ ID NO: 136616 - protein, 33 aa, Artificial Sequence
  Description of Artificial Sequence: Synthetic polypeptide
SEEEIRTTNPVATEQYGCYSTSVDVENLNEESI

SEQ ID NO: 136617 - protein, 36 aa, Artificial Sequence
  Description of Artificial Sequence: Synthetic polypeptide
SEEEIRTTNPVATEQYGKVISTGSLSDYSPGGNNRF

SEQ ID NO: 136618 - protein, 34 aa, Artificial Sequence
  Description of Artificial Sequence: Synthetic polypeptide
SEEEIRTTNPVATEQYGQCVCGTEALQNFGSDQA

SEQ ID NO: 136619 - protein, 37 aa, Artificial Sequence
  Description of Artificial Sequence: Synthetic polypeptide
DEEEIRTTNPVATEQYGCVTSTWGADNIERFGSNPVS

SEQ ID NO: 136620 - protein, 37 aa, Artificial Sequence
  Description of Artificial Sequence: Synthetic polypeptide
AEEEIRTTNPVATEQYGSVSTTNGTDQNGNIGTNQEQ

SEQ ID NO: 136621 - protein, 37 aa, Artificial Sequence
  Description of Artificial Sequence: Synthetic polypeptide
AEEEIRTTNPVATEQYGSVSTTNGTDQNGNIGTNPGE

SEQ ID NO: 136622 - protein, 35 aa, Artificial Sequence
  Description of Artificial Sequence: Synthetic polypeptide
SEEEIRTTNPVATEQYGSCGSTVGDLGQGGGQEGI

SEQ ID NO: 136623 - protein, 36 aa, Artificial Sequence
  Description of Artificial Sequence: Synthetic polypeptide
DEEEIRTTNPVATEQYGCVTSTTPADPTERFGSNPV

SEQ ID NO: 136624 - protein, 33 aa, Artificial Sequence
  Description of Artificial Sequence: Synthetic polypeptide
SEEEIRTTNPVATEQYGSFSCNEHDERPEDSQQ

SEQ ID NO: 136625 - protein, 34 aa, Artificial Sequence
  Description of Artificial Sequence: Synthetic polypeptide
DEEEISTTNPVAYEQYGCVCSNTNHQNFGSETQA

SEQ ID NO: 136626 - protein, 36 aa, Artificial Sequence
  Description of Artificial Sequence: Synthetic polypeptide
DEEEIRTTNPVATEQYGCVTSTTPADNNERFISNPV

SEQ ID NO: 136627 - protein, 34 aa, Artificial Sequence
  Description of Artificial Sequence: Synthetic polypeptide
DEEEISTTNPVAYEPYRGQSVAQNELSQGPGISR

SEQ ID NO: 136628 - protein, 36 aa, Artificial Sequence
  Description of Artificial Sequence: Synthetic polypeptide
AEEEIRTTNPVATEQYGSVSTTLQLNDNEEIGTTTV

SEQ ID NO: 136629 - protein, 35 aa, Artificial Sequence
  Description of Artificial Sequence: Synthetic polypeptide
DEEEIRTTNPCATEQYGSVPEIANLQADTEPVGQN

SEQ ID NO: 136630 - protein, 34 aa, Artificial Sequence
  Description of Artificial Sequence: Synthetic polypeptide
DEEEIRTTNPCATEQYGSVPEIGLQATTPPVGQN

SEQ ID NO: 136631 - protein, 35 aa, Artificial Sequence
  Description of Artificial Sequence: Synthetic polypeptide
DEEEIRTTNPCATEQYGVVATVTNLNLQAGTEEED

SEQ ID NO: 136632 - protein, 36 aa, Artificial Sequence
  Description of Artificial Sequence: Synthetic polypeptide
DEEEIRTTNPCATEQYGVVATVVNQTNLQQGTEEND

SEQ ID NO: 136633 - protein, 37 aa, Artificial Sequence
  Description of Artificial Sequence: Synthetic polypeptide
DEEEIRTTNPCATEQYGVVSTVGNLQAGTEQGTNQDD

SEQ ID NO: 136634 - protein, 37 aa, Artificial Sequence
  Description of Artificial Sequence: Synthetic polypeptide
AEEEIRTTNPVATEQYGSVSTTNANTEQGTTEAGNEE

SEQ ID NO: 136635 - protein, 35 aa, Artificial Sequence
  Description of Artificial Sequence: Synthetic polypeptide
SEEEIRTTNPVATEQYGSVNNTTEGDDEGMFENRN

SEQ ID NO: 136636 - protein, 35 aa, Artificial Sequence
  Description of Artificial Sequence: Synthetic polypeptide
SEEEIRTTNPVATEQYGSVNSDMDLIQQNNQGEFD

SEQ ID NO: 136637 - protein, 37 aa, Artificial Sequence
  Description of Artificial Sequence: Synthetic polypeptide
AEEEIRTTNPVATEQYGSVSTTNANLQAGTEAGEEEG

SEQ ID NO: 136638 - protein, 37 aa, Artificial Sequence
  Description of Artificial Sequence: Synthetic polypeptide
AEEEIRTTNPVATEQYGSVSTTLTQQQQIGTTTNVED

SEQ ID NO: 136639 - protein, 36 aa, Artificial Sequence
  Description of Artificial Sequence: Synthetic polypeptide
AEEEIRTTNPVATEQYGSVSTTLSELGNTEAGNTEG

SEQ ID NO: 136640 - protein, 35 aa, Artificial Sequence
  Description of Artificial Sequence: Synthetic polypeptide
DEEEIRTTNPCATEQYGVVATVNQNNLQAGTQEED

SEQ ID NO: 136641 - protein, 37 aa, Artificial Sequence
  Description of Artificial Sequence: Synthetic polypeptide
AEEEIRTTNPVATEQYGSVSTTLQQLQQGTETGTNTA

SEQ ID NO: 136642 - protein, 37 aa, Artificial Sequence
  Description of Artificial Sequence: Synthetic polypeptide
DEEEIRTTNPCATEQYGVVSTVNLQAGTEQGGNNQDD

SEQ ID NO: 136643 - protein, 35 aa, Artificial Sequence
  Description of Artificial Sequence: Synthetic polypeptide
SEEEIRTTNPVATEQYGSVSAMGDLDNLINQGEGD

SEQ ID NO: 136644 - protein, 35 aa, Artificial Sequence
  Description of Artificial Sequence: Synthetic polypeptide
SEEEIRTTNPVATEQYGSVSAMGDLDQPNNQGEGE

SEQ ID NO: 136645 - protein, 36 aa, Artificial Sequence
  Description of Artificial Sequence: Synthetic polypeptide
AEEEIRTTNPVATEQYGSVSTTLQLNQNEEIGTTDE

SEQ ID NO: 136646 - protein, 36 aa, Artificial Sequence
  Description of Artificial Sequence: Synthetic polypeptide
AEEEIRTTNPVATEQYGSVSTTLQLNNNEEIGTTVD

SEQ ID NO: 136647 - protein, 36 aa, Artificial Sequence
  Description of Artificial Sequence: Synthetic polypeptide
AEEEIRTTNPVATEQYGSVSTTLQLNNNEEIGTTDG

SEQ ID NO: 136648 - protein, 36 aa, Artificial Sequence
  Description of Artificial Sequence: Synthetic polypeptide
DEEEIRTTNPCATEQYGVVSTVNNQAGTEQGNNQTD

SEQ ID NO: 136649 - protein, 37 aa, Artificial Sequence
  Description of Artificial Sequence: Synthetic polypeptide
AEEEIRTTNPVATEQYGSVSTTLQLNGNEEIGTTTDD

SEQ ID NO: 136650 - protein, 36 aa, Artificial Sequence
  Description of Artificial Sequence: Synthetic polypeptide
DEEEIRTTNPCATEQYGVVSTVNNQIGTEQGNNQDQ

SEQ ID NO: 136651 - protein, 36 aa, Artificial Sequence
  Description of Artificial Sequence: Synthetic polypeptide
DEEEIRTTNPCATEQYGVVSTVNLQAGTEQGETDDD

SEQ ID NO: 136652 - protein, 36 aa, Artificial Sequence
  Description of Artificial Sequence: Synthetic polypeptide
SEEEIRTTNPVATEQYGSVISLTGSLSGSPGGNNDF

SEQ ID NO: 136653 - protein, 35 aa, Artificial Sequence
  Description of Artificial Sequence: Synthetic polypeptide
DEEEIRTTNPCATEQYGVVATVNGTNLQAGTEEED

SEQ ID NO: 136654 - protein, 35 aa, Artificial Sequence
  Description of Artificial Sequence: Synthetic polypeptide
SEEEIRTTNPVATEQYGSVIDQQSNEGQGGGENDG

SEQ ID NO: 136655 - protein, 36 aa, Artificial Sequence
  Description of Artificial Sequence: Synthetic polypeptide
AEEEIRTTNPVATEQYGSVSTTNGNGNQEQGEEQDE

SEQ ID NO: 136656 - protein, 37 aa, Artificial Sequence
  Description of Artificial Sequence: Synthetic polypeptide
AEEEIRTTNPVATEQYGSVSTTNGNDQNNNIGTNNTD

SEQ ID NO: 136657 - protein, 37 aa, Artificial Sequence
  Description of Artificial Sequence: Synthetic polypeptide
AEEEIRTTNPVATEQYGSVSTTNGNDQNGNIGTTTMN

SEQ ID NO: 136658 - protein, 34 aa, Artificial Sequence
  Description of Artificial Sequence: Synthetic polypeptide
DEEEIRTTNPCATEQYGSVPELALQETTGPVGQY

SEQ ID NO: 136659 - protein, 37 aa, Artificial Sequence
  Description of Artificial Sequence: Synthetic polypeptide
AEEEIRTTNPVATEQYGSVSTTNGNDQNGNIGTNEEN

SEQ ID NO: 136660 - protein, 37 aa, Artificial Sequence
  Description of Artificial Sequence: Synthetic polypeptide
AEEEIRTTNPVATEQYGSVSTTNGNDQNGNIGTEEGD

SEQ ID NO: 136661 - protein, 36 aa, Artificial Sequence
  Description of Artificial Sequence: Synthetic polypeptide
AEEEIRTTNPVATEQYGSVSTTNGNDENNNIGTNEM

SEQ ID NO: 136662 - protein, 36 aa, Artificial Sequence
  Description of Artificial Sequence: Synthetic polypeptide
AEEEIRTTNPVATEQYGSVSTTNGNANNNIGTNQMN

SEQ ID NO: 136663 - protein, 34 aa, Artificial Sequence
  Description of Artificial Sequence: Synthetic polypeptide
DEEEIRTTNPCATEQYGSVPEMALQATTVGVPEE

SEQ ID NO: 136664 - protein, 34 aa, Artificial Sequence
  Description of Artificial Sequence: Synthetic polypeptide
DEEEIRTTNPCATEQYGSVPEMALQATVIVPGEL

SEQ ID NO: 136665 - protein, 36 aa, Artificial Sequence
  Description of Artificial Sequence: Synthetic polypeptide
SEEEIRTTNPVATEQYGSVCGSVTGDNGQGGEQEQF

SEQ ID NO: 136666 - protein, 35 aa, Artificial Sequence
  Description of Artificial Sequence: Synthetic polypeptide
DEEEIRTTNPVATEQYGCVSTVVNDIENDGTSIST

SEQ ID NO: 136667 - protein, 35 aa, Artificial Sequence
  Description of Artificial Sequence: Synthetic polypeptide
DEEEIRTTNPCATEQYGSVSPENGQQEPLIGEVVE

SEQ ID NO: 136668 - protein, 36 aa, Artificial Sequence
  Description of Artificial Sequence: Synthetic polypeptide
AEEEIRTTNPVATEQYGSVSTTNGDQNNNIGTELGD

SEQ ID NO: 136669 - protein, 36 aa, Artificial Sequence
  Description of Artificial Sequence: Synthetic polypeptide
DEEEIRTTNPCATEQYGSVSSTTPAGPNMRNGMNPV

SEQ ID NO: 136670 - protein, 35 aa, Artificial Sequence
  Description of Artificial Sequence: Synthetic polypeptide
DEEEIRTTNPCATEQYGSVSSTTPAGPNRNGMTPV

SEQ ID NO: 136671 - protein, 37 aa, Artificial Sequence
  Description of Artificial Sequence: Synthetic polypeptide
DEEEIRTTNPCATEQYGSVSTVNQQAGTEQGNNNQDD

SEQ ID NO: 136672 - protein, 36 aa, Artificial Sequence
  Description of Artificial Sequence: Synthetic polypeptide
DEEEIRTTNPCATEQYGSVSVSTNQISTEQGTNDDN

SEQ ID NO: 136673 - protein, 37 aa, Artificial Sequence
  Description of Artificial Sequence: Synthetic polypeptide
AEEEIRTTNPVATEQYGSVSTTNDQAGNNNQGTNQME

SEQ ID NO: 136674 - protein, 35 aa, Artificial Sequence
  Description of Artificial Sequence: Synthetic polypeptide
DEEEIRTTNPCATEQYGSVSVYSNQISTEQGTNDG

SEQ ID NO: 136675 - protein, 35 aa, Artificial Sequence
  Description of Artificial Sequence: Synthetic polypeptide
DEEEIRTTNPCATEQYGSVSVYVNQAGTEQGNNDG

SEQ ID NO: 136676 - protein, 37 aa, Artificial Sequence
  Description of Artificial Sequence: Synthetic polypeptide
AEEEIRTTNPVATEQYGSVSTTNGNLEQGTEEGTQED

SEQ ID NO: 136677 - protein, 34 aa, Artificial Sequence
  Description of Artificial Sequence: Synthetic polypeptide
DEEEISTTNPVATEQYGQCVCSTEDNQFFGSDQP

SEQ ID NO: 136678 - protein, 33 aa, Artificial Sequence
  Description of Artificial Sequence: Synthetic polypeptide
DEEEIRTTNPCAYEQWGSVYCTDNDQHREDDVA

SEQ ID NO: 136679 - protein, 30 aa, Artificial Sequence
  Description of Artificial Sequence: Synthetic polypeptide
DDSEIASTNPVSTEGYGVVSANTIQSSGNQ

SEQ ID NO: 136680 - protein, 35 aa, Artificial Sequence
  Description of Artificial Sequence: Synthetic polypeptide
DEEEIRTTNPIATFQYGSVSSTPAGPNMRNGMNPV

SEQ ID NO: 136681 - protein, 38 aa, Artificial Sequence
  Description of Artificial Sequence: Synthetic polypeptide
AEEEIRTTNPVATEQYGSVSTNTANLQNGNEQGNNAEE

SEQ ID NO: 136682 - protein, 36 aa, Artificial Sequence
  Description of Artificial Sequence: Synthetic polypeptide
AEEEIRTTNPVATEQYGSVSTNQNNQNQGEQGTEAG

SEQ ID NO: 136683 - protein, 34 aa, Artificial Sequence
  Description of Artificial Sequence: Synthetic polypeptide
DEEEIRTTNPLATEHYGSVVSEGVMSSQHGGSPR

SEQ ID NO: 136684 - protein, 36 aa, Artificial Sequence
  Description of Artificial Sequence: Synthetic polypeptide
AEEEIRTTNPVATEQYGSVSTNQNNQNNQEIGTEAL

SEQ ID NO: 136685 - protein, 35 aa, Artificial Sequence
  Description of Artificial Sequence: Synthetic polypeptide
DEEEIRTTNPVATEQYGCVCSWNEHNQENFNSDQA

SEQ ID NO: 136686 - protein, 38 aa, Artificial Sequence
  Description of Artificial Sequence: Synthetic polypeptide
AEEEIRTTNPVATEQYGSVSTNQGNLQNNNEQGNNNVE

SEQ ID NO: 136687 - protein, 36 aa, Artificial Sequence
  Description of Artificial Sequence: Synthetic polypeptide
AEEEIRTTNPVATEQYGSVSTNPNNENNETGTNSTE

SEQ ID NO: 136688 - protein, 36 aa, Artificial Sequence
  Description of Artificial Sequence: Synthetic polypeptide
AEEEIRTTNPVATEQYGSVSTNPNDENSETGTNVTT

SEQ ID NO: 136689 - protein, 38 aa, Artificial Sequence
  Description of Artificial Sequence: Synthetic polypeptide
AEEEIRTTNPVATEQYGSVSTNTANLQQGNSEQGNNVE

SEQ ID NO: 136690 - protein, 35 aa, Artificial Sequence
  Description of Artificial Sequence: Synthetic polypeptide
DEEEIRTTNPVATEQYGCVCSWGNHQENFNSQFQS

SEQ ID NO: 136691 - protein, 35 aa, Artificial Sequence
  Description of Artificial Sequence: Synthetic polypeptide
SEEEIRTTNPVAWEQYGSVSTNKHSSETPMGSDRN

SEQ ID NO: 136692 - protein, 34 aa, Artificial Sequence
  Description of Artificial Sequence: Synthetic polypeptide
DEEEISTTNPVATEQYGQCVCSWELQNSNSDNQS

SEQ ID NO: 136693 - protein, 34 aa, Artificial Sequence
  Description of Artificial Sequence: Synthetic polypeptide
DEEEISTTNPVATEQYGQCVCSWELQESFGSEQI

SEQ ID NO: 136694 - protein, 34 aa, Artificial Sequence
  Description of Artificial Sequence: Synthetic polypeptide
DEEEIRTTNPVATEQYGCVCSWGEPQNFNSDTQS

SEQ ID NO: 136695 - protein, 34 aa, Artificial Sequence
  Description of Artificial Sequence: Synthetic polypeptide
DEEEIRTTNPVATEQYGCVCSWGEPQNFGSEFQP

SEQ ID NO: 136696 - protein, 34 aa, Artificial Sequence
  Description of Artificial Sequence: Synthetic polypeptide
DEEEIRTTNPVATEQYGCVCSWGEPQESFNSDQS

SEQ ID NO: 136697 - protein, 33 aa, Artificial Sequence
  Description of Artificial Sequence: Synthetic polypeptide
SEEEIRTTNPVAYEQWGHVYWIDQNAQRGMGHR

SEQ ID NO: 136698 - protein, 35 aa, Artificial Sequence
  Description of Artificial Sequence: Synthetic polypeptide
SEEEIRTTNPVAYEQWGQVSSCTNMQSADGPLNRA

SEQ ID NO: 136699 - protein, 34 aa, Artificial Sequence
  Description of Artificial Sequence: Synthetic polypeptide
SEEEIRTTNPVAYEQWGQVSSCTNMQSADGPNQK

SEQ ID NO: 136700 - protein, 32 aa, Artificial Sequence
  Description of Artificial Sequence: Synthetic polypeptide
SEEEIRTTNPVAWDSYGSCSNHNLHRGSDQFD

SEQ ID NO: 136701 - protein, 34 aa, Artificial Sequence
  Description of Artificial Sequence: Synthetic polypeptide
DEEEIRTTNPVATEQYGCVCVNTEHQENFGSEQA

SEQ ID NO: 136702 - protein, 35 aa, Artificial Sequence
  Description of Artificial Sequence: Synthetic polypeptide
DEEEIRTTNPVATEQYGCVCVNTGELIERFGSDQS

SEQ ID NO: 136703 - protein, 36 aa, Artificial Sequence
  Description of Artificial Sequence: Synthetic polypeptide
DEEEIRTTNPIATEQYGSVSSTTPAGPNMRNGMNPV

SEQ ID NO: 136704 - protein, 34 aa, Artificial Sequence
  Description of Artificial Sequence: Synthetic polypeptide
SEEEIRTTNPVATESWGSVFSNENDHERGQDQRP

SEQ ID NO: 136705 - protein, 34 aa, Artificial Sequence
  Description of Artificial Sequence: Synthetic polypeptide
SEEEIRTTNPVATESWGSVFSNMNDHERSGGDHR

SEQ ID NO: 136706 - protein, 34 aa, Artificial Sequence
  Description of Artificial Sequence: Synthetic polypeptide
SEEEIRTTNPVATESWGSVFSNPNDHHERSGDQR

SEQ ID NO: 136707 - protein, 34 aa, Artificial Sequence
  Description of Artificial Sequence: Synthetic polypeptide
SEEEIRTTNPVATESWGSVFSNVNDMHERNGDQR

SEQ ID NO: 136708 - protein, 34 aa, Artificial Sequence
  Description of Artificial Sequence: Synthetic polypeptide
SEEEIRTTNPVATESYGSVSIMGDLGQQNQGEGT

SEQ ID NO: 136709 - protein, 34 aa, Artificial Sequence
  Description of Artificial Sequence: Synthetic polypeptide
DEEEIRTTNPIATEQWGAVSANTPAGNMRNGPPV

SEQ ID NO: 136710 - protein, 36 aa, Artificial Sequence
  Description of Artificial Sequence: Synthetic polypeptide
AEEEIRTTNPVATEQYGSVSTQNNQANNEQGTTTDI

SEQ ID NO: 136711 - protein, 36 aa, Artificial Sequence
  Description of Artificial Sequence: Synthetic polypeptide
DEEEIRTTNPVATEQYGCVMSTTPAGPNMRNGMNPV

SEQ ID NO: 136712 - protein, 34 aa, Artificial Sequence
  Description of Artificial Sequence: Synthetic polypeptide
DEEEIRTTNPVATEQYGCVIWTNEQEQIETQIEN

SEQ ID NO: 136713 - protein, 35 aa, Artificial Sequence
  Description of Artificial Sequence: Synthetic polypeptide
DEEEIRTTNPVATEQYGCVHYTGPSTARNGGNNSI

SEQ ID NO: 136714 - protein, 35 aa, Artificial Sequence
  Description of Artificial Sequence: Synthetic polypeptide
DEEEIRTTNPIATEQYGAVSATAPAWAERNGMNYI

SEQ ID NO: 136715 - protein, 37 aa, Artificial Sequence
  Description of Artificial Sequence: Synthetic polypeptide
AEEEIRTTNPVATEQYGSVSTNTNQQGNNQQGTNQNQ

SEQ ID NO: 136716 - protein, 37 aa, Artificial Sequence
  Description of Artificial Sequence: Synthetic polypeptide
AEEEIRTTNPVATEQYGSVSTNTNQQGNNQQGNNQEA

SEQ ID NO: 136717 - protein, 34 aa, Artificial Sequence
  Description of Artificial Sequence: Synthetic polypeptide
DEEEIRTTNPIATEQYGAVSATTPAGNMRNGPPV

SEQ ID NO: 136718 - protein, 30 aa, Artificial Sequence
  Description of Artificial Sequence: Synthetic polypeptide
DEEEIRTTNPIATEQYGEAANAEDWQHEPK

SEQ ID NO: 136719 - protein, 37 aa, Artificial Sequence
  Description of Artificial Sequence: Synthetic polypeptide
AEEEIRTTNPVATEQYGSVSTNTNQENQGEQGTNVTE

SEQ ID NO: 136720 - protein, 30 aa, Artificial Sequence
  Description of Artificial Sequence: Synthetic polypeptide
DEEEIRTTNPIATEQYGEAANEEDWQHEPK

SEQ ID NO: 136721 - protein, 37 aa, Artificial Sequence
  Description of Artificial Sequence: Synthetic polypeptide
AEEEIRTTNPVATEQYGSVSTNTNQAGNTEQGTNANE

SEQ ID NO: 136722 - protein, 37 aa, Artificial Sequence
  Description of Artificial Sequence: Synthetic polypeptide
AEEEIRTTNPVATEQYGSVSTNTNNQNSTETGNNNTD

SEQ ID NO: 136723 - protein, 36 aa, Artificial Sequence
  Description of Artificial Sequence: Synthetic polypeptide
DEEEIRTTNPVATEQYGCVDTPTNGDETTQSGQDNQ

SEQ ID NO: 136724 - protein, 36 aa, Artificial Sequence
  Description of Artificial Sequence: Synthetic polypeptide
DEEEIRTTNPIATEQYGSVSATTPAGPNMRNGMNPV

SEQ ID NO: 136725 - protein, 35 aa, Artificial Sequence
  Description of Artificial Sequence: Synthetic polypeptide
SEEEIRTTNPVAYEQWGQVVSCCTNMQSADYGNRT

SEQ ID NO: 136726 - protein, 34 aa, Artificial Sequence
  Description of Artificial Sequence: Synthetic polypeptide
SEEEIRTTNPVATESWGSVFSNDLNDHERNGDQR

SEQ ID NO: 136727 - protein, 31 aa, Artificial Sequence
  Description of Artificial Sequence: Synthetic polypeptide
SEEEIRTTNPVAYEQWGSVAWIEELQVMDST

SEQ ID NO: 136728 - protein, 33 aa, Artificial Sequence
  Description of Artificial Sequence: Synthetic polypeptide
SEEEIRTTNPVAYEQWGSVAYWVDDKQRGMNQQ

SEQ ID NO: 136729 - protein, 32 aa, Artificial Sequence
  Description of Artificial Sequence: Synthetic polypeptide
SEEEIRTTNPVSTEGYGSCFNTNVHIGSDQRD

SEQ ID NO: 136730 - protein, 34 aa, Artificial Sequence
  Description of Artificial Sequence: Synthetic polypeptide
DEEEIRTTNPVATEQYGCVCSWGEHNQNFNSDQS

SEQ ID NO: 136731 - protein, 34 aa, Artificial Sequence
  Description of Artificial Sequence: Synthetic polypeptide
DEEEIRTTNPVATEQYGCVCSWGEHNQNFNSDQQ

SEQ ID NO: 136732 - protein, 35 aa, Artificial Sequence
  Description of Artificial Sequence: Synthetic polypeptide
DEEEIRTTNPVATEQYGCVCSWGEHNQNFGSNNQS

SEQ ID NO: 136733 - protein, 35 aa, Artificial Sequence
  Description of Artificial Sequence: Synthetic polypeptide
DEEEISTTNPVATEQYGQCVCSTGALQENFNSDQS

SEQ ID NO: 136734 - protein, 34 aa, Artificial Sequence
  Description of Artificial Sequence: Synthetic polypeptide
DEEEISTTNPVATEQYGQCVCSTETQHFNSENVS

SEQ ID NO: 136735 - protein, 34 aa, Artificial Sequence
  Description of Artificial Sequence: Synthetic polypeptide
DEEEISTTNPVATEQYGQCVCSTETQEAFNSDQN

SEQ ID NO: 136736 - protein, 36 aa, Artificial Sequence
  Description of Artificial Sequence: Synthetic polypeptide
DEEEISTTNPVATEQYGQCVCSTENNQENFGSENQA

SEQ ID NO: 136737 - protein, 34 aa, Artificial Sequence
  Description of Artificial Sequence: Synthetic polypeptide
DEEEIRTTNPVATEQYGCVCSWGEHNQGFNSEQS

SEQ ID NO: 136738 - protein, 32 aa, Artificial Sequence
  Description of Artificial Sequence: Synthetic polypeptide
SEEEIRTTNPVSTEGYGSCFNTALHDGSDQRD

SEQ ID NO: 136739 - protein, 36 aa, Artificial Sequence
  Description of Artificial Sequence: Synthetic polypeptide
AEEEIRTTNPVATEQYGSVSTNNNQQNQEQGTEGAD

SEQ ID NO: 136740 - protein, 33 aa, Artificial Sequence
  Description of Artificial Sequence: Synthetic polypeptide
DEEEISTTNPVATEQYGQCVCSTEHQNISEFQF

SEQ ID NO: 136741 - protein, 34 aa, Artificial Sequence
  Description of Artificial Sequence: Synthetic polypeptide
DEEEIRTTNPVATEQYGCVCSWGEHNQFFGSDQS

SEQ ID NO: 136742 - protein, 36 aa, Artificial Sequence
  Description of Artificial Sequence: Synthetic polypeptide
AEEEIRTTNPVATEQYGSVSTNNNQQNNTEQGTEAL

SEQ ID NO: 136743 - protein, 37 aa, Artificial Sequence
  Description of Artificial Sequence: Synthetic polypeptide
AEEEIRTTNPVATEQYGSVSTNNNQQGNTQQGTDTNN

SEQ ID NO: 136744 - protein, 34 aa, Artificial Sequence
  Description of Artificial Sequence: Synthetic polypeptide
DEEEISTTNPVATEQYGQCVCSTEHEQNFGSQTQ

SEQ ID NO: 136745 - protein, 33 aa, Artificial Sequence
  Description of Artificial Sequence: Synthetic polypeptide
SEEEISTTNPVATEQYGCVTSVTEHQGFGSDQS

SEQ ID NO: 136746 - protein, 37 aa, Artificial Sequence
  Description of Artificial Sequence: Synthetic polypeptide
AEEEIRTTNPVATEQYGSVSTNNNQQGNNQQGNNNND

SEQ ID NO: 136747 - protein, 34 aa, Artificial Sequence
  Description of Artificial Sequence: Synthetic polypeptide
DEEEISTTNPVATEQYGQCVCSTEETQNFGSQTQ

SEQ ID NO: 136748 - protein, 35 aa, Artificial Sequence
  Description of Artificial Sequence: Synthetic polypeptide
DEEEISTTNPVATEQYGQCVCSTEEHNQRFNSDQD

SEQ ID NO: 136749 - protein, 35 aa, Artificial Sequence
  Description of Artificial Sequence: Synthetic polypeptide
DEEEISTTNPVATEQYGQCVCSTELNQNFGSDTQS

SEQ ID NO: 136750 - protein, 34 aa, Artificial Sequence
  Description of Artificial Sequence: Synthetic polypeptide
SEEEIRTTNPVSTEGYGSACFNTVNLHRGSDQRD

SEQ ID NO: 136751 - protein, 35 aa, Artificial Sequence
  Description of Artificial Sequence: Synthetic polypeptide
SEEEIRTTNPVGTEQWGSVVSTANELGERGDQTAE

SEQ ID NO: 136752 - protein, 35 aa, Artificial Sequence
  Description of Artificial Sequence: Synthetic polypeptide
DEEEIRTTNPVATEQYGCVCSWGEHNQSFGSENQS

SEQ ID NO: 136753 - protein, 33 aa, Artificial Sequence
  Description of Artificial Sequence: Synthetic polypeptide
SEEEIRTTNPVAYEQWGSVAYWVDDKQRGPNHE

SEQ ID NO: 136754 - protein, 34 aa, Artificial Sequence
  Description of Artificial Sequence: Synthetic polypeptide
DEEEIRTTNPVATEQYGCVCSWGELQENFISDQS

SEQ ID NO: 136755 - protein, 32 aa, Artificial Sequence
  Description of Artificial Sequence: Synthetic polypeptide
SEEEIRTTNPVAYEQWGVVYWIDGEQRGAGHR

SEQ ID NO: 136756 - protein, 34 aa, Artificial Sequence
  Description of Artificial Sequence: Synthetic polypeptide
SEEEIRTTNPVAYEQWGYTISAPNEGDQDRGNAR

SEQ ID NO: 136757 - protein, 33 aa, Artificial Sequence
  Description of Artificial Sequence: Synthetic polypeptide
SEEEIRTTNPVAYEQYGCVCGTGALQNFGSDQS

SEQ ID NO: 136758 - protein, 34 aa, Artificial Sequence
  Description of Artificial Sequence: Synthetic polypeptide
SEEEIRTTNPVAYEQYGQVVSAENDNLQRSQIPF

SEQ ID NO: 136759 - protein, 34 aa, Artificial Sequence
  Description of Artificial Sequence: Synthetic polypeptide
DEEEIRTTNPVATEQYGCVCSWGEHQNFPSNFQS

SEQ ID NO: 136760 - protein, 34 aa, Artificial Sequence
  Description of Artificial Sequence: Synthetic polypeptide
DEEEIRTTNPVATEQYGCVCSWGEHQNFISNNQG

SEQ ID NO: 136761 - protein, 34 aa, Artificial Sequence
  Description of Artificial Sequence: Synthetic polypeptide
DEEEISTTNPVATEQYGQCVCSTPLAENFNSEQS

SEQ ID NO: 136762 - protein, 34 aa, Artificial Sequence
  Description of Artificial Sequence: Synthetic polypeptide
DEEEISTTNPVATEQYGQCVCSTPHQEHFGSQQS

SEQ ID NO: 136763 - protein, 33 aa, Artificial Sequence
  Description of Artificial Sequence: Synthetic polypeptide
DEEEIRTTNPVATEQYGCVCSWGEHQHFFSDQT

SEQ ID NO: 136764 - protein, 35 aa, Artificial Sequence
  Description of Artificial Sequence: Synthetic polypeptide
SEEEIRTTNPVAYEQYGSVYACTNASSQNKGSPRV

SEQ ID NO: 136765 - protein, 34 aa, Artificial Sequence
  Description of Artificial Sequence: Synthetic polypeptide
DEEEIRTTNPVATEQYGCVCSWGEHQGFGSDTQS

SEQ ID NO: 136766 - protein, 34 aa, Artificial Sequence
  Description of Artificial Sequence: Synthetic polypeptide
SEEEIRTTNPVAYERWGQVSVCTNMQSGDGGNRN

SEQ ID NO: 136767 - protein, 34 aa, Artificial Sequence
  Description of Artificial Sequence: Synthetic polypeptide
DEEEIRTTNPVATEQYGCVCSWGEHQEYFGSDQA

SEQ ID NO: 136768 - protein, 34 aa, Artificial Sequence
  Description of Artificial Sequence: Synthetic polypeptide
DEEEIRTTNPVATEQYGCVCSWGEHQENFNSEQA

SEQ ID NO: 136769 - protein, 34 aa, Artificial Sequence
  Description of Artificial Sequence: Synthetic polypeptide
DEEEIRTTNPVATEQYGCVCSWGEHQENFNSDQS

SEQ ID NO: 136770 - protein, 35 aa, Artificial Sequence
  Description of Artificial Sequence: Synthetic polypeptide
DEEEISTTNPVATEQYGQCVCSTGELQNFNSQTQF

SEQ ID NO: 136771 - protein, 34 aa, Artificial Sequence
  Description of Artificial Sequence: Synthetic polypeptide
DEEEISTTNPVATEQYGQCVCSTGEHTNFGSNLS

SEQ ID NO: 136772 - protein, 35 aa, Artificial Sequence
  Description of Artificial Sequence: Synthetic polypeptide
DEEEIRTTNPVATEQYGCVCSWGEHQEGFNSDTQA

SEQ ID NO: 136773 - protein, 35 aa, Artificial Sequence
  Description of Artificial Sequence: Synthetic polypeptide
DEEEIRTTNPVATEQYGCVCSWGEHQEFFGSDNQS

SEQ ID NO: 136774 - protein, 34 aa, Artificial Sequence
  Description of Artificial Sequence: Synthetic polypeptide
SEEEIRTTNPVAYEQWGSVAYWLDVDKQRGDNHK

SEQ ID NO: 136775 - protein, 36 aa, Artificial Sequence
  Description of Artificial Sequence: Synthetic polypeptide
AEEEIRTTNPVATEQYGSVSTSSNQAGTESGTNTAN

SEQ ID NO: 136776 - protein, 35 aa, Artificial Sequence
  Description of Artificial Sequence: Synthetic polypeptide
SEEEIRTTNPVATESWGSVFHSENDQHERQGQDQR

SEQ ID NO: 136777 - protein, 32 aa, Artificial Sequence
  Description of Artificial Sequence: Synthetic polypeptide
SEEEIRTTNPVATEQYGSWAPALQVEHQEDQN

SEQ ID NO: 136778 - protein, 31 aa, Artificial Sequence
  Description of Artificial Sequence: Synthetic polypeptide
DDSEIATTNPVATEGYGNVSATDLEDHVGEL

SEQ ID NO: 136779 - protein, 36 aa, Artificial Sequence
  Description of Artificial Sequence: Synthetic polypeptide
DEEEIRTTNPDATEQYGSVSSTTPAEPNMRNGMNPV

SEQ ID NO: 136780 - protein, 36 aa, Artificial Sequence
  Description of Artificial Sequence: Synthetic polypeptide
DEEEIRTTNPDATEQYGSVSSTTPAGPNMRNGMNPV

SEQ ID NO: 136781 - protein, 35 aa, Artificial Sequence
  Description of Artificial Sequence: Synthetic polypeptide
DEEEIRTTNPVAYEQWGCSYNSINDHDQRGHSDRH

SEQ ID NO: 136782 - protein, 32 aa, Artificial Sequence
  Description of Artificial Sequence: Synthetic polypeptide
DDSEIATTNPVATEQYGNVSATDLEDHEGEDL

SEQ ID NO: 136783 - protein, 32 aa, Artificial Sequence
  Description of Artificial Sequence: Synthetic polypeptide
DDSEIATTNPVATEQYGSVAANTLEDHEGQDL

SEQ ID NO: 136784 - protein, 32 aa, Artificial Sequence
  Description of Artificial Sequence: Synthetic polypeptide
DDSEIATTNPVATEQYGSVAANTLESHEGQDL

SEQ ID NO: 136785 - protein, 34 aa, Artificial Sequence
  Description of Artificial Sequence: Synthetic polypeptide
DEEEIRTTNPVAYEQWGCSYNVRNDLDGRGDRER

SEQ ID NO: 136786 - protein, 36 aa, Artificial Sequence
  Description of Artificial Sequence: Synthetic polypeptide
AEEEIRTTNPVATEQYGSVSTSNQGNNNEQGNNGGG

SEQ ID NO: 136787 - protein, 30 aa, Artificial Sequence
  Description of Artificial Sequence: Synthetic polypeptide
DDSEIATTNPVATEGYGNVPANTCQRVEQK

SEQ ID NO: 136788 - protein, 35 aa, Artificial Sequence
  Description of Artificial Sequence: Synthetic polypeptide
DEEEIRTTNPVAYEQWGESVQIDRNDDGQRGHRAR

SEQ ID NO: 136789 - protein, 35 aa, Artificial Sequence
  Description of Artificial Sequence: Synthetic polypeptide
DEEEIRTTNPEATECYGSVPRTWLEATRFEGKNEW

SEQ ID NO: 136790 - protein, 32 aa, Artificial Sequence
  Description of Artificial Sequence: Synthetic polypeptide
DEEEIRTTNPEATEGYGCCCSTEHAYFGSNQS

SEQ ID NO: 136791 - protein, 31 aa, Artificial Sequence
  Description of Artificial Sequence: Synthetic polypeptide
DDSEIATTNPVSTEGWGNVAANTIQDREGNR

SEQ ID NO: 136792 - protein, 33 aa, Artificial Sequence
  Description of Artificial Sequence: Synthetic polypeptide
DEEEIRTTNPEATEQYGCVCETEELANFGSDQS

SEQ ID NO: 136793 - protein, 32 aa, Artificial Sequence
  Description of Artificial Sequence: Synthetic polypeptide
DEEEIRTTNPEATEQYGCVCPTEDASFGSEQA

SEQ ID NO: 136794 - protein, 33 aa, Artificial Sequence
  Description of Artificial Sequence: Synthetic polypeptide
DEEEIRTTNPEATEQYGCVCPTELAESFGSEQS

SEQ ID NO: 136795 - protein, 32 aa, Artificial Sequence
  Description of Artificial Sequence: Synthetic polypeptide
DDSEIATTNPVSTEGYGNVATNPAIQSRVGQR

SEQ ID NO: 136796 - protein, 33 aa, Artificial Sequence
  Description of Artificial Sequence: Synthetic polypeptide
DEEEIRTTNPEATEQYGCVCPTGELANSGSDQS

SEQ ID NO: 136797 - protein, 32 aa, Artificial Sequence
  Description of Artificial Sequence: Synthetic polypeptide
DDSEIATTNPVSTEGYGSVATNPAINSRVGQR

SEQ ID NO: 136798 - protein, 33 aa, Artificial Sequence
  Description of Artificial Sequence: Synthetic polypeptide
DEEEIRTTNPEATCQYGCVCPTDHNQRFGSDQS

SEQ ID NO: 136799 - protein, 32 aa, Artificial Sequence
  Description of Artificial Sequence: Synthetic polypeptide
DEEEIRTTNPCCTAQWGCVAGTNGLADGDNAQ

SEQ ID NO: 136800 - protein, 32 aa, Artificial Sequence
  Description of Artificial Sequence: Synthetic polypeptide
DDSEIATTNPVATEGYGNVAANTIVQSREGND

SEQ ID NO: 136801 - protein, 31 aa, Artificial Sequence
  Description of Artificial Sequence: Synthetic polypeptide
DEEEIRTTNPCCTAQWGCVAGTGLADGDNTW

SEQ ID NO: 136802 - protein, 36 aa, Artificial Sequence
  Description of Artificial Sequence: Synthetic polypeptide
AEEEIRTTNPVATEQYGSVSTSSNNDEQGTTNNQDD

SEQ ID NO: 136803 - protein, 36 aa, Artificial Sequence
  Description of Artificial Sequence: Synthetic polypeptide
AEEEIRTTNPVATEQYGSVSTSQNNTEQGNTNNQDD

SEQ ID NO: 136804 - protein, 37 aa, Artificial Sequence
  Description of Artificial Sequence: Synthetic polypeptide
DEEEISTTNPVATEQYGSVSSTTPALGPNMRNGMNPV

SEQ ID NO: 136805 - protein, 36 aa, Artificial Sequence
  Description of Artificial Sequence: Synthetic polypeptide
DEEEISTTNPVATEQYGSVSSTTPAGPRMRNGMNPV

SEQ ID NO: 136806 - protein, 34 aa, Artificial Sequence
  Description of Artificial Sequence: Synthetic polypeptide
DEEEIRTTNPVAYEQWGCCVWQTNDHHQRGGIID

SEQ ID NO: 136807 - protein, 36 aa, Artificial Sequence
  Description of Artificial Sequence: Synthetic polypeptide
DEEEISTTNPVATEQYGSVSSTTPAGPNMRNGMNPV

SEQ ID NO: 136808 - protein, 36 aa, Artificial Sequence
  Description of Artificial Sequence: Synthetic polypeptide
DEEEISTTNPVATEQYGSVSSTTPAGPFMRNGMNPV

SEQ ID NO: 136809 - protein, 31 aa, Artificial Sequence
  Description of Artificial Sequence: Synthetic polypeptide
DDSEIASTNPVSTEQYGNVAANTIQSRVGQR

SEQ ID NO: 136810 - protein, 36 aa, Artificial Sequence
  Description of Artificial Sequence: Synthetic polypeptide
AEEEIRTTNPVATEQYGSVSTSQNGTEQGNNNNDDN

SEQ ID NO: 136811 - protein, 30 aa, Artificial Sequence
  Description of Artificial Sequence: Synthetic polypeptide
DDSEIASTNPVSTEQYGNVANTIMSRVGQR

SEQ ID NO: 136812 - protein, 37 aa, Artificial Sequence
  Description of Artificial Sequence: Synthetic polypeptide
DEEEIRTTNPVAYEQWGCSTVSYTNALSHRPGIGNFV

SEQ ID NO: 136813 - protein, 31 aa, Artificial Sequence
  Description of Artificial Sequence: Synthetic polypeptide
DDSEIASTNPVSTEQYGNVSANTEQSRVEQR

SEQ ID NO: 136814 - protein, 36 aa, Artificial Sequence
  Description of Artificial Sequence: Synthetic polypeptide
AEEEIRTTNPVATEQYGSVSTSQNGDEQGTNNNDDG

SEQ ID NO: 136815 - protein, 32 aa, Artificial Sequence
  Description of Artificial Sequence: Synthetic polypeptide
DDSEIASTNPVSTEQYGNVSTNTGNSRVGNPV

SEQ ID NO: 136816 - protein, 32 aa, Artificial Sequence
  Description of Artificial Sequence: Synthetic polypeptide
DEEEIRTTNPCAYMQYGSVSSGNIGFHGDDAH

SEQ ID NO: 136817 - protein, 30 aa, Artificial Sequence
  Description of Artificial Sequence: Synthetic polypeptide
DDSEIASVNPVSTEGYGNVANNLQSRVGQR

SEQ ID NO: 136818 - protein, 35 aa, Artificial Sequence
  Description of Artificial Sequence: Synthetic polypeptide
AEEEIRTTNPVATEQYGSVSTSQAGTEQGNVNNDD

SEQ ID NO: 136819 - protein, 34 aa, Artificial Sequence
  Description of Artificial Sequence: Synthetic polypeptide
DEEEIRTTNPVAYEQWGCSYNERNDLDQNGHRPR

SEQ ID NO: 136820 - protein, 31 aa, Artificial Sequence
  Description of Artificial Sequence: Synthetic polypeptide
DDSEIATTNPVATECWGSVSCTEQDRVGEQG

SEQ ID NO: 136821 - protein, 34 aa, Artificial Sequence
  Description of Artificial Sequence: Synthetic polypeptide
DEEEIRTTNPVAYEQWGCSYNHRNDHDQRGHRMQ

SEQ ID NO: 136822 - protein, 31 aa, Artificial Sequence
  Description of Artificial Sequence: Synthetic polypeptide
DDSEIATTNPVATEGWGNVSNITEQDREGNG

SEQ ID NO: 136823 - protein, 31 aa, Artificial Sequence
  Description of Artificial Sequence: Synthetic polypeptide
DDSEIATTNPVSTEQWGDVSANIEQSRVEQR

SEQ ID NO: 136824 - protein, 32 aa, Artificial Sequence
  Description of Artificial Sequence: Synthetic polypeptide
DEEEIRTTNPIATECWGATTWSEEDLARGNYI

SEQ ID NO: 136825 - protein, 35 aa, Artificial Sequence
  Description of Artificial Sequence: Synthetic polypeptide
SEEEIRTTNPVATEQYGSVSWDTLLENNYASNINE

SEQ ID NO: 136826 - protein, 35 aa, Artificial Sequence
  Description of Artificial Sequence: Synthetic polypeptide
DEEEIRTTNPVAYEQWGHMNVSYTNEHQHRNGGEF

SEQ ID NO: 136827 - protein, 36 aa, Artificial Sequence
  Description of Artificial Sequence: Synthetic polypeptide
DEEEIRTTNPHATECYGSVSSTTPAGNNMRNGMNPV

SEQ ID NO: 136828 - protein, 30 aa, Artificial Sequence
  Description of Artificial Sequence: Synthetic polypeptide
DDSEIRSTNPVSTEGYGNVANTIQSRVGQR

SEQ ID NO: 136829 - protein, 35 aa, Artificial Sequence
  Description of Artificial Sequence: Synthetic polypeptide
SEEEIRTTNPVATEQYGSVYAPTHMYSQEGTNDQE

SEQ ID NO: 136830 - protein, 33 aa, Artificial Sequence
  Description of Artificial Sequence: Synthetic polypeptide
SEEEIRTTNPVATEQYGSVYCDDMNNGFENNMD

SEQ ID NO: 136831 - protein, 34 aa, Artificial Sequence
  Description of Artificial Sequence: Synthetic polypeptide
SEEEIRTTNPVATEQYGSVYMPTHMYSEGTNDHS

SEQ ID NO: 136832 - protein, 34 aa, Artificial Sequence
  Description of Artificial Sequence: Synthetic polypeptide
SEEEIRTTNPVATEQYGSVYMPTHMYSIEGTNDE

SEQ ID NO: 136833 - protein, 33 aa, Artificial Sequence
  Description of Artificial Sequence: Synthetic polypeptide
SEEEIRTTNPVATEQYGSVYPEDDMNNGFENNG

SEQ ID NO: 136834 - protein, 34 aa, Artificial Sequence
  Description of Artificial Sequence: Synthetic polypeptide
SEEEIRTTNPVATEQYGSVYPTDDMNNEFEENNM

SEQ ID NO: 136835 - protein, 34 aa, Artificial Sequence
  Description of Artificial Sequence: Synthetic polypeptide
DDSEIRSTNPVSTEGYGSVSACINIPQSRVGENR

SEQ ID NO: 136836 - protein, 36 aa, Artificial Sequence
  Description of Artificial Sequence: Synthetic polypeptide
DEEEIRTTNPGATEQYGSVSSTTPSGPNMRNGMNPV

SEQ ID NO: 136837 - protein, 32 aa, Artificial Sequence
  Description of Artificial Sequence: Synthetic polypeptide
DDSEIRSTNPVSTEGYGSVSCINIPQSREGQG

SEQ ID NO: 136838 - protein, 34 aa, Artificial Sequence
  Description of Artificial Sequence: Synthetic polypeptide
SEEEIRTTNPVATEQYGSVYPTDDNNNGFENNMN

SEQ ID NO: 136839 - protein, 35 aa, Artificial Sequence
  Description of Artificial Sequence: Synthetic polypeptide
DEEEIRTTNPVATEQYGCVSNMGNGGGQGEDEGFI

SEQ ID NO: 136840 - protein, 34 aa, Artificial Sequence
  Description of Artificial Sequence: Synthetic polypeptide
SEEEIRTTNPVATEQYGSVYTPTHEYSEGTNDEM

SEQ ID NO: 136841 - protein, 34 aa, Artificial Sequence
  Description of Artificial Sequence: Synthetic polypeptide
DEEEISTTNPVATEQYGQCVCSWNTQENFNSNQS

SEQ ID NO: 136842 - protein, 35 aa, Artificial Sequence
  Description of Artificial Sequence: Synthetic polypeptide
DEEEISTTNPVATEQYGQCVCSWNHNQNFGSENQS

SEQ ID NO: 136843 - protein, 35 aa, Artificial Sequence
  Description of Artificial Sequence: Synthetic polypeptide
SEEEIRTTNPVATEQYGSVYTPTHMYSEGTNDFRV

SEQ ID NO: 136844 - protein, 34 aa, Artificial Sequence
  Description of Artificial Sequence: Synthetic polypeptide
SEEEIRTTNPVATEQYGSVYTPTHMYSIEGTEDR

SEQ ID NO: 136845 - protein, 32 aa, Artificial Sequence
  Description of Artificial Sequence: Synthetic polypeptide
SEEEIRTTNPVATEQYGSWAIPALQEMQFDQF

SEQ ID NO: 136846 - protein, 32 aa, Artificial Sequence
  Description of Artificial Sequence: Synthetic polypeptide
SEEEIRTTNPVATEQYGSWAPALDQEVQFDQQ

SEQ ID NO: 136847 - protein, 35 aa, Artificial Sequence
  Description of Artificial Sequence: Synthetic polypeptide
DEEEIRTTNPVAYEQWGHTNVSYWNELQHQRPGGE

SEQ ID NO: 136848 - protein, 36 aa, Artificial Sequence
  Description of Artificial Sequence: Synthetic polypeptide
DEEEIRTTNPFATEQYGSVSSTTPAGPNMRNGMNPV

SEQ ID NO: 136849 - protein, 37 aa, Artificial Sequence
  Description of Artificial Sequence: Synthetic polypeptide
DEEEIRTTNPFATEQYGSVASVTLDNDTLVQKGDEPV

SEQ ID NO: 136850 - protein, 35 aa, Artificial Sequence
  Description of Artificial Sequence: Synthetic polypeptide
DEEEIRTTNPVAYEQWGHTNVSYTLELQHRPGGGF

SEQ ID NO: 136851 - protein, 35 aa, Artificial Sequence
  Description of Artificial Sequence: Synthetic polypeptide
DEEEIRTTNPVAYEQWGHNNVSYTENDDQHRPGGF

SEQ ID NO: 136852 - protein, 33 aa, Artificial Sequence
  Description of Artificial Sequence: Synthetic polypeptide
DEEEIRTTNPEATEQYGSVPREWLEATTIEGKE

SEQ ID NO: 136853 - protein, 31 aa, Artificial Sequence
  Description of Artificial Sequence: Synthetic polypeptide
DDSEIATTNPVSTEQYGNVSATDLEDHEGEL

SEQ ID NO: 136854 - protein, 32 aa, Artificial Sequence
  Description of Artificial Sequence: Synthetic polypeptide
DDSEIATTNPVSTEQYGSVAANTLQSHEGQDL

SEQ ID NO: 136855 - protein, 36 aa, Artificial Sequence
  Description of Artificial Sequence: Synthetic polypeptide
AEEEIRTTNPVATEQYGSVSTSNNNGNDESGTNVDN

SEQ ID NO: 136856 - protein, 36 aa, Artificial Sequence
  Description of Artificial Sequence: Synthetic polypeptide
DEEEIRTTNPVATEQYGCVSSTTPAGPNMRNGMNPV

SEQ ID NO: 136857 - protein, 36 aa, Artificial Sequence
  Description of Artificial Sequence: Synthetic polypeptide
DEEEIRTTNPVATEQYGCVSSTTPAGPNMRAGDNPV

SEQ ID NO: 136858 - protein, 30 aa, Artificial Sequence
  Description of Artificial Sequence: Synthetic polypeptide
DDSEIRCTNPVSTEGYGNVANTIQSRVGQR

SEQ ID NO: 136859 - protein, 36 aa, Artificial Sequence
  Description of Artificial Sequence: Synthetic polypeptide
DEEEIRTTNPVATEQYGCVSSTTDAGPNMRNGMNPV

SEQ ID NO: 136860 - protein, 35 aa, Artificial Sequence
  Description of Artificial Sequence: Synthetic polypeptide
DEEEIRTTNPEATEQYGSVPRTWWLEATRFEGKQE

SEQ ID NO: 136861 - protein, 33 aa, Artificial Sequence
  Description of Artificial Sequence: Synthetic polypeptide
DDSEIRSTNPVATECWGSVSCINEPQDREGENG

SEQ ID NO: 136862 - protein, 33 aa, Artificial Sequence
  Description of Artificial Sequence: Synthetic polypeptide
DDSEIRSTNPVATEGWGSVSCINEPQDREGENG

SEQ ID NO: 136863 - protein, 36 aa, Artificial Sequence
  Description of Artificial Sequence: Synthetic polypeptide
DEEEIRTTNPEATEQYGSVSCTTPAGPNMRNGMNPV

SEQ ID NO: 136864 - protein, 33 aa, Artificial Sequence
  Description of Artificial Sequence: Synthetic polypeptide
DDSEIRSTNPVATEGWGSVSCINEPQSREGENG

SEQ ID NO: 136865 - protein, 36 aa, Artificial Sequence
  Description of Artificial Sequence: Synthetic polypeptide
DEEEIRTTNPEATEQYGSVSSTTPAGPNMRNGMNPV

SEQ ID NO: 136866 - protein, 37 aa, Artificial Sequence
  Description of Artificial Sequence: Synthetic polypeptide
DEEEISTTNPVATEQYGSTVSTANEFSQQSNGGNELY

SEQ ID NO: 136867 - protein, 35 aa, Artificial Sequence
  Description of Artificial Sequence: Synthetic polypeptide
DEEEISTTNPVATEQYGSTVCFCTANAPSFGGGKR

SEQ ID NO: 136868 - protein, 34 aa, Artificial Sequence
  Description of Artificial Sequence: Synthetic polypeptide
DEEEIRTTNPEATESYGSVPRTWLEATRFEGKSE

SEQ ID NO: 136869 - protein, 34 aa, Artificial Sequence
  Description of Artificial Sequence: Synthetic polypeptide
DEEEIRTTNPEATRQYGQVPRSVDLTQPRGEEFN

SEQ ID NO: 136870 - protein, 31 aa, Artificial Sequence
  Description of Artificial Sequence: Synthetic polypeptide
DDSEIRSTNPVATEQYGNVAAETIQSAVGQR

SEQ ID NO: 136871 - protein, 34 aa, Artificial Sequence
  Description of Artificial Sequence: Synthetic polypeptide
DEEEIRTTNPEAYEQYGSVPCTWLSASTGGKNEN

SEQ ID NO: 136872 - protein, 31 aa, Artificial Sequence
  Description of Artificial Sequence: Synthetic polypeptide
DDSEIATTNPVSTEQYGNVAATDGIQFEGQR

SEQ ID NO: 136873 - protein, 33 aa, Artificial Sequence
  Description of Artificial Sequence: Synthetic polypeptide
TEEEIRTTNPVATMAYGKTISTNLSDVDGGNNE

SEQ ID NO: 136874 - protein, 35 aa, Artificial Sequence
  Description of Artificial Sequence: Synthetic polypeptide
AEEEIRTTNPVATEQYGSVATTLVNGNEEGTTTDE

SEQ ID NO: 136875 - protein, 35 aa, Artificial Sequence
  Description of Artificial Sequence: Synthetic polypeptide
DEEEISTTNPVATEQYGCVCSWELNQENFGSENQP

SEQ ID NO: 136876 - protein, 35 aa, Artificial Sequence
  Description of Artificial Sequence: Synthetic polypeptide
DEEEIRTTNPVATEQYGCVCSSEHNQENFGSENQF

SEQ ID NO: 136877 - protein, 31 aa, Artificial Sequence
  Description of Artificial Sequence: Synthetic polypeptide
TEEEIRTTNPAATSRYGCVGATVALTQGGQG

SEQ ID NO: 136878 - protein, 35 aa, Artificial Sequence
  Description of Artificial Sequence: Synthetic polypeptide
TEEEIRTTNPAATVQYGHSLPSTNNMDQRQMSNFR

SEQ ID NO: 136879 - protein, 33 aa, Artificial Sequence
  Description of Artificial Sequence: Synthetic polypeptide
TEEEIRTTNPCAYDQYGQVVPCTDLSQREGNNS

SEQ ID NO: 136880 - protein, 31 aa, Artificial Sequence
  Description of Artificial Sequence: Synthetic polypeptide
TEEEIRTTNPEATSMYGCVYATVALDQGGRG

SEQ ID NO: 136881 - protein, 31 aa, Artificial Sequence
  Description of Artificial Sequence: Synthetic polypeptide
TEEEIRTTNPGATSRYGCVYDTVALDQGGQG

SEQ ID NO: 136882 - protein, 33 aa, Artificial Sequence
  Description of Artificial Sequence: Synthetic polypeptide
DEEEIRTTNPVATEQYGCVCSSEEHQSFISDQA

SEQ ID NO: 136883 - protein, 34 aa, Artificial Sequence
  Description of Artificial Sequence: Synthetic polypeptide
DEEEIRTTNPVATEQYGCVCSSEEHQNFGSDTQL

SEQ ID NO: 136884 - protein, 34 aa, Artificial Sequence
  Description of Artificial Sequence: Synthetic polypeptide
DEEEIRTTNPVATEQYGCVCSSEEHQNFGSDTQA

SEQ ID NO: 136885 - protein, 34 aa, Artificial Sequence
  Description of Artificial Sequence: Synthetic polypeptide
DEEEIRTTNPVATEQYGCVCSSEHQEFFISDNQS

SEQ ID NO: 136886 - protein, 34 aa, Artificial Sequence
  Description of Artificial Sequence: Synthetic polypeptide
DEEEIRTTNPVATEQYGCVCSSEEHQFFGSDTQY

SEQ ID NO: 136887 - protein, 32 aa, Artificial Sequence
  Description of Artificial Sequence: Synthetic polypeptide
TEEEIRTTNPTATEAYGKISANLSDVDGGNNE

SEQ ID NO: 136888 - protein, 34 aa, Artificial Sequence
  Description of Artificial Sequence: Synthetic polypeptide
DEEEIRTTNPVATEQYGCVCSSEEHNQNFNSQQV

SEQ ID NO: 136889 - protein, 31 aa, Artificial Sequence
  Description of Artificial Sequence: Synthetic polypeptide
TEEEIRTTNPVAHSKYGCVGATVALDQGGQG

SEQ ID NO: 136890 - protein, 37 aa, Artificial Sequence
  Description of Artificial Sequence: Synthetic polypeptide
AEEEIRTTNPVATEAYGSVSTVVNNLQQGNQGGNNTQ

SEQ ID NO: 136891 - protein, 36 aa, Artificial Sequence
  Description of Artificial Sequence: Synthetic polypeptide
TEEEIRTTNPVATDQYGSTVPSAGNNLSDTAGTNNR

SEQ ID NO: 136892 - protein, 32 aa, Artificial Sequence
  Description of Artificial Sequence: Synthetic polypeptide
TEEEIRTTNPVATDRYGCVGATVALDQGAGQG

SEQ ID NO: 136893 - protein, 35 aa, Artificial Sequence
  Description of Artificial Sequence: Synthetic polypeptide
AEEEIRTTNPVATEAYGSVSTVTNQQLQQNSEEED

SEQ ID NO: 136894 - protein, 36 aa, Artificial Sequence
  Description of Artificial Sequence: Synthetic polypeptide
TEEEIRTTNPVATEAWGSVCSKTNDDLDQRNANDTV

SEQ ID NO: 136895 - protein, 35 aa, Artificial Sequence
  Description of Artificial Sequence: Synthetic polypeptide
AEEEIRTTNPVATEAYGSVSTVTNNQQQANEEETD

SEQ ID NO: 136896 - protein, 35 aa, Artificial Sequence
  Description of Artificial Sequence: Synthetic polypeptide
AEEEIRTTNPVATEAYGSVSTVVSNNNVEEGTNEQ

SEQ ID NO: 136897 - protein, 33 aa, Artificial Sequence
  Description of Artificial Sequence: Synthetic polypeptide
DEEEIRTTNPVATEQYGCVCSSEHQEFFISDQY

SEQ ID NO: 136898 - protein, 34 aa, Artificial Sequence
  Description of Artificial Sequence: Synthetic polypeptide
DEEEIRTTNPVATEQYGCVCSSEHQEGFGSDTQV

SEQ ID NO: 136899 - protein, 36 aa, Artificial Sequence
  Description of Artificial Sequence: Synthetic polypeptide
AEEEIRTTNPVATEAYGSVSVTTNLLQGSTGEDEDE

SEQ ID NO: 136900 - protein, 34 aa, Artificial Sequence
  Description of Artificial Sequence: Synthetic polypeptide
DEEEIRTTNPVATEQYGCVCSSGEDHQHFGSEQS

SEQ ID NO: 136901 - protein, 34 aa, Artificial Sequence
  Description of Artificial Sequence: Synthetic polypeptide
DEEEIRTTNPVATEQYGCVCSSGEDHQHFGSEQA

SEQ ID NO: 136902 - protein, 35 aa, Artificial Sequence
  Description of Artificial Sequence: Synthetic polypeptide
AEEEIRTTNPVATEAYGSVVVVVTTNLQQGEEEEE

SEQ ID NO: 136903 - protein, 33 aa, Artificial Sequence
  Description of Artificial Sequence: Synthetic polypeptide
TEEEIQTTNPVAYEAYGSVVNTAGVQRGGNNLD

SEQ ID NO: 136904 - protein, 33 aa, Artificial Sequence
  Description of Artificial Sequence: Synthetic polypeptide
TEEEIRATNPVATEAYGKISTNLSDVDGGNNEY

SEQ ID NO: 136905 - protein, 34 aa, Artificial Sequence
  Description of Artificial Sequence: Synthetic polypeptide
TEEEIRCTNPIATEEYGCTVSENELSMRTGGNRT

SEQ ID NO: 136906 - protein, 35 aa, Artificial Sequence
  Description of Artificial Sequence: Synthetic polypeptide
TEEEIRCTNPIATEPYGSTVSEENELSMRTGGNRT

SEQ ID NO: 136907 - protein, 35 aa, Artificial Sequence
  Description of Artificial Sequence: Synthetic polypeptide
TEEEIRCTNPIATEQYGSTVQSENELSMETGGNRT

SEQ ID NO: 136908 - protein, 34 aa, Artificial Sequence
  Description of Artificial Sequence: Synthetic polypeptide
DEEEIRTTNPVATEQYGCVCSSGEDDQFFGSDQS

SEQ ID NO: 136909 - protein, 35 aa, Artificial Sequence
  Description of Artificial Sequence: Synthetic polypeptide
DEEEIRTTNPVATEQYGCVCSSENPQENFNSDNQL

SEQ ID NO: 136910 - protein, 34 aa, Artificial Sequence
  Description of Artificial Sequence: Synthetic polypeptide
TEEEIRCTNPIATEQYGSTVSENELSMKTGGNET

SEQ ID NO: 136911 - protein, 36 aa, Artificial Sequence
  Description of Artificial Sequence: Synthetic polypeptide
AEEEIRTTNPVATEAYGSVVVSVTNNQEQGNNNNNL

SEQ ID NO: 136912 - protein, 34 aa, Artificial Sequence
  Description of Artificial Sequence: Synthetic polypeptide
AEEEIRTTNPVATEAYGSVVTVVNNQQQGEEEED

SEQ ID NO: 136913 - protein, 37 aa, Artificial Sequence
  Description of Artificial Sequence: Synthetic polypeptide
AEEEIRTTNPVATEAYGSVSVVVTTNLQAGTEEGNND

SEQ ID NO: 136914 - protein, 36 aa, Artificial Sequence
  Description of Artificial Sequence: Synthetic polypeptide
AEEEIRTTNPVATEAYGSVSVVTNNNNNQAGNNNTD

SEQ ID NO: 136915 - protein, 34 aa, Artificial Sequence
  Description of Artificial Sequence: Synthetic polypeptide
TEEEIRCTNPIATEQYGTTVSENELSMFTGGNRT

SEQ ID NO: 136916 - protein, 35 aa, Artificial Sequence
  Description of Artificial Sequence: Synthetic polypeptide
AEEEIRTTNPVATEAYGSVSVTTNNNNEAGNNATE

SEQ ID NO: 136917 - protein, 33 aa, Artificial Sequence
  Description of Artificial Sequence: Synthetic polypeptide
DEEEIRTTNPVATEQYGCVCSSEHQENFTSDQA

SEQ ID NO: 136918 - protein, 34 aa, Artificial Sequence
  Description of Artificial Sequence: Synthetic polypeptide
DEEEIRTTNPVATEQYGCVCSSEHQENFGSDTQF

SEQ ID NO: 136919 - protein, 33 aa, Artificial Sequence
  Description of Artificial Sequence: Synthetic polypeptide
DEEEIRTTNPVATEQYGCVCSSEHQEHFFSDQS

SEQ ID NO: 136920 - protein, 32 aa, Artificial Sequence
  Description of Artificial Sequence: Synthetic polypeptide
TEEEIRCTNPTAYEQWGSVSGENDDDMRGANQ

SEQ ID NO: 136921 - protein, 33 aa, Artificial Sequence
  Description of Artificial Sequence: Synthetic polypeptide
TEEEIRTTNPVATEAYGEISANLSDDSGGNNEF

SEQ ID NO: 136922 - protein, 31 aa, Artificial Sequence
  Description of Artificial Sequence: Synthetic polypeptide
TEEEIMTTNPVATTRYGCVYATVALDQGGQG

SEQ ID NO: 136923 - protein, 33 aa, Artificial Sequence
  Description of Artificial Sequence: Synthetic polypeptide
TEEEIRTTNPVATEAYGEISTELSDESGGNNEE

SEQ ID NO: 136924 - protein, 34 aa, Artificial Sequence
  Description of Artificial Sequence: Synthetic polypeptide
TEEEIRTTNPVATEAYGEISTNNLSDDSGGNNEC

SEQ ID NO: 136925 - protein, 33 aa, Artificial Sequence
  Description of Artificial Sequence: Synthetic polypeptide
DEEEISTTNPVATEQYGCVCSNWEHQYFGSDQA

SEQ ID NO: 136926 - protein, 33 aa, Artificial Sequence
  Description of Artificial Sequence: Synthetic polypeptide
TEEEIRTTNPVATEAYRGKISTDLSDVDGGNNE

SEQ ID NO: 136927 - protein, 35 aa, Artificial Sequence
  Description of Artificial Sequence: Synthetic polypeptide
DEEEIRTTNPVATEQYGCVCSNWGNHQENFGSDQD

SEQ ID NO: 136928 - protein, 34 aa, Artificial Sequence
  Description of Artificial Sequence: Synthetic polypeptide
DEEEISTTNPVATEQYGCVCSNWEHQEHFGSNQF

SEQ ID NO: 136929 - protein, 35 aa, Artificial Sequence
  Description of Artificial Sequence: Synthetic polypeptide
DEEEIRTTNPVATEQYGCVCSNWGNHQEHFNSNQT

SEQ ID NO: 136930 - protein, 35 aa, Artificial Sequence
  Description of Artificial Sequence: Synthetic polypeptide
DEEEIRTTNPVATEQYGCVCSNWGNDHQNFGSDQS

SEQ ID NO: 136931 - protein, 34 aa, Artificial Sequence
  Description of Artificial Sequence: Synthetic polypeptide
TEEEIRTTNPVATEGYGSVSIMGDGGQRNQGEGT

SEQ ID NO: 136932 - protein, 33 aa, Artificial Sequence
  Description of Artificial Sequence: Synthetic polypeptide
DEEEISTTNPVATEQYGCVCSNWEHNQNFGSDQ

SEQ ID NO: 136933 - protein, 35 aa, Artificial Sequence
  Description of Artificial Sequence: Synthetic polypeptide
TEEEIRTTNPVATEGYGSVSITNNFGQGEGEGGEE

SEQ ID NO: 136934 - protein, 34 aa, Artificial Sequence
  Description of Artificial Sequence: Synthetic polypeptide
DEEEISTTNPVATEQYGCVCSNWELNQNFNSEQA

SEQ ID NO: 136935 - protein, 35 aa, Artificial Sequence
  Description of Artificial Sequence: Synthetic polypeptide
TEEEIRTTNPVATEGYGSVSVDQNLQEGGQGEGQE

SEQ ID NO: 136936 - protein, 35 aa, Artificial Sequence
  Description of Artificial Sequence: Synthetic polypeptide
AEEEIRTTNPVATEAYGSVSTTQQQNQEQGTNNVE

SEQ ID NO: 136937 - protein, 36 aa, Artificial Sequence
  Description of Artificial Sequence: Synthetic polypeptide
AEEEIRTTNPVATEAYGSVSTTQQQLQNGNNNQIDE

SEQ ID NO: 136938 - protein, 36 aa, Artificial Sequence
  Description of Artificial Sequence: Synthetic polypeptide
AEEEIRTTNPVATEAYGSVSTTQQQLNNQNGNQIGE

SEQ ID NO: 136939 - protein, 35 aa, Artificial Sequence
  Description of Artificial Sequence: Synthetic polypeptide
AEEEIRTTNPVATEAYGSVSTTQNQNDEQGTNNVE

SEQ ID NO: 136940 - protein, 36 aa, Artificial Sequence
  Description of Artificial Sequence: Synthetic polypeptide
AEEEIRTTNPVATEAYGSVSTTQLQNNDEQGTNNVE

SEQ ID NO: 136941 - protein, 36 aa, Artificial Sequence
  Description of Artificial Sequence: Synthetic polypeptide
AEEEIRTTNPVATEAYGSVSTTNQQVGTEAGTNTDL

SEQ ID NO: 136942 - protein, 36 aa, Artificial Sequence
  Description of Artificial Sequence: Synthetic polypeptide
AEEEIRTTNPVATEAYGSVSTTNQQSGTDEGNNTDT

SEQ ID NO: 136943 - protein, 36 aa, Artificial Sequence
  Description of Artificial Sequence: Synthetic polypeptide
TEEEIRTTNPVATEIQYWGSVLMTSNQPQRDDNAQP

SEQ ID NO: 136944 - protein, 36 aa, Artificial Sequence
  Description of Artificial Sequence: Synthetic polypeptide
AEEEIRTTNPVATEAYGSVSTTNQQQNNGNQQLGTD

SEQ ID NO: 136945 - protein, 35 aa, Artificial Sequence
  Description of Artificial Sequence: Synthetic polypeptide
DEEEIRTTNPVATEQYGCVCSNWGETQNFISDNQS

SEQ ID NO: 136946 - protein, 34 aa, Artificial Sequence
  Description of Artificial Sequence: Synthetic polypeptide
DEEEISTTNPVATEQYGCVCSNWELQENFNSEAS

SEQ ID NO: 136947 - protein, 34 aa, Artificial Sequence
  Description of Artificial Sequence: Synthetic polypeptide
DEEEISTTNPVATEQYGCVCSNWELQESFGSDQS

SEQ ID NO: 136948 - protein, 34 aa, Artificial Sequence
  Description of Artificial Sequence: Synthetic polypeptide
DEEEIRTTNPVATEQYGCVCSNWGPHQNFNSQQA

SEQ ID NO: 136949 - protein, 34 aa, Artificial Sequence
  Description of Artificial Sequence: Synthetic polypeptide
DEEEIRTTNPVATEQYGCVCSSEEDQFFNSDTQE

SEQ ID NO: 136950 - protein, 33 aa, Artificial Sequence
  Description of Artificial Sequence: Synthetic polypeptide
DEEEIRTTNPVATEQYGCVCSSEDTEFFGSEQS

SEQ ID NO: 136951 - protein, 33 aa, Artificial Sequence
  Description of Artificial Sequence: Synthetic polypeptide
TEEEIRTTNPVATEAYGKISINLSDHEDGGNNE

SEQ ID NO: 136952 - protein, 33 aa, Artificial Sequence
  Description of Artificial Sequence: Synthetic polypeptide
TEEEIRTTNPVATEAYGKISTNNFSDVDGGNNE

SEQ ID NO: 136953 - protein, 34 aa, Artificial Sequence
  Description of Artificial Sequence: Synthetic polypeptide
DEEEIRTTNPVATEQYGCVCSSEDHQEFFGSEQS

SEQ ID NO: 136954 - protein, 35 aa, Artificial Sequence
  Description of Artificial Sequence: Synthetic polypeptide
AEEEIRTTNPVATEAYGSVSTVTNNQQLQEEEEED

SEQ ID NO: 136955 - protein, 35 aa, Artificial Sequence
  Description of Artificial Sequence: Synthetic polypeptide
DEEEIRTTNPVATEQYGCVCSNWYHQENFGSDNQS

SEQ ID NO: 136956 - protein, 35 aa, Artificial Sequence
  Description of Artificial Sequence: Synthetic polypeptide
AEEEIRTTNPVATEAYGSVSTVTNNQLQQNEEEDD

SEQ ID NO: 136957 - protein, 36 aa, Artificial Sequence
  Description of Artificial Sequence: Synthetic polypeptide
AEEEIRTTNPVATEAYGSVSTVTNNQLQNQEEENDD

SEQ ID NO: 136958 - protein, 36 aa, Artificial Sequence
  Description of Artificial Sequence: Synthetic polypeptide
AEEEIRTTNPVATEAYGSVSTVTNNNQQGEGGTNEG

SEQ ID NO: 136959 - protein, 36 aa, Artificial Sequence
  Description of Artificial Sequence: Synthetic polypeptide
AEEEIRTTNPVATEAYGSVSTVTNNLQLQQNEEEEQ

SEQ ID NO: 136960 - protein, 36 aa, Artificial Sequence
  Description of Artificial Sequence: Synthetic polypeptide
DEEEIRTTNPVATEQYGCVCSNWNEHQEFFGSDNQA

SEQ ID NO: 136961 - protein, 37 aa, Artificial Sequence
  Description of Artificial Sequence: Synthetic polypeptide
AEEEIRTTNPVATEAYGSVSTVTNLQLGNEQGTDEEE

SEQ ID NO: 136962 - protein, 36 aa, Artificial Sequence
  Description of Artificial Sequence: Synthetic polypeptide
AEEEIRTTNPVATEAYGSVSTVNQQLGNNNEGNIQE

SEQ ID NO: 136963 - protein, 36 aa, Artificial Sequence
  Description of Artificial Sequence: Synthetic polypeptide
AEEEIRTTNPVATEAYGSVSTVNQQAGNNQQGEISE

SEQ ID NO: 136964 - protein, 36 aa, Artificial Sequence
  Description of Artificial Sequence: Synthetic polypeptide
AEEEIRTTNPVATEAYGSVSTVNNQQGNDEGENTDT

SEQ ID NO: 136965 - protein, 36 aa, Artificial Sequence
  Description of Artificial Sequence: Synthetic polypeptide
AEEEIRTTNPVATEAYGSVSTVNLGNQQEATNVATE

SEQ ID NO: 136966 - protein, 35 aa, Artificial Sequence
  Description of Artificial Sequence: Synthetic polypeptide
AEEEIRTTNPVATEAYGSVSTTVTNNQEATNNATE

SEQ ID NO: 136967 - protein, 34 aa, Artificial Sequence
  Description of Artificial Sequence: Synthetic polypeptide
AEEEIRTTNPVATEAYGSVSTTVNQNVEQGTEES

SEQ ID NO: 136968 - protein, 35 aa, Artificial Sequence
  Description of Artificial Sequence: Synthetic polypeptide
DEEEIRTTNPVATEQYGCVCSNWMEHQFFGSDNQS

SEQ ID NO: 136969 - protein, 35 aa, Artificial Sequence
  Description of Artificial Sequence: Synthetic polypeptide
AEEEIRTTNPVATEAYGSVSTTTQNGNVEVGNEED

SEQ ID NO: 136970 - protein, 34 aa, Artificial Sequence
  Description of Artificial Sequence: Synthetic polypeptide
DEEEIRTTNPVATEQYGCVCSSEEDTSFNSENQE

SEQ ID NO: 136971 - protein, 36 aa, Artificial Sequence
  Description of Artificial Sequence: Synthetic polypeptide
AEEEIRTTNPVATEAYGSVSTTNQQLNNNQGNINQE

SEQ ID NO: 136972 - protein, 34 aa, Artificial Sequence
  Description of Artificial Sequence: Synthetic polypeptide
DEEEIRTTNPVATEQYGCVCSSGEDHQNSGSDQP

SEQ ID NO: 136973 - protein, 33 aa, Artificial Sequence
  Description of Artificial Sequence: Synthetic polypeptide
DEEEIRTTNPVATEQYGCVCSSGEHANFGSEQS

SEQ ID NO: 136974 - protein, 33 aa, Artificial Sequence
  Description of Artificial Sequence: Synthetic polypeptide
DEEEISTTNPVATEQYGCVCSSEHQENFNSNQS

SEQ ID NO: 136975 - protein, 33 aa, Artificial Sequence
  Description of Artificial Sequence: Synthetic polypeptide
DEEEISTTNPVATEQYGCVCSSEHQEHFNSNQD

SEQ ID NO: 136976 - protein, 31 aa, Artificial Sequence
  Description of Artificial Sequence: Synthetic polypeptide
TEEEIASVNPVSYEQYGVTVSINLSQSGGNQ

SEQ ID NO: 136977 - protein, 33 aa, Artificial Sequence
  Description of Artificial Sequence: Synthetic polypeptide
DEEEISTTNPVATEQYGCVCSSEHANFGSENQS

SEQ ID NO: 136978 - protein, 32 aa, Artificial Sequence
  Description of Artificial Sequence: Synthetic polypeptide
TEEEIATTNPEATQQYGEVCTIDQGQRGMNKF

SEQ ID NO: 136979 - protein, 28 aa, Artificial Sequence
  Description of Artificial Sequence: Synthetic peptide
TEEEIATTNPHATEQYGEAPEVCQHEEK

SEQ ID NO: 136980 - protein, 28 aa, Artificial Sequence
  Description of Artificial Sequence: Synthetic peptide
TEEEIATTNPTATEQYGEAPEVCQHEEK

SEQ ID NO: 136981 - protein, 34 aa, Artificial Sequence
  Description of Artificial Sequence: Synthetic polypeptide
AEEEIRTTNPVATEEYGCSCSSGNLNQNFNSNQS

SEQ ID NO: 136982 - protein, 34 aa, Artificial Sequence
  Description of Artificial Sequence: Synthetic polypeptide
AEEEIRTTNPVATEEYGCSCSSGELQYFGSDNQA

SEQ ID NO: 136983 - protein, 35 aa, Artificial Sequence
  Description of Artificial Sequence: Synthetic polypeptide
DEEEIRTTNPVATEQYGCVCSTEDHAEGFGSDNQS

SEQ ID NO: 136984 - protein, 32 aa, Artificial Sequence
  Description of Artificial Sequence: Synthetic polypeptide
AEEEIRTTNPVATEEYGCSCSSGEHQYFGSDQ

SEQ ID NO: 136985 - protein, 35 aa, Artificial Sequence
  Description of Artificial Sequence: Synthetic polypeptide
DEEEIRTTNPVATEQYGCVCSTEDDNQENFNSDQS

SEQ ID NO: 136986 - protein, 34 aa, Artificial Sequence
  Description of Artificial Sequence: Synthetic polypeptide
TEEEIATTNPVATEPYGVVVSTNLDGNTGGDNNE

SEQ ID NO: 136987 - protein, 30 aa, Artificial Sequence
  Description of Artificial Sequence: Synthetic polypeptide
TEEEIATTNPVATEQYGCSCPWVDNQHIEQ

SEQ ID NO: 136988 - protein, 29 aa, Artificial Sequence
  Description of Artificial Sequence: Synthetic peptide
TEEEIATTNPVATEQYGEAPEVCQHEECK

SEQ ID NO: 136989 - protein, 34 aa, Artificial Sequence
  Description of Artificial Sequence: Synthetic polypeptide
DEEEISTTNPVATEQYGCVCSNWNHQENFGSDQS

SEQ ID NO: 136990 - protein, 34 aa, Artificial Sequence
  Description of Artificial Sequence: Synthetic polypeptide
DEEEISTTNPVATEQYGCVCSNWNHNQNFNSDQA

SEQ ID NO: 136991 - protein, 29 aa, Artificial Sequence
  Description of Artificial Sequence: Synthetic peptide
TEEEIATTNPVATEQYGEAPEVEIQHEEK

SEQ ID NO: 136992 - protein, 29 aa, Artificial Sequence
  Description of Artificial Sequence: Synthetic peptide
TEEEIATTNPVATEQYGESPWEDQHEEQF

SEQ ID NO: 136993 - protein, 29 aa, Artificial Sequence
  Description of Artificial Sequence: Synthetic peptide
TEEEIATTNPVATEQYGEYPWVDQHESEQ

SEQ ID NO: 136994 - protein, 28 aa, Artificial Sequence
  Description of Artificial Sequence: Synthetic peptide
TEEEIATTNPVATENYGEAPEVCQHEEK

SEQ ID NO: 136995 - protein, 34 aa, Artificial Sequence
  Description of Artificial Sequence: Synthetic polypeptide
DEEEIRTTNPVATEQYGCVCSTEDHENFGSETQP

SEQ ID NO: 136996 - protein, 31 aa, Artificial Sequence
  Description of Artificial Sequence: Synthetic polypeptide
TEEEIASVNPVSTEAYGVVSDNELQSTGGNQ

SEQ ID NO: 136997 - protein, 31 aa, Artificial Sequence
  Description of Artificial Sequence: Synthetic polypeptide
TEEEIASVNPVCYEQYGVVVSCDNLSQSGNQ

SEQ ID NO: 136998 - protein, 32 aa, Artificial Sequence
  Description of Artificial Sequence: Synthetic polypeptide
TEEEIASVNPVCTEQYGVVSCDNLSQSGGNYQ

SEQ ID NO: 136999 - protein, 32 aa, Artificial Sequence
  Description of Artificial Sequence: Synthetic polypeptide
TEEEIASVNPVCTEQYGVVSCINLSQSVGNNQ

SEQ ID NO: 137000 - protein, 34 aa, Artificial Sequence
  Description of Artificial Sequence: Synthetic polypeptide
DEEEIRTTNPVATEQYGCVCSTEDIQENFISQQS

SEQ ID NO: 137001 - protein, 34 aa, Artificial Sequence
  Description of Artificial Sequence: Synthetic polypeptide
DEEEISTTNPVATEQYGCVCSSGEHNQFFGSNQA

SEQ ID NO: 137002 - protein, 34 aa, Artificial Sequence
  Description of Artificial Sequence: Synthetic polypeptide
DEEEIRTTNPVATEQYGCVCSTEDHQEYFISEQT

SEQ ID NO: 137003 - protein, 32 aa, Artificial Sequence
  Description of Artificial Sequence: Synthetic polypeptide
TEEEIASVNPVCTEQYGVVSINELSQSTGNNQ

SEQ ID NO: 137004 - protein, 32 aa, Artificial Sequence
  Description of Artificial Sequence: Synthetic polypeptide
TEEEIASVNPVCTEQYGVVSINLSQSTGGNYQ

SEQ ID NO: 137005 - protein, 33 aa, Artificial Sequence
  Description of Artificial Sequence: Synthetic polypeptide
DEEEISTTNPVATEQYGCVCSSGEDQFFGSEQM

SEQ ID NO: 137006 - protein, 32 aa, Artificial Sequence
  Description of Artificial Sequence: Synthetic polypeptide
TEEEIASVNPVCTEQYGVVSYINSLSQSGGNQ

SEQ ID NO: 137007 - protein, 35 aa, Artificial Sequence
  Description of Artificial Sequence: Synthetic polypeptide
DEEEIRTTNPVATEQYGCVCSTEDHNQNFGSDTQA

SEQ ID NO: 137008 - protein, 35 aa, Artificial Sequence
  Description of Artificial Sequence: Synthetic polypeptide
DEEEIRTTNPVATEQYGCVCSTEDHNQEYFNSDQS

SEQ ID NO: 137009 - protein, 35 aa, Artificial Sequence
  Description of Artificial Sequence: Synthetic polypeptide
DEEEIRTTNPVATEQYGCVCSTEDHNQESFGSEQY

SEQ ID NO: 137010 - protein, 30 aa, Artificial Sequence
  Description of Artificial Sequence: Synthetic polypeptide
TEEEIASVNPVCYEQYGVVPSINLSQSVNQ

SEQ ID NO: 137011 - protein, 36 aa, Artificial Sequence
  Description of Artificial Sequence: Synthetic polypeptide
DEEEIRTTNPVATEQYGCVCSTEDHNQENFGSNTQS

SEQ ID NO: 137012 - protein, 30 aa, Artificial Sequence
  Description of Artificial Sequence: Synthetic polypeptide
TEEEIASVNPVCYEQYGVVSCINHSQSGNQ

SEQ ID NO: 137013 - protein, 31 aa, Artificial Sequence
  Description of Artificial Sequence: Synthetic polypeptide
TEEEIASVNPVCYEQYGVVSCLNLSQSGGNQ

SEQ ID NO: 137014 - protein, 31 aa, Artificial Sequence
  Description of Artificial Sequence: Synthetic polypeptide
TEEEIASVNPVCYEQYGVVSCNLSQSTVGNQ

SEQ ID NO: 137015 - protein, 32 aa, Artificial Sequence
  Description of Artificial Sequence: Synthetic polypeptide
DEEEISTTNPVATEQYGCVCSSEPQNFFSEQS

SEQ ID NO: 137016 - protein, 33 aa, Artificial Sequence
  Description of Artificial Sequence: Synthetic polypeptide
DEEEISTTNPVATEQYGCVCSSEPNQNFNSDQA

SEQ ID NO: 137017 - protein, 30 aa, Artificial Sequence
  Description of Artificial Sequence: Synthetic polypeptide
TEEEIASVNPVCYEQYGVVSINLSQSGGSQ

SEQ ID NO: 137018 - protein, 34 aa, Artificial Sequence
  Description of Artificial Sequence: Synthetic polypeptide
DEEEISTTNPVATEQYGCVCSSENHNQNFNSQQA

SEQ ID NO: 137019 - protein, 33 aa, Artificial Sequence
  Description of Artificial Sequence: Synthetic polypeptide
AEEEIRTTNPVATEEYGCISCINGSTDRGGNNY

SEQ ID NO: 137020 - protein, 33 aa, Artificial Sequence
  Description of Artificial Sequence: Synthetic polypeptide
DEEEIRTTNPVATEQYGCVCSSGEHAFFGSDQA

SEQ ID NO: 137021 - protein, 34 aa, Artificial Sequence
  Description of Artificial Sequence: Synthetic polypeptide
DEEEIRTTNPVATEQYGCVCSTAHNENFNSETQS

SEQ ID NO: 137022 - protein, 35 aa, Artificial Sequence
  Description of Artificial Sequence: Synthetic polypeptide
DEEEIRTTNPVATEQYGCVCSSPELQENFNSDNQS

SEQ ID NO: 137023 - protein, 34 aa, Artificial Sequence
  Description of Artificial Sequence: Synthetic polypeptide
DEEEIRTTNPVATEQYGCVCSSGEHNQNFNSNQS

SEQ ID NO: 137024 - protein, 34 aa, Artificial Sequence
  Description of Artificial Sequence: Synthetic polypeptide
TEEEIATTNPVAYEQYGVSVVGLNELSQSPGNND

SEQ ID NO: 137025 - protein, 28 aa, Artificial Sequence
  Description of Artificial Sequence: Synthetic peptide
TEEEIATTNPVCTEQYGEAPEVCQHEEK

SEQ ID NO: 137026 - protein, 34 aa, Artificial Sequence
  Description of Artificial Sequence: Synthetic polypeptide
TEEEIATTNPVSTEQYGSVSWNEGEKQRQRGDGH

SEQ ID NO: 137027 - protein, 34 aa, Artificial Sequence
  Description of Artificial Sequence: Synthetic polypeptide
TEEEIATTNPVVTEQYGSVSWNEGEGRQRGDTQD

SEQ ID NO: 137028 - protein, 35 aa, Artificial Sequence
  Description of Artificial Sequence: Synthetic polypeptide
DEEEIRTTNPVATEQYGCVCSSGEHNQNFGSQNQS

SEQ ID NO: 137029 - protein, 34 aa, Artificial Sequence
  Description of Artificial Sequence: Synthetic polypeptide
DEEEIRTTNPVATEQYGCVCSSGEHNQNFGSEQI

SEQ ID NO: 137030 - protein, 35 aa, Artificial Sequence
  Description of Artificial Sequence: Synthetic polypeptide
DEEEIRTTNPVATEQYGCVCSSGEHNQNFGSDNQV

SEQ ID NO: 137031 - protein, 35 aa, Artificial Sequence
  Description of Artificial Sequence: Synthetic polypeptide
AEEEIRTTNPVATEAYGVVSTTNQQQQANNGNGNE

SEQ ID NO: 137032 - protein, 34 aa, Artificial Sequence
  Description of Artificial Sequence: Synthetic polypeptide
DEEEIRTTNPVATEQYGCVCSSGEHQEGFQSEQS

SEQ ID NO: 137033 - protein, 35 aa, Artificial Sequence
  Description of Artificial Sequence: Synthetic polypeptide
AEEEIRTTNPVATEAYGVVSTTNQNQNQEQGNNVE

SEQ ID NO: 137034 - protein, 34 aa, Artificial Sequence
  Description of Artificial Sequence: Synthetic polypeptide
DEEEIRTTNPVATEQYGCVCSSGEHNQGFNSNQS

SEQ ID NO: 137035 - protein, 34 aa, Artificial Sequence
  Description of Artificial Sequence: Synthetic polypeptide
DEEEIRTTNPVATEQYGCVCSSGEHNQGFGSDDA

SEQ ID NO: 137036 - protein, 36 aa, Artificial Sequence
  Description of Artificial Sequence: Synthetic polypeptide
AEEEIRTTNPVATEAYGVVSTSVGNLQQGNIGNNQD

SEQ ID NO: 137037 - protein, 35 aa, Artificial Sequence
  Description of Artificial Sequence: Synthetic polypeptide
DEEEIRTTNPVATEQYGCVCSSGEHNQEFFGSNQA

SEQ ID NO: 137038 - protein, 33 aa, Artificial Sequence
  Description of Artificial Sequence: Synthetic polypeptide
TEEEICTTNPVAYEAYGSVVNTPAMVQRGNNEK

SEQ ID NO: 137039 - protein, 33 aa, Artificial Sequence
  Description of Artificial Sequence: Synthetic polypeptide
TEEEICTTNPVAYEQYGSVPVTAMTSQPPGSRP

SEQ ID NO: 137040 - protein, 34 aa, Artificial Sequence
  Description of Artificial Sequence: Synthetic polypeptide
DEEEIRTTNPVATEQYGCVCSSGEHINFGSNFQP

SEQ ID NO: 137041 - protein, 33 aa, Artificial Sequence
  Description of Artificial Sequence: Synthetic polypeptide
TEEEICTTNPVAYEQYGSVVPVTAMQSQPGKRP

SEQ ID NO: 137042 - protein, 34 aa, Artificial Sequence
  Description of Artificial Sequence: Synthetic polypeptide
TEEEICTTNPVGTQAWGSVVSTNMLSQSTGMNRW

SEQ ID NO: 137043 - protein, 34 aa, Artificial Sequence
  Description of Artificial Sequence: Synthetic polypeptide
DEEEIRTTNPVATEQYGCVCSSGEHNQHFGSEQS

SEQ ID NO: 137044 - protein, 34 aa, Artificial Sequence
  Description of Artificial Sequence: Synthetic polypeptide
DEEEIRTTNPVATEQYGCVCSSGEHQENFGSDQI

SEQ ID NO: 137045 - protein, 35 aa, Artificial Sequence
  Description of Artificial Sequence: Synthetic polypeptide
DEEEIRTTNPVATEQYGCVCSSGEHQEYFGSDNQA

SEQ ID NO: 137046 - protein, 34 aa, Artificial Sequence
  Description of Artificial Sequence: Synthetic polypeptide
DEEEIRTTNPVATEQYGCVCSSGEHQNFGSQTQA

SEQ ID NO: 137047 - protein, 37 aa, Artificial Sequence
  Description of Artificial Sequence: Synthetic polypeptide
AEEEIRTTNPVATEAYGVVSVSVVTNLQQGNNQNGQD

SEQ ID NO: 137048 - protein, 37 aa, Artificial Sequence
  Description of Artificial Sequence: Synthetic polypeptide
AEEEIRTTNPVATEAYGVVSVSVVTNLQQGNNEENQD

SEQ ID NO: 137049 - protein, 36 aa, Artificial Sequence
  Description of Artificial Sequence: Synthetic polypeptide
TEEEIATTNPVATEQYGVSVVPGCLNLSQRPGGNMD

SEQ ID NO: 137050 - protein, 36 aa, Artificial Sequence
  Description of Artificial Sequence: Synthetic polypeptide
TEEEIATTNPVATEQYGVSVVPHYLNELSQRPGNMD

SEQ ID NO: 137051 - protein, 37 aa, Artificial Sequence
  Description of Artificial Sequence: Synthetic polypeptide
AEEEIRTTNPVATEAYGVVSVSVVTNLQAGNNENLQD

SEQ ID NO: 137052 - protein, 34 aa, Artificial Sequence
  Description of Artificial Sequence: Synthetic polypeptide
DEEEISTTNPVATEQYGCVCSNWGNHQNFGSEAA

SEQ ID NO: 137053 - protein, 34 aa, Artificial Sequence
  Description of Artificial Sequence: Synthetic polypeptide
DEEEISTTNPVATEQYGCVCSNWGNHQNFGSDQA

SEQ ID NO: 137054 - protein, 35 aa, Artificial Sequence
  Description of Artificial Sequence: Synthetic polypeptide
TEEEIATTNPVAWEQYGSVSCTGQAQVRTVQNNER

SEQ ID NO: 137055 - protein, 37 aa, Artificial Sequence
  Description of Artificial Sequence: Synthetic polypeptide
AEEEIRTTNPVATEAYGVVSVSVTNNLQLNNGNNNQD

SEQ ID NO: 137056 - protein, 34 aa, Artificial Sequence
  Description of Artificial Sequence: Synthetic polypeptide
DEEEISTTNPVATEQYGCVCSNWGELQHFNSDQA

SEQ ID NO: 137057 - protein, 35 aa, Artificial Sequence
  Description of Artificial Sequence: Synthetic polypeptide
TEEEIATTNPVAYEQDGKVSSTANELSQQGENYRN

SEQ ID NO: 137058 - protein, 35 aa, Artificial Sequence
  Description of Artificial Sequence: Synthetic polypeptide
TEEEIATTNPVAYEQDGSVVSTANELSQQGEEYRN

SEQ ID NO: 137059 - protein, 34 aa, Artificial Sequence
  Description of Artificial Sequence: Synthetic polypeptide
DEEEIRTTNPVATEQYGCVCSSMEHQNFISDNQP

SEQ ID NO: 137060 - protein, 33 aa, Artificial Sequence
  Description of Artificial Sequence: Synthetic polypeptide
DEEEIRTTNPVATEQYGCVCSSGPHENFGSEQY

SEQ ID NO: 137061 - protein, 28 aa, Artificial Sequence
  Description of Artificial Sequence: Synthetic peptide
TEEEIATTNPVAYEQYGEAPEVPQHEEK

SEQ ID NO: 137062 - protein, 35 aa, Artificial Sequence
  Description of Artificial Sequence: Synthetic polypeptide
TEEEIATTNPVAYEQYGISVSTINEHQPNPGGHNT

SEQ ID NO: 137063 - protein, 34 aa, Artificial Sequence
  Description of Artificial Sequence: Synthetic polypeptide
TEEEIATTNPVAYEQYGNVSTANEDSQNGENYHN

SEQ ID NO: 137064 - protein, 34 aa, Artificial Sequence
  Description of Artificial Sequence: Synthetic polypeptide
DEEEIRTTNPVATEQYGCVCSSGNHEGFGSETQT

SEQ ID NO: 137065 - protein, 34 aa, Artificial Sequence
  Description of Artificial Sequence: Synthetic polypeptide
DEEEIRTTNPVATEQYGCVCSSGETQFFGSETQS

SEQ ID NO: 137066 - protein, 34 aa, Artificial Sequence
  Description of Artificial Sequence: Synthetic polypeptide
DEEEIRTTNPVATEQYGCVCSSGEPQHFNSENQS

SEQ ID NO: 137067 - protein, 37 aa, Artificial Sequence
  Description of Artificial Sequence: Synthetic polypeptide
AEEEIRTTNPVATEAYGVVSVSVSTNLQLNNGNNNQD

SEQ ID NO: 137068 - protein, 37 aa, Artificial Sequence
  Description of Artificial Sequence: Synthetic polypeptide
AEEEIRTTNPVATEAYGVVSVSVVTNNLGQNGTNNQM

SEQ ID NO: 137069 - protein, 31 aa, Artificial Sequence
  Description of Artificial Sequence: Synthetic polypeptide
TEEEIASVNPVCTEQYGVVCSWELQSGSNQG

SEQ ID NO: 137070 - protein, 32 aa, Artificial Sequence
  Description of Artificial Sequence: Synthetic polypeptide
TEEEIRTTNPVATEPYGKIHTHEESQNRVGTF

SEQ ID NO: 137071 - protein, 35 aa, Artificial Sequence
  Description of Artificial Sequence: Synthetic polypeptide
DEEEIRTTNPVATEQYGCVCSNWGELQESFGSEQA

SEQ ID NO: 137072 - protein, 35 aa, Artificial Sequence
  Description of Artificial Sequence: Synthetic polypeptide
DEEEIRTTNPVATEQYGCVCSNWELQEHFNSENQA

SEQ ID NO: 137073 - protein, 34 aa, Artificial Sequence
  Description of Artificial Sequence: Synthetic polypeptide
DEEEISTTNPVATEQYGCVCSNTEDQENFNSDQS

SEQ ID NO: 137074 - protein, 34 aa, Artificial Sequence
  Description of Artificial Sequence: Synthetic polypeptide
DEEEISTTNPVATEQYGCVCSNTEDQENFGSDQS

SEQ ID NO: 137075 - protein, 34 aa, Artificial Sequence
  Description of Artificial Sequence: Synthetic polypeptide
DEEEIRTTNPVATEQYGCVCSNWEHQSFGSETQA

SEQ ID NO: 137076 - protein, 34 aa, Artificial Sequence
  Description of Artificial Sequence: Synthetic polypeptide
DEEEIRTTNPVATEQYGCVCSNWEHQNFNSQTQA

SEQ ID NO: 137077 - protein, 34 aa, Artificial Sequence
  Description of Artificial Sequence: Synthetic polypeptide
DEEEIRTTNPVATEQYGCVCSNWEHQEYFGSEQS

SEQ ID NO: 137078 - protein, 34 aa, Artificial Sequence
  Description of Artificial Sequence: Synthetic polypeptide
DEEEIRTTNPVATEQYGCVCSNWEHQESFGSDQN

SEQ ID NO: 137079 - protein, 34 aa, Artificial Sequence
  Description of Artificial Sequence: Synthetic polypeptide
DEEEISTTNPVATEQYGCVCSNTEDDQYFGSEQD

SEQ ID NO: 137080 - protein, 36 aa, Artificial Sequence
  Description of Artificial Sequence: Synthetic polypeptide
TEEEIRTTNPVATEQYGSVSDNGVGGQTEDNGNEDD

SEQ ID NO: 137081 - protein, 35 aa, Artificial Sequence
  Description of Artificial Sequence: Synthetic polypeptide
DEEEIRTTNPVATEQYGCVCSNWENHNQNFGSEQS

SEQ ID NO: 137082 - protein, 35 aa, Artificial Sequence
  Description of Artificial Sequence: Synthetic polypeptide
DEEEIRTTNPVATEQYGCVCSNWEHQENFGSENQA

SEQ ID NO: 137083 - protein, 36 aa, Artificial Sequence
  Description of Artificial Sequence: Synthetic polypeptide
TEEEIRTTNPVATEQYGSVSETTPAGPNMRNGMNPV

SEQ ID NO: 137084 - protein, 35 aa, Artificial Sequence
  Description of Artificial Sequence: Synthetic polypeptide
DEEEIRTTNPVATEQYGCVCSNWEHQEHFGSNTQS

SEQ ID NO: 137085 - protein, 35 aa, Artificial Sequence
  Description of Artificial Sequence: Synthetic polypeptide
DEEEIRTTNPVATEQYGCVCSNWEHQEFFGSDNQE

SEQ ID NO: 137086 - protein, 34 aa, Artificial Sequence
  Description of Artificial Sequence: Synthetic polypeptide
DEEEIRTTNPVATEQYGCVCSNWEHNQSFNSEQE

SEQ ID NO: 137087 - protein, 34 aa, Artificial Sequence
  Description of Artificial Sequence: Synthetic polypeptide
DEEEIRTTNPVATEQYGCVCSNWEHNQNFGSDQA

SEQ ID NO: 137088 - protein, 35 aa, Artificial Sequence
  Description of Artificial Sequence: Synthetic polypeptide
TEEEIRTTNPVATEQYGSVSPDVSLAQEHGVHPSL

SEQ ID NO: 137089 - protein, 35 aa, Artificial Sequence
  Description of Artificial Sequence: Synthetic polypeptide
TEEEIRTTNPVATEQYGSVSPDVSLAQMHGELPPN

SEQ ID NO: 137090 - protein, 35 aa, Artificial Sequence
  Description of Artificial Sequence: Synthetic polypeptide
TEEEIRTTNPVATEQYGSVSPDVSLAQMHGVAPPE

SEQ ID NO: 137091 - protein, 35 aa, Artificial Sequence
  Description of Artificial Sequence: Synthetic polypeptide
TEEEIRTTNPVATEQYGSVSPDVSTAGMHGEHNPI

SEQ ID NO: 137092 - protein, 34 aa, Artificial Sequence
  Description of Artificial Sequence: Synthetic polypeptide
DEEEIRTTNPVATEQYGCVCSNWEHQENFGSDQA

SEQ ID NO: 137093 - protein, 35 aa, Artificial Sequence
  Description of Artificial Sequence: Synthetic polypeptide
DEEEIRTTNPVATEQYGCVCSNWENLAENFGSQQA

SEQ ID NO: 137094 - protein, 34 aa, Artificial Sequence
  Description of Artificial Sequence: Synthetic polypeptide
DEEEIRTTNPVATEQYGCVCSNWEPHQNFGSDQS

SEQ ID NO: 137095 - protein, 34 aa, Artificial Sequence
  Description of Artificial Sequence: Synthetic polypeptide
DEEEISTTNPVATEQYGCVCSNTEEHQNFGSDQG

SEQ ID NO: 137096 - protein, 36 aa, Artificial Sequence
  Description of Artificial Sequence: Synthetic polypeptide
AEEEIRATNPCATEQYGSVSTVNNQLNNQIGTNIVD

SEQ ID NO: 137097 - protein, 36 aa, Artificial Sequence
  Description of Artificial Sequence: Synthetic polypeptide
AEEEIRATNPCATEQYGSVSTVNNQLLQQIGTNNVD

SEQ ID NO: 137098 - protein, 36 aa, Artificial Sequence
  Description of Artificial Sequence: Synthetic polypeptide
AEEEIRATNPCATEQYGSVSTVNLLQMNQIGTNNVD

SEQ ID NO: 137099 - protein, 36 aa, Artificial Sequence
  Description of Artificial Sequence: Synthetic polypeptide
AEEEIRATNPCATEQYGSVSTVANQLNQQIGTNNVE

SEQ ID NO: 137100 - protein, 35 aa, Artificial Sequence
  Description of Artificial Sequence: Synthetic polypeptide
AEEEIRATNPCATEQYGSVSTNQNNLLEQGTNNND

SEQ ID NO: 137101 - protein, 35 aa, Artificial Sequence
  Description of Artificial Sequence: Synthetic polypeptide
AEEEIRATNPCATEQYGSVSTNGNNLDEQGTNNVD

SEQ ID NO: 137102 - protein, 35 aa, Artificial Sequence
  Description of Artificial Sequence: Synthetic polypeptide
AEEEIRATNPCATEQYGSVSTEQQLNQQIGTNVTD

SEQ ID NO: 137103 - protein, 35 aa, Artificial Sequence
  Description of Artificial Sequence: Synthetic polypeptide
AEEEIRATNPCATEQYGSVSTEQNQGNQQIGTNVD

SEQ ID NO: 137104 - protein, 35 aa, Artificial Sequence
  Description of Artificial Sequence: Synthetic polypeptide
AEEEIRATNPCATEQYGSVSTEQNNNLEQGTNNVD

SEQ ID NO: 137105 - protein, 35 aa, Artificial Sequence
  Description of Artificial Sequence: Synthetic polypeptide
AEEEIRATNPCATEQYGSVSTENQLMEEIGTNQME

SEQ ID NO: 137106 - protein, 35 aa, Artificial Sequence
  Description of Artificial Sequence: Synthetic polypeptide
DEEEIRTTNPVATEQYGCVCSNWGEDDQNFGSNQS

SEQ ID NO: 137107 - protein, 35 aa, Artificial Sequence
  Description of Artificial Sequence: Synthetic polypeptide
DEEEISTTNPVATEQYGCVCSNTEHNQEGFNSQQN

SEQ ID NO: 137108 - protein, 36 aa, Artificial Sequence
  Description of Artificial Sequence: Synthetic polypeptide
AEEEIRATNPCATEQYGSVSTENNQNLNQQIGTNTD

SEQ ID NO: 137109 - protein, 36 aa, Artificial Sequence
  Description of Artificial Sequence: Synthetic polypeptide
AEEEIRATNPCATEQYGSVSTENNQLQNQQIGTNVA

SEQ ID NO: 137110 - protein, 36 aa, Artificial Sequence
  Description of Artificial Sequence: Synthetic polypeptide
AEEEIRATNPCATEQYGSVSTENNQLQGNQIGTNVD

SEQ ID NO: 137111 - protein, 35 aa, Artificial Sequence
  Description of Artificial Sequence: Synthetic polypeptide
AEEEIRATNPCATEQYGSVSTENNQLEEIGTNLME

SEQ ID NO: 137112 - protein, 35 aa, Artificial Sequence
  Description of Artificial Sequence: Synthetic polypeptide
DEEEISTTNPVATEQYGCVCSNTEELQYFNSNNQD

SEQ ID NO: 137113 - protein, 34 aa, Artificial Sequence
  Description of Artificial Sequence: Synthetic polypeptide
DEEEISTTNPVATEQYGCVCSNTEELQNFFSEQS

SEQ ID NO: 137114 - protein, 35 aa, Artificial Sequence
  Description of Artificial Sequence: Synthetic polypeptide
DEEEISTTNPVATEQYGCVCSNTEELNQNFGSDQF

SEQ ID NO: 137115 - protein, 34 aa, Artificial Sequence
  Description of Artificial Sequence: Synthetic polypeptide
DEEEIRTTNPVATEQYGCVCSNWETQENFGSDQS

SEQ ID NO: 137116 - protein, 34 aa, Artificial Sequence
  Description of Artificial Sequence: Synthetic polypeptide
DEEEISTTNPVATEQYGCVCSNTEEHQNFGSEQA

SEQ ID NO: 137117 - protein, 33 aa, Artificial Sequence
  Description of Artificial Sequence: Synthetic polypeptide
DEEEIRTTNPVATEQYGCVCSNWEHINFGSDQS

SEQ ID NO: 137118 - protein, 34 aa, Artificial Sequence
  Description of Artificial Sequence: Synthetic polypeptide
DEEEISTTNPVATEQYGCVCSNTEHQENFGSEQQ

SEQ ID NO: 137119 - protein, 34 aa, Artificial Sequence
  Description of Artificial Sequence: Synthetic polypeptide
DEEEIRTTNPVATEQYGCVCSNWEHDQNFGSDQA

SEQ ID NO: 137120 - protein, 36 aa, Artificial Sequence
  Description of Artificial Sequence: Synthetic polypeptide
TEEEIRTTNPVATEQYGSVSSGTFNDGQGEGGEEGG

SEQ ID NO: 137121 - protein, 36 aa, Artificial Sequence
  Description of Artificial Sequence: Synthetic polypeptide
TEEEIRTTNPVATEQYGSVVPNCTSNALSQRVEIYE

SEQ ID NO: 137122 - protein, 36 aa, Artificial Sequence
  Description of Artificial Sequence: Synthetic polypeptide
AEEEICTTNPVATEQYGVVSTTNTNLQAGNNAEQQE

SEQ ID NO: 137123 - protein, 31 aa, Artificial Sequence
  Description of Artificial Sequence: Synthetic polypeptide
AEEEICTTNPVATEQYGVVAVTEVEQEEEQE

SEQ ID NO: 137124 - protein, 30 aa, Artificial Sequence
  Description of Artificial Sequence: Synthetic polypeptide
AEEEICTTNPVATEQYGVVAVEVVEQSEEE

SEQ ID NO: 137125 - protein, 32 aa, Artificial Sequence
  Description of Artificial Sequence: Synthetic polypeptide
AEEEICTTNPVATEQYGVVAVEVNEQQGEDEE

SEQ ID NO: 137126 - protein, 30 aa, Artificial Sequence
  Description of Artificial Sequence: Synthetic polypeptide
AEEEICTTNPVATEQYGVVAVEVEQQEETD

SEQ ID NO: 137127 - protein, 36 aa, Artificial Sequence
  Description of Artificial Sequence: Synthetic polypeptide
TEEEIRTTNPVATEQYGSVVTMTDGDNGQRFNDNGQ

SEQ ID NO: 137128 - protein, 33 aa, Artificial Sequence
  Description of Artificial Sequence: Synthetic polypeptide
DEEEISTTNPVATEQYGCVCSMWEHQNGGSEQP

SEQ ID NO: 137129 - protein, 35 aa, Artificial Sequence
  Description of Artificial Sequence: Synthetic polypeptide
TEEEIRTTNPVATEQYGTTVPFTNPSQDRVANNDS

SEQ ID NO: 137130 - protein, 35 aa, Artificial Sequence
  Description of Artificial Sequence: Synthetic polypeptide
TEEEIRTTNPVATEQYGSVVGTFNDGDEEGGGNTN

SEQ ID NO: 137131 - protein, 33 aa, Artificial Sequence
  Description of Artificial Sequence: Synthetic polypeptide
TEEEIRTTNPVATERYGKIAQTNLSDVDGGNNE

SEQ ID NO: 137132 - protein, 35 aa, Artificial Sequence
  Description of Artificial Sequence: Synthetic polypeptide
DEEEIRTTNPVATEAYGTVSTSGTNNNEQGNNQTN

SEQ ID NO: 137133 - protein, 35 aa, Artificial Sequence
  Description of Artificial Sequence: Synthetic polypeptide
DEEEIRTTNPVATEAYGTVSTSNTNDEQGTNTNQQ

SEQ ID NO: 137134 - protein, 35 aa, Artificial Sequence
  Description of Artificial Sequence: Synthetic polypeptide
DEEEIRTTNPVATEAYGTVSTSNTNTEQGSNNNQF

SEQ ID NO: 137135 - protein, 36 aa, Artificial Sequence
  Description of Artificial Sequence: Synthetic polypeptide
DEEEIRTTNPVAYEQYGESVSPSVNPELFRVGEPVG

SEQ ID NO: 137136 - protein, 35 aa, Artificial Sequence
  Description of Artificial Sequence: Synthetic polypeptide
DEEEIRTTNPVATEAYGTVSTSTNNDEQGTNTNQF

SEQ ID NO: 137137 - protein, 34 aa, Artificial Sequence
  Description of Artificial Sequence: Synthetic polypeptide
DEEEISTTNPVATEQYGCVCSMTGELQGFDSEQD

SEQ ID NO: 137138 - protein, 34 aa, Artificial Sequence
  Description of Artificial Sequence: Synthetic polypeptide
DEEEISTTNPVATEQYGCVCSMTGEHQYFGSDQA

SEQ ID NO: 137139 - protein, 35 aa, Artificial Sequence
  Description of Artificial Sequence: Synthetic polypeptide
DEEEISTTNPVATEQYGCVCSMTGEHQAFGSNTQS

SEQ ID NO: 137140 - protein, 31 aa, Artificial Sequence
  Description of Artificial Sequence: Synthetic polypeptide
TEEEIRTTNPVATKRFGCVVATVALDQGGQG

SEQ ID NO: 137141 - protein, 34 aa, Artificial Sequence
  Description of Artificial Sequence: Synthetic polypeptide
TEEEIRTTNPVATERYGKISTANLSDVDGGNNEG

SEQ ID NO: 137142 - protein, 35 aa, Artificial Sequence
  Description of Artificial Sequence: Synthetic polypeptide
DEEEIRTTNPVATEQYGCVCSNTPYPQENFNSEQS

SEQ ID NO: 137143 - protein, 34 aa, Artificial Sequence
  Description of Artificial Sequence: Synthetic polypeptide
DEEEIRTTNPVATEQYGCVCSNTVEHENFNSDQA

SEQ ID NO: 137144 - protein, 34 aa, Artificial Sequence
  Description of Artificial Sequence: Synthetic polypeptide
DEEEIRTTNPVATEQYGCVCSNTYHQENFPSDQS

SEQ ID NO: 137145 - protein, 35 aa, Artificial Sequence
  Description of Artificial Sequence: Synthetic polypeptide
DEEEIRTTNPVATEQYGCVCSNWEELQENFGSQQA

SEQ ID NO: 137146 - protein, 36 aa, Artificial Sequence
  Description of Artificial Sequence: Synthetic polypeptide
TEEEIRTTNPVATEQYGSVSSTTPAGPNMRNGMNPV

SEQ ID NO: 137147 - protein, 34 aa, Artificial Sequence
  Description of Artificial Sequence: Synthetic polypeptide
DEEEIRTTNPVATEQYGCVCSNWEELAYFGSQQS

SEQ ID NO: 137148 - protein, 34 aa, Artificial Sequence
  Description of Artificial Sequence: Synthetic polypeptide
DEEEIRTTNPVATEQYGCVCSNWEEHQSFGSEQE

SEQ ID NO: 137149 - protein, 35 aa, Artificial Sequence
  Description of Artificial Sequence: Synthetic polypeptide
DEEEIRTTNPVATEQYGCVCSNWEEHQENGNSDQL

SEQ ID NO: 137150 - protein, 36 aa, Artificial Sequence
  Description of Artificial Sequence: Synthetic polypeptide
AEEEICTTNPVATEQYGVVSVTVTNLQQGTNNNEDD

SEQ ID NO: 137151 - protein, 33 aa, Artificial Sequence
  Description of Artificial Sequence: Synthetic polypeptide
DEEEISTTNPVATEQYGCVCSNSEHQYFGSEQF

SEQ ID NO: 137152 - protein, 36 aa, Artificial Sequence
  Description of Artificial Sequence: Synthetic polypeptide
AEEEICTTNPVATEQYGVVSVTVTNLQQGNNQEQQD

SEQ ID NO: 137153 - protein, 36 aa, Artificial Sequence
  Description of Artificial Sequence: Synthetic polypeptide
AEEEICTTNPVATEQYGVVSVTTTNLQQGNGNNEAD

SEQ ID NO: 137154 - protein, 36 aa, Artificial Sequence
  Description of Artificial Sequence: Synthetic polypeptide
AEEEICTTNPVATEQYGVVSVTTNLQQQGTGNNNDD

SEQ ID NO: 137155 - protein, 34 aa, Artificial Sequence
  Description of Artificial Sequence: Synthetic polypeptide
DEEEIRTTNPVATEQYGCVCSNWEDQENFGSDQT

SEQ ID NO: 137156 - protein, 34 aa, Artificial Sequence
  Description of Artificial Sequence: Synthetic polypeptide
DEEEIRTTNPVATEQYGCVCSNWEDQEFFNSDQE

SEQ ID NO: 137157 - protein, 36 aa, Artificial Sequence
  Description of Artificial Sequence: Synthetic polypeptide
AEEEICTTNPVATEQYGVVSVTTNLEQGGNGNNEDD

SEQ ID NO: 137158 - protein, 35 aa, Artificial Sequence
  Description of Artificial Sequence: Synthetic polypeptide
TEEEIRTTNPVATEQYGSVSTSNTTEEREVVELQL

SEQ ID NO: 137159 - protein, 36 aa, Artificial Sequence
  Description of Artificial Sequence: Synthetic polypeptide
TEEEIRTTNPVATEQYGSVSTTSNTVEEREVVELND

SEQ ID NO: 137160 - protein, 36 aa, Artificial Sequence
  Description of Artificial Sequence: Synthetic polypeptide
AEEEICTTNPVATEQYGVVSVTNTNLQSGNNVNNQD

SEQ ID NO: 137161 - protein, 34 aa, Artificial Sequence
  Description of Artificial Sequence: Synthetic polypeptide
DEEEISTTNPVATEQYGCVCSNSEDHQHFGSNQD

SEQ ID NO: 137162 - protein, 36 aa, Artificial Sequence
  Description of Artificial Sequence: Synthetic polypeptide
AEEEICTTNPVATEQYGVVSVTNTNLQQGNNANQQD

SEQ ID NO: 137163 - protein, 36 aa, Artificial Sequence
  Description of Artificial Sequence: Synthetic polypeptide
AEEEICTTNPVATEQYGVVSVTNTNLQAGNNVQEQD

SEQ ID NO: 137164 - protein, 36 aa, Artificial Sequence
  Description of Artificial Sequence: Synthetic polypeptide
AEEEICTTNPVATEQYGVVSVTNTNLQAGNNNQQEE

SEQ ID NO: 137165 - protein, 36 aa, Artificial Sequence
  Description of Artificial Sequence: Synthetic polypeptide
AEEEICTTNPVATEQYGVVSVTNTNLGQAGNGNQND

SEQ ID NO: 137166 - protein, 33 aa, Artificial Sequence
  Description of Artificial Sequence: Synthetic polypeptide
DEEEIRTTNPVATEQYGCVCSNWEHANFISDQS

SEQ ID NO: 137167 - protein, 36 aa, Artificial Sequence
  Description of Artificial Sequence: Synthetic polypeptide
AEEEIRTTNPVATEAYGSVSTTNQQLGNNQGNEGQE

SEQ ID NO: 137168 - protein, 33 aa, Artificial Sequence
  Description of Artificial Sequence: Synthetic polypeptide
DEEEISTTNPVATEQYGCVCSNTEHQENFLSDQ

SEQ ID NO: 137169 - protein, 36 aa, Artificial Sequence
  Description of Artificial Sequence: Synthetic polypeptide
AEEEIRATNPCATEQYGSVSTVNNQLNNQQIGTNVD

SEQ ID NO: 137170 - protein, 36 aa, Artificial Sequence
  Description of Artificial Sequence: Synthetic polypeptide
AEEEIRTTNPVATEAYGSVSTTNLNNQQATTNVATE

SEQ ID NO: 137171 - protein, 36 aa, Artificial Sequence
  Description of Artificial Sequence: Synthetic polypeptide
AEEEIRTTNPVATEAYGSVSTTNLNNQNQATNVATE

SEQ ID NO: 137172 - protein, 35 aa, Artificial Sequence
  Description of Artificial Sequence: Synthetic polypeptide
AEEEIRTTNPVATEAYGSVSTTNLLQGSTTEEEDE

SEQ ID NO: 137173 - protein, 34 aa, Artificial Sequence
  Description of Artificial Sequence: Synthetic polypeptide
DEEEISTTNPVATEQYGCVCSNWEDLQHFGSEQD

SEQ ID NO: 137174 - protein, 36 aa, Artificial Sequence
  Description of Artificial Sequence: Synthetic polypeptide
AEEEIRTTNPVATEAYGSVSTTNGNNQDEGTNNATE

SEQ ID NO: 137175 - protein, 36 aa, Artificial Sequence
  Description of Artificial Sequence: Synthetic polypeptide
AEEEIRTTNPVATEAYGSVSTTNDNNQQGATNVATE

SEQ ID NO: 137176 - protein, 36 aa, Artificial Sequence
  Description of Artificial Sequence: Synthetic polypeptide
AEEEIRTTNPVATEAYGSVSTSNNQQGTQQGTNQED

SEQ ID NO: 137177 - protein, 36 aa, Artificial Sequence
  Description of Artificial Sequence: Synthetic polypeptide
AEEEIRTTNPVATEAYGSVSTSNNQANTEQGNNNDT

SEQ ID NO: 137178 - protein, 33 aa, Artificial Sequence
  Description of Artificial Sequence: Synthetic polypeptide
DEEEIRTTNPVAYEQYGCVCSWEPHQNFGSDQS

SEQ ID NO: 137179 - protein, 36 aa, Artificial Sequence
  Description of Artificial Sequence: Synthetic polypeptide
AEEEIRTTNPVATEAYGSVSTTNLNNQQEATNNATE

SEQ ID NO: 137180 - protein, 35 aa, Artificial Sequence
  Description of Artificial Sequence: Synthetic polypeptide
DEEEISTTNPVATEQYGCVCSNTPLQENFGSETQL

SEQ ID NO: 137181 - protein, 33 aa, Artificial Sequence
  Description of Artificial Sequence: Synthetic polypeptide
DEEEISTTNPVATEQYGCVCSNTPHANFNSEQG

SEQ ID NO: 137182 - protein, 36 aa, Artificial Sequence
  Description of Artificial Sequence: Synthetic polypeptide
AEEEIRTTNPVATEAYGSVSTNQLNNQQEATNVATE

SEQ ID NO: 137183 - protein, 33 aa, Artificial Sequence
  Description of Artificial Sequence: Synthetic polypeptide
DEEEIRTTNPVAYEQYGCVCWNTNHQGFDSDQA

SEQ ID NO: 137184 - protein, 33 aa, Artificial Sequence
  Description of Artificial Sequence: Synthetic polypeptide
DEEEIRTTNPVAYEQYGCVCWWNHNQYFNSDQS

SEQ ID NO: 137185 - protein, 35 aa, Artificial Sequence
  Description of Artificial Sequence: Synthetic polypeptide
AEEEIRTTNPVATEAYGSVSTDTQNGNVEQGTEEN

SEQ ID NO: 137186 - protein, 33 aa, Artificial Sequence
  Description of Artificial Sequence: Synthetic polypeptide
AEEEIRTTNPCAYEQWGSVYCTDNDQHNGHNGI

SEQ ID NO: 137187 - protein, 33 aa, Artificial Sequence
  Description of Artificial Sequence: Synthetic polypeptide
DEAAIRTTNPVATEQYGCVCSTGEHQNFGSEQS

SEQ ID NO: 137188 - protein, 36 aa, Artificial Sequence
  Description of Artificial Sequence: Synthetic polypeptide
DEEEISTTNPVATEQYGCVCSNTNDHQENSGSDNQL

SEQ ID NO: 137189 - protein, 35 aa, Artificial Sequence
  Description of Artificial Sequence: Synthetic polypeptide
DEEEISTTNPVATEQYGCVCSNTNDDQENFGSEQA

SEQ ID NO: 137190 - protein, 34 aa, Artificial Sequence
  Description of Artificial Sequence: Synthetic polypeptide
DEEEISTTNPVATEQYGCVCSNTPHQNFGSQTQL

SEQ ID NO: 137191 - protein, 36 aa, Artificial Sequence
  Description of Artificial Sequence: Synthetic polypeptide
AEEEIRTTNPVATEAYGSVSTTNLQNLQEATNVATE

SEQ ID NO: 137192 - protein, 34 aa, Artificial Sequence
  Description of Artificial Sequence: Synthetic polypeptide
DEEEIRTTNPVATEQYGCVCSNWGEHQNFGSQQS

SEQ ID NO: 137193 - protein, 34 aa, Artificial Sequence
  Description of Artificial Sequence: Synthetic polypeptide
DEEEIRTTNPVATEQYGCVCSNWGEHQNFGSQQT

SEQ ID NO: 137194 - protein, 35 aa, Artificial Sequence
  Description of Artificial Sequence: Synthetic polypeptide
DEEEIRTTNPVATEQYGCVCSNWGELQENFNSDQA

SEQ ID NO: 137195 - protein, 35 aa, Artificial Sequence
  Description of Artificial Sequence: Synthetic polypeptide
DEEEIRTTNPVATEQYGCVCSNWGELQEFFGSDQS

SEQ ID NO: 137196 - protein, 36 aa, Artificial Sequence
  Description of Artificial Sequence: Synthetic polypeptide
TEEEIRTTNPVATEPYGSLVPNATSNELSQRVTNYE

SEQ ID NO: 137197 - protein, 36 aa, Artificial Sequence
  Description of Artificial Sequence: Synthetic polypeptide
AEEEIRTTNPVATEAYGSVSTTNQNQNQEQGTNQNE

SEQ ID NO: 137198 - protein, 35 aa, Artificial Sequence
  Description of Artificial Sequence: Synthetic polypeptide
AEEEIRTTNPVATEAYGSVSTTNQNQNENNNNATE

SEQ ID NO: 137199 - protein, 35 aa, Artificial Sequence
  Description of Artificial Sequence: Synthetic polypeptide
DEEEIRTTNPVATEQYGCVCSNWGEHQYFGSENQI

SEQ ID NO: 137200 - protein, 37 aa, Artificial Sequence
  Description of Artificial Sequence: Synthetic polypeptide
AEEEIRTTNPVATEAYGSVSTTNQLQNGTEQGTNVVE

SEQ ID NO: 137201 - protein, 36 aa, Artificial Sequence
  Description of Artificial Sequence: Synthetic polypeptide
AEEEIRTTNPVATEAYGSVSTTNQLLQNNQQGEIGE

SEQ ID NO: 137202 - protein, 36 aa, Artificial Sequence
  Description of Artificial Sequence: Synthetic polypeptide
AEEEIRTTNPVATEAYGSVSTTNNQVGTEAGTNQDN

SEQ ID NO: 137203 - protein, 35 aa, Artificial Sequence
  Description of Artificial Sequence: Synthetic polypeptide
AEEEIRTTNPVATEAYGSVSTTNNQQQQNQISEGD

SEQ ID NO: 137204 - protein, 34 aa, Artificial Sequence
  Description of Artificial Sequence: Synthetic polypeptide
DEEEIRTTNPVATEQYGCVCSNWGEHQNSNSDQS

SEQ ID NO: 137205 - protein, 35 aa, Artificial Sequence
  Description of Artificial Sequence: Synthetic polypeptide
AEEEIRTTNPVATEAYGSVSTTNNQQQNNQINEED

SEQ ID NO: 137206 - protein, 36 aa, Artificial Sequence
  Description of Artificial Sequence: Synthetic polypeptide
AEEEIRTTNPVATEAYGSVSTTNNQQQGNQNANEED

SEQ ID NO: 137207 - protein, 36 aa, Artificial Sequence
  Description of Artificial Sequence: Synthetic polypeptide
AEEEIRTTNPVATEAYGSVSTTNNQQGTEQGTINAD

SEQ ID NO: 137208 - protein, 35 aa, Artificial Sequence
  Description of Artificial Sequence: Synthetic polypeptide
AEEEIRTTNPVATEAYGSVSTTNNQNQTNQINEGD

SEQ ID NO: 137209 - protein, 36 aa, Artificial Sequence
  Description of Artificial Sequence: Synthetic polypeptide
AEEEIRTTNPVATEAYGSVSTTNNQNNQGNQENEED

SEQ ID NO: 137210 - protein, 37 aa, Artificial Sequence
  Description of Artificial Sequence: Synthetic polypeptide
AEEEIRTTNPVATEAYGSVSTTNNQLQQGNQIGEEGD

SEQ ID NO: 137211 - protein, 36 aa, Artificial Sequence
  Description of Artificial Sequence: Synthetic polypeptide
AEEEIRTTNPVATEAYGSVSTTNNQLQNNNQANEED

SEQ ID NO: 137212 - protein, 34 aa, Artificial Sequence
  Description of Artificial Sequence: Synthetic polypeptide
DEEEIRTTNPVATEQYGCVCSNWGEHQNFNSDQS

SEQ ID NO: 137213 - protein, 35 aa, Artificial Sequence
  Description of Artificial Sequence: Synthetic polypeptide
AEEEIRTTNPVATEAYGSVSTTNNNTNNNIGTNDE

SEQ ID NO: 137214 - protein, 36 aa, Artificial Sequence
  Description of Artificial Sequence: Synthetic polypeptide
AEEEIRTTNPVATEAYGSVSTTNNNLQANEQGTDEM

SEQ ID NO: 137215 - protein, 33 aa, Artificial Sequence
  Description of Artificial Sequence: Synthetic polypeptide
DEAAIRTTNPVATEQYGCVCSTGEHQNFGSDQS

SEQ ID NO: 137216 - protein, 34 aa, Artificial Sequence
  Description of Artificial Sequence: Synthetic polypeptide
DEEEISTTNPVATEQYGCVCSNTEHQESFGSQQE

SEQ ID NO: 137217 - protein, 35 aa, Artificial Sequence
  Description of Artificial Sequence: Synthetic polypeptide
TEEEIRTTNPVATEQYGCVCNTEALNQNFGSNNQA

SEQ ID NO: 137218 - protein, 36 aa, Artificial Sequence
  Description of Artificial Sequence: Synthetic polypeptide
TEEEIRTTNPVATEQYGQCVCNTGNLNQNFGSDNQM

SEQ ID NO: 137219 - protein, 36 aa, Artificial Sequence
  Description of Artificial Sequence: Synthetic polypeptide
AEEEIRATNPCATEQYGSVSTVTNQLGNQQQGTNVD

SEQ ID NO: 137220 - protein, 35 aa, Artificial Sequence
  Description of Artificial Sequence: Synthetic polypeptide
DEEEISTTNPVATEQYGCVCSNTGEDLQNFGSEQA

SEQ ID NO: 137221 - protein, 36 aa, Artificial Sequence
  Description of Artificial Sequence: Synthetic polypeptide
DEEEISTTNPVATEQYGCVCSNTGEDLNQNFGSNQG

SEQ ID NO: 137222 - protein, 34 aa, Artificial Sequence
  Description of Artificial Sequence: Synthetic polypeptide
DEEEISTTNPVATEQYGCVCSNTGAPQNFGSEQA

SEQ ID NO: 137223 - protein, 34 aa, Artificial Sequence
  Description of Artificial Sequence: Synthetic polypeptide
DEEEISTTNPVATEQYGCVCSNTETQENSGSDQL

SEQ ID NO: 137224 - protein, 35 aa, Artificial Sequence
  Description of Artificial Sequence: Synthetic polypeptide
AEEEIRATNPCATEQYGSVSTVNQQNQQIGTNPVD

SEQ ID NO: 137225 - protein, 34 aa, Artificial Sequence
  Description of Artificial Sequence: Synthetic polypeptide
DEEEISTTNPVATEQYGCVCSNTETNQNFNSQQS

SEQ ID NO: 137226 - protein, 34 aa, Artificial Sequence
  Description of Artificial Sequence: Synthetic polypeptide
DEEEISTTNPVATEQYGCVCSNTETNQNFNSQQA

SEQ ID NO: 137227 - protein, 36 aa, Artificial Sequence
  Description of Artificial Sequence: Synthetic polypeptide
DEEEIRTTNPVAYEQYGCVVPSCTNLQEGTPTIPQY

SEQ ID NO: 137228 - protein, 36 aa, Artificial Sequence
  Description of Artificial Sequence: Synthetic polypeptide
AEEEIRATNPCATEQYGSVSTVTNQLNNQQGTNQED

SEQ ID NO: 137229 - protein, 36 aa, Artificial Sequence
  Description of Artificial Sequence: Synthetic polypeptide
AEEEIRATNPCATEQYGSVSTVNQLQNQQIGTNNVD

SEQ ID NO: 137230 - protein, 35 aa, Artificial Sequence
  Description of Artificial Sequence: Synthetic polypeptide
DEEEIRTTNPVAYEQYGCVVPSTNGQEGTPTIYQL

SEQ ID NO: 137231 - protein, 36 aa, Artificial Sequence
  Description of Artificial Sequence: Synthetic polypeptide
DEEEIRTTNPVAYEQYGCVVPSTNLPQEGTPTSPVY

SEQ ID NO: 137232 - protein, 34 aa, Artificial Sequence
  Description of Artificial Sequence: Synthetic polypeptide
DEEEISTTNPVATEQYGCVCSNTELQNFISETQA

SEQ ID NO: 137233 - protein, 36 aa, Artificial Sequence
  Description of Artificial Sequence: Synthetic polypeptide
DEEEIRTTNPVAYEQYGDVPSTTNAGSTTRNGGNPV

SEQ ID NO: 137234 - protein, 32 aa, Artificial Sequence
  Description of Artificial Sequence: Synthetic polypeptide
DEAAIRTTNPVATEQYGCFCSTNDIHFGSEQS

SEQ ID NO: 137235 - protein, 36 aa, Artificial Sequence
  Description of Artificial Sequence: Synthetic polypeptide
DEEEISTTNPVATEQYGCVCSNTELNQENFGSNNQA

SEQ ID NO: 137236 - protein, 36 aa, Artificial Sequence
  Description of Artificial Sequence: Synthetic polypeptide
AEEEIRATNPCATEQYGSVSTVNNQLQNQQQGTNVE

SEQ ID NO: 137237 - protein, 34 aa, Artificial Sequence
  Description of Artificial Sequence: Synthetic polypeptide
DEEEISTTNPVATEQYGCVCSNTELDANFGSEQP

SEQ ID NO: 137238 - protein, 36 aa, Artificial Sequence
  Description of Artificial Sequence: Synthetic polypeptide
AEEEIRATNPCATEQYGSVSTVNNQLNQQIGTNGED

SEQ ID NO: 137239 - protein, 35 aa, Artificial Sequence
  Description of Artificial Sequence: Synthetic polypeptide
DEEEIRTTNPVAYEQYGCVVPSLNLQQGTPTDYQY

SEQ ID NO: 137240 - protein, 36 aa, Artificial Sequence
  Description of Artificial Sequence: Synthetic polypeptide
AEEEIRATNPCATEQYGSVSTVTNQLNQQIGTNTVD

SEQ ID NO: 137241 - protein, 35 aa, Artificial Sequence
  Description of Artificial Sequence: Synthetic polypeptide
AEEEIRATNPCATEQYGSVSTVTQLDNQQIGTNVD

SEQ ID NO: 137242 - protein, 34 aa, Artificial Sequence
  Description of Artificial Sequence: Synthetic polypeptide
DEEEISTTNPVATEQYGCVCSNTGEEQYFGSEQS

SEQ ID NO: 137243 - protein, 37 aa, Artificial Sequence
  Description of Artificial Sequence: Synthetic polypeptide
AEEEIRTTNPCATEQYGSVSTVVTNNNNLQQGTNIED

SEQ ID NO: 137244 - protein, 35 aa, Artificial Sequence
  Description of Artificial Sequence: Synthetic polypeptide
DEEEISTTNPVATEQYGCVCSNTGNLTENFGSEQA

SEQ ID NO: 137245 - protein, 37 aa, Artificial Sequence
  Description of Artificial Sequence: Synthetic polypeptide
AEEEIRTTNPCATEQYGSVSTVVTNNNNLQQGSNISE

SEQ ID NO: 137246 - protein, 35 aa, Artificial Sequence
  Description of Artificial Sequence: Synthetic polypeptide
TEEEIRTTNPVATEQYGQTVPSAGNNLSDEFGNNI

SEQ ID NO: 137247 - protein, 36 aa, Artificial Sequence
  Description of Artificial Sequence: Synthetic polypeptide
DEEEISTTNPVATEQYGCVCSNTGNLNQNFNSENQS

SEQ ID NO: 137248 - protein, 35 aa, Artificial Sequence
  Description of Artificial Sequence: Synthetic polypeptide
DEEEISTTNPVATEQYGCVCSNTGNHQFFNSDFQS

SEQ ID NO: 137249 - protein, 35 aa, Artificial Sequence
  Description of Artificial Sequence: Synthetic polypeptide
DEEEISTTNPVATEQYGCVCSNTGNHQENSGSEQL

SEQ ID NO: 137250 - protein, 34 aa, Artificial Sequence
  Description of Artificial Sequence: Synthetic polypeptide
DEEEISTTNPVATEQYGCVCSNTGNHAFFNSNQP

SEQ ID NO: 137251 - protein, 33 aa, Artificial Sequence
  Description of Artificial Sequence: Synthetic polypeptide
AEEEIRCTNPTAYEQWGSVSGENDDDMRNGSNR

SEQ ID NO: 137252 - protein, 34 aa, Artificial Sequence
  Description of Artificial Sequence: Synthetic polypeptide
DEEEIRTTNPVATEQYGCVCSNWGEDQNFNSDQE

SEQ ID NO: 137253 - protein, 33 aa, Artificial Sequence
  Description of Artificial Sequence: Synthetic polypeptide
AEEEIRATNPVATEQYGSVSANNHDANPSGSFT

SEQ ID NO: 137254 - protein, 34 aa, Artificial Sequence
  Description of Artificial Sequence: Synthetic polypeptide
DEEEISTTNPVATEQYGCVCSNTGELANFGSQQG

SEQ ID NO: 137255 - protein, 36 aa, Artificial Sequence
  Description of Artificial Sequence: Synthetic polypeptide
DEEEIRTTNPVATEQYGCVCSNWGEDLQNFGSDNQS

SEQ ID NO: 137256 - protein, 32 aa, Artificial Sequence
  Description of Artificial Sequence: Synthetic polypeptide
AEEEIRATNPVATEQYGSVAANNHDAPSGSFP

SEQ ID NO: 137257 - protein, 33 aa, Artificial Sequence
  Description of Artificial Sequence: Synthetic polypeptide
AEEEIRATNPVATEQYGSASANNHDADPSGSNN

SEQ ID NO: 137258 - protein, 35 aa, Artificial Sequence
  Description of Artificial Sequence: Synthetic polypeptide
DEEEISTTNPVATEQYGCVCSNTGEHNTNFGSNQA

SEQ ID NO: 137259 - protein, 35 aa, Artificial Sequence
  Description of Artificial Sequence: Synthetic polypeptide
AEEEIRATNPVATEQYGCVAITNHADEQAGMGNPR

SEQ ID NO: 137260 - protein, 34 aa, Artificial Sequence
  Description of Artificial Sequence: Synthetic polypeptide
TEEEIRTTNPVATEQYGSTVYTPTHMGSEGTNDE

SEQ ID NO: 137261 - protein, 33 aa, Artificial Sequence
  Description of Artificial Sequence: Synthetic polypeptide
TEEEIRTTNPVATEQYGSVAVMLAPLINGQTTP

SEQ ID NO: 137262 - protein, 35 aa, Artificial Sequence
  Description of Artificial Sequence: Synthetic polypeptide
AEEEIRATNPCATEQYGVVSTENQLNQQIGTNNVD

SEQ ID NO: 137263 - protein, 36 aa, Artificial Sequence
  Description of Artificial Sequence: Synthetic polypeptide
TEEEIRTTNPVATEQYGSVICLTGSLSDSPGGNNRW

SEQ ID NO: 137264 - protein, 35 aa, Artificial Sequence
  Description of Artificial Sequence: Synthetic polypeptide
DEEEISTTNPVATEQYGCVCSNTGPTQNFGSDNQL

SEQ ID NO: 137265 - protein, 36 aa, Artificial Sequence
  Description of Artificial Sequence: Synthetic polypeptide
AEEEIRTTNPVATEQYGSVATTLQNGNEEQGTTTDD

SEQ ID NO: 137266 - protein, 32 aa, Artificial Sequence
  Description of Artificial Sequence: Synthetic polypeptide
TEEEIASVNPVCTEQYGQVVSINLSQSGGNNQ

SEQ ID NO: 137267 - protein, 33 aa, Artificial Sequence
  Description of Artificial Sequence: Synthetic polypeptide
DEEEISTTNPVATEQYGCVCSSGEHQRFISDQG

SEQ ID NO: 137268 - protein, 37 aa, Artificial Sequence
  Description of Artificial Sequence: Synthetic polypeptide
DEEEIRTTNPVATEAYGSVSTTNNEQQGNNQEDEEDD

SEQ ID NO: 137269 - protein, 38 aa, Artificial Sequence
  Description of Artificial Sequence: Synthetic polypeptide
DEEEIRTTNPVATEAYGSVSTTNNGLQQGNNQETEEDT

SEQ ID NO: 137270 - protein, 34 aa, Artificial Sequence
  Description of Artificial Sequence: Synthetic polypeptide
TAEEIRCTNPVATEQYGSVSPTNLDETQNETQHM

SEQ ID NO: 137271 - protein, 37 aa, Artificial Sequence
  Description of Artificial Sequence: Synthetic polypeptide
DEEEIRTTNPVATEAYGSVSTTNNGNQNGNNQEDEED

SEQ ID NO: 137272 - protein, 31 aa, Artificial Sequence
  Description of Artificial Sequence: Synthetic polypeptide
TAGEIATTNPVAYEQWGSVCTENKLDDLGSR

SEQ ID NO: 137273 - protein, 34 aa, Artificial Sequence
  Description of Artificial Sequence: Synthetic polypeptide
DEEEIRTTNPVAYEQWGSVYHWINDHQDTKGGER

SEQ ID NO: 137274 - protein, 35 aa, Artificial Sequence
  Description of Artificial Sequence: Synthetic polypeptide
AEEEIRTTNPVATEQYGCVCSNWGNHQNFGSENQS

SEQ ID NO: 137275 - protein, 34 aa, Artificial Sequence
  Description of Artificial Sequence: Synthetic polypeptide
DEEEISTTNPVATEQYGCVCSTNHQENFPSDTQG

SEQ ID NO: 137276 - protein, 35 aa, Artificial Sequence
  Description of Artificial Sequence: Synthetic polypeptide
DEEEIRTTNPVAYEQWGSYWSTINPNPQDVNGNND

SEQ ID NO: 137277 - protein, 34 aa, Artificial Sequence
  Description of Artificial Sequence: Synthetic polypeptide
AEEEIRTTNPVATEQYGCVCSSENLANFNSQFQA

SEQ ID NO: 137278 - protein, 33 aa, Artificial Sequence
  Description of Artificial Sequence: Synthetic polypeptide
TDEEEIATTNPVAYEKWGTVCSTNDGQMNGNDQ

SEQ ID NO: 137279 - protein, 34 aa, Artificial Sequence
  Description of Artificial Sequence: Synthetic polypeptide
DEEEIRTTNPVAYEQWGTSVSATADLGQHDIAPN

SEQ ID NO: 137280 - protein, 37 aa, Artificial Sequence
  Description of Artificial Sequence: Synthetic polypeptide
DEEEIRTTNPVATEAYGSVSTTNNGQQGNNDEETEDE

SEQ ID NO: 137281 - protein, 31 aa, Artificial Sequence
  Description of Artificial Sequence: Synthetic polypeptide
DDSEVACTNPVATEGYGNVSANTIQSRVGQR

SEQ ID NO: 137282 - protein, 37 aa, Artificial Sequence
  Description of Artificial Sequence: Synthetic polypeptide
DEEEIRTTNPVATEAYGSVSTTNNGQQGNNQEDEENQ

SEQ ID NO: 137283 - protein, 32 aa, Artificial Sequence
  Description of Artificial Sequence: Synthetic polypeptide
TDETIRTTNPVATEQYGAVSSNHQTVRVQVLA

SEQ ID NO: 137284 - protein, 31 aa, Artificial Sequence
  Description of Artificial Sequence: Synthetic polypeptide
DDSEVACTNPVATEGYGSVAANTIQSRVGQR

SEQ ID NO: 137285 - protein, 33 aa, Artificial Sequence
  Description of Artificial Sequence: Synthetic polypeptide
DEEEIRTTNPVAYEQWGTYVYTDMNDRNGNNGS

SEQ ID NO: 137286 - protein, 33 aa, Artificial Sequence
  Description of Artificial Sequence: Synthetic polypeptide
DEEEIRTTNPVAYEQWGTYVYTIDMADRNGNGS

SEQ ID NO: 137287 - protein, 32 aa, Artificial Sequence
  Description of Artificial Sequence: Synthetic polypeptide
TEACIRTTNPVATEQYGCVCSTNHAYFLSNQS

SEQ ID NO: 137288 - protein, 37 aa, Artificial Sequence
  Description of Artificial Sequence: Synthetic polypeptide
DEEEIRTTNPVATEAYGSVSTTNNGNQQGNNNEDEEN

SEQ ID NO: 137289 - protein, 38 aa, Artificial Sequence
  Description of Artificial Sequence: Synthetic polypeptide
DEEEIRTTNPVATEAYGSVSTNTNNNLQGNQQGTNNTD

SEQ ID NO: 137290 - protein, 37 aa, Artificial Sequence
  Description of Artificial Sequence: Synthetic polypeptide
DEEEIRTTNPVATEAYGSVSTNNQNNQQGTNNNAEND

SEQ ID NO: 137291 - protein, 37 aa, Artificial Sequence
  Description of Artificial Sequence: Synthetic polypeptide
DEEEIRTTNPVATEAYGSVSTNNNNNQQGTNNNDTNE

SEQ ID NO: 137292 - protein, 33 aa, Artificial Sequence
  Description of Artificial Sequence: Synthetic polypeptide
SSEEIRTTNPVAYHQYGSVVSTVHSQHPGNNFQ

SEQ ID NO: 137293 - protein, 34 aa, Artificial Sequence
  Description of Artificial Sequence: Synthetic polypeptide
SSEEIRTTNPVAYHQYGSVVSTVLSQGNGGNNFD

SEQ ID NO: 137294 - protein, 34 aa, Artificial Sequence
  Description of Artificial Sequence: Synthetic polypeptide
SSSEIRTTNPVATEQYGSVSMSLSTQEGMIENFP

SEQ ID NO: 137295 - protein, 31 aa, Artificial Sequence
  Description of Artificial Sequence: Synthetic polypeptide
STAEIACTNPVATEQYGCVATNLTAEGGNEE

SEQ ID NO: 137296 - protein, 33 aa, Artificial Sequence
  Description of Artificial Sequence: Synthetic polypeptide
DEEEISTTNPVATEQYGCVCSTPDHAYFNSEQS

SEQ ID NO: 137297 - protein, 36 aa, Artificial Sequence
  Description of Artificial Sequence: Synthetic polypeptide
DEEEIRTTNPVATEAYGSVCSVTDNDPQGGLEDDML

SEQ ID NO: 137298 - protein, 36 aa, Artificial Sequence
  Description of Artificial Sequence: Synthetic polypeptide
DEEEISTTNPVATEQYGCVCSTNSLFQENFGSETQS

SEQ ID NO: 137299 - protein, 36 aa, Artificial Sequence
  Description of Artificial Sequence: Synthetic polypeptide
DEEEIRTTNPVATEAYGSVPSTTPAGPNTRTGGNNV

SEQ ID NO: 137300 - protein, 35 aa, Artificial Sequence
  Description of Artificial Sequence: Synthetic polypeptide
DEEEISTTNPVATEQYGCVCSTNSHFQESFGSEFS

SEQ ID NO: 137301 - protein, 36 aa, Artificial Sequence
  Description of Artificial Sequence: Synthetic polypeptide
DEEEISTTNPVATEQYGCVCSTNSHFQENFGSENQA

SEQ ID NO: 137302 - protein, 36 aa, Artificial Sequence
  Description of Artificial Sequence: Synthetic polypeptide
DEEEIRTTNPVATEAYGSVSSCTPAGPTNRNGGNPV

SEQ ID NO: 137303 - protein, 34 aa, Artificial Sequence
  Description of Artificial Sequence: Synthetic polypeptide
AEEEIRTTNPVATEQYGCVCSTEHNQNFGSETQS

SEQ ID NO: 137304 - protein, 36 aa, Artificial Sequence
  Description of Artificial Sequence: Synthetic polypeptide
DEEEIRTTNPVATEAYGSVSSTTPAGPNMRIGMNPV

SEQ ID NO: 137305 - protein, 36 aa, Artificial Sequence
  Description of Artificial Sequence: Synthetic polypeptide
DEEEIRTTNPVATEAYGSVSSTTPAGPNMRNGMNPV

SEQ ID NO: 137306 - protein, 36 aa, Artificial Sequence
  Description of Artificial Sequence: Synthetic polypeptide
DEEEIRTTNPVATEAYGSVSSTTPAGPNMRNGMNWV

SEQ ID NO: 137307 - protein, 33 aa, Artificial Sequence
  Description of Artificial Sequence: Synthetic polypeptide
AEEEIRTTNPVATEQYGCVCSTEHIEGFGSDQS

SEQ ID NO: 137308 - protein, 37 aa, Artificial Sequence
  Description of Artificial Sequence: Synthetic polypeptide
DEEEIRTTNPVATEAYGSVSTNLEQGNNNQEEEEEDE

SEQ ID NO: 137309 - protein, 34 aa, Artificial Sequence
  Description of Artificial Sequence: Synthetic polypeptide
AEEEIRTTNPVATEQYGCVCSTEEHQNFGSDDQS

SEQ ID NO: 137310 - protein, 31 aa, Artificial Sequence
  Description of Artificial Sequence: Synthetic polypeptide
DDSEIVTTNPVSTEGYGTVSATDGPQRVGQD

SEQ ID NO: 137311 - protein, 38 aa, Artificial Sequence
  Description of Artificial Sequence: Synthetic polypeptide
DEEEIRTTNPVATEAYGSVSTNLQQGTNLQEATNVATE

SEQ ID NO: 137312 - protein, 31 aa, Artificial Sequence
  Description of Artificial Sequence: Synthetic polypeptide
STTAEIACTNPVAYEQYGSVATNLQSNNDQM

SEQ ID NO: 137313 - protein, 34 aa, Artificial Sequence
  Description of Artificial Sequence: Synthetic polypeptide
DEEEISTTNPVATEQYGCVCSTNDHQENFISEQS

SEQ ID NO: 137314 - protein, 35 aa, Artificial Sequence
  Description of Artificial Sequence: Synthetic polypeptide
DEEEISTTNPVATEQYGCVCSTPNPQENFNSETQS

SEQ ID NO: 137315 - protein, 35 aa, Artificial Sequence
  Description of Artificial Sequence: Synthetic polypeptide
DEEEISTTNPVATEQYGCVCSTNDHQEHFGSETQA

SEQ ID NO: 137316 - protein, 33 aa, Artificial Sequence
  Description of Artificial Sequence: Synthetic polypeptide
DEEEIRTTNPVAYEQWGVSWSLDNMEDRRQDNE

SEQ ID NO: 137317 - protein, 35 aa, Artificial Sequence
  Description of Artificial Sequence: Synthetic polypeptide
AEEEIRTTNPVATEQYGCVCSNTEDLQENFGSDQS

SEQ ID NO: 137318 - protein, 33 aa, Artificial Sequence
  Description of Artificial Sequence: Synthetic polypeptide
AEEEIRTTNPVATEQYGCVCSNSEHQNFGSDQS

SEQ ID NO: 137319 - protein, 31 aa, Artificial Sequence
  Description of Artificial Sequence: Synthetic polypeptide
TEAEIRTTNPVAYERYGSVVATALMENGGSK

SEQ ID NO: 137320 - protein, 37 aa, Artificial Sequence
  Description of Artificial Sequence: Synthetic polypeptide
DEEEIRTTNPVATEAYGSVSTVNNNNQQGNNNNDTND

SEQ ID NO: 137321 - protein, 37 aa, Artificial Sequence
  Description of Artificial Sequence: Synthetic polypeptide
DEEEIRTTNPVATEAYGSVSTVNNNNQQGTNNNTNND

SEQ ID NO: 137322 - protein, 37 aa, Artificial Sequence
  Description of Artificial Sequence: Synthetic polypeptide
DEEEIRTTNPVATEAYGSVSTVNNNNQQGTNTTETTN

SEQ ID NO: 137323 - protein, 34 aa, Artificial Sequence
  Description of Artificial Sequence: Synthetic polypeptide
DEEEIRTTNPVAYEQYGCVAACTNASGKGGDSRY

SEQ ID NO: 137324 - protein, 35 aa, Artificial Sequence
  Description of Artificial Sequence: Synthetic polypeptide
DEEEIRTTNPVAYEQYGCVASCCPNLSGDGGDSRY

SEQ ID NO: 137325 - protein, 35 aa, Artificial Sequence
  Description of Artificial Sequence: Synthetic polypeptide
DEEEIRTTNPVAYEQYGCVASCTGLSGTDGGDSRY

SEQ ID NO: 137326 - protein, 34 aa, Artificial Sequence
  Description of Artificial Sequence: Synthetic polypeptide
TEAEIRTTNPVATESYGSVVSVLNQSQKTGGNHC

SEQ ID NO: 137327 - protein, 35 aa, Artificial Sequence
  Description of Artificial Sequence: Synthetic polypeptide
DEEEIRTTNPVAYEQYGCVASCTGNLSGKGGDSAY

SEQ ID NO: 137328 - protein, 35 aa, Artificial Sequence
  Description of Artificial Sequence: Synthetic polypeptide
DEEEIRTTNPVAYEQYGCVASCTNFSGKAGGDSRY

SEQ ID NO: 137329 - protein, 34 aa, Artificial Sequence
  Description of Artificial Sequence: Synthetic polypeptide
DEEEIRTTNPVAYEQYGCVASCTNPSGKGGDSKY

SEQ ID NO: 137330 - protein, 35 aa, Artificial Sequence
  Description of Artificial Sequence: Synthetic polypeptide
DEEEIRTTNPVAYEQYGCVASCTNWSGTNGGDSRY

SEQ ID NO: 137331 - protein, 34 aa, Artificial Sequence
  Description of Artificial Sequence: Synthetic polypeptide
DEEEISTTNPVATEQYGCVCSTGNHNQNFPSEQG

SEQ ID NO: 137332 - protein, 35 aa, Artificial Sequence
  Description of Artificial Sequence: Synthetic polypeptide
DEEEIRTTNPVAYEQYGCVASCTPNLSGKGGGSHY

SEQ ID NO: 137333 - protein, 35 aa, Artificial Sequence
  Description of Artificial Sequence: Synthetic polypeptide
DEEEISTTNPVATEQYGCVCSTGNHNQFFNSDNQA

SEQ ID NO: 137334 - protein, 36 aa, Artificial Sequence
  Description of Artificial Sequence: Synthetic polypeptide
DEEEISTTNPVATEQYGCVCSTGNHNQESFGSENQP

SEQ ID NO: 137335 - protein, 36 aa, Artificial Sequence
  Description of Artificial Sequence: Synthetic polypeptide
DEEEIRTTNPVATEAYGSVSTVNNNQNQQQNNNDTN

SEQ ID NO: 137336 - protein, 37 aa, Artificial Sequence
  Description of Artificial Sequence: Synthetic polypeptide
DEEEIRTTNPVATEAYGSVSTVNNQQGNQNNTNEETD

SEQ ID NO: 137337 - protein, 35 aa, Artificial Sequence
  Description of Artificial Sequence: Synthetic polypeptide
DEEEIRTTNPVAYEQYGCVASCTNAGSGKGGDSRY

SEQ ID NO: 137338 - protein, 34 aa, Artificial Sequence
  Description of Artificial Sequence: Synthetic polypeptide
AEEEIRTTNPVATEQYGCVCSNTEHQNFGSDTQS

SEQ ID NO: 137339 - protein, 34 aa, Artificial Sequence
  Description of Artificial Sequence: Synthetic polypeptide
AEEEIRTTNPVATEQYGCVCSNTEHQNFNSDTQI

SEQ ID NO: 137340 - protein, 38 aa, Artificial Sequence
  Description of Artificial Sequence: Synthetic polypeptide
DEEEIRTTNPVATEAYGSVSTVNNNNLQGNEEIGNTEN

SEQ ID NO: 137341 - protein, 31 aa, Artificial Sequence
  Description of Artificial Sequence: Synthetic polypeptide
TEAEIATTNPVAYEQWGSISKTLEDRQNMQR

SEQ ID NO: 137342 - protein, 37 aa, Artificial Sequence
  Description of Artificial Sequence: Synthetic polypeptide
DEEEIRTTNPVATEAYGSVSTTNNGQQGNNQEDTEDT

SEQ ID NO: 137343 - protein, 37 aa, Artificial Sequence
  Description of Artificial Sequence: Synthetic polypeptide
DEEEIRTTNPVATEAYGSVSTTNNGQQGNNQEGEEDE

SEQ ID NO: 137344 - protein, 35 aa, Artificial Sequence
  Description of Artificial Sequence: Synthetic polypeptide
DEEEISTTNPVATEQYGCVCSTMEHQEGFGSNNQA

SEQ ID NO: 137345 - protein, 35 aa, Artificial Sequence
  Description of Artificial Sequence: Synthetic polypeptide
DEEEISTTNPVATEQYGCVCSTMEHNQNFGSDNQA

SEQ ID NO: 137346 - protein, 33 aa, Artificial Sequence
  Description of Artificial Sequence: Synthetic polypeptide
DEEEISTTNPVATEQYGCVCSTMEHISFGSDQS

SEQ ID NO: 137347 - protein, 38 aa, Artificial Sequence
  Description of Artificial Sequence: Synthetic polypeptide
DEEEIRTTNPVATEAYGSVSTTNQQLQQGNNNGGNEDG

SEQ ID NO: 137348 - protein, 34 aa, Artificial Sequence
  Description of Artificial Sequence: Synthetic polypeptide
DEEEISTTNPVATEQYGCVCSTMEDHQSFGSDQV

SEQ ID NO: 137349 - protein, 37 aa, Artificial Sequence
  Description of Artificial Sequence: Synthetic polypeptide
DEEEIRTTNPVATEAYGSVSTTNQQQGNQQGTTEEND

SEQ ID NO: 137350 - protein, 35 aa, Artificial Sequence
  Description of Artificial Sequence: Synthetic polypeptide
DEEEIRTTNPVAYEQYGATVVACTGNALQAVTDSR

SEQ ID NO: 137351 - protein, 37 aa, Artificial Sequence
  Description of Artificial Sequence: Synthetic polypeptide
DEEEIRTTNPVATEAYGSVSTTNQQQQNGNQQGTTED

SEQ ID NO: 137352 - protein, 34 aa, Artificial Sequence
  Description of Artificial Sequence: Synthetic polypeptide
DEEEISTTNPVATEQYGCVCSTGYHQENFGSQQF

SEQ ID NO: 137353 - protein, 38 aa, Artificial Sequence
  Description of Artificial Sequence: Synthetic polypeptide
DEEEIRTTNPVATEAYGSVSTTVNLQQGTTEQGNNNTD

SEQ ID NO: 137354 - protein, 37 aa, Artificial Sequence
  Description of Artificial Sequence: Synthetic polypeptide
DEEEIRTTNPVATEAYGSVSTTVNNQLGGNQNTEEQD

SEQ ID NO: 137355 - protein, 38 aa, Artificial Sequence
  Description of Artificial Sequence: Synthetic polypeptide
DEEEIRTTNPVATEAYGSVSTTVVNNLQQGNNTTEDEE

SEQ ID NO: 137356 - protein, 37 aa, Artificial Sequence
  Description of Artificial Sequence: Synthetic polypeptide
DEEEIRTTNPVATEAYGSVSTVNGNQQQGTNNNATND

SEQ ID NO: 137357 - protein, 34 aa, Artificial Sequence
  Description of Artificial Sequence: Synthetic polypeptide
AEEEIRTTNPVATEQYGCVCSNTNDANFNSQFQA

SEQ ID NO: 137358 - protein, 35 aa, Artificial Sequence
  Description of Artificial Sequence: Synthetic polypeptide
AEEEIRTTNPVATEQYGCVCSNTGYHQENFGSNQA

SEQ ID NO: 137359 - protein, 35 aa, Artificial Sequence
  Description of Artificial Sequence: Synthetic polypeptide
TEAEIRTTNPVATEQYGSVPNCTSNAWSQRVEGPE

SEQ ID NO: 137360 - protein, 38 aa, Artificial Sequence
  Description of Artificial Sequence: Synthetic polypeptide
DEEEIRTTNPVATEAYGSVSTVNLQAGNTEQGTVTTDD

SEQ ID NO: 137361 - protein, 38 aa, Artificial Sequence
  Description of Artificial Sequence: Synthetic polypeptide
DEEEIRTTNPVATEAYGSVSTVNNNNLQAGNNEDEGDT

SEQ ID NO: 137362 - protein, 36 aa, Artificial Sequence
  Description of Artificial Sequence: Synthetic polypeptide
DEEEISTTNPVATEQYGCVCSTMNSLFQEHFGSEQS

SEQ ID NO: 137363 - protein, 32 aa, Artificial Sequence
  Description of Artificial Sequence: Synthetic polypeptide
TECEIATTNPVSTEQYGSVSWNEGDRQGMDSH

SEQ ID NO: 137364 - protein, 34 aa, Artificial Sequence
  Description of Artificial Sequence: Synthetic polypeptide
SSEEIRTTNPVAYHQYGSVVSCTVLSQQGGNNFQ

SEQ ID NO: 137365 - protein, 36 aa, Artificial Sequence
  Description of Artificial Sequence: Synthetic polypeptide
DEEEISTTNPVATEQYGCVCSTTEDLNQNFGSENQS

SEQ ID NO: 137366 - protein, 35 aa, Artificial Sequence
  Description of Artificial Sequence: Synthetic polypeptide
DEEEIRTTNPVATEQYGCVCSTGEHNQEHFNSEQL

SEQ ID NO: 137367 - protein, 36 aa, Artificial Sequence
  Description of Artificial Sequence: Synthetic polypeptide
DEEEIRTTNPVATEQYGCVCSTGEHNQEGFNSQNQS

SEQ ID NO: 137368 - protein, 35 aa, Artificial Sequence
  Description of Artificial Sequence: Synthetic polypeptide
DEEEIRTTNPVATEQYGCVCSTGEHNQEGFISDQS

SEQ ID NO: 137369 - protein, 35 aa, Artificial Sequence
  Description of Artificial Sequence: Synthetic polypeptide
DEEEIRTTNPVATEQYGCVCSTGEHNIENFNSDQP

SEQ ID NO: 137370 - protein, 35 aa, Artificial Sequence
  Description of Artificial Sequence: Synthetic polypeptide
DEEEIRTTNPVATEQYGCVCSTGEHNENFISDNQS

SEQ ID NO: 137371 - protein, 35 aa, Artificial Sequence
  Description of Artificial Sequence: Synthetic polypeptide
DEEEIRTTNPVATEQYGCVCSTGEHNEEYFNSDQA

SEQ ID NO: 137372 - protein, 36 aa, Artificial Sequence
  Description of Artificial Sequence: Synthetic polypeptide
DEEEIRTTNPVATEQYGCVCSTGEHNEENFGSNNQS

SEQ ID NO: 137373 - protein, 36 aa, Artificial Sequence
  Description of Artificial Sequence: Synthetic polypeptide
DEEEIRTTNPVATEQYGCVCSTGEHNEEGFGSDNQS

SEQ ID NO: 137374 - protein, 35 aa, Artificial Sequence
  Description of Artificial Sequence: Synthetic polypeptide
DEEEIRTTNPVATEQYGCVCSTGEHNANFNSNTQL

SEQ ID NO: 137375 - protein, 34 aa, Artificial Sequence
  Description of Artificial Sequence: Synthetic polypeptide
DEEEISTTNPVATEQYGCVCSWEEHNQSFGSNQP

SEQ ID NO: 137376 - protein, 35 aa, Artificial Sequence
  Description of Artificial Sequence: Synthetic polypeptide
DEEEIRTTNPVATEQYGCVCSTGEHNAENFNSQQS

SEQ ID NO: 137377 - protein, 35 aa, Artificial Sequence
  Description of Artificial Sequence: Synthetic polypeptide
DEEEIRTTNPVATEQYGCVCSTGEHFQGFNSNTQA

SEQ ID NO: 137378 - protein, 34 aa, Artificial Sequence
  Description of Artificial Sequence: Synthetic polypeptide
DEEEIRTTNPVATEQYGCVCSTGEHFENFNSNQP

SEQ ID NO: 137379 - protein, 32 aa, Artificial Sequence
  Description of Artificial Sequence: Synthetic polypeptide
SSEEIATTNPVATTQWGSVWTWDHDQDREGNF

SEQ ID NO: 137380 - protein, 35 aa, Artificial Sequence
  Description of Artificial Sequence: Synthetic polypeptide
DEEEIRTTNPVATEQYGCVCSTGEHEQEYFGSDQG

SEQ ID NO: 137381 - protein, 34 aa, Artificial Sequence
  Description of Artificial Sequence: Synthetic polypeptide
DEEEIRTTNPVATEQYGCVCSTGEHENFNSETQP

SEQ ID NO: 137382 - protein, 35 aa, Artificial Sequence
  Description of Artificial Sequence: Synthetic polypeptide
DEEEIRTTNPVATEQYGCVCSTGEHEEHFGSDNQS

SEQ ID NO: 137383 - protein, 35 aa, Artificial Sequence
  Description of Artificial Sequence: Synthetic polypeptide
DEEEIRTTNPVATEQYGCVCSTGEHDINFGSDNQS

SEQ ID NO: 137384 - protein, 33 aa, Artificial Sequence
  Description of Artificial Sequence: Synthetic polypeptide
DEEEISTTNPVATEQYGCVCSWEDQENFNSNQA

SEQ ID NO: 137385 - protein, 32 aa, Artificial Sequence
  Description of Artificial Sequence: Synthetic polypeptide
SSEEIRTTNPVATCQYGCVCSWEHQNFGSNFA

SEQ ID NO: 137386 - protein, 35 aa, Artificial Sequence
  Description of Artificial Sequence: Synthetic polypeptide
DEEEIRTTNPVATEQYGCVCSTGEHNAENFNSDQS

SEQ ID NO: 137387 - protein, 33 aa, Artificial Sequence
  Description of Artificial Sequence: Synthetic polypeptide
SQEEIRTTNPVATEQYGCVNTSVLELMRPENKE

SEQ ID NO: 137388 - protein, 33 aa, Artificial Sequence
  Description of Artificial Sequence: Synthetic polypeptide
SQEEIRTTNPVATEQYGCVNITSPLELRPENKE

SEQ ID NO: 137389 - protein, 34 aa, Artificial Sequence
  Description of Artificial Sequence: Synthetic polypeptide
DEEEISTTNPVATEQYGCVCSWEEHQFFGSNTQY

SEQ ID NO: 137390 - protein, 33 aa, Artificial Sequence
  Description of Artificial Sequence: Synthetic polypeptide
DEEEISTTNPVATEQYGCVCSWELENFGSETQP

SEQ ID NO: 137391 - protein, 36 aa, Artificial Sequence
  Description of Artificial Sequence: Synthetic polypeptide
AEEEIRTTNPVATEQYGSVATNNNNQNGTEAGEDNS

SEQ ID NO: 137392 - protein, 33 aa, Artificial Sequence
  Description of Artificial Sequence: Synthetic polypeptide
DEEEISTTNPVATEQYGCVCSWEHQHFGSQTQS

SEQ ID NO: 137393 - protein, 37 aa, Artificial Sequence
  Description of Artificial Sequence: Synthetic polypeptide
AEEEIRTTNPVATEQYGSVATNLNNQNGTEAGVTNSS

SEQ ID NO: 137394 - protein, 33 aa, Artificial Sequence
  Description of Artificial Sequence: Synthetic polypeptide
DEEEISTTNPVATEQYGCVCSWEHQEHFNSDQF

SEQ ID NO: 137395 - protein, 33 aa, Artificial Sequence
  Description of Artificial Sequence: Synthetic polypeptide
DEEEISTTNPVATEQYGCVCSWEHQEHFGSDQE

SEQ ID NO: 137396 - protein, 33 aa, Artificial Sequence
  Description of Artificial Sequence: Synthetic polypeptide
DEEEISTTNPVATEQYGCVCSWEHNQNFNSQQA

SEQ ID NO: 137397 - protein, 36 aa, Artificial Sequence
  Description of Artificial Sequence: Synthetic polypeptide
AEEEIRTTNPVATEQYGSVATNLNNQNGTEAGEDEQ

SEQ ID NO: 137398 - protein, 35 aa, Artificial Sequence
  Description of Artificial Sequence: Synthetic polypeptide
DEEEIRTTNPVATEQYGCVCSTGEHNQNFFSDNQT

SEQ ID NO: 137399 - protein, 34 aa, Artificial Sequence
  Description of Artificial Sequence: Synthetic polypeptide
DEEEISTTNPVATEQYGCVCSWEHNQGFGSENQA

SEQ ID NO: 137400 - protein, 35 aa, Artificial Sequence
  Description of Artificial Sequence: Synthetic polypeptide
AEEEIRTTNPVATEQYGQCVCSWGNHQNFGSENQA

SEQ ID NO: 137401 - protein, 34 aa, Artificial Sequence
  Description of Artificial Sequence: Synthetic polypeptide
DEEEISTTNPVATEQYGCVCSWEHNQEGFNSNQS

SEQ ID NO: 137402 - protein, 35 aa, Artificial Sequence
  Description of Artificial Sequence: Synthetic polypeptide
DEEEIRTTNPVATEQYGCVCSTGEHNQFFNSETQE

SEQ ID NO: 137403 - protein, 30 aa, Artificial Sequence
  Description of Artificial Sequence: Synthetic polypeptide
SQEEIRTTNPVATEQWGTYCWNLTEEINVY

SEQ ID NO: 137404 - protein, 34 aa, Artificial Sequence
  Description of Artificial Sequence: Synthetic polypeptide
DEEEIRTTNPVATEQYGCVCSTGEHNQFFISDQQ

SEQ ID NO: 137405 - protein, 35 aa, Artificial Sequence
  Description of Artificial Sequence: Synthetic polypeptide
DEEEIRTTNPVATEQYGCVCSTGEHNQEYFNSDQS

SEQ ID NO: 137406 - protein, 33 aa, Artificial Sequence
  Description of Artificial Sequence: Synthetic polypeptide
DEEEISTTNPVATEQYGCVCSWEHEQYFNSDQS

SEQ ID NO: 137407 - protein, 32 aa, Artificial Sequence
  Description of Artificial Sequence: Synthetic polypeptide
DEEEISTTNPVATEQYGCVCSWEHANFNSQQS

SEQ ID NO: 137408 - protein, 35 aa, Artificial Sequence
  Description of Artificial Sequence: Synthetic polypeptide
DEEEIRTTNPVATEQYGCVCSTGEHNQENFGSQQA

SEQ ID NO: 137409 - protein, 35 aa, Artificial Sequence
  Description of Artificial Sequence: Synthetic polypeptide
DEEEIRTTNPVATEQYGCVCSTGEHNQENFGSDQE

SEQ ID NO: 137410 - protein, 33 aa, Artificial Sequence
  Description of Artificial Sequence: Synthetic polypeptide
DEEEISTTNPVATEQYGCVCSWEEHQYFGSDQA

SEQ ID NO: 137411 - protein, 34 aa, Artificial Sequence
  Description of Artificial Sequence: Synthetic polypeptide
DEEEISTTNPVATEQYGCVCSWEDLQENFGSDQG

SEQ ID NO: 137412 - protein, 34 aa, Artificial Sequence
  Description of Artificial Sequence: Synthetic polypeptide
AEEEIRTTNPVATEQYGCVCSTENHIEFFGSEQS

SEQ ID NO: 137413 - protein, 34 aa, Artificial Sequence
  Description of Artificial Sequence: Synthetic polypeptide
DEEEISTTNPVATEQYGCVCSWEDHQNFGSNNQA

SEQ ID NO: 137414 - protein, 34 aa, Artificial Sequence
  Description of Artificial Sequence: Synthetic polypeptide
DEEEIRTTNPVATEQYGCVCSTGEHANFGSDTQI

SEQ ID NO: 137415 - protein, 34 aa, Artificial Sequence
  Description of Artificial Sequence: Synthetic polypeptide
AEEEIRTTNPVATEQYGCVCSWEHQENFGSDNQS

SEQ ID NO: 137416 - protein, 35 aa, Artificial Sequence
  Description of Artificial Sequence: Synthetic polypeptide
DEEEISTTNPVATEQYGCVCSTWEHNINFGSENQS

SEQ ID NO: 137417 - protein, 35 aa, Artificial Sequence
  Description of Artificial Sequence: Synthetic polypeptide
DEEEISTTNPVATEQYGCVCSTWEHDQEGFNSDQY

SEQ ID NO: 137418 - protein, 33 aa, Artificial Sequence
  Description of Artificial Sequence: Synthetic polypeptide
AEEEIRTTNPVATEQYGCVCSWEHNQNFNSEQQ

SEQ ID NO: 137419 - protein, 35 aa, Artificial Sequence
  Description of Artificial Sequence: Synthetic polypeptide
DEEEIRTTNPVATEQYGCVCSTGEDHNEGFGSDQS

SEQ ID NO: 137420 - protein, 35 aa, Artificial Sequence
  Description of Artificial Sequence: Synthetic polypeptide
DEEEISTTNPVATEQYGCVCSTWEDHQNFGSDNQS

SEQ ID NO: 137421 - protein, 35 aa, Artificial Sequence
  Description of Artificial Sequence: Synthetic polypeptide
AEEEIRTTNPVATEQYGCVCSTNLNAESFNSEFQS

SEQ ID NO: 137422 - protein, 34 aa, Artificial Sequence
  Description of Artificial Sequence: Synthetic polypeptide
DEEEISTTNPVATEQYGCVCSTVEHNQNFGSDQS

SEQ ID NO: 137423 - protein, 34 aa, Artificial Sequence
  Description of Artificial Sequence: Synthetic polypeptide
DEEEIRTTNPVATEQYGCVCSTGEDHAFFGSQQP

SEQ ID NO: 137424 - protein, 34 aa, Artificial Sequence
  Description of Artificial Sequence: Synthetic polypeptide
DEEEISTTNPVATEQYGCVCSTWEHQNFNSNNQS

SEQ ID NO: 137425 - protein, 35 aa, Artificial Sequence
  Description of Artificial Sequence: Synthetic polypeptide
DEEEIRTTNPVATEQYGCVCSTGEDEENFISDNQP

SEQ ID NO: 137426 - protein, 35 aa, Artificial Sequence
  Description of Artificial Sequence: Synthetic polypeptide
DEEEIRTTNPVATEQYGCVCSTGEDDQENFNSDQS

SEQ ID NO: 137427 - protein, 35 aa, Artificial Sequence
  Description of Artificial Sequence: Synthetic polypeptide
AEEEIRTTNPVATEQYGCVCSTGNHQEFFNSDFQS

SEQ ID NO: 137428 - protein, 35 aa, Artificial Sequence
  Description of Artificial Sequence: Synthetic polypeptide
DEEEIRTTNPVATEQYGCVCSTGEDDQEFFGSDQA

SEQ ID NO: 137429 - protein, 35 aa, Artificial Sequence
  Description of Artificial Sequence: Synthetic polypeptide
AEEEIRTTNPVATEQYGCVCSTGEHQEYFGSENQA

SEQ ID NO: 137430 - protein, 34 aa, Artificial Sequence
  Description of Artificial Sequence: Synthetic polypeptide
AEEEIRTTNPVATEQYGCVCSTGEHNQNFGSDQG

SEQ ID NO: 137431 - protein, 35 aa, Artificial Sequence
  Description of Artificial Sequence: Synthetic polypeptide
DEEEISTTNPVATEQYGCVCSTTGEDQNFGSNTQS

SEQ ID NO: 137432 - protein, 33 aa, Artificial Sequence
  Description of Artificial Sequence: Synthetic polypeptide
SSEEIRTTNPVAYHHYGSVVSTVHSQRGGNNGQ

SEQ ID NO: 137433 - protein, 33 aa, Artificial Sequence
  Description of Artificial Sequence: Synthetic polypeptide
DEEEISTTNPVATEQYGCVCSTTEHAFFGSDQP

SEQ ID NO: 137434 - protein, 35 aa, Artificial Sequence
  Description of Artificial Sequence: Synthetic polypeptide
DEEEIRTTNPVATEQYGCVCSTGAHQEFFNSQFQS

SEQ ID NO: 137435 - protein, 34 aa, Artificial Sequence
  Description of Artificial Sequence: Synthetic polypeptide
DEEEISTTNPVATEQYGCVCSTTMEHQNFNSDQS

SEQ ID NO: 137436 - protein, 35 aa, Artificial Sequence
  Description of Artificial Sequence: Synthetic polypeptide
DEEEIRTTNPVATEQYGCVCSTGEDHNQFFGSQQT

SEQ ID NO: 137437 - protein, 35 aa, Artificial Sequence
  Description of Artificial Sequence: Synthetic polypeptide
DEEEIRTTNPVATEQYGCVCSTGEDHNQGFGSDQA

SEQ ID NO: 137438 - protein, 36 aa, Artificial Sequence
  Description of Artificial Sequence: Synthetic polypeptide
DEEEIRTTNPVATEQYGCVCSTGEDHNQNFGSDNQS

SEQ ID NO: 137439 - protein, 35 aa, Artificial Sequence
  Description of Artificial Sequence: Synthetic polypeptide
DEEEIRTTNPVATEQYGCVCSTGEGTQENFNSDQY

SEQ ID NO: 137440 - protein, 35 aa, Artificial Sequence
  Description of Artificial Sequence: Synthetic polypeptide
DEEEIRTTNPVATEAYGSCSMTEAWLNQSTIGSQE

SEQ ID NO: 137441 - protein, 35 aa, Artificial Sequence
  Description of Artificial Sequence: Synthetic polypeptide
DEEEIRTTNPVATEQYGCVCSTGEDTQNFISDNQS

SEQ ID NO: 137442 - protein, 34 aa, Artificial Sequence
  Description of Artificial Sequence: Synthetic polypeptide
SSEEIRTTNPVATDQYGSVSPWWAVEQRGQNDIN

SEQ ID NO: 137443 - protein, 34 aa, Artificial Sequence
  Description of Artificial Sequence: Synthetic polypeptide
SSEEIRTTNPVATDQYGSVSPWWSVEQRGQNDMF

SEQ ID NO: 137444 - protein, 34 aa, Artificial Sequence
  Description of Artificial Sequence: Synthetic polypeptide
SSEEIRTTNPVATDQYGSVSTGDGQQDIGQGNDQ

SEQ ID NO: 137445 - protein, 35 aa, Artificial Sequence
  Description of Artificial Sequence: Synthetic polypeptide
DEEEISTTNPVATEQYGCVCSTWNEHQGFNSDPQS

SEQ ID NO: 137446 - protein, 35 aa, Artificial Sequence
  Description of Artificial Sequence: Synthetic polypeptide
DEEEIRTTNPVATEAYGSCSMTSAWLSQTIGSSQE

SEQ ID NO: 137447 - protein, 35 aa, Artificial Sequence
  Description of Artificial Sequence: Synthetic polypeptide
DEEEISTTNPVATEQYGCVCSTWGELQNFNSDTQS

SEQ ID NO: 137448 - protein, 35 aa, Artificial Sequence
  Description of Artificial Sequence: Synthetic polypeptide
DEEEIRTTNPVATEQYGCVCSTGEDQENFNSENQA

SEQ ID NO: 137449 - protein, 35 aa, Artificial Sequence
  Description of Artificial Sequence: Synthetic polypeptide
DEEEIRTTNPVATEQYGCVCSTGEDQENFNSDTQM

SEQ ID NO: 137450 - protein, 34 aa, Artificial Sequence
  Description of Artificial Sequence: Synthetic polypeptide
DEEEIRTTNPVATEQYGCVCSTGEDQENFISEQA

SEQ ID NO: 137451 - protein, 35 aa, Artificial Sequence
  Description of Artificial Sequence: Synthetic polypeptide
DEEEIRTTNPVATEQYGCVCSTGEDHQNFTSDNQN

SEQ ID NO: 137452 - protein, 35 aa, Artificial Sequence
  Description of Artificial Sequence: Synthetic polypeptide
DEEEIRTTNPVATEQYGCVCSTGEDHQNFGSEFIP

SEQ ID NO: 137453 - protein, 35 aa, Artificial Sequence
  Description of Artificial Sequence: Synthetic polypeptide
DEEEIRTTNPVATEQYGCVCSTGEDHQEFFNSQQS

SEQ ID NO: 137454 - protein, 33 aa, Artificial Sequence
  Description of Artificial Sequence: Synthetic polypeptide
SSEEIRTTNPVATHQYGCVCSTEHNQRFGSEQA

SEQ ID NO: 137455 - protein, 35 aa, Artificial Sequence
  Description of Artificial Sequence: Synthetic polypeptide
DEEEIRTTNPVATEQYGCVCSTGEDHNQNFNSQQS

SEQ ID NO: 137456 - protein, 35 aa, Artificial Sequence
  Description of Artificial Sequence: Synthetic polypeptide
DEEEIRTTNPVATEQYGCVCSTGEDHNQNFNSNQS

SEQ ID NO: 137457 - protein, 32 aa, Artificial Sequence
  Description of Artificial Sequence: Synthetic polypeptide
SSEEIRTTNPVATHQYGCVCSTEHQNFGSQQA

SEQ ID NO: 137458 - protein, 32 aa, Artificial Sequence
  Description of Artificial Sequence: Synthetic polypeptide
SSEEIRTTNPVATHQYGCVCSTELANFGSDQS

SEQ ID NO: 137459 - protein, 35 aa, Artificial Sequence
  Description of Artificial Sequence: Synthetic polypeptide
DEEEIRTTNPVATEQYGCVCSTGEDHNQNFGSDQS

SEQ ID NO: 137460 - protein, 34 aa, Artificial Sequence
  Description of Artificial Sequence: Synthetic polypeptide
DEEEIRTTNPVATEQYGCVCSTGEHANFNSDFQS

SEQ ID NO: 137461 - protein, 35 aa, Artificial Sequence
  Description of Artificial Sequence: Synthetic polypeptide
DEEEIRTTNPVATEQYGCVCSTEDNQENFNSDNQS

SEQ ID NO: 137462 - protein, 37 aa, Artificial Sequence
  Description of Artificial Sequence: Synthetic polypeptide
DEEEIRTTNPVATEAYGSVSTVNNQQQNGNQNNDTED

SEQ ID NO: 137463 - protein, 30 aa, Artificial Sequence
  Description of Artificial Sequence: Synthetic polypeptide
TEDEIACTNPVAYEQWGEASIENDQRGGER

SEQ ID NO: 137464 - protein, 35 aa, Artificial Sequence
  Description of Artificial Sequence: Synthetic polypeptide
DEEEISTTNPVATEQYGCVCSTEGHNQGFGSENQS

SEQ ID NO: 137465 - protein, 34 aa, Artificial Sequence
  Description of Artificial Sequence: Synthetic polypeptide
DEEEISTTNPVATEQYGCVCSTEELTEAFGSEQA

SEQ ID NO: 137466 - protein, 35 aa, Artificial Sequence
  Description of Artificial Sequence: Synthetic polypeptide
DEEEIRTTNPVATEQYGCVCSTEEHNQYFNSNTQS

SEQ ID NO: 137467 - protein, 35 aa, Artificial Sequence
  Description of Artificial Sequence: Synthetic polypeptide
DEEEIRTTNPVATEQYGCVCSTEEHNQYFGSETQS

SEQ ID NO: 137468 - protein, 35 aa, Artificial Sequence
  Description of Artificial Sequence: Synthetic polypeptide
DEEEIRTTNPVATEQYGCVCSTEEHNQNFNSQNQS

SEQ ID NO: 137469 - protein, 34 aa, Artificial Sequence
  Description of Artificial Sequence: Synthetic polypeptide
DEEEIRTTNPVATEQYGCVCSTEEHNQNFISQQA

SEQ ID NO: 137470 - protein, 35 aa, Artificial Sequence
  Description of Artificial Sequence: Synthetic polypeptide
DEEEIRTTNPVATEQYGCVCSTEEHNQHFNSDNQL

SEQ ID NO: 137471 - protein, 35 aa, Artificial Sequence
  Description of Artificial Sequence: Synthetic polypeptide
DEEEIRTTNPVATEQYGCVCSTEEHNQEYFNSDQQ

SEQ ID NO: 137472 - protein, 35 aa, Artificial Sequence
  Description of Artificial Sequence: Synthetic polypeptide
DEEEIRTTNPVATEQYGCVCSTEEHNQENFNSNQA

SEQ ID NO: 137473 - protein, 35 aa, Artificial Sequence
  Description of Artificial Sequence: Synthetic polypeptide
DEEEIRTTNPVATEQYGCVCSTEEHQEHFPSNTQS

SEQ ID NO: 137474 - protein, 34 aa, Artificial Sequence
  Description of Artificial Sequence: Synthetic polypeptide
DEEEISTTNPVATEQYGCVCSTEEHQYFFSENQA

SEQ ID NO: 137475 - protein, 35 aa, Artificial Sequence
  Description of Artificial Sequence: Synthetic polypeptide
DEEEIRTTNPVATEQYGCVCSTEEHNQEHFGSEQA

SEQ ID NO: 137476 - protein, 34 aa, Artificial Sequence
  Description of Artificial Sequence: Synthetic polypeptide
DEEEISTTNPVATEQYGCVCSTEEHNQNFGSQQS

SEQ ID NO: 137477 - protein, 34 aa, Artificial Sequence
  Description of Artificial Sequence: Synthetic polypeptide
DEEEIRTTNPVATEQYGCVCSTEEHNANFNSDQA

SEQ ID NO: 137478 - protein, 35 aa, Artificial Sequence
  Description of Artificial Sequence: Synthetic polypeptide
DEEEIRTTNPVATEQYGCVCSTEEHNAENFNSQQS

SEQ ID NO: 137479 - protein, 35 aa, Artificial Sequence
  Description of Artificial Sequence: Synthetic polypeptide
DEEEIRTTNPVATEQYGCVCSTEEHNAENFNSNQP

SEQ ID NO: 137480 - protein, 35 aa, Artificial Sequence
  Description of Artificial Sequence: Synthetic polypeptide
DEEEIRTTNPVATEQYGCVCSTEEHNAENFNSDQM

SEQ ID NO: 137481 - protein, 34 aa, Artificial Sequence
  Description of Artificial Sequence: Synthetic polypeptide
DEEEISTTNPVATEQYGCVCSTEEHNQEHFGSDQ

SEQ ID NO: 137482 - protein, 34 aa, Artificial Sequence
  Description of Artificial Sequence: Synthetic polypeptide
DEEEIRTTNPVATEQYGCVCSTEEHIHFGSETQL

SEQ ID NO: 137483 - protein, 34 aa, Artificial Sequence
  Description of Artificial Sequence: Synthetic polypeptide
DEEEISTTNPVATEQYGCVCSTEEDQNFNSQTQS

SEQ ID NO: 137484 - protein, 34 aa, Artificial Sequence
  Description of Artificial Sequence: Synthetic polypeptide
DEEEISTTNPVATEQYGCVCSTEEHQSFGSDTQA

SEQ ID NO: 137485 - protein, 34 aa, Artificial Sequence
  Description of Artificial Sequence: Synthetic polypeptide
DEEEIRTTNPVATEQYGCVCSTEEHQENFFSDQS

SEQ ID NO: 137486 - protein, 33 aa, Artificial Sequence
  Description of Artificial Sequence: Synthetic polypeptide
DEEEISTTNPVATEQYGCVCSTEHAGFGSETQS

SEQ ID NO: 137487 - protein, 34 aa, Artificial Sequence
  Description of Artificial Sequence: Synthetic polypeptide
DEEEIRTTNPVATEQYGCVCSTEEHQESFTSDQN

SEQ ID NO: 137488 - protein, 34 aa, Artificial Sequence
  Description of Artificial Sequence: Synthetic polypeptide
DEEEISTTNPVATEQYGCVCSTEHQEHFGSDTQF

SEQ ID NO: 137489 - protein, 35 aa, Artificial Sequence
  Description of Artificial Sequence: Synthetic polypeptide
DEEEIRTTNPVATEQYGCVCSTEELTESFGSETQS

SEQ ID NO: 137490 - protein, 35 aa, Artificial Sequence
  Description of Artificial Sequence: Synthetic polypeptide
DEEEISTTNPVATEQYGCVCSTEHNTEHFGSENQA

SEQ ID NO: 137491 - protein, 33 aa, Artificial Sequence
  Description of Artificial Sequence: Synthetic polypeptide
DEEEISTTNPVATEQYGCVCSTEHNQYFISEQS

SEQ ID NO: 137492 - protein, 33 aa, Artificial Sequence
  Description of Artificial Sequence: Synthetic polypeptide
DEEEIRTTNPVAYEQYGCVCSNWEHQNFGSDQE

SEQ ID NO: 137493 - protein, 34 aa, Artificial Sequence
  Description of Artificial Sequence: Synthetic polypeptide
DEEEIRTTNPVAYEQYGCVCSNWELQENFGSEQG

SEQ ID NO: 137494 - protein, 34 aa, Artificial Sequence
  Description of Artificial Sequence: Synthetic polypeptide
DEEEIRTTNPVATEQYGCVCSTEEHTEFFGSDAS

SEQ ID NO: 137495 - protein, 34 aa, Artificial Sequence
  Description of Artificial Sequence: Synthetic polypeptide
DEEEISTTNPVATEQYGCVCSTEHNQNFGSETQI

SEQ ID NO: 137496 - protein, 35 aa, Artificial Sequence
  Description of Artificial Sequence: Synthetic polypeptide
TEECIRTTNPVATEQYGQVVSCTQNEQSQFLGGND

SEQ ID NO: 137497 - protein, 34 aa, Artificial Sequence
  Description of Artificial Sequence: Synthetic polypeptide
DEEEISTTNPVATEQYGCVCSTEHNQENFNSQQM

SEQ ID NO: 137498 - protein, 34 aa, Artificial Sequence
  Description of Artificial Sequence: Synthetic polypeptide
DEEEISTTNPVATEQYGCVCSTEHNQENFNSQQA

SEQ ID NO: 137499 - protein, 34 aa, Artificial Sequence
  Description of Artificial Sequence: Synthetic polypeptide
DEEEISTTNPVATEQYGCVCSTEHNQENFNSEQS

SEQ ID NO: 137500 - protein, 34 aa, Artificial Sequence
  Description of Artificial Sequence: Synthetic polypeptide
DEEEISTTNPVATEQYGCVCSTEHNQENFGSQQV

SEQ ID NO: 137501 - protein, 34 aa, Artificial Sequence
  Description of Artificial Sequence: Synthetic polypeptide
DEEEISTTNPVATEQYGCVCSTEHNIEGFGSDQS

SEQ ID NO: 137502 - protein, 36 aa, Artificial Sequence
  Description of Artificial Sequence: Synthetic polypeptide
DEEEIRTTNPVATEAYGSVVSNWLVNLGMTGNTQID

SEQ ID NO: 137503 - protein, 34 aa, Artificial Sequence
  Description of Artificial Sequence: Synthetic polypeptide
DEEEISTTNPVATEQYGCVCSTEHNEEHFGSDQA

SEQ ID NO: 137504 - protein, 34 aa, Artificial Sequence
  Description of Artificial Sequence: Synthetic polypeptide
DEEEIRTTNPVATEQYGCVCSTEEHQNFISDTQV

SEQ ID NO: 137505 - protein, 34 aa, Artificial Sequence
  Description of Artificial Sequence: Synthetic polypeptide
DEEEISTTNPVATEQYGCVCSTEHFQSFNSNTQG

SEQ ID NO: 137506 - protein, 34 aa, Artificial Sequence
  Description of Artificial Sequence: Synthetic polypeptide
DEEEIRTTNPVATEQYGCVCSTEEHQNFISDTQA

SEQ ID NO: 137507 - protein, 34 aa, Artificial Sequence
  Description of Artificial Sequence: Synthetic polypeptide
DEEEISTTNPVATEQYGCVCSTEHFEGFGSNNQS

SEQ ID NO: 137508 - protein, 34 aa, Artificial Sequence
  Description of Artificial Sequence: Synthetic polypeptide
DEEEISTTNPVATEQYGCVCSTEHDQGFNSDTQG

SEQ ID NO: 137509 - protein, 34 aa, Artificial Sequence
  Description of Artificial Sequence: Synthetic polypeptide
DEEEIRTTNPVATEQYGCVCSTEEHIESFGSDQA

SEQ ID NO: 137510 - protein, 33 aa, Artificial Sequence
  Description of Artificial Sequence: Synthetic polypeptide
DEEEISTTNPVATEQYGCVCSTEHQENFPSVQA

SEQ ID NO: 137511 - protein, 34 aa, Artificial Sequence
  Description of Artificial Sequence: Synthetic polypeptide
DEEEISTTNPVATEQYGCVCSTEEDNQGFNSDQA

SEQ ID NO: 137512 - protein, 32 aa, Artificial Sequence
  Description of Artificial Sequence: Synthetic polypeptide
TEECIRTTNPVAYEQYGTTVSCTINVSQSDEN

SEQ ID NO: 137513 - protein, 33 aa, Artificial Sequence
  Description of Artificial Sequence: Synthetic polypeptide
TEEEIAATNPVAYEQYGNTVSVIMALQGTGGNR

SEQ ID NO: 137514 - protein, 34 aa, Artificial Sequence
  Description of Artificial Sequence: Synthetic polypeptide
DEEEIRTTNPVATEQYGCVCSTEEDIEFFNSEQS

SEQ ID NO: 137515 - protein, 34 aa, Artificial Sequence
  Description of Artificial Sequence: Synthetic polypeptide
DEEEIRTTNPVATEQYGCVCSTEEDHQYFISDQT

SEQ ID NO: 137516 - protein, 35 aa, Artificial Sequence
  Description of Artificial Sequence: Synthetic polypeptide
DEEEIRTTNPVAYEQYGCVCSTGEDHQENFGSNQA

SEQ ID NO: 137517 - protein, 34 aa, Artificial Sequence
  Description of Artificial Sequence: Synthetic polypeptide
DEEEIRTTNPVAYEQYGCVCSTGEDTQNFGSDQS

SEQ ID NO: 137518 - protein, 36 aa, Artificial Sequence
  Description of Artificial Sequence: Synthetic polypeptide
DEEEIRTTNPVATEQYGCVCSTEEDHNQNFGSNNQA

SEQ ID NO: 137519 - protein, 35 aa, Artificial Sequence
  Description of Artificial Sequence: Synthetic polypeptide
DEEEIRTTNPVATEQYGCVCSTEEDHNQHFNSNQL

SEQ ID NO: 137520 - protein, 33 aa, Artificial Sequence
  Description of Artificial Sequence: Synthetic polypeptide
DEEEISTTNPVATEQYGCVCSSNHQENFISDQG

SEQ ID NO: 137521 - protein, 35 aa, Artificial Sequence
  Description of Artificial Sequence: Synthetic polypeptide
DEEEIRTTNPVAYEQYGCVCSTGEHQEHFGSENQS

SEQ ID NO: 137522 - protein, 31 aa, Artificial Sequence
  Description of Artificial Sequence: Synthetic polypeptide
TEEDIRTTNPVATSMYGCVDATVALDQGGQG

SEQ ID NO: 137523 - protein, 34 aa, Artificial Sequence
  Description of Artificial Sequence: Synthetic polypeptide
DEEEIRTTNPVAYEQYGCVCSTGELENFGSETQP

SEQ ID NO: 137524 - protein, 34 aa, Artificial Sequence
  Description of Artificial Sequence: Synthetic polypeptide
DEEEISTTNPVATEQYGCVCSSMEHQGFGSNNQS

SEQ ID NO: 137525 - protein, 36 aa, Artificial Sequence
  Description of Artificial Sequence: Synthetic polypeptide
DEEEIRTTNPVATEQYGCVCSTEEDHNQEFFGSNQN

SEQ ID NO: 137526 - protein, 35 aa, Artificial Sequence
  Description of Artificial Sequence: Synthetic polypeptide
DEEEIRTTNPVATEQYGCVCSTEEDHAFFGSNTQP

SEQ ID NO: 137527 - protein, 34 aa, Artificial Sequence
  Description of Artificial Sequence: Synthetic polypeptide
DEEEIRTTNPVATEQYGCVCSTEEDEHFNSETQA

SEQ ID NO: 137528 - protein, 34 aa, Artificial Sequence
  Description of Artificial Sequence: Synthetic polypeptide
DEEEIRTTNPVATEQYGCVCSTEEDAEFFGSEQP

SEQ ID NO: 137529 - protein, 32 aa, Artificial Sequence
  Description of Artificial Sequence: Synthetic polypeptide
TEEEIACTNPVAYEPYGSVATNLDQAGGQDEH

SEQ ID NO: 137530 - protein, 31 aa, Artificial Sequence
  Description of Artificial Sequence: Synthetic polypeptide
TEEEIASVNPVCTEPYGVVSCINELQSGGNQ

SEQ ID NO: 137531 - protein, 34 aa, Artificial Sequence
  Description of Artificial Sequence: Synthetic polypeptide
DEEEIRTTNPVAYEQYGCVCSTMEHQNFGSETQL

SEQ ID NO: 137532 - protein, 32 aa, Artificial Sequence
  Description of Artificial Sequence: Synthetic polypeptide
TEEEIASVNPVCTEQYGCVVCTDNGLQSGNEQ

SEQ ID NO: 137533 - protein, 33 aa, Artificial Sequence
  Description of Artificial Sequence: Synthetic polypeptide
DEEEISTTNPVATEQYGCVCSSMEHQSFGSDQA

SEQ ID NO: 137534 - protein, 33 aa, Artificial Sequence
  Description of Artificial Sequence: Synthetic polypeptide
DEEEISTTNPVATEQYGCVCSSPLIENFNSEQS

SEQ ID NO: 137535 - protein, 35 aa, Artificial Sequence
  Description of Artificial Sequence: Synthetic polypeptide
DEEEISTTNPVATEQYGCVCSSVELQENFGSENQS

SEQ ID NO: 137536 - protein, 36 aa, Artificial Sequence
  Description of Artificial Sequence: Synthetic polypeptide
DEEEIRTTNPVATEQYGCVCSTEEDLNQNFNSDFQP

SEQ ID NO: 137537 - protein, 33 aa, Artificial Sequence
  Description of Artificial Sequence: Synthetic polypeptide
TEECIRTTNPVAYEQYGTTVSCTMNVSQSYGEN

SEQ ID NO: 137538 - protein, 34 aa, Artificial Sequence
  Description of Artificial Sequence: Synthetic polypeptide
DEEEIRTTNPVATEQYGCVCSTEEHAFFGSDFQP

SEQ ID NO: 137539 - protein, 34 aa, Artificial Sequence
  Description of Artificial Sequence: Synthetic polypeptide
DEEEISTTNPVATEQYGCVCSTEDQENFGSDFQS

SEQ ID NO: 137540 - protein, 34 aa, Artificial Sequence
  Description of Artificial Sequence: Synthetic polypeptide
DEEEIRTTNPVAYEQYGCVCSSGEHQEGFNSDQG

SEQ ID NO: 137541 - protein, 34 aa, Artificial Sequence
  Description of Artificial Sequence: Synthetic polypeptide
DEEEISTTNPVATEQYGCVCSTEDNQENFGSDQP

SEQ ID NO: 137542 - protein, 35 aa, Artificial Sequence
  Description of Artificial Sequence: Synthetic polypeptide
DEEEISTTNPVATEQYGCVCSTEDNQEGFGSENQG

SEQ ID NO: 137543 - protein, 34 aa, Artificial Sequence
  Description of Artificial Sequence: Synthetic polypeptide
DEEEIRTTNPVAYEQYGCVCSTEDHQEHFNSDQA

SEQ ID NO: 137544 - protein, 32 aa, Artificial Sequence
  Description of Artificial Sequence: Synthetic polypeptide
TEECISTTNPVATEQYGCVCSWEHQENFGSNQ

SEQ ID NO: 137545 - protein, 34 aa, Artificial Sequence
  Description of Artificial Sequence: Synthetic polypeptide
DEEEISTTNPVATEQYGCVCSTEDHQENFNSDQS

SEQ ID NO: 137546 - protein, 34 aa, Artificial Sequence
  Description of Artificial Sequence: Synthetic polypeptide
DEEEISTTNPVATEQYGCVCSTEDHNQNFPSNQG

SEQ ID NO: 137547 - protein, 32 aa, Artificial Sequence
  Description of Artificial Sequence: Synthetic polypeptide
TEECISTTNPVATEQYGCVCSWNHQNFGSDQM

SEQ ID NO: 137548 - protein, 35 aa, Artificial Sequence
  Description of Artificial Sequence: Synthetic polypeptide
DEEEIRTTNPVATEQYGCVCSTEEDQEHFNSNTQL

SEQ ID NO: 137549 - protein, 32 aa, Artificial Sequence
  Description of Artificial Sequence: Synthetic polypeptide
TEECISTTNPVAYEQWGSVSKNLEMDLGGERG

SEQ ID NO: 137550 - protein, 35 aa, Artificial Sequence
  Description of Artificial Sequence: Synthetic polypeptide
DEEEIRTTNPVATEQYGCVCSTEEDPQFFGSETQA

SEQ ID NO: 137551 - protein, 34 aa, Artificial Sequence
  Description of Artificial Sequence: Synthetic polypeptide
DEEEISTTNPVATEQYGCVCSTEDDQESFGSEQS

SEQ ID NO: 137552 - protein, 36 aa, Artificial Sequence
  Description of Artificial Sequence: Synthetic polypeptide
DEEEIRTTNPVATEQYGCVCSTEEDLTEFFGSDNQS

SEQ ID NO: 137553 - protein, 34 aa, Artificial Sequence
  Description of Artificial Sequence: Synthetic polypeptide
DEEEISTTNPVATEQYGCVCSTEAHQEFFGSDQS

SEQ ID NO: 137554 - protein, 33 aa, Artificial Sequence
  Description of Artificial Sequence: Synthetic polypeptide
TEECVRTTNPIAYEQYGCVVSCTDLSQLGGNYR

SEQ ID NO: 137555 - protein, 29 aa, Artificial Sequence
  Description of Artificial Sequence: Synthetic peptide
DDSEVACTNPVSTEGYGEVANNIQSRGGR

SEQ ID NO: 137556 - protein, 29 aa, Artificial Sequence
  Description of Artificial Sequence: Synthetic peptide
DDSEVACTNPVSTEGYGEVANNIQSRGQR

SEQ ID NO: 137557 - protein, 35 aa, Artificial Sequence
  Description of Artificial Sequence: Synthetic polypeptide
TEECVRTTNPIAYEQYGETVQSTANLSQRGGNNRL

SEQ ID NO: 137558 - protein, 34 aa, Artificial Sequence
  Description of Artificial Sequence: Synthetic polypeptide
DEEEISTTNPVATEQYGCVCSTEEDLANFNSNQD

SEQ ID NO: 137559 - protein, 34 aa, Artificial Sequence
  Description of Artificial Sequence: Synthetic polypeptide
DEEEISTTNPVATEQYGCVCSTGEPQENFNSNQS

SEQ ID NO: 137560 - protein, 34 aa, Artificial Sequence
  Description of Artificial Sequence: Synthetic polypeptide
DEEEIRTTNPVATEQYGCVCSTEEPHANFGSDQL

SEQ ID NO: 137561 - protein, 34 aa, Artificial Sequence
  Description of Artificial Sequence: Synthetic polypeptide
DEEEIRTTNPVATEQYGCVCSTEEPQEHFISDQE

SEQ ID NO: 137562 - protein, 33 aa, Artificial Sequence
  Description of Artificial Sequence: Synthetic polypeptide
DEEEIRTTNPVAYEQYGCVCQTELNQYFDSEQS

SEQ ID NO: 137563 - protein, 35 aa, Artificial Sequence
  Description of Artificial Sequence: Synthetic polypeptide
DEEEISTTNPVATEQYGCVCSTGEHQEGFGSDNQD

SEQ ID NO: 137564 - protein, 38 aa, Artificial Sequence
  Description of Artificial Sequence: Synthetic polypeptide
DEEEIRTTNPVATEAYGSVSTVTNTNLQAGNTNDEEDE

SEQ ID NO: 137565 - protein, 32 aa, Artificial Sequence
  Description of Artificial Sequence: Synthetic polypeptide
TEDEIRTTNPVAYESWGCVSTNLQGNEGGMSP

SEQ ID NO: 137566 - protein, 34 aa, Artificial Sequence
  Description of Artificial Sequence: Synthetic polypeptide
DEEEISTTNPVATEQYGCVCSTGEHNQYFGSEQA

SEQ ID NO: 137567 - protein, 34 aa, Artificial Sequence
  Description of Artificial Sequence: Synthetic polypeptide
DEEEISTTNPVATEQYGCVCSTGEHNQYFGSDQS

SEQ ID NO: 137568 - protein, 38 aa, Artificial Sequence
  Description of Artificial Sequence: Synthetic polypeptide
DEEEIRTTNPVATEAYGSVSTVTNTNLQLGNTNVEEGE

SEQ ID NO: 137569 - protein, 34 aa, Artificial Sequence
  Description of Artificial Sequence: Synthetic polypeptide
DEEEISTTNPVATEQYGCVCSTGEHNQNFNSDQS

SEQ ID NO: 137570 - protein, 34 aa, Artificial Sequence
  Description of Artificial Sequence: Synthetic polypeptide
DEEEISTTNPVATEQYGCVCSTGEHNQNFNSDQG

SEQ ID NO: 137571 - protein, 38 aa, Artificial Sequence
  Description of Artificial Sequence: Synthetic polypeptide
DEEEIRTTNPVATEAYGSVSTVTNNQLGTQLGNNNNNQ

SEQ ID NO: 137572 - protein, 32 aa, Artificial Sequence
  Description of Artificial Sequence: Synthetic polypeptide
TEDQIRTTNPVAYESYGCTVSNTNLSHTGDNE

SEQ ID NO: 137573 - protein, 34 aa, Artificial Sequence
  Description of Artificial Sequence: Synthetic polypeptide
DEEEISTTNPVATEQYGCVCSTGEHNQGFGSDTQ

SEQ ID NO: 137574 - protein, 37 aa, Artificial Sequence
  Description of Artificial Sequence: Synthetic polypeptide
DEEEIRTTNPVATEAYGSVSTVVNNQQGTTNEETEED

SEQ ID NO: 137575 - protein, 33 aa, Artificial Sequence
  Description of Artificial Sequence: Synthetic polypeptide
TEEAEIRTTNPVAYEQWGSVSGGNGNSGEGNTS

SEQ ID NO: 137576 - protein, 37 aa, Artificial Sequence
  Description of Artificial Sequence: Synthetic polypeptide
DEEEIRTTNPVATEAYGSVSTVVNQQQLGNTDEEEND

SEQ ID NO: 137577 - protein, 38 aa, Artificial Sequence
  Description of Artificial Sequence: Synthetic polypeptide
DEEEIRTTNPVATEAYGSVSTVVNTNLQLGGNNDEQGV

SEQ ID NO: 137578 - protein, 34 aa, Artificial Sequence
  Description of Artificial Sequence: Synthetic polypeptide
TEEAEIRTTNPVAYESWGSVATNLNQGDVGQNQH

SEQ ID NO: 137579 - protein, 34 aa, Artificial Sequence
  Description of Artificial Sequence: Synthetic polypeptide
TEEAIRTTNPAATVQYGMSLPSTNNMDQRQGHFR

SEQ ID NO: 137580 - protein, 34 aa, Artificial Sequence
  Description of Artificial Sequence: Synthetic polypeptide
DEEEISTTNPVATEQYGCVCSTGEHNANFGSDQA

SEQ ID NO: 137581 - protein, 32 aa, Artificial Sequence
  Description of Artificial Sequence: Synthetic polypeptide
TEEAIRTTNPVATEAYGKISTGLSDEDGGNNE

SEQ ID NO: 137582 - protein, 37 aa, Artificial Sequence
  Description of Artificial Sequence: Synthetic polypeptide
DEEEIRTTNPVATEAYGSVSTVVNNNNNQQGTNDTDE

SEQ ID NO: 137583 - protein, 34 aa, Artificial Sequence
  Description of Artificial Sequence: Synthetic polypeptide
DEEEISTTNPVATEQYGCVCSTGEHQNFGSQTQV

SEQ ID NO: 137584 - protein, 34 aa, Artificial Sequence
  Description of Artificial Sequence: Synthetic polypeptide
DEEEISTTNPVATEQYGCVCSTGEHQNFPSNNQS

SEQ ID NO: 137585 - protein, 34 aa, Artificial Sequence
  Description of Artificial Sequence: Synthetic polypeptide
DEEEISTTNPVATEQYGCVCSTGEHQNSISQNQS

SEQ ID NO: 137586 - protein, 34 aa, Artificial Sequence
  Description of Artificial Sequence: Synthetic polypeptide
DEEEISTTNPVATEQYGCVCSTGENQNFGSDTQA

SEQ ID NO: 137587 - protein, 38 aa, Artificial Sequence
  Description of Artificial Sequence: Synthetic polypeptide
DEEEIRTTNPVATEAYGSVSTVNNTNLQLGNQNDEQGD

SEQ ID NO: 137588 - protein, 34 aa, Artificial Sequence
  Description of Artificial Sequence: Synthetic polypeptide
DEEEISTTNPVATEQYGCVCSTGELTENFNSQQS

SEQ ID NO: 137589 - protein, 34 aa, Artificial Sequence
  Description of Artificial Sequence: Synthetic polypeptide
DEEEIRTTNPVAYEQYGCVCGTENLNQYFDSDQA

SEQ ID NO: 137590 - protein, 34 aa, Artificial Sequence
  Description of Artificial Sequence: Synthetic polypeptide
DEEEISTTNPVATEQYGCVCSTGELQNFSSEPQS

SEQ ID NO: 137591 - protein, 37 aa, Artificial Sequence
  Description of Artificial Sequence: Synthetic polypeptide
DEEEIRTTNPVATEAYGSVSTVNQNNQQGTNNNTTDD

SEQ ID NO: 137592 - protein, 38 aa, Artificial Sequence
  Description of Artificial Sequence: Synthetic polypeptide
DEEEIRTTNPVATEAYGSVSTVNQQLQQGTEEGNTTNQ

SEQ ID NO: 137593 - protein, 35 aa, Artificial Sequence
  Description of Artificial Sequence: Synthetic polypeptide
DEEEISTTNPVATEQYGCVCSTGELQENFLSDNQS

SEQ ID NO: 137594 - protein, 32 aa, Artificial Sequence
  Description of Artificial Sequence: Synthetic polypeptide
DEEEIRTTNPVAYEQYGCVCGWELQYFDSDQA

SEQ ID NO: 137595 - protein, 37 aa, Artificial Sequence
  Description of Artificial Sequence: Synthetic polypeptide
DEEEIRTTNPVATEAYGSVSTVNQQQGNQQGTNEEQD

SEQ ID NO: 137596 - protein, 35 aa, Artificial Sequence
  Description of Artificial Sequence: Synthetic polypeptide
DEEEISTTNPVATEQYGCVCSTGELNQENFGSDQG

SEQ ID NO: 137597 - protein, 34 aa, Artificial Sequence
  Description of Artificial Sequence: Synthetic polypeptide
DEEEISTTNPVATEQYGCVCSTGELNANFNSDQA

SEQ ID NO: 137598 - protein, 36 aa, Artificial Sequence
  Description of Artificial Sequence: Synthetic polypeptide
DEEEIRTTNPVATEAYGSVSTVQQANTEQGTNANQD

SEQ ID NO: 137599 - protein, 35 aa, Artificial Sequence
  Description of Artificial Sequence: Synthetic polypeptide
DEEEISTTNPVATEQYGCVCSTGELFQENFNSDQA

SEQ ID NO: 137600 - protein, 35 aa, Artificial Sequence
  Description of Artificial Sequence: Synthetic polypeptide
DEEEISTTNPVATEQYGCVCSTGELDQNFNSDNQS

SEQ ID NO: 137601 - protein, 34 aa, Artificial Sequence
  Description of Artificial Sequence: Synthetic polypeptide
DEEEIRTTNPVAYEQYGCVCGWNLNQYFDSDNQS

SEQ ID NO: 137602 - protein, 33 aa, Artificial Sequence
  Description of Artificial Sequence: Synthetic polypeptide
DEEEIRTTNPVAYEQYGCVCGWNLQEYFDSDQS

SEQ ID NO: 137603 - protein, 33 aa, Artificial Sequence
  Description of Artificial Sequence: Synthetic polypeptide
DEEEISTTNPVATEQYGCVCSTGEHTNFISNQA

SEQ ID NO: 137604 - protein, 33 aa, Artificial Sequence
  Description of Artificial Sequence: Synthetic polypeptide
DEEEISTTNPVATEQYGCVCSTGEHQYFMSDQA

SEQ ID NO: 137605 - protein, 34 aa, Artificial Sequence
  Description of Artificial Sequence: Synthetic polypeptide
TEDEIRTTNPVATQQYGCVVSCTNVSERGGNNPL

SEQ ID NO: 137606 - protein, 37 aa, Artificial Sequence
  Description of Artificial Sequence: Synthetic polypeptide
DEEEIRTTNPVATEAYGSVSTVTNNNLTEQGSNNNTD

SEQ ID NO: 137607 - protein, 34 aa, Artificial Sequence
  Description of Artificial Sequence: Synthetic polypeptide
DEEEIRTTNPVATEQYGCVCSTEHQENFDSDFQS

SEQ ID NO: 137608 - protein, 33 aa, Artificial Sequence
  Description of Artificial Sequence: Synthetic polypeptide
DEEEISTTNPVATEQYGCVCSTEHQHFTSETQS

SEQ ID NO: 137609 - protein, 33 aa, Artificial Sequence
  Description of Artificial Sequence: Synthetic polypeptide
TEECIATTNPVATEQYGSVSWNEGIDRQGGTMS

SEQ ID NO: 137610 - protein, 32 aa, Artificial Sequence
  Description of Artificial Sequence: Synthetic polypeptide
DEEEIRTTNPVAYEQYGCVCQWEHQNFGSEDS

SEQ ID NO: 137611 - protein, 34 aa, Artificial Sequence
  Description of Artificial Sequence: Synthetic polypeptide
TEECIRTTNPVATEQYGCVCSTGNLAYFLSDNQS

SEQ ID NO: 137612 - protein, 34 aa, Artificial Sequence
  Description of Artificial Sequence: Synthetic polypeptide
DEEEIRTTNPVAYEQYGCVCSNTEHNANFGSEQS

SEQ ID NO: 137613 - protein, 34 aa, Artificial Sequence
  Description of Artificial Sequence: Synthetic polypeptide
DEEEIRTTNPVAYEQYGCVCSNTEHNQNFGSEQF

SEQ ID NO: 137614 - protein, 34 aa, Artificial Sequence
  Description of Artificial Sequence: Synthetic polypeptide
DEEEIRTTNPVATEQYGCVCSTEHAEFFGSDTQA

SEQ ID NO: 137615 - protein, 38 aa, Artificial Sequence
  Description of Artificial Sequence: Synthetic polypeptide
DEEEIRTTNPVATEAYGSVSVTVVNNLQQGTNDTEDEE

SEQ ID NO: 137616 - protein, 34 aa, Artificial Sequence
  Description of Artificial Sequence: Synthetic polypeptide
DEEEIRTTNPVAYEQYGCVCSNTGEHANFGSNQS

SEQ ID NO: 137617 - protein, 34 aa, Artificial Sequence
  Description of Artificial Sequence: Synthetic polypeptide
DEEEISTTNPVATEQYGCVCSTELQENFFSETQM

SEQ ID NO: 137618 - protein, 33 aa, Artificial Sequence
  Description of Artificial Sequence: Synthetic polypeptide
TEECIRTTNPVATEQYGCVCSTNLNAFFLSDQS

SEQ ID NO: 137619 - protein, 35 aa, Artificial Sequence
  Description of Artificial Sequence: Synthetic polypeptide
DEEEISTTNPVATEQYGCVCSTELNQENFISENQS

SEQ ID NO: 137620 - protein, 33 aa, Artificial Sequence
  Description of Artificial Sequence: Synthetic polypeptide
TEECIRTTNPVATEQYGCVCSTELNAHFLSNQM

SEQ ID NO: 137621 - protein, 33 aa, Artificial Sequence
  Description of Artificial Sequence: Synthetic polypeptide
TEECIRTTNPVATEQYGCVCSTPLNANFLSNQA

SEQ ID NO: 137622 - protein, 35 aa, Artificial Sequence
  Description of Artificial Sequence: Synthetic polypeptide
DEEEIRTTNPVAYEQYGCVCSNTGELQNFNSDPQT

SEQ ID NO: 137623 - protein, 33 aa, Artificial Sequence
  Description of Artificial Sequence: Synthetic polypeptide
TEECIRTTNPVATEQYGCVCSTTNLAYFLSDQS

SEQ ID NO: 137624 - protein, 35 aa, Artificial Sequence
  Description of Artificial Sequence: Synthetic polypeptide
DEEEIRTTNPVAYEQYGCVCSNTNEHQEGFISEQA

SEQ ID NO: 137625 - protein, 33 aa, Artificial Sequence
  Description of Artificial Sequence: Synthetic polypeptide
DEEEISTTNPVATEQYGCVCSTEHQYFPSDTQS

SEQ ID NO: 137626 - protein, 34 aa, Artificial Sequence
  Description of Artificial Sequence: Synthetic polypeptide
TEECIRTTNPVATEQYGCVSCTLNEFSQFLGGPD

SEQ ID NO: 137627 - protein, 34 aa, Artificial Sequence
  Description of Artificial Sequence: Synthetic polypeptide
TEECIRTTNPVATEQYGCVSCTLNENSAFLGGND

SEQ ID NO: 137628 - protein, 35 aa, Artificial Sequence
  Description of Artificial Sequence: Synthetic polypeptide
DEEEIRTTNPVATEQYGCVCSTEEPQEYFNSETQS

SEQ ID NO: 137629 - protein, 33 aa, Artificial Sequence
  Description of Artificial Sequence: Synthetic polypeptide
DEEEISTTNPVATEQYGCVCSTEHQNFTSDTQA

SEQ ID NO: 137630 - protein, 35 aa, Artificial Sequence
  Description of Artificial Sequence: Synthetic polypeptide
TEECIRTTNPVATEQYGCVSCTQNEVSQFEGGNAP

SEQ ID NO: 137631 - protein, 36 aa, Artificial Sequence
  Description of Artificial Sequence: Synthetic polypeptide
DEEEIRTTNPVAYEQYGCVCSNTGELQEHFGSENQA

SEQ ID NO: 137632 - protein, 33 aa, Artificial Sequence
  Description of Artificial Sequence: Synthetic polypeptide
TEECIRTTNPVATEQYGCVCSTELAYFLSQNQS

SEQ ID NO: 137633 - protein, 35 aa, Artificial Sequence
  Description of Artificial Sequence: Synthetic polypeptide
DEEEISTTNPVATEQYGCVCSTENDHQEHFGSEQS

SEQ ID NO: 137634 - protein, 35 aa, Artificial Sequence
  Description of Artificial Sequence: Synthetic polypeptide
DEEEISTTNPVATEQYGCVCSTENHNQENFGSQQS

SEQ ID NO: 137635 - protein, 31 aa, Artificial Sequence
  Description of Artificial Sequence: Synthetic polypeptide
TEECIATTNPVAYEQWGSVSKTLEVEGGGRD

SEQ ID NO: 137636 - protein, 35 aa, Artificial Sequence
  Description of Artificial Sequence: Synthetic polypeptide
DEEEISTTNPVATEQYGCVCSTGEDQESFGSDNQS

SEQ ID NO: 137637 - protein, 34 aa, Artificial Sequence
  Description of Artificial Sequence: Synthetic polypeptide
DEEEISTTNPVATEQYGCVCSTGEDNQNFGSDQG

SEQ ID NO: 137638 - protein, 35 aa, Artificial Sequence
  Description of Artificial Sequence: Synthetic polypeptide
DEEEISTTNPVATEQYGCVCSTGEDNQHFGSENQS

SEQ ID NO: 137639 - protein, 32 aa, Artificial Sequence
  Description of Artificial Sequence: Synthetic polypeptide
TEECIATTNPVAYEQWGSVSKTNNPEMLGGPR

SEQ ID NO: 137640 - protein, 30 aa, Artificial Sequence
  Description of Artificial Sequence: Synthetic polypeptide
TEECIATTNPVAYEQWGVVSKNLEMLDGES

SEQ ID NO: 137641 - protein, 35 aa, Artificial Sequence
  Description of Artificial Sequence: Synthetic polypeptide
DEEEISTTNPVATEQYGCVCSTGEDLQNFNSNTQS

SEQ ID NO: 137642 - protein, 34 aa, Artificial Sequence
  Description of Artificial Sequence: Synthetic polypeptide
DEEEIRTTNPVATEQYGCVCSTEHQEFFFSDTQT

SEQ ID NO: 137643 - protein, 34 aa, Artificial Sequence
  Description of Artificial Sequence: Synthetic polypeptide
DEEEIRTTNPVATEQYGCVCSTEHNQENFISDQT

SEQ ID NO: 137644 - protein, 35 aa, Artificial Sequence
  Description of Artificial Sequence: Synthetic polypeptide
DEEEIRTTNPVATEQYGCVCSTEHNQENFISDNQS

SEQ ID NO: 137645 - protein, 32 aa, Artificial Sequence
  Description of Artificial Sequence: Synthetic polypeptide
TEECIRATNPVAYEQYGTTVSCTQNVSQFGEN

SEQ ID NO: 137646 - protein, 34 aa, Artificial Sequence
  Description of Artificial Sequence: Synthetic polypeptide
DEEEISTTNPVATEQYGCVCSTETNQENFNSNQS

SEQ ID NO: 137647 - protein, 34 aa, Artificial Sequence
  Description of Artificial Sequence: Synthetic polypeptide
DEEEIRTTNPVATEQYGCVCSTEHNIFFNSDTQS

SEQ ID NO: 137648 - protein, 35 aa, Artificial Sequence
  Description of Artificial Sequence: Synthetic polypeptide
DEEEISTTNPVATEQYGCVCSTESLNQVHFGSEQS

SEQ ID NO: 137649 - protein, 35 aa, Artificial Sequence
  Description of Artificial Sequence: Synthetic polypeptide
DEEEIRTTNPVATEQYGCVCSTEHNAENFNSDTQS

SEQ ID NO: 137650 - protein, 33 aa, Artificial Sequence
  Description of Artificial Sequence: Synthetic polypeptide
DEEEISTTNPVATEQYGCVCSTEPTANFNSEQA

SEQ ID NO: 137651 - protein, 35 aa, Artificial Sequence
  Description of Artificial Sequence: Synthetic polypeptide
DEEEIRTTNPVATEQYGCVCSTEHEQEYFGSDTDS

SEQ ID NO: 137652 - protein, 38 aa, Artificial Sequence
  Description of Artificial Sequence: Synthetic polypeptide
DEEEIRTTNPVATEAYGSVSVTVTNNNLQQGTTNEEEE

SEQ ID NO: 137653 - protein, 35 aa, Artificial Sequence
  Description of Artificial Sequence: Synthetic polypeptide
DEEEIRTTNPVATEQYGCVCSTEHDQENFNSETQP

SEQ ID NO: 137654 - protein, 34 aa, Artificial Sequence
  Description of Artificial Sequence: Synthetic polypeptide
AEEEIRTTNPVATEHYGQSVVSENMSSAHGGSPR

SEQ ID NO: 137655 - protein, 35 aa, Artificial Sequence
  Description of Artificial Sequence: Synthetic polypeptide
DEEEISTTNPVATEQYGCVCSTENHNQNFGSDTQS

SEQ ID NO: 137656 - protein, 32 aa, Artificial Sequence
  Description of Artificial Sequence: Synthetic polypeptide
TEECIATTNPVAYEQWGSVSKTLEEMQGGGRD

SEQ ID NO: 137657 - protein, 30 aa, Artificial Sequence
  Description of Artificial Sequence: Synthetic polypeptide
QEQEIASTNPVATEGYGVVSTTLEDHEGDI

SEQ ID NO: 137658 - protein, 32 aa, Artificial Sequence
  Description of Artificial Sequence: Synthetic polypeptide
DEAVIGTTNPVATEQWGCVCSTDDLQYFNSDQ

SEQ ID NO: 137659 - protein, 32 aa, Artificial Sequence
  Description of Artificial Sequence: Synthetic polypeptide
DEHEIRTTNPVAYEQWGSVSHPEDDRQNMNNE

SEQ ID NO: 137660 - protein, 35 aa, Artificial Sequence
  Description of Artificial Sequence: Synthetic polypeptide
DEEEIRTTNPVATEQYGSVGCNTPLLESQIMVLVV

SEQ ID NO: 137661 - protein, 34 aa, Artificial Sequence
  Description of Artificial Sequence: Synthetic polypeptide
DEEEIRTTNPVATEQYGSVCEANITADALMGDQM

SEQ ID NO: 137662 - protein, 34 aa, Artificial Sequence
  Description of Artificial Sequence: Synthetic polypeptide
DEEEIRTTNPVATEQYGSVCEDEPLQQAMLIEVP

SEQ ID NO: 137663 - protein, 35 aa, Artificial Sequence
  Description of Artificial Sequence: Synthetic polypeptide
DEEEIRTTNPVATEQYGSVGCMTLMLEPAQDEMSD

SEQ ID NO: 137664 - protein, 38 aa, Artificial Sequence
  Description of Artificial Sequence: Synthetic polypeptide
DEEEIRTTNPVATEQYGVVSTTVNLNLQQGNNDEDEDT

SEQ ID NO: 137665 - protein, 30 aa, Artificial Sequence
  Description of Artificial Sequence: Synthetic polypeptide
QENEIATTNPVASEQWGDVSCILMNAAGDR

SEQ ID NO: 137666 - protein, 38 aa, Artificial Sequence
  Description of Artificial Sequence: Synthetic polypeptide
DEEEIRTTNPVATEQYGVVSTTVNLNLQQGNNDEEEDE

SEQ ID NO: 137667 - protein, 35 aa, Artificial Sequence
  Description of Artificial Sequence: Synthetic polypeptide
DEEEIRTTNPVATEQYGSVCFAQNEDEQMQPQLNS

SEQ ID NO: 137668 - protein, 35 aa, Artificial Sequence
  Description of Artificial Sequence: Synthetic polypeptide
DEEEIRTTNPVATEQYGSVCFNHMGEEQPEGEVEI

SEQ ID NO: 137669 - protein, 36 aa, Artificial Sequence
  Description of Artificial Sequence: Synthetic polypeptide
DEEEIRTTNPVATEQYGSVCFTENAMSDQPSFENGI

SEQ ID NO: 137670 - protein, 35 aa, Artificial Sequence
  Description of Artificial Sequence: Synthetic polypeptide
DEEEIRTTNPVATEQYGSVCFVYLETWTFEGQTND

SEQ ID NO: 137671 - protein, 28 aa, Artificial Sequence
  Description of Artificial Sequence: Synthetic peptide
QENEIATTNPMATECWGDVSECLQHEEL

SEQ ID NO: 137672 - protein, 33 aa, Artificial Sequence
  Description of Artificial Sequence: Synthetic polypeptide
DEEEIATTNPVAYEQYGSVATNDADTGGGDQFG

SEQ ID NO: 137673 - protein, 29 aa, Artificial Sequence
  Description of Artificial Sequence: Synthetic peptide
QENEIATTNPLATECYGFVSECLAQHEQL

SEQ ID NO: 137674 - protein, 34 aa, Artificial Sequence
  Description of Artificial Sequence: Synthetic polypeptide
DEEEIATTNPVAYEQYGSVATGPPQPTASPGSRM

SEQ ID NO: 137675 - protein, 34 aa, Artificial Sequence
  Description of Artificial Sequence: Synthetic polypeptide
DEEEIATTNPVAYEQYGSVATGPPPNASPDGSRM

SEQ ID NO: 137676 - protein, 36 aa, Artificial Sequence
  Description of Artificial Sequence: Synthetic polypeptide
AEEEIRTTNPVATEQYGSVSTVVNQQQQTATTNANE

SEQ ID NO: 137677 - protein, 33 aa, Artificial Sequence
  Description of Artificial Sequence: Synthetic polypeptide
DEMEINTTNPVATEQYGTVCSATDCPVEFEGND

SEQ ID NO: 137678 - protein, 33 aa, Artificial Sequence
  Description of Artificial Sequence: Synthetic polypeptide
DEMEINTTNPVATEQYGTVCSATDGPVEFEGND

SEQ ID NO: 137679 - protein, 33 aa, Artificial Sequence
  Description of Artificial Sequence: Synthetic polypeptide
DEEEIATTNPVAYEQYGSVATAGTPTRNNDELH

SEQ ID NO: 137680 - protein, 33 aa, Artificial Sequence
  Description of Artificial Sequence: Synthetic polypeptide
QEEEIRTTNPVATEQYGDVQGNFNDEGGGENGA

SEQ ID NO: 137681 - protein, 32 aa, Artificial Sequence
  Description of Artificial Sequence: Synthetic polypeptide
QEEEIRTTNPVATEQYGDVMSGMGGNGDGEEA

SEQ ID NO: 137682 - protein, 33 aa, Artificial Sequence
  Description of Artificial Sequence: Synthetic polypeptide
DEMEIQTTNPVATEQYGTVCSATDGPVEFEGND

SEQ ID NO: 137683 - protein, 34 aa, Artificial Sequence
  Description of Artificial Sequence: Synthetic polypeptide
DEEEIRTTNPVATEQYGSVGCPEPLLEQQLLLEH

SEQ ID NO: 137684 - protein, 33 aa, Artificial Sequence
  Description of Artificial Sequence: Synthetic polypeptide
QEEEIRTTNPVATEQYGDVMSGIGGNGQGEEAS

SEQ ID NO: 137685 - protein, 35 aa, Artificial Sequence
  Description of Artificial Sequence: Synthetic polypeptide
DEEEIRTTNPVATEQYGSVCMSMLQQENVVQEIQT

SEQ ID NO: 137686 - protein, 34 aa, Artificial Sequence
  Description of Artificial Sequence: Synthetic polypeptide
DEEEIRTTNPVATEQYGSVCMPESLVQHPVEVEE

SEQ ID NO: 137687 - protein, 33 aa, Artificial Sequence
  Description of Artificial Sequence: Synthetic polypeptide
DEMEIQTTNPVATEQYGTVISATDGPVEFEGND

SEQ ID NO: 137688 - protein, 38 aa, Artificial Sequence
  Description of Artificial Sequence: Synthetic polypeptide
DEEEIRTTNPVATEQYGVVSTTVNLQAGNQQGNDEEED

SEQ ID NO: 137689 - protein, 35 aa, Artificial Sequence
  Description of Artificial Sequence: Synthetic polypeptide
QEEEIRTTNPVATEQYGDVGGTNMNMGQGGGNDGD

SEQ ID NO: 137690 - protein, 34 aa, Artificial Sequence
  Description of Artificial Sequence: Synthetic polypeptide
DEEEIRTTNPVATEQYGSVCMPEDSLQQTPVEIE

SEQ ID NO: 137691 - protein, 28 aa, Artificial Sequence
  Description of Artificial Sequence: Synthetic peptide
QENEIATTNPCSTECYGIVSECLQHETL

SEQ ID NO: 137692 - protein, 30 aa, Artificial Sequence
  Description of Artificial Sequence: Synthetic polypeptide
QENEIATTNPVATEAYGCVSGEPLQKHEEL

SEQ ID NO: 137693 - protein, 30 aa, Artificial Sequence
  Description of Artificial Sequence: Synthetic polypeptide
QENEIATTNPVATEAYGCVSWELQHSSELS

SEQ ID NO: 137694 - protein, 35 aa, Artificial Sequence
  Description of Artificial Sequence: Synthetic polypeptide
DEHEIRTTNPVATEQYGSCSPWVYLETERNFNDDR

SEQ ID NO: 137695 - protein, 35 aa, Artificial Sequence
  Description of Artificial Sequence: Synthetic polypeptide
DEEEIRTTNPVATEQYGSVGCPTPLLEEQQLVLPH

SEQ ID NO: 137696 - protein, 35 aa, Artificial Sequence
  Description of Artificial Sequence: Synthetic polypeptide
DEEEIRTTNPVATEQYGSVGCPTPLLEMQQLVQEH

SEQ ID NO: 137697 - protein, 36 aa, Artificial Sequence
  Description of Artificial Sequence: Synthetic polypeptide
DEEEIRTTNPVATEQYGSVGCPTPLLEQQIMVEEVR

SEQ ID NO: 137698 - protein, 35 aa, Artificial Sequence
  Description of Artificial Sequence: Synthetic polypeptide
DEEEIRTTNPVATEQYGSVGCPTPLLESQLFVLEV

SEQ ID NO: 137699 - protein, 29 aa, Artificial Sequence
  Description of Artificial Sequence: Synthetic peptide
QENEIATTNPVATECWGKVSEDLSQHEEL

SEQ ID NO: 137700 - protein, 35 aa, Artificial Sequence
  Description of Artificial Sequence: Synthetic polypeptide
DEHEIRTTNPVATEQYGKTISTNEFSGLREGGSNW

SEQ ID NO: 137701 - protein, 35 aa, Artificial Sequence
  Description of Artificial Sequence: Synthetic polypeptide
DAEEIATTNPVATEQYGSVCAMDNLGNPGNQEGNN

SEQ ID NO: 137702 - protein, 35 aa, Artificial Sequence
  Description of Artificial Sequence: Synthetic polypeptide
DEHEIRTTNPVATEQYGKTISTNEFAGLKTGGSNQ

SEQ ID NO: 137703 - protein, 33 aa, Artificial Sequence
  Description of Artificial Sequence: Synthetic polypeptide
DEEEIATTNPVAYEQYGSVCAAANPLDREVPDS

SEQ ID NO: 137704 - protein, 29 aa, Artificial Sequence
  Description of Artificial Sequence: Synthetic peptide
QENEIATTNPVATECYGATSECLQHEEYL

SEQ ID NO: 137705 - protein, 32 aa, Artificial Sequence
  Description of Artificial Sequence: Synthetic polypeptide
DEEEIATTNPVAYEQYGSVCAANAWIPRDMEA

SEQ ID NO: 137706 - protein, 34 aa, Artificial Sequence
  Description of Artificial Sequence: Synthetic polypeptide
DEEEIATTNPVAYEQYGSVCAATAQLQAAENDGQ

SEQ ID NO: 137707 - protein, 30 aa, Artificial Sequence
  Description of Artificial Sequence: Synthetic polypeptide
QEEEIRTTNPVATEQWGEVSEVEMNAAEEA

SEQ ID NO: 137708 - protein, 30 aa, Artificial Sequence
  Description of Artificial Sequence: Synthetic polypeptide
QEEEIRTTNPVATEQWGEVSEVCMNHAEEA

SEQ ID NO: 137709 - protein, 33 aa, Artificial Sequence
  Description of Artificial Sequence: Synthetic polypeptide
DEEEIATTNPVAYEQYGSVCAAANGLQSEQMDS

SEQ ID NO: 137710 - protein, 34 aa, Artificial Sequence
  Description of Artificial Sequence: Synthetic polypeptide
DEMEINTTNPVATEQYGTSVCSATDGPVEFEGND

SEQ ID NO: 137711 - protein, 34 aa, Artificial Sequence
  Description of Artificial Sequence: Synthetic polypeptide
DEEEIATTNPVAYEQYGSVATTAGTQTANGPDER

SEQ ID NO: 137712 - protein, 34 aa, Artificial Sequence
  Description of Artificial Sequence: Synthetic polypeptide
DEHEIRTTNPVATEQYGLCSSVSLQVTDGDDNQE

SEQ ID NO: 137713 - protein, 34 aa, Artificial Sequence
  Description of Artificial Sequence: Synthetic polypeptide
DEHEIRTTNPVATEQYGSCSPWLSETERNYNDDP

SEQ ID NO: 137714 - protein, 30 aa, Artificial Sequence
  Description of Artificial Sequence: Synthetic polypeptide
QENEIATTNPVATEAYGDVSECLQAHCEEL

SEQ ID NO: 137715 - protein, 34 aa, Artificial Sequence
  Description of Artificial Sequence: Synthetic polypeptide
DEHEIRTTNPVATEQYGSCINVTYSLQTGEEQQE

SEQ ID NO: 137716 - protein, 36 aa, Artificial Sequence
  Description of Artificial Sequence: Synthetic polypeptide
DEEEIRTTNPVATEQYGSVCATNPQENPDDQTGGFA

SEQ ID NO: 137717 - protein, 35 aa, Artificial Sequence
  Description of Artificial Sequence: Synthetic polypeptide
DEEEIRTTNPVATEQYGSVCATNPELNEHDDMLAG

SEQ ID NO: 137718 - protein, 36 aa, Artificial Sequence
  Description of Artificial Sequence: Synthetic polypeptide
DEEEIRTTNPVATEQYGSVCATNPELGQEHQDDIAG

SEQ ID NO: 137719 - protein, 37 aa, Artificial Sequence
  Description of Artificial Sequence: Synthetic polypeptide
DEEEIRTTNPVATEQYGVVSTVVNNQQGNDTEEEEDG

SEQ ID NO: 137720 - protein, 34 aa, Artificial Sequence
  Description of Artificial Sequence: Synthetic polypeptide
QEEEIRTTNPVATEQYGAVDTDNMNNGEGGNNIE

SEQ ID NO: 137721 - protein, 35 aa, Artificial Sequence
  Description of Artificial Sequence: Synthetic polypeptide
DEEEIRTTNPVATEQYGSVGCPRPLILEQQMVLER

SEQ ID NO: 137722 - protein, 29 aa, Artificial Sequence
  Description of Artificial Sequence: Synthetic peptide
QENEIATTNPVATECWGDVSCICLQHEEG

SEQ ID NO: 137723 - protein, 35 aa, Artificial Sequence
  Description of Artificial Sequence: Synthetic polypeptide
DEEEIRTTNPVATEQYGSVGCPTPALEHQIMVLEV

SEQ ID NO: 137724 - protein, 30 aa, Artificial Sequence
  Description of Artificial Sequence: Synthetic polypeptide
QENEIATTNPVATECWGDVSCICLQREEEG

SEQ ID NO: 137725 - protein, 36 aa, Artificial Sequence
  Description of Artificial Sequence: Synthetic polypeptide
DEEEIRTTNPVATEQYGSVGCPTPLDESQIMVLERQ

SEQ ID NO: 137726 - protein, 28 aa, Artificial Sequence
  Description of Artificial Sequence: Synthetic peptide
QENEIATTNPVATECWGDVSECLMAEEL

SEQ ID NO: 137727 - protein, 36 aa, Artificial Sequence
  Description of Artificial Sequence: Synthetic polypeptide
DEEEIRTTNPVATEQYGSVCATNNEPTGGDDLENDG

SEQ ID NO: 137728 - protein, 30 aa, Artificial Sequence
  Description of Artificial Sequence: Synthetic polypeptide
QEEEIRTTNPVATEQWGEVSEICMNHAEEA

SEQ ID NO: 137729 - protein, 30 aa, Artificial Sequence
  Description of Artificial Sequence: Synthetic polypeptide
QENEIATTNPCASEQWGDVSCILQNSAGTR

SEQ ID NO: 137730 - protein, 28 aa, Artificial Sequence
  Description of Artificial Sequence: Synthetic peptide
QENEIASVNPVCTEQYGVVSDCLQSEEL

SEQ ID NO: 137731 - protein, 34 aa, Artificial Sequence
  Description of Artificial Sequence: Synthetic polypeptide
DEMEIHTTNPVATEQYGTVCSATSGPVEQEGEND

SEQ ID NO: 137732 - protein, 33 aa, Artificial Sequence
  Description of Artificial Sequence: Synthetic polypeptide
DEMEIHTTNPVATEQYGTVCSATSGPVEFEGNN

SEQ ID NO: 137733 - protein, 33 aa, Artificial Sequence
  Description of Artificial Sequence: Synthetic polypeptide
DEHEIRTTNPVATEQYGSVCSVTYDMETIELEI

SEQ ID NO: 137734 - protein, 28 aa, Artificial Sequence
  Description of Artificial Sequence: Synthetic peptide
QENEIASTNPVGTECYGVMASTLQHGDL

SEQ ID NO: 137735 - protein, 33 aa, Artificial Sequence
  Description of Artificial Sequence: Synthetic polypeptide
DEMEIHTTNPVATEQYGTVCSATDVTVEFEGND

SEQ ID NO: 137736 - protein, 33 aa, Artificial Sequence
  Description of Artificial Sequence: Synthetic polypeptide
DEMEIHTTNPVATEQYGTVCSATDGPVEFEGND

SEQ ID NO: 137737 - protein, 33 aa, Artificial Sequence
  Description of Artificial Sequence: Synthetic polypeptide
DEMEIHTTNPVATEQYGTVCSATDGPVEAEGND

SEQ ID NO: 137738 - protein, 30 aa, Artificial Sequence
  Description of Artificial Sequence: Synthetic polypeptide
QEEEIRTTNPVATEQYGEAANEEDWQHEPK

SEQ ID NO: 137739 - protein, 36 aa, Artificial Sequence
  Description of Artificial Sequence: Synthetic polypeptide
AEEEIRTTNPVATEQYGSVSTVVNQQQTEEGEDTEG

SEQ ID NO: 137740 - protein, 33 aa, Artificial Sequence
  Description of Artificial Sequence: Synthetic polypeptide
DEMEIGTTNPVATEQYGTVCSATEGPVEFEGND

SEQ ID NO: 137741 - protein, 33 aa, Artificial Sequence
  Description of Artificial Sequence: Synthetic polypeptide
DEMEIGTTNPVATEQYGTVCSATDGPVEFEGNW

SEQ ID NO: 137742 - protein, 33 aa, Artificial Sequence
  Description of Artificial Sequence: Synthetic polypeptide
DEMEIGTTNPVATEQYGTVCSATDGPVEFEGND

SEQ ID NO: 137743 - protein, 38 aa, Artificial Sequence
  Description of Artificial Sequence: Synthetic polypeptide
DEEEIRTTNPVATEQYGVVSTTVNLQLQQGNNEEDEDE

SEQ ID NO: 137744 - protein, 31 aa, Artificial Sequence
  Description of Artificial Sequence: Synthetic polypeptide
QEEEIRTTNPVATEQYGEAPCIVEPQDHGEG

SEQ ID NO: 137745 - protein, 33 aa, Artificial Sequence
  Description of Artificial Sequence: Synthetic polypeptide
DEMEIGTTNPVATEQYGKVCSATDSPHVFEGND

SEQ ID NO: 137746 - protein, 33 aa, Artificial Sequence
  Description of Artificial Sequence: Synthetic polypeptide
DEMEIGTTNPVATEQYGHVCSATYGPVEFEGNK

SEQ ID NO: 137747 - protein, 37 aa, Artificial Sequence
  Description of Artificial Sequence: Synthetic polypeptide
DEEEIRTTNPVATEQYGSVFSTTPAMPNMENGMNPVG

SEQ ID NO: 137748 - protein, 28 aa, Artificial Sequence
  Description of Artificial Sequence: Synthetic peptide
QENEIASTNPVATEGYGVMSSTLQHEEI

SEQ ID NO: 137749 - protein, 37 aa, Artificial Sequence
  Description of Artificial Sequence: Synthetic polypeptide
AEEEIRTTNPVATEQYGSVSVTTNNNQQLQQGTEEGN

SEQ ID NO: 137750 - protein, 33 aa, Artificial Sequence
  Description of Artificial Sequence: Synthetic polypeptide
DEMEIETTNPVATEQYGTVCSATDGPVEFEGND

SEQ ID NO: 137751 - protein, 35 aa, Artificial Sequence
  Description of Artificial Sequence: Synthetic polypeptide
DEEEIATTNPVAYEQYGSVANAGNLQAAPGEIMNN

SEQ ID NO: 137752 - protein, 33 aa, Artificial Sequence
  Description of Artificial Sequence: Synthetic polypeptide
DEMEIETTNPVATEQYGTVCSATDGSVEFEGND

SEQ ID NO: 137753 - protein, 29 aa, Artificial Sequence
  Description of Artificial Sequence: Synthetic peptide
QENEIASTNPVATEQWGDVSSIEQNHGDA

SEQ ID NO: 137754 - protein, 33 aa, Artificial Sequence
  Description of Artificial Sequence: Synthetic polypeptide
DEMEIHTTNPVATEQYGTVCSATVGPVEFEGND

SEQ ID NO: 137755 - protein, 33 aa, Artificial Sequence
  Description of Artificial Sequence: Synthetic polypeptide
DEMEIFTTNPVATEQYGTVCSATDGPVEFEGND

SEQ ID NO: 137756 - protein, 34 aa, Artificial Sequence
  Description of Artificial Sequence: Synthetic polypeptide
DEMEIFTTNPVATEQYGTVCSATDGPVEQFEGND

SEQ ID NO: 137757 - protein, 35 aa, Artificial Sequence
  Description of Artificial Sequence: Synthetic polypeptide
AEEEIRTTNPVATEQYGSVSTVVNQQQTEQTEDEE

SEQ ID NO: 137758 - protein, 35 aa, Artificial Sequence
  Description of Artificial Sequence: Synthetic polypeptide
DEEEIRTTNPVATEQYGSVCNTFNCMYGRYEYSAD

SEQ ID NO: 137759 - protein, 33 aa, Artificial Sequence
  Description of Artificial Sequence: Synthetic polypeptide
DEMEIFTTNPVATEQYGTVCSATDGPVSFEGND

SEQ ID NO: 137760 - protein, 36 aa, Artificial Sequence
  Description of Artificial Sequence: Synthetic polypeptide
DEEEIRTTNPVATEQYGSVFSDMMTTAGEGGGNDEG

SEQ ID NO: 137761 - protein, 30 aa, Artificial Sequence
  Description of Artificial Sequence: Synthetic polypeptide
QEEEIRTTNPVATEQYGEAPEACQMHEEPK

SEQ ID NO: 137762 - protein, 33 aa, Artificial Sequence
  Description of Artificial Sequence: Synthetic polypeptide
DEMEIFTTNPVATEQYGTVCSATDGPVEFEGNW

SEQ ID NO: 137763 - protein, 33 aa, Artificial Sequence
  Description of Artificial Sequence: Synthetic polypeptide
DEMEIITTNPVATEQYGFVCSATDGPVEFEGND

SEQ ID NO: 137764 - protein, 33 aa, Artificial Sequence
  Description of Artificial Sequence: Synthetic polypeptide
DEMEIITTNPVATEQYGKVCSATDGPVEFEGND

SEQ ID NO: 137765 - protein, 35 aa, Artificial Sequence
  Description of Artificial Sequence: Synthetic polypeptide
DEEEIRTTNPVATEQYGSVFTDDQMTGQTVGGGGG

SEQ ID NO: 137766 - protein, 33 aa, Artificial Sequence
  Description of Artificial Sequence: Synthetic polypeptide
DEMEIKTTNPVATEQYGTVCSATDGPVEFEGND

SEQ ID NO: 137767 - protein, 28 aa, Artificial Sequence
  Description of Artificial Sequence: Synthetic peptide
QENEIASTNPVSTECYGDVAECLQREQL

SEQ ID NO: 137768 - protein, 35 aa, Artificial Sequence
  Description of Artificial Sequence: Synthetic polypeptide
QEEEIRTTNPVATEQYGDVSVDQNDGQQNIEGNEG

SEQ ID NO: 137769 - protein, 34 aa, Artificial Sequence
  Description of Artificial Sequence: Synthetic polypeptide
DEMEIKTTNPVATEQYGTVCSATDGPVERFEGND

SEQ ID NO: 137770 - protein, 28 aa, Artificial Sequence
  Description of Artificial Sequence: Synthetic peptide
QENEIASTNPVSTECYGDVSECLQHEEL

SEQ ID NO: 137771 - protein, 35 aa, Artificial Sequence
  Description of Artificial Sequence: Synthetic polypeptide
DEEEIRTTNPVATEQYGSVFTNAPPMADFGSDQYY

SEQ ID NO: 137772 - protein, 38 aa, Artificial Sequence
  Description of Artificial Sequence: Synthetic polypeptide
DEEEIRTTNPVATEQYGVVSTTVNLQAGNQQGNTTEDD

SEQ ID NO: 137773 - protein, 28 aa, Artificial Sequence
  Description of Artificial Sequence: Synthetic peptide
QENEIASTNPVSTEGYGTMASTLQHGDI

SEQ ID NO: 137774 - protein, 37 aa, Artificial Sequence
  Description of Artificial Sequence: Synthetic polypeptide
DEEEIRTTNPVATEQYGSVFTPTNGDETTQSGQDHNQ

SEQ ID NO: 137775 - protein, 34 aa, Artificial Sequence
  Description of Artificial Sequence: Synthetic polypeptide
QEEEIRTTNPVATEQYGDVSIDIMNGEDEEGNGG

SEQ ID NO: 137776 - protein, 33 aa, Artificial Sequence
  Description of Artificial Sequence: Synthetic polypeptide
DEMEILTTNPVATEQYGTVCSATDGPVEFEGND

SEQ ID NO: 137777 - protein, 29 aa, Artificial Sequence
  Description of Artificial Sequence: Synthetic peptide
QENEIASTNPVSTEPYGTMSSETLQQGNH

SEQ ID NO: 137778 - protein, 28 aa, Artificial Sequence
  Description of Artificial Sequence: Synthetic peptide
QENEIASVNPVATECYGVVSECLQHEEQ

SEQ ID NO: 137779 - protein, 33 aa, Artificial Sequence
  Description of Artificial Sequence: Synthetic polypeptide
DEMEIMTTNPVATEQYGTVCSATDGPVEFEGND

SEQ ID NO: 137780 - protein, 33 aa, Artificial Sequence
  Description of Artificial Sequence: Synthetic polypeptide
DEEEIATTNPVATEQYGSVATPAITNDPMPADE

SEQ ID NO: 137781 - protein, 33 aa, Artificial Sequence
  Description of Artificial Sequence: Synthetic polypeptide
DEMEIMTTNPVATEQYGTVCSATDGPVEFQGND

SEQ ID NO: 137782 - protein, 28 aa, Artificial Sequence
  Description of Artificial Sequence: Synthetic peptide
QENEIASTNPVSTECYGDVAECLQREEL

SEQ ID NO: 137783 - protein, 33 aa, Artificial Sequence
  Description of Artificial Sequence: Synthetic polypeptide
DEMEIKTTNPVATEQYGHVCSATDGPVEFEGND

SEQ ID NO: 137784 - protein, 33 aa, Artificial Sequence
  Description of Artificial Sequence: Synthetic polypeptide
DEMEIITTNPVATEQYGTVCSATDGPVEFEGND

SEQ ID NO: 137785 - protein, 28 aa, Artificial Sequence
  Description of Artificial Sequence: Synthetic peptide
QENEIASTNPVGTEGYGVMASTLQHGDI

SEQ ID NO: 137786 - protein, 28 aa, Artificial Sequence
  Description of Artificial Sequence: Synthetic peptide
QENEIASTNPVGTEGYGVMASTLQHGEI

SEQ ID NO: 137787 - protein, 28 aa, Artificial Sequence
  Description of Artificial Sequence: Synthetic peptide
QENEIASTNPVGTEGYGVMSSCLQHGDI

SEQ ID NO: 137788 - protein, 33 aa, Artificial Sequence
  Description of Artificial Sequence: Synthetic polypeptide
DEMEIITTNPVATEQYGTVCSATDGPVEFEGNE

SEQ ID NO: 137789 - protein, 28 aa, Artificial Sequence
  Description of Artificial Sequence: Synthetic peptide
QENEIASTNPVGTEGYGVMSSTLQHGDI

SEQ ID NO: 137790 - protein, 34 aa, Artificial Sequence
  Description of Artificial Sequence: Synthetic polypeptide
QEEEIRTTNPVATEQYGDVVGNTNGGEGQGENGN

SEQ ID NO: 137791 - protein, 33 aa, Artificial Sequence
  Description of Artificial Sequence: Synthetic polypeptide
DEMEIITTNPVATEQYGTVCSATDGPVEFLGND

SEQ ID NO: 137792 - protein, 28 aa, Artificial Sequence
  Description of Artificial Sequence: Synthetic peptide
QENEIASTNPVGTEGYGVVASCLQHGDI

SEQ ID NO: 137793 - protein, 28 aa, Artificial Sequence
  Description of Artificial Sequence: Synthetic peptide
QENEIASTNPVGTEGYGVVASTLQHEDI

SEQ ID NO: 137794 - protein, 33 aa, Artificial Sequence
  Description of Artificial Sequence: Synthetic polypeptide
DDAEISTTNPVATEQYGCVCSTNDHQSFGSDQA

SEQ ID NO: 137795 - protein, 34 aa, Artificial Sequence
  Description of Artificial Sequence: Synthetic polypeptide
QEEEIRTTNPVATEQYGDVVTGIQNDGNGGNQEE

SEQ ID NO: 137796 - protein, 34 aa, Artificial Sequence
  Description of Artificial Sequence: Synthetic polypeptide
DEEEIATTNPVAYEQYGSVANPNGDPAEGNPERN

SEQ ID NO: 137797 - protein, 28 aa, Artificial Sequence
  Description of Artificial Sequence: Synthetic peptide
QENEIASTNPVGTEGYGVVSECLQHEDL

SEQ ID NO: 137798 - protein, 33 aa, Artificial Sequence
  Description of Artificial Sequence: Synthetic polypeptide
DEMEIITTNPVATEQYGTVCSATDGTVEFEGND

SEQ ID NO: 137799 - protein, 30 aa, Artificial Sequence
  Description of Artificial Sequence: Synthetic polypeptide
QEEEIRTTNPVATEQWGEVSEICMNHAEDA

SEQ ID NO: 137800 - protein, 30 aa, Artificial Sequence
  Description of Artificial Sequence: Synthetic polypeptide
QEEEIRTTNPVATEQWGEVSEICMNAAEDA

SEQ ID NO: 137801 - protein, 34 aa, Artificial Sequence
  Description of Artificial Sequence: Synthetic polypeptide
DEEEIATTNPVAYEQYGSVCAATNPLQADEVPDS

SEQ ID NO: 137802 - protein, 34 aa, Artificial Sequence
  Description of Artificial Sequence: Synthetic polypeptide
DEEEIRTTNPVATEQYGSVAVSMLIQEVSSEQEA

SEQ ID NO: 137803 - protein, 36 aa, Artificial Sequence
  Description of Artificial Sequence: Synthetic polypeptide
DEEEIRTTNPVATEQYGSVGGPSNNDQWSENVVDQE

SEQ ID NO: 137804 - protein, 30 aa, Artificial Sequence
  Description of Artificial Sequence: Synthetic polypeptide
QENEIATTNPVATECYGDVSCICLQHEEEL

SEQ ID NO: 137805 - protein, 37 aa, Artificial Sequence
  Description of Artificial Sequence: Synthetic polypeptide
DEEEIRTTNPVATEQYGSVAWPFSTLENNSQFQENTD

SEQ ID NO: 137806 - protein, 36 aa, Artificial Sequence
  Description of Artificial Sequence: Synthetic polypeptide
DEEEIRTTNPVATEQYGSVGGPSNNDQSNNNVVDQE

SEQ ID NO: 137807 - protein, 38 aa, Artificial Sequence
  Description of Artificial Sequence: Synthetic polypeptide
DEEEIRTTNPVATEQYGSVAWPFSTNLENNRQFQENDD

SEQ ID NO: 137808 - protein, 35 aa, Artificial Sequence
  Description of Artificial Sequence: Synthetic polypeptide
QEEEIRTTNPVATDQYGVVMSDFNMLIREGQGNGN

SEQ ID NO: 137809 - protein, 36 aa, Artificial Sequence
  Description of Artificial Sequence: Synthetic polypeptide
DEEEIRTTNPVATEQYGSVGGPSNDHQSRENVVDQL

SEQ ID NO: 137810 - protein, 30 aa, Artificial Sequence
  Description of Artificial Sequence: Synthetic polypeptide
QENEIATTNPVATECYGDVSCECCLQHEEL

SEQ ID NO: 137811 - protein, 35 aa, Artificial Sequence
  Description of Artificial Sequence: Synthetic polypeptide
DEHEIRTTNPVATEPYGSVCFTNEDHTDQGGDNET

SEQ ID NO: 137812 - protein, 37 aa, Artificial Sequence
  Description of Artificial Sequence: Synthetic polypeptide
DEEEIRTTNPVATEQYGSVAYPFSTLENARQFQENDD

SEQ ID NO: 137813 - protein, 30 aa, Artificial Sequence
  Description of Artificial Sequence: Synthetic polypeptide
QENEIATTNPVATECYGDVSANCIQSHEQL

SEQ ID NO: 137814 - protein, 30 aa, Artificial Sequence
  Description of Artificial Sequence: Synthetic polypeptide
QENEIATTNPVATECYGDVSANCIQSHEEL

SEQ ID NO: 137815 - protein, 30 aa, Artificial Sequence
  Description of Artificial Sequence: Synthetic polypeptide
QENEIATTNPVATECYGDVSAECLQHEQEL

SEQ ID NO: 137816 - protein, 37 aa, Artificial Sequence
  Description of Artificial Sequence: Synthetic polypeptide
DEEEIRTTNPVATEQYGVVSTTTNQQGQEQGTNVATE

SEQ ID NO: 137817 - protein, 30 aa, Artificial Sequence
  Description of Artificial Sequence: Synthetic polypeptide
QEEEIRTTNPVATECWGEVPEVCPQDREEK

SEQ ID NO: 137818 - protein, 34 aa, Artificial Sequence
  Description of Artificial Sequence: Synthetic polypeptide
DEMEIRTTNPVATCQYGCVCNTGELQNFGSNTQA

SEQ ID NO: 137819 - protein, 33 aa, Artificial Sequence
  Description of Artificial Sequence: Synthetic polypeptide
DEMEIRTTNPVATCQYGCVCNTGEHQNFGSNQS

SEQ ID NO: 137820 - protein, 33 aa, Artificial Sequence
  Description of Artificial Sequence: Synthetic polypeptide
DEEEIATTNPVAYEQYGSVCQAANVDQAPANDS

SEQ ID NO: 137821 - protein, 31 aa, Artificial Sequence
  Description of Artificial Sequence: Synthetic polypeptide
DEHEIRTTNPVATEQWGDVVLIEMNAAEDAR

SEQ ID NO: 137822 - protein, 30 aa, Artificial Sequence
  Description of Artificial Sequence: Synthetic polypeptide
QENEIATTNPVATECYGDVPSFECLQHEEL

SEQ ID NO: 137823 - protein, 31 aa, Artificial Sequence
  Description of Artificial Sequence: Synthetic polypeptide
DEHEIRTTNPVATEQWGDVSEIEMNAATWDA

SEQ ID NO: 137824 - protein, 30 aa, Artificial Sequence
  Description of Artificial Sequence: Synthetic polypeptide
DEHEIRTTNPVATEQWGDVSEIEMNAAEDA

SEQ ID NO: 137825 - protein, 29 aa, Artificial Sequence
  Description of Artificial Sequence: Synthetic peptide
QENEIATTNPVATECYGDVSDCTQKHEEL

SEQ ID NO: 137826 - protein, 33 aa, Artificial Sequence
  Description of Artificial Sequence: Synthetic polypeptide
DEEEIRTTNPVATEQYGSVCAADPVTDDGGTWY

SEQ ID NO: 137827 - protein, 35 aa, Artificial Sequence
  Description of Artificial Sequence: Synthetic polypeptide
DEHEIRTTNPVATEPYGVVCFTNEDHTDQGGDNHR

SEQ ID NO: 137828 - protein, 29 aa, Artificial Sequence
  Description of Artificial Sequence: Synthetic peptide
QENEIATTNPVATECYGDVSAECLEHEEL

SEQ ID NO: 137829 - protein, 36 aa, Artificial Sequence
  Description of Artificial Sequence: Synthetic polypeptide
DEEEIRTTNPVATEQYGSVCAAANDLPQEHQDGTEA

SEQ ID NO: 137830 - protein, 30 aa, Artificial Sequence
  Description of Artificial Sequence: Synthetic polypeptide
QENEIATTNPVATECYGDVSAECLQHEEEL

SEQ ID NO: 137831 - protein, 30 aa, Artificial Sequence
  Description of Artificial Sequence: Synthetic polypeptide
QEEEIRTTNPVATECWGEVPEVEPQDREEG

SEQ ID NO: 137832 - protein, 30 aa, Artificial Sequence
  Description of Artificial Sequence: Synthetic polypeptide
QENEIATTNPVATECYGDVSAECLQHEELD

SEQ ID NO: 137833 - protein, 30 aa, Artificial Sequence
  Description of Artificial Sequence: Synthetic polypeptide
QENEIATTNPVATECYGDVSAECGLQHEEL

SEQ ID NO: 137834 - protein, 29 aa, Artificial Sequence
  Description of Artificial Sequence: Synthetic peptide
QENEIATTNPVATECYGDVSDEPGQHEEL

SEQ ID NO: 137835 - protein, 30 aa, Artificial Sequence
  Description of Artificial Sequence: Synthetic polypeptide
QENEIATTNPVATECYGDVSEACLQHEEGL

SEQ ID NO: 137836 - protein, 32 aa, Artificial Sequence
  Description of Artificial Sequence: Synthetic polypeptide
DEMEIRTTNPVATCQYGCVCQTEDQNFGSDQA

SEQ ID NO: 137837 - protein, 29 aa, Artificial Sequence
  Description of Artificial Sequence: Synthetic peptide
QENEIATTNPVATECYGDVSECEQNAEEA

SEQ ID NO: 137838 - protein, 38 aa, Artificial Sequence
  Description of Artificial Sequence: Synthetic polypeptide
AEEEIRTTNPVATEQYGSVSVTTTNNLQQGTEEGNNTD

SEQ ID NO: 137839 - protein, 37 aa, Artificial Sequence
  Description of Artificial Sequence: Synthetic polypeptide
AEEEIRTTNPVATEQYGSVSVTTTNQQNNQQGTNAND

SEQ ID NO: 137840 - protein, 38 aa, Artificial Sequence
  Description of Artificial Sequence: Synthetic polypeptide
DEEEIRTTNPVATEQYGSVATVNGNNLQQGEENEEDET

SEQ ID NO: 137841 - protein, 37 aa, Artificial Sequence
  Description of Artificial Sequence: Synthetic polypeptide
DEEEIRTTNPVATEQYGSVATTVNTNNLQQGEDEEDE

SEQ ID NO: 137842 - protein, 36 aa, Artificial Sequence
  Description of Artificial Sequence: Synthetic polypeptide
DEEEIRTTNPVATEQYGSVATTTNNNQLQQNEDEES

SEQ ID NO: 137843 - protein, 33 aa, Artificial Sequence
  Description of Artificial Sequence: Synthetic polypeptide
DDECIRCTNPVATEQYGCVCSTELQENSGSQQA

SEQ ID NO: 137844 - protein, 28 aa, Artificial Sequence
  Description of Artificial Sequence: Synthetic peptide
QEGEIAPTNPCSSEQYGIVSCNEQSGTA

SEQ ID NO: 137845 - protein, 38 aa, Artificial Sequence
  Description of Artificial Sequence: Synthetic polypeptide
DEEEIRTTNPVATEQYGVVSTVVNQNLQQGTNDEEEDE

SEQ ID NO: 137846 - protein, 37 aa, Artificial Sequence
  Description of Artificial Sequence: Synthetic polypeptide
DEEEIRTTNPVATEQYGSVATTTNELQAGTEGGTTEE

SEQ ID NO: 137847 - protein, 37 aa, Artificial Sequence
  Description of Artificial Sequence: Synthetic polypeptide
DEEEIRTTNPVATEQYGSVATTQNNLQAGSEGGTTET

SEQ ID NO: 137848 - protein, 37 aa, Artificial Sequence
  Description of Artificial Sequence: Synthetic polypeptide
AEEEIRTTNPVATEQYGSVSVTTTNQQNQQQGTTTND

SEQ ID NO: 137849 - protein, 34 aa, Artificial Sequence
  Description of Artificial Sequence: Synthetic polypeptide
DEEEIRTTNPVATEQYGSVGGQDDGIEEDTGNGG

SEQ ID NO: 137850 - protein, 29 aa, Artificial Sequence
  Description of Artificial Sequence: Synthetic peptide
QENEIATTNPVATECYGDVSECIQHNEEL

SEQ ID NO: 137851 - protein, 37 aa, Artificial Sequence
  Description of Artificial Sequence: Synthetic polypeptide
DEEEIRTTNPVATEQYGVVSTVVNQNGNQQGNNDEDD

SEQ ID NO: 137852 - protein, 29 aa, Artificial Sequence
  Description of Artificial Sequence: Synthetic peptide
QENEIATTNPVATECYGDVPEVVLQGEEL

SEQ ID NO: 137853 - protein, 37 aa, Artificial Sequence
  Description of Artificial Sequence: Synthetic polypeptide
AEEEIRTTNPVATEQYGSVSVTTTNLQAGTEAGEEQG

SEQ ID NO: 137854 - protein, 36 aa, Artificial Sequence
  Description of Artificial Sequence: Synthetic polypeptide
DEEEIRTTNPVATEQYGSVGGPSYNEASRDNVVDQL

SEQ ID NO: 137855 - protein, 35 aa, Artificial Sequence
  Description of Artificial Sequence: Synthetic polypeptide
DEHEIRTTNPVATENYGSVCSNWNDGQDRQGKTEP

SEQ ID NO: 137856 - protein, 34 aa, Artificial Sequence
  Description of Artificial Sequence: Synthetic polypeptide
DEHEIRTTNPVATENYGCVATTPGNQQDRNGDEP

SEQ ID NO: 137857 - protein, 37 aa, Artificial Sequence
  Description of Artificial Sequence: Synthetic polypeptide
DEEEIRTTNPVATEQYGSVATVQNQLQAGTETGTTEG

SEQ ID NO: 137858 - protein, 38 aa, Artificial Sequence
  Description of Artificial Sequence: Synthetic polypeptide
DEEEIRTTNPVATEQYGSVATVNTNNLQQGENDEEDEQ

SEQ ID NO: 137859 - protein, 37 aa, Artificial Sequence
  Description of Artificial Sequence: Synthetic polypeptide
DEEEIRTTNPVATEQYGVVSTTTNQQAGNQAGTTEDE

SEQ ID NO: 137860 - protein, 36 aa, Artificial Sequence
  Description of Artificial Sequence: Synthetic polypeptide
DEEEIRTTNPVATEQYGSVATVNNNQLNQGEDEEDE

SEQ ID NO: 137861 - protein, 37 aa, Artificial Sequence
  Description of Artificial Sequence: Synthetic polypeptide
AEEEIRTTNPVATEQYGSVSVTTQQLQQQIGTEQGNT

SEQ ID NO: 137862 - protein, 36 aa, Artificial Sequence
  Description of Artificial Sequence: Synthetic polypeptide
DEEEIRTTNPVATEQYGSVGGPSNNDSSGENVVDQL

SEQ ID NO: 137863 - protein, 38 aa, Artificial Sequence
  Description of Artificial Sequence: Synthetic polypeptide
DEEEIRTTNPVATEQYGVVSTVVNQLQAGNQQGTNDDE

SEQ ID NO: 137864 - protein, 38 aa, Artificial Sequence
  Description of Artificial Sequence: Synthetic polypeptide
DEEEIRTTNPVATEQYGVVSTVVNQLQAGNQQGTTQEE

SEQ ID NO: 137865 - protein, 33 aa, Artificial Sequence
  Description of Artificial Sequence: Synthetic polypeptide
DEHEIRTTNPVATENYGCVATTGMQNDRNGDEP

SEQ ID NO: 137866 - protein, 33 aa, Artificial Sequence
  Description of Artificial Sequence: Synthetic polypeptide
DEHEIRTTNPVATENYGCVATTGMQADRQGDHP

SEQ ID NO: 137867 - protein, 32 aa, Artificial Sequence
  Description of Artificial Sequence: Synthetic polypeptide
DEHEIRTTNPVATENYGCVATTGMNDSNGDAP

SEQ ID NO: 137868 - protein, 33 aa, Artificial Sequence
  Description of Artificial Sequence: Synthetic polypeptide
DEMEIRTTNPVATCQYGCVCSTGELENFGSDQS

SEQ ID NO: 137869 - protein, 33 aa, Artificial Sequence
  Description of Artificial Sequence: Synthetic polypeptide
DEHEIRTTNPVATENYGCVATTGMQQQDRQGDH

SEQ ID NO: 137870 - protein, 30 aa, Artificial Sequence
  Description of Artificial Sequence: Synthetic polypeptide
QEEEIRTTNPVATECWGEVPEVEPQDREEK

SEQ ID NO: 137871 - protein, 36 aa, Artificial Sequence
  Description of Artificial Sequence: Synthetic polypeptide
DEEEIRTTNPVATEQYGVVSTTTQSGNQEQGTNNQE

SEQ ID NO: 137872 - protein, 29 aa, Artificial Sequence
  Description of Artificial Sequence: Synthetic peptide
QENEIATTNPVATECYGDVGSECLAHHEN

SEQ ID NO: 137873 - protein, 36 aa, Artificial Sequence
  Description of Artificial Sequence: Synthetic polypeptide
DEEEIRTTNPVATEQYGSVGDFGNTDGQENDDGNMG

SEQ ID NO: 137874 - protein, 28 aa, Artificial Sequence
  Description of Artificial Sequence: Synthetic peptide
QENEIATTNPVATECYGDVAECLAHEEI

SEQ ID NO: 137875 - protein, 28 aa, Artificial Sequence
  Description of Artificial Sequence: Synthetic peptide
QENEIATTNPVATECYGDVAECLAPEEI

SEQ ID NO: 137876 - protein, 37 aa, Artificial Sequence
  Description of Artificial Sequence: Synthetic polypeptide
AEEEIRTTNPVATEQYGSVSVTTNNTQQGNTEQGEEQ

SEQ ID NO: 137877 - protein, 35 aa, Artificial Sequence
  Description of Artificial Sequence: Synthetic polypeptide
DEEEIRTTNPVATEQYGSVGDFGQGNDDEGNGQAG

SEQ ID NO: 137878 - protein, 28 aa, Artificial Sequence
  Description of Artificial Sequence: Synthetic peptide
QENEIATTNPVATECYGDVAECLHHEEL

SEQ ID NO: 137879 - protein, 28 aa, Artificial Sequence
  Description of Artificial Sequence: Synthetic peptide
QENEIATTNPVATECYGDVAACLAPEEI

SEQ ID NO: 137880 - protein, 37 aa, Artificial Sequence
  Description of Artificial Sequence: Synthetic polypeptide
DEEEIRTTNPVATEQYGVVSTVVNNQQGNNNTNEDEE

SEQ ID NO: 137881 - protein, 29 aa, Artificial Sequence
  Description of Artificial Sequence: Synthetic peptide
QENEIATTNPVATECYGDVAECLQHVEEL

SEQ ID NO: 137882 - protein, 32 aa, Artificial Sequence
  Description of Artificial Sequence: Synthetic polypeptide
DDCEIRTTNPVATEQWGSVPDTFWLETESQER

SEQ ID NO: 137883 - protein, 34 aa, Artificial Sequence
  Description of Artificial Sequence: Synthetic polypeptide
DEEEIRTTNPVATEQYGSVGDFGQGNDDETGGDG

SEQ ID NO: 137884 - protein, 34 aa, Artificial Sequence
  Description of Artificial Sequence: Synthetic polypeptide
DEEEIRTTNPVATEQYGSVGDFGQGNDGEDGGMG

SEQ ID NO: 137885 - protein, 34 aa, Artificial Sequence
  Description of Artificial Sequence: Synthetic polypeptide
DDCEIRTTNPVATEQYGSVCPDTFWLETRSQCRE

SEQ ID NO: 137886 - protein, 29 aa, Artificial Sequence
  Description of Artificial Sequence: Synthetic peptide
QENEIATTNPVATECYGDVAEMLQFHEEL

SEQ ID NO: 137887 - protein, 33 aa, Artificial Sequence
  Description of Artificial Sequence: Synthetic polypeptide
QEEEIRTTNPVATEPYGKISTHEESQNSVGNFK

SEQ ID NO: 137888 - protein, 36 aa, Artificial Sequence
  Description of Artificial Sequence: Synthetic polypeptide
DEEEIRTTNPVATEQYGSVGDFNNEGQEGGNGQGEL

SEQ ID NO: 137889 - protein, 29 aa, Artificial Sequence
  Description of Artificial Sequence: Synthetic peptide
QEEEIRTTNPVATEPYGTAPEDCQQQEEK

SEQ ID NO: 137890 - protein, 30 aa, Artificial Sequence
  Description of Artificial Sequence: Synthetic polypeptide
QEEEIRTTNPVATEPYGTASEDCQQQQEEK

SEQ ID NO: 137891 - protein, 30 aa, Artificial Sequence
  Description of Artificial Sequence: Synthetic polypeptide
QEEEIRTTNPVATEQWGEVPEVEQNHAEEA

SEQ ID NO: 137892 - protein, 34 aa, Artificial Sequence
  Description of Artificial Sequence: Synthetic polypeptide
DEEEIATTNPVAYEQYGSVCAATNPLQGAEVPDS

SEQ ID NO: 137893 - protein, 35 aa, Artificial Sequence
  Description of Artificial Sequence: Synthetic polypeptide
DEEEIRTTNPVATEQYGSVGDDGQGNDGEDGGNAG

SEQ ID NO: 137894 - protein, 30 aa, Artificial Sequence
  Description of Artificial Sequence: Synthetic polypeptide
QEEEIRTTNPVATEQWGEVPEIEQNHAEEA

SEQ ID NO: 137895 - protein, 33 aa, Artificial Sequence
  Description of Artificial Sequence: Synthetic polypeptide
DEEEIRTTNPVATEQYGSVCAPIMLSPNIIVVP

SEQ ID NO: 137896 - protein, 33 aa, Artificial Sequence
  Description of Artificial Sequence: Synthetic polypeptide
DEEEIRTTNPVATEQYGSVCAPIMLDPNIAPVP

SEQ ID NO: 137897 - protein, 36 aa, Artificial Sequence
  Description of Artificial Sequence: Synthetic polypeptide
DEEEIRTTNPVATEQYGSVCAMTNGEPTGGDLENDG

SEQ ID NO: 137898 - protein, 34 aa, Artificial Sequence
  Description of Artificial Sequence: Synthetic polypeptide
DEEEIRTTNPVATEQYGSVGDFGEGNDDEGGEAG

SEQ ID NO: 137899 - protein, 30 aa, Artificial Sequence
  Description of Artificial Sequence: Synthetic polypeptide
QENEIATTNPVATECYGCVSWELQHISETL

SEQ ID NO: 137900 - protein, 28 aa, Artificial Sequence
  Description of Artificial Sequence: Synthetic peptide
QEEEIRTTNPVATEQWGEAPEICMHEDK

SEQ ID NO: 137901 - protein, 28 aa, Artificial Sequence
  Description of Artificial Sequence: Synthetic peptide
QEEEIRTTNPVATEQWGEAPEICMAEDK

SEQ ID NO: 137902 - protein, 30 aa, Artificial Sequence
  Description of Artificial Sequence: Synthetic polypeptide
QENEIATTNPVATECYGCVSWELQHSSEQA

SEQ ID NO: 137903 - protein, 35 aa, Artificial Sequence
  Description of Artificial Sequence: Synthetic polypeptide
DEEEIRTTNPVATEQYGSVGDFGNDGQENDDENGS

SEQ ID NO: 137904 - protein, 28 aa, Artificial Sequence
  Description of Artificial Sequence: Synthetic peptide
QENEIATTNPVATECYGDASECCQHEEL

SEQ ID NO: 137905 - protein, 30 aa, Artificial Sequence
  Description of Artificial Sequence: Synthetic polypeptide
QENEIATTNPVATECYGCVSGEPLQHEDEL

SEQ ID NO: 137906 - protein, 37 aa, Artificial Sequence
  Description of Artificial Sequence: Synthetic polypeptide
AEEEIRTTNPVATEQYGSVSVTTNNNQQLQIGTEQGQ

SEQ ID NO: 137907 - protein, 32 aa, Artificial Sequence
  Description of Artificial Sequence: Synthetic polypeptide
DDCEIRTTNPVATEQYGSVPDTFWHETESQNI

SEQ ID NO: 137908 - protein, 35 aa, Artificial Sequence
  Description of Artificial Sequence: Synthetic polypeptide
DEEEIRTTNPVATEQYGSVCAGTDGLPNDLAEAGP

SEQ ID NO: 137909 - protein, 37 aa, Artificial Sequence
  Description of Artificial Sequence: Synthetic polypeptide
DEEEIRTTNPVATEQYGVVSTVVNNQQGNQQNQNDED

SEQ ID NO: 137910 - protein, 33 aa, Artificial Sequence
  Description of Artificial Sequence: Synthetic polypeptide
DDCEIRTTNPVATEQYGVVSTKTLENTMPSNND

SEQ ID NO: 137911 - protein, 32 aa, Artificial Sequence
  Description of Artificial Sequence: Synthetic polypeptide
DDDAICTVNPVATEQYGSVSTLNLFETGFEHN

SEQ ID NO: 137912 - protein, 29 aa, Artificial Sequence
  Description of Artificial Sequence: Synthetic peptide
QENEIATTNPVATECYGDVCSECPQHEED

SEQ ID NO: 137913 - protein, 29 aa, Artificial Sequence
  Description of Artificial Sequence: Synthetic peptide
QENEIATTNPVATECYGDVCSECPQHEEL

SEQ ID NO: 137914 - protein, 33 aa, Artificial Sequence
  Description of Artificial Sequence: Synthetic polypeptide
DEMEIRTTNPVATCQYGCVCNSELQENFGSNQS

SEQ ID NO: 137915 - protein, 36 aa, Artificial Sequence
  Description of Artificial Sequence: Synthetic polypeptide
DEEEIRTTNPVATEQYGSVGFCTRASSNYNGGNNET

SEQ ID NO: 137916 - protein, 36 aa, Artificial Sequence
  Description of Artificial Sequence: Synthetic polypeptide
DEEEIRTTNPVATEQYGVVSTVVNNQQGTEDEEETD

SEQ ID NO: 137917 - protein, 35 aa, Artificial Sequence
  Description of Artificial Sequence: Synthetic polypeptide
DEEEIATTNPVAYEQYGSVCAVTAELADTGGNSRD

SEQ ID NO: 137918 - protein, 36 aa, Artificial Sequence
  Description of Artificial Sequence: Synthetic polypeptide
DEEEIRTTNPVATEQYGSVGGPSENQSSRENVVDQE

SEQ ID NO: 137919 - protein, 37 aa, Artificial Sequence
  Description of Artificial Sequence: Synthetic polypeptide
DEEEIRTTNPVATEQYGSVGGPSLNNDQSRENVADQE

SEQ ID NO: 137920 - protein, 30 aa, Artificial Sequence
  Description of Artificial Sequence: Synthetic polypeptide
QENEIATTNPVATECYGDVCSTDCPQHEED

SEQ ID NO: 137921 - protein, 37 aa, Artificial Sequence
  Description of Artificial Sequence: Synthetic polypeptide
DEEEIRTTNPVATEQYGVVSTVVNNQQGTNEEEETEE

SEQ ID NO: 137922 - protein, 35 aa, Artificial Sequence
  Description of Artificial Sequence: Synthetic polypeptide
DEEEIRTTNPVATEQYGSVCAATAQLAATAEGDHN

SEQ ID NO: 137923 - protein, 31 aa, Artificial Sequence
  Description of Artificial Sequence: Synthetic polypeptide
DEHEIRTTNPVATEQWGTVSKEIEMNGGEDA

SEQ ID NO: 137924 - protein, 33 aa, Artificial Sequence
  Description of Artificial Sequence: Synthetic polypeptide
DDCEIRTTNPVATEQYGSVPDTFWLETESQDRE

SEQ ID NO: 137925 - protein, 30 aa, Artificial Sequence
  Description of Artificial Sequence: Synthetic polypeptide
QENEIATTNPVATECYGDVCSAECLEFEND

SEQ ID NO: 137926 - protein, 29 aa, Artificial Sequence
  Description of Artificial Sequence: Synthetic peptide
QENEIATTNPVATECYGDVCLECLQHEEL

SEQ ID NO: 137927 - protein, 35 aa, Artificial Sequence
  Description of Artificial Sequence: Synthetic polypeptide
DEEEIRTTNPVATEQYGSVCAENNLEHLVGEELEY

SEQ ID NO: 137928 - protein, 35 aa, Artificial Sequence
  Description of Artificial Sequence: Synthetic polypeptide
DEEEIATTNPVAYEQYGSVCATNPQENPDDQGQRA

SEQ ID NO: 137929 - protein, 34 aa, Artificial Sequence
  Description of Artificial Sequence: Synthetic polypeptide
DEEEIATTNPVAYEQYGSVCATNPQLNPDDQGRD

SEQ ID NO: 137930 - protein, 33 aa, Artificial Sequence
  Description of Artificial Sequence: Synthetic polypeptide
QEEEIRTTNPVATEGYGSVGTDTTMDNGGGGFN

SEQ ID NO: 137931 - protein, 37 aa, Artificial Sequence
  Description of Artificial Sequence: Synthetic polypeptide
DEEEIRTTNPVATEQYGVVSTVVNNQQGNQEEQEDED

SEQ ID NO: 137932 - protein, 35 aa, Artificial Sequence
  Description of Artificial Sequence: Synthetic polypeptide
DEHEIRTTNPVATEQYGCVSTNDVTEIFFLQDHPI

SEQ ID NO: 137933 - protein, 36 aa, Artificial Sequence
  Description of Artificial Sequence: Synthetic polypeptide
DEHEIRTTNPVATEQYGCVCSTIMLEELRNGNEEVF

SEQ ID NO: 137934 - protein, 29 aa, Artificial Sequence
  Description of Artificial Sequence: Synthetic peptide
QENEIATTNPVATECYGDVCECLQHEESL

SEQ ID NO: 137935 - protein, 36 aa, Artificial Sequence
  Description of Artificial Sequence: Synthetic polypeptide
DEEEIRTTNPVATEQYGSVGEMVNTQQINTQPGMQN

SEQ ID NO: 137936 - protein, 37 aa, Artificial Sequence
  Description of Artificial Sequence: Synthetic polypeptide
DEEEIRTTNPVATEQYGVVSTVVNNQQGNQNQNDTTD

SEQ ID NO: 137937 - protein, 33 aa, Artificial Sequence
  Description of Artificial Sequence: Synthetic polypeptide
QEEEIRTTNPVATEFYGSVGTTDTMDNGGGGQG

SEQ ID NO: 137938 - protein, 33 aa, Artificial Sequence
  Description of Artificial Sequence: Synthetic polypeptide
QEEEIRTTNPVATEFYGSVDENNMDGGGNENEG

SEQ ID NO: 137939 - protein, 36 aa, Artificial Sequence
  Description of Artificial Sequence: Synthetic polypeptide
DEEEIRTTNPVATEQYGSVGENTMGNSQQNGPEEGL

SEQ ID NO: 137940 - protein, 28 aa, Artificial Sequence
  Description of Artificial Sequence: Synthetic peptide
QENEIATTNPVATECYGDVCECSQHEEL

SEQ ID NO: 137941 - protein, 35 aa, Artificial Sequence
  Description of Artificial Sequence: Synthetic polypeptide
QEEEIRTTNPVATEFYGSVQTGDNDQGEGEEGNTI

SEQ ID NO: 137942 - protein, 32 aa, Artificial Sequence
  Description of Artificial Sequence: Synthetic polypeptide
DEEEIATTNPVAYEQYGSVAMNDTATGAGDEH

SEQ ID NO: 137943 - protein, 35 aa, Artificial Sequence
  Description of Artificial Sequence: Synthetic polypeptide
DEEEIATTNPVATEQYGSVCAAANNLDEAGNNVNH

SEQ ID NO: 137944 - protein, 29 aa, Artificial Sequence
  Description of Artificial Sequence: Synthetic peptide
QEEEIRTTNPVATEQYGEAPEVCMAAEDA

SEQ ID NO: 137945 - protein, 35 aa, Artificial Sequence
  Description of Artificial Sequence: Synthetic polypeptide
DEHEIRTTNPVATEQYGSVSTNDTEEIFVLEDHPI

SEQ ID NO: 137946 - protein, 34 aa, Artificial Sequence
  Description of Artificial Sequence: Synthetic polypeptide
DEEEIRTTNPVATEQYGSVEVDTLGDEGGGQDFM

SEQ ID NO: 137947 - protein, 37 aa, Artificial Sequence
  Description of Artificial Sequence: Synthetic polypeptide
DEEEIRTTNPVATEQYGVVSTVVNNNNQQGNQEEDED

SEQ ID NO: 137948 - protein, 34 aa, Artificial Sequence
  Description of Artificial Sequence: Synthetic polypeptide
DEEEIATTNPVATEQYGSVCAAINGEEAGDSMNN

SEQ ID NO: 137949 - protein, 36 aa, Artificial Sequence
  Description of Artificial Sequence: Synthetic polypeptide
DEHEIRTTNPVATEQYGSVSTNDVTEEIFMLQDHYN

SEQ ID NO: 137950 - protein, 31 aa, Artificial Sequence
  Description of Artificial Sequence: Synthetic polypeptide
QEMEIATTNPVGTEQYGTVCSATTPVEFGND

SEQ ID NO: 137951 - protein, 36 aa, Artificial Sequence
  Description of Artificial Sequence: Synthetic polypeptide
DEHEIRTTNPVATEQYGSVSTNDVTLEIFMLQDHPI

SEQ ID NO: 137952 - protein, 28 aa, Artificial Sequence
  Description of Artificial Sequence: Synthetic peptide
QEMEIATTNPVGTEQYGTMSSTPEHGDI

SEQ ID NO: 137953 - protein, 35 aa, Artificial Sequence
  Description of Artificial Sequence: Synthetic polypeptide
DEEEIATTNPVATEQYGSVCAAMAHLQAMAPNDRE

SEQ ID NO: 137954 - protein, 28 aa, Artificial Sequence
  Description of Artificial Sequence: Synthetic peptide
QEMEIATTNPVGTEQYGTMSSTPEFGDI

SEQ ID NO: 137955 - protein, 34 aa, Artificial Sequence
  Description of Artificial Sequence: Synthetic polypeptide
DEEEIATTNPVATEQYGSVCAAMAHLQAMPNDHP

SEQ ID NO: 137956 - protein, 35 aa, Artificial Sequence
  Description of Artificial Sequence: Synthetic polypeptide
QEEEIRTTNPVATEQYGSVCSPTADLETNDGTQES

SEQ ID NO: 137957 - protein, 30 aa, Artificial Sequence
  Description of Artificial Sequence: Synthetic polypeptide
QEMEIATTNPVGTEQYGTMCSATTPEFGNI

SEQ ID NO: 137958 - protein, 36 aa, Artificial Sequence
  Description of Artificial Sequence: Synthetic polypeptide
QEEEIRTTNPVATEQYGSVCSPTNMLPETNDDTQES

SEQ ID NO: 137959 - protein, 30 aa, Artificial Sequence
  Description of Artificial Sequence: Synthetic polypeptide
QEMEIATTNPVGTEQYGTMCSASTPEFGNI

SEQ ID NO: 137960 - protein, 35 aa, Artificial Sequence
  Description of Artificial Sequence: Synthetic polypeptide
QEEEIRTTNPVATEQYGSVCSPTNNEEDNDDTQES

SEQ ID NO: 137961 - protein, 35 aa, Artificial Sequence
  Description of Artificial Sequence: Synthetic polypeptide
QEEEIRTTNPVATEQYGSVCSPTNNLETMDDTQEQ

SEQ ID NO: 137962 - protein, 30 aa, Artificial Sequence
  Description of Artificial Sequence: Synthetic polypeptide
QEMEIATTNPVATEQYGTVCPAEVPQHENK

SEQ ID NO: 137963 - protein, 35 aa, Artificial Sequence
  Description of Artificial Sequence: Synthetic polypeptide
QEEEIRTTNPVATEQYGSVDSGMNGQQFEGGEEME

SEQ ID NO: 137964 - protein, 33 aa, Artificial Sequence
  Description of Artificial Sequence: Synthetic polypeptide
DEEEIATTNPVAYEQWGVSWSLDNMEQRADSNV

SEQ ID NO: 137965 - protein, 33 aa, Artificial Sequence
  Description of Artificial Sequence: Synthetic polypeptide
DEEEIATTNPVAYEQWGVSWSLDNMEQRDDSER

SEQ ID NO: 137966 - protein, 32 aa, Artificial Sequence
  Description of Artificial Sequence: Synthetic polypeptide
QEMEIATTNPVATEQYGTVCSATDGLEFEEND

SEQ ID NO: 137967 - protein, 32 aa, Artificial Sequence
  Description of Artificial Sequence: Synthetic polypeptide
QEMEIATTNPVATEQYGTVCSTDGPVEFEGNK

SEQ ID NO: 137968 - protein, 32 aa, Artificial Sequence
  Description of Artificial Sequence: Synthetic polypeptide
QEMEIATTNPVSTEQYGIVCSACNLVESEGND

SEQ ID NO: 137969 - protein, 32 aa, Artificial Sequence
  Description of Artificial Sequence: Synthetic polypeptide
QEMEIATTNPVATEQYGTVCSTDGPVEHEGNK

SEQ ID NO: 137970 - protein, 30 aa, Artificial Sequence
  Description of Artificial Sequence: Synthetic polypeptide
QEMEIATTNPVATEQYGTVSTDVCVEFEEK

SEQ ID NO: 137971 - protein, 36 aa, Artificial Sequence
  Description of Artificial Sequence: Synthetic polypeptide
QEEEIRTTNPVATEQYGSVDNTDNINQNEGEGEENQ

SEQ ID NO: 137972 - protein, 35 aa, Artificial Sequence
  Description of Artificial Sequence: Synthetic polypeptide
QEEEIRTTNPVATEQYGSVDNTDINQEEGQGNINE

SEQ ID NO: 137973 - protein, 35 aa, Artificial Sequence
  Description of Artificial Sequence: Synthetic polypeptide
QEEEIRTTNPVATEQYGSVCVPTNELERNDDTQES

SEQ ID NO: 137974 - protein, 35 aa, Artificial Sequence
  Description of Artificial Sequence: Synthetic polypeptide
DEEEIATTNPVATEQYGSVCAAMANDQDPGENDNN

SEQ ID NO: 137975 - protein, 35 aa, Artificial Sequence
  Description of Artificial Sequence: Synthetic polypeptide
QEEEIRTTNPVATEQYGSVCSPTNQLETNDDTQEP

SEQ ID NO: 137976 - protein, 35 aa, Artificial Sequence
  Description of Artificial Sequence: Synthetic polypeptide
QEEEIRTTNPVATEQYGSVDNTDNIQQNEGEGEET

SEQ ID NO: 137977 - protein, 34 aa, Artificial Sequence
  Description of Artificial Sequence: Synthetic polypeptide
DEEEIATTNPVATEQYGSVCAADNPQLNDMDGGN

SEQ ID NO: 137978 - protein, 34 aa, Artificial Sequence
  Description of Artificial Sequence: Synthetic polypeptide
DEEEIATTNPVATEQYGSVCAADNPLNDMDINNN

SEQ ID NO: 137979 - protein, 31 aa, Artificial Sequence
  Description of Artificial Sequence: Synthetic polypeptide
QEMEIVSTNPVATEGYGTVCSATGPVQHGND

SEQ ID NO: 137980 - protein, 31 aa, Artificial Sequence
  Description of Artificial Sequence: Synthetic polypeptide
QEMEIVTTNPVATEQYGTAPATDVPQHEGND

SEQ ID NO: 137981 - protein, 35 aa, Artificial Sequence
  Description of Artificial Sequence: Synthetic polypeptide
DEEEIATTNPVATEQYGSVCAADNHLADADGNDNH

SEQ ID NO: 137982 - protein, 34 aa, Artificial Sequence
  Description of Artificial Sequence: Synthetic polypeptide
DEEEIATTNPVATEQYGSVCAADNHGQDSDINEE

SEQ ID NO: 137983 - protein, 35 aa, Artificial Sequence
  Description of Artificial Sequence: Synthetic polypeptide
DEEEIRTTNPVATEQYGSVFETELGQPILDVSQDQ

SEQ ID NO: 137984 - protein, 30 aa, Artificial Sequence
  Description of Artificial Sequence: Synthetic polypeptide
QEMEIVTTNPVATEQYGTVCSAECPEFGEL

SEQ ID NO: 137985 - protein, 35 aa, Artificial Sequence
  Description of Artificial Sequence: Synthetic polypeptide
DEEEIATTNPVATEQYGSVCAADNHGQDSDINDRS

SEQ ID NO: 137986 - protein, 35 aa, Artificial Sequence
  Description of Artificial Sequence: Synthetic polypeptide
DEEEIATTNPVATEQYGSVCAADNNLADAGGNDEH

SEQ ID NO: 137987 - protein, 32 aa, Artificial Sequence
  Description of Artificial Sequence: Synthetic polypeptide
QEMEIVTTNPVATEQYGTVCSASDGLEFEGNI

SEQ ID NO: 137988 - protein, 37 aa, Artificial Sequence
  Description of Artificial Sequence: Synthetic polypeptide
DEEEIRTTNPVATEQYGVVSTVVNNNQQAGNEEETED

SEQ ID NO: 137989 - protein, 38 aa, Artificial Sequence
  Description of Artificial Sequence: Synthetic polypeptide
DEEEIRTTNPVATEQYGVVSTTVNQNLQQGNNQEDEDD

SEQ ID NO: 137990 - protein, 33 aa, Artificial Sequence
  Description of Artificial Sequence: Synthetic polypeptide
DEMEIATTNPVAYERWGSVSTNLNQGAEGGGMS

SEQ ID NO: 137991 - protein, 35 aa, Artificial Sequence
  Description of Artificial Sequence: Synthetic polypeptide
DEEEIATTNPVATEQYGSVCAADNHGQDSDIENRD

SEQ ID NO: 137992 - protein, 34 aa, Artificial Sequence
  Description of Artificial Sequence: Synthetic polypeptide
DEEEIRTTNPVATEQYGSVFGDEDDEGGNDTTNI

SEQ ID NO: 137993 - protein, 32 aa, Artificial Sequence
  Description of Artificial Sequence: Synthetic polypeptide
QEMEIVTTNPVATEQYGTVCSATDGPVEFGNL

SEQ ID NO: 137994 - protein, 31 aa, Artificial Sequence
  Description of Artificial Sequence: Synthetic polypeptide
QEMEIVTTNPVATEQYGTVCSATCPVEFGEL

SEQ ID NO: 137995 - protein, 36 aa, Artificial Sequence
  Description of Artificial Sequence: Synthetic polypeptide
QEEEIRTTNPVATEQYGSVDSIFGNMGQEGEGTNGQ

SEQ ID NO: 137996 - protein, 37 aa, Artificial Sequence
  Description of Artificial Sequence: Synthetic polypeptide
AEEEIRTTNPVATEQYGSVSVTTNNDQAGTIGTNTNN

SEQ ID NO: 137997 - protein, 35 aa, Artificial Sequence
  Description of Artificial Sequence: Synthetic polypeptide
DEEEIATTNPVATEQYGSVCAADNNLADRDINDEH

SEQ ID NO: 137998 - protein, 35 aa, Artificial Sequence
  Description of Artificial Sequence: Synthetic polypeptide
DEEEIATTNPVATEQYGSVCAADNPLNDMDGGNND

SEQ ID NO: 137999 - protein, 35 aa, Artificial Sequence
  Description of Artificial Sequence: Synthetic polypeptide
DEEEIATTNPVATEQYGSVCAADNPLNDMDGGANY

SEQ ID NO: 138000 - protein, 34 aa, Artificial Sequence
  Description of Artificial Sequence: Synthetic polypeptide
DEEEIATTNPVAYEQWGVVCSTNDLGEDQRDQEG

SEQ ID NO: 138001 - protein, 32 aa, Artificial Sequence
  Description of Artificial Sequence: Synthetic polypeptide
DEEEIATTNPVAYEQWGVVSGGNGNSGEGNTT

SEQ ID NO: 138002 - protein, 35 aa, Artificial Sequence
  Description of Artificial Sequence: Synthetic polypeptide
DDAEIRTTNPVATEQYGCVCSNTGNDLQSFGSDQA

SEQ ID NO: 138003 - protein, 34 aa, Artificial Sequence
  Description of Artificial Sequence: Synthetic polypeptide
DDAEIRTTNPVATEQYGCVCSNWNDLQSFGSDQS

SEQ ID NO: 138004 - protein, 32 aa, Artificial Sequence
  Description of Artificial Sequence: Synthetic polypeptide
QEMEIVTTNPVATEQYGIVCSACNPVEFEGND

SEQ ID NO: 138005 - protein, 32 aa, Artificial Sequence
  Description of Artificial Sequence: Synthetic polypeptide
DDAEIRTTNPVATEQYGCVCSSEDHQSFGSDQ

SEQ ID NO: 138006 - protein, 34 aa, Artificial Sequence
  Description of Artificial Sequence: Synthetic polypeptide
DEMEIATTNPVAYEQYGTVCSYTDGPNEQHGNTA

SEQ ID NO: 138007 - protein, 29 aa, Artificial Sequence
  Description of Artificial Sequence: Synthetic peptide
QEMEIVTTNPVATECYGTVSAECPEFGEL

SEQ ID NO: 138008 - protein, 35 aa, Artificial Sequence
  Description of Artificial Sequence: Synthetic polypeptide
DEEEIRTTNPVATEQYGSVEWTPMPQEPELNVQLD

SEQ ID NO: 138009 - protein, 34 aa, Artificial Sequence
  Description of Artificial Sequence: Synthetic polypeptide
DEEEIRTTNPVATEQYGSVCSNHLSEPSEEVSQF

SEQ ID NO: 138010 - protein, 36 aa, Artificial Sequence
  Description of Artificial Sequence: Synthetic polypeptide
DEEEIRTTNPVATEQYGSVEWTTPAGPNMRNGMNPV

SEQ ID NO: 138011 - protein, 35 aa, Artificial Sequence
  Description of Artificial Sequence: Synthetic polypeptide
DEEEIRTTNPVATEQYGSVCSNEVQDTQENVEENA

SEQ ID NO: 138012 - protein, 37 aa, Artificial Sequence
  Description of Artificial Sequence: Synthetic polypeptide
AEEEIRTTNPVATEQYGSVSVTTNNDNQQGNGNNDEG

SEQ ID NO: 138013 - protein, 30 aa, Artificial Sequence
  Description of Artificial Sequence: Synthetic polypeptide
QEMEIATTNPVATEQYGEVCSTDVCEHEEK

SEQ ID NO: 138014 - protein, 33 aa, Artificial Sequence
  Description of Artificial Sequence: Synthetic polypeptide
DEEEIATTNPVAYEQWGTVCSTTENDEHDGNEQ

SEQ ID NO: 138015 - protein, 35 aa, Artificial Sequence
  Description of Artificial Sequence: Synthetic polypeptide
QEEEIRTTNPVATEQYGSVDTTDINQNEGEGNTEN

SEQ ID NO: 138016 - protein, 34 aa, Artificial Sequence
  Description of Artificial Sequence: Synthetic polypeptide
DEEEIRTTNPVATEQYGSVCSPDYLIEDTEIMQS

SEQ ID NO: 138017 - protein, 34 aa, Artificial Sequence
  Description of Artificial Sequence: Synthetic polypeptide
DEEEIRTTNPVATEQYGSVCSPDNMIEDTEIMES

SEQ ID NO: 138018 - protein, 30 aa, Artificial Sequence
  Description of Artificial Sequence: Synthetic polypeptide
QEMEIACTNPCSYEQYGCVCSCNLQSSGER

SEQ ID NO: 138019 - protein, 35 aa, Artificial Sequence
  Description of Artificial Sequence: Synthetic polypeptide
QEEEIRTTNPVATEQYGSVMGDGNNNNEFTQGGNT

SEQ ID NO: 138020 - protein, 35 aa, Artificial Sequence
  Description of Artificial Sequence: Synthetic polypeptide
QEEEIRTTNPVATEQYGSVMGDDENLQIGEGEEGT

SEQ ID NO: 138021 - protein, 28 aa, Artificial Sequence
  Description of Artificial Sequence: Synthetic peptide
QEMEIACTNPCSYEQYGCVSWEDQSGDR

SEQ ID NO: 138022 - protein, 33 aa, Artificial Sequence
  Description of Artificial Sequence: Synthetic polypeptide
QEEEIRTTNPVATEQYGSVMGDNMNSEIGGDGN

SEQ ID NO: 138023 - protein, 36 aa, Artificial Sequence
  Description of Artificial Sequence: Synthetic polypeptide
QEEEIRTTNPVATEQYGSVITDTGQGLQNGEGGNTT

SEQ ID NO: 138024 - protein, 29 aa, Artificial Sequence
  Description of Artificial Sequence: Synthetic peptide
QEMEIACTNPCSYEQYGCVSWNTQSGSER

SEQ ID NO: 138025 - protein, 30 aa, Artificial Sequence
  Description of Artificial Sequence: Synthetic polypeptide
QEMEIACTNPCSYEQYGIVSWNLQSGSDRS

SEQ ID NO: 138026 - protein, 36 aa, Artificial Sequence
  Description of Artificial Sequence: Synthetic polypeptide
QEEEIRTTNPVATEQYGSVISTMNLNIFNEGGGGGE

SEQ ID NO: 138027 - protein, 29 aa, Artificial Sequence
  Description of Artificial Sequence: Synthetic peptide
QEMEIACTNPCSYEQYGVVSWNLQSGDQA

SEQ ID NO: 138028 - protein, 35 aa, Artificial Sequence
  Description of Artificial Sequence: Synthetic polypeptide
QEEEIRTTNPVATEQYGSVISTLPDQQGEGGQGEV

SEQ ID NO: 138029 - protein, 33 aa, Artificial Sequence
  Description of Artificial Sequence: Synthetic polypeptide
DEEEIATTNPVAYEQWGSVTGDNGEQGRGGDHP

SEQ ID NO: 138030 - protein, 30 aa, Artificial Sequence
  Description of Artificial Sequence: Synthetic polypeptide
QEMEIACTNPCSYEQYGCVSWNLQSLGSTR

SEQ ID NO: 138031 - protein, 35 aa, Artificial Sequence
  Description of Artificial Sequence: Synthetic polypeptide
QEEEIRTTNPVATEQYGSVISNDNSGLELEGEGED

SEQ ID NO: 138032 - protein, 32 aa, Artificial Sequence
  Description of Artificial Sequence: Synthetic polypeptide
DEMEIATTNPVAYEGWGEVATNLQGDAGNGSN

SEQ ID NO: 138033 - protein, 34 aa, Artificial Sequence
  Description of Artificial Sequence: Synthetic polypeptide
QEEEIRTTNPVATEQYGSVMGLENGGQGDNEEQG

SEQ ID NO: 138034 - protein, 35 aa, Artificial Sequence
  Description of Artificial Sequence: Synthetic polypeptide
DEEEIRTTNPVATEQYGSVCSPEPEDNMGLSQNID

SEQ ID NO: 138035 - protein, 34 aa, Artificial Sequence
  Description of Artificial Sequence: Synthetic polypeptide
DEEEIATTNPVATEQYGSVCAAMNHDNMGEENTW

SEQ ID NO: 138036 - protein, 28 aa, Artificial Sequence
  Description of Artificial Sequence: Synthetic peptide
QEKEIATTNPVATEQYGEAPEVCQHEEK

SEQ ID NO: 138037 - protein, 28 aa, Artificial Sequence
  Description of Artificial Sequence: Synthetic peptide
QEKEIATTNPVATEQYGEAPVVCQHEEK

SEQ ID NO: 138038 - protein, 28 aa, Artificial Sequence
  Description of Artificial Sequence: Synthetic peptide
QELEIASTNPVGTEGYGVMASTLQHGDI

SEQ ID NO: 138039 - protein, 28 aa, Artificial Sequence
  Description of Artificial Sequence: Synthetic peptide
QELEIATTNPVATEQYGEAPEVCQHEEK

SEQ ID NO: 138040 - protein, 33 aa, Artificial Sequence
  Description of Artificial Sequence: Synthetic polypeptide
QELETCTTNPVATEQYGSVSTGDGDQLIGNGGG

SEQ ID NO: 138041 - protein, 28 aa, Artificial Sequence
  Description of Artificial Sequence: Synthetic peptide
QELEIATTNPVATEQYGEAPEVCQHEEV

SEQ ID NO: 138042 - protein, 28 aa, Artificial Sequence
  Description of Artificial Sequence: Synthetic peptide
QELEIATTNPVATEQYGEAPEVCQHEEW

SEQ ID NO: 138043 - protein, 29 aa, Artificial Sequence
  Description of Artificial Sequence: Synthetic peptide
QELEIATTNPVATEQYGEAPEVCQHGEEK

SEQ ID NO: 138044 - protein, 28 aa, Artificial Sequence
  Description of Artificial Sequence: Synthetic peptide
QELEIATTNPVATEQYGEAWEVCQHEEK

SEQ ID NO: 138045 - protein, 35 aa, Artificial Sequence
  Description of Artificial Sequence: Synthetic polypeptide
QEEEIRTTNPVATEQYGSVMGTNDNNNEFGQEDGN

SEQ ID NO: 138046 - protein, 35 aa, Artificial Sequence
  Description of Artificial Sequence: Synthetic polypeptide
QEEEIRTTNPVATEQYGSVMGNFNGGNGQTGNGGN

SEQ ID NO: 138047 - protein, 35 aa, Artificial Sequence
  Description of Artificial Sequence: Synthetic polypeptide
QEEEIRTTNPVATEQYGSVMGLGNEQDENGGENDD

SEQ ID NO: 138048 - protein, 35 aa, Artificial Sequence
  Description of Artificial Sequence: Synthetic polypeptide
QEEEIRTTNPVATEQYGSVMGTVNGQFEEGGEEED

SEQ ID NO: 138049 - protein, 37 aa, Artificial Sequence
  Description of Artificial Sequence: Synthetic polypeptide
DEEEIRTTNPVATEQYGVVSTVVNNNQQQGNEEEEEA

SEQ ID NO: 138050 - protein, 35 aa, Artificial Sequence
  Description of Artificial Sequence: Synthetic polypeptide
QEEEIRTTNPVATEQYGSVISGNNMDDGEGGNDTG

SEQ ID NO: 138051 - protein, 34 aa, Artificial Sequence
  Description of Artificial Sequence: Synthetic polypeptide
DEEEIATTNPVAYEQWGSVTGDNGIQNRGGDANP

SEQ ID NO: 138052 - protein, 34 aa, Artificial Sequence
  Description of Artificial Sequence: Synthetic polypeptide
DEEEIATTNPVATEQYGSVCAAMHLQAMAPEDRH

SEQ ID NO: 138053 - protein, 33 aa, Artificial Sequence
  Description of Artificial Sequence: Synthetic polypeptide
DEEEIATTNPVATEQYGSVCAAMHGQDSGEDMD

SEQ ID NO: 138054 - protein, 31 aa, Artificial Sequence
  Description of Artificial Sequence: Synthetic polypeptide
QEMEIATTNPVATECYGTVCSAECLVQFENL

SEQ ID NO: 138055 - protein, 34 aa, Artificial Sequence
  Description of Artificial Sequence: Synthetic polypeptide
DEEEIRTTNPVATEQYGSVETPSLIPTVVEQFQV

SEQ ID NO: 138056 - protein, 34 aa, Artificial Sequence
  Description of Artificial Sequence: Synthetic polypeptide
DEEEIATTNPVATEQYGSVCAAMHGPQDSGENDH

SEQ ID NO: 138057 - protein, 33 aa, Artificial Sequence
  Description of Artificial Sequence: Synthetic polypeptide
DEEEIATTNPVAYEQWGTVCAAGNLQGDGDNSM

SEQ ID NO: 138058 - protein, 34 aa, Artificial Sequence
  Description of Artificial Sequence: Synthetic polypeptide
DEEEIATTNPVATEQYGSVCAAMHLQAMAPNDFP

SEQ ID NO: 138059 - protein, 35 aa, Artificial Sequence
  Description of Artificial Sequence: Synthetic polypeptide
QEEEIRTTNPVATEQYGSVGDFGNDGQENDDGNQG

SEQ ID NO: 138060 - protein, 33 aa, Artificial Sequence
  Description of Artificial Sequence: Synthetic polypeptide
DEEEIATTNPVATEQYGSVCAAMHDPQDSGEDH

SEQ ID NO: 138061 - protein, 30 aa, Artificial Sequence
  Description of Artificial Sequence: Synthetic polypeptide
QEMEIATTNPVATEQYGEACSTDVCQHEEK

SEQ ID NO: 138062 - protein, 28 aa, Artificial Sequence
  Description of Artificial Sequence: Synthetic peptide
QEMEIATTNPVATEQYGEAPEVCEHGEK

SEQ ID NO: 138063 - protein, 28 aa, Artificial Sequence
  Description of Artificial Sequence: Synthetic peptide
QEMEIATTNPVATEQYGEAPEVCQHEEK

SEQ ID NO: 138064 - protein, 35 aa, Artificial Sequence
  Description of Artificial Sequence: Synthetic polypeptide
QEEEIRTTNPVATEQYGSVDTVMIGNGGDDGEENQ

SEQ ID NO: 138065 - protein, 33 aa, Artificial Sequence
  Description of Artificial Sequence: Synthetic polypeptide
QEEEIRTTNPVATEQYGSVDTTDTMDNGGGEFI

SEQ ID NO: 138066 - protein, 37 aa, Artificial Sequence
  Description of Artificial Sequence: Synthetic polypeptide
AEEEIRTTNPVATEQYGSVSTVVSNTGNQAGNTNQTD

SEQ ID NO: 138067 - protein, 34 aa, Artificial Sequence
  Description of Artificial Sequence: Synthetic polypeptide
QEEEIRTTNPVATEQYGSVISCGVAVSQGTGGST

SEQ ID NO: 138068 - protein, 29 aa, Artificial Sequence
  Description of Artificial Sequence: Synthetic peptide
QEMEIASTNPVGTEGYGVVSASTLQHGDI

SEQ ID NO: 138069 - protein, 28 aa, Artificial Sequence
  Description of Artificial Sequence: Synthetic peptide
QEMEIASTNPVGTEGYGVMATTLQHGDI

SEQ ID NO: 138070 - protein, 34 aa, Artificial Sequence
  Description of Artificial Sequence: Synthetic polypeptide
DEEEIATTNPVAYEQWGSVTGGDNAGQGGRGDMR

SEQ ID NO: 138071 - protein, 32 aa, Artificial Sequence
  Description of Artificial Sequence: Synthetic polypeptide
DEEEIATTNPVAYEQWGSVTGGNMNDRAGEGD

SEQ ID NO: 138072 - protein, 34 aa, Artificial Sequence
  Description of Artificial Sequence: Synthetic polypeptide
DEEEIATTNPVAYEQWGSVTGGPNGNQGVGNGRD

SEQ ID NO: 138073 - protein, 32 aa, Artificial Sequence
  Description of Artificial Sequence: Synthetic polypeptide
QEMEIAPTNPVATEQYGIVCSATDNLEFEGTD

SEQ ID NO: 138074 - protein, 34 aa, Artificial Sequence
  Description of Artificial Sequence: Synthetic polypeptide
QEEEIRTTNPVATEQYGSVGTTTMDNGGGGGEEG

SEQ ID NO: 138075 - protein, 31 aa, Artificial Sequence
  Description of Artificial Sequence: Synthetic polypeptide
QEMEIAPTNPVSTEQYGIVCSTDNLEFEGTD

SEQ ID NO: 138076 - protein, 34 aa, Artificial Sequence
  Description of Artificial Sequence: Synthetic polypeptide
QEEEIRTTNPVATEQYGSVGTDTTMDINGGGGFG

SEQ ID NO: 138077 - protein, 34 aa, Artificial Sequence
  Description of Artificial Sequence: Synthetic polypeptide
DEEEIATTNPVAYEQWGSVVSTENLDGNHGGIFE

SEQ ID NO: 138078 - protein, 35 aa, Artificial Sequence
  Description of Artificial Sequence: Synthetic polypeptide
DEEEIATTNPVATEQYGSVCAAMHPLQAMDPNDRH

SEQ ID NO: 138079 - protein, 29 aa, Artificial Sequence
  Description of Artificial Sequence: Synthetic peptide
QEMEIASTNPCSYEQYGCVSWNLQSGSTA

SEQ ID NO: 138080 - protein, 32 aa, Artificial Sequence
  Description of Artificial Sequence: Synthetic polypeptide
DEEEIATTNPVAYEQWGSYWSTINETQDNTAE

SEQ ID NO: 138081 - protein, 38 aa, Artificial Sequence
  Description of Artificial Sequence: Synthetic polypeptide
DEEEIRTTNPVATEQYGVVSTTVNQNLQQGNNQEDEED

SEQ ID NO: 138082 - protein, 28 aa, Artificial Sequence
  Description of Artificial Sequence: Synthetic peptide
QEMEIASTNPVGTEGYGVMASTLQHGDI

SEQ ID NO: 138083 - protein, 33 aa, Artificial Sequence
  Description of Artificial Sequence: Synthetic polypeptide
DEEEIATTNPVATEQYGSVCAAMHLQAMPDDTN

SEQ ID NO: 138084 - protein, 34 aa, Artificial Sequence
  Description of Artificial Sequence: Synthetic polypeptide
DEEEIATTNPVATEQYGSVCAAMLHDNAMENAER

SEQ ID NO: 138085 - protein, 37 aa, Artificial Sequence
  Description of Artificial Sequence: Synthetic polypeptide
DEEEIRTTNPVATEQYGSVGGTMNQQDTGGENGGGQG

SEQ ID NO: 138086 - protein, 31 aa, Artificial Sequence
  Description of Artificial Sequence: Synthetic polypeptide
DEMEIATTNPVCTEQYGTVCSDDGPESEGND

SEQ ID NO: 138087 - protein, 31 aa, Artificial Sequence
  Description of Artificial Sequence: Synthetic polypeptide
QEMEIVTTNPVATEQYGTVCSATGPVEFGEL

SEQ ID NO: 138088 - protein, 34 aa, Artificial Sequence
  Description of Artificial Sequence: Synthetic polypeptide
DEHEIRTTNPVATEQYGSVRTLLETETNYNDDDQ

SEQ ID NO: 138089 - protein, 35 aa, Artificial Sequence
  Description of Artificial Sequence: Synthetic polypeptide
DEEEIRTTNPVATEQYGSVCPPNNLEHLVGEAEEV

SEQ ID NO: 138090 - protein, 33 aa, Artificial Sequence
  Description of Artificial Sequence: Synthetic polypeptide
DEMEICTTNPVATEQYGTVCSATDGPVEHEGND

SEQ ID NO: 138091 - protein, 34 aa, Artificial Sequence
  Description of Artificial Sequence: Synthetic polypeptide
DEEEIRTTNPVATEQYGSVCPQALPEERELDVVI

SEQ ID NO: 138092 - protein, 28 aa, Artificial Sequence
  Description of Artificial Sequence: Synthetic peptide
QENEIAPTNPVASEQYGDVSCIEMAGTA

SEQ ID NO: 138093 - protein, 34 aa, Artificial Sequence
  Description of Artificial Sequence: Synthetic polypeptide
DEMEICTTNPVATEQYGTVCSATDGPVEFWGNDR

SEQ ID NO: 138094 - protein, 35 aa, Artificial Sequence
  Description of Artificial Sequence: Synthetic polypeptide
DEEEIRTTNPVATEQYGSVCPQALTEERMLMNVVI

SEQ ID NO: 138095 - protein, 33 aa, Artificial Sequence
  Description of Artificial Sequence: Synthetic polypeptide
DEMEICTTNPVATEQYGTVCSATDGPVEFEGNN

SEQ ID NO: 138096 - protein, 37 aa, Artificial Sequence
  Description of Artificial Sequence: Synthetic polypeptide
DEEEIRTTNPVATEQYGVVSTVVNNQNLQQGTEDEEE

SEQ ID NO: 138097 - protein, 33 aa, Artificial Sequence
  Description of Artificial Sequence: Synthetic polypeptide
DEMEICTTNPVATEQYGTVCSATDGPVEFEGND

SEQ ID NO: 138098 - protein, 33 aa, Artificial Sequence
  Description of Artificial Sequence: Synthetic polypeptide
DEMEICTTNPVATEQYGTVCSATAGPVEFEGND

SEQ ID NO: 138099 - protein, 36 aa, Artificial Sequence
  Description of Artificial Sequence: Synthetic polypeptide
DEEEIRTTNPVATEQYGSVCPQSLSQIPRLGVEIID

SEQ ID NO: 138100 - protein, 35 aa, Artificial Sequence
  Description of Artificial Sequence: Synthetic polypeptide
DEEEIRTTNPVATEQYGSVFGSSDDEGGNDTTENI

SEQ ID NO: 138101 - protein, 29 aa, Artificial Sequence
  Description of Artificial Sequence: Synthetic peptide
QENEIAPTNPCSSEQYGIVSCNLQSNGTH

SEQ ID NO: 138102 - protein, 28 aa, Artificial Sequence
  Description of Artificial Sequence: Synthetic peptide
QENEIAPTNPCSSEQYGIVSCNLQAEDA

SEQ ID NO: 138103 - protein, 29 aa, Artificial Sequence
  Description of Artificial Sequence: Synthetic peptide
QENEIAPTNPCSSEQWGIVSCNLQSAGTR

SEQ ID NO: 138104 - protein, 37 aa, Artificial Sequence
  Description of Artificial Sequence: Synthetic polypeptide
DEEEIRTTNPVATEQYGVVSTVVNNQNLQQGEEEEDE

SEQ ID NO: 138105 - protein, 37 aa, Artificial Sequence
  Description of Artificial Sequence: Synthetic polypeptide
DEEEIRTTNPVATEQYGVVSTVVNNQNGNQGNQEETD

SEQ ID NO: 138106 - protein, 37 aa, Artificial Sequence
  Description of Artificial Sequence: Synthetic polypeptide
AEEEIRTTNPVATEQYGSVSVTTNNNQAGNIGTNTNE

SEQ ID NO: 138107 - protein, 36 aa, Artificial Sequence
  Description of Artificial Sequence: Synthetic polypeptide
DEEEIRTTNPVATEQYGSVCSANLSFDGQQMLFVQV

SEQ ID NO: 138108 - protein, 35 aa, Artificial Sequence
  Description of Artificial Sequence: Synthetic polypeptide
DEEEIRTTNPVATEQYGSVFGSFEDDTGGNQENDQ

SEQ ID NO: 138109 - protein, 37 aa, Artificial Sequence
  Description of Artificial Sequence: Synthetic polypeptide
AEEEIRTTNPVATEQYGSVSTVVSNGEQLGNNQNQTD

SEQ ID NO: 138110 - protein, 29 aa, Artificial Sequence
  Description of Artificial Sequence: Synthetic peptide
QEEEIRTTNPVATEQYGEAPNEVWAHEEK

SEQ ID NO: 138111 - protein, 33 aa, Artificial Sequence
  Description of Artificial Sequence: Synthetic polypeptide
DEHEIRTTNPVATEQYGSVQTVMEEVDEGEEDI

SEQ ID NO: 138112 - protein, 35 aa, Artificial Sequence
  Description of Artificial Sequence: Synthetic polypeptide
DEEEIRTTNPVATEQYGSVCRTDDMQNDVVNSDIL

SEQ ID NO: 138113 - protein, 35 aa, Artificial Sequence
  Description of Artificial Sequence: Synthetic polypeptide
DEMEICTTNPVATEQYGSVSCTNGTQLTFGSKQFE

SEQ ID NO: 138114 - protein, 28 aa, Artificial Sequence
  Description of Artificial Sequence: Synthetic peptide
QENEIAGTNPVATECYGDVSECAQHEEL

SEQ ID NO: 138115 - protein, 28 aa, Artificial Sequence
  Description of Artificial Sequence: Synthetic peptide
QENEIAGTNPVATECYGDVSECHQHEEL

SEQ ID NO: 138116 - protein, 37 aa, Artificial Sequence
  Description of Artificial Sequence: Synthetic polypeptide
DEEEIRTTNPVATEQYGVVSTVVNNQNGNQQGNTNTD

SEQ ID NO: 138117 - protein, 37 aa, Artificial Sequence
  Description of Artificial Sequence: Synthetic polypeptide
DEEEIRTTNPVATEQYGVVSTVVNNQNGNQQGTEQGQ

SEQ ID NO: 138118 - protein, 36 aa, Artificial Sequence
  Description of Artificial Sequence: Synthetic polypeptide
DEEEIRTTNPVATEQYGVVSTVVNNQNGTEDEEDED

SEQ ID NO: 138119 - protein, 37 aa, Artificial Sequence
  Description of Artificial Sequence: Synthetic polypeptide
AEEEIRTTNPVATEQYGSVSTVVSNANNQLGNNNQTD

SEQ ID NO: 138120 - protein, 34 aa, Artificial Sequence
  Description of Artificial Sequence: Synthetic polypeptide
DEHEIRTTNPVATEQYGSVQIVTEEVDEGEEDRI

SEQ ID NO: 138121 - protein, 36 aa, Artificial Sequence
  Description of Artificial Sequence: Synthetic polypeptide
DEEEIRTTNPVATEQYGSVCPHEVNGNERELLGINV

SEQ ID NO: 138122 - protein, 33 aa, Artificial Sequence
  Description of Artificial Sequence: Synthetic polypeptide
DEMEICTTNPVATEQYGTVCSLTDGPVEFEGND

SEQ ID NO: 138123 - protein, 34 aa, Artificial Sequence
  Description of Artificial Sequence: Synthetic polypeptide
DEEEIRTTNPVATEQYGSVFGVDDEFGAGETNNI

SEQ ID NO: 138124 - protein, 34 aa, Artificial Sequence
  Description of Artificial Sequence: Synthetic polypeptide
DEEEIATTNPVAYEQYGSVAATNYLTGTPDGSEN

SEQ ID NO: 138125 - protein, 34 aa, Artificial Sequence
  Description of Artificial Sequence: Synthetic polypeptide
DEEEIATTNPVAYEQYGSVAGEGGGQNHQDGNGN

SEQ ID NO: 138126 - protein, 36 aa, Artificial Sequence
  Description of Artificial Sequence: Synthetic polypeptide
DEHEIRTTNPVATEQYGSVFHTDNDHQQGDQRGDHP

SEQ ID NO: 138127 - protein, 34 aa, Artificial Sequence
  Description of Artificial Sequence: Synthetic polypeptide
DEEEIATTNPVAYEQYGSVAGEGGQNHQDGNAQN

SEQ ID NO: 138128 - protein, 34 aa, Artificial Sequence
  Description of Artificial Sequence: Synthetic polypeptide
DEEEIATTNPVAYEQYGSVAGTNGTGAEGGNMID

SEQ ID NO: 138129 - protein, 33 aa, Artificial Sequence
  Description of Artificial Sequence: Synthetic polypeptide
DEEEIATTNPVATEQYGSVCAADNHGQDSDIEF

SEQ ID NO: 138130 - protein, 34 aa, Artificial Sequence
  Description of Artificial Sequence: Synthetic polypeptide
DEMEICTTNPVATEQYGTVSTVTDGNPVEEEGND

SEQ ID NO: 138131 - protein, 38 aa, Artificial Sequence
  Description of Artificial Sequence: Synthetic polypeptide
DEEEIRTTNPVATEQYGVVSTTVNLQQGNTEQGNTDDD

SEQ ID NO: 138132 - protein, 33 aa, Artificial Sequence
  Description of Artificial Sequence: Synthetic polypeptide
DEMEICTTNPVATEQYGTVSVVTDGAVESEGND

SEQ ID NO: 138133 - protein, 33 aa, Artificial Sequence
  Description of Artificial Sequence: Synthetic polypeptide
DEMEICTTNPVATEQYGTVTVVTDGQVEQEGND

SEQ ID NO: 138134 - protein, 33 aa, Artificial Sequence
  Description of Artificial Sequence: Synthetic polypeptide
DEMEICTTNPVATEQYGTVVSATDGPVEFEGND

SEQ ID NO: 138135 - protein, 35 aa, Artificial Sequence
  Description of Artificial Sequence: Synthetic polypeptide
DEEEIATTNPVATEQYGSVCAAANNLDEAGTNNVN

SEQ ID NO: 138136 - protein, 38 aa, Artificial Sequence
  Description of Artificial Sequence: Synthetic polypeptide
DEEEIRTTNPVATEQYGVVSTTVNLQQGNQQGSTTDDD

SEQ ID NO: 138137 - protein, 37 aa, Artificial Sequence
  Description of Artificial Sequence: Synthetic polypeptide
DEEEIRTTNPVATEQYGSVFGVTNMQDQDEGGGEGNT

SEQ ID NO: 138138 - protein, 36 aa, Artificial Sequence
  Description of Artificial Sequence: Synthetic polypeptide
AEEEIRTTNPVATEQYGSVSTVVSNGNNVDEGTNSD

SEQ ID NO: 138139 - protein, 30 aa, Artificial Sequence
  Description of Artificial Sequence: Synthetic polypeptide
QEEEIRTTNPVATEQYGEAPEVEMNAAEDA

SEQ ID NO: 138140 - protein, 33 aa, Artificial Sequence
  Description of Artificial Sequence: Synthetic polypeptide
DEMEICTTNPVATEQYGTVCSWTDGPVEFEGND

SEQ ID NO: 138141 - protein, 35 aa, Artificial Sequence
  Description of Artificial Sequence: Synthetic polypeptide
DEEEIRTTNPVATEQYGSVCPEPNMEILRGLEEEL

SEQ ID NO: 138142 - protein, 28 aa, Artificial Sequence
  Description of Artificial Sequence: Synthetic peptide
QENEIAPTNPVSSEPYGIISCNIQQGTR

SEQ ID NO: 138143 - protein, 33 aa, Artificial Sequence
  Description of Artificial Sequence: Synthetic polypeptide
DEMEICTTNPVATEQYGTVCSRTDGPVEKEGND

SEQ ID NO: 138144 - protein, 36 aa, Artificial Sequence
  Description of Artificial Sequence: Synthetic polypeptide
DEEEIRTTNPVATEQYGVVSTVVNNQNNQNTEEEED

SEQ ID NO: 138145 - protein, 33 aa, Artificial Sequence
  Description of Artificial Sequence: Synthetic polypeptide
DEMEICTTNPVATEQYGTVCSTTDGPSEFEGND

SEQ ID NO: 138146 - protein, 28 aa, Artificial Sequence
  Description of Artificial Sequence: Synthetic peptide
QENEIASTNPVATECYGDVAECLQHEEL

SEQ ID NO: 138147 - protein, 36 aa, Artificial Sequence
  Description of Artificial Sequence: Synthetic polypeptide
DEEEIRTTNPVATEQYGSVFGSTDDEQGEEFDTNIG

SEQ ID NO: 138148 - protein, 28 aa, Artificial Sequence
  Description of Artificial Sequence: Synthetic peptide
QENEIASTNPVATECYGDVASCLQHEDL

SEQ ID NO: 138149 - protein, 28 aa, Artificial Sequence
  Description of Artificial Sequence: Synthetic peptide
QENEIASTNPVATEGWGVVSSTEQAGDA

SEQ ID NO: 138150 - protein, 37 aa, Artificial Sequence
  Description of Artificial Sequence: Synthetic polypeptide
DEEEIRTTNPVATEQYGVVSTVVNNQNQEQGTTEENE

SEQ ID NO: 138151 - protein, 34 aa, Artificial Sequence
  Description of Artificial Sequence: Synthetic polypeptide
DEHEIRTTNPVATEQYGSVISVEHDLNTGEEQYE

SEQ ID NO: 138152 - protein, 28 aa, Artificial Sequence
  Description of Artificial Sequence: Synthetic peptide
QENEIASTNPVATEGWGVVSSTEQAGDI

SEQ ID NO: 138153 - protein, 33 aa, Artificial Sequence
  Description of Artificial Sequence: Synthetic polypeptide
DEMEICTTNPVATEQYGTVCSVTDGIVEIEGND

SEQ ID NO: 138154 - protein, 34 aa, Artificial Sequence
  Description of Artificial Sequence: Synthetic polypeptide
DEEEIATTNPVAYEQYGSVAATNLTGTPDGSDEN

SEQ ID NO: 138155 - protein, 30 aa, Artificial Sequence
  Description of Artificial Sequence: Synthetic polypeptide
QENEIASTNPVATECYGNVSANCIQSREQL

SEQ ID NO: 138156 - protein, 35 aa, Artificial Sequence
  Description of Artificial Sequence: Synthetic polypeptide
DEEEIRTTNPVATEQYGSVFGSFEDDEGGNTENDP

SEQ ID NO: 138157 - protein, 35 aa, Artificial Sequence
  Description of Artificial Sequence: Synthetic polypeptide
DEEEIRTTNPVATEQYGSVFGSFEDDEGGNQTNNV

SEQ ID NO: 138158 - protein, 35 aa, Artificial Sequence
  Description of Artificial Sequence: Synthetic polypeptide
DEEEIRTTNPVATEQYGSVFGSFEDDEGGNQNNID

SEQ ID NO: 138159 - protein, 36 aa, Artificial Sequence
  Description of Artificial Sequence: Synthetic polypeptide
DEHEIRTTNPVATEQYGSVSSTTPAGPNMRNGMNPV

SEQ ID NO: 138160 - protein, 36 aa, Artificial Sequence
  Description of Artificial Sequence: Synthetic polypeptide
DEHEIRTTNPVATEQYGSVSSTTGAGPNMRNGMNPV

SEQ ID NO: 138161 - protein, 29 aa, Artificial Sequence
  Description of Artificial Sequence: Synthetic peptide
QENCIATTNPVATECYGDVYSECLQHEEL

SEQ ID NO: 138162 - protein, 29 aa, Artificial Sequence
  Description of Artificial Sequence: Synthetic peptide
QENCIATTNPVATECYGQVSEVLQHEEHL

SEQ ID NO: 138163 - protein, 28 aa, Artificial Sequence
  Description of Artificial Sequence: Synthetic peptide
QENDIATTNPVATECYGDVSECIQHEEL

SEQ ID NO: 138164 - protein, 29 aa, Artificial Sequence
  Description of Artificial Sequence: Synthetic peptide
QENEIAATNPVATECYGDVSECCLQHEEL

SEQ ID NO: 138165 - protein, 37 aa, Artificial Sequence
  Description of Artificial Sequence: Synthetic polypeptide
DEEEIRTTNPVATEQYGSVCSITLEMLPQARNEEPSE

SEQ ID NO: 138166 - protein, 34 aa, Artificial Sequence
  Description of Artificial Sequence: Synthetic polypeptide
QEEEIRTTNPVATEQYGMATIMTNGGQGGENETN

SEQ ID NO: 138167 - protein, 36 aa, Artificial Sequence
  Description of Artificial Sequence: Synthetic polypeptide
QEEEIRTTNPVATEQYGLVSSTTPNGPNMRNGMNPV

SEQ ID NO: 138168 - protein, 37 aa, Artificial Sequence
  Description of Artificial Sequence: Synthetic polypeptide
DEEEIRTTNPVATEQYGSVFGDSGENVLDGGEGENEQ

SEQ ID NO: 138169 - protein, 36 aa, Artificial Sequence
  Description of Artificial Sequence: Synthetic polypeptide
QEEEIRTTNPVATEQYGIVSSTTPAGPNMRNGMNPR

SEQ ID NO: 138170 - protein, 28 aa, Artificial Sequence
  Description of Artificial Sequence: Synthetic peptide
QENEIACTNPVATECWGDVSECLQHEEL

SEQ ID NO: 138171 - protein, 35 aa, Artificial Sequence
  Description of Artificial Sequence: Synthetic polypeptide
DEEEIRTTNPVATEQYGSVFGDTDDEGGNDEQTNI

SEQ ID NO: 138172 - protein, 35 aa, Artificial Sequence
  Description of Artificial Sequence: Synthetic polypeptide
DEEEIRTTNPVATEQYGSVCSENELEHLVLEVEEV

SEQ ID NO: 138173 - protein, 29 aa, Artificial Sequence
  Description of Artificial Sequence: Synthetic peptide
QENEIAATNPVATECYGDVSWCLCQHEEL

SEQ ID NO: 138174 - protein, 34 aa, Artificial Sequence
  Description of Artificial Sequence: Synthetic polypeptide
QEEEIRTTNPVATEQYGEVSPTTPACQMHNEEPV

SEQ ID NO: 138175 - protein, 30 aa, Artificial Sequence
  Description of Artificial Sequence: Synthetic polypeptide
DEMEIATTNPVGTEQYGVMASGPVEFEGND

SEQ ID NO: 138176 - protein, 34 aa, Artificial Sequence
  Description of Artificial Sequence: Synthetic polypeptide
QEEEIRTTNPVATEQYGMVSIFTGVGQGDNEGQN

SEQ ID NO: 138177 - protein, 32 aa, Artificial Sequence
  Description of Artificial Sequence: Synthetic polypeptide
QEMEIVTTNPVATEQYGTVCSTDGPVEFEGND

SEQ ID NO: 138178 - protein, 32 aa, Artificial Sequence
  Description of Artificial Sequence: Synthetic polypeptide
QEMEIVTTNPVATEQYGTVCSTDGPVEFEGNK

SEQ ID NO: 138179 - protein, 30 aa, Artificial Sequence
  Description of Artificial Sequence: Synthetic polypeptide
DEMEIATTNPVGTEQYGTMASGPVEFEGND

SEQ ID NO: 138180 - protein, 31 aa, Artificial Sequence
  Description of Artificial Sequence: Synthetic polypeptide
DEMEIATTNPVGTEQYGTMSATGPVEFEGND

SEQ ID NO: 138181 - protein, 30 aa, Artificial Sequence
  Description of Artificial Sequence: Synthetic polypeptide
DEMEIATTNPVGTEQYGTMSSGPVEFEGND

SEQ ID NO: 138182 - protein, 30 aa, Artificial Sequence
  Description of Artificial Sequence: Synthetic polypeptide
QEMEIVTTNPVATEQYGTVSTDVCVEFEEK

SEQ ID NO: 138183 - protein, 29 aa, Artificial Sequence
  Description of Artificial Sequence: Synthetic peptide
QENAIATTNPVATEAYGDVSECLQHELLP

SEQ ID NO: 138184 - protein, 32 aa, Artificial Sequence
  Description of Artificial Sequence: Synthetic polypeptide
DEMEIATTNPVGTEQYGTVCSATDGPVEFGND

SEQ ID NO: 138185 - protein, 28 aa, Artificial Sequence
  Description of Artificial Sequence: Synthetic peptide
QEMEIVTTNPVGTEGYGTVATTPEHGDI

SEQ ID NO: 138186 - protein, 29 aa, Artificial Sequence
  Description of Artificial Sequence: Synthetic peptide
DEMEIATTNPVGTEQYGVMAASTPEFGDD

SEQ ID NO: 138187 - protein, 29 aa, Artificial Sequence
  Description of Artificial Sequence: Synthetic peptide
QEMEIVTTNPVGTEQYGTVAATTPEHGDI

SEQ ID NO: 138188 - protein, 31 aa, Artificial Sequence
  Description of Artificial Sequence: Synthetic polypeptide
QEMEIVTTNPVGTEQYGTVSATDGPEFEGNI

SEQ ID NO: 138189 - protein, 29 aa, Artificial Sequence
  Description of Artificial Sequence: Synthetic peptide
DEMEIATTNPVGTEQYGVMAASTPEHGDD

SEQ ID NO: 138190 - protein, 30 aa, Artificial Sequence
  Description of Artificial Sequence: Synthetic polypeptide
QEMEIVTTNPVGTEQYGTVSATDGPEFGDI

SEQ ID NO: 138191 - protein, 35 aa, Artificial Sequence
  Description of Artificial Sequence: Synthetic polypeptide
QEEEIRTTNPVATEQYGMVSIFTGVGQGGNEGNQN

SEQ ID NO: 138192 - protein, 36 aa, Artificial Sequence
  Description of Artificial Sequence: Synthetic polypeptide
QEEEIRTTNPVATEQYGMVSITDMEGNQGQGDGNDG

SEQ ID NO: 138193 - protein, 37 aa, Artificial Sequence
  Description of Artificial Sequence: Synthetic polypeptide
DEEEIRTTNPVATEQYGVVSTVVNNQAGTNDEDEEED

SEQ ID NO: 138194 - protein, 36 aa, Artificial Sequence
  Description of Artificial Sequence: Synthetic polypeptide
DEEEIRTTNPVATEQYGSVCSENDLEHTLVGEEEEY

SEQ ID NO: 138195 - protein, 35 aa, Artificial Sequence
  Description of Artificial Sequence: Synthetic polypeptide
DEEEIRTTNPVATEQYGSVFGSFEDDEGGNIENTQ

SEQ ID NO: 138196 - protein, 28 aa, Artificial Sequence
  Description of Artificial Sequence: Synthetic peptide
QENEIACTNPVATEQYGEAPENCQHEEK

SEQ ID NO: 138197 - protein, 28 aa, Artificial Sequence
  Description of Artificial Sequence: Synthetic peptide
QENEIACTNPVATEQYGEAPEVCQHGEK

SEQ ID NO: 138198 - protein, 36 aa, Artificial Sequence
  Description of Artificial Sequence: Synthetic polypeptide
DEEEIRTTNPVATEQYGSVFGSFEDDEGGNLQENIQ

SEQ ID NO: 138199 - protein, 35 aa, Artificial Sequence
  Description of Artificial Sequence: Synthetic polypeptide
DEEEIRTTNPVATEQYGSVFGSFEDDEGGNQEEIA

SEQ ID NO: 138200 - protein, 34 aa, Artificial Sequence
  Description of Artificial Sequence: Synthetic polypeptide
DEEEIATTNPVAYEQYGSACSAANPLADAEGNHH

SEQ ID NO: 138201 - protein, 37 aa, Artificial Sequence
  Description of Artificial Sequence: Synthetic polypeptide
AEEEIRTTNPVATEQYGSVSTVVSNGTQAGNNNNQTD

SEQ ID NO: 138202 - protein, 37 aa, Artificial Sequence
  Description of Artificial Sequence: Synthetic polypeptide
AEEEIRTTNPVATEQYGSVSVTTNNNLQLQIGTEEGS

SEQ ID NO: 138203 - protein, 37 aa, Artificial Sequence
  Description of Artificial Sequence: Synthetic polypeptide
DEEEIRTTNPVATEQYGVVSTVVNNQNDEQGTNEEED

SEQ ID NO: 138204 - protein, 36 aa, Artificial Sequence
  Description of Artificial Sequence: Synthetic polypeptide
DEEEIRTTNPVATEQYGSVFGSFEDDEGGNQEGNNQ

SEQ ID NO: 138205 - protein, 37 aa, Artificial Sequence
  Description of Artificial Sequence: Synthetic polypeptide
AEEEIRTTNPVATEQYGSVSTVVSNGNQNGVTQNQTD

SEQ ID NO: 138206 - protein, 37 aa, Artificial Sequence
  Description of Artificial Sequence: Synthetic polypeptide
AEEEIRTTNPVATEQYGSVSTVVSNGNQLGNTNNQTD

SEQ ID NO: 138207 - protein, 35 aa, Artificial Sequence
  Description of Artificial Sequence: Synthetic polypeptide
AEEEIRTTNPVATEQYGSVSTVVSNGNQGVTEQTD

SEQ ID NO: 138208 - protein, 36 aa, Artificial Sequence
  Description of Artificial Sequence: Synthetic polypeptide
AEEEIRTTNPVATEQYGSVSTVVSNGNQGVNNNQTD

SEQ ID NO: 138209 - protein, 37 aa, Artificial Sequence
  Description of Artificial Sequence: Synthetic polypeptide
AEEEIRTTNPVATEQYGSVSTVVSNGNQQGSTGNQTD

SEQ ID NO: 138210 - protein, 37 aa, Artificial Sequence
  Description of Artificial Sequence: Synthetic polypeptide
DDAEIRTTNPVATEQYGSVCSTNIMLEELRNGNEEVF

SEQ ID NO: 138211 - protein, 35 aa, Artificial Sequence
  Description of Artificial Sequence: Synthetic polypeptide
DEEEIRTTNPVATEQYGSVFGSFEDDEGGNGENIG

SEQ ID NO: 138212 - protein, 34 aa, Artificial Sequence
  Description of Artificial Sequence: Synthetic polypeptide
DEEEIATTNPVAYEQYGSACSAANNLDDTGNDTM

SEQ ID NO: 138213 - protein, 37 aa, Artificial Sequence
  Description of Artificial Sequence: Synthetic polypeptide
AEEEIRTTNPVATEQYGSVSTVVSNNGNQEGTNNQTD

SEQ ID NO: 138214 - protein, 29 aa, Artificial Sequence
  Description of Artificial Sequence: Synthetic peptide
QENEIACTNPVATECYGDVSSEQLQHEEL

SEQ ID NO: 138215 - protein, 37 aa, Artificial Sequence
  Description of Artificial Sequence: Synthetic polypeptide
AEEEIRTTNPVATEQYGSVSTVVSNNGEQLGNNNDTD

SEQ ID NO: 138216 - protein, 32 aa, Artificial Sequence
  Description of Artificial Sequence: Synthetic polypeptide
QEEEIRTTNPVATEQYGEVSPEPVGNMHNEEV

SEQ ID NO: 138217 - protein, 36 aa, Artificial Sequence
  Description of Artificial Sequence: Synthetic polypeptide
DEEEIRTTNPVATEQYGSVFGSETDDEGGNDTTNIF

SEQ ID NO: 138218 - protein, 38 aa, Artificial Sequence
  Description of Artificial Sequence: Synthetic polypeptide
AEEEIRTTNPVATEQYGSVSTVVSNLGNQEGTTNNATD

SEQ ID NO: 138219 - protein, 35 aa, Artificial Sequence
  Description of Artificial Sequence: Synthetic polypeptide
DEEEIATTNPVAYEQYGSACSAANNLQDAGEGNHN

SEQ ID NO: 138220 - protein, 35 aa, Artificial Sequence
  Description of Artificial Sequence: Synthetic polypeptide
DDAEIRTTNPVATEQYGSVSFTMNDHTDNQSEDNQ

SEQ ID NO: 138221 - protein, 35 aa, Artificial Sequence
  Description of Artificial Sequence: Synthetic polypeptide
DEEEIRTTNPVATEQYGSVFGSFDDEGGNQTTDNF

SEQ ID NO: 138222 - protein, 35 aa, Artificial Sequence
  Description of Artificial Sequence: Synthetic polypeptide
DEEEIRTTNPVATEQYGSVFGSFDQSEGGNQENIE

SEQ ID NO: 138223 - protein, 36 aa, Artificial Sequence
  Description of Artificial Sequence: Synthetic polypeptide
DDAEIRTTNPVATEQYGSVVSTIMLEELRMGNEEVF

SEQ ID NO: 138224 - protein, 35 aa, Artificial Sequence
  Description of Artificial Sequence: Synthetic polypeptide
DEEEIRTTNPVATEQYGSVFGSFEDDEGGESENIV

SEQ ID NO: 138225 - protein, 34 aa, Artificial Sequence
  Description of Artificial Sequence: Synthetic polypeptide
DDAEIRTTNPVATEQYGSVWSTIQDNTQEDEEQN

SEQ ID NO: 138226 - protein, 35 aa, Artificial Sequence
  Description of Artificial Sequence: Synthetic polypeptide
DEEEIATTNPVAYEQYGSACSAANDLQEAAIGNDN

SEQ ID NO: 138227 - protein, 37 aa, Artificial Sequence
  Description of Artificial Sequence: Synthetic polypeptide
AEEEIRTTNPVATEQYGSVSTVVSNGVQLGNNNNTTD

SEQ ID NO: 138228 - protein, 38 aa, Artificial Sequence
  Description of Artificial Sequence: Synthetic polypeptide
DEEEIRTTNPVATEQYGVVSTVVNQNLQQGTNQEEEDE

SEQ ID NO: 138229 - protein, 34 aa, Artificial Sequence
  Description of Artificial Sequence: Synthetic polypeptide
QEEEIRTTNPCATEQYGSVSSTTPAGPNRGMTPV

SEQ ID NO: 138230 - protein, 37 aa, Artificial Sequence
  Description of Artificial Sequence: Synthetic polypeptide
DEEEIRTTNPVATEQYGSVATTNNQLQAGTETGTTES

SEQ ID NO: 138231 - protein, 37 aa, Artificial Sequence
  Description of Artificial Sequence: Synthetic polypeptide
DEEEIRTTNPVATEQYGSVGSWTPNGVQPLQMVQEAD

SEQ ID NO: 138232 - protein, 32 aa, Artificial Sequence
  Description of Artificial Sequence: Synthetic polypeptide
QENEIATTNPVATECYGDVSTPCLQMHNGMEV

SEQ ID NO: 138233 - protein, 30 aa, Artificial Sequence
  Description of Artificial Sequence: Synthetic polypeptide
QENEIATTNPVATECYGDVSTEPCLNHEEL

SEQ ID NO: 138234 - protein, 31 aa, Artificial Sequence
  Description of Artificial Sequence: Synthetic polypeptide
DDEEIASTNPVSTEGYGNVAANTIQSRVGQR

SEQ ID NO: 138235 - protein, 33 aa, Artificial Sequence
  Description of Artificial Sequence: Synthetic polypeptide
DEHEIKTTNPVATEQYGTVCSATDGPSEFEGND

SEQ ID NO: 138236 - protein, 37 aa, Artificial Sequence
  Description of Artificial Sequence: Synthetic polypeptide
AEEEIRTTNPVATEQYGSVTVVVTTNLQQGNNEENEE

SEQ ID NO: 138237 - protein, 31 aa, Artificial Sequence
  Description of Artificial Sequence: Synthetic polypeptide
QENEIATTNPVATECYGDVSTDLEDHEGEDL

SEQ ID NO: 138238 - protein, 34 aa, Artificial Sequence
  Description of Artificial Sequence: Synthetic polypeptide
DEEEIRTTNPVATEQYGSVACWEDVQRPMQVATI

SEQ ID NO: 138239 - protein, 32 aa, Artificial Sequence
  Description of Artificial Sequence: Synthetic polypeptide
QENEIATTNPVATECYGDVSSTTCLQHEMNPL

SEQ ID NO: 138240 - protein, 32 aa, Artificial Sequence
  Description of Artificial Sequence: Synthetic polypeptide
QENEIATTNPVATECYGDVSSTECLQHEMNPL

SEQ ID NO: 138241 - protein, 33 aa, Artificial Sequence
  Description of Artificial Sequence: Synthetic polypeptide
DEHEIRCTNPVATECYGEVSTDNGGNHAGDNEP

SEQ ID NO: 138242 - protein, 34 aa, Artificial Sequence
  Description of Artificial Sequence: Synthetic polypeptide
DEEEIRTTNPVATEQYGSVADNMVITAMTQANAD

SEQ ID NO: 138243 - protein, 30 aa, Artificial Sequence
  Description of Artificial Sequence: Synthetic polypeptide
QENEIATTNPVATECYGDVSSECQLQHEEL

SEQ ID NO: 138244 - protein, 30 aa, Artificial Sequence
  Description of Artificial Sequence: Synthetic polypeptide
DDEEIASTNPVSTEGYGNVAANNIQRVGQQ

SEQ ID NO: 138245 - protein, 30 aa, Artificial Sequence
  Description of Artificial Sequence: Synthetic polypeptide
QENEIATTNPVATECYGDVSSECLQQHEEL

SEQ ID NO: 138246 - protein, 30 aa, Artificial Sequence
  Description of Artificial Sequence: Synthetic polypeptide
QENEIATTNPVATECYGDVSSECLQHEPEL

SEQ ID NO: 138247 - protein, 37 aa, Artificial Sequence
  Description of Artificial Sequence: Synthetic polypeptide
AEEEIRTTNPVATEQYGSVTVVVTTNLNQNEGEENEL

SEQ ID NO: 138248 - protein, 37 aa, Artificial Sequence
  Description of Artificial Sequence: Synthetic polypeptide
DEEEIRTTNPVATEQYGVVSTTNQNQQAGNNNNQQND

SEQ ID NO: 138249 - protein, 34 aa, Artificial Sequence
  Description of Artificial Sequence: Synthetic polypeptide
DAEEIATTNPVATEQWGSVTSATHLQTQGGEGFN

SEQ ID NO: 138250 - protein, 35 aa, Artificial Sequence
  Description of Artificial Sequence: Synthetic polypeptide
DEEEICTTNPVATECYGSVTTGNTGNQGGHGNNND

SEQ ID NO: 138251 - protein, 37 aa, Artificial Sequence
  Description of Artificial Sequence: Synthetic polypeptide
AEEEIRTTNPVATEQYGSVTVVVTNNLQQGNDEENED

SEQ ID NO: 138252 - protein, 37 aa, Artificial Sequence
  Description of Artificial Sequence: Synthetic polypeptide
DEEEIRTTNPVATEQYGVVSTVVSNNNLQQGTEEDED

SEQ ID NO: 138253 - protein, 30 aa, Artificial Sequence
  Description of Artificial Sequence: Synthetic polypeptide
QENEIATTNPVATECYGDVSQECLNQHEEL

SEQ ID NO: 138254 - protein, 37 aa, Artificial Sequence
  Description of Artificial Sequence: Synthetic polypeptide
DEEEIRTTNPVATEQYGSVAATNPDGPNMRNGMNTVD

SEQ ID NO: 138255 - protein, 35 aa, Artificial Sequence
  Description of Artificial Sequence: Synthetic polypeptide
DEEEICTTNPVATECYGVVSTGNEGNQGGHGNGND

SEQ ID NO: 138256 - protein, 29 aa, Artificial Sequence
  Description of Artificial Sequence: Synthetic peptide
QENEIATTNPVATECYGDVSRECTQHEEL

SEQ ID NO: 138257 - protein, 29 aa, Artificial Sequence
  Description of Artificial Sequence: Synthetic peptide
QENEIATTNPVATECYGDVSSECLHHEEL

SEQ ID NO: 138258 - protein, 30 aa, Artificial Sequence
  Description of Artificial Sequence: Synthetic polypeptide
QENEIATTNPVATECYGDVSSECLQHEEEL

SEQ ID NO: 138259 - protein, 31 aa, Artificial Sequence
  Description of Artificial Sequence: Synthetic polypeptide
DEMEIRTTNPVATEQYGCVCQTAHINFMSEQ

SEQ ID NO: 138260 - protein, 32 aa, Artificial Sequence
  Description of Artificial Sequence: Synthetic polypeptide
DEMEIRTTNPVATEQYGCVCQTALINFSSDQS

SEQ ID NO: 138261 - protein, 34 aa, Artificial Sequence
  Description of Artificial Sequence: Synthetic polypeptide
DEEEIRTTNPVATEQYGSVADPVGLIEPTPGQIE

SEQ ID NO: 138262 - protein, 37 aa, Artificial Sequence
  Description of Artificial Sequence: Synthetic polypeptide
DEEEIRTTNPVATEQYGVVSTVVSNNNNQQGTEENQD

SEQ ID NO: 138263 - protein, 30 aa, Artificial Sequence
  Description of Artificial Sequence: Synthetic polypeptide
QENEIATTNPVATECYGDVSVECLQHEELL

SEQ ID NO: 138264 - protein, 32 aa, Artificial Sequence
  Description of Artificial Sequence: Synthetic polypeptide
DDEEIASTNPVSTEGYGNVSTNPTIQMRNGQV

SEQ ID NO: 138265 - protein, 32 aa, Artificial Sequence
  Description of Artificial Sequence: Synthetic polypeptide
DDEEIASTNPVSTEGYGNVSTNPTIQMRVGQV

SEQ ID NO: 138266 - protein, 39 aa, Artificial Sequence
  Description of Artificial Sequence: Synthetic polypeptide
DEEEIRTTNPVATEQYGVVSTVVSTNLQQLGNNDEETET

SEQ ID NO: 138267 - protein, 39 aa, Artificial Sequence
  Description of Artificial Sequence: Synthetic polypeptide
DEEEIRTTNPVATEQYGVVSTVVSTNLQQLGNQDEEGTE

SEQ ID NO: 138268 - protein, 39 aa, Artificial Sequence
  Description of Artificial Sequence: Synthetic polypeptide
DEEEIRTTNPVATEQYGVVSTVVSTNLQQYGNNDEENED

SEQ ID NO: 138269 - protein, 36 aa, Artificial Sequence
  Description of Artificial Sequence: Synthetic polypeptide
DEEEIRTTNPVATEQYGSVGSWTPNVQPTQMVQEPL

SEQ ID NO: 138270 - protein, 36 aa, Artificial Sequence
  Description of Artificial Sequence: Synthetic polypeptide
DEEEIRTTNPVATEQYGSVGSWTPNVQPTQMVQSHD

SEQ ID NO: 138271 - protein, 32 aa, Artificial Sequence
  Description of Artificial Sequence: Synthetic polypeptide
DEHEIATTNPVAYGAHYGSVSTNLQNHDEMAM

SEQ ID NO: 138272 - protein, 34 aa, Artificial Sequence
  Description of Artificial Sequence: Synthetic polypeptide
DEHEIATTNPVGTEQYGSVPSCTTLSTSTGTNMV

SEQ ID NO: 138273 - protein, 30 aa, Artificial Sequence
  Description of Artificial Sequence: Synthetic polypeptide
QENEIATTNPVATECYGDVTSECLQGHEEL

SEQ ID NO: 138274 - protein, 29 aa, Artificial Sequence
  Description of Artificial Sequence: Synthetic peptide
QENEIATTNPVATECYGDVVQECLQHEEL

SEQ ID NO: 138275 - protein, 30 aa, Artificial Sequence
  Description of Artificial Sequence: Synthetic polypeptide
QENEIATTNPVATECYGDVVRSECLQHEEL

SEQ ID NO: 138276 - protein, 37 aa, Artificial Sequence
  Description of Artificial Sequence: Synthetic polypeptide
DEEEIRTTNPVATEQYGVVSTTNNQQQQQQGTNVATE

SEQ ID NO: 138277 - protein, 38 aa, Artificial Sequence
  Description of Artificial Sequence: Synthetic polypeptide
DEEEIRTTNPVATEQYGVVSTVVSTNNQQGNNEEDEDE

SEQ ID NO: 138278 - protein, 31 aa, Artificial Sequence
  Description of Artificial Sequence: Synthetic polypeptide
DEHEIATTNPVAYEQYGVCSTIDQHHQKGDN

SEQ ID NO: 138279 - protein, 30 aa, Artificial Sequence
  Description of Artificial Sequence: Synthetic polypeptide
QENEIATTNPVATECYGDVVSECLQHESEL

SEQ ID NO: 138280 - protein, 34 aa, Artificial Sequence
  Description of Artificial Sequence: Synthetic polypeptide
DEMEIRTTNPVATEQYGCVCSTGEHQFFNSDFQS

SEQ ID NO: 138281 - protein, 37 aa, Artificial Sequence
  Description of Artificial Sequence: Synthetic polypeptide
AEEEIRTTNPVATEQYGSVTVVVTNNLQGNNGEENEL

SEQ ID NO: 138282 - protein, 36 aa, Artificial Sequence
  Description of Artificial Sequence: Synthetic polypeptide
DEEEIRTTNPVATEQYGSVGSWTPNVQPTQMVDEFD

SEQ ID NO: 138283 - protein, 28 aa, Artificial Sequence
  Description of Artificial Sequence: Synthetic peptide
QEEEIATVNPVCTEQYGEAPEVCQSENK

SEQ ID NO: 138284 - protein, 34 aa, Artificial Sequence
  Description of Artificial Sequence: Synthetic polypeptide
DEHEICTTNPVATEQYGEVSTGGPLQDHQGGGMG

SEQ ID NO: 138285 - protein, 38 aa, Artificial Sequence
  Description of Artificial Sequence: Synthetic polypeptide
DEEEIRTTNPVATEQYGVVSTTNQLQAGTEQGTEQGNQ

SEQ ID NO: 138286 - protein, 35 aa, Artificial Sequence
  Description of Artificial Sequence: Synthetic polypeptide
DEHEICTTNPVATECYGVVSTGNPMNQGDRGGNES

SEQ ID NO: 138287 - protein, 30 aa, Artificial Sequence
  Description of Artificial Sequence: Synthetic polypeptide
QENEIATTNPVATECYGDVSVEMCLQHEEL

SEQ ID NO: 138288 - protein, 37 aa, Artificial Sequence
  Description of Artificial Sequence: Synthetic polypeptide
DEEEIRTTNPVATEQYGVVSTVVSNQQAGNNNDEDEE

SEQ ID NO: 138289 - protein, 34 aa, Artificial Sequence
  Description of Artificial Sequence: Synthetic polypeptide
DEHEICTTNPVATECYGSVSTGNGNTGGHGGDND

SEQ ID NO: 138290 - protein, 39 aa, Artificial Sequence
  Description of Artificial Sequence: Synthetic polypeptide
DEEEIRTTNPVATEQYGVVSTVVSTNLQQGNNQDEENED

SEQ ID NO: 138291 - protein, 35 aa, Artificial Sequence
  Description of Artificial Sequence: Synthetic polypeptide
DEHEICTTNPVATECYGSVSTGNEGNQGGHGQNND

SEQ ID NO: 138292 - protein, 33 aa, Artificial Sequence
  Description of Artificial Sequence: Synthetic polypeptide
DEEEICTTNPVATEQWGEVSTGGPDHGGQGGRE

SEQ ID NO: 138293 - protein, 29 aa, Artificial Sequence
  Description of Artificial Sequence: Synthetic peptide
QENEIATTNPVATECYGDVSWECRQHEEL

SEQ ID NO: 138294 - protein, 34 aa, Artificial Sequence
  Description of Artificial Sequence: Synthetic polypeptide
DEEEICTTNPVATEQWGEVSTGGQGDHGGQGRRE

SEQ ID NO: 138295 - protein, 34 aa, Artificial Sequence
  Description of Artificial Sequence: Synthetic polypeptide
DEHEIATTNPVGYEQYGISTVSCTTLSPRGTNEV

SEQ ID NO: 138296 - protein, 33 aa, Artificial Sequence
  Description of Artificial Sequence: Synthetic polypeptide
DEHEIATTNPVGYEAYGSTVSCTTLSPRGTNKV

SEQ ID NO: 138297 - protein, 36 aa, Artificial Sequence
  Description of Artificial Sequence: Synthetic polypeptide
DEEEIRTTNPVATEQYGSVGSWTPNVNQTQMVQVAT

SEQ ID NO: 138298 - protein, 35 aa, Artificial Sequence
  Description of Artificial Sequence: Synthetic polypeptide
DEEEICTTNPVATEQWGEVSTGGNPQDHQGGNTEE

SEQ ID NO: 138299 - protein, 37 aa, Artificial Sequence
  Description of Artificial Sequence: Synthetic polypeptide
DEEEIRTTNPVATEQYGVVSTTNQNQQNNNQQGTNED

SEQ ID NO: 138300 - protein, 35 aa, Artificial Sequence
  Description of Artificial Sequence: Synthetic polypeptide
DEHEIRTTNPCATECYGSVSTGLNGQERQQENGEQ

SEQ ID NO: 138301 - protein, 38 aa, Artificial Sequence
  Description of Artificial Sequence: Synthetic polypeptide
DEEEIRTTNPVATEQYGVVSTVVSNNLQQGNNQDESEQ

SEQ ID NO: 138302 - protein, 33 aa, Artificial Sequence
  Description of Artificial Sequence: Synthetic polypeptide
DEHEIRTTNPCATEIWGSVSTGNPDDRQNEGQE

SEQ ID NO: 138303 - protein, 35 aa, Artificial Sequence
  Description of Artificial Sequence: Synthetic polypeptide
DEEEIATTNPVATEQYGSACSANNDIPQDNMGENG

SEQ ID NO: 138304 - protein, 35 aa, Artificial Sequence
  Description of Artificial Sequence: Synthetic polypeptide
DEHEIRTTNPCATEIWGSVSTGNLDQDRQNEGDEQ

SEQ ID NO: 138305 - protein, 34 aa, Artificial Sequence
  Description of Artificial Sequence: Synthetic polypeptide
DEHEIRTTNPCATEIWGSVSTGNLDDRQNEGQGA

SEQ ID NO: 138306 - protein, 37 aa, Artificial Sequence
  Description of Artificial Sequence: Synthetic polypeptide
DEEEIRTTNPVATEQYGVVSTVVNTQQGTEDENEEED

SEQ ID NO: 138307 - protein, 30 aa, Artificial Sequence
  Description of Artificial Sequence: Synthetic polypeptide
QENEIATTNPVATECYGDVSKECLQHEEIL

SEQ ID NO: 138308 - protein, 35 aa, Artificial Sequence
  Description of Artificial Sequence: Synthetic polypeptide
DEEEIRTTNPVATEQYGSVAEPTGIILEPTIEEAR

SEQ ID NO: 138309 - protein, 37 aa, Artificial Sequence
  Description of Artificial Sequence: Synthetic polypeptide
AEEEIRTTNPVATEQYGSVTVVTTNLQQGNTNEENEM

SEQ ID NO: 138310 - protein, 37 aa, Artificial Sequence
  Description of Artificial Sequence: Synthetic polypeptide
DEEEIRTTNPVATEQYGSVAEPIGNMLQPPNTVNERR

SEQ ID NO: 138311 - protein, 36 aa, Artificial Sequence
  Description of Artificial Sequence: Synthetic polypeptide
DEHEIRTTNPCATEHYGSVSTGNGLPQDRQNEGQEA

SEQ ID NO: 138312 - protein, 34 aa, Artificial Sequence
  Description of Artificial Sequence: Synthetic polypeptide
DEHEIRTTNPCATEHWGSVSTNLNGNDGQPNGDM

SEQ ID NO: 138313 - protein, 38 aa, Artificial Sequence
  Description of Artificial Sequence: Synthetic polypeptide
DEEEIRTTNPVATEQYGVVSTTNQQLQQGTEQGTNQEQ

SEQ ID NO: 138314 - protein, 34 aa, Artificial Sequence
  Description of Artificial Sequence: Synthetic polypeptide
DEHEIRTTNPCATEEWGSVSTGNLDDRQNEGQEQ

SEQ ID NO: 138315 - protein, 35 aa, Artificial Sequence
  Description of Artificial Sequence: Synthetic polypeptide
DEEEIRTTNPVATEQYGSVAENLCNPLINNEENEI

SEQ ID NO: 138316 - protein, 30 aa, Artificial Sequence
  Description of Artificial Sequence: Synthetic polypeptide
QEEEICTTNPVATEQYGEAPEVCQQHEREK

SEQ ID NO: 138317 - protein, 29 aa, Artificial Sequence
  Description of Artificial Sequence: Synthetic peptide
QEEEICTTNPVATEQYGEAPEVCQHEEEK

SEQ ID NO: 138318 - protein, 34 aa, Artificial Sequence
  Description of Artificial Sequence: Synthetic polypeptide
DEHEIRTTNPCATENWGSVSTGNQQDRQNEGQES

SEQ ID NO: 138319 - protein, 35 aa, Artificial Sequence
  Description of Artificial Sequence: Synthetic polypeptide
DEEEICTTNPVATECYGSVTTGNEGNQGGHGNGNA

SEQ ID NO: 138320 - protein, 37 aa, Artificial Sequence
  Description of Artificial Sequence: Synthetic polypeptide
AEEEIRTTNPVATEQYGSVTVTVTTNNLNQIGTTNAD

SEQ ID NO: 138321 - protein, 37 aa, Artificial Sequence
  Description of Artificial Sequence: Synthetic polypeptide
DEEEIRTTNPVATEQYGVVSTTNQQQGNQQGTEQGED

SEQ ID NO: 138322 - protein, 33 aa, Artificial Sequence
  Description of Artificial Sequence: Synthetic polypeptide
DEMEIRTTNPVATEQYGCICSWNTQNFISDNQS

SEQ ID NO: 138323 - protein, 35 aa, Artificial Sequence
  Description of Artificial Sequence: Synthetic polypeptide
DEEEIRTTNPVATEQYGSVAESSTTEVPTHVPNDG

SEQ ID NO: 138324 - protein, 34 aa, Artificial Sequence
  Description of Artificial Sequence: Synthetic polypeptide
DEEEIRTTNPVATEQYGSVAESPTTEVPTTTPDF

SEQ ID NO: 138325 - protein, 34 aa, Artificial Sequence
  Description of Artificial Sequence: Synthetic polypeptide
DEEEIRTTNPVATEQYGSVAESPTTEVPTTPLDW

SEQ ID NO: 138326 - protein, 37 aa, Artificial Sequence
  Description of Artificial Sequence: Synthetic polypeptide
AEEEIRTTNPVATEQYGSVTVVTTNLQQGNIGEENEI

SEQ ID NO: 138327 - protein, 37 aa, Artificial Sequence
  Description of Artificial Sequence: Synthetic polypeptide
DEEEIRTTNPVATEQYGVVSTVVNTQAGNNEEEEEED

SEQ ID NO: 138328 - protein, 37 aa, Artificial Sequence
  Description of Artificial Sequence: Synthetic polypeptide
AEEEIRTTNPVATEQYGSVTVVTNNNQLQQGNDEEDD

SEQ ID NO: 138329 - protein, 37 aa, Artificial Sequence
  Description of Artificial Sequence: Synthetic polypeptide
AEEEIRTTNPVATEQYGSVTVVTTNLLQQGNNEEDEE

SEQ ID NO: 138330 - protein, 37 aa, Artificial Sequence
  Description of Artificial Sequence: Synthetic polypeptide
DEEEIRTTNPVATEQYGVVSTTNQQNTEQGTNEQGEE

SEQ ID NO: 138331 - protein, 35 aa, Artificial Sequence
  Description of Artificial Sequence: Synthetic polypeptide
DEEEIRTTNPVATEQYGSVAESATTEVPTTVPNDY

SEQ ID NO: 138332 - protein, 35 aa, Artificial Sequence
  Description of Artificial Sequence: Synthetic polypeptide
DEEEIRTTNPVATEQYGSVAEPTYVEEERGMVSVM

SEQ ID NO: 138333 - protein, 35 aa, Artificial Sequence
  Description of Artificial Sequence: Synthetic polypeptide
DEHEIRTTNPCATEPYGSVCFTNEDHTDQGGNNHR

SEQ ID NO: 138334 - protein, 37 aa, Artificial Sequence
  Description of Artificial Sequence: Synthetic polypeptide
DEEEIRTTNPVATEQYGVVSTTNQQQGNDEQGTTTTD

SEQ ID NO: 138335 - protein, 30 aa, Artificial Sequence
  Description of Artificial Sequence: Synthetic polypeptide
QENEIATTNPVATECYGDVVSVCNLSHEEL

SEQ ID NO: 138336 - protein, 30 aa, Artificial Sequence
  Description of Artificial Sequence: Synthetic polypeptide
QENEIATTNPVATECYGDVSMECLQQHEEL

SEQ ID NO: 138337 - protein, 30 aa, Artificial Sequence
  Description of Artificial Sequence: Synthetic polypeptide
QENEIATTNPVATECYGDVSNACLQEHEEL

SEQ ID NO: 138338 - protein, 36 aa, Artificial Sequence
  Description of Artificial Sequence: Synthetic polypeptide
DEEEIRTTNPVATEQYGVVSTTNQQGNQATTNVATE

SEQ ID NO: 138339 - protein, 38 aa, Artificial Sequence
  Description of Artificial Sequence: Synthetic polypeptide
DEEEIRTTNPVATEQYGVVSTVVSNLQAGTENGNQEDD

SEQ ID NO: 138340 - protein, 30 aa, Artificial Sequence
  Description of Artificial Sequence: Synthetic polypeptide
QENEIATTNPVATECYGDVSNECLQHEELE

SEQ ID NO: 138341 - protein, 36 aa, Artificial Sequence
  Description of Artificial Sequence: Synthetic polypeptide
AEEEIRTTNPVATEQYGSVTVVVTNLQQNEEEENEL

SEQ ID NO: 138342 - protein, 37 aa, Artificial Sequence
  Description of Artificial Sequence: Synthetic polypeptide
DEEEIRTTNPVATEQYGVVSTTNQQAGNQQGNNEENQ

SEQ ID NO: 138343 - protein, 35 aa, Artificial Sequence
  Description of Artificial Sequence: Synthetic polypeptide
DEHEIRTTNPCATECYGSVSTGNLDDDRQNEGGEM

SEQ ID NO: 138344 - protein, 37 aa, Artificial Sequence
  Description of Artificial Sequence: Synthetic polypeptide
DEEEIRTTNPVATEQYGVVSTVVSNLQAGSEEGSTVQ

SEQ ID NO: 138345 - protein, 34 aa, Artificial Sequence
  Description of Artificial Sequence: Synthetic polypeptide
DEMEIRTTNPVATEQYGCTCSTTNHNQNFGSDQS

SEQ ID NO: 138346 - protein, 34 aa, Artificial Sequence
  Description of Artificial Sequence: Synthetic polypeptide
DEHEIRTTNPCATECYGSVSTGNEAGNAGENGAE

SEQ ID NO: 138347 - protein, 34 aa, Artificial Sequence
  Description of Artificial Sequence: Synthetic polypeptide
DEHEIRTTNPCATECYGSVSTGNDRNERQNENNE

SEQ ID NO: 138348 - protein, 30 aa, Artificial Sequence
  Description of Artificial Sequence: Synthetic polypeptide
QENEIATTNPVATECYGDVSNECLQHEELG

SEQ ID NO: 138349 - protein, 33 aa, Artificial Sequence
  Description of Artificial Sequence: Synthetic polypeptide
DEMEIRTTNPVATEQYGCTCSWGNHQHFGSDQS

SEQ ID NO: 138350 - protein, 38 aa, Artificial Sequence
  Description of Artificial Sequence: Synthetic polypeptide
DEEEIRTTNPVATEQYGVVSTVVSNLQQLGNNDEQGED

SEQ ID NO: 138351 - protein, 38 aa, Artificial Sequence
  Description of Artificial Sequence: Synthetic polypeptide
DEEEIRTTNPVATEQYGVVSTVVSNLQQNTEQGTNQEQ

SEQ ID NO: 138352 - protein, 37 aa, Artificial Sequence
  Description of Artificial Sequence: Synthetic polypeptide
DEEEIRTTNPVATEQYGVVSTVVSNLQQGTEAGEEEE

SEQ ID NO: 138353 - protein, 37 aa, Artificial Sequence
  Description of Artificial Sequence: Synthetic polypeptide
AEEEIRTTNPVATEQYGSVTVVTTNLQQGTNNEENEL

SEQ ID NO: 138354 - protein, 37 aa, Artificial Sequence
  Description of Artificial Sequence: Synthetic polypeptide
AEEEIRTTNPVATEQYGSVTVVVTNLQQGNQGEEEEE

SEQ ID NO: 138355 - protein, 38 aa, Artificial Sequence
  Description of Artificial Sequence: Synthetic polypeptide
DEEEIRTTNPVATEQYGVVSTVVSNLQAGNSEYGSVPE

SEQ ID NO: 138356 - protein, 37 aa, Artificial Sequence
  Description of Artificial Sequence: Synthetic polypeptide
AEEEIRTTNPVATEQYGSVTVVTTNNLQQGNNEENED

SEQ ID NO: 138357 - protein, 35 aa, Artificial Sequence
  Description of Artificial Sequence: Synthetic polypeptide
DEEEICTTNPVATECYGSVTTGNQGNQGGHGGGNG

SEQ ID NO: 138358 - protein, 37 aa, Artificial Sequence
  Description of Artificial Sequence: Synthetic polypeptide
AEEEIRTTNPVATEQYGSVTVVTVNLQQGNNGEENEQ

SEQ ID NO: 138359 - protein, 35 aa, Artificial Sequence
  Description of Artificial Sequence: Synthetic polypeptide
DEEEICTTNPVATECYGSVTTGNQGNQGGHGGNNH

SEQ ID NO: 138360 - protein, 35 aa, Artificial Sequence
  Description of Artificial Sequence: Synthetic polypeptide
DEEEIRTTNPVATEQYGSVAEESPTTEVRTTPPMV

SEQ ID NO: 138361 - protein, 30 aa, Artificial Sequence
  Description of Artificial Sequence: Synthetic polypeptide
DDEEIASTNPVSTEGYGNVAADNIQRVGQQ

SEQ ID NO: 138362 - protein, 37 aa, Artificial Sequence
  Description of Artificial Sequence: Synthetic polypeptide
AEEEIRTTNPVATEQYGSVTVVVTNLQQGNIGEENED

SEQ ID NO: 138363 - protein, 37 aa, Artificial Sequence
  Description of Artificial Sequence: Synthetic polypeptide
AEEEIRTTNPVATEQYGSVTVVVTNLQQGNGNEENED

SEQ ID NO: 138364 - protein, 38 aa, Artificial Sequence
  Description of Artificial Sequence: Synthetic polypeptide
DEEEIRTTNPVATEQYGVVSTVVSNLEQGNNNDEQGND

SEQ ID NO: 138365 - protein, 37 aa, Artificial Sequence
  Description of Artificial Sequence: Synthetic polypeptide
AEEEIRTTNPVATEQYGSVTVVVTNLQQGNGTEENEE

SEQ ID NO: 138366 - protein, 38 aa, Artificial Sequence
  Description of Artificial Sequence: Synthetic polypeptide
DEEEIRTTNPVATEQYGVVSTVVSNLQAGNSEGGSVNQ

SEQ ID NO: 138367 - protein, 35 aa, Artificial Sequence
  Description of Artificial Sequence: Synthetic polypeptide
DEHEIRTTNPCATECYGSVSTGNQGQERQNMNGEQ

SEQ ID NO: 138368 - protein, 38 aa, Artificial Sequence
  Description of Artificial Sequence: Synthetic polypeptide
DEEEIRTTNPVATEQYGVVSTTNQQLQNGTEQGNNQTE

SEQ ID NO: 138369 - protein, 35 aa, Artificial Sequence
  Description of Artificial Sequence: Synthetic polypeptide
DEHEIRTTNPCATECYGSVSTGNQGQERQNENMES

SEQ ID NO: 138370 - protein, 33 aa, Artificial Sequence
  Description of Artificial Sequence: Synthetic polypeptide
DEMEIRTTNPVATEQYGCTCSTGEPQHFGSDQS

SEQ ID NO: 138371 - protein, 36 aa, Artificial Sequence
  Description of Artificial Sequence: Synthetic polypeptide
DEEEIRTTNPVATEQYGSVAETPNVGAMLGFEGSEQ

SEQ ID NO: 138372 - protein, 30 aa, Artificial Sequence
  Description of Artificial Sequence: Synthetic polypeptide
QENEIATTNPVATECYGDVWSECLQHEEGL

SEQ ID NO: 138373 - protein, 30 aa, Artificial Sequence
  Description of Artificial Sequence: Synthetic polypeptide
QENEIATTNPVATECYGDVWSECLQHEEGV

SEQ ID NO: 138374 - protein, 28 aa, Artificial Sequence
  Description of Artificial Sequence: Synthetic peptide
QEEEIATTNPVAYEQYGVAYEVCQHEEC

SEQ ID NO: 138375 - protein, 35 aa, Artificial Sequence
  Description of Artificial Sequence: Synthetic polypeptide
AEEEIRTTNPVATEQYGSVVTNTNDESGTVNNDTT

SEQ ID NO: 138376 - protein, 33 aa, Artificial Sequence
  Description of Artificial Sequence: Synthetic polypeptide
DEHEIATTNPVAYEQWGSVTGMNDQDERNGNAI

SEQ ID NO: 138377 - protein, 33 aa, Artificial Sequence
  Description of Artificial Sequence: Synthetic polypeptide
DEEEICTTNPVAYEQWGEVATNDGNQGQRGQET

SEQ ID NO: 138378 - protein, 33 aa, Artificial Sequence
  Description of Artificial Sequence: Synthetic polypeptide
DEEEIRTTNPVATEQYGSVGWPFGDQAPMEEQE

SEQ ID NO: 138379 - protein, 34 aa, Artificial Sequence
  Description of Artificial Sequence: Synthetic polypeptide
DEEEIATTNPVATEQYGSACAATANDQDLPGGEN

SEQ ID NO: 138380 - protein, 35 aa, Artificial Sequence
  Description of Artificial Sequence: Synthetic polypeptide
DEEEIATTNPVATEQYGSACAATANDQDMPGENAN

SEQ ID NO: 138381 - protein, 34 aa, Artificial Sequence
  Description of Artificial Sequence: Synthetic polypeptide
DEEEIRTTNPVATEQYGSVGVNGHVVREDVVPDN

SEQ ID NO: 138382 - protein, 28 aa, Artificial Sequence
  Description of Artificial Sequence: Synthetic peptide
QEEEIATTNPVGTEQYGEAASVCQHEDI

SEQ ID NO: 138383 - protein, 33 aa, Artificial Sequence
  Description of Artificial Sequence: Synthetic polypeptide
DEEEICTTNPVAYEQWGEVATNDGNQGQAGNEP

SEQ ID NO: 138384 - protein, 29 aa, Artificial Sequence
  Description of Artificial Sequence: Synthetic peptide
QENEIATTNPVATECYGRVSECLHSHEEL

SEQ ID NO: 138385 - protein, 28 aa, Artificial Sequence
  Description of Artificial Sequence: Synthetic peptide
QEEEIATTNPVGTEQYGEAPEVCQHEEK

SEQ ID NO: 138386 - protein, 35 aa, Artificial Sequence
  Description of Artificial Sequence: Synthetic polypeptide
DEEEIRTTNPVATEQYGSVGVMMMEEPQIGTNEGL

SEQ ID NO: 138387 - protein, 34 aa, Artificial Sequence
  Description of Artificial Sequence: Synthetic polypeptide
DEMEIRTTNPVATEQYGCVSTLLLTQFNSLQDDE

SEQ ID NO: 138388 - protein, 35 aa, Artificial Sequence
  Description of Artificial Sequence: Synthetic polypeptide
DEMEIRTTNPVATEQYGCVSTLLLTQFNGLQDITP

SEQ ID NO: 138389 - protein, 34 aa, Artificial Sequence
  Description of Artificial Sequence: Synthetic polypeptide
DEEEICTTNPVAYEQWGEVATGGNLQDHQGGNEP

SEQ ID NO: 138390 - protein, 34 aa, Artificial Sequence
  Description of Artificial Sequence: Synthetic polypeptide
DEEEICTTNPVAYEQWGEVATENDGNQGQRGNAT

SEQ ID NO: 138391 - protein, 30 aa, Artificial Sequence
  Description of Artificial Sequence: Synthetic polypeptide
QENEIATTNPVATECYGNVHSEICLQHEEL

SEQ ID NO: 138392 - protein, 31 aa, Artificial Sequence
  Description of Artificial Sequence: Synthetic polypeptide
QENEIATTNPVATECYGNVSAECLQSRVEEL

SEQ ID NO: 138393 - protein, 33 aa, Artificial Sequence
  Description of Artificial Sequence: Synthetic polypeptide
DEEEIATTNPVATEQYGSACAATGEEPAGEQNN

SEQ ID NO: 138394 - protein, 28 aa, Artificial Sequence
  Description of Artificial Sequence: Synthetic peptide
QEEEIATTNPVGTEQYGEMAEVCQHEEK

SEQ ID NO: 138395 - protein, 30 aa, Artificial Sequence
  Description of Artificial Sequence: Synthetic polypeptide
QENEIATTNPVATECYGNVSAHLQDSEEAH

SEQ ID NO: 138396 - protein, 30 aa, Artificial Sequence
  Description of Artificial Sequence: Synthetic polypeptide
QENEIATTNPVATECYGNVSANCIQSHEQL

SEQ ID NO: 138397 - protein, 37 aa, Artificial Sequence
  Description of Artificial Sequence: Synthetic polypeptide
AEEEIRTTNPVATEQYGSVVTNTNNLQQGNNQQGNTD

SEQ ID NO: 138398 - protein, 35 aa, Artificial Sequence
  Description of Artificial Sequence: Synthetic polypeptide
DEEEIRTTNPVATEQYGSVGVCLRASSNNGGNNET

SEQ ID NO: 138399 - protein, 34 aa, Artificial Sequence
  Description of Artificial Sequence: Synthetic polypeptide
DEMEIRTTNPVATEQYGCVSTLDVTQFNGLQDFE

SEQ ID NO: 138400 - protein, 37 aa, Artificial Sequence
  Description of Artificial Sequence: Synthetic polypeptide
DEEEIRTTNPVATEQYGVVSTTNNNQQGNNNEQGTNE

SEQ ID NO: 138401 - protein, 37 aa, Artificial Sequence
  Description of Artificial Sequence: Synthetic polypeptide
DEEEIRTTNPVATEQYGVVSTTNNNQNQQQGNNTNVE

SEQ ID NO: 138402 - protein, 35 aa, Artificial Sequence
  Description of Artificial Sequence: Synthetic polypeptide
DEMEIRTTNPVATEQYGCVSTLLLTEFNGLQDAEI

SEQ ID NO: 138403 - protein, 29 aa, Artificial Sequence
  Description of Artificial Sequence: Synthetic peptide
QENEIATTNPVATECYGQAVSVVLAHEEL

SEQ ID NO: 138404 - protein, 37 aa, Artificial Sequence
  Description of Artificial Sequence: Synthetic polypeptide
DEEEIRTTNPVATEQYGVVSTTNNNQNQQIGNNAGTD

SEQ ID NO: 138405 - protein, 37 aa, Artificial Sequence
  Description of Artificial Sequence: Synthetic polypeptide
DEEEIRTTNPVATEQYGVVSTTNNNQQGNNQEQNGTD

SEQ ID NO: 138406 - protein, 30 aa, Artificial Sequence
  Description of Artificial Sequence: Synthetic polypeptide
QENEIATTNPVATECYGSGVPECLQHEHEM

SEQ ID NO: 138407 - protein, 33 aa, Artificial Sequence
  Description of Artificial Sequence: Synthetic polypeptide
QEEEIATTNPVAYEQYGSVATNLVATPADNKAE

SEQ ID NO: 138408 - protein, 34 aa, Artificial Sequence
  Description of Artificial Sequence: Synthetic polypeptide
DEEEICTTNPVAYEQWGEVSTGGLQDHQGGNTGI

SEQ ID NO: 138409 - protein, 38 aa, Artificial Sequence
  Description of Artificial Sequence: Synthetic polypeptide
DEEEIRTTNPVATEQYGVVSTTNLQSGVNTEQGTTQDD

SEQ ID NO: 138410 - protein, 35 aa, Artificial Sequence
  Description of Artificial Sequence: Synthetic polypeptide
DEHEIATTNPVAYEQWGSVSKNNEQLQERSGDNNT

SEQ ID NO: 138411 - protein, 35 aa, Artificial Sequence
  Description of Artificial Sequence: Synthetic polypeptide
DEHEIATTNPVAYEQWGSVSKNDEQLQERPGDNDA

SEQ ID NO: 138412 - protein, 38 aa, Artificial Sequence
  Description of Artificial Sequence: Synthetic polypeptide
DEEEIRTTNPVATEQYGVVSTTNLQSGSNTEQGSTEDD

SEQ ID NO: 138413 - protein, 35 aa, Artificial Sequence
  Description of Artificial Sequence: Synthetic polypeptide
AEEEIRTTNPVATEQYGSVSTVVNQQEQTETEDEA

SEQ ID NO: 138414 - protein, 29 aa, Artificial Sequence
  Description of Artificial Sequence: Synthetic peptide
QEEEIATTNPVAYEQYGEAYEWCQHGEEK

SEQ ID NO: 138415 - protein, 35 aa, Artificial Sequence
  Description of Artificial Sequence: Synthetic polypeptide
AEEEIRTTNPVATEQYGSVSTVVNQQGTTEDTEDE

SEQ ID NO: 138416 - protein, 33 aa, Artificial Sequence
  Description of Artificial Sequence: Synthetic polypeptide
DEHEIATTNPVAYEQWGSVSHPLDDRQNMGNNE

SEQ ID NO: 138417 - protein, 38 aa, Artificial Sequence
  Description of Artificial Sequence: Synthetic polypeptide
DEEEIRTTNPVATEQYGVVSTTNLQQSGNTEQGSTQDT

SEQ ID NO: 138418 - protein, 38 aa, Artificial Sequence
  Description of Artificial Sequence: Synthetic polypeptide
DEEEIRTTNPVATEQYGVVSTTNLQQQQGTEQGTTNED

SEQ ID NO: 138419 - protein, 32 aa, Artificial Sequence
  Description of Artificial Sequence: Synthetic polypeptide
DEHEIATTNPVAYEQWGSVSGGNGNKGEGNTS

SEQ ID NO: 138420 - protein, 33 aa, Artificial Sequence
  Description of Artificial Sequence: Synthetic polypeptide
DEHEIATTNPVAYEQWGSVSGDNPGGQQNGGAR

SEQ ID NO: 138421 - protein, 37 aa, Artificial Sequence
  Description of Artificial Sequence: Synthetic polypeptide
DEEEIRTTNPVATEQYGVVSTTNLQQQNQATTNVATE

SEQ ID NO: 138422 - protein, 32 aa, Artificial Sequence
  Description of Artificial Sequence: Synthetic polypeptide
DEHEIATTNPVAYEQWGSVSGDNGGQHNGGAV

SEQ ID NO: 138423 - protein, 31 aa, Artificial Sequence
  Description of Artificial Sequence: Synthetic polypeptide
QENEIATTNPVATECYGSVSEPAGNMHEMNL

SEQ ID NO: 138424 - protein, 33 aa, Artificial Sequence
  Description of Artificial Sequence: Synthetic polypeptide
DEEEICTTNPVAYEAYGVVSCMNSLSQVDGGEF

SEQ ID NO: 138425 - protein, 35 aa, Artificial Sequence
  Description of Artificial Sequence: Synthetic polypeptide
DEHEIATTNPVAYEQWGSVSKTDEQLQERQGGNAM

SEQ ID NO: 138426 - protein, 33 aa, Artificial Sequence
  Description of Artificial Sequence: Synthetic polypeptide
DEEEICTTNPVAYEQWGSVTGPNNDQGNMGGQR

SEQ ID NO: 138427 - protein, 34 aa, Artificial Sequence
  Description of Artificial Sequence: Synthetic polypeptide
DEEEICTTNPVAYEQWGEVSTNDGNQGQAGGDAR

SEQ ID NO: 138428 - protein, 33 aa, Artificial Sequence
  Description of Artificial Sequence: Synthetic polypeptide
DEHEIATTNPVAYEQWGSVSTVGPGQGNMGNGH

SEQ ID NO: 138429 - protein, 34 aa, Artificial Sequence
  Description of Artificial Sequence: Synthetic polypeptide
DAEEIATTNPVATEQWGAVTSTNHLQTEGGPTED

SEQ ID NO: 138430 - protein, 34 aa, Artificial Sequence
  Description of Artificial Sequence: Synthetic polypeptide
DAEEIATTNPVATEQWGAVTSTNHLQTEGGDTDD

SEQ ID NO: 138431 - protein, 39 aa, Artificial Sequence
  Description of Artificial Sequence: Synthetic polypeptide
DEEEIRTTNPVATEQYGVVSTVVSTTNLQAGNQDEEDED

SEQ ID NO: 138432 - protein, 34 aa, Artificial Sequence
  Description of Artificial Sequence: Synthetic polypeptide
DEEEIRTTNPVATEQYGSVHENLNGIVLFELTTT

SEQ ID NO: 138433 - protein, 30 aa, Artificial Sequence
  Description of Artificial Sequence: Synthetic polypeptide
QEEEIATTNPVAYEQYGEIPEVQQHEGENK

SEQ ID NO: 138434 - protein, 38 aa, Artificial Sequence
  Description of Artificial Sequence: Synthetic polypeptide
DEEEIRTTNPVATEQYGVVSTVVSTTNLQNQINTEQGS

SEQ ID NO: 138435 - protein, 38 aa, Artificial Sequence
  Description of Artificial Sequence: Synthetic polypeptide
DEEEIRTTNPVATEQYGVVSTVVSTTNLQQQGTTEQGS

SEQ ID NO: 138436 - protein, 39 aa, Artificial Sequence
  Description of Artificial Sequence: Synthetic polypeptide
DEEEIRTTNPVATEQYGVVSTVVSTTNLQSGNNNQQQED

SEQ ID NO: 138437 - protein, 37 aa, Artificial Sequence
  Description of Artificial Sequence: Synthetic polypeptide
DEEEIRTTNPVATEQYGSTVPSTTPAGPNARTGGNPV

SEQ ID NO: 138438 - protein, 38 aa, Artificial Sequence
  Description of Artificial Sequence: Synthetic polypeptide
DEEEIRTTNPVATEQYGVVSTTNLSSGNNNQQGTNPTE

SEQ ID NO: 138439 - protein, 33 aa, Artificial Sequence
  Description of Artificial Sequence: Synthetic polypeptide
QEEEIATTNPVAYEQYGSVAATNLDADPGGEHH

SEQ ID NO: 138440 - protein, 31 aa, Artificial Sequence
  Description of Artificial Sequence: Synthetic polypeptide
QENEIATTNPVATECYGSVSEDLEDHEGEDL

SEQ ID NO: 138441 - protein, 36 aa, Artificial Sequence
  Description of Artificial Sequence: Synthetic polypeptide
DEEEIRTTNPVATEQYGSVHENSLLIQTETLENEDS

SEQ ID NO: 138442 - protein, 28 aa, Artificial Sequence
  Description of Artificial Sequence: Synthetic peptide
QEEEIATTNPVSTEPYGEASEVCQHEEH

SEQ ID NO: 138443 - protein, 29 aa, Artificial Sequence
  Description of Artificial Sequence: Synthetic peptide
QEEEIATTNPVSTEPYGEASMDIQHNGEH

SEQ ID NO: 138444 - protein, 33 aa, Artificial Sequence
  Description of Artificial Sequence: Synthetic polypeptide
DEEEICTTNPVAYEAYGHVSCQNSLSQFSGGEF

SEQ ID NO: 138445 - protein, 31 aa, Artificial Sequence
  Description of Artificial Sequence: Synthetic polypeptide
DEHEIATTNPVAYEQYGSVCMAGTQALQVDD

SEQ ID NO: 138446 - protein, 28 aa, Artificial Sequence
  Description of Artificial Sequence: Synthetic peptide
QENEIATTNPVATECYGEVPEVCQHEEK

SEQ ID NO: 138447 - protein, 36 aa, Artificial Sequence
  Description of Artificial Sequence: Synthetic polypeptide
DEEEIRTTNPVATEQYGSTWSTTPAGPNMRNGMNYV

SEQ ID NO: 138448 - protein, 34 aa, Artificial Sequence
  Description of Artificial Sequence: Synthetic polypeptide
DEEEICTTNPVATEQYGSVRCTEESSNTSGNNED

SEQ ID NO: 138449 - protein, 37 aa, Artificial Sequence
  Description of Artificial Sequence: Synthetic polypeptide
DEEEIRTTNPVATEQYGVVSTTNNQQGNNQQGTTTDD

SEQ ID NO: 138450 - protein, 33 aa, Artificial Sequence
  Description of Artificial Sequence: Synthetic polypeptide
DEHEIATTNPVAYEQYGSTVATNGQPQDPNENQ

SEQ ID NO: 138451 - protein, 33 aa, Artificial Sequence
  Description of Artificial Sequence: Synthetic polypeptide
QEEEIATTNPVSTEQYGIVSTAGPNMRNGMTPR

SEQ ID NO: 138452 - protein, 30 aa, Artificial Sequence
  Description of Artificial Sequence: Synthetic polypeptide
QENEIATTNPVATECYGGVSDEFLQTHEEM

SEQ ID NO: 138453 - protein, 34 aa, Artificial Sequence
  Description of Artificial Sequence: Synthetic polypeptide
DEMEIRTTNPVATEQYGCVMWTVNHMEENNQDGN

SEQ ID NO: 138454 - protein, 36 aa, Artificial Sequence
  Description of Artificial Sequence: Synthetic polypeptide
DEEEICTTNPVATEQYGSVSSTTPAGPNMRNGMNPV

SEQ ID NO: 138455 - protein, 35 aa, Artificial Sequence
  Description of Artificial Sequence: Synthetic polypeptide
DEEEIATTNPVATEQYGSACATNPLQDDPGDGQDI

SEQ ID NO: 138456 - protein, 35 aa, Artificial Sequence
  Description of Artificial Sequence: Synthetic polypeptide
DEMEIRTTNPVATEQYGCVSALLLTQFNGLQDAEF

SEQ ID NO: 138457 - protein, 35 aa, Artificial Sequence
  Description of Artificial Sequence: Synthetic polypeptide
DEEEIATTNPVATEQYGSACATNPLAEAEIGNGNF

SEQ ID NO: 138458 - protein, 33 aa, Artificial Sequence
  Description of Artificial Sequence: Synthetic polypeptide
DEEEIATTNPVATEQYGSACATGLAPGEQMEGA

SEQ ID NO: 138459 - protein, 30 aa, Artificial Sequence
  Description of Artificial Sequence: Synthetic polypeptide
QENEIATTNPVATECYGGVSECSLQHSEEM

SEQ ID NO: 138460 - protein, 29 aa, Artificial Sequence
  Description of Artificial Sequence: Synthetic peptide
QEEEIATTNPVSTEQYGEAPMVIQQHENK

SEQ ID NO: 138461 - protein, 35 aa, Artificial Sequence
  Description of Artificial Sequence: Synthetic polypeptide
DEEEIRTTNPVATEQYGSTYMTENGLSMYTIEPNM

SEQ ID NO: 138462 - protein, 33 aa, Artificial Sequence
  Description of Artificial Sequence: Synthetic polypeptide
DEHEIATTNPVAYEQYGSVSAANNLTASGGDED

SEQ ID NO: 138463 - protein, 29 aa, Artificial Sequence
  Description of Artificial Sequence: Synthetic peptide
QENEIATTNPVATECYGDVYMECLQHEEL

SEQ ID NO: 138464 - protein, 29 aa, Artificial Sequence
  Description of Artificial Sequence: Synthetic peptide
QENEIATTNPVATECYGDVYQECLQHEEL

SEQ ID NO: 138465 - protein, 30 aa, Artificial Sequence
  Description of Artificial Sequence: Synthetic polypeptide
QENEIATTNPVATECYGDVYSECLQHFEEL

SEQ ID NO: 138466 - protein, 28 aa, Artificial Sequence
  Description of Artificial Sequence: Synthetic peptide
QEEEIATVNPVATEQYGEAPEWCQHEEK

SEQ ID NO: 138467 - protein, 36 aa, Artificial Sequence
  Description of Artificial Sequence: Synthetic polypeptide
DEEEIRTTNPVATEQYGVVSTTNNQQGTEQGTEDEE

SEQ ID NO: 138468 - protein, 28 aa, Artificial Sequence
  Description of Artificial Sequence: Synthetic peptide
QEEEIATVNPVATEQYGEAPEVCQNEEK

SEQ ID NO: 138469 - protein, 28 aa, Artificial Sequence
  Description of Artificial Sequence: Synthetic peptide
QENEIATTNPVATECYGEVPECCQHEEL

SEQ ID NO: 138470 - protein, 33 aa, Artificial Sequence
  Description of Artificial Sequence: Synthetic polypeptide
DEMEIRTTNPVATEQYGCVCSWGEHQNFGSEQG

SEQ ID NO: 138471 - protein, 36 aa, Artificial Sequence
  Description of Artificial Sequence: Synthetic polypeptide
AEEEIRTTNPVATEQYGSVSTVVNQQQNQATNNANE

SEQ ID NO: 138472 - protein, 37 aa, Artificial Sequence
  Description of Artificial Sequence: Synthetic polypeptide
DEEEIRTTNPVATEQYGVVSTVVSTNQQAGTTETGSE

SEQ ID NO: 138473 - protein, 34 aa, Artificial Sequence
  Description of Artificial Sequence: Synthetic polypeptide
DEHEIATTNPVAYEQYGSVSATDNLPQNHDITDS

SEQ ID NO: 138474 - protein, 34 aa, Artificial Sequence
  Description of Artificial Sequence: Synthetic polypeptide
DEEEIRTTNPVATEQYGSVAAGVPDDGMNPSNPE

SEQ ID NO: 138475 - protein, 30 aa, Artificial Sequence
  Description of Artificial Sequence: Synthetic polypeptide
QEEEIATTNPVSTEQYGTIPMEDIQQHGNK

SEQ ID NO: 138476 - protein, 28 aa, Artificial Sequence
  Description of Artificial Sequence: Synthetic peptide
QENEIATTNPVATECYGEASEVCQHEEL

SEQ ID NO: 138477 - protein, 28 aa, Artificial Sequence
  Description of Artificial Sequence: Synthetic peptide
QEEEIATVNPVATEQYGEAPEVCQHEEK

SEQ ID NO: 138478 - protein, 38 aa, Artificial Sequence
  Description of Artificial Sequence: Synthetic polypeptide
DEEEIRTTNPVATEQYGVVSTTNNQQQQLQQGTNNQDD

SEQ ID NO: 138479 - protein, 33 aa, Artificial Sequence
  Description of Artificial Sequence: Synthetic polypeptide
DEEEICTTNPVATESWGSVSTGGNTGNADGMTD

SEQ ID NO: 138480 - protein, 34 aa, Artificial Sequence
  Description of Artificial Sequence: Synthetic polypeptide
DEMEIRTTNPVATEQYGCVSCSQPLQDRSQEEKN

SEQ ID NO: 138481 - protein, 37 aa, Artificial Sequence
  Description of Artificial Sequence: Synthetic polypeptide
DEEEIRTTNPVATEQYGSTVSSTTPAGPNMRNGMNPV

SEQ ID NO: 138482 - protein, 28 aa, Artificial Sequence
  Description of Artificial Sequence: Synthetic peptide
QEEEIATTNPVSTEQYGEAPEVCQHEEK

SEQ ID NO: 138483 - protein, 28 aa, Artificial Sequence
  Description of Artificial Sequence: Synthetic peptide
QEEEIATTNPVSTEQYGEAPETIQHEEK

SEQ ID NO: 138484 - protein, 28 aa, Artificial Sequence
  Description of Artificial Sequence: Synthetic peptide
QEEEIATTNPVSTEQYGEAPEQCQHEEK

SEQ ID NO: 138485 - protein, 34 aa, Artificial Sequence
  Description of Artificial Sequence: Synthetic polypeptide
DEMEIRTTNPVATEQYGCVSPLDLTQFNGTQDAI

SEQ ID NO: 138486 - protein, 33 aa, Artificial Sequence
  Description of Artificial Sequence: Synthetic polypeptide
DEHEIATTNPVAYEQWGTVSSTNTGQNGEANDP

SEQ ID NO: 138487 - protein, 33 aa, Artificial Sequence
  Description of Artificial Sequence: Synthetic polypeptide
DEMEIRTTNPVATEQYGCVSNEVELDFGDEGSQ

SEQ ID NO: 138488 - protein, 37 aa, Artificial Sequence
  Description of Artificial Sequence: Synthetic polypeptide
DEEEIRTTNPVATEQYGSTVSSTTPAGPNMRKGMNPV

SEQ ID NO: 138489 - protein, 28 aa, Artificial Sequence
  Description of Artificial Sequence: Synthetic peptide
QEEEIATTNPVSTEQYGEAAETIQHEEK

SEQ ID NO: 138490 - protein, 37 aa, Artificial Sequence
  Description of Artificial Sequence: Synthetic polypeptide
DEEEIRTTNPVATEQYGSTVSSTTEAWPNMRNGMNPI

SEQ ID NO: 138491 - protein, 36 aa, Artificial Sequence
  Description of Artificial Sequence: Synthetic polypeptide
DEEEIRTTNPVATEQYGSVGTPTMEGWQQGMAQNQI

SEQ ID NO: 138492 - protein, 34 aa, Artificial Sequence
  Description of Artificial Sequence: Synthetic polypeptide
DEEEICTTNPVATEYWGSVSTTNNLNGENHNNGA

SEQ ID NO: 138493 - protein, 29 aa, Artificial Sequence
  Description of Artificial Sequence: Synthetic peptide
QEEEIATTNPVSTEPYGEASMDIQHNGEK

SEQ ID NO: 138494 - protein, 32 aa, Artificial Sequence
  Description of Artificial Sequence: Synthetic polypeptide
DEHEIATTNPVAYEQWGSVYHTNDNHDGHGDR

SEQ ID NO: 138495 - protein, 38 aa, Artificial Sequence
  Description of Artificial Sequence: Synthetic polypeptide
DEEEIRTTNPVATEQYGVVSTTNNQLQAGTEQGNNQEQ

SEQ ID NO: 138496 - protein, 33 aa, Artificial Sequence
  Description of Artificial Sequence: Synthetic polypeptide
DEEEICTTNPVATESWGSVSTNGGNAGADGMTD

SEQ ID NO: 138497 - protein, 28 aa, Artificial Sequence
  Description of Artificial Sequence: Synthetic peptide
QEEEIATTNPVSTEQYGEAPEVCQHEET

SEQ ID NO: 138498 - protein, 37 aa, Artificial Sequence
  Description of Artificial Sequence: Synthetic polypeptide
DEEEIRTTNPVATEQYGSTVSSTTPAGSNERTGGNPV

SEQ ID NO: 138499 - protein, 35 aa, Artificial Sequence
  Description of Artificial Sequence: Synthetic polypeptide
DEEEIATTNPVATEQYGSACAATNPLQNEMGGDPH

SEQ ID NO: 138500 - protein, 34 aa, Artificial Sequence
  Description of Artificial Sequence: Synthetic polypeptide
DEEEICTTNPVATESYGVVSTGGNAGGADGGMDR

SEQ ID NO: 138501 - protein, 37 aa, Artificial Sequence
  Description of Artificial Sequence: Synthetic polypeptide
DEEEIRTTNPVATEQYGSTVSSTTTAGPNMRNGMNPV

SEQ ID NO: 138502 - protein, 35 aa, Artificial Sequence
  Description of Artificial Sequence: Synthetic polypeptide
DEEEIATTNPVATEQYGSACAATNPLQDDPAVGDW

SEQ ID NO: 138503 - protein, 37 aa, Artificial Sequence
  Description of Artificial Sequence: Synthetic polypeptide
DEEEIRTTNPVATEQYGSTVSSTTPDGPNMRKGMNYV

SEQ ID NO: 138504 - protein, 30 aa, Artificial Sequence
  Description of Artificial Sequence: Synthetic polypeptide
QENEIATTNPVATECYGHVSVEELQHEEEL

SEQ ID NO: 138505 - protein, 28 aa, Artificial Sequence
  Description of Artificial Sequence: Synthetic peptide
QEEEIATTNPVSTEQYGEAPEVCQHEHK

SEQ ID NO: 138506 - protein, 28 aa, Artificial Sequence
  Description of Artificial Sequence: Synthetic peptide
QEEEIATTNPVSTEQYGEAPEVIQHEEK

SEQ ID NO: 138507 - protein, 38 aa, Artificial Sequence
  Description of Artificial Sequence: Synthetic polypeptide
DEEEIRTTNPVATEQYGVVSTTNNQNLQQGNNQEEEDE

SEQ ID NO: 138508 - protein, 30 aa, Artificial Sequence
  Description of Artificial Sequence: Synthetic polypeptide
QENEIATTNPVATECYGIVISEFLQHETEL

SEQ ID NO: 138509 - protein, 38 aa, Artificial Sequence
  Description of Artificial Sequence: Synthetic polypeptide
DEEEIRTTNPVATEQYGVVSTTNNQNLQQGNNNEDEDD

SEQ ID NO: 138510 - protein, 35 aa, Artificial Sequence
  Description of Artificial Sequence: Synthetic polypeptide
DEMEIRTTNPVATEQYGCVSFTLLHTQFNGDQDSE

SEQ ID NO: 138511 - protein, 37 aa, Artificial Sequence
  Description of Artificial Sequence: Synthetic polypeptide
DEEEIRTTNPVATEQYGSTVSSTTPDGPNMRKGMNPV

SEQ ID NO: 138512 - protein, 34 aa, Artificial Sequence
  Description of Artificial Sequence: Synthetic polypeptide
DEMEIRTTNPVATEQYGCVSGWNSLEFGEFEQQV

SEQ ID NO: 138513 - protein, 29 aa, Artificial Sequence
  Description of Artificial Sequence: Synthetic peptide
QEEEIATTNPVSTEQYGEAPEVCQQNENK

SEQ ID NO: 138514 - protein, 28 aa, Artificial Sequence
  Description of Artificial Sequence: Synthetic peptide
QEKEIASTNPVGTEGYGVMASTLQHGDI

SEQ ID NO: 138515 - protein, 34 aa, Artificial Sequence
  Description of Artificial Sequence: Synthetic polypeptide
DEEEIRTTNPVATEQYGSVAEWPTTEVPTAPNDV

SEQ ID NO: 138516 - protein, 36 aa, Artificial Sequence
  Description of Artificial Sequence: Synthetic polypeptide
DEEEIRTTNPVATEQYGSVAFVNLGIENRSLVNENQ

SEQ ID NO: 138517 - protein, 33 aa, Artificial Sequence
  Description of Artificial Sequence: Synthetic polypeptide
DEMEIRTTNPVATECWGTVCSCINEPQFEGENG

SEQ ID NO: 138518 - protein, 34 aa, Artificial Sequence
  Description of Artificial Sequence: Synthetic polypeptide
DEEEIATVNPVCTEQYGSVSSTTALPNSNGMNPQ

SEQ ID NO: 138519 - protein, 33 aa, Artificial Sequence
  Description of Artificial Sequence: Synthetic polypeptide
DEMEIRTTNPVATECWGTVCSCINEPEREGENG

SEQ ID NO: 138520 - protein, 30 aa, Artificial Sequence
  Description of Artificial Sequence: Synthetic polypeptide
QENEIATTNPVATECYGDVSECLQHNEMEL

SEQ ID NO: 138521 - protein, 34 aa, Artificial Sequence
  Description of Artificial Sequence: Synthetic polypeptide
DEEEIATVNPVCTEQYGSVSSTPNGNMSNGMNPV

SEQ ID NO: 138522 - protein, 32 aa, Artificial Sequence
  Description of Artificial Sequence: Synthetic polypeptide
QEEEIRCTNPAATEQYGSVVSSIGGMGGNGGI

SEQ ID NO: 138523 - protein, 36 aa, Artificial Sequence
  Description of Artificial Sequence: Synthetic polypeptide
DEEEIRTTNPVATEQYGSVGSESNGHIVPQVGVQLN

SEQ ID NO: 138524 - protein, 36 aa, Artificial Sequence
  Description of Artificial Sequence: Synthetic polypeptide
DEEEIATTNPVATEQYGSVAGTNPLPAEAPIGTENA

SEQ ID NO: 138525 - protein, 35 aa, Artificial Sequence
  Description of Artificial Sequence: Synthetic polypeptide
DEEEIRTTNPVATEQYGSVGSAWQNVQTQMVQQAD

SEQ ID NO: 138526 - protein, 37 aa, Artificial Sequence
  Description of Artificial Sequence: Synthetic polypeptide
DEEEIRTTNPVATEQYGSVGQSWMTTSEPLGFLQNRQ

SEQ ID NO: 138527 - protein, 36 aa, Artificial Sequence
  Description of Artificial Sequence: Synthetic polypeptide
DEEEIRTTNPVATEQYGSVGQSLNEHELTTQGLLQL

SEQ ID NO: 138528 - protein, 33 aa, Artificial Sequence
  Description of Artificial Sequence: Synthetic polypeptide
DDECIRTTNPVAYEQYGCVCSTNHNQNFNSDLS

SEQ ID NO: 138529 - protein, 33 aa, Artificial Sequence
  Description of Artificial Sequence: Synthetic polypeptide
DEEEIATVNPVATEQYGCVAGTGLQSNNNHQES

SEQ ID NO: 138530 - protein, 36 aa, Artificial Sequence
  Description of Artificial Sequence: Synthetic polypeptide
DEEEIRTTNPVATEQYGSVGQPTPAGPMMQNGMNPV

SEQ ID NO: 138531 - protein, 33 aa, Artificial Sequence
  Description of Artificial Sequence: Synthetic polypeptide
DEEEIATVNPVATEQYGCVAGTGLQAAMNNQEE

SEQ ID NO: 138532 - protein, 33 aa, Artificial Sequence
  Description of Artificial Sequence: Synthetic polypeptide
DEEEIATVNPVATEQYGCVAGNGLQSNNNQPEE

SEQ ID NO: 138533 - protein, 33 aa, Artificial Sequence
  Description of Artificial Sequence: Synthetic polypeptide
DEEEIATVNPVATEQYGCVAGAGLQNRANNQEN

SEQ ID NO: 138534 - protein, 33 aa, Artificial Sequence
  Description of Artificial Sequence: Synthetic polypeptide
DEMEIRTTNPVATDQYGTVSTTAALDEVVVNIG

SEQ ID NO: 138535 - protein, 34 aa, Artificial Sequence
  Description of Artificial Sequence: Synthetic polypeptide
DEMEIRTTNPVATEAYGSVSSTDHDSSIREENMM

SEQ ID NO: 138536 - protein, 36 aa, Artificial Sequence
  Description of Artificial Sequence: Synthetic polypeptide
DEEEIRTTNPVATEQYGSVGPTTNMMMQEFGEEESN

SEQ ID NO: 138537 - protein, 30 aa, Artificial Sequence
  Description of Artificial Sequence: Synthetic polypeptide
QENEIATTNPVATECYGDVSECLQHELESL

SEQ ID NO: 138538 - protein, 35 aa, Artificial Sequence
  Description of Artificial Sequence: Synthetic polypeptide
DEHEIRTTNPVATEAWGSVCSTWEGQQGAQNDSDR

SEQ ID NO: 138539 - protein, 30 aa, Artificial Sequence
  Description of Artificial Sequence: Synthetic polypeptide
DEEEIATTNPVSTEQYGEAPAEVCQRVEEK

SEQ ID NO: 138540 - protein, 32 aa, Artificial Sequence
  Description of Artificial Sequence: Synthetic polypeptide
QEEEIRCTNPAATEQYGSVVSIGGMGDGNGGE

SEQ ID NO: 138541 - protein, 37 aa, Artificial Sequence
  Description of Artificial Sequence: Synthetic polypeptide
DEEEIRTTNPVATEQYGSVGQPSNPNVQSRENVVDQL

SEQ ID NO: 138542 - protein, 35 aa, Artificial Sequence
  Description of Artificial Sequence: Synthetic polypeptide
DEEEIATTNPVSTEQYGSVSSTTPAGPNMRNGNPV

SEQ ID NO: 138543 - protein, 33 aa, Artificial Sequence
  Description of Artificial Sequence: Synthetic polypeptide
DEEEIATTNPVTTEHWGSVYCMDNDQDQRQGNE

SEQ ID NO: 138544 - protein, 33 aa, Artificial Sequence
  Description of Artificial Sequence: Synthetic polypeptide
DEEEIATTNPYATEQYGSVPTVQVDHFQVNGAV

SEQ ID NO: 138545 - protein, 36 aa, Artificial Sequence
  Description of Artificial Sequence: Synthetic polypeptide
AEEEIRTTNPVATEQYGSVSVTVNNNEQGTNNNEEF

SEQ ID NO: 138546 - protein, 32 aa, Artificial Sequence
  Description of Artificial Sequence: Synthetic polypeptide
DEEEIATTNPYAVEQYGSVPTVQDVYQMSERV

SEQ ID NO: 138547 - protein, 32 aa, Artificial Sequence
  Description of Artificial Sequence: Synthetic polypeptide
DEEEIATVNPVATEQWGCVAGNGLQSNNNHAE

SEQ ID NO: 138548 - protein, 33 aa, Artificial Sequence
  Description of Artificial Sequence: Synthetic polypeptide
DEEEIATTNPVSTEQYGSVCAAPLQNHQGGEQG

SEQ ID NO: 138549 - protein, 37 aa, Artificial Sequence
  Description of Artificial Sequence: Synthetic polypeptide
DEEEIRTTNPVATEQYGVVSTTNQQQQQNGNNQETED

SEQ ID NO: 138550 - protein, 32 aa, Artificial Sequence
  Description of Artificial Sequence: Synthetic polypeptide
QEEEIRCTNPAATEQYGSVVSEGGMGGENGGV

SEQ ID NO: 138551 - protein, 31 aa, Artificial Sequence
  Description of Artificial Sequence: Synthetic polypeptide
QEEEIRCTNPAATEQYGSVSSEGGMGGDGGG

SEQ ID NO: 138552 - protein, 35 aa, Artificial Sequence
  Description of Artificial Sequence: Synthetic polypeptide
DEEEIRTTNPVATEQYGSVASVPLLETQIELVDDL

SEQ ID NO: 138553 - protein, 37 aa, Artificial Sequence
  Description of Artificial Sequence: Synthetic polypeptide
DEEEIRTTNPVATEQYGSVASTTPAIGPNMRNGMNPV

SEQ ID NO: 138554 - protein, 35 aa, Artificial Sequence
  Description of Artificial Sequence: Synthetic polypeptide
DEEEIATTNPVATEQYGSVACSADNPLAEAIGDHQ

SEQ ID NO: 138555 - protein, 38 aa, Artificial Sequence
  Description of Artificial Sequence: Synthetic polypeptide
DEEEIRTTNPVATEQYGVVSTVVNTNLQAGNNDEDEDE

SEQ ID NO: 138556 - protein, 38 aa, Artificial Sequence
  Description of Artificial Sequence: Synthetic polypeptide
DEEEIRTTNPVATEQYGVVSTVVNTNLQAGNNEEQEDE

SEQ ID NO: 138557 - protein, 32 aa, Artificial Sequence
  Description of Artificial Sequence: Synthetic polypeptide
DEMEIRTTNPVATECYGTVCANADGPEPEGND

SEQ ID NO: 138558 - protein, 30 aa, Artificial Sequence
  Description of Artificial Sequence: Synthetic polypeptide
QENEIATTNPVATECYGDVSECLQQHEETL

SEQ ID NO: 138559 - protein, 32 aa, Artificial Sequence
  Description of Artificial Sequence: Synthetic polypeptide
DEMEIRTTNPVATECYGTVCANADGPEPKGND

SEQ ID NO: 138560 - protein, 32 aa, Artificial Sequence
  Description of Artificial Sequence: Synthetic polypeptide
DEMEIRTTNPVATECYGTVCSAADGPEPEGND

SEQ ID NO: 138561 - protein, 31 aa, Artificial Sequence
  Description of Artificial Sequence: Synthetic polypeptide
DEHEIRTTNPVATDQYGSVNMQMQFNSIQPK

SEQ ID NO: 138562 - protein, 33 aa, Artificial Sequence
  Description of Artificial Sequence: Synthetic polypeptide
DEMEIRTTNPVATECYGTVCSATDGPVEFEGND

SEQ ID NO: 138563 - protein, 38 aa, Artificial Sequence
  Description of Artificial Sequence: Synthetic polypeptide
DEEEIRTTNPVATEQYGVVSTVVNTNLQAGNQEDTEED

SEQ ID NO: 138564 - protein, 38 aa, Artificial Sequence
  Description of Artificial Sequence: Synthetic polypeptide
DEEEIRTTNPVATEQYGVVSTVVNTNLQAGNQESEEDE

SEQ ID NO: 138565 - protein, 38 aa, Artificial Sequence
  Description of Artificial Sequence: Synthetic polypeptide
DEEEIRTTNPVATEQYGVVSTVVNTNLQAGNQNDTEDE

SEQ ID NO: 138566 - protein, 38 aa, Artificial Sequence
  Description of Artificial Sequence: Synthetic polypeptide
AEEEIRTTNPVATEQYGSVSVTVTTNNGNLQQGTNGID

SEQ ID NO: 138567 - protein, 34 aa, Artificial Sequence
  Description of Artificial Sequence: Synthetic polypeptide
DEMEIRTTNPVATDQYGSVTSSGLEHPRQAQNDF

SEQ ID NO: 138568 - protein, 36 aa, Artificial Sequence
  Description of Artificial Sequence: Synthetic polypeptide
DEEEIRTTNPVATEQYGSVASVSSWPLEQLGDEVFP

SEQ ID NO: 138569 - protein, 36 aa, Artificial Sequence
  Description of Artificial Sequence: Synthetic polypeptide
DEEEIRTTNPVATEQYGSVASWTGNVQPTQMVQEAD

SEQ ID NO: 138570 - protein, 35 aa, Artificial Sequence
  Description of Artificial Sequence: Synthetic polypeptide
DEEEIRTTNPVATEQYGSVGSGMGGQNNMEEEGDE

SEQ ID NO: 138571 - protein, 37 aa, Artificial Sequence
  Description of Artificial Sequence: Synthetic polypeptide
AEEEIRTTNPVATEQYGSVSVTVTNGNQQGTGNNNDD

SEQ ID NO: 138572 - protein, 34 aa, Artificial Sequence
  Description of Artificial Sequence: Synthetic polypeptide
QEEEIRATNPVATEQYGSVVQNNDDEEQGEGEND

SEQ ID NO: 138573 - protein, 34 aa, Artificial Sequence
  Description of Artificial Sequence: Synthetic polypeptide
DEEEIATTNPVATEQYGSVAGANPTEAEGGNMDD

SEQ ID NO: 138574 - protein, 34 aa, Artificial Sequence
  Description of Artificial Sequence: Synthetic polypeptide
QEEEIRATNPVATEQYGSVSNGDTGQDEGGQNST

SEQ ID NO: 138575 - protein, 37 aa, Artificial Sequence
  Description of Artificial Sequence: Synthetic polypeptide
DEEEICNTTNPVATEAYGISVSTGNADSTRPGTNNRP

SEQ ID NO: 138576 - protein, 36 aa, Artificial Sequence
  Description of Artificial Sequence: Synthetic polypeptide
DEEEIRTTNPVATEQYGSVASVTPAGPNARVGMMPV

SEQ ID NO: 138577 - protein, 36 aa, Artificial Sequence
  Description of Artificial Sequence: Synthetic polypeptide
DEEEIATTNPVATEQYGSVACSGNNDIPQDNGNHNM

SEQ ID NO: 138578 - protein, 33 aa, Artificial Sequence
  Description of Artificial Sequence: Synthetic polypeptide
DEEEICTTNPCAYEQWGSVPTWENDQANGGNEG

SEQ ID NO: 138579 - protein, 30 aa, Artificial Sequence
  Description of Artificial Sequence: Synthetic polypeptide
QENEIATTNPVATECYGDVSECLQNAAEEL

SEQ ID NO: 138580 - protein, 30 aa, Artificial Sequence
  Description of Artificial Sequence: Synthetic polypeptide
QENEIATTNPVATECYGDVSECLQNHAEDA

SEQ ID NO: 138581 - protein, 30 aa, Artificial Sequence
  Description of Artificial Sequence: Synthetic polypeptide
QENEIATTNPVATECYGDVSECLQNHAEEA

SEQ ID NO: 138582 - protein, 30 aa, Artificial Sequence
  Description of Artificial Sequence: Synthetic polypeptide
QENEIATTNPVATECYGDVSECLQNHAEEL

SEQ ID NO: 138583 - protein, 36 aa, Artificial Sequence
  Description of Artificial Sequence: Synthetic polypeptide
DEEEIATTNPVATEQYGSVACSGNNDIPQDNEGNNH

SEQ ID NO: 138584 - protein, 31 aa, Artificial Sequence
  Description of Artificial Sequence: Synthetic polypeptide
DEEEICTTNPCAYEQWGCVPTWDLADRQGSE

SEQ ID NO: 138585 - protein, 34 aa, Artificial Sequence
  Description of Artificial Sequence: Synthetic polypeptide
DEEEIATTNPVCTEQYGSVSSTTAGPNSNGMNPV

SEQ ID NO: 138586 - protein, 35 aa, Artificial Sequence
  Description of Artificial Sequence: Synthetic polypeptide
DEEEIATTNPVATEQYGSVAITQLDQLAEGPGEHD

SEQ ID NO: 138587 - protein, 34 aa, Artificial Sequence
  Description of Artificial Sequence: Synthetic polypeptide
DEEEIATTNPVATEQYGSVAMNGLTAPDNGDTDM

SEQ ID NO: 138588 - protein, 35 aa, Artificial Sequence
  Description of Artificial Sequence: Synthetic polypeptide
DEMEIRTTNPVATDQYGCSVSLTNVGETQFEQNGK

SEQ ID NO: 138589 - protein, 37 aa, Artificial Sequence
  Description of Artificial Sequence: Synthetic polypeptide
DEEEIRTTNPVATEQYGVVSTTTNLQQGTEQGTTTEE

SEQ ID NO: 138590 - protein, 33 aa, Artificial Sequence
  Description of Artificial Sequence: Synthetic polypeptide
DDECIRTTNPVATEQYGCVCSTGEHQNFVSNLG

SEQ ID NO: 138591 - protein, 33 aa, Artificial Sequence
  Description of Artificial Sequence: Synthetic polypeptide
DDECIRTTNPVATEQYGCVCSTGNHQNFISDLA

SEQ ID NO: 138592 - protein, 38 aa, Artificial Sequence
  Description of Artificial Sequence: Synthetic polypeptide
DEEEIRTTNPVATEQYGVVSTTTNLQAGTEQGTTEDNE

SEQ ID NO: 138593 - protein, 34 aa, Artificial Sequence
  Description of Artificial Sequence: Synthetic polypeptide
DDECIRTTNPVATEQYGCVCSTNHNQNFNSDNLA

SEQ ID NO: 138594 - protein, 29 aa, Artificial Sequence
  Description of Artificial Sequence: Synthetic peptide
QENEIATTNPVATECYGDVSECKQHEELN

SEQ ID NO: 138595 - protein, 34 aa, Artificial Sequence
  Description of Artificial Sequence: Synthetic polypeptide
DEEEIRTTNPVATEQYGSVATTMEQEVQLLELLV

SEQ ID NO: 138596 - protein, 35 aa, Artificial Sequence
  Description of Artificial Sequence: Synthetic polypeptide
DEHEIRTTNPVATEHYGSVCQTNDLQDHQQQGGDA

SEQ ID NO: 138597 - protein, 35 aa, Artificial Sequence
  Description of Artificial Sequence: Synthetic polypeptide
DEEEIATTNPVAYEQYGSVISWTDNSLFTVYNNEF

SEQ ID NO: 138598 - protein, 37 aa, Artificial Sequence
  Description of Artificial Sequence: Synthetic polypeptide
DEEEIRTTNPVATEQYGSVATTLNQLQAGTEGGTTED

SEQ ID NO: 138599 - protein, 33 aa, Artificial Sequence
  Description of Artificial Sequence: Synthetic polypeptide
DEMEIRTTNPVATDQYGCVNSTNNLESIIEKHP

SEQ ID NO: 138600 - protein, 35 aa, Artificial Sequence
  Description of Artificial Sequence: Synthetic polypeptide
DEHEIRTTNPVATEHYGSVAITDNQDDQRQGGGGE

SEQ ID NO: 138601 - protein, 36 aa, Artificial Sequence
  Description of Artificial Sequence: Synthetic polypeptide
DEEEIRTTNPVATEQYGSVATTLNQLNNGEEGTTDE

SEQ ID NO: 138602 - protein, 32 aa, Artificial Sequence
  Description of Artificial Sequence: Synthetic polypeptide
DEMEIRTTNPVATDQYGCVCNTEHQHFGSDQS

SEQ ID NO: 138603 - protein, 33 aa, Artificial Sequence
  Description of Artificial Sequence: Synthetic polypeptide
DEHEIRTTNPVATEHWGCVSGGNGEERNMNGNQ

SEQ ID NO: 138604 - protein, 34 aa, Artificial Sequence
  Description of Artificial Sequence: Synthetic polypeptide
QEEEIRSTNPVATEQYGSVSGGMEGQEGGGEGNA

SEQ ID NO: 138605 - protein, 28 aa, Artificial Sequence
  Description of Artificial Sequence: Synthetic peptide
QENEIATTNPVATECYGDVSECKNHEEL

SEQ ID NO: 138606 - protein, 35 aa, Artificial Sequence
  Description of Artificial Sequence: Synthetic polypeptide
QEEEIRTTNPCATEQYGIVSSTPNGPNMRNGMNPV

SEQ ID NO: 138607 - protein, 37 aa, Artificial Sequence
  Description of Artificial Sequence: Synthetic polypeptide
DEEEIRTTNPVATEQYGSVGGWSNTNQQSLENNVDQY

SEQ ID NO: 138608 - protein, 29 aa, Artificial Sequence
  Description of Artificial Sequence: Synthetic peptide
QENEIATTNPVATECYGDVSECIQQHEEL

SEQ ID NO: 138609 - protein, 35 aa, Artificial Sequence
  Description of Artificial Sequence: Synthetic polypeptide
DEEEIRTTNPVATEQYGSVGIITINAEGEQQLVEG

SEQ ID NO: 138610 - protein, 37 aa, Artificial Sequence
  Description of Artificial Sequence: Synthetic polypeptide
DEEEIRTTNPVATEQYGSVATTNNNLQAGTETGTEEG

SEQ ID NO: 138611 - protein, 37 aa, Artificial Sequence
  Description of Artificial Sequence: Synthetic polypeptide
DEEEIRTTNPVATEQYGSVATTNNNLQAGTEQGTTDE

SEQ ID NO: 138612 - protein, 37 aa, Artificial Sequence
  Description of Artificial Sequence: Synthetic polypeptide
DEEEIRTTNPVATEQYGSVATTNLQLQAGTEGGTTEG

SEQ ID NO: 138613 - protein, 37 aa, Artificial Sequence
  Description of Artificial Sequence: Synthetic polypeptide
DEEEIRTTNPVATEQYGSVATTNNNLQAGTEGGSTET

SEQ ID NO: 138614 - protein, 33 aa, Artificial Sequence
  Description of Artificial Sequence: Synthetic polypeptide
DDECIRTTNPVATEQYGCVCSTEHNQYFNSNQS

SEQ ID NO: 138615 - protein, 33 aa, Artificial Sequence
  Description of Artificial Sequence: Synthetic polypeptide
DDECIRTTNPVATEQYGCVCSTEHQNFVSQNLS

SEQ ID NO: 138616 - protein, 30 aa, Artificial Sequence
  Description of Artificial Sequence: Synthetic polypeptide
QENEIATTNPVATECYGDVSECKLQHEHEL

SEQ ID NO: 138617 - protein, 31 aa, Artificial Sequence
  Description of Artificial Sequence: Synthetic polypeptide
DAEEIATTNPVATEQYGSVCAAPVDDGPQEE

SEQ ID NO: 138618 - protein, 32 aa, Artificial Sequence
  Description of Artificial Sequence: Synthetic polypeptide
DAEEIATTNPVATEQYGSVCAAPPANDMPGED

SEQ ID NO: 138619 - protein, 35 aa, Artificial Sequence
  Description of Artificial Sequence: Synthetic polypeptide
DAEEIATTNPVATEQYGSVCAANPLQEAQDGNQMN

SEQ ID NO: 138620 - protein, 37 aa, Artificial Sequence
  Description of Artificial Sequence: Synthetic polypeptide
DEEEIRTTNPVATEQYGSVATTNNNLQAGTEEGTTEM

SEQ ID NO: 138621 - protein, 38 aa, Artificial Sequence
  Description of Artificial Sequence: Synthetic polypeptide
DEEEIRTTNPVATEQYGVVSTVVNTNLQAGNQQGTEDN

SEQ ID NO: 138622 - protein, 38 aa, Artificial Sequence
  Description of Artificial Sequence: Synthetic polypeptide
DEEEIRTTNPVATEQYGVVSTTTNLQAGTEQGTENTNE

SEQ ID NO: 138623 - protein, 35 aa, Artificial Sequence
  Description of Artificial Sequence: Synthetic polypeptide
DEEEIATTNPVAYEQYGSVSAANDHPLDSDDGNDN

SEQ ID NO: 138624 - protein, 33 aa, Artificial Sequence
  Description of Artificial Sequence: Synthetic polypeptide
DEEEIATTNPVAYEQYGTVATNDGGQQNKGGGE

SEQ ID NO: 138625 - protein, 34 aa, Artificial Sequence
  Description of Artificial Sequence: Synthetic polypeptide
DEEEIATTNPVATEQYGSVANTGTGGEYGAEGGR

SEQ ID NO: 138626 - protein, 30 aa, Artificial Sequence
  Description of Artificial Sequence: Synthetic polypeptide
QENEIATTNPVATECYGDVSECLQHEDEPL

SEQ ID NO: 138627 - protein, 33 aa, Artificial Sequence
  Description of Artificial Sequence: Synthetic polypeptide
DEEEIATTNPVATEQYGSVANPGNGEYGDEGGL

SEQ ID NO: 138628 - protein, 37 aa, Artificial Sequence
  Description of Artificial Sequence: Synthetic polypeptide
DEEEIRTTNPVATEQYGVVSTVVNQQQGNQEEEEEDG

SEQ ID NO: 138629 - protein, 37 aa, Artificial Sequence
  Description of Artificial Sequence: Synthetic polypeptide
DEEEIRTTNPVATEQYGVVSTVVNQQQGTTNEEEEED

SEQ ID NO: 138630 - protein, 38 aa, Artificial Sequence
  Description of Artificial Sequence: Synthetic polypeptide
DEEEIRTTNPVATEQYGVVSTVVNQQLQIGTNNNEEEE

SEQ ID NO: 138631 - protein, 37 aa, Artificial Sequence
  Description of Artificial Sequence: Synthetic polypeptide
DEEEIRTTNPVATEQYGVVSTVVNQQQLGNQNTEDED

SEQ ID NO: 138632 - protein, 35 aa, Artificial Sequence
  Description of Artificial Sequence: Synthetic polypeptide
DEEEIATTNPVATEQYGSVAMNNLTNPDDGMGDRA

SEQ ID NO: 138633 - protein, 34 aa, Artificial Sequence
  Description of Artificial Sequence: Synthetic polypeptide
DEEEIRTTNPVATEQYGSVGPAIPQQNVGVVQHQ

SEQ ID NO: 138634 - protein, 32 aa, Artificial Sequence
  Description of Artificial Sequence: Synthetic polypeptide
DAEEIATTNPVATEQYGSVCAAGPLDTMPGDH

SEQ ID NO: 138635 - protein, 36 aa, Artificial Sequence
  Description of Artificial Sequence: Synthetic polypeptide
DEEEIRTTNPVATEQYGSVGPNSLEQQTTLGVMEID

SEQ ID NO: 138636 - protein, 34 aa, Artificial Sequence
  Description of Artificial Sequence: Synthetic polypeptide
DEEEIATTNPVCTEQYGSVSSTTAGPNSNGMNPQ

SEQ ID NO: 138637 - protein, 36 aa, Artificial Sequence
  Description of Artificial Sequence: Synthetic polypeptide
DEEEIRTTNPVATEQYGVVSTVVNQQQNNDEETEEE

SEQ ID NO: 138638 - protein, 37 aa, Artificial Sequence
  Description of Artificial Sequence: Synthetic polypeptide
AEEEIRTTNPVATEQYGSVSVTVNLLQGNNNTETGTE

SEQ ID NO: 138639 - protein, 30 aa, Artificial Sequence
  Description of Artificial Sequence: Synthetic polypeptide
QENEIATTNPVATECYGDVSECLKQHEEEL

SEQ ID NO: 138640 - protein, 38 aa, Artificial Sequence
  Description of Artificial Sequence: Synthetic polypeptide
DEEEIRTTNPVATEQYGVVSTVVNQQLQEGTNNAEEND

SEQ ID NO: 138641 - protein, 35 aa, Artificial Sequence
  Description of Artificial Sequence: Synthetic polypeptide
DEEEIATTNPVAYEQYGSVYACTNAISQTKGSPRV

SEQ ID NO: 138642 - protein, 33 aa, Artificial Sequence
  Description of Artificial Sequence: Synthetic polypeptide
DEEEIATTNPVAYEQYGSVSCTMNYESDDQDEE

SEQ ID NO: 138643 - protein, 29 aa, Artificial Sequence
  Description of Artificial Sequence: Synthetic peptide
QENEIATTNPVATECYGDVSECLNHEEPL

SEQ ID NO: 138644 - protein, 37 aa, Artificial Sequence
  Description of Artificial Sequence: Synthetic polypeptide
DEEEIRTTNPVATEQYGSVATNSATEQYGSVTQNDET

SEQ ID NO: 138645 - protein, 33 aa, Artificial Sequence
  Description of Artificial Sequence: Synthetic polypeptide
DEMEIRTTNPVATDQYGCVSASVVLERQQNNPS

SEQ ID NO: 138646 - protein, 37 aa, Artificial Sequence
  Description of Artificial Sequence: Synthetic polypeptide
DEEEIRTTNPVATEQYGVVSTVVNQQANNQQGTNEDE

SEQ ID NO: 138647 - protein, 30 aa, Artificial Sequence
  Description of Artificial Sequence: Synthetic polypeptide
QENEIATTNPVATECYGDVSECLQCHEELN

SEQ ID NO: 138648 - protein, 35 aa, Artificial Sequence
  Description of Artificial Sequence: Synthetic polypeptide
DEMEIRTTNPVATDQYGCVSLTENVLDMTQFQNGK

SEQ ID NO: 138649 - protein, 33 aa, Artificial Sequence
  Description of Artificial Sequence: Synthetic polypeptide
QEEEIRSTNPVATEQYGAVNDNFDQIGEDENIG

SEQ ID NO: 138650 - protein, 37 aa, Artificial Sequence
  Description of Artificial Sequence: Synthetic polypeptide
AEEEIRTTNPVATEQYGSVSVTVNDNGTNQQGNNVAE

SEQ ID NO: 138651 - protein, 38 aa, Artificial Sequence
  Description of Artificial Sequence: Synthetic polypeptide
DEEEIRTTNPVATEQYGVVSTVVNQQLQAGTNATEEEE

SEQ ID NO: 138652 - protein, 38 aa, Artificial Sequence
  Description of Artificial Sequence: Synthetic polypeptide
DEEEIRTTNPVATEQYGVVSTVVNQQLQAGTNVTEEND

SEQ ID NO: 138653 - protein, 34 aa, Artificial Sequence
  Description of Artificial Sequence: Synthetic polypeptide
DEHEIRTTNPVATECYGVVSPTDGLNNRGGGDIH

SEQ ID NO: 138654 - protein, 36 aa, Artificial Sequence
  Description of Artificial Sequence: Synthetic polypeptide
DEEEIATTNPVAYEQYGSVTSWHDNSLFTVRGNEFP

SEQ ID NO: 138655 - protein, 38 aa, Artificial Sequence
  Description of Artificial Sequence: Synthetic polypeptide
DEEEIRTTNPVATEQYGVVSTTTNLQAGNQQGTTNEED

SEQ ID NO: 138656 - protein, 30 aa, Artificial Sequence
  Description of Artificial Sequence: Synthetic polypeptide
QENEIATTNPVATECYGDVSECLQDHKEEL

SEQ ID NO: 138657 - protein, 37 aa, Artificial Sequence
  Description of Artificial Sequence: Synthetic polypeptide
AEEEIRTTNPVATEQYGSVTVTVTTNLQQGIGTTNTE

SEQ ID NO: 138658 - protein, 28 aa, Artificial Sequence
  Description of Artificial Sequence: Synthetic peptide
QEEEIQTTNPVATEQYGEAPEVCWHEEK

SEQ ID NO: 138659 - protein, 29 aa, Artificial Sequence
  Description of Artificial Sequence: Synthetic peptide
QEEEIQTTNPVATEQYGEAAPEVCQHEEK

SEQ ID NO: 138660 - protein, 35 aa, Artificial Sequence
  Description of Artificial Sequence: Synthetic polypeptide
AEEEIRTTNPVATEQYGSVTTVTNQQQNQENNNNQ

SEQ ID NO: 138661 - protein, 36 aa, Artificial Sequence
  Description of Artificial Sequence: Synthetic polypeptide
AEEEIRTTNPVATEQYGSVTTVTNNNLQGNQENNTD

SEQ ID NO: 138662 - protein, 36 aa, Artificial Sequence
  Description of Artificial Sequence: Synthetic polypeptide
DEEEIATTNPVATEQYGSACSATNPGAEAEIGNDRF

SEQ ID NO: 138663 - protein, 35 aa, Artificial Sequence
  Description of Artificial Sequence: Synthetic polypeptide
AEEEIRTTNPVATEQYGSVTTVTNMEQGTNNVTEQ

SEQ ID NO: 138664 - protein, 36 aa, Artificial Sequence
  Description of Artificial Sequence: Synthetic polypeptide
DEEEIATTNPVATEQYGSACSATNPLAEAEIGNGNE

SEQ ID NO: 138665 - protein, 35 aa, Artificial Sequence
  Description of Artificial Sequence: Synthetic polypeptide
DEEEIATTNPVATEQYGSACSGNNDIPQDNGGNGN

SEQ ID NO: 138666 - protein, 34 aa, Artificial Sequence
  Description of Artificial Sequence: Synthetic polypeptide
DEEEIATTNPVATEQYGSACSLANMGQAEDPNEH

SEQ ID NO: 138667 - protein, 35 aa, Artificial Sequence
  Description of Artificial Sequence: Synthetic polypeptide
DEEEIATTNPVATEQYGSACSTNDQQEHQDGTATE

SEQ ID NO: 138668 - protein, 34 aa, Artificial Sequence
  Description of Artificial Sequence: Synthetic polypeptide
DEHEIRTTNPCAYEQWGEVCSTDNLGDTNGMNQR

SEQ ID NO: 138669 - protein, 30 aa, Artificial Sequence
  Description of Artificial Sequence: Synthetic polypeptide
DEEEIATTNPVATEQYGSAPAEVCEHEEEL

SEQ ID NO: 138670 - protein, 37 aa, Artificial Sequence
  Description of Artificial Sequence: Synthetic polypeptide
DEEEIRTTNPVATEQYGVVSTTNQQQQGNNNNEEGED

SEQ ID NO: 138671 - protein, 31 aa, Artificial Sequence
  Description of Artificial Sequence: Synthetic polypeptide
DEMEIRTTNPVATEQWGTVSEDGEMNFAGDA

SEQ ID NO: 138672 - protein, 31 aa, Artificial Sequence
  Description of Artificial Sequence: Synthetic polypeptide
DEMEIRTTNPVATEQWGTVSEDGEMNAAGDA

SEQ ID NO: 138673 - protein, 37 aa, Artificial Sequence
  Description of Artificial Sequence: Synthetic polypeptide
DEEEIRTTNPVATEQYGVVSTTNQQQQGNNQQGTEDE

SEQ ID NO: 138674 - protein, 33 aa, Artificial Sequence
  Description of Artificial Sequence: Synthetic polypeptide
DEMEIRTTNPVATEQWGTVCSCIGEPEREGENG

SEQ ID NO: 138675 - protein, 32 aa, Artificial Sequence
  Description of Artificial Sequence: Synthetic polypeptide
DEHEIRTTNPCAYEQWGSVATDNGNHGHGNAE

SEQ ID NO: 138676 - protein, 33 aa, Artificial Sequence
  Description of Artificial Sequence: Synthetic polypeptide
DEMEIRTTNPVATEQWGTVCSATIGPPEFEGNG

SEQ ID NO: 138677 - protein, 38 aa, Artificial Sequence
  Description of Artificial Sequence: Synthetic polypeptide
AEEEIRTTNPVATEQYGSVSVVVNTNLEQGSEGGSNLQ

SEQ ID NO: 138678 - protein, 35 aa, Artificial Sequence
  Description of Artificial Sequence: Synthetic polypeptide
DEEEIATTNPVATEQYGSCAAATGNLQIDPPENHH

SEQ ID NO: 138679 - protein, 33 aa, Artificial Sequence
  Description of Artificial Sequence: Synthetic polypeptide
DEMEIRTTNPVATEQWGTVCSACIGEPEREGNG

SEQ ID NO: 138680 - protein, 37 aa, Artificial Sequence
  Description of Artificial Sequence: Synthetic polypeptide
DEEEIRTTNPVATEQYGSVAQTTPAGPNLRQGMNPVL

SEQ ID NO: 138681 - protein, 30 aa, Artificial Sequence
  Description of Artificial Sequence: Synthetic polypeptide
QENEIATTNPVATECYGDVSEGCLQHEQEL

SEQ ID NO: 138682 - protein, 35 aa, Artificial Sequence
  Description of Artificial Sequence: Synthetic polypeptide
DEEEICTTNPVATECYGSVATTGNGNQGGHGGNND

SEQ ID NO: 138683 - protein, 33 aa, Artificial Sequence
  Description of Artificial Sequence: Synthetic polypeptide
DEEEIRTTNPVATEQYGSVAQMGTQQTMVLLAD

SEQ ID NO: 138684 - protein, 35 aa, Artificial Sequence
  Description of Artificial Sequence: Synthetic polypeptide
DEEEICTTNPVATECYGSVATTGNGNQGGHGNNND

SEQ ID NO: 138685 - protein, 35 aa, Artificial Sequence
  Description of Artificial Sequence: Synthetic polypeptide
DEEEIATTNPVATEQYGSASSTTPAGPNRNGMNPV

SEQ ID NO: 138686 - protein, 34 aa, Artificial Sequence
  Description of Artificial Sequence: Synthetic polypeptide
QEEEICTTNPVATEQYGSVATNLVATPADINAEE

SEQ ID NO: 138687 - protein, 33 aa, Artificial Sequence
  Description of Artificial Sequence: Synthetic polypeptide
DEMEIRTTNPVATEQWGTVCSATDGPVEAEGND

SEQ ID NO: 138688 - protein, 33 aa, Artificial Sequence
  Description of Artificial Sequence: Synthetic polypeptide
DEMEIRTTNPVATEQWGTVCSATDGPVEFEGND

SEQ ID NO: 138689 - protein, 36 aa, Artificial Sequence
  Description of Artificial Sequence: Synthetic polypeptide
AEEEIRTTNPVATEQYGSVTTNTDGNNNLQGTNDEE

SEQ ID NO: 138690 - protein, 32 aa, Artificial Sequence
  Description of Artificial Sequence: Synthetic polypeptide
DEMEIRTTNPVATEQWGTVCSATGEVEFEGDD

SEQ ID NO: 138691 - protein, 37 aa, Artificial Sequence
  Description of Artificial Sequence: Synthetic polypeptide
AEEEIRTTNPVATEQYGSVSVVVTNNQQGTQGNNTQD

SEQ ID NO: 138692 - protein, 36 aa, Artificial Sequence
  Description of Artificial Sequence: Synthetic polypeptide
DEEEICTTNPVATECYGSVSTGNAGNQGGHGGNGKD

SEQ ID NO: 138693 - protein, 37 aa, Artificial Sequence
  Description of Artificial Sequence: Synthetic polypeptide
DEEEIRTTNPVATEQYGSVAPIINQLMEQRQMPEGGI

SEQ ID NO: 138694 - protein, 34 aa, Artificial Sequence
  Description of Artificial Sequence: Synthetic polypeptide
DEEEIRTTNPVATEQYGSVAPHVQELNVPIMQLN

SEQ ID NO: 138695 - protein, 37 aa, Artificial Sequence
  Description of Artificial Sequence: Synthetic polypeptide
DEEEIRTTNPVATEQYGVVSTTNQQQGNTEQGTEEQE

SEQ ID NO: 138696 - protein, 37 aa, Artificial Sequence
  Description of Artificial Sequence: Synthetic polypeptide
DEEEIRTTNPVATEQYGVVSTTNQQQGNQQGTTEEED

SEQ ID NO: 138697 - protein, 30 aa, Artificial Sequence
  Description of Artificial Sequence: Synthetic polypeptide
QENEIATTNPVATECYGDVSEPCGQREEPL

SEQ ID NO: 138698 - protein, 31 aa, Artificial Sequence
  Description of Artificial Sequence: Synthetic polypeptide
QENEIATTNPVATECYGDVSEPCLQRNEMEL

SEQ ID NO: 138699 - protein, 36 aa, Artificial Sequence
  Description of Artificial Sequence: Synthetic polypeptide
DEEEICTTNPVATECYGSVSTGNNGNQGGHGGGKND

SEQ ID NO: 138700 - protein, 36 aa, Artificial Sequence
  Description of Artificial Sequence: Synthetic polypeptide
DEEEICTTNPVATECYGSVSTGNQGAQGGHGNNPND

SEQ ID NO: 138701 - protein, 29 aa, Artificial Sequence
  Description of Artificial Sequence: Synthetic peptide
QENEIATTNPVATECYGDVSEPCGQHEEL

SEQ ID NO: 138702 - protein, 34 aa, Artificial Sequence
  Description of Artificial Sequence: Synthetic polypeptide
DEMEIRTTNPVATEQYGCICSTWETQNFGSDNQS

SEQ ID NO: 138703 - protein, 36 aa, Artificial Sequence
  Description of Artificial Sequence: Synthetic polypeptide
DEEEICTTNPVATECYGSVSTGNQGQQGGHGQNNND

SEQ ID NO: 138704 - protein, 35 aa, Artificial Sequence
  Description of Artificial Sequence: Synthetic polypeptide
DEEEICTTNPVATECYGSVSTGNTGNAGGTGNGND

SEQ ID NO: 138705 - protein, 32 aa, Artificial Sequence
  Description of Artificial Sequence: Synthetic polypeptide
DEMEIRTTNPVATEQYGCICSWETANFNSDQS

SEQ ID NO: 138706 - protein, 37 aa, Artificial Sequence
  Description of Artificial Sequence: Synthetic polypeptide
AEEEIRTTNPVATEQYGSVTVTVTNLQSNEQGTNTNN

SEQ ID NO: 138707 - protein, 37 aa, Artificial Sequence
  Description of Artificial Sequence: Synthetic polypeptide
AEEEIRTTNPVATEQYGSVTVTVTTNLNQEIGTTNPD

SEQ ID NO: 138708 - protein, 36 aa, Artificial Sequence
  Description of Artificial Sequence: Synthetic polypeptide
DEEEIRTTNPVATEQYGSVAGSVNGFGQENIGGEGT

SEQ ID NO: 138709 - protein, 36 aa, Artificial Sequence
  Description of Artificial Sequence: Synthetic polypeptide
DEEEICTTNPVATECYGSVSTGNQGNQGGHGGGNNQ

SEQ ID NO: 138710 - protein, 34 aa, Artificial Sequence
  Description of Artificial Sequence: Synthetic polypeptide
DEEEIATTNPVATEQYGSCAAATNDATAGGENNH

SEQ ID NO: 138711 - protein, 29 aa, Artificial Sequence
  Description of Artificial Sequence: Synthetic peptide
QENEIATTNPVATECYGDVSEPCAQHEEL

SEQ ID NO: 138712 - protein, 37 aa, Artificial Sequence
  Description of Artificial Sequence: Synthetic polypeptide
AEEEIRTTNPVATEQYGSVTVTTNNLQGNEAGTNNND

SEQ ID NO: 138713 - protein, 35 aa, Artificial Sequence
  Description of Artificial Sequence: Synthetic polypeptide
DEEEIRTTNPVATEQYGSVANTTSVVEQEALVEVR

SEQ ID NO: 138714 - protein, 36 aa, Artificial Sequence
  Description of Artificial Sequence: Synthetic polypeptide
DEEEICTTNPVATECYGSVSTGNEGNQGGHGGNGNK

SEQ ID NO: 138715 - protein, 32 aa, Artificial Sequence
  Description of Artificial Sequence: Synthetic polypeptide
DEHEIRTTNPCAYEEWGSVAGENDHGGRGNAR

SEQ ID NO: 138716 - protein, 36 aa, Artificial Sequence
  Description of Artificial Sequence: Synthetic polypeptide
AEEEIRTTNPVATEQYGSVSTVVNQQQQEIGEDEEA

SEQ ID NO: 138717 - protein, 34 aa, Artificial Sequence
  Description of Artificial Sequence: Synthetic polypeptide
DEMEIRTTNPVATEQYGCICSNTGNTQNFGSDTQ

SEQ ID NO: 138718 - protein, 36 aa, Artificial Sequence
  Description of Artificial Sequence: Synthetic polypeptide
AEEEIRTTNPVATEQYGSVSTVVNQQQNQETENNND

SEQ ID NO: 138719 - protein, 34 aa, Artificial Sequence
  Description of Artificial Sequence: Synthetic polypeptide
DEMEIRTTNPVATEQYGCICSTGETQRFGSDTQS

SEQ ID NO: 138720 - protein, 35 aa, Artificial Sequence
  Description of Artificial Sequence: Synthetic polypeptide
AEEEIRTTNPVATEQYGSVTVNTNDESGTVTNVTN

SEQ ID NO: 138721 - protein, 38 aa, Artificial Sequence
  Description of Artificial Sequence: Synthetic polypeptide
AEEEIRTTNPVATEQYGSVTVSVTTNLQAGSEGGNTQV

SEQ ID NO: 138722 - protein, 35 aa, Artificial Sequence
  Description of Artificial Sequence: Synthetic polypeptide
DEEEIATTNPVATEQYGSACSAPNLQDSPDGSAEE

SEQ ID NO: 138723 - protein, 33 aa, Artificial Sequence
  Description of Artificial Sequence: Synthetic polypeptide
DEMEIRTTNPVATEQYGCICSTETNQNFGSQQG

SEQ ID NO: 138724 - protein, 34 aa, Artificial Sequence
  Description of Artificial Sequence: Synthetic polypeptide
DEEEIATTNPVATEQYGSACSAPNLAEAEAGGDF

SEQ ID NO: 138725 - protein, 30 aa, Artificial Sequence
  Description of Artificial Sequence: Synthetic polypeptide
QENEIATTNPVATECYGDVSEPALQHEMEL

SEQ ID NO: 138726 - protein, 36 aa, Artificial Sequence
  Description of Artificial Sequence: Synthetic polypeptide
DEEEIATTNPVATEQYGSACSANPNLQDSPDGQANE

SEQ ID NO: 138727 - protein, 36 aa, Artificial Sequence
  Description of Artificial Sequence: Synthetic polypeptide
DEEEIATTNPVATEQYGSACSATNNEQDQGGDINEM

SEQ ID NO: 138728 - protein, 35 aa, Artificial Sequence
  Description of Artificial Sequence: Synthetic polypeptide
DEEEICTTNPVATECYGSVATGNQGNQGGHGNGNK

SEQ ID NO: 138729 - protein, 34 aa, Artificial Sequence
  Description of Artificial Sequence: Synthetic polypeptide
DEMEIRTTNPVATEQWGSVCSACINEPEDFEGND

SEQ ID NO: 138730 - protein, 35 aa, Artificial Sequence
  Description of Artificial Sequence: Synthetic polypeptide
DEEEICTTNPVATECYGSVATGNQGNQGGHGGNTD

SEQ ID NO: 138731 - protein, 38 aa, Artificial Sequence
  Description of Artificial Sequence: Synthetic polypeptide
DEEEIRTTNPVATEQYGVVSTVVNTNLQQGTNDEDEDT

SEQ ID NO: 138732 - protein, 29 aa, Artificial Sequence
  Description of Artificial Sequence: Synthetic peptide
QEEEIKTTNPVATEQYGAIADEVGQHEEA

SEQ ID NO: 138733 - protein, 38 aa, Artificial Sequence
  Description of Artificial Sequence: Synthetic polypeptide
DEEEIRTTNPVATEQYGVVSTVVNTNLQQGTNQEQEDE

SEQ ID NO: 138734 - protein, 28 aa, Artificial Sequence
  Description of Artificial Sequence: Synthetic peptide
QEEEIKTTNPVATEHYGEAPEVCQHEEK

SEQ ID NO: 138735 - protein, 32 aa, Artificial Sequence
  Description of Artificial Sequence: Synthetic polypeptide
QEEEIHTTNPVATEQYGAVAGPEVGQGEGENQ

SEQ ID NO: 138736 - protein, 33 aa, Artificial Sequence
  Description of Artificial Sequence: Synthetic polypeptide
DEEEIATTNPVATEQYGSVAAQGGDTANPEPMR

SEQ ID NO: 138737 - protein, 38 aa, Artificial Sequence
  Description of Artificial Sequence: Synthetic polypeptide
DEEEIRTTNPVATEQYGVVSTVVNTNLQQGTNDEDEDE

SEQ ID NO: 138738 - protein, 30 aa, Artificial Sequence
  Description of Artificial Sequence: Synthetic polypeptide
QENEIATTNPVATECYGDVSECPLQEHEEL

SEQ ID NO: 138739 - protein, 34 aa, Artificial Sequence
  Description of Artificial Sequence: Synthetic polypeptide
DEEEIATTNPVATEQYGSVAAGNNQDSMGGMTVH

SEQ ID NO: 138740 - protein, 38 aa, Artificial Sequence
  Description of Artificial Sequence: Synthetic polypeptide
DEEEIRTTNPVATEQYGVVSTVVNTNLQSGNNNEQQQT

SEQ ID NO: 138741 - protein, 38 aa, Artificial Sequence
  Description of Artificial Sequence: Synthetic polypeptide
DEEEIRTTNPVATEQYGVVSTVVNTNLQSGTNNNQQQD

SEQ ID NO: 138742 - protein, 34 aa, Artificial Sequence
  Description of Artificial Sequence: Synthetic polypeptide
DEEEIATTNPVATEQYGSTVCAANMGEQPDMQNS

SEQ ID NO: 138743 - protein, 38 aa, Artificial Sequence
  Description of Artificial Sequence: Synthetic polypeptide
DEEEIRTTNPVATEQYGVVSTVVNTNLQYGNQQNEEDD

SEQ ID NO: 138744 - protein, 29 aa, Artificial Sequence
  Description of Artificial Sequence: Synthetic peptide
QENEIATTNPVATECYGDVSECPQHEHEL

SEQ ID NO: 138745 - protein, 37 aa, Artificial Sequence
  Description of Artificial Sequence: Synthetic polypeptide
DEEEIRTTNPVATEQYGSVASPTFSLVELQIVEVNSE

SEQ ID NO: 138746 - protein, 29 aa, Artificial Sequence
  Description of Artificial Sequence: Synthetic peptide
QENEIATTNPVATECYGDVSECPQNHEEL

SEQ ID NO: 138747 - protein, 31 aa, Artificial Sequence
  Description of Artificial Sequence: Synthetic polypeptide
QEEEIKTTNPVATEQYGAVAGPEVGQHGEED

SEQ ID NO: 138748 - protein, 35 aa, Artificial Sequence
  Description of Artificial Sequence: Synthetic polypeptide
DEEEICTTNPMAYEEYGSVPTNNALSQHRTGGSNP

SEQ ID NO: 138749 - protein, 38 aa, Artificial Sequence
  Description of Artificial Sequence: Synthetic polypeptide
DEEEIRTTNPVATEQYGVVSTVVNTNLQLGNQQEEEED

SEQ ID NO: 138750 - protein, 32 aa, Artificial Sequence
  Description of Artificial Sequence: Synthetic polypeptide
DEHEIRTTNPVATDQYGSVNMQEQQGSIQSPK

SEQ ID NO: 138751 - protein, 33 aa, Artificial Sequence
  Description of Artificial Sequence: Synthetic polypeptide
DEHEIRTTNPVATDQYGSVNLMVQLQQGSIQPK

SEQ ID NO: 138752 - protein, 38 aa, Artificial Sequence
  Description of Artificial Sequence: Synthetic polypeptide
DEEEIRTTNPVATEQYGVVSTVVNTNLQQGNNDEDTDT

SEQ ID NO: 138753 - protein, 32 aa, Artificial Sequence
  Description of Artificial Sequence: Synthetic polypeptide
DEEEICTTNPMATETYGSVPTPDPQHAGEEFD

SEQ ID NO: 138754 - protein, 30 aa, Artificial Sequence
  Description of Artificial Sequence: Synthetic polypeptide
QENEIATTNPVATECYGDVSECLQSHEEDL

SEQ ID NO: 138755 - protein, 33 aa, Artificial Sequence
  Description of Artificial Sequence: Synthetic polypeptide
DEEEICTTNPMAYETYGSVCTPDPQHASGENFR

SEQ ID NO: 138756 - protein, 28 aa, Artificial Sequence
  Description of Artificial Sequence: Synthetic peptide
QEEEINTTNPVATEKYGEAPEVCQHEEK

SEQ ID NO: 138757 - protein, 36 aa, Artificial Sequence
  Description of Artificial Sequence: Synthetic polypeptide
DEEEIRTTNPVATEQYGSVGSNTMGLSQQNEPEETL

SEQ ID NO: 138758 - protein, 29 aa, Artificial Sequence
  Description of Artificial Sequence: Synthetic peptide
QEEEIKTTNPVATEQYGVIAPEVMQHEEE

SEQ ID NO: 138759 - protein, 33 aa, Artificial Sequence
  Description of Artificial Sequence: Synthetic polypeptide
DEEEICTTNPMATETYGSVVTPDPQHAGEIFRT

SEQ ID NO: 138760 - protein, 33 aa, Artificial Sequence
  Description of Artificial Sequence: Synthetic polypeptide
DEEEICTTNPMATQTYGSVPTPDPQHASGENFR

SEQ ID NO: 138761 - protein, 35 aa, Artificial Sequence
  Description of Artificial Sequence: Synthetic polypeptide
QEEEIKTTNPVATEQYGSVIADNLDGEGQGGNEQI

SEQ ID NO: 138762 - protein, 37 aa, Artificial Sequence
  Description of Artificial Sequence: Synthetic polypeptide
DEEEIRTTNPVATEQYGSVGSNTMGLSQQNMGPEEYL

SEQ ID NO: 138763 - protein, 38 aa, Artificial Sequence
  Description of Artificial Sequence: Synthetic polypeptide
DEEEIRTTNPVATEQYGVVSTVVNTNLQQGTEETGNTD

SEQ ID NO: 138764 - protein, 33 aa, Artificial Sequence
  Description of Artificial Sequence: Synthetic polypeptide
DEEEIATTNPVATEQYGSVAATPEDPGEAGSLS

SEQ ID NO: 138765 - protein, 37 aa, Artificial Sequence
  Description of Artificial Sequence: Synthetic polypeptide
DEEEIRTTNPVATEQYGVVSTTNQQQQNNNQQGNNTE

SEQ ID NO: 138766 - protein, 36 aa, Artificial Sequence
  Description of Artificial Sequence: Synthetic polypeptide
AEEEIRTTNPVATEQYGSVSVVSNNGQQGTNQNNQD

SEQ ID NO: 138767 - protein, 31 aa, Artificial Sequence
  Description of Artificial Sequence: Synthetic polypeptide
DEMEIRTTNPVATEQWGDVCSEIEMNAAENA

SEQ ID NO: 138768 - protein, 35 aa, Artificial Sequence
  Description of Artificial Sequence: Synthetic polypeptide
DEEEIATTNPVATEQYGSMSSTTPAGPNMRGMNPV

SEQ ID NO: 138769 - protein, 36 aa, Artificial Sequence
  Description of Artificial Sequence: Synthetic polypeptide
AEEEIRTTNPVATEQYGSVSVVTNNNNAEQGNNTNQ

SEQ ID NO: 138770 - protein, 37 aa, Artificial Sequence
  Description of Artificial Sequence: Synthetic polypeptide
AEEEIRTTNPVATEQYGSVSVVTNNNNQQLGNNNQDE

SEQ ID NO: 138771 - protein, 35 aa, Artificial Sequence
  Description of Artificial Sequence: Synthetic polypeptide
DEEEICTTNPVATECYGEVSTGNEGNQGNHGNNND

SEQ ID NO: 138772 - protein, 35 aa, Artificial Sequence
  Description of Artificial Sequence: Synthetic polypeptide
DEEEIATTNPVATEQYGSCSGTGNPDNSEHGTVRG

SEQ ID NO: 138773 - protein, 30 aa, Artificial Sequence
  Description of Artificial Sequence: Synthetic polypeptide
QENEIATTNPVATECYGDVSECWLQHEEEL

SEQ ID NO: 138774 - protein, 31 aa, Artificial Sequence
  Description of Artificial Sequence: Synthetic polypeptide
QENEIATTNPVATECYGDVSEDLQDHEGEDL

SEQ ID NO: 138775 - protein, 35 aa, Artificial Sequence
  Description of Artificial Sequence: Synthetic polypeptide
DEEEICTTNPVATECYGSVATGNGNQGNHGGNGND

SEQ ID NO: 138776 - protein, 37 aa, Artificial Sequence
  Description of Artificial Sequence: Synthetic polypeptide
DEEEIRTTNPVATEQYGVVSTVVNTNNQQQGTEQGNQ

SEQ ID NO: 138777 - protein, 30 aa, Artificial Sequence
  Description of Artificial Sequence: Synthetic polypeptide
DEMEIRTTNPVATEQWGDVSEIEMNAAEDA

SEQ ID NO: 138778 - protein, 30 aa, Artificial Sequence
  Description of Artificial Sequence: Synthetic polypeptide
DEMEIRTTNPVATEQWGDVSEIEMNIAEDE

SEQ ID NO: 138779 - protein, 34 aa, Artificial Sequence
  Description of Artificial Sequence: Synthetic polypeptide
DEEEIATTNPVATEQYGSCPAANNDQGSEEGNQE

SEQ ID NO: 138780 - protein, 37 aa, Artificial Sequence
  Description of Artificial Sequence: Synthetic polypeptide
AEEEIRTTNPVATEQYGSVSVVTTNNQNQQIGTNNTE

SEQ ID NO: 138781 - protein, 30 aa, Artificial Sequence
  Description of Artificial Sequence: Synthetic polypeptide
DEMEIRTTNPVATEQWGDVSEIEMFAAEDA

SEQ ID NO: 138782 - protein, 34 aa, Artificial Sequence
  Description of Artificial Sequence: Synthetic polypeptide
DEEEIATTNPVATEQYGSTCAMTEHLEARDQDPR

SEQ ID NO: 138783 - protein, 36 aa, Artificial Sequence
  Description of Artificial Sequence: Synthetic polypeptide
DEEEIATTNPVATEQYGSMSSTTPAGPQMRNGMNPV

SEQ ID NO: 138784 - protein, 36 aa, Artificial Sequence
  Description of Artificial Sequence: Synthetic polypeptide
DEEEIRTTNPVATEQYGSVASPQFSLELQIVPVNVL

SEQ ID NO: 138785 - protein, 36 aa, Artificial Sequence
  Description of Artificial Sequence: Synthetic polypeptide
DEEEIRTTNPVATEQYGSVGSNVGDPGQEDQEGGNT

SEQ ID NO: 138786 - protein, 37 aa, Artificial Sequence
  Description of Artificial Sequence: Synthetic polypeptide
AEEEIRTTNPVATEQYGSVSVVSNNLQQGTNGNNEQD

SEQ ID NO: 138787 - protein, 36 aa, Artificial Sequence
  Description of Artificial Sequence: Synthetic polypeptide
DEEEIRTTNPVATEQYGSVGSPMNMVIQMRPPEEDE

SEQ ID NO: 138788 - protein, 37 aa, Artificial Sequence
  Description of Artificial Sequence: Synthetic polypeptide
AEEEIRTTNPVATEQYGSVSVVSTNNQQQGTQGNNTD

SEQ ID NO: 138789 - protein, 37 aa, Artificial Sequence
  Description of Artificial Sequence: Synthetic polypeptide
AEEEIRTTNPVATEQYGSVSVVSTNQQQGTIGTNNQD

SEQ ID NO: 138790 - protein, 30 aa, Artificial Sequence
  Description of Artificial Sequence: Synthetic polypeptide
DEMEIRTTNPVATEQWGAVSEVEMIAAEDA

SEQ ID NO: 138791 - protein, 35 aa, Artificial Sequence
  Description of Artificial Sequence: Synthetic polypeptide
DEEEIATTNPVATEQYGSMSSTTPTGPNMRGMNPV

SEQ ID NO: 138792 - protein, 36 aa, Artificial Sequence
  Description of Artificial Sequence: Synthetic polypeptide
DEEEIRTTNPVATEQYGSVASPTFSLEQPIVEVQVL

SEQ ID NO: 138793 - protein, 32 aa, Artificial Sequence
  Description of Artificial Sequence: Synthetic polypeptide
DEMEIRTTNPVATEQWGDVCSAEGPMNAEGNA

SEQ ID NO: 138794 - protein, 36 aa, Artificial Sequence
  Description of Artificial Sequence: Synthetic polypeptide
DEEEIRTTNPVATEQYGSVGSPWNNLQVTEFEVLIQ

SEQ ID NO: 138795 - protein, 36 aa, Artificial Sequence
  Description of Artificial Sequence: Synthetic polypeptide
DEEEIATTNPVATEQYGSMSSTTPTGPQMRNGMNPV

SEQ ID NO: 138796 - protein, 37 aa, Artificial Sequence
  Description of Artificial Sequence: Synthetic polypeptide
AEEEIRTTNPVATEQYGSVSVVTNNNLGNLQGNNQNQ

SEQ ID NO: 138797 - protein, 29 aa, Artificial Sequence
  Description of Artificial Sequence: Synthetic peptide
QENEIATTNPVATECYGDVSECRQHEREL

SEQ ID NO: 138798 - protein, 30 aa, Artificial Sequence
  Description of Artificial Sequence: Synthetic polypeptide
QENEIATTNPVATECYGDVSECTLQHEELC

SEQ ID NO: 138799 - protein, 37 aa, Artificial Sequence
  Description of Artificial Sequence: Synthetic polypeptide
AEEEIRTTNPVATEQYGSVSVVSVNLQQGTNANNQQD

SEQ ID NO: 138800 - protein, 33 aa, Artificial Sequence
  Description of Artificial Sequence: Synthetic polypeptide
DEMEIATTNPVATTQWGCVSRTNPDERQGDNEP

SEQ ID NO: 138801 - protein, 32 aa, Artificial Sequence
  Description of Artificial Sequence: Synthetic polypeptide
DEMEIATTNPVATTQWGCVSRTNDGEQQSNEP

SEQ ID NO: 138802 - protein, 35 aa, Artificial Sequence
  Description of Artificial Sequence: Synthetic polypeptide
QEEEIRTTNPVATEQYGSVNDDLQSEQGEFENGEE

SEQ ID NO: 138803 - protein, 37 aa, Artificial Sequence
  Description of Artificial Sequence: Synthetic polypeptide
DEEEIRTTNPVATEQYGSVCSTTPADNAERSGSQPVA

SEQ ID NO: 138804 - protein, 37 aa, Artificial Sequence
  Description of Artificial Sequence: Synthetic polypeptide
DEEEIRTTNPVATEQYGVVSTVQQQQNNQQGTNVATE

SEQ ID NO: 138805 - protein, 34 aa, Artificial Sequence
  Description of Artificial Sequence: Synthetic polypeptide
DEEEIATTNPVATEQYGSVCAMGLGAPGEQMEGR

SEQ ID NO: 138806 - protein, 37 aa, Artificial Sequence
  Description of Artificial Sequence: Synthetic polypeptide
DEEEIRTTNPVATEQYGSVCSTTPADNAEYFGGNPVS

SEQ ID NO: 138807 - protein, 36 aa, Artificial Sequence
  Description of Artificial Sequence: Synthetic polypeptide
DEEEIRTTNPVATEQYGSVCSTTPADNEEHFGSDPV

SEQ ID NO: 138808 - protein, 35 aa, Artificial Sequence
  Description of Artificial Sequence: Synthetic polypeptide
DEEEIRTTNPVATEQYGSVDSTMEMTDDGQGEDGQ

SEQ ID NO: 138809 - protein, 37 aa, Artificial Sequence
  Description of Artificial Sequence: Synthetic polypeptide
DEEEIRTTNPVATEQYGSVCSTTPADNIENFGMNPVI

SEQ ID NO: 138810 - protein, 37 aa, Artificial Sequence
  Description of Artificial Sequence: Synthetic polypeptide
DEEEIRTTNPVATEQYGVVSTVNVNNLQQGTTTEETD

SEQ ID NO: 138811 - protein, 37 aa, Artificial Sequence
  Description of Artificial Sequence: Synthetic polypeptide
DEEEIRTTNPVATEQYGSVCSTTPADNNERFGSQPVL

SEQ ID NO: 138812 - protein, 37 aa, Artificial Sequence
  Description of Artificial Sequence: Synthetic polypeptide
DEEEIRTTNPVATEQYGVVSTVNTTNQQAGNNQEQET

SEQ ID NO: 138813 - protein, 36 aa, Artificial Sequence
  Description of Artificial Sequence: Synthetic polypeptide
DAEEIRTTNPVATEQYGSVSSTTPAGPNMRNGNNPV

SEQ ID NO: 138814 - protein, 31 aa, Artificial Sequence
  Description of Artificial Sequence: Synthetic polypeptide
QEGEIACTNPVATEQYGCVATNLQAPEEDTA

SEQ ID NO: 138815 - protein, 36 aa, Artificial Sequence
  Description of Artificial Sequence: Synthetic polypeptide
DAEEIRTTNPVATEQYGSVSSTTPAGPNMRNGMNPV

SEQ ID NO: 138816 - protein, 36 aa, Artificial Sequence
  Description of Artificial Sequence: Synthetic polypeptide
DAEEIRTTNPVATEQYGSVLSTTPAGPNMRNGMNPV

SEQ ID NO: 138817 - protein, 36 aa, Artificial Sequence
  Description of Artificial Sequence: Synthetic polypeptide
DEEEIATTNPVATEQYGSVCAMNNALDPMAPGMNRM

SEQ ID NO: 138818 - protein, 36 aa, Artificial Sequence
  Description of Artificial Sequence: Synthetic polypeptide
DEEEIRTTNPVATEQYGSVCSTTPAGEIEYFGSNPV

SEQ ID NO: 138819 - protein, 37 aa, Artificial Sequence
  Description of Artificial Sequence: Synthetic polypeptide
DEEEIRTTNPVATEQYGSVCSTTPAGETERFGSNPVA

SEQ ID NO: 138820 - protein, 33 aa, Artificial Sequence
  Description of Artificial Sequence: Synthetic polypeptide
DELEIVTTNPVATEQYGTVCSATDGPVEFEGND

SEQ ID NO: 138821 - protein, 33 aa, Artificial Sequence
  Description of Artificial Sequence: Synthetic polypeptide
DELEIVTTNPVATEQYGTVCSATDPPVEFEGND

SEQ ID NO: 138822 - protein, 38 aa, Artificial Sequence
  Description of Artificial Sequence: Synthetic polypeptide
DEEEIRTTNPVATEQYGVVSTVNQQQQNLQAGNTEQGQ

SEQ ID NO: 138823 - protein, 28 aa, Artificial Sequence
  Description of Artificial Sequence: Synthetic peptide
QEGEIAPTNPCASEQYGIVSCNEMSGDA

SEQ ID NO: 138824 - protein, 30 aa, Artificial Sequence
  Description of Artificial Sequence: Synthetic polypeptide
QEGEIAPTNPCASEQYGIVSCINLQSGETG

SEQ ID NO: 138825 - protein, 29 aa, Artificial Sequence
  Description of Artificial Sequence: Synthetic peptide
QEGEIAPTNPCASEQYGIVSCDNPEFGTR

SEQ ID NO: 138826 - protein, 37 aa, Artificial Sequence
  Description of Artificial Sequence: Synthetic polypeptide
DEEEIRTTNPVATEQYGSVCSTTPADENERFGSNPVS

SEQ ID NO: 138827 - protein, 37 aa, Artificial Sequence
  Description of Artificial Sequence: Synthetic polypeptide
AEEEIRTTNPVATEQYGSVSVSVTNNNTQQGSTNEQE

SEQ ID NO: 138828 - protein, 37 aa, Artificial Sequence
  Description of Artificial Sequence: Synthetic polypeptide
DEEEIRTTNPVATEQYGSVDSQGVNELDMRQGQMQQD

SEQ ID NO: 138829 - protein, 37 aa, Artificial Sequence
  Description of Artificial Sequence: Synthetic polypeptide
DEEEIRTTNPVATEQYGVVSTVNQQQQQGTNEEEDEE

SEQ ID NO: 138830 - protein, 36 aa, Artificial Sequence
  Description of Artificial Sequence: Synthetic polypeptide
DEEEIRTTNPVATEQYGVVSTVNQQQQQNNEETEED

SEQ ID NO: 138831 - protein, 38 aa, Artificial Sequence
  Description of Artificial Sequence: Synthetic polypeptide
DEEEIRTTNPVATEQYGVVSTVNTNLQQGTEQGNNNTE

SEQ ID NO: 138832 - protein, 34 aa, Artificial Sequence
  Description of Artificial Sequence: Synthetic polypeptide
DAEEIRSTNPVATEQYGSVSPTNSGPETRMEQQE

SEQ ID NO: 138833 - protein, 36 aa, Artificial Sequence
  Description of Artificial Sequence: Synthetic polypeptide
DEEEIATTNPVATEQYGSVCAMNNGEPQDQGGNPRE

SEQ ID NO: 138834 - protein, 34 aa, Artificial Sequence
  Description of Artificial Sequence: Synthetic polypeptide
DEEEIRTTNPVATEQYGSVDSPVIELNVPILQLE

SEQ ID NO: 138835 - protein, 38 aa, Artificial Sequence
  Description of Artificial Sequence: Synthetic polypeptide
DEEEIRTTNPVATEQYGVVSTVSTNLQAGTEQGTEETE

SEQ ID NO: 138836 - protein, 38 aa, Artificial Sequence
  Description of Artificial Sequence: Synthetic polypeptide
DEEEIRTTNPVATEQYGVVSTVSTNLQQGTEQGTDEEE

SEQ ID NO: 138837 - protein, 37 aa, Artificial Sequence
  Description of Artificial Sequence: Synthetic polypeptide
DEEEIRTTNPVATEQYGSVCSTTPADDPNERSGSNPV

SEQ ID NO: 138838 - protein, 38 aa, Artificial Sequence
  Description of Artificial Sequence: Synthetic polypeptide
DEEEIRTTNPVATEQYGVVSTVTNLQAGNQAGTNDEED

SEQ ID NO: 138839 - protein, 38 aa, Artificial Sequence
  Description of Artificial Sequence: Synthetic polypeptide
DEEEIRTTNPVATEQYGVVSTVTNLQAGNQAGTTNVEE

SEQ ID NO: 138840 - protein, 37 aa, Artificial Sequence
  Description of Artificial Sequence: Synthetic polypeptide
DEEEIATTNPVATEQYGSVCAGTDGLTQPDDEMGNRA

SEQ ID NO: 138841 - protein, 35 aa, Artificial Sequence
  Description of Artificial Sequence: Synthetic polypeptide
DEEEIATTNPVATEQYGSVCAGPDNLQNDDLGAQA

SEQ ID NO: 138842 - protein, 38 aa, Artificial Sequence
  Description of Artificial Sequence: Synthetic polypeptide
DEEEIRTTNPVATEQYGVVSTVTNLQAGNQENQNETTD

SEQ ID NO: 138843 - protein, 28 aa, Artificial Sequence
  Description of Artificial Sequence: Synthetic peptide
QEFEIATTNPVATEQYGEAVEVCQHEEK

SEQ ID NO: 138844 - protein, 33 aa, Artificial Sequence
  Description of Artificial Sequence: Synthetic polypeptide
DEEEIATTNPVATEQYGSVCAGTDPPTDDQGEQ

SEQ ID NO: 138845 - protein, 33 aa, Artificial Sequence
  Description of Artificial Sequence: Synthetic polypeptide
DEHEIRTTNPVAYEQWGSVSHGLDDRQNMNANN

SEQ ID NO: 138846 - protein, 28 aa, Artificial Sequence
  Description of Artificial Sequence: Synthetic peptide
QEFEIATTNPVATEQYGEAPEVCQHETK

SEQ ID NO: 138847 - protein, 38 aa, Artificial Sequence
  Description of Artificial Sequence: Synthetic polypeptide
DEEEIRTTNPVATEQYGVVSTVTNLQAGNQQGTTEDED

SEQ ID NO: 138848 - protein, 34 aa, Artificial Sequence
  Description of Artificial Sequence: Synthetic polypeptide
DEEEIATTNPVATEQYGSVCSVGDDIDPGAQMER

SEQ ID NO: 138849 - protein, 28 aa, Artificial Sequence
  Description of Artificial Sequence: Synthetic peptide
QEFEIATTNPVATEQYGEAPEVCQHEEK

SEQ ID NO: 138850 - protein, 28 aa, Artificial Sequence
  Description of Artificial Sequence: Synthetic peptide
QEFEIASTNPVGTEGYGVMASTLQHGDI

SEQ ID NO: 138851 - protein, 33 aa, Artificial Sequence
  Description of Artificial Sequence: Synthetic polypeptide
DEHEIRTTNPVAYEQWGSVSGGNGNMAGEGNTS

SEQ ID NO: 138852 - protein, 38 aa, Artificial Sequence
  Description of Artificial Sequence: Synthetic polypeptide
DEEEIRTTNPVATEQYGVVSTVTNLQAGNQQGTEQGED

SEQ ID NO: 138853 - protein, 31 aa, Artificial Sequence
  Description of Artificial Sequence: Synthetic polypeptide
QEGEIAPTNPCSTEQYGIVSACNLQDSEGTR

SEQ ID NO: 138854 - protein, 28 aa, Artificial Sequence
  Description of Artificial Sequence: Synthetic peptide
QEGCIAPTNPCSSEQYGIVSCNLQSGTH

SEQ ID NO: 138855 - protein, 35 aa, Artificial Sequence
  Description of Artificial Sequence: Synthetic polypeptide
DEEEIATTNPVATEQYGSVCAGTNGLADRPLDEAM

SEQ ID NO: 138856 - protein, 38 aa, Artificial Sequence
  Description of Artificial Sequence: Synthetic polypeptide
DEEEIRTTNPVATEQYGVVSTVTGNNNLQQGTEEGAND

SEQ ID NO: 138857 - protein, 37 aa, Artificial Sequence
  Description of Artificial Sequence: Synthetic polypeptide
DEEEIRTTNPVATEQYGVVSTVTNANNQQGNNEEQQD

SEQ ID NO: 138858 - protein, 38 aa, Artificial Sequence
  Description of Artificial Sequence: Synthetic polypeptide
DEEEIRTTNPVATEQYGVVSTVTNLNQQGNEQGTTEDE

SEQ ID NO: 138859 - protein, 33 aa, Artificial Sequence
  Description of Artificial Sequence: Synthetic polypeptide
DEHEIRTTNPVAYEQWGSVSHPLPDDRQNMNNN

SEQ ID NO: 138860 - protein, 33 aa, Artificial Sequence
  Description of Artificial Sequence: Synthetic polypeptide
DEHEIRTTNPVAYEQWGSVSHPLDDRQNDNVAE

SEQ ID NO: 138861 - protein, 32 aa, Artificial Sequence
  Description of Artificial Sequence: Synthetic polypeptide
DEMAIRTTNPVATEQYGCFCSTEDINFGSNQS

SEQ ID NO: 138862 - protein, 34 aa, Artificial Sequence
  Description of Artificial Sequence: Synthetic polypeptide
DEEEIATTNPVATEQYGSVCAGTGPAPGEQMEGN

SEQ ID NO: 138863 - protein, 38 aa, Artificial Sequence
  Description of Artificial Sequence: Synthetic polypeptide
DEEEIRTTNPVATEQYGVVSTVTNLQAGNQAGTEAGND

SEQ ID NO: 138864 - protein, 32 aa, Artificial Sequence
  Description of Artificial Sequence: Synthetic polypeptide
DEMAIRTTNPVATEQYGCFCSTEHIYFGSNQA

SEQ ID NO: 138865 - protein, 36 aa, Artificial Sequence
  Description of Artificial Sequence: Synthetic polypeptide
DEEEIATTNPVATEQYGSVCAGTNPLQEHQDGDQHQ

SEQ ID NO: 138866 - protein, 38 aa, Artificial Sequence
  Description of Artificial Sequence: Synthetic polypeptide
DEEEIRTTNPVATEQYGVVSTVTNLQAGNQAGTETGSE

SEQ ID NO: 138867 - protein, 32 aa, Artificial Sequence
  Description of Artificial Sequence: Synthetic polypeptide
DEMAIRTTNPVATEQYGCFCSTNHNIGFGSEQ

SEQ ID NO: 138868 - protein, 28 aa, Artificial Sequence
  Description of Artificial Sequence: Synthetic peptide
QEGEIAATNPCSSTQYGIVSCNLQSGTM

SEQ ID NO: 138869 - protein, 33 aa, Artificial Sequence
  Description of Artificial Sequence: Synthetic polypeptide
DEMAIRTTNPVATEQYGCFCSTPHNINFGSNQS

SEQ ID NO: 138870 - protein, 34 aa, Artificial Sequence
  Description of Artificial Sequence: Synthetic polypeptide
DEEEIATTNPVATEQYGSVCAHNPEEADNQENNH

SEQ ID NO: 138871 - protein, 37 aa, Artificial Sequence
  Description of Artificial Sequence: Synthetic polypeptide
DEEEIRTTNPVATEQYGVVSTVNQQQQNGNNEQGSTE

SEQ ID NO: 138872 - protein, 33 aa, Artificial Sequence
  Description of Artificial Sequence: Synthetic polypeptide
DELEIVTTNPVATEQYGTVCSATDGPGEFEGND

SEQ ID NO: 138873 - protein, 30 aa, Artificial Sequence
  Description of Artificial Sequence: Synthetic polypeptide
QEGEIAPTNPCSTEQYGIVSACDGLQSGTR

SEQ ID NO: 138874 - protein, 35 aa, Artificial Sequence
  Description of Artificial Sequence: Synthetic polypeptide
DEEEIRTTNPVATEQYGSVCSVDNNHNIDAMGEGA

SEQ ID NO: 138875 - protein, 28 aa, Artificial Sequence
  Description of Artificial Sequence: Synthetic peptide
QEGEIAPTNPCSSWQYGIVSCNLQSGTV

SEQ ID NO: 138876 - protein, 34 aa, Artificial Sequence
  Description of Artificial Sequence: Synthetic polypeptide
DEHEIRTTNPVAYEQWGVVVPTDNDGDQAGGMNR

SEQ ID NO: 138877 - protein, 36 aa, Artificial Sequence
  Description of Artificial Sequence: Synthetic polypeptide
DELEIRTTNPVATEQYGSVSSTTPAGPNMRNGMNPV

SEQ ID NO: 138878 - protein, 37 aa, Artificial Sequence
  Description of Artificial Sequence: Synthetic polypeptide
DEEEIRTTNPVATEQYGVVSTVNQQQGNNNQEDTTDT

SEQ ID NO: 138879 - protein, 37 aa, Artificial Sequence
  Description of Artificial Sequence: Synthetic polypeptide
DEEEIRTTNPVATEQYGVVSTVNQQQGNNNQQGNVDE

SEQ ID NO: 138880 - protein, 37 aa, Artificial Sequence
  Description of Artificial Sequence: Synthetic polypeptide
DEEEIRTTNPVATEQYGVVSTVNQQQGNNDEEGTNDT

SEQ ID NO: 138881 - protein, 33 aa, Artificial Sequence
  Description of Artificial Sequence: Synthetic polypeptide
DEHEIRTTNPVAYEQWGVVSTTNHNNDAGNNSI

SEQ ID NO: 138882 - protein, 37 aa, Artificial Sequence
  Description of Artificial Sequence: Synthetic polypeptide
DEEEIRTTNPVATEQYGVVSTVNQQQGNNQGEDTNDE

SEQ ID NO: 138883 - protein, 37 aa, Artificial Sequence
  Description of Artificial Sequence: Synthetic polypeptide
DEEEIRTTNPVATEQYGVVSTVNQQQGNNQNGNNNQD

SEQ ID NO: 138884 - protein, 37 aa, Artificial Sequence
  Description of Artificial Sequence: Synthetic polypeptide
DEEEIRTTNPVATEQYGVVSTVNQQQGNNQQGTEGQE

SEQ ID NO: 138885 - protein, 37 aa, Artificial Sequence
  Description of Artificial Sequence: Synthetic polypeptide
DEEEIRTTNPVATEQYGVVSTVNQQQGNNQQIGTDTE

SEQ ID NO: 138886 - protein, 34 aa, Artificial Sequence
  Description of Artificial Sequence: Synthetic polypeptide
DEHEIRTTNPVAYEQWGVVCSTNDGEHQGGNTTS

SEQ ID NO: 138887 - protein, 33 aa, Artificial Sequence
  Description of Artificial Sequence: Synthetic polypeptide
DEHEIRTTNPVAYEQWGTYVYTIDMLDRGNGSD

SEQ ID NO: 138888 - protein, 37 aa, Artificial Sequence
  Description of Artificial Sequence: Synthetic polypeptide
DEEEIRTTNPVATEQYGVVSTVNQQQGNNQEETTEDE

SEQ ID NO: 138889 - protein, 32 aa, Artificial Sequence
  Description of Artificial Sequence: Synthetic polypeptide
DEHEIRTTNPVAYEQWGTVSTTNGGNMGTGTS

SEQ ID NO: 138890 - protein, 34 aa, Artificial Sequence
  Description of Artificial Sequence: Synthetic polypeptide
DEHEIRTTNPVAYEQYGHTVQACTHLSQRLSGVT

SEQ ID NO: 138891 - protein, 36 aa, Artificial Sequence
  Description of Artificial Sequence: Synthetic polypeptide
DEEEIATTNPVATEQYGSVCSTNDQPQEHQDGTADK

SEQ ID NO: 138892 - protein, 28 aa, Artificial Sequence
  Description of Artificial Sequence: Synthetic peptide
QEGEIAPTNPCSSHEYGIVSCNLQSGTR

SEQ ID NO: 138893 - protein, 35 aa, Artificial Sequence
  Description of Artificial Sequence: Synthetic polypeptide
DEEEIRTTNPVATEQYGSVCSWDPNVQTQMVQQAD

SEQ ID NO: 138894 - protein, 28 aa, Artificial Sequence
  Description of Artificial Sequence: Synthetic peptide
QEGEIAPTNPCSSMQYGIVSCNLQSHTR

SEQ ID NO: 138895 - protein, 36 aa, Artificial Sequence
  Description of Artificial Sequence: Synthetic polypeptide
DEEEIATTNPVATEQYGSVCSPVGNLPLDSGEENHN

SEQ ID NO: 138896 - protein, 33 aa, Artificial Sequence
  Description of Artificial Sequence: Synthetic polypeptide
DAEEIATTNPVAYEQYGSVSAGNNQDSGGMTVH

SEQ ID NO: 138897 - protein, 36 aa, Artificial Sequence
  Description of Artificial Sequence: Synthetic polypeptide
DEEEIATTNPVATEQYGSVCSTNDPQQEHQDGTAMK

SEQ ID NO: 138898 - protein, 37 aa, Artificial Sequence
  Description of Artificial Sequence: Synthetic polypeptide
DEEEIRTTNPVATEQYGVVSTVNQQQGNNANQQGNTE

SEQ ID NO: 138899 - protein, 28 aa, Artificial Sequence
  Description of Artificial Sequence: Synthetic peptide
QEGEIAPTNPCSSTQYGIVSCNLQSGTH

SEQ ID NO: 138900 - protein, 37 aa, Artificial Sequence
  Description of Artificial Sequence: Synthetic polypeptide
DEEEIRTTNPVATEQYGVVSTVNQQQAGNNNQTEETD

SEQ ID NO: 138901 - protein, 37 aa, Artificial Sequence
  Description of Artificial Sequence: Synthetic polypeptide
DEEEIRTTNPVATEQYGVVSTVNQQQGGNQQSTEEDE

SEQ ID NO: 138902 - protein, 37 aa, Artificial Sequence
  Description of Artificial Sequence: Synthetic polypeptide
DEEEIRTTNPVATEQYGVVSTVNQQQGNANNEEEDED

SEQ ID NO: 138903 - protein, 35 aa, Artificial Sequence
  Description of Artificial Sequence: Synthetic polypeptide
DELEIRTTNPVATEQYGSVMPTVGDETTQSGQDNQ

SEQ ID NO: 138904 - protein, 36 aa, Artificial Sequence
  Description of Artificial Sequence: Synthetic polypeptide
DELEIRTTNPVATEQYGSVSSHTPAGPNMRNGMNPV

SEQ ID NO: 138905 - protein, 31 aa, Artificial Sequence
  Description of Artificial Sequence: Synthetic polypeptide
DAEEIATTNPVAYEQYGVVAASNLNTDNNNT

SEQ ID NO: 138906 - protein, 31 aa, Artificial Sequence
  Description of Artificial Sequence: Synthetic polypeptide
QEGEIAPTNPCASEQYGSVSSTCNGQSGTPV

SEQ ID NO: 138907 - protein, 29 aa, Artificial Sequence
  Description of Artificial Sequence: Synthetic peptide
QEFEIASTNPVGTEGYGGVMASTLQHGDI

SEQ ID NO: 138908 - protein, 36 aa, Artificial Sequence
  Description of Artificial Sequence: Synthetic polypeptide
DELEIRTTNPVATEQYGSVSSTTPAHPNMRNGMNPV

SEQ ID NO: 138909 - protein, 31 aa, Artificial Sequence
  Description of Artificial Sequence: Synthetic polypeptide
DEHEIRTTNPVAYEQWGTVSKEIEMRAGEDE

SEQ ID NO: 138910 - protein, 33 aa, Artificial Sequence
  Description of Artificial Sequence: Synthetic polypeptide
DEHEIRTTNPVAYEQWGSVSTTGPQGLTGQDGS

SEQ ID NO: 138911 - protein, 37 aa, Artificial Sequence
  Description of Artificial Sequence: Synthetic polypeptide
DEEEIRTTNPVATEQYGVVSTVNQQQLQQNTEQGTTD

SEQ ID NO: 138912 - protein, 34 aa, Artificial Sequence
  Description of Artificial Sequence: Synthetic polypeptide
DEHEIRTTNPVAYEQWGSVSTTGPEQGLTGNDDS

SEQ ID NO: 138913 - protein, 37 aa, Artificial Sequence
  Description of Artificial Sequence: Synthetic polypeptide
DEEEIRTTNPVATEQYGSVDSPMMTLINHRLNEQSGQ

SEQ ID NO: 138914 - protein, 37 aa, Artificial Sequence
  Description of Artificial Sequence: Synthetic polypeptide
DEEEIRTTNPVATEQYGVVSTVNQQQNNGNNTEQGED

SEQ ID NO: 138915 - protein, 36 aa, Artificial Sequence
  Description of Artificial Sequence: Synthetic polypeptide
DEEEIRTTNPVATEQYGSVDSPMPLLQEHVLTVANV

SEQ ID NO: 138916 - protein, 35 aa, Artificial Sequence
  Description of Artificial Sequence: Synthetic polypeptide
DEEEIRTTNPVATEQYGSVDSPINNVEEELGEELD

SEQ ID NO: 138917 - protein, 37 aa, Artificial Sequence
  Description of Artificial Sequence: Synthetic polypeptide
DEEEIRTTNPVATEQYGSVDSPTINLEEFEQQPEVYI

SEQ ID NO: 138918 - protein, 38 aa, Artificial Sequence
  Description of Artificial Sequence: Synthetic polypeptide
DEEEIRTTNPVATEQYGVVSTVNLQQGNTEAGTTDTQD

SEQ ID NO: 138919 - protein, 28 aa, Artificial Sequence
  Description of Artificial Sequence: Synthetic peptide
QEGEIAPTNPCSTEQYGIMACNLQHGDI

SEQ ID NO: 138920 - protein, 31 aa, Artificial Sequence
  Description of Artificial Sequence: Synthetic polypeptide
DAEEIATTNPVGTEQWGGCCATNLADRPDRW

SEQ ID NO: 138921 - protein, 37 aa, Artificial Sequence
  Description of Artificial Sequence: Synthetic polypeptide
DEEEIRTTNPVATEQYGVVSTVNQQQNQQQGTNEDED

SEQ ID NO: 138922 - protein, 37 aa, Artificial Sequence
  Description of Artificial Sequence: Synthetic polypeptide
DEEEIRTTNPVATEQYGVVSTVNQQQQGNNNQQGETD

SEQ ID NO: 138923 - protein, 37 aa, Artificial Sequence
  Description of Artificial Sequence: Synthetic polypeptide
DEEEIRTTNPVATEQYGVVSTVNQQQQLQQGTTEEGS

SEQ ID NO: 138924 - protein, 37 aa, Artificial Sequence
  Description of Artificial Sequence: Synthetic polypeptide
DEEEIRTTNPVATEQYGSVDSPTINLIEFEQQPEAYQ

SEQ ID NO: 138925 - protein, 37 aa, Artificial Sequence
  Description of Artificial Sequence: Synthetic polypeptide
DEEEIRTTNPVATEQYGVVSTVNQQQGNQAQGTEQGQ

SEQ ID NO: 138926 - protein, 38 aa, Artificial Sequence
  Description of Artificial Sequence: Synthetic polypeptide
DEEEIRTTNPVATEQYGVVSTVNQQQLQEGTNVATNEQ

SEQ ID NO: 138927 - protein, 34 aa, Artificial Sequence
  Description of Artificial Sequence: Synthetic polypeptide
DEEEIRTTNPVATEQYGSVDSPHEELNVPIMQLT

SEQ ID NO: 138928 - protein, 37 aa, Artificial Sequence
  Description of Artificial Sequence: Synthetic polypeptide
DEEEIRTTNPVATEQYGVVSTVNQQQGNQQGNNNNED

SEQ ID NO: 138929 - protein, 33 aa, Artificial Sequence
  Description of Artificial Sequence: Synthetic polypeptide
DEHEIRTTNPVAYEQWGTISHTDNHQREGTGQE

SEQ ID NO: 138930 - protein, 33 aa, Artificial Sequence
  Description of Artificial Sequence: Synthetic polypeptide
DEHEIRTTNPVAYEQWGTISHTDNHQREDGAGM

SEQ ID NO: 138931 - protein, 37 aa, Artificial Sequence
  Description of Artificial Sequence: Synthetic polypeptide
DEEEIRTTNPVATEQYGVVSTVNQQQGNQQGNTNTDD

SEQ ID NO: 138932 - protein, 37 aa, Artificial Sequence
  Description of Artificial Sequence: Synthetic polypeptide
DEEEIRTTNPVATEQYGVVSTVNQQQGNQQGTNEENE

SEQ ID NO: 138933 - protein, 37 aa, Artificial Sequence
  Description of Artificial Sequence: Synthetic polypeptide
DEEEIRTTNPVATEQYGVVSTVNQQQGNQQGTTDGTD

SEQ ID NO: 138934 - protein, 38 aa, Artificial Sequence
  Description of Artificial Sequence: Synthetic polypeptide
DEEEIRTTNPVATEQYGVVSTVNQQQLQAGTNVTEDEE

SEQ ID NO: 138935 - protein, 37 aa, Artificial Sequence
  Description of Artificial Sequence: Synthetic polypeptide
DEEEIRTTNPVATEQYGVVSTVNQQQGNQQIGTTEDE

SEQ ID NO: 138936 - protein, 37 aa, Artificial Sequence
  Description of Artificial Sequence: Synthetic polypeptide
DEEEIRTTNPVATEQYGVVSTVNQQQGNQQSNNNNQD

SEQ ID NO: 138937 - protein, 37 aa, Artificial Sequence
  Description of Artificial Sequence: Synthetic polypeptide
DEEEIRTTNPVATEQYGSVCSTTPAHNNERSGSDPVA

SEQ ID NO: 138938 - protein, 35 aa, Artificial Sequence
  Description of Artificial Sequence: Synthetic polypeptide
DEEEIRTTNPVATEQYGSVDSPAIPQQNVGVQQHQ

SEQ ID NO: 138939 - protein, 38 aa, Artificial Sequence
  Description of Artificial Sequence: Synthetic polypeptide
DEEEIRTTNPVATEQYGVVSTVNLQQGNTEQGTTEDED

SEQ ID NO: 138940 - protein, 37 aa, Artificial Sequence
  Description of Artificial Sequence: Synthetic polypeptide
DEEEIRTTNPVATEQYGVVSTVNQQQGTNDEETTTDS

SEQ ID NO: 138941 - protein, 37 aa, Artificial Sequence
  Description of Artificial Sequence: Synthetic polypeptide
DEEEIRTTNPVATEQYGVVSTVNQQQLNGNNEEEEEA

SEQ ID NO: 138942 - protein, 33 aa, Artificial Sequence
  Description of Artificial Sequence: Synthetic polypeptide
DEHEIRTTNPVAYEQWGSVTTPNQGNTMGNNEV

SEQ ID NO: 138943 - protein, 28 aa, Artificial Sequence
  Description of Artificial Sequence: Synthetic peptide
QEGEIAPTNPCSSGQYGIVSCNLQSGTL

SEQ ID NO: 138944 - protein, 34 aa, Artificial Sequence
  Description of Artificial Sequence: Synthetic polypeptide
DEEEIATTNPVATEQYGSVCAGEGNLNNDANGQE

SEQ ID NO: 138945 - protein, 32 aa, Artificial Sequence
  Description of Artificial Sequence: Synthetic polypeptide
QEEVICCTNPVAYEQYGSVAMNEQRGGPNDSV

SEQ ID NO: 138946 - protein, 32 aa, Artificial Sequence
  Description of Artificial Sequence: Synthetic polypeptide
DEHEIRTTNPVAYEQWGEVYHPNDDRQNTNTR

SEQ ID NO: 138947 - protein, 35 aa, Artificial Sequence
  Description of Artificial Sequence: Synthetic polypeptide
DEEEIRTTNPVATEQYGSVDTVMIGNGGDDENNTQ

SEQ ID NO: 138948 - protein, 30 aa, Artificial Sequence
  Description of Artificial Sequence: Synthetic polypeptide
QEGEIAPTNPCSYEQYGIVSCNLQSGQGRH

SEQ ID NO: 138949 - protein, 35 aa, Artificial Sequence
  Description of Artificial Sequence: Synthetic polypeptide
DEEEIRTTNPVATEQYGSVDTTDTGDDEQGDGEEG

SEQ ID NO: 138950 - protein, 35 aa, Artificial Sequence
  Description of Artificial Sequence: Synthetic polypeptide
DEEEIRTTNPVATEQYGSVDTTDLPGPEGDEGGDE

SEQ ID NO: 138951 - protein, 33 aa, Artificial Sequence
  Description of Artificial Sequence: Synthetic polypeptide
DEHEIRTTNPVAYEQWGEVYHWNDDRQNGNKTR

SEQ ID NO: 138952 - protein, 36 aa, Artificial Sequence
  Description of Artificial Sequence: Synthetic polypeptide
DEEEIRTTNPVATEQYGSVDTQQNIIQGGGQEQTTQ

SEQ ID NO: 138953 - protein, 29 aa, Artificial Sequence
  Description of Artificial Sequence: Synthetic peptide
QEGEIAPTNPCSYEQYGIVSCNLQSGDTT

SEQ ID NO: 138954 - protein, 29 aa, Artificial Sequence
  Description of Artificial Sequence: Synthetic peptide
QEGEIAPTNPCSYEQYGIVSCNLQSDTVR

SEQ ID NO: 138955 - protein, 35 aa, Artificial Sequence
  Description of Artificial Sequence: Synthetic polypeptide
DEEEIATTNPVATEQYGSVPCWDNHGQQRQGKDDN

SEQ ID NO: 138956 - protein, 35 aa, Artificial Sequence
  Description of Artificial Sequence: Synthetic polypeptide
DEEEIATTNPVATEQYGSVPCWDNHGQDRQGKDHQ

SEQ ID NO: 138957 - protein, 38 aa, Artificial Sequence
  Description of Artificial Sequence: Synthetic polypeptide
DEEEIRTTNPVATEQYGVVSTVTNLQQLGNQQGTTTDE

SEQ ID NO: 138958 - protein, 35 aa, Artificial Sequence
  Description of Artificial Sequence: Synthetic polypeptide
DEEEIATTNPVATEQYGSVCAATNGEEAGMEMNNP

SEQ ID NO: 138959 - protein, 34 aa, Artificial Sequence
  Description of Artificial Sequence: Synthetic polypeptide
DEEEIATTNPVATEQYGSVCAATNNEEMMGMGEG

SEQ ID NO: 138960 - protein, 30 aa, Artificial Sequence
  Description of Artificial Sequence: Synthetic polypeptide
QEGEIAPTNPCSYEQYGIVSCNALSQSGTR

SEQ ID NO: 138961 - protein, 30 aa, Artificial Sequence
  Description of Artificial Sequence: Synthetic polypeptide
QEGEIAPTNPCSYEQYGIVSANLQSGGTRH

SEQ ID NO: 138962 - protein, 30 aa, Artificial Sequence
  Description of Artificial Sequence: Synthetic polypeptide
QEGEIAPTNPCSYEQYGIVPSCCNLQSGSR

SEQ ID NO: 138963 - protein, 34 aa, Artificial Sequence
  Description of Artificial Sequence: Synthetic polypeptide
DEHEIRTTNPVAYEQWGSTVTTPGNQGNMGNNGR

SEQ ID NO: 138964 - protein, 35 aa, Artificial Sequence
  Description of Artificial Sequence: Synthetic polypeptide
QEEGIRTTNPVATEQYGSVSVTNGGEEGEQGNGGN

SEQ ID NO: 138965 - protein, 30 aa, Artificial Sequence
  Description of Artificial Sequence: Synthetic polypeptide
QEGEIAPTNPCSYEQYGCVSCNLQQSGGTR

SEQ ID NO: 138966 - protein, 35 aa, Artificial Sequence
  Description of Artificial Sequence: Synthetic polypeptide
QEEGIRTTNPVATEQYGSVSTVNGGEEGGQGEEGN

SEQ ID NO: 138967 - protein, 34 aa, Artificial Sequence
  Description of Artificial Sequence: Synthetic polypeptide
QEEGIRTTNPVATEQYGSVSTTGGEEGGQGNETN

SEQ ID NO: 138968 - protein, 34 aa, Artificial Sequence
  Description of Artificial Sequence: Synthetic polypeptide
DEEEIATTNPVATEQYGSVCADTDPPTDDGNGDP

SEQ ID NO: 138969 - protein, 35 aa, Artificial Sequence
  Description of Artificial Sequence: Synthetic polypeptide
DEEEIRTTNPVATEQYGSVDTVMIGNGGDNDGEIQ

SEQ ID NO: 138970 - protein, 37 aa, Artificial Sequence
  Description of Artificial Sequence: Synthetic polypeptide
AEEEIRTTNPVATEQYGSVSVTNGNLEQGSEGGTVIN

SEQ ID NO: 138971 - protein, 30 aa, Artificial Sequence
  Description of Artificial Sequence: Synthetic polypeptide
QEGEIAPTNPCSYEQYGITVSCNELQSGDR

SEQ ID NO: 138972 - protein, 36 aa, Artificial Sequence
  Description of Artificial Sequence: Synthetic polypeptide
DEEEIATTNPVATEQYGSVCADSNDLPQEHMGDNEA

SEQ ID NO: 138973 - protein, 35 aa, Artificial Sequence
  Description of Artificial Sequence: Synthetic polypeptide
DEEEIATTNPVATEQYGSVCADSNDGQEHQGDNEA

SEQ ID NO: 138974 - protein, 35 aa, Artificial Sequence
  Description of Artificial Sequence: Synthetic polypeptide
DEEEIATTNPVATEQYGSVCADINDTDIGGEMNRM

SEQ ID NO: 138975 - protein, 34 aa, Artificial Sequence
  Description of Artificial Sequence: Synthetic polypeptide
DEEEIATTNPVATEQYGSVCAATNPEEAEMEMGN

SEQ ID NO: 138976 - protein, 29 aa, Artificial Sequence
  Description of Artificial Sequence: Synthetic peptide
QEGEIAPTNPCSYEQYGIVACNLQSGTRD

SEQ ID NO: 138977 - protein, 38 aa, Artificial Sequence
  Description of Artificial Sequence: Synthetic polypeptide
DEEEIRTTNPVATEQYGVVSTVTNLQQGNQAGTEAGEE

SEQ ID NO: 138978 - protein, 33 aa, Artificial Sequence
  Description of Artificial Sequence: Synthetic polypeptide
DEHEIRTTNPVAYEQWGEVYHPNDDRQMGNGTR

SEQ ID NO: 138979 - protein, 30 aa, Artificial Sequence
  Description of Artificial Sequence: Synthetic polypeptide
QEGEIAPTNPCSYEQYGIVSCNLQSGTDRK

SEQ ID NO: 138980 - protein, 32 aa, Artificial Sequence
  Description of Artificial Sequence: Synthetic polypeptide
DAGEIATTNPVAYEQWGSVCTENHLDDLDGDR

SEQ ID NO: 138981 - protein, 34 aa, Artificial Sequence
  Description of Artificial Sequence: Synthetic polypeptide
DEHEIRTTNPVAYEQWGESVQIQRNDDVQRGHER

SEQ ID NO: 138982 - protein, 34 aa, Artificial Sequence
  Description of Artificial Sequence: Synthetic polypeptide
DEHEIRTTNPVAYEQWGESVQIQRNDDLQRGSDM

SEQ ID NO: 138983 - protein, 30 aa, Artificial Sequence
  Description of Artificial Sequence: Synthetic polypeptide
QEGEIAPTNPCSYEQYGQVSCNLSQSAGTR

SEQ ID NO: 138984 - protein, 35 aa, Artificial Sequence
  Description of Artificial Sequence: Synthetic polypeptide
DEEEIATTNPVATEQYGSVCAATMHGEQDSDGSRH

SEQ ID NO: 138985 - protein, 29 aa, Artificial Sequence
  Description of Artificial Sequence: Synthetic peptide
QEGEIAPTNPCSYEQYGTIVSCNLQSGTT

SEQ ID NO: 138986 - protein, 29 aa, Artificial Sequence
  Description of Artificial Sequence: Synthetic peptide
QEGEIAPTNPCSYEQYGTTVSCNLQSGTQ

SEQ ID NO: 138987 - protein, 31 aa, Artificial Sequence
  Description of Artificial Sequence: Synthetic polypeptide
QEGEIAPTNPCSYEQYGQVPSCNLQSGGTNR

SEQ ID NO: 138988 - protein, 36 aa, Artificial Sequence
  Description of Artificial Sequence: Synthetic polypeptide
DEEEIRTTNPVATEQYGSVEGPTTPLQHRNEVEVMI

SEQ ID NO: 138989 - protein, 34 aa, Artificial Sequence
  Description of Artificial Sequence: Synthetic polypeptide
DEHEIRTTNPVAYEQWGCVTGNPLNDTQRGNDDD

SEQ ID NO: 138990 - protein, 30 aa, Artificial Sequence
  Description of Artificial Sequence: Synthetic polypeptide
QEEEVATTNPVATEQYGNVPEVIQSHVGQK

SEQ ID NO: 138991 - protein, 29 aa, Artificial Sequence
  Description of Artificial Sequence: Synthetic peptide
QEGEIAPTNPCSYEQYGVVSCHLSQSGTR

SEQ ID NO: 138992 - protein, 36 aa, Artificial Sequence
  Description of Artificial Sequence: Synthetic polypeptide
DEEEIRTTNPVATEQYGSVEGWNLGMDIPMEGESNS

SEQ ID NO: 138993 - protein, 28 aa, Artificial Sequence
  Description of Artificial Sequence: Synthetic peptide
QEEEVATTNPVATEQYGEAPEVCQHEEK

SEQ ID NO: 138994 - protein, 32 aa, Artificial Sequence
  Description of Artificial Sequence: Synthetic polypeptide
DAGEIATTNPVAYEQWGSVCTENHLDDLGTGR

SEQ ID NO: 138995 - protein, 31 aa, Artificial Sequence
  Description of Artificial Sequence: Synthetic polypeptide
QEGEIAPTNPCSYEQYGTVSCNELQSGGENR

SEQ ID NO: 138996 - protein, 31 aa, Artificial Sequence
  Description of Artificial Sequence: Synthetic polypeptide
QEGEIAPTNPCSYEQYGCVSCCNLQSGTTNR

SEQ ID NO: 138997 - protein, 31 aa, Artificial Sequence
  Description of Artificial Sequence: Synthetic polypeptide
QEGEIAPTNPCSYEQYGQTVSCNLQSGGSNR

SEQ ID NO: 138998 - protein, 30 aa, Artificial Sequence
  Description of Artificial Sequence: Synthetic polypeptide
QEGEIAPTNPCSYEQYGKVSCNLQSGGTNE

SEQ ID NO: 138999 - protein, 32 aa, Artificial Sequence
  Description of Artificial Sequence: Synthetic polypeptide
DAGEIATTNPVAYEQWGSVCTENHLDDLGMRN

SEQ ID NO: 139000 - protein, 34 aa, Artificial Sequence
  Description of Artificial Sequence: Synthetic polypeptide
QEEGIRTTNPVATEQYGSVSTNGGEEGGQGEEMQ

SEQ ID NO: 139001 - protein, 29 aa, Artificial Sequence
  Description of Artificial Sequence: Synthetic peptide
QEGEIAPTNPCSYEQYGIVSCNLQTSGTS

SEQ ID NO: 139002 - protein, 34 aa, Artificial Sequence
  Description of Artificial Sequence: Synthetic polypeptide
QEEGIRTTNPVATEQYGSVSTNGGEDGGQGEEIN

SEQ ID NO: 139003 - protein, 33 aa, Artificial Sequence
  Description of Artificial Sequence: Synthetic polypeptide
DEHEIRTTNPVAYEQWGEVSTNLNGEDHQNEQD

SEQ ID NO: 139004 - protein, 36 aa, Artificial Sequence
  Description of Artificial Sequence: Synthetic polypeptide
DEEEIRTTNPVATEQYGSVDTVMIGNNGGDDGENQG

SEQ ID NO: 139005 - protein, 29 aa, Artificial Sequence
  Description of Artificial Sequence: Synthetic peptide
QEGEIAPTNPCSYEQYGKVSCNLSDSGTR

SEQ ID NO: 139006 - protein, 34 aa, Artificial Sequence
  Description of Artificial Sequence: Synthetic polypeptide
QEEGIRTTNPVATEQYGSVSTGGGDQNDGQEEGD

SEQ ID NO: 139007 - protein, 37 aa, Artificial Sequence
  Description of Artificial Sequence: Synthetic polypeptide
DEEEIRTTNPVATEQYGSVDYPSLNMLEQERQVSQDE

SEQ ID NO: 139008 - protein, 38 aa, Artificial Sequence
  Description of Artificial Sequence: Synthetic polypeptide
DEEEIRTTNPVATEQYGSVDYPSLNMLEQERVNPSQDV

SEQ ID NO: 139009 - protein, 33 aa, Artificial Sequence
  Description of Artificial Sequence: Synthetic polypeptide
DEHEIRTTNPVAYEQWGEVSHPNDDRQNMNNTR

SEQ ID NO: 139010 - protein, 35 aa, Artificial Sequence
  Description of Artificial Sequence: Synthetic polypeptide
DEEEIATTNPVATEQYGSVSAGPPTANGAGMGAED

SEQ ID NO: 139011 - protein, 34 aa, Artificial Sequence
  Description of Artificial Sequence: Synthetic polypeptide
DEEEIATTNPVATEQYGSVCAATNDEEAIAEMNN

SEQ ID NO: 139012 - protein, 28 aa, Artificial Sequence
  Description of Artificial Sequence: Synthetic peptide
QEEGIATTNPVATEQYGEAPEVCQHEEK

SEQ ID NO: 139013 - protein, 37 aa, Artificial Sequence
  Description of Artificial Sequence: Synthetic polypeptide
DEEEIRTTNPVATEQYGVVSTVTNNLNNNNQAGTEDE

SEQ ID NO: 139014 - protein, 28 aa, Artificial Sequence
  Description of Artificial Sequence: Synthetic peptide
QEEHIATTNPVATEQYGEAPEVCQHEEK

SEQ ID NO: 139015 - protein, 28 aa, Artificial Sequence
  Description of Artificial Sequence: Synthetic peptide
QEEHIATTNPVATEQYGEAPEVCQHEIK

SEQ ID NO: 139016 - protein, 28 aa, Artificial Sequence
  Description of Artificial Sequence: Synthetic peptide
QEEHIATTNPVATEQYGEAPQVCQHEEK

SEQ ID NO: 139017 - protein, 35 aa, Artificial Sequence
  Description of Artificial Sequence: Synthetic polypeptide
DEEEIATTNPVATEQYGSVCAGEGLQDQPGGQDNH

SEQ ID NO: 139018 - protein, 36 aa, Artificial Sequence
  Description of Artificial Sequence: Synthetic polypeptide
QEETIRTTNPVATEQYGSVSVTNGGEEQGGQGNQGT

SEQ ID NO: 139019 - protein, 28 aa, Artificial Sequence
  Description of Artificial Sequence: Synthetic peptide
QEETIATTNPVATEQYGEAPEVCQHEEK

SEQ ID NO: 139020 - protein, 28 aa, Artificial Sequence
  Description of Artificial Sequence: Synthetic peptide
QEESIATTNPVATEQYGEAPMVCQHEEK

SEQ ID NO: 139021 - protein, 28 aa, Artificial Sequence
  Description of Artificial Sequence: Synthetic peptide
QEESIATTNPVATEQYGEAPEVCQHEEK

SEQ ID NO: 139022 - protein, 28 aa, Artificial Sequence
  Description of Artificial Sequence: Synthetic peptide
QEEQIATTNPVATEQYGEAPEVCQHEET

SEQ ID NO: 139023 - protein, 36 aa, Artificial Sequence
  Description of Artificial Sequence: Synthetic polypeptide
DEEEIATTNPVATEQYGSVCTGNPTGPQAMGNDNEA

SEQ ID NO: 139024 - protein, 34 aa, Artificial Sequence
  Description of Artificial Sequence: Synthetic polypeptide
DEHEIRTTNPVAYEQWGSVCYNNPDGHQGGNNQR

SEQ ID NO: 139025 - protein, 33 aa, Artificial Sequence
  Description of Artificial Sequence: Synthetic polypeptide
DEHEIRTTNPVAYEQWGSVCYNNDGHHGGNEER

SEQ ID NO: 139026 - protein, 28 aa, Artificial Sequence
  Description of Artificial Sequence: Synthetic peptide
QEEQIATTNPVATEQYGEAPEVCQHEEK

SEQ ID NO: 139027 - protein, 28 aa, Artificial Sequence
  Description of Artificial Sequence: Synthetic peptide
QEEPIATTNPVATEQYGEAPEVCQHEEK

SEQ ID NO: 139028 - protein, 33 aa, Artificial Sequence
  Description of Artificial Sequence: Synthetic polypeptide
DEHEIRTTNPVAYEQWGSVCYNNDGHHGDNNQR

SEQ ID NO: 139029 - protein, 34 aa, Artificial Sequence
  Description of Artificial Sequence: Synthetic polypeptide
DEHEIRTTNPVAYEQWGSVCVTDNGDPHQHNNDR

SEQ ID NO: 139030 - protein, 35 aa, Artificial Sequence
  Description of Artificial Sequence: Synthetic polypeptide
DEEEIRTTNPVATEQYGSVDTDNFTDETGQGTEGI

SEQ ID NO: 139031 - protein, 33 aa, Artificial Sequence
  Description of Artificial Sequence: Synthetic polypeptide
DEMCIGTTNPVATEQWGCVCSTDDLNQYFGSNQ

SEQ ID NO: 139032 - protein, 35 aa, Artificial Sequence
  Description of Artificial Sequence: Synthetic polypeptide
DEEEIATTNPVATEQYGSVCTVANNTTADMIGNND

SEQ ID NO: 139033 - protein, 35 aa, Artificial Sequence
  Description of Artificial Sequence: Synthetic polypeptide
DEEEIATTNPVATEQYGSVCTDTPLPDDSGDGADR

SEQ ID NO: 139034 - protein, 38 aa, Artificial Sequence
  Description of Artificial Sequence: Synthetic polypeptide
DEEEIRTTNPVATEQYGVVSTVNLQQGNQEQGTNQDED

SEQ ID NO: 139035 - protein, 30 aa, Artificial Sequence
  Description of Artificial Sequence: Synthetic polypeptide
QEEVICCTNPVAYEQYGSVAMNENVGGNSK

SEQ ID NO: 139036 - protein, 33 aa, Artificial Sequence
  Description of Artificial Sequence: Synthetic polypeptide
DEHEIRTTNPVAYEQWGSVSGGMNQGADNGNVA

SEQ ID NO: 139037 - protein, 35 aa, Artificial Sequence
  Description of Artificial Sequence: Synthetic polypeptide
DEEEIATTNPVATEQYGSVCSVGDDINIDAMMENR

SEQ ID NO: 139038 - protein, 36 aa, Artificial Sequence
  Description of Artificial Sequence: Synthetic polypeptide
DEEEIRTTNPVATEQYGSVDSVTTGQPIEREQISLL

SEQ ID NO: 139039 - protein, 33 aa, Artificial Sequence
  Description of Artificial Sequence: Synthetic polypeptide
QEEVICCTNPVATEQYGSVASNNNQTAGGPNST

SEQ ID NO: 139040 - protein, 29 aa, Artificial Sequence
  Description of Artificial Sequence: Synthetic peptide
QEEVIATTNPVATEQYGEASPEVCQHEEK

SEQ ID NO: 139041 - protein, 35 aa, Artificial Sequence
  Description of Artificial Sequence: Synthetic polypeptide
DEEEIATTNPVATEQYGSVCSVGNQENDMVGDDQR

SEQ ID NO: 139042 - protein, 33 aa, Artificial Sequence
  Description of Artificial Sequence: Synthetic polypeptide
DEHEIRTTNPVAYEQWGSVSGGGNQGAMNGNVE

SEQ ID NO: 139043 - protein, 28 aa, Artificial Sequence
  Description of Artificial Sequence: Synthetic peptide
QEEVIATTNPVATEQYGEAPEECQHEEK

SEQ ID NO: 139044 - protein, 33 aa, Artificial Sequence
  Description of Artificial Sequence: Synthetic polypeptide
DEHEIRTTNPVAYEQWGSVSGGGNQGADNGNQD

SEQ ID NO: 139045 - protein, 33 aa, Artificial Sequence
  Description of Artificial Sequence: Synthetic polypeptide
DEHEIRTTNPVAYEQWGSVSGGGNQGADNGNEG

SEQ ID NO: 139046 - protein, 35 aa, Artificial Sequence
  Description of Artificial Sequence: Synthetic polypeptide
DEEEIATTNPVATEQYGSVCSVGNDGNTGEGGSNH

SEQ ID NO: 139047 - protein, 32 aa, Artificial Sequence
  Description of Artificial Sequence: Synthetic polypeptide
QEEVIACTNPVATEQYGSVSMNNSQAGGPGDS

SEQ ID NO: 139048 - protein, 37 aa, Artificial Sequence
  Description of Artificial Sequence: Synthetic polypeptide
DEEEIRTTNPVATEQYGSVCSTTGAGNNEGFGSNPVI

SEQ ID NO: 139049 - protein, 28 aa, Artificial Sequence
  Description of Artificial Sequence: Synthetic peptide
QEEVIATTNPVATEQYGEAPEVCQHEEK

SEQ ID NO: 139050 - protein, 37 aa, Artificial Sequence
  Description of Artificial Sequence: Synthetic polypeptide
DEEEIRTTNPVATEQYGSVDSTVNGFGQENGQGEFGG

SEQ ID NO: 139051 - protein, 31 aa, Artificial Sequence
  Description of Artificial Sequence: Synthetic polypeptide
DEMCIRTTNPLATEQFGCVCSSELQSFGSDQ

SEQ ID NO: 139052 - protein, 36 aa, Artificial Sequence
  Description of Artificial Sequence: Synthetic polypeptide
DEEEIRTTNPVATEQYGSVDTDTMGQSGDGEEDNDP

SEQ ID NO: 139053 - protein, 35 aa, Artificial Sequence
  Description of Artificial Sequence: Synthetic polypeptide
DEEEIRTTNPVATEQYGSVDTDTMGQSGDQEEGAD

SEQ ID NO: 139054 - protein, 28 aa, Artificial Sequence
  Description of Artificial Sequence: Synthetic peptide
QEEKIATTNPVATEQYGEAPEVCQHEEK

SEQ ID NO: 139055 - protein, 35 aa, Artificial Sequence
  Description of Artificial Sequence: Synthetic polypeptide
DEEEIATTNPVATEQYGSVCAGEGDNQNQGNQDRH

SEQ ID NO: 139056 - protein, 34 aa, Artificial Sequence
  Description of Artificial Sequence: Synthetic polypeptide
QEEIIRTTNPVATEQYGCVSTNTGQQTFPENQND

SEQ ID NO: 139057 - protein, 36 aa, Artificial Sequence
  Description of Artificial Sequence: Synthetic polypeptide
DEHEIRTTNPVAYEQWGSVCSTGDNDMQRDGDNNND

SEQ ID NO: 139058 - protein, 31 aa, Artificial Sequence
  Description of Artificial Sequence: Synthetic polypeptide
DEEEIATTNPVATEQYGSVPAEVCEHEEEDL

SEQ ID NO: 139059 - protein, 30 aa, Artificial Sequence
  Description of Artificial Sequence: Synthetic polypeptide
QEGEIAPTNPCSYEAYGKVSCCNLQSGTNR

SEQ ID NO: 139060 - protein, 35 aa, Artificial Sequence
  Description of Artificial Sequence: Synthetic polypeptide
DEHEIRTTNPVAYEQWGSVCSTENDQRNDTQNGMG

SEQ ID NO: 139061 - protein, 31 aa, Artificial Sequence
  Description of Artificial Sequence: Synthetic polypeptide
DAEEIATTNPVATEQYGSVCSAPPADDMPGE

SEQ ID NO: 139062 - protein, 37 aa, Artificial Sequence
  Description of Artificial Sequence: Synthetic polypeptide
DEEEIRTTNPVATEQYGSVDTGTMLGGGQDENGNGQQ

SEQ ID NO: 139063 - protein, 28 aa, Artificial Sequence
  Description of Artificial Sequence: Synthetic peptide
QEGEIAPTNPCSYEPYGIVACNLQNGTR

SEQ ID NO: 139064 - protein, 37 aa, Artificial Sequence
  Description of Artificial Sequence: Synthetic polypeptide
DEEEIRTTNPVATEQYGSVDTGTMNGGDQDEVGNGQQ

SEQ ID NO: 139065 - protein, 28 aa, Artificial Sequence
  Description of Artificial Sequence: Synthetic peptide
QEEIIATTNPVATEQYGEAPEVCQHEEK

SEQ ID NO: 139066 - protein, 36 aa, Artificial Sequence
  Description of Artificial Sequence: Synthetic polypeptide
DEEEIRTTNPVATEQYGSVDTNDDNTDEGEGGNDQE

SEQ ID NO: 139067 - protein, 34 aa, Artificial Sequence
  Description of Artificial Sequence: Synthetic polypeptide
DEHEIRTTNPVAYEQWGSVCSTENDNNDTQNGGA

SEQ ID NO: 139068 - protein, 34 aa, Artificial Sequence
  Description of Artificial Sequence: Synthetic polypeptide
DEHEIRTTNPVAYEQWGSVCSTTDQVGDTQNGMA

SEQ ID NO: 139069 - protein, 35 aa, Artificial Sequence
  Description of Artificial Sequence: Synthetic polypeptide
DEHEIRTTNPVAYEQWGSVCSTGNNDMQPDGSNNV

SEQ ID NO: 139070 - protein, 34 aa, Artificial Sequence
  Description of Artificial Sequence: Synthetic polypeptide
DEHEIRTTNPVAYEQWGSVCSTIDDERQQGGDDR

SEQ ID NO: 139071 - protein, 38 aa, Artificial Sequence
  Description of Artificial Sequence: Synthetic polypeptide
DEEEIRTTNPVATEQYGVVSTVTNLQAGTNQGGTNTAE

SEQ ID NO: 139072 - protein, 35 aa, Artificial Sequence
  Description of Artificial Sequence: Synthetic polypeptide
DEHEIRTTNPVAYEQWGSVCSTNQNDQGEHGNESH

SEQ ID NO: 139073 - protein, 36 aa, Artificial Sequence
  Description of Artificial Sequence: Synthetic polypeptide
DEEEIRTTNPVATEQYGSVDTDTMGQSGDNEEGNDD

SEQ ID NO: 139074 - protein, 28 aa, Artificial Sequence
  Description of Artificial Sequence: Synthetic peptide
QEENIATTNPVATEQYGEAPEVCQHEEK

SEQ ID NO: 139075 - protein, 36 aa, Artificial Sequence
  Description of Artificial Sequence: Synthetic polypeptide
DEEEIATTNPVATEQYGSVFSTTPAGPNMRNGMNPV

SEQ ID NO: 139076 - protein, 34 aa, Artificial Sequence
  Description of Artificial Sequence: Synthetic polypeptide
DEHEIRTTNPVAYEQWGSVCSTNQNDQGEEGQES

SEQ ID NO: 139077 - protein, 28 aa, Artificial Sequence
  Description of Artificial Sequence: Synthetic peptide
QEELIATTNPVATEQYGEAPEVCQHEEK

SEQ ID NO: 139078 - protein, 28 aa, Artificial Sequence
  Description of Artificial Sequence: Synthetic peptide
QEENIATTNPVATEQYGEAIEVCQHEEK

SEQ ID NO: 139079 - protein, 28 aa, Artificial Sequence
  Description of Artificial Sequence: Synthetic peptide
QEEMIATTNPVATEQYGEAPEVCQHEEK

SEQ ID NO: 139080 - protein, 38 aa, Artificial Sequence
  Description of Artificial Sequence: Synthetic polypeptide
DEEEIRTTNPVATEQYGVVSTVTNLQNQEQGNNDEEDE

SEQ ID NO: 139081 - protein, 30 aa, Artificial Sequence
  Description of Artificial Sequence: Synthetic polypeptide
QEGEIAPTNPCSYEAYGCVSCNLQSGGTNR

SEQ ID NO: 139082 - protein, 38 aa, Artificial Sequence
  Description of Artificial Sequence: Synthetic polypeptide
DEEEIRTTNPVATEQYGVVSTVTNLQNQEQGNNDEVED

SEQ ID NO: 139083 - protein, 34 aa, Artificial Sequence
  Description of Artificial Sequence: Synthetic polypeptide
DEHEIRTTNPVAYEQWGSVCSTMDDERNQNGDDR

SEQ ID NO: 139084 - protein, 34 aa, Artificial Sequence
  Description of Artificial Sequence: Synthetic polypeptide
DEHEIRTTNPVAYEQWGSVCSTINIDGEGGNNTA

SEQ ID NO: 139085 - protein, 38 aa, Artificial Sequence
  Description of Artificial Sequence: Synthetic polypeptide
DEEEIRTTNPVATEQYGVVSTVTNLQNATEQGTNQTED

SEQ ID NO: 139086 - protein, 30 aa, Artificial Sequence
  Description of Artificial Sequence: Synthetic polypeptide
QEEEVASTNPVATEQYGNVANTCQSRVGQK

SEQ ID NO: 139087 - protein, 28 aa, Artificial Sequence
  Description of Artificial Sequence: Synthetic peptide
QEGEIAPTNPCSSEYYGIVSCNYQSGTR

SEQ ID NO: 139088 - protein, 35 aa, Artificial Sequence
  Description of Artificial Sequence: Synthetic polypeptide
DEEEIATTNPVATEQYGSVCSPTGTLVEMVGDQEA

SEQ ID NO: 139089 - protein, 36 aa, Artificial Sequence
  Description of Artificial Sequence: Synthetic polypeptide
DEEEIRTTNPVATEQYGVVSTVNNNQQGTTTETEED

SEQ ID NO: 139090 - protein, 37 aa, Artificial Sequence
  Description of Artificial Sequence: Synthetic polypeptide
DEEEIRTTNPVATEQYGVVSTVNNNQQLQQGEEEEEE

SEQ ID NO: 139091 - protein, 38 aa, Artificial Sequence
  Description of Artificial Sequence: Synthetic polypeptide
DEEEIRTTNPVATEQYGVVSTVNNNQQNLQQGNQEEED

SEQ ID NO: 139092 - protein, 28 aa, Artificial Sequence
  Description of Artificial Sequence: Synthetic peptide
QEGEIAPTNPCSSEQYGIASCNLQSEER

SEQ ID NO: 139093 - protein, 28 aa, Artificial Sequence
  Description of Artificial Sequence: Synthetic peptide
QEGEIAPTNPCSSEQYGIASCNLQSETR

SEQ ID NO: 139094 - protein, 28 aa, Artificial Sequence
  Description of Artificial Sequence: Synthetic peptide
QEGEIAPTNPCSSEQYGICSCNLQSGTK

SEQ ID NO: 139095 - protein, 35 aa, Artificial Sequence
  Description of Artificial Sequence: Synthetic polypeptide
DEEEIRTTNPVATEQYGSVDDTTNMDDGGGEGQGI

SEQ ID NO: 139096 - protein, 34 aa, Artificial Sequence
  Description of Artificial Sequence: Synthetic polypeptide
DEEEIATTNPVATEQYGSVCAPNPLENDDLGAQM

SEQ ID NO: 139097 - protein, 35 aa, Artificial Sequence
  Description of Artificial Sequence: Synthetic polypeptide
DEEEIATTNPVATEQYGSVCAPMNLEQDDLMGAQE

SEQ ID NO: 139098 - protein, 31 aa, Artificial Sequence
  Description of Artificial Sequence: Synthetic polypeptide
DAEEIATTNPVAYEQWGSVCMAGTDNPQGDD

SEQ ID NO: 139099 - protein, 35 aa, Artificial Sequence
  Description of Artificial Sequence: Synthetic polypeptide
DEEEIATTNPVATEQYGSVCAPGNALQLDVENDNN

SEQ ID NO: 139100 - protein, 38 aa, Artificial Sequence
  Description of Artificial Sequence: Synthetic polypeptide
DEEEIRTTNPVATEQYGVVSTVNNTNLQSGNNNDEDED

SEQ ID NO: 139101 - protein, 38 aa, Artificial Sequence
  Description of Artificial Sequence: Synthetic polypeptide
DEEEIRTTNPVATEQYGVVSTVNNTNLQQGNQEEEEED

SEQ ID NO: 139102 - protein, 28 aa, Artificial Sequence
  Description of Artificial Sequence: Synthetic peptide
QEGEIAPTNPCSSEQYGIVACNLQSCTR

SEQ ID NO: 139103 - protein, 28 aa, Artificial Sequence
  Description of Artificial Sequence: Synthetic peptide
QEGEIAPTNPCSSEQYGIVACNLQSGTI

SEQ ID NO: 139104 - protein, 37 aa, Artificial Sequence
  Description of Artificial Sequence: Synthetic polypeptide
DEEEIRTTNPVATEQYGVVSTVNNQQQQQQGTTNATE

SEQ ID NO: 139105 - protein, 35 aa, Artificial Sequence
  Description of Artificial Sequence: Synthetic polypeptide
DEEEIATTNPVATEQYGSVCANNNLIQDPDNDNAE

SEQ ID NO: 139106 - protein, 33 aa, Artificial Sequence
  Description of Artificial Sequence: Synthetic polypeptide
DEHVISTTNPVAYEQWGTVSKTQDDLQNRGDAR

SEQ ID NO: 139107 - protein, 37 aa, Artificial Sequence
  Description of Artificial Sequence: Synthetic polypeptide
DEEEIRTTNPVATEQYGVVSTVNNQQNNQQGNNQDED

SEQ ID NO: 139108 - protein, 30 aa, Artificial Sequence
  Description of Artificial Sequence: Synthetic polypeptide
QEGEIAPTNPCSSEQYGIVSCNLQSGDTTR

SEQ ID NO: 139109 - protein, 31 aa, Artificial Sequence
  Description of Artificial Sequence: Synthetic polypeptide
DEHVIATTNPVAYEQWGTVSKTDDLQRQDAQ

SEQ ID NO: 139110 - protein, 29 aa, Artificial Sequence
  Description of Artificial Sequence: Synthetic peptide
QEGEIAPTNPCSSEQYGIVACNLQSKGTR

SEQ ID NO: 139111 - protein, 36 aa, Artificial Sequence
  Description of Artificial Sequence: Synthetic polypeptide
DEIEIRTTNPVATEQYGSVSSTTPAGPNMRNGFNPV

SEQ ID NO: 139112 - protein, 33 aa, Artificial Sequence
  Description of Artificial Sequence: Synthetic polypeptide
DAEEIATTNPVAYEQYGSVAITNQDNGNPEGTP

SEQ ID NO: 139113 - protein, 34 aa, Artificial Sequence
  Description of Artificial Sequence: Synthetic polypeptide
DEEEIATTNPVATEQYGSVCAMTPLEATDSGGSD

SEQ ID NO: 139114 - protein, 35 aa, Artificial Sequence
  Description of Artificial Sequence: Synthetic polypeptide
DEEEIATTNPVATEQYGSVCAMWNGVGDEAGNMRE

SEQ ID NO: 139115 - protein, 32 aa, Artificial Sequence
  Description of Artificial Sequence: Synthetic polypeptide
DEHQIRTTNPVAYDQWGSTVNTQESSQRVGND

SEQ ID NO: 139116 - protein, 35 aa, Artificial Sequence
  Description of Artificial Sequence: Synthetic polypeptide
DEHPIRTTNPVATEQYGKTISTNEFSGVREGGDNR

SEQ ID NO: 139117 - protein, 37 aa, Artificial Sequence
  Description of Artificial Sequence: Synthetic polypeptide
DEEEIRTTNPVATEQYGVVSTVNNQQQQNATEQGNTT

SEQ ID NO: 139118 - protein, 36 aa, Artificial Sequence
  Description of Artificial Sequence: Synthetic polypeptide
DEIEIRTTNPVATEQYGSVSSTTPAGPNMRNGMNPV

SEQ ID NO: 139119 - protein, 34 aa, Artificial Sequence
  Description of Artificial Sequence: Synthetic polypeptide
DEEEIATTNPVATEQYGSVCANNNLENDDLGAQA

SEQ ID NO: 139120 - protein, 35 aa, Artificial Sequence
  Description of Artificial Sequence: Synthetic polypeptide
DEEEIATTNPVATEQYGSVCAMTTGGAESIGNERF

SEQ ID NO: 139121 - protein, 37 aa, Artificial Sequence
  Description of Artificial Sequence: Synthetic polypeptide
DEEEIRTTNPVATEQYGVVSTVNNNQQGNQQNEEEDE

SEQ ID NO: 139122 - protein, 35 aa, Artificial Sequence
  Description of Artificial Sequence: Synthetic polypeptide
DEEEIATTNPVATEQYGSVCAMTGLAPGEQMEGAE

SEQ ID NO: 139123 - protein, 29 aa, Artificial Sequence
  Description of Artificial Sequence: Synthetic peptide
QEGEIAPTNPCSSEQYGIVSCNLQSGTQD

SEQ ID NO: 139124 - protein, 36 aa, Artificial Sequence
  Description of Artificial Sequence: Synthetic polypeptide
DEEEIRTTNPVATEQYGSVDKTTPAGPNMRNGMNPV

SEQ ID NO: 139125 - protein, 35 aa, Artificial Sequence
  Description of Artificial Sequence: Synthetic polypeptide
DEEEIATTNPVATEQYGSVCAQNGDEQTDDGGSRD

SEQ ID NO: 139126 - protein, 35 aa, Artificial Sequence
  Description of Artificial Sequence: Synthetic polypeptide
DEEEIATTNPVATEQYGSVCAQNGDEQTDDGGVNT

SEQ ID NO: 139127 - protein, 35 aa, Artificial Sequence
  Description of Artificial Sequence: Synthetic polypeptide
DEEEIATTNPVATEQYGSVCAQNGDEQTDDNGVRE

SEQ ID NO: 139128 - protein, 35 aa, Artificial Sequence
  Description of Artificial Sequence: Synthetic polypeptide
DEEEIATTNPVATEQYGSVCAQNPQQEHQDGNQMQ

SEQ ID NO: 139129 - protein, 29 aa, Artificial Sequence
  Description of Artificial Sequence: Synthetic peptide
QEGEIAPTNPCSSEQYGIVSCNLQSNGTH

SEQ ID NO: 139130 - protein, 30 aa, Artificial Sequence
  Description of Artificial Sequence: Synthetic polypeptide
QEGEIAPTNPCSSEQYGIVSCNLQSGVTGR

SEQ ID NO: 139131 - protein, 35 aa, Artificial Sequence
  Description of Artificial Sequence: Synthetic polypeptide
DEEEIRTTNPVATEQYGSVDLTPNQHDERDQVIDQ

SEQ ID NO: 139132 - protein, 34 aa, Artificial Sequence
  Description of Artificial Sequence: Synthetic polypeptide
DEEEIATTNPVATEQYGSVCATADGPTGDDGENG

SEQ ID NO: 139133 - protein, 33 aa, Artificial Sequence
  Description of Artificial Sequence: Synthetic polypeptide
DEEEIATTNPVATEQYGSVCATADPGTDDGGES

SEQ ID NO: 139134 - protein, 37 aa, Artificial Sequence
  Description of Artificial Sequence: Synthetic polypeptide
DEEEIRTTNPVATEQYGVVSTVNQLQQNQQGTTEDED

SEQ ID NO: 139135 - protein, 30 aa, Artificial Sequence
  Description of Artificial Sequence: Synthetic polypeptide
QEGEIAPTNPCSSEQYGIVSCNLQSQGTAR

SEQ ID NO: 139136 - protein, 34 aa, Artificial Sequence
  Description of Artificial Sequence: Synthetic polypeptide
DEEEIATTNPVATEQYGSVCATADPTGTDDGNEY

SEQ ID NO: 139137 - protein, 35 aa, Artificial Sequence
  Description of Artificial Sequence: Synthetic polypeptide
DEEEIRTTNPVATEQYGSVDLTPRQHPERDQVIED

SEQ ID NO: 139138 - protein, 35 aa, Artificial Sequence
  Description of Artificial Sequence: Synthetic polypeptide
DEEEIRTTNPVATEQYGSVDLTPNSHPERDQVIDL

SEQ ID NO: 139139 - protein, 28 aa, Artificial Sequence
  Description of Artificial Sequence: Synthetic peptide
QEGEIAPTNPCSSEQYGIVACNLQSNTR

SEQ ID NO: 139140 - protein, 35 aa, Artificial Sequence
  Description of Artificial Sequence: Synthetic polypeptide
DEEEIATTNPVATEQYGSVCAPTNQGLPAEAPNNQ

SEQ ID NO: 139141 - protein, 37 aa, Artificial Sequence
  Description of Artificial Sequence: Synthetic polypeptide
DEEEIRTTNPVATEQYGVVSTVNNNQQGNQEDETNDT

SEQ ID NO: 139142 - protein, 28 aa, Artificial Sequence
  Description of Artificial Sequence: Synthetic peptide
QEGEIAPTNPCSSEQYGEVSEVLQHETR

SEQ ID NO: 139143 - protein, 33 aa, Artificial Sequence
  Description of Artificial Sequence: Synthetic polypeptide
DEHEIVTTNPVATEQYGTVCSATDGPVEWEGND

SEQ ID NO: 139144 - protein, 29 aa, Artificial Sequence
  Description of Artificial Sequence: Synthetic peptide
QEGEIAPTNPCSSEQYGEVSCNLQSGSTT

SEQ ID NO: 139145 - protein, 34 aa, Artificial Sequence
  Description of Artificial Sequence: Synthetic polypeptide
DEEEIRTTNPVATEQYGSVDGPWIEGNVPIMQLE

SEQ ID NO: 139146 - protein, 37 aa, Artificial Sequence
  Description of Artificial Sequence: Synthetic polypeptide
DEEEIRTTNPVATEQYGVVSTVNNNQQGNQENQGTTD

SEQ ID NO: 139147 - protein, 33 aa, Artificial Sequence
  Description of Artificial Sequence: Synthetic polypeptide
DEHEIVTTNPVATEQYGTVCSATDGPVEFEGNT

SEQ ID NO: 139148 - protein, 32 aa, Artificial Sequence
  Description of Artificial Sequence: Synthetic polypeptide
DAEEIATTNPVAYEQYGSVATAGTQTRNQDEA

SEQ ID NO: 139149 - protein, 28 aa, Artificial Sequence
  Description of Artificial Sequence: Synthetic peptide
QEGEIAPTNPCSSEQYGEVPCNCQSGER

SEQ ID NO: 139150 - protein, 33 aa, Artificial Sequence
  Description of Artificial Sequence: Synthetic polypeptide
DEIEIVTTNPVATEQYGTVCSATDGPVEFEGND

SEQ ID NO: 139151 - protein, 33 aa, Artificial Sequence
  Description of Artificial Sequence: Synthetic polypeptide
DEHEIVTTNPVATEQYGTVCSATDGPVEFEGND

SEQ ID NO: 139152 - protein, 35 aa, Artificial Sequence
  Description of Artificial Sequence: Synthetic polypeptide
DEEEIATTNPVATEQYGSVCAPTNGHEVDDPGQRN

SEQ ID NO: 139153 - protein, 37 aa, Artificial Sequence
  Description of Artificial Sequence: Synthetic polypeptide
DEEEIRTTNPVATEQYGVVSTVNNNQQGNQEGNGTDD

SEQ ID NO: 139154 - protein, 33 aa, Artificial Sequence
  Description of Artificial Sequence: Synthetic polypeptide
DEIQIVTTNPVATEQYGSVSTGGQGGQGQGDTQ

SEQ ID NO: 139155 - protein, 28 aa, Artificial Sequence
  Description of Artificial Sequence: Synthetic peptide
QEGEIAPTNPCSSEQYGDVSENLQSEEL

SEQ ID NO: 139156 - protein, 33 aa, Artificial Sequence
  Description of Artificial Sequence: Synthetic polypeptide
DEHEIVTTNPVATEQYGTVCSATDGPVEFEGNS

SEQ ID NO: 139157 - protein, 28 aa, Artificial Sequence
  Description of Artificial Sequence: Synthetic peptide
QEGEIAPTNPCSSEQYGIVASNLQHGTI

SEQ ID NO: 139158 - protein, 37 aa, Artificial Sequence
  Description of Artificial Sequence: Synthetic polypeptide
DEEEIRTTNPVATEQYGVVSTVNNQQNNQQGNNDEED

SEQ ID NO: 139159 - protein, 37 aa, Artificial Sequence
  Description of Artificial Sequence: Synthetic polypeptide
DEEEIRTTNPVATEQYGVVSTVNNQQNGNQQGNQQNE

SEQ ID NO: 139160 - protein, 37 aa, Artificial Sequence
  Description of Artificial Sequence: Synthetic polypeptide
DEEEIRTTNPVATEQYGVVSTVNNQQGNQQGTEETED

SEQ ID NO: 139161 - protein, 37 aa, Artificial Sequence
  Description of Artificial Sequence: Synthetic polypeptide
DEIEEIDRHWVPNATEQYDGSGVSTDNLQQRSGQNRQ

SEQ ID NO: 139162 - protein, 34 aa, Artificial Sequence
  Description of Artificial Sequence: Synthetic polypeptide
DEEEIATTNPVATEQYGSVCAMTGVEPEDMGNDQ

SEQ ID NO: 139163 - protein, 36 aa, Artificial Sequence
  Description of Artificial Sequence: Synthetic polypeptide
DEEEIRTTNPVATEQYGSVCWPTGNELEGTNMEQKD

SEQ ID NO: 139164 - protein, 32 aa, Artificial Sequence
  Description of Artificial Sequence: Synthetic polypeptide
DEIEEIATTNPVAYEAWGTVSTNLNGDTNDTS

SEQ ID NO: 139165 - protein, 28 aa, Artificial Sequence
  Description of Artificial Sequence: Synthetic peptide
QEGEIAPTNPCSSEQYGIVSCGPQSGTR

SEQ ID NO: 139166 - protein, 28 aa, Artificial Sequence
  Description of Artificial Sequence: Synthetic peptide
QEGEIAPTNPCSSEQYGIVSCNLQAEDA

SEQ ID NO: 139167 - protein, 29 aa, Artificial Sequence
  Description of Artificial Sequence: Synthetic peptide
QEGEIAPTNPCSSEQYGIVSCGNLQSGTQ

SEQ ID NO: 139168 - protein, 30 aa, Artificial Sequence
  Description of Artificial Sequence: Synthetic polypeptide
QEGEIAPTNPCSSEQYGIVSCENLQSGTTR

SEQ ID NO: 139169 - protein, 36 aa, Artificial Sequence
  Description of Artificial Sequence: Synthetic polypeptide
DEEEIATTNPVATEQYGSVCAMTNGELQDNGMEGEN

SEQ ID NO: 139170 - protein, 38 aa, Artificial Sequence
  Description of Artificial Sequence: Synthetic polypeptide
DEEEIRTTNPVATEQYGVVSTVNNQLQQGNQQGTNQDE

SEQ ID NO: 139171 - protein, 37 aa, Artificial Sequence
  Description of Artificial Sequence: Synthetic polypeptide
DEEEIRTTNPVATEQYGVVSTVNNQQGNQQGTTEEEE

SEQ ID NO: 139172 - protein, 38 aa, Artificial Sequence
  Description of Artificial Sequence: Synthetic polypeptide
DEEEIRTTNPVATEQYGVVSTVNNQQLQIGTTNTEDED

SEQ ID NO: 139173 - protein, 38 aa, Artificial Sequence
  Description of Artificial Sequence: Synthetic polypeptide
DEEEIRTTNPVATEQYGVVSTVNNQLQAGNQQGTDEDE

SEQ ID NO: 139174 - protein, 34 aa, Artificial Sequence
  Description of Artificial Sequence: Synthetic polypeptide
DEEEIRTTNPVATEQYGSVDDGEMDNGGGEDGGE

SEQ ID NO: 139175 - protein, 37 aa, Artificial Sequence
  Description of Artificial Sequence: Synthetic polypeptide
DEEEIATTNPVATEQYGSVCAMTNGELQDNPGQENNL

SEQ ID NO: 139176 - protein, 37 aa, Artificial Sequence
  Description of Artificial Sequence: Synthetic polypeptide
DEEEIRTTNPVATEQYGVVSTVNNQQGNQNQGTDEQQ

SEQ ID NO: 139177 - protein, 32 aa, Artificial Sequence
  Description of Artificial Sequence: Synthetic polypeptide
DEIEIATTNPVATLQYGHVSCTRACPQPGDTM

SEQ ID NO: 139178 - protein, 34 aa, Artificial Sequence
  Description of Artificial Sequence: Synthetic polypeptide
DEEEIATTNPVATEQYGSVCAMTGVLPEQGEEFQ

SEQ ID NO: 139179 - protein, 34 aa, Artificial Sequence
  Description of Artificial Sequence: Synthetic polypeptide
DAEEIATTNPVAYEQYGSCATGNLQAAPGEIMNN

SEQ ID NO: 139180 - protein, 36 aa, Artificial Sequence
  Description of Artificial Sequence: Synthetic polypeptide
DEEEIATTNPVATEQYGSVCAMTMNGGAESEIGNER

SEQ ID NO: 139181 - protein, 35 aa, Artificial Sequence
  Description of Artificial Sequence: Synthetic polypeptide
DEEEIATTNPVATEQYGSVCAMTGVLPEDGENDQQ

SEQ ID NO: 139182 - protein, 29 aa, Artificial Sequence
  Description of Artificial Sequence: Synthetic peptide
QEGEIAPTNPCSSEQYGIVSCNHQSGSTR

SEQ ID NO: 139183 - protein, 32 aa, Artificial Sequence
  Description of Artificial Sequence: Synthetic polypeptide
DAEEIATTNPVAYEQYGSTTAGTNGTAEGNHN

SEQ ID NO: 139184 - protein, 33 aa, Artificial Sequence
  Description of Artificial Sequence: Synthetic polypeptide
DEIEIATTNPVATLQYGHVSCNRACPQPEGNFM

SEQ ID NO: 139185 - protein, 29 aa, Artificial Sequence
  Description of Artificial Sequence: Synthetic peptide
QEGEIAPTNPCSSEQYGIVSCNHQSKGTR

SEQ ID NO: 139186 - protein, 35 aa, Artificial Sequence
  Description of Artificial Sequence: Synthetic polypeptide
DEEEIATTNPVATEQYGSVCAMTGVLEEGDGENDQ

SEQ ID NO: 139187 - protein, 33 aa, Artificial Sequence
  Description of Artificial Sequence: Synthetic polypeptide
DEIEIGTTNPVATEQYGTVCSATDGPVEFEGND

SEQ ID NO: 139188 - protein, 35 aa, Artificial Sequence
  Description of Artificial Sequence: Synthetic polypeptide
DEEEIRTTNPVATEQYGSVCYPLELPQDRNEEPSE

SEQ ID NO: 139189 - protein, 29 aa, Artificial Sequence
  Description of Artificial Sequence: Synthetic peptide
QEGEIAPTNPCSSEQYGIVSCNIQSNGTR

SEQ ID NO: 139190 - protein, 28 aa, Artificial Sequence
  Description of Artificial Sequence: Synthetic peptide
QEGEIAPTNPCSSEQYGIVSCNKQSGMA

SEQ ID NO: 139191 - protein, 37 aa, Artificial Sequence
  Description of Artificial Sequence: Synthetic polypeptide
DEEEIATTNPVATEQYGSVCAMTNGELPQDNGGEHRK

SEQ ID NO: 139192 - protein, 34 aa, Artificial Sequence
  Description of Artificial Sequence: Synthetic polypeptide
DAEEIATTNPVAYEQYGSTVATNDQAAEGPNENQ

SEQ ID NO: 139193 - protein, 36 aa, Artificial Sequence
  Description of Artificial Sequence: Synthetic polypeptide
DEEEIRTTNPVATEQYGSVDNATQNDFGQEDGEEQT

SEQ ID NO: 139194 - protein, 33 aa, Artificial Sequence
  Description of Artificial Sequence: Synthetic polypeptide
DEEEIRTTNPVATEQYGSVDDGGENDGGEEDEG

SEQ ID NO: 139195 - protein, 36 aa, Artificial Sequence
  Description of Artificial Sequence: Synthetic polypeptide
DEEEIRTTNPVATEQYGVVSTVNNQQLQQNDEETET

SEQ ID NO: 139196 - protein, 35 aa, Artificial Sequence
  Description of Artificial Sequence: Synthetic polypeptide
DEEEIATTNPVATEQYGSVCAMTNGLNPDADNMEM

SEQ ID NO: 139197 - protein, 36 aa, Artificial Sequence
  Description of Artificial Sequence: Synthetic polypeptide
DEEEIRTTNPVATEQYGSVDDNTMGDEDQGEIGGNT

SEQ ID NO: 139198 - protein, 28 aa, Artificial Sequence
  Description of Artificial Sequence: Synthetic peptide
QEGEIAPTNPCSSEQYGIVSCALQSKTR

SEQ ID NO: 139199 - protein, 35 aa, Artificial Sequence
  Description of Artificial Sequence: Synthetic polypeptide
DEEEIATTNPVATEQYGSVCAMTNHGEQTLDGEDQ

SEQ ID NO: 139200 - protein, 34 aa, Artificial Sequence
  Description of Artificial Sequence: Synthetic polypeptide
DEEEIATTNPVATEQYGSVCAMTGVEPEDGENDD

SEQ ID NO: 139201 - protein, 35 aa, Artificial Sequence
  Description of Artificial Sequence: Synthetic polypeptide
DEEEIATTNPVATEQYGSVCAMTNHGEQTLDGGPT

SEQ ID NO: 139202 - protein, 28 aa, Artificial Sequence
  Description of Artificial Sequence: Synthetic peptide
QEGEIAPTNPCSSEQYGIVSCCLQSGTL

SEQ ID NO: 139203 - protein, 37 aa, Artificial Sequence
  Description of Artificial Sequence: Synthetic polypeptide
DEEEIATTNPVATEQYGSVCAMTNNDLQPDDSPGGNP

SEQ ID NO: 139204 - protein, 28 aa, Artificial Sequence
  Description of Artificial Sequence: Synthetic peptide
QEGEIAPTNPCSSEQYGIVSCNLQSEEL

SEQ ID NO: 139205 - protein, 28 aa, Artificial Sequence
  Description of Artificial Sequence: Synthetic peptide
QEGEIAPTNPCSSEQYGIVSCNLQSETG

SEQ ID NO: 139206 - protein, 36 aa, Artificial Sequence
  Description of Artificial Sequence: Synthetic polypeptide
DEEEIRTTNPVATEQYGSVDDTDLGIGQENEGETGG

SEQ ID NO: 139207 - protein, 36 aa, Artificial Sequence
  Description of Artificial Sequence: Synthetic polypeptide
DEIEIRTTNPVATEQYGSVCTPPANLETGYMEDMND

SEQ ID NO: 139208 - protein, 36 aa, Artificial Sequence
  Description of Artificial Sequence: Synthetic polypeptide
DEEEIATTNPVATEQYGSVCAMTNPDLPADGSNGDP

SEQ ID NO: 139209 - protein, 30 aa, Artificial Sequence
  Description of Artificial Sequence: Synthetic polypeptide
QEGEIAPTNPCSSEQYGIVSCNLQSGDTRE

SEQ ID NO: 139210 - protein, 35 aa, Artificial Sequence
  Description of Artificial Sequence: Synthetic polypeptide
DEEEIRTTNPVATEQYGSVCTTSYAVEPFQLVEVR

SEQ ID NO: 139211 - protein, 32 aa, Artificial Sequence
  Description of Artificial Sequence: Synthetic polypeptide
DAEEIATTNPVAYEQYGSVAANNLQENPHAPN

SEQ ID NO: 139212 - protein, 30 aa, Artificial Sequence
  Description of Artificial Sequence: Synthetic polypeptide
DEIEIRTTNPVATEQWGDVSMIEMNAAEDA

SEQ ID NO: 139213 - protein, 34 aa, Artificial Sequence
  Description of Artificial Sequence: Synthetic polypeptide
DEEEIRTTNPVATEQYGSVCVNGHDVYEDVGPDN

SEQ ID NO: 139214 - protein, 30 aa, Artificial Sequence
  Description of Artificial Sequence: Synthetic polypeptide
QEGEIAPTNPCSSEQYGIVSCENLQESGTR

SEQ ID NO: 139215 - protein, 28 aa, Artificial Sequence
  Description of Artificial Sequence: Synthetic peptide
QEGEIAPTNPCSSEQYGIVSCEKQSGTR

SEQ ID NO: 139216 - protein, 35 aa, Artificial Sequence
  Description of Artificial Sequence: Synthetic polypeptide
DEEEIRTTNPVATEQYGSVCVPYLTEVLEVGEIVL

SEQ ID NO: 139217 - protein, 36 aa, Artificial Sequence
  Description of Artificial Sequence: Synthetic polypeptide
DEEEIRTTNPVATEQYGSVDDGTNNMDEGGGGNNIQ

SEQ ID NO: 139218 - protein, 37 aa, Artificial Sequence
  Description of Artificial Sequence: Synthetic polypeptide
DEEEIRTTNPVATEQYGSVCVPTALEMQQADGQTNED

SEQ ID NO: 139219 - protein, 29 aa, Artificial Sequence
  Description of Artificial Sequence: Synthetic peptide
QEGEIAPTNPCSSEQYGIVSCNLQGGTTN

SEQ ID NO: 139220 - protein, 35 aa, Artificial Sequence
  Description of Artificial Sequence: Synthetic polypeptide
DEEEIRTTNPVATEQYGSVDDGTNNMDNGGIGQET

SEQ ID NO: 139221 - protein, 35 aa, Artificial Sequence
  Description of Artificial Sequence: Synthetic polypeptide
DEIEIRTTNPVATECWGSVSVPINEPQERVGENGI

SEQ ID NO: 139222 - protein, 36 aa, Artificial Sequence
  Description of Artificial Sequence: Synthetic polypeptide
DEEEIRTTNPVATEQYGSVCVPPENLEIRVLENDEL

SEQ ID NO: 139223 - protein, 33 aa, Artificial Sequence
  Description of Artificial Sequence: Synthetic polypeptide
DEIAEIATTNPVAYEQWGSVAWNDDQNQGDANR

SEQ ID NO: 139224 - protein, 28 aa, Artificial Sequence
  Description of Artificial Sequence: Synthetic peptide
QEGEIAPTNPCSSEQYGIVSCDLQSDTR

SEQ ID NO: 139225 - protein, 30 aa, Artificial Sequence
  Description of Artificial Sequence: Synthetic polypeptide
DEIEIRTTNPVATEQWGDVSEIEMCAAEDA

SEQ ID NO: 139226 - protein, 28 aa, Artificial Sequence
  Description of Artificial Sequence: Synthetic peptide
QEGEIAPTNPCSSEQYGIVSCNLQHETL

SEQ ID NO: 139227 - protein, 30 aa, Artificial Sequence
  Description of Artificial Sequence: Synthetic polypeptide
DEIEIRTTNPVATEQWGDVSEIEMNAAEDA

SEQ ID NO: 139228 - protein, 28 aa, Artificial Sequence
  Description of Artificial Sequence: Synthetic peptide
QEGEIAPTNPCSSEQYGIVSCDLQSGTH

SEQ ID NO: 139229 - protein, 33 aa, Artificial Sequence
  Description of Artificial Sequence: Synthetic polypeptide
DEHEIRTTNPVAYEQYGTVATNDGGQQNGGGEH

SEQ ID NO: 139230 - protein, 35 aa, Artificial Sequence
  Description of Artificial Sequence: Synthetic polypeptide
DEHEISTTNPVATEIYGSVCSNWNDGQDREGDTTR

SEQ ID NO: 139231 - protein, 36 aa, Artificial Sequence
  Description of Artificial Sequence: Synthetic polypeptide
DEEEIRTTNPVATEQYGSVDNFNLNDEQGEGGEGTN

SEQ ID NO: 139232 - protein, 37 aa, Artificial Sequence
  Description of Artificial Sequence: Synthetic polypeptide
DEEEIRTTNPVATEQYGVVSTVNQQAGNQQGNNDEDD

SEQ ID NO: 139233 - protein, 30 aa, Artificial Sequence
  Description of Artificial Sequence: Synthetic polypeptide
QEGEIAPTNPCSSEQYGTVSCNLQSGDTGR

SEQ ID NO: 139234 - protein, 37 aa, Artificial Sequence
  Description of Artificial Sequence: Synthetic polypeptide
DEEEIRTTNPVATEQYGVVSTVNNNLQNQQGTTEQGS

SEQ ID NO: 139235 - protein, 37 aa, Artificial Sequence
  Description of Artificial Sequence: Synthetic polypeptide
DEEEIRTTNPVATEQYGVVSTVNQQAGNQQGNDQEDE

SEQ ID NO: 139236 - protein, 38 aa, Artificial Sequence
  Description of Artificial Sequence: Synthetic polypeptide
DEEEIRTTNPVATEQYGVVSTVNNNLQQQQGTNNDETN

SEQ ID NO: 139237 - protein, 35 aa, Artificial Sequence
  Description of Artificial Sequence: Synthetic polypeptide
DEEEIRTTNPVATEQYGSVDNTQPGIGGDNGGETQ

SEQ ID NO: 139238 - protein, 28 aa, Artificial Sequence
  Description of Artificial Sequence: Synthetic peptide
QEGEIAPTNPCSSEQYGTVSCNLQSDTE

SEQ ID NO: 139239 - protein, 36 aa, Artificial Sequence
  Description of Artificial Sequence: Synthetic polypeptide
DEEEIATTNPVATEQYGSVCSMNNQNNEAMIGDKRN

SEQ ID NO: 139240 - protein, 28 aa, Artificial Sequence
  Description of Artificial Sequence: Synthetic peptide
QEGEIAPTNPCGTEQYGIMACNLQHGDI

SEQ ID NO: 139241 - protein, 37 aa, Artificial Sequence
  Description of Artificial Sequence: Synthetic polypeptide
DEEEIRTTNPVATEQYGVVSTVNQQAGNQANGTDEEA

SEQ ID NO: 139242 - protein, 31 aa, Artificial Sequence
  Description of Artificial Sequence: Synthetic polypeptide
DEHEIRTTNPVAYERYGVVTGGNPAGDNNER

SEQ ID NO: 139243 - protein, 34 aa, Artificial Sequence
  Description of Artificial Sequence: Synthetic polypeptide
DEEEIRTTNPVATEQYGSVDNTEMDWYQNVLEME

SEQ ID NO: 139244 - protein, 32 aa, Artificial Sequence
  Description of Artificial Sequence: Synthetic polypeptide
DEHEIRTTNPVAYERYGVVTGGNPNAGQDNER

SEQ ID NO: 139245 - protein, 37 aa, Artificial Sequence
  Description of Artificial Sequence: Synthetic polypeptide
DEEEIRTTNPVATEQYGVVSTVNQQAGNQAIGTDEQD

SEQ ID NO: 139246 - protein, 37 aa, Artificial Sequence
  Description of Artificial Sequence: Synthetic polypeptide
DEEEIRTTNPVATEQYGVVSTVNQQAGNQAGNTETGS

SEQ ID NO: 139247 - protein, 37 aa, Artificial Sequence
  Description of Artificial Sequence: Synthetic polypeptide
DEEEIRTTNPVATEQYGVVSTVNQNQQGNQQSTEEDT

SEQ ID NO: 139248 - protein, 29 aa, Artificial Sequence
  Description of Artificial Sequence: Synthetic peptide
QEGEIAPTNPCSSEQYGTVSCNLQDGTEM

SEQ ID NO: 139249 - protein, 36 aa, Artificial Sequence
  Description of Artificial Sequence: Synthetic polypeptide
DEEEIATTNPVATEQYGSVCPTDNDQNQQGQRNDGN

SEQ ID NO: 139250 - protein, 35 aa, Artificial Sequence
  Description of Artificial Sequence: Synthetic polypeptide
DEEEIRTTNPVATEQYGSVCTDTPLPDDSGDMGDN

SEQ ID NO: 139251 - protein, 36 aa, Artificial Sequence
  Description of Artificial Sequence: Synthetic polypeptide
DEEEIRTTNPVATEQYGSVCTDTPLPDDSGDGMGNE

SEQ ID NO: 139252 - protein, 33 aa, Artificial Sequence
  Description of Artificial Sequence: Synthetic polypeptide
DEKEIVTTNPVATEQYGDVCSATDGPVEFEGND

SEQ ID NO: 139253 - protein, 33 aa, Artificial Sequence
  Description of Artificial Sequence: Synthetic polypeptide
DEKEIVTTNPVATEQYGTVCSATDGPVEFEGND

SEQ ID NO: 139254 - protein, 35 aa, Artificial Sequence
  Description of Artificial Sequence: Synthetic polypeptide
DEEEIRTTNPVATEQYGSVDNPRNPLNENFVVERI

SEQ ID NO: 139255 - protein, 35 aa, Artificial Sequence
  Description of Artificial Sequence: Synthetic polypeptide
DEEEIATTNPVATEQYGSVCSMPQDNGTPMGENGN

SEQ ID NO: 139256 - protein, 31 aa, Artificial Sequence
  Description of Artificial Sequence: Synthetic polypeptide
DAEEIATTNPVAYEPYGSVCTTDQGNPNPPV

SEQ ID NO: 139257 - protein, 29 aa, Artificial Sequence
  Description of Artificial Sequence: Synthetic peptide
QEGEIAPTNPCSSEQYGQVSCNLESGTRG

SEQ ID NO: 139258 - protein, 30 aa, Artificial Sequence
  Description of Artificial Sequence: Synthetic polypeptide
QEGEIAPTNPCSSEQYGQVSCNLQSDGTTR

SEQ ID NO: 139259 - protein, 37 aa, Artificial Sequence
  Description of Artificial Sequence: Synthetic polypeptide
DEEEIRTTNPVATEQYGVVSTVNQNQLQNNGTTEEEE

SEQ ID NO: 139260 - protein, 35 aa, Artificial Sequence
  Description of Artificial Sequence: Synthetic polypeptide
DEEEIRTTNPVATEQYGSVDNPRVLHINNFVAERI

SEQ ID NO: 139261 - protein, 34 aa, Artificial Sequence
  Description of Artificial Sequence: Synthetic polypeptide
DEEEIATTNPVATEQYGSVCAMNNNLEPSDIDNA

SEQ ID NO: 139262 - protein, 28 aa, Artificial Sequence
  Description of Artificial Sequence: Synthetic peptide
QEGEIAPTNPCSSEQYGTVACNLQSGTQ

SEQ ID NO: 139263 - protein, 37 aa, Artificial Sequence
  Description of Artificial Sequence: Synthetic polypeptide
DEEEIRTTNPVATEQYGVVSTVNNNNQQGNQQGNTEE

SEQ ID NO: 139264 - protein, 29 aa, Artificial Sequence
  Description of Artificial Sequence: Synthetic peptide
QEGEIAPTNPCSSEQYGTVSCNLQSGTDI

SEQ ID NO: 139265 - protein, 34 aa, Artificial Sequence
  Description of Artificial Sequence: Synthetic polypeptide
DEEEIATTNPVATEQYGSVCAMNNHTAPDNQERH

SEQ ID NO: 139266 - protein, 30 aa, Artificial Sequence
  Description of Artificial Sequence: Synthetic polypeptide
DEHEIRTTNPVAYERWGVVTGMNDAGDNER

SEQ ID NO: 139267 - protein, 37 aa, Artificial Sequence
  Description of Artificial Sequence: Synthetic polypeptide
DEEEIRTTNPVATEQYGVVSTVNQQGGNQQGTEEEED

SEQ ID NO: 139268 - protein, 35 aa, Artificial Sequence
  Description of Artificial Sequence: Synthetic polypeptide
DEEEIRTTNPVATEQYGSVDSDNMNMGEGGGQQEG

SEQ ID NO: 139269 - protein, 35 aa, Artificial Sequence
  Description of Artificial Sequence: Synthetic polypeptide
DEEEIATTNPVATEQYGSVCSPMNGHVSDDPGQRN

SEQ ID NO: 139270 - protein, 38 aa, Artificial Sequence
  Description of Artificial Sequence: Synthetic polypeptide
DEEEIRTTNPVATEQYGVVSTVNLQSGNTEQGTNQQGQ

SEQ ID NO: 139271 - protein, 36 aa, Artificial Sequence
  Description of Artificial Sequence: Synthetic polypeptide
DEEEIRTTNPVATEQYGSVDSGMNGQNQEGGGGEEG

SEQ ID NO: 139272 - protein, 37 aa, Artificial Sequence
  Description of Artificial Sequence: Synthetic polypeptide
DEEEIRTTNPVATEQYGVVSTVNQQGNQNIGTNQEEE

SEQ ID NO: 139273 - protein, 36 aa, Artificial Sequence
  Description of Artificial Sequence: Synthetic polypeptide
DEEEIATTNPVATEQYGSVCSPANTHQEAEDGNEND

SEQ ID NO: 139274 - protein, 34 aa, Artificial Sequence
  Description of Artificial Sequence: Synthetic polypeptide
DEEEIATTNPVATEQYGSVCSPPGGAEAEGGNEN

SEQ ID NO: 139275 - protein, 30 aa, Artificial Sequence
  Description of Artificial Sequence: Synthetic polypeptide
DELEIRTTNPVATEQWGDVSEIEMNAAEDA

SEQ ID NO: 139276 - protein, 30 aa, Artificial Sequence
  Description of Artificial Sequence: Synthetic polypeptide
DELEIRTTNPVATEQWGDVSEIEYNAAEDA

SEQ ID NO: 139277 - protein, 30 aa, Artificial Sequence
  Description of Artificial Sequence: Synthetic polypeptide
DELEIRTTNPVATEQWGDVSEIVMNAAEDA

SEQ ID NO: 139278 - protein, 28 aa, Artificial Sequence
  Description of Artificial Sequence: Synthetic peptide
QEGEIAPTNPCSSESYGIVACNLQSGTR

SEQ ID NO: 139279 - protein, 32 aa, Artificial Sequence
  Description of Artificial Sequence: Synthetic polypeptide
DAEEIATTNPVAYEQYGSVCMAGTQNPQGVDD

SEQ ID NO: 139280 - protein, 36 aa, Artificial Sequence
  Description of Artificial Sequence: Synthetic polypeptide
DEEEIRTTNPVATEQYGSVDSITMGAEQVMLMEGDS

SEQ ID NO: 139281 - protein, 30 aa, Artificial Sequence
  Description of Artificial Sequence: Synthetic polypeptide
DELEIRTTNPVATEQWGDVSCIEMNAAEDA

SEQ ID NO: 139282 - protein, 28 aa, Artificial Sequence
  Description of Artificial Sequence: Synthetic peptide
QEGEIAPTNPCSSAQYGIVSCNFQSGTR

SEQ ID NO: 139283 - protein, 28 aa, Artificial Sequence
  Description of Artificial Sequence: Synthetic peptide
QEGEIAPTNPCSSEQYGVVSCNTQSDTR

SEQ ID NO: 139284 - protein, 28 aa, Artificial Sequence
  Description of Artificial Sequence: Synthetic peptide
QEGEIAPTNPCATEQYGIVSCVCQHETK

SEQ ID NO: 139285 - protein, 31 aa, Artificial Sequence
  Description of Artificial Sequence: Synthetic polypeptide
DEHEIRTTNPVAYERWGVATTNPNDNGDNER

SEQ ID NO: 139286 - protein, 38 aa, Artificial Sequence
  Description of Artificial Sequence: Synthetic polypeptide
DEEEIRTTNPVATEQYGVVSTVNNLQQGNNQQGQTEEE

SEQ ID NO: 139287 - protein, 30 aa, Artificial Sequence
  Description of Artificial Sequence: Synthetic polypeptide
DEHEIRTTNPVAYERWGVATTNPDGQDNER

SEQ ID NO: 139288 - protein, 38 aa, Artificial Sequence
  Description of Artificial Sequence: Synthetic polypeptide
DEEEIRTTNPVATEQYGVVSTVNNLQQGNNQQGEEEDE

SEQ ID NO: 139289 - protein, 37 aa, Artificial Sequence
  Description of Artificial Sequence: Synthetic polypeptide
DEEEIRTTNPVATEQYGVVSTVNQQAGNQQGTTDEEE

SEQ ID NO: 139290 - protein, 37 aa, Artificial Sequence
  Description of Artificial Sequence: Synthetic polypeptide
DEEEIRTTNPVATEQYGVVSTVNQQAGNQQNTTEESE

SEQ ID NO: 139291 - protein, 33 aa, Artificial Sequence
  Description of Artificial Sequence: Synthetic polypeptide
DEHEIRTTNPVAYEQYGTVYCTDFQNDRGGGGA

SEQ ID NO: 139292 - protein, 30 aa, Artificial Sequence
  Description of Artificial Sequence: Synthetic polypeptide
QEGEIAPTNPCSSEQYGTVSCNLQSGTTRK

SEQ ID NO: 139293 - protein, 37 aa, Artificial Sequence
  Description of Artificial Sequence: Synthetic polypeptide
DEEEIRTTNPVATEQYGVVSTVNQQAGNTEQGNSTTD

SEQ ID NO: 139294 - protein, 36 aa, Artificial Sequence
  Description of Artificial Sequence: Synthetic polypeptide
DEEEIRTTNPVATEQYGSVDPGFNTNGQGQEGEGGQ

SEQ ID NO: 139295 - protein, 35 aa, Artificial Sequence
  Description of Artificial Sequence: Synthetic polypeptide
DEEEIRTTNPVATEQYGSVDPTTTEHMEMEGQNVQ

SEQ ID NO: 139296 - protein, 35 aa, Artificial Sequence
  Description of Artificial Sequence: Synthetic polypeptide
DEEEIRTTNPVATEQYGSVDQEGQNIQDGGEEDEG

SEQ ID NO: 139297 - protein, 30 aa, Artificial Sequence
  Description of Artificial Sequence: Synthetic polypeptide
DEHEIRTTNPVAYERWGNVTTNPDGNDNEE

SEQ ID NO: 139298 - protein, 30 aa, Artificial Sequence
  Description of Artificial Sequence: Synthetic polypeptide
QEGEIAPTNPCSSEQYGVVSCNLQSGGGTR

SEQ ID NO: 139299 - protein, 36 aa, Artificial Sequence
  Description of Artificial Sequence: Synthetic polypeptide
DEEEIRTTNPVATEQYGSVDNTTPAGPNMRNGMNPV

SEQ ID NO: 139300 - protein, 34 aa, Artificial Sequence
  Description of Artificial Sequence: Synthetic polypeptide
DEHEIRTTNPVAYESWGSVSGDNLEGDRQGENGK

SEQ ID NO: 139301 - protein, 34 aa, Artificial Sequence
  Description of Artificial Sequence: Synthetic polypeptide
DEHEIRTTNPVAYESWGSVSGDNLNGDRQGDNDK

SEQ ID NO: 139302 - protein, 35 aa, Artificial Sequence
  Description of Artificial Sequence: Synthetic polypeptide
DEEEIRTTNPVATEQYGSVCTEMLVQDVQLLEVLG

SEQ ID NO: 139303 - protein, 32 aa, Artificial Sequence
  Description of Artificial Sequence: Synthetic polypeptide
DEHEIRTTNPVGYEAYGSVSQIMISTPVGGNR

SEQ ID NO: 139304 - protein, 36 aa, Artificial Sequence
  Description of Artificial Sequence: Synthetic polypeptide
DEEEIATTNPVATEQYGSVCATNPEEAPDDQHNNRW

SEQ ID NO: 139305 - protein, 34 aa, Artificial Sequence
  Description of Artificial Sequence: Synthetic polypeptide
DEEEIATTNPVATEQYGSVCATNPEQQDDQTEGT

SEQ ID NO: 139306 - protein, 28 aa, Artificial Sequence
  Description of Artificial Sequence: Synthetic peptide
QEGEIAPTNPCSSEQYGIVSCQLQSQTR

SEQ ID NO: 139307 - protein, 29 aa, Artificial Sequence
  Description of Artificial Sequence: Synthetic peptide
QEGEIAPTNPCSSEQWGIVSCNLQSEGTR

SEQ ID NO: 139308 - protein, 29 aa, Artificial Sequence
  Description of Artificial Sequence: Synthetic peptide
QEGEIAPTNPCSSEQYGIVSCSNTQSGTR

SEQ ID NO: 139309 - protein, 29 aa, Artificial Sequence
  Description of Artificial Sequence: Synthetic peptide
QEGEIAPTNPCSSEQWGIVSCNLQSGTQR

SEQ ID NO: 139310 - protein, 28 aa, Artificial Sequence
  Description of Artificial Sequence: Synthetic peptide
QEGEIAPTNPCSSEQWGIVSCNLMSGTR

SEQ ID NO: 139311 - protein, 28 aa, Artificial Sequence
  Description of Artificial Sequence: Synthetic peptide
QEGEIAPTNPCSSEQYGIVSCVLQSETR

SEQ ID NO: 139312 - protein, 28 aa, Artificial Sequence
  Description of Artificial Sequence: Synthetic peptide
QEGEIAPTNPCSSEQWGIVSCNLMSGDR

SEQ ID NO: 139313 - protein, 28 aa, Artificial Sequence
  Description of Artificial Sequence: Synthetic peptide
QEGEIAPTNPCSSEQFGIVSCNLQSGTF

SEQ ID NO: 139314 - protein, 29 aa, Artificial Sequence
  Description of Artificial Sequence: Synthetic peptide
QEGEIAPTNPCSSEPYGIVSCNLQSPGTR

SEQ ID NO: 139315 - protein, 29 aa, Artificial Sequence
  Description of Artificial Sequence: Synthetic peptide
QEGEIAPTNPCSSEPYGIVSCNLQSGTRM

SEQ ID NO: 139316 - protein, 37 aa, Artificial Sequence
  Description of Artificial Sequence: Synthetic polypeptide
DEEEIRTTNPVATEQYGVVSTVNQNNNQQGNNNQNQD

SEQ ID NO: 139317 - protein, 32 aa, Artificial Sequence
  Description of Artificial Sequence: Synthetic polypeptide
DEHEIRTTNPVAYQQYGCVCLWNDDERGHNQN

SEQ ID NO: 139318 - protein, 29 aa, Artificial Sequence
  Description of Artificial Sequence: Synthetic peptide
QEGEIAPTNPCSSEPYGIVSCNLQSGGTR

SEQ ID NO: 139319 - protein, 28 aa, Artificial Sequence
  Description of Artificial Sequence: Synthetic peptide
QEGEIAPTNPCSSEQYGIVSCNVQSLTR

SEQ ID NO: 139320 - protein, 28 aa, Artificial Sequence
  Description of Artificial Sequence: Synthetic peptide
QEGEIAPTNPCSSEQYGIVSCNVQLETR

SEQ ID NO: 139321 - protein, 35 aa, Artificial Sequence
  Description of Artificial Sequence: Synthetic polypeptide
DEEEIRTTNPVATEQYGSVDNFNNMNVDIGGNGEE

SEQ ID NO: 139322 - protein, 29 aa, Artificial Sequence
  Description of Artificial Sequence: Synthetic peptide
QEGEIAPTNPCSSEQYGIVSCNNLQSGTG

SEQ ID NO: 139323 - protein, 29 aa, Artificial Sequence
  Description of Artificial Sequence: Synthetic peptide
QEGEIAPTNPCSSEQYGAVSCNLQKGETG

SEQ ID NO: 139324 - protein, 37 aa, Artificial Sequence
  Description of Artificial Sequence: Synthetic polypeptide
DEEEIRTTNPVATEQYGVVSTVNQNGNQQGNNQEEET

SEQ ID NO: 139325 - protein, 28 aa, Artificial Sequence
  Description of Artificial Sequence: Synthetic peptide
QEGEIAPTNPCSSEQYGIVSCNNQSGTN

SEQ ID NO: 139326 - protein, 34 aa, Artificial Sequence
  Description of Artificial Sequence: Synthetic polypeptide
DEEEIATTNPVATEQYGSVCATNNPAEANAENGE

SEQ ID NO: 139327 - protein, 28 aa, Artificial Sequence
  Description of Artificial Sequence: Synthetic peptide
QEGEIAPTNPCSSEQWGIVSENLQSGTA

SEQ ID NO: 139328 - protein, 29 aa, Artificial Sequence
  Description of Artificial Sequence: Synthetic peptide
QEGEIAPTNPCSSEQYGAVSCNDLQSGTN

SEQ ID NO: 139329 - protein, 28 aa, Artificial Sequence
  Description of Artificial Sequence: Synthetic peptide
QEGEIAPTNPCSSEQYGIVSCNQQSGTY

SEQ ID NO: 139330 - protein, 29 aa, Artificial Sequence
  Description of Artificial Sequence: Synthetic peptide
QEGEIAPTNPCSSEQWGVVSCNLQSGDTR

SEQ ID NO: 139331 - protein, 36 aa, Artificial Sequence
  Description of Artificial Sequence: Synthetic polypeptide
DEEEIATTNPVATEQYGSVCATNNPMQQRNQDEGTA

SEQ ID NO: 139332 - protein, 29 aa, Artificial Sequence
  Description of Artificial Sequence: Synthetic peptide
QEGEIAPTNPCSSEQWGTVSCNLQSGGTR

SEQ ID NO: 139333 - protein, 35 aa, Artificial Sequence
  Description of Artificial Sequence: Synthetic polypeptide
DEEEIATTNPVATEQYGSVCATNNQDQDSDDNAYG

SEQ ID NO: 139334 - protein, 35 aa, Artificial Sequence
  Description of Artificial Sequence: Synthetic polypeptide
DEEEIATTNPVATEQYGSVCATNPEEAGDGQMGLH

SEQ ID NO: 139335 - protein, 35 aa, Artificial Sequence
  Description of Artificial Sequence: Synthetic polypeptide
DEEEIATTNPVATEQYGSVCATNNPMQQGMQTQGT

SEQ ID NO: 139336 - protein, 30 aa, Artificial Sequence
  Description of Artificial Sequence: Synthetic polypeptide
QEGEIAPTNPCSSEQYGIVSCNLQSVGATR

SEQ ID NO: 139337 - protein, 32 aa, Artificial Sequence
  Description of Artificial Sequence: Synthetic polypeptide
DEHEIRTTNPVAYQQYGCVAGTNDEHHGGNHP

SEQ ID NO: 139338 - protein, 37 aa, Artificial Sequence
  Description of Artificial Sequence: Synthetic polypeptide
DEEEIRTTNPVATEQYGVVSTVNQNNNQQGNNTEDED

SEQ ID NO: 139339 - protein, 36 aa, Artificial Sequence
  Description of Artificial Sequence: Synthetic polypeptide
DEKEIRTTNPVATEQYGSVSSTTKAGPNMRNGMNPV

SEQ ID NO: 139340 - protein, 34 aa, Artificial Sequence
  Description of Artificial Sequence: Synthetic polypeptide
DEEEIRTTNPVATEQYGSVCTGALTYTPDSDQFD

SEQ ID NO: 139341 - protein, 36 aa, Artificial Sequence
  Description of Artificial Sequence: Synthetic polypeptide
DEKEIRTTNPVATEQYGSVSSTTPAGPNMRNGMNPV

SEQ ID NO: 139342 - protein, 29 aa, Artificial Sequence
  Description of Artificial Sequence: Synthetic peptide
QEGEIAPTNPCSSEGYGIVACNLQSRGTR

SEQ ID NO: 139343 - protein, 35 aa, Artificial Sequence
  Description of Artificial Sequence: Synthetic polypeptide
DEEEIRTTNPVATEQYGSVDNPRIVLGNNFVAERL

SEQ ID NO: 139344 - protein, 34 aa, Artificial Sequence
  Description of Artificial Sequence: Synthetic polypeptide
DEHEIRTTNPVAYESWGSVSGDNQLGDRQGDNGN

SEQ ID NO: 139345 - protein, 37 aa, Artificial Sequence
  Description of Artificial Sequence: Synthetic polypeptide
DEEEIRTTNPVATEQYGVVSTVNQNQLQGNNEEEEEI

SEQ ID NO: 139346 - protein, 28 aa, Artificial Sequence
  Description of Artificial Sequence: Synthetic peptide
QEGEIAPTNPCSSECYGIVSCNLQSGTL

SEQ ID NO: 139347 - protein, 28 aa, Artificial Sequence
  Description of Artificial Sequence: Synthetic peptide
QEGEIAPTNPCSSECYGIVACNLQSGTR

SEQ ID NO: 139348 - protein, 34 aa, Artificial Sequence
  Description of Artificial Sequence: Synthetic polypeptide
DEHEIRTTNPVAYESWGSVSGDNLNGDRQGQNGP

SEQ ID NO: 139349 - protein, 28 aa, Artificial Sequence
  Description of Artificial Sequence: Synthetic peptide
QEGEIAPTNPCSSEAYGIVSCNYQSGTR

SEQ ID NO: 139350 - protein, 34 aa, Artificial Sequence
  Description of Artificial Sequence: Synthetic polypeptide
DEEEIRTTNPVATEQYGSVCTETHAEAIPNMHET

SEQ ID NO: 139351 - protein, 34 aa, Artificial Sequence
  Description of Artificial Sequence: Synthetic polypeptide
DEHEIRTTNPVAYESWGSVSGDNLNGDRQGDNQM

SEQ ID NO: 139352 - protein, 28 aa, Artificial Sequence
  Description of Artificial Sequence: Synthetic peptide
QEGEIAPTNPCSSDMYGIVSCNLQSGTR

SEQ ID NO: 139353 - protein, 28 aa, Artificial Sequence
  Description of Artificial Sequence: Synthetic peptide
QEGEIAPTNPCSSECYGIVSCCLQSGTR

SEQ ID NO: 139354 - protein, 36 aa, Artificial Sequence
  Description of Artificial Sequence: Synthetic polypeptide
DEEEIATTNPVATEQYGSVCATNPQLNPDDQMGDTM

SEQ ID NO: 139355 - protein, 28 aa, Artificial Sequence
  Description of Artificial Sequence: Synthetic peptide
QEGEIAPTNPCSSEGYGIVSCNLQSFTR

SEQ ID NO: 139356 - protein, 37 aa, Artificial Sequence
  Description of Artificial Sequence: Synthetic polypeptide
DEEEIRTTNPVATEQYGVVSTVNQNNQQGNNNEDEDT

SEQ ID NO: 139357 - protein, 28 aa, Artificial Sequence
  Description of Artificial Sequence: Synthetic peptide
QEGEIAPTNPCSSEQYGIVSENLQSEEL

SEQ ID NO: 139358 - protein, 28 aa, Artificial Sequence
  Description of Artificial Sequence: Synthetic peptide
QEGEIAPTNPCSSEQYGIVSENLQSETK

SEQ ID NO: 139359 - protein, 32 aa, Artificial Sequence
  Description of Artificial Sequence: Synthetic polypeptide
DEHEIRTTNPVAYMQWGSVPTWEDQHQGNNDV

SEQ ID NO: 139360 - protein, 32 aa, Artificial Sequence
  Description of Artificial Sequence: Synthetic polypeptide
DEHEIRTTNPVAYMQWGSVPTWEDQHQGNAGH

SEQ ID NO: 139361 - protein, 31 aa, Artificial Sequence
  Description of Artificial Sequence: Synthetic polypeptide
DEHEIRTTNPVAYMQWGSVPTWEDQHQGGMD

SEQ ID NO: 139362 - protein, 34 aa, Artificial Sequence
  Description of Artificial Sequence: Synthetic polypeptide
DEEEIATTNPVATEQYGSVCATPLADAHLDGEAP

SEQ ID NO: 139363 - protein, 37 aa, Artificial Sequence
  Description of Artificial Sequence: Synthetic polypeptide
DEEEIRTTNPVATEQYGVVSTVNQNNQQQGTNDTTDD

SEQ ID NO: 139364 - protein, 28 aa, Artificial Sequence
  Description of Artificial Sequence: Synthetic peptide
QEGEIAPTNPCSSEPYGIISCNLQSGTR

SEQ ID NO: 139365 - protein, 28 aa, Artificial Sequence
  Description of Artificial Sequence: Synthetic peptide
QEGEIAPTNPCSSEIYGIISCNLQSGTR

SEQ ID NO: 139366 - protein, 34 aa, Artificial Sequence
  Description of Artificial Sequence: Synthetic polypeptide
DEEEIATTNPVATEQYGSVCATTPGGAEAPIGDR

SEQ ID NO: 139367 - protein, 36 aa, Artificial Sequence
  Description of Artificial Sequence: Synthetic polypeptide
DEEEIRTTNPVATEQYGSVCTMSMLQQENNLQQVQT

SEQ ID NO: 139368 - protein, 28 aa, Artificial Sequence
  Description of Artificial Sequence: Synthetic peptide
QEGEIAPTNPCSSEQYGIVVCNHQSGTR

SEQ ID NO: 139369 - protein, 30 aa, Artificial Sequence
  Description of Artificial Sequence: Synthetic polypeptide
DEKEIRTTNPVATEQWGDVSEIEMNAAEDA

SEQ ID NO: 139370 - protein, 31 aa, Artificial Sequence
  Description of Artificial Sequence: Synthetic polypeptide
DEKEIRTTNPVATEQWGDVSEIEMNAAEDSA

SEQ ID NO: 139371 - protein, 33 aa, Artificial Sequence
  Description of Artificial Sequence: Synthetic polypeptide
DEKEIRTTNIVATECWGSVSCINEPQDREVENG

SEQ ID NO: 139372 - protein, 32 aa, Artificial Sequence
  Description of Artificial Sequence: Synthetic polypeptide
DEHEIATTNPVAYEQWGSVSGDNDNNRGDSLM

SEQ ID NO: 139373 - protein, 30 aa, Artificial Sequence
  Description of Artificial Sequence: Synthetic polypeptide
QEEEVASTNPVATEQYGNVAETCQSRVGQK

SEQ ID NO: 139374 - protein, 33 aa, Artificial Sequence
  Description of Artificial Sequence: Synthetic polypeptide
DAGEIATTNPVAYEQWGSVCTENHLDDLRGDMR

SEQ ID NO: 139375 - protein, 33 aa, Artificial Sequence
  Description of Artificial Sequence: Synthetic polypeptide
DEMEIATTNPVATEQYGTVCSATDGPVEFEGNK

SEQ ID NO: 139376 - protein, 33 aa, Artificial Sequence
  Description of Artificial Sequence: Synthetic polypeptide
DEMEIATTNPVATEQYGTVCSATDGPVEFEGND

SEQ ID NO: 139377 - protein, 37 aa, Artificial Sequence
  Description of Artificial Sequence: Synthetic polypeptide
DEEEIRTTNPVATEQYGVVSTVVGNNLQQGTEEGSTD

SEQ ID NO: 139378 - protein, 32 aa, Artificial Sequence
  Description of Artificial Sequence: Synthetic polypeptide
DEEEIATTNPVAYEQWGSVCYNQDGDTGNNQA

SEQ ID NO: 139379 - protein, 30 aa, Artificial Sequence
  Description of Artificial Sequence: Synthetic polypeptide
DCEEIRATNPVAYEQWGSSYYTEHMQHGEQ

SEQ ID NO: 139380 - protein, 32 aa, Artificial Sequence
  Description of Artificial Sequence: Synthetic polypeptide
DCEEIRATNPVAYEQWGSSYYTEHGQRGMNND

SEQ ID NO: 139381 - protein, 35 aa, Artificial Sequence
  Description of Artificial Sequence: Synthetic polypeptide
DEEEIATTNPVAYEQWGSVCSNWNDGQNERQGNDG

SEQ ID NO: 139382 - protein, 33 aa, Artificial Sequence
  Description of Artificial Sequence: Synthetic polypeptide
DEEEIATTNPVAYEQWGSVCSNWEHQEQDMINR

SEQ ID NO: 139383 - protein, 37 aa, Artificial Sequence
  Description of Artificial Sequence: Synthetic polypeptide
AEEEIRTTNPVATEQYGSVSTVVTNNLQQNDENNESE

SEQ ID NO: 139384 - protein, 33 aa, Artificial Sequence
  Description of Artificial Sequence: Synthetic polypeptide
DEEEIATTNPVAYEQWGSVCNTIQREGRGDTDR

SEQ ID NO: 139385 - protein, 37 aa, Artificial Sequence
  Description of Artificial Sequence: Synthetic polypeptide
DEHEIRTTNPVATEQYGSVVSTNTMLEELENGNEEVF

SEQ ID NO: 139386 - protein, 33 aa, Artificial Sequence
  Description of Artificial Sequence: Synthetic polypeptide
DEEEIATTNPVAYEQWGSVCNTFNREGQGDTDR

SEQ ID NO: 139387 - protein, 34 aa, Artificial Sequence
  Description of Artificial Sequence: Synthetic polypeptide
DEEEIATTNPVATEQYGSVCAAMNPGNDMDGNAN

SEQ ID NO: 139388 - protein, 34 aa, Artificial Sequence
  Description of Artificial Sequence: Synthetic polypeptide
DEMEIATTNPVATEQYGTVCSATDGPQEFEGNDH

SEQ ID NO: 139389 - protein, 32 aa, Artificial Sequence
  Description of Artificial Sequence: Synthetic polypeptide
DEEEIATTNPVAYEQWGSVCMAGTEGNHQVND

SEQ ID NO: 139390 - protein, 33 aa, Artificial Sequence
  Description of Artificial Sequence: Synthetic polypeptide
DEMEIATTNPVATEQYGTVCSATDGPGEMEGND

SEQ ID NO: 139391 - protein, 35 aa, Artificial Sequence
  Description of Artificial Sequence: Synthetic polypeptide
DEEEIATTNPVATEQYGSVCAAMNPLNDMDGGMNH

SEQ ID NO: 139392 - protein, 30 aa, Artificial Sequence
  Description of Artificial Sequence: Synthetic polypeptide
QEGEIATTNPVSSEQYGIVSCDLEHEGEDR

SEQ ID NO: 139393 - protein, 35 aa, Artificial Sequence
  Description of Artificial Sequence: Synthetic polypeptide
DEEEIATTNPVAYEQWGSVAKTNDLQEQRMGDHAK

SEQ ID NO: 139394 - protein, 33 aa, Artificial Sequence
  Description of Artificial Sequence: Synthetic polypeptide
DEMEIATTNPVATEQYGTVCSATDGHSEGEGND

SEQ ID NO: 139395 - protein, 33 aa, Artificial Sequence
  Description of Artificial Sequence: Synthetic polypeptide
DEMEIATTNPVATEQYGTVCSATDGIVEFEGND

SEQ ID NO: 139396 - protein, 34 aa, Artificial Sequence
  Description of Artificial Sequence: Synthetic polypeptide
DEEEIRTTNPVATEQYGSVETMPGHQEQPIEQVS

SEQ ID NO: 139397 - protein, 33 aa, Artificial Sequence
  Description of Artificial Sequence: Synthetic polypeptide
DEMEIATTNPVATEQYGTVCSATDGLVEFEEND

SEQ ID NO: 139398 - protein, 33 aa, Artificial Sequence
  Description of Artificial Sequence: Synthetic polypeptide
DEMEIATTNPVATEQYGTVCSATDGPVEFEGNL

SEQ ID NO: 139399 - protein, 34 aa, Artificial Sequence
  Description of Artificial Sequence: Synthetic polypeptide
DEEEIATTNPVATEQYGSVCAAMNPLNDMDPLGN

SEQ ID NO: 139400 - protein, 30 aa, Artificial Sequence
  Description of Artificial Sequence: Synthetic polypeptide
QEGEIATTNPVSSEQYGTISCNIQQQNGNH

SEQ ID NO: 139401 - protein, 34 aa, Artificial Sequence
  Description of Artificial Sequence: Synthetic polypeptide
DEEEIATTNPVAYEQWGSVAPTWNDHQERDMPRM

SEQ ID NO: 139402 - protein, 35 aa, Artificial Sequence
  Description of Artificial Sequence: Synthetic polypeptide
DEEEIATTNPVATEQYGSVCAAMNPLNDMDGNENM

SEQ ID NO: 139403 - protein, 33 aa, Artificial Sequence
  Description of Artificial Sequence: Synthetic polypeptide
DEMEIATTNPVATEQYGTVCSATDGPDGFEGND

SEQ ID NO: 139404 - protein, 33 aa, Artificial Sequence
  Description of Artificial Sequence: Synthetic polypeptide
DEEEIATTNPVAYEQWGSVAWTEHDQRDFDGSM

SEQ ID NO: 139405 - protein, 33 aa, Artificial Sequence
  Description of Artificial Sequence: Synthetic polypeptide
DEMEIATTNPVATEQYGTVCSATDGPEEGDGND

SEQ ID NO: 139406 - protein, 33 aa, Artificial Sequence
  Description of Artificial Sequence: Synthetic polypeptide
DEMEIATTNPVATEQYGTVCSATDGMVEDEGND

SEQ ID NO: 139407 - protein, 36 aa, Artificial Sequence
  Description of Artificial Sequence: Synthetic polypeptide
AEEEIRTTNPVATEQYGSVSTVVTNGTNQADEQIRE

SEQ ID NO: 139408 - protein, 33 aa, Artificial Sequence
  Description of Artificial Sequence: Synthetic polypeptide
DEEEIATTNPVAYEQWGSVSGGGGNHQGEGGLG

SEQ ID NO: 139409 - protein, 37 aa, Artificial Sequence
  Description of Artificial Sequence: Synthetic polypeptide
AEEEIRTTNPVATEQYGSVSTVVTNGNNQEDEGTNVA

SEQ ID NO: 139410 - protein, 36 aa, Artificial Sequence
  Description of Artificial Sequence: Synthetic polypeptide
DEEEIRTTNPVATEQYGVVSTVVNLEEGTTTEEEED

SEQ ID NO: 139411 - protein, 38 aa, Artificial Sequence
  Description of Artificial Sequence: Synthetic polypeptide
DEEEIRTTNPVATEQYGVVSTVVNLNQQGNQQGTNQDE

SEQ ID NO: 139412 - protein, 37 aa, Artificial Sequence
  Description of Artificial Sequence: Synthetic polypeptide
AEEEIRTTNPVATEQYGSVSTVVTDGTNNQLGGNEDE

SEQ ID NO: 139413 - protein, 38 aa, Artificial Sequence
  Description of Artificial Sequence: Synthetic polypeptide
DEEEIRTTNPVATEQYGVVSTTVVSNLQAGNNDEDEDE

SEQ ID NO: 139414 - protein, 37 aa, Artificial Sequence
  Description of Artificial Sequence: Synthetic polypeptide
AEEEIRTTNPVATEQYGSVSTVVTDGNNQLGGNNDDT

SEQ ID NO: 139415 - protein, 33 aa, Artificial Sequence
  Description of Artificial Sequence: Synthetic polypeptide
DEEEIATTNPVAYEQWGSVSGGNGNHSGEGNSA

SEQ ID NO: 139416 - protein, 31 aa, Artificial Sequence
  Description of Artificial Sequence: Synthetic polypeptide
QEGEIRPTNPVSTEQYGIVSCNLPNSGMTPV

SEQ ID NO: 139417 - protein, 34 aa, Artificial Sequence
  Description of Artificial Sequence: Synthetic polypeptide
DEEEIATTNPVATEQYGSVCAAMNHLQAMPEDTP

SEQ ID NO: 139418 - protein, 35 aa, Artificial Sequence
  Description of Artificial Sequence: Synthetic polypeptide
DEEEIATTNPVATEQYGSVCAAMNHLQAMHNNDNP

SEQ ID NO: 139419 - protein, 33 aa, Artificial Sequence
  Description of Artificial Sequence: Synthetic polypeptide
DEEEIATTNPVAYEQWGSVSGGNGNSGEGNNTP

SEQ ID NO: 139420 - protein, 33 aa, Artificial Sequence
  Description of Artificial Sequence: Synthetic polypeptide
DEEEIATTNPVAYEQWGSVSGGNGNSGGDGNTS

SEQ ID NO: 139421 - protein, 38 aa, Artificial Sequence
  Description of Artificial Sequence: Synthetic polypeptide
DEEEIRTTNPVATEQYGVVSTVVNLQAGNNQQSTEQGS

SEQ ID NO: 139422 - protein, 33 aa, Artificial Sequence
  Description of Artificial Sequence: Synthetic polypeptide
DEMEIATTNPVATEQYGTVCSATDRKVEFEGND

SEQ ID NO: 139423 - protein, 36 aa, Artificial Sequence
  Description of Artificial Sequence: Synthetic polypeptide
DEEEIATTNPVATEQYGSVCAAMNHLQAMAPMGDRH

SEQ ID NO: 139424 - protein, 32 aa, Artificial Sequence
  Description of Artificial Sequence: Synthetic polypeptide
DEMEIATTNPVATEQYGTVCSATDPVEFEGEL

SEQ ID NO: 139425 - protein, 31 aa, Artificial Sequence
  Description of Artificial Sequence: Synthetic polypeptide
QEGEIATTNPVSSEQYGIVSACGPVQSEGNR

SEQ ID NO: 139426 - protein, 35 aa, Artificial Sequence
  Description of Artificial Sequence: Synthetic polypeptide
QEEEIRTTNPVATEQYGSVQQVTNDQGEGEEGEIG

SEQ ID NO: 139427 - protein, 38 aa, Artificial Sequence
  Description of Artificial Sequence: Synthetic polypeptide
DEEEIRTTNPVATEQYGVVSTTVVTNLQAGNEEEEEDE

SEQ ID NO: 139428 - protein, 37 aa, Artificial Sequence
  Description of Artificial Sequence: Synthetic polypeptide
AEEEIRTTNPVATEQYGSVSTVVTNGNNNQLGGNNDD

SEQ ID NO: 139429 - protein, 37 aa, Artificial Sequence
  Description of Artificial Sequence: Synthetic polypeptide
AEEEIRTTNPVATEQYGSVSTVVTNGNLNNLGGNNDD

SEQ ID NO: 139430 - protein, 33 aa, Artificial Sequence
  Description of Artificial Sequence: Synthetic polypeptide
DEMEIATTNPVATEQYGTVCSATDGPVEHEGND

SEQ ID NO: 139431 - protein, 37 aa, Artificial Sequence
  Description of Artificial Sequence: Synthetic polypeptide
AEEEIRTTNPVATEQYGSVSTVVTNGGEQLGNNNQTD

SEQ ID NO: 139432 - protein, 38 aa, Artificial Sequence
  Description of Artificial Sequence: Synthetic polypeptide
DEEEIRTTNPVATEQYGVVSTTVVTNLQQGNQEGDEDE

SEQ ID NO: 139433 - protein, 33 aa, Artificial Sequence
  Description of Artificial Sequence: Synthetic polypeptide
DEMEIATTNPVATEQYGTVCSATDGPVKAEGND

SEQ ID NO: 139434 - protein, 33 aa, Artificial Sequence
  Description of Artificial Sequence: Synthetic polypeptide
DEMEIATTNPVATEQYGTVCSATDLVEFEGEDL

SEQ ID NO: 139435 - protein, 38 aa, Artificial Sequence
  Description of Artificial Sequence: Synthetic polypeptide
DEEEIRTTNPVATEQYGVVSTTVVTNLQQGNNNNQQTD

SEQ ID NO: 139436 - protein, 38 aa, Artificial Sequence
  Description of Artificial Sequence: Synthetic polypeptide
DEEEIRTTNPVATEQYGVVSTTVVTNLQQGNDEEDEDT

SEQ ID NO: 139437 - protein, 34 aa, Artificial Sequence
  Description of Artificial Sequence: Synthetic polypeptide
QEEEIRTTNPVATEQYGSVQTDNTMDENGGGEFG

SEQ ID NO: 139438 - protein, 33 aa, Artificial Sequence
  Description of Artificial Sequence: Synthetic polypeptide
DEMEIATTNPVATEQYGTVCSATDLEDHEGEDL

SEQ ID NO: 139439 - protein, 31 aa, Artificial Sequence
  Description of Artificial Sequence: Synthetic polypeptide
QEGEIRPTNPVSSEPYGTVSCENLQQSNGTR

SEQ ID NO: 139440 - protein, 38 aa, Artificial Sequence
  Description of Artificial Sequence: Synthetic polypeptide
DEEEIRTTNPVATEQYGVVSTTVVTNLQAGNVTEAGTE

SEQ ID NO: 139441 - protein, 38 aa, Artificial Sequence
  Description of Artificial Sequence: Synthetic polypeptide
DEEEIRTTNPVATEQYGVVSTVVNGNLQQGNNEEEEDE

SEQ ID NO: 139442 - protein, 37 aa, Artificial Sequence
  Description of Artificial Sequence: Synthetic polypeptide
AEEEIRTTNPVATEQYGSVSTVVTDQGNNNQGGTNDD

SEQ ID NO: 139443 - protein, 35 aa, Artificial Sequence
  Description of Artificial Sequence: Synthetic polypeptide
DEEEIATTNPVAYEQWGSVAKTNDLQEQRLGDIDI

SEQ ID NO: 139444 - protein, 33 aa, Artificial Sequence
  Description of Artificial Sequence: Synthetic polypeptide
DEMEIATTNPVATEQYGTVCSATDGGVEDDGNN

SEQ ID NO: 139445 - protein, 34 aa, Artificial Sequence
  Description of Artificial Sequence: Synthetic polypeptide
DEEEIATTNPVATEQYGSVCAANANEQDDPGGEN

SEQ ID NO: 139446 - protein, 30 aa, Artificial Sequence
  Description of Artificial Sequence: Synthetic polypeptide
QEGEIATTNPVATECYGHVCSEELIHGEEL

SEQ ID NO: 139447 - protein, 34 aa, Artificial Sequence
  Description of Artificial Sequence: Synthetic polypeptide
DEEEIATTNPVATEQYGSVCAANNGDPQADPDNN

SEQ ID NO: 139448 - protein, 34 aa, Artificial Sequence
  Description of Artificial Sequence: Synthetic polypeptide
QEEEIRTTNPVATEQYGSVSPTPVGPNMHNEMEV

SEQ ID NO: 139449 - protein, 30 aa, Artificial Sequence
  Description of Artificial Sequence: Synthetic polypeptide
QEGEIATTNPVATECYGHVSEELQHEEHLA

SEQ ID NO: 139450 - protein, 36 aa, Artificial Sequence
  Description of Artificial Sequence: Synthetic polypeptide
DEEEIRTTNPVATEQYGSVESWTPNVQNTQMVQEAD

SEQ ID NO: 139451 - protein, 35 aa, Artificial Sequence
  Description of Artificial Sequence: Synthetic polypeptide
QEEEIRTTNPVATEQYGSVSPTEVGPNMRNEMNPV

SEQ ID NO: 139452 - protein, 36 aa, Artificial Sequence
  Description of Artificial Sequence: Synthetic polypeptide
DEEEIRTTNPVATEQYGVVSTVNDQAGTEQGTEDTE

SEQ ID NO: 139453 - protein, 35 aa, Artificial Sequence
  Description of Artificial Sequence: Synthetic polypeptide
QEEEIRTTNPVATEQYGSVSPTEAGPNMRNEMNPV

SEQ ID NO: 139454 - protein, 37 aa, Artificial Sequence
  Description of Artificial Sequence: Synthetic polypeptide
DEEEIRTTNPVATEQYGVVSTVLQAGTEAGTNQQDED

SEQ ID NO: 139455 - protein, 33 aa, Artificial Sequence
  Description of Artificial Sequence: Synthetic polypeptide
DCAEIRTTNPVATEQYGCVSINVSENGFNQDKE

SEQ ID NO: 139456 - protein, 35 aa, Artificial Sequence
  Description of Artificial Sequence: Synthetic polypeptide
QEEEIRTTNPVATEQYGSVSNNDVMDPEEMGNGDD

SEQ ID NO: 139457 - protein, 30 aa, Artificial Sequence
  Description of Artificial Sequence: Synthetic polypeptide
QEGEIATTNPVATECYGQVSIEWLEQHEEL

SEQ ID NO: 139458 - protein, 34 aa, Artificial Sequence
  Description of Artificial Sequence: Synthetic polypeptide
DEMEIATTNPVATEQYGSVSTTELNEDHFGSEDL

SEQ ID NO: 139459 - protein, 34 aa, Artificial Sequence
  Description of Artificial Sequence: Synthetic polypeptide
DEMEIATTNPVATEQYGSVSWTDLQEDHQQEDLG

SEQ ID NO: 139460 - protein, 34 aa, Artificial Sequence
  Description of Artificial Sequence: Synthetic polypeptide
DEMEIATTNPVATEQYGSVSNTDLNEDHEGSETL

SEQ ID NO: 139461 - protein, 36 aa, Artificial Sequence
  Description of Artificial Sequence: Synthetic polypeptide
QEEEIRTTNPVATEQYGSVSNNDNMDQGGGQTNQDG

SEQ ID NO: 139462 - protein, 33 aa, Artificial Sequence
  Description of Artificial Sequence: Synthetic polypeptide
DEMEIATTNPVATEQYGSVSATDGPVEFEGEDD

SEQ ID NO: 139463 - protein, 37 aa, Artificial Sequence
  Description of Artificial Sequence: Synthetic polypeptide
DEEEIRTTNPVATEQYGVVSTVNDQQGSTNATEEEDQ

SEQ ID NO: 139464 - protein, 34 aa, Artificial Sequence
  Description of Artificial Sequence: Synthetic polypeptide
DEEEIATTNPVATEQYGSVCAANNGEEAGDLMNM

SEQ ID NO: 139465 - protein, 34 aa, Artificial Sequence
  Description of Artificial Sequence: Synthetic polypeptide
DEHEIRTTNPVATESWGSVSCWNISQTAQGNNPF

SEQ ID NO: 139466 - protein, 37 aa, Artificial Sequence
  Description of Artificial Sequence: Synthetic polypeptide
DEEEIRTTNPVATEQYGVVSTVTSNNNNQQGEEEEND

SEQ ID NO: 139467 - protein, 35 aa, Artificial Sequence
  Description of Artificial Sequence: Synthetic polypeptide
QEEEIRTTNPVATEQYGSVSSTEAGPNMRNEMNPV

SEQ ID NO: 139468 - protein, 31 aa, Artificial Sequence
  Description of Artificial Sequence: Synthetic polypeptide
QEGEIATTNPVATECYGCVSEELQHGEYELA

SEQ ID NO: 139469 - protein, 36 aa, Artificial Sequence
  Description of Artificial Sequence: Synthetic polypeptide
QEEEIRTTNPVATEQYGSVSSTDNGLIGEFTGGQTI

SEQ ID NO: 139470 - protein, 37 aa, Artificial Sequence
  Description of Artificial Sequence: Synthetic polypeptide
DEEEIRTTNPVATEQYGSVESTTPAGPNMENGMNPVN

SEQ ID NO: 139471 - protein, 35 aa, Artificial Sequence
  Description of Artificial Sequence: Synthetic polypeptide
DEHEIRTTNPVATESWGSVCSGDNNLGDRQGDNGK

SEQ ID NO: 139472 - protein, 34 aa, Artificial Sequence
  Description of Artificial Sequence: Synthetic polypeptide
DEEEIATTNPVATEQYGSVCAANNGEAPDAGMND

SEQ ID NO: 139473 - protein, 34 aa, Artificial Sequence
  Description of Artificial Sequence: Synthetic polypeptide
DEHEIRTTNPVATESWGSVCSGDNLGDRQGQDGK

SEQ ID NO: 139474 - protein, 34 aa, Artificial Sequence
  Description of Artificial Sequence: Synthetic polypeptide
DEEEIATTNPVATEQYGSVCAANNGDQIDPDENH

SEQ ID NO: 139475 - protein, 34 aa, Artificial Sequence
  Description of Artificial Sequence: Synthetic polypeptide
DEMEIATTNPVATEQYGSVCSTTDPNEEHEGEDL

SEQ ID NO: 139476 - protein, 36 aa, Artificial Sequence
  Description of Artificial Sequence: Synthetic polypeptide
AEEEIRTTNPVATEQYGSVSTVVTNTTNEAGNEEQM

SEQ ID NO: 139477 - protein, 33 aa, Artificial Sequence
  Description of Artificial Sequence: Synthetic polypeptide
DEEEIATTNPVATEQYGSVCAANNGDQIDPDAN

SEQ ID NO: 139478 - protein, 36 aa, Artificial Sequence
  Description of Artificial Sequence: Synthetic polypeptide
QEEEIRTTNPVATEQYGSVSSTCPAGPNMRNGMNPV

SEQ ID NO: 139479 - protein, 36 aa, Artificial Sequence
  Description of Artificial Sequence: Synthetic polypeptide
DEEEIATTNPVATEQYGSVCAAMNHLQAMAPENDRN

SEQ ID NO: 139480 - protein, 34 aa, Artificial Sequence
  Description of Artificial Sequence: Synthetic polypeptide
DEEEIATTNPVATEQYGSVCAANMGEQPDDGGED

SEQ ID NO: 139481 - protein, 33 aa, Artificial Sequence
  Description of Artificial Sequence: Synthetic polypeptide
QEGEIATTNPVATEQWGSVSCINEPQDREGETG

SEQ ID NO: 139482 - protein, 33 aa, Artificial Sequence
  Description of Artificial Sequence: Synthetic polypeptide
DCEEIGTTNPVAYERYGSVATDNEDQGPVGNNE

SEQ ID NO: 139483 - protein, 38 aa, Artificial Sequence
  Description of Artificial Sequence: Synthetic polypeptide
DEEEIRTTNPVATEQYGVVSTVVANLQGNTEAGNTEGS

SEQ ID NO: 139484 - protein, 37 aa, Artificial Sequence
  Description of Artificial Sequence: Synthetic polypeptide
DEEEIRTTNPVATEQYGVVSTVVANQQGNQQGNNEEN

SEQ ID NO: 139485 - protein, 32 aa, Artificial Sequence
  Description of Artificial Sequence: Synthetic polypeptide
DEMEIATTNPVATEQYGTVCSAEGPVEFEGND

SEQ ID NO: 139486 - protein, 34 aa, Artificial Sequence
  Description of Artificial Sequence: Synthetic polypeptide
DEEEIATTNPVATEQYGSVCAANMGEAIDIGENH

SEQ ID NO: 139487 - protein, 35 aa, Artificial Sequence
  Description of Artificial Sequence: Synthetic polypeptide
DEEEIATTNPVATEQYGSVCAANHIENIDDQDENR

SEQ ID NO: 139488 - protein, 28 aa, Artificial Sequence
  Description of Artificial Sequence: Synthetic peptide
QEGEIATTNPVATEQYGEAPHVCQHEEK

SEQ ID NO: 139489 - protein, 37 aa, Artificial Sequence
  Description of Artificial Sequence: Synthetic polypeptide
AEEEIRTTNPVATEQYGSVSTVVTNQQNGTEAGNEDE

SEQ ID NO: 139490 - protein, 28 aa, Artificial Sequence
  Description of Artificial Sequence: Synthetic peptide
QEGEIATTNPVATEQYGIAPCVCQHEEK

SEQ ID NO: 139491 - protein, 33 aa, Artificial Sequence
  Description of Artificial Sequence: Synthetic polypeptide
DEMEIATTNPVATEQYGTVCSATDDPEDFEGND

SEQ ID NO: 139492 - protein, 33 aa, Artificial Sequence
  Description of Artificial Sequence: Synthetic polypeptide
DEMEIATTNPVATEQYGTVCSATDDPEDHEGND

SEQ ID NO: 139493 - protein, 28 aa, Artificial Sequence
  Description of Artificial Sequence: Synthetic peptide
QEGEIATTNPVATEQYGIAPEVCQHEEK

SEQ ID NO: 139494 - protein, 36 aa, Artificial Sequence
  Description of Artificial Sequence: Synthetic polypeptide
QEEEIRTTNPVATEQYGSVSDTGMQGGNEGGGNNEE

SEQ ID NO: 139495 - protein, 33 aa, Artificial Sequence
  Description of Artificial Sequence: Synthetic polypeptide
DEMEIATTNPVATEQYGTVCSATDDPVEFEGND

SEQ ID NO: 139496 - protein, 34 aa, Artificial Sequence
  Description of Artificial Sequence: Synthetic polypeptide
DEEEIATTNPVATEQYGSVCAANGEEAGDEMNNN

SEQ ID NO: 139497 - protein, 33 aa, Artificial Sequence
  Description of Artificial Sequence: Synthetic polypeptide
QEGEIATTNPVATEQWGIVSCINEPQDREGETR

SEQ ID NO: 139498 - protein, 28 aa, Artificial Sequence
  Description of Artificial Sequence: Synthetic peptide
QEGEIATTNPVATEQYGEAPFVCQHEEK

SEQ ID NO: 139499 - protein, 32 aa, Artificial Sequence
  Description of Artificial Sequence: Synthetic polypeptide
DCEEIASTNPVAYEQWGSSTGDTNMQRGMNNM

SEQ ID NO: 139500 - protein, 36 aa, Artificial Sequence
  Description of Artificial Sequence: Synthetic polypeptide
QEEEIRTTNPVATEQYGSVSNFNDNMDQGGGQTNQG

SEQ ID NO: 139501 - protein, 32 aa, Artificial Sequence
  Description of Artificial Sequence: Synthetic polypeptide
DEMEIATTNPVATEQYGTACSTDGPVEFEGND

SEQ ID NO: 139502 - protein, 32 aa, Artificial Sequence
  Description of Artificial Sequence: Synthetic polypeptide
DEMEIATTNPVATEQYGTMCSATGPVEFEGND

SEQ ID NO: 139503 - protein, 34 aa, Artificial Sequence
  Description of Artificial Sequence: Synthetic polypeptide
DCEDIRATNPVATEQYGSVSTNQNQAHNQFQTIG

SEQ ID NO: 139504 - protein, 33 aa, Artificial Sequence
  Description of Artificial Sequence: Synthetic polypeptide
DEMEIATTNPVATEQYGTTCSATDGPNEFEGND

SEQ ID NO: 139505 - protein, 35 aa, Artificial Sequence
  Description of Artificial Sequence: Synthetic polypeptide
DEEEIATTNPVATEQYGSVCAANMGEEQIDMGENN

SEQ ID NO: 139506 - protein, 29 aa, Artificial Sequence
  Description of Artificial Sequence: Synthetic peptide
QEGEIATTNPVATEQYGEAPEVCQPGEEK

SEQ ID NO: 139507 - protein, 36 aa, Artificial Sequence
  Description of Artificial Sequence: Synthetic polypeptide
QEEEIRTTNPVATEQYGSVSHTTPAGPNMRNGMNPV

SEQ ID NO: 139508 - protein, 33 aa, Artificial Sequence
  Description of Artificial Sequence: Synthetic polypeptide
DEMEIATTNPVATEQYGTVCAATDTIVEFVGNR

SEQ ID NO: 139509 - protein, 33 aa, Artificial Sequence
  Description of Artificial Sequence: Synthetic polypeptide
DEEEIATTNPVATEQYGSVCAANMGEAPDQNTP

SEQ ID NO: 139510 - protein, 33 aa, Artificial Sequence
  Description of Artificial Sequence: Synthetic polypeptide
DEEEIATTNPVATEQYGSVCAANMGEAPDQGES

SEQ ID NO: 139511 - protein, 37 aa, Artificial Sequence
  Description of Artificial Sequence: Synthetic polypeptide
AEEEIRTTNPVATEQYGSVSTVVTNTNNQDEGTNNVE

SEQ ID NO: 139512 - protein, 28 aa, Artificial Sequence
  Description of Artificial Sequence: Synthetic peptide
QEGEIATTNPVATEQYGEAPEVCQHEEK

SEQ ID NO: 139513 - protein, 29 aa, Artificial Sequence
  Description of Artificial Sequence: Synthetic peptide
QEGEIATTNPVATEQYGEAPEVCQHENEK

SEQ ID NO: 139514 - protein, 38 aa, Artificial Sequence
  Description of Artificial Sequence: Synthetic polypeptide
DEEEIRTTNPVATEQYGVVSTVTVTNLQAGTNEEDEDE

SEQ ID NO: 139515 - protein, 30 aa, Artificial Sequence
  Description of Artificial Sequence: Synthetic polypeptide
QEGEIATTNPVATECYGCVSAELQHEEELF

SEQ ID NO: 139516 - protein, 38 aa, Artificial Sequence
  Description of Artificial Sequence: Synthetic polypeptide
DEEEIRTTNPVATEQYGVVSTVVNLQAGNQAGTEEGQD

SEQ ID NO: 139517 - protein, 38 aa, Artificial Sequence
  Description of Artificial Sequence: Synthetic polypeptide
DEEEIRTTNPVATEQYGVVSTVVNLQNQQQGTNEEEDD

SEQ ID NO: 139518 - protein, 36 aa, Artificial Sequence
  Description of Artificial Sequence: Synthetic polypeptide
DEEEIRTTNPVATEQYGSVCSPLYLPQLISNEEPSE

SEQ ID NO: 139519 - protein, 36 aa, Artificial Sequence
  Description of Artificial Sequence: Synthetic polypeptide
DEEEIRTTNPVATEQYGSVCSPLYLPQSIINEEPEE

SEQ ID NO: 139520 - protein, 36 aa, Artificial Sequence
  Description of Artificial Sequence: Synthetic polypeptide
DEEEIRTTNPVATEQYGSVCSPMLQMLQNMFEEQEL

SEQ ID NO: 139521 - protein, 34 aa, Artificial Sequence
  Description of Artificial Sequence: Synthetic polypeptide
DCSEIRTTNPVATECWGSVSCINEPQDREGENQG

SEQ ID NO: 139522 - protein, 28 aa, Artificial Sequence
  Description of Artificial Sequence: Synthetic peptide
QEHEIACTNPVGTEGYGVFASTLQDGDI

SEQ ID NO: 139523 - protein, 33 aa, Artificial Sequence
  Description of Artificial Sequence: Synthetic polypeptide
DCSEIRTTNPVATECWGSVSCINEPQDMEGENG

SEQ ID NO: 139524 - protein, 33 aa, Artificial Sequence
  Description of Artificial Sequence: Synthetic polypeptide
DCSEIRTTNPVATECWGSVECINEPQDREGENG

SEQ ID NO: 139525 - protein, 33 aa, Artificial Sequence
  Description of Artificial Sequence: Synthetic polypeptide
DCSEIRTTNPVATECWGAVSCFNEPQDREGENG

SEQ ID NO: 139526 - protein, 32 aa, Artificial Sequence
  Description of Artificial Sequence: Synthetic polypeptide
DCQETATTNPVATEQYGSVSATDLEDHEGEDL

SEQ ID NO: 139527 - protein, 34 aa, Artificial Sequence
  Description of Artificial Sequence: Synthetic polypeptide
QEEEIRTTNPVATEQYGSVNTDNMFEIGDGQEQG

SEQ ID NO: 139528 - protein, 38 aa, Artificial Sequence
  Description of Artificial Sequence: Synthetic polypeptide
DEEEIRTTNPVATEQYGVVSTTVTNLQAGNQQGTNQEE

SEQ ID NO: 139529 - protein, 38 aa, Artificial Sequence
  Description of Artificial Sequence: Synthetic polypeptide
DEEEIRTTNPVATEQYGVVSTTVTNLQLQQGTTNEEED

SEQ ID NO: 139530 - protein, 33 aa, Artificial Sequence
  Description of Artificial Sequence: Synthetic polypeptide
DEMEIATTNPVATEQYGTVSATDLVEDHEGEDL

SEQ ID NO: 139531 - protein, 36 aa, Artificial Sequence
  Description of Artificial Sequence: Synthetic polypeptide
DCQEIRTTNPVAYEQYGSVCSTTEGLFIARGGENRR

SEQ ID NO: 139532 - protein, 29 aa, Artificial Sequence
  Description of Artificial Sequence: Synthetic peptide
QEHEIAATNPVGTEGYGVMASTGLQHGDI

SEQ ID NO: 139533 - protein, 38 aa, Artificial Sequence
  Description of Artificial Sequence: Synthetic polypeptide
DEEEIRTTNPVATEQYGVVSTVVNNNNQLQQGNETIED

SEQ ID NO: 139534 - protein, 29 aa, Artificial Sequence
  Description of Artificial Sequence: Synthetic peptide
QEHEIAATNPCVYEQWGIVSCNLQSGMTR

SEQ ID NO: 139535 - protein, 28 aa, Artificial Sequence
  Description of Artificial Sequence: Synthetic peptide
QEGNIAPTNPCSSECYGIVSCNLQSGTR

SEQ ID NO: 139536 - protein, 28 aa, Artificial Sequence
  Description of Artificial Sequence: Synthetic peptide
QEGNIAPTNPCSSEQYGIVSCGLQSGTR

SEQ ID NO: 139537 - protein, 28 aa, Artificial Sequence
  Description of Artificial Sequence: Synthetic peptide
QEGSIAPTNPCSSEQYGIVCCNLQSGTR

SEQ ID NO: 139538 - protein, 28 aa, Artificial Sequence
  Description of Artificial Sequence: Synthetic peptide
QEGSIAPTNPCSSEQYGIVSCNLQSGTS

SEQ ID NO: 139539 - protein, 28 aa, Artificial Sequence
  Description of Artificial Sequence: Synthetic peptide
QEGSIAPTNPCSSEQYGIVSCNYQSGTR

SEQ ID NO: 139540 - protein, 32 aa, Artificial Sequence
  Description of Artificial Sequence: Synthetic polypeptide
DEMEIATTNPVATEQYGTVSATDCPVEFEGEL

SEQ ID NO: 139541 - protein, 35 aa, Artificial Sequence
  Description of Artificial Sequence: Synthetic polypeptide
DEEEIATTNPVATEQYGSVCAAMNHDQAMPNDDRP

SEQ ID NO: 139542 - protein, 35 aa, Artificial Sequence
  Description of Artificial Sequence: Synthetic polypeptide
QEEEIRTTNPVATEQYGSVNTDNMFETGGNNEEQD

SEQ ID NO: 139543 - protein, 34 aa, Artificial Sequence
  Description of Artificial Sequence: Synthetic polypeptide
QEEEIRTTNPVATEQYGSVNTDNMFETGGGEQGD

SEQ ID NO: 139544 - protein, 28 aa, Artificial Sequence
  Description of Artificial Sequence: Synthetic peptide
QEGTIAPTNPCSSESYGIVSCNLQSGTR

SEQ ID NO: 139545 - protein, 33 aa, Artificial Sequence
  Description of Artificial Sequence: Synthetic polypeptide
DCQEIATTNPVASEQYGSVSATDLEDHEGEDLR

SEQ ID NO: 139546 - protein, 33 aa, Artificial Sequence
  Description of Artificial Sequence: Synthetic polypeptide
DEMEIATTNPVATEQYGTVSATDLVEDFEGEDL

SEQ ID NO: 139547 - protein, 32 aa, Artificial Sequence
  Description of Artificial Sequence: Synthetic polypeptide
DCQEIATTNPVATEQYGLVSATDLEDHEGEDL

SEQ ID NO: 139548 - protein, 38 aa, Artificial Sequence
  Description of Artificial Sequence: Synthetic polypeptide
DEEEIRTTNPVATEQYGVVSTTVTNLQNGNQAGNQDDE

SEQ ID NO: 139549 - protein, 33 aa, Artificial Sequence
  Description of Artificial Sequence: Synthetic polypeptide
DEMEIATTNPVATEQYGTVSATDDPVEDFEGNL

SEQ ID NO: 139550 - protein, 34 aa, Artificial Sequence
  Description of Artificial Sequence: Synthetic polypeptide
QEEEIRTTNPVATEQYGSVNTDNFFETGGGQEQQ

SEQ ID NO: 139551 - protein, 29 aa, Artificial Sequence
  Description of Artificial Sequence: Synthetic peptide
QEHEIAPTNPCSYEQWGQVSCNLQSDGTR

SEQ ID NO: 139552 - protein, 29 aa, Artificial Sequence
  Description of Artificial Sequence: Synthetic peptide
QEHEIAPTNPCSYEQYGIVSCNDQSGMTR

SEQ ID NO: 139553 - protein, 33 aa, Artificial Sequence
  Description of Artificial Sequence: Synthetic polypeptide
DEMEIATTNPVATEQYGVVCAATDGLVEFEGND

SEQ ID NO: 139554 - protein, 32 aa, Artificial Sequence
  Description of Artificial Sequence: Synthetic polypeptide
QEHEIRTTNPVAYESYGSVQSQNISFPVGNNS

SEQ ID NO: 139555 - protein, 33 aa, Artificial Sequence
  Description of Artificial Sequence: Synthetic polypeptide
DEMEIATTNPVATEQYGVVCSATDGPVEFEGND

SEQ ID NO: 139556 - protein, 36 aa, Artificial Sequence
  Description of Artificial Sequence: Synthetic polypeptide
DEEEIRTTNPVATEQYGSVCSPLELPQSVSNEENEE

SEQ ID NO: 139557 - protein, 33 aa, Artificial Sequence
  Description of Artificial Sequence: Synthetic polypeptide
DEMEIATTNPVATEQYGVVCSATDGPVEHEGND

SEQ ID NO: 139558 - protein, 35 aa, Artificial Sequence
  Description of Artificial Sequence: Synthetic polypeptide
QEEEIRTTNPVATEQYGSVNITGDQQDEGQGNNQQ

SEQ ID NO: 139559 - protein, 38 aa, Artificial Sequence
  Description of Artificial Sequence: Synthetic polypeptide
DEEEIRTTNPVATEQYGVVSTTVNTNLEQGNIGTNTEE

SEQ ID NO: 139560 - protein, 36 aa, Artificial Sequence
  Description of Artificial Sequence: Synthetic polypeptide
DEEEIRTTNPVATEQYGSVCSPLELPQSIVNEEPSL

SEQ ID NO: 139561 - protein, 36 aa, Artificial Sequence
  Description of Artificial Sequence: Synthetic polypeptide
DEEEIRTTNPVATEQYGSVCSPLELPQIITNEEHLE

SEQ ID NO: 139562 - protein, 28 aa, Artificial Sequence
  Description of Artificial Sequence: Synthetic peptide
QEIEIATTNPVATEQYGEAPEVCQHEEK

SEQ ID NO: 139563 - protein, 37 aa, Artificial Sequence
  Description of Artificial Sequence: Synthetic polypeptide
DEEEIRTTNPVATEQYGVVSTTVNQQAGNQQGNQEQD

SEQ ID NO: 139564 - protein, 35 aa, Artificial Sequence
  Description of Artificial Sequence: Synthetic polypeptide
DEEEIATTNPVATEQYGSVCAAMNHDQAMAPGQRP

SEQ ID NO: 139565 - protein, 33 aa, Artificial Sequence
  Description of Artificial Sequence: Synthetic polypeptide
DEMEIATTNPVATQQWGCVSTWNNDNERNGNEP

SEQ ID NO: 139566 - protein, 36 aa, Artificial Sequence
  Description of Artificial Sequence: Synthetic polypeptide
DEEEIRTTNPVATEQYGSVCSPLEGPQARANEEPHS

SEQ ID NO: 139567 - protein, 28 aa, Artificial Sequence
  Description of Artificial Sequence: Synthetic peptide
QEIEIASTNPVGTEGYGVMASTLQHGDI

SEQ ID NO: 139568 - protein, 34 aa, Artificial Sequence
  Description of Artificial Sequence: Synthetic polypeptide
QEGETRTTNPVATEQYGSVSTGDGNQRIEGGAGD

SEQ ID NO: 139569 - protein, 32 aa, Artificial Sequence
  Description of Artificial Sequence: Synthetic polypeptide
DEMEIATTNPVATEQYGVMCSATGPVEHEGND

SEQ ID NO: 139570 - protein, 38 aa, Artificial Sequence
  Description of Artificial Sequence: Synthetic polypeptide
DEEEIRTTNPVATEQYGVVSTTVNTNLQAGSNDEDEDD

SEQ ID NO: 139571 - protein, 30 aa, Artificial Sequence
  Description of Artificial Sequence: Synthetic polypeptide
QEHEIAPTNPCSYEQYGIVSCNLQSDGTTR

SEQ ID NO: 139572 - protein, 35 aa, Artificial Sequence
  Description of Artificial Sequence: Synthetic polypeptide
DEEEIRTTNPVATEQYGSVCSPLPGPLAQQEEPSS

SEQ ID NO: 139573 - protein, 28 aa, Artificial Sequence
  Description of Artificial Sequence: Synthetic peptide
QEHEIASTNPVGTEGYGVMASTLQHGDI

SEQ ID NO: 139574 - protein, 28 aa, Artificial Sequence
  Description of Artificial Sequence: Synthetic peptide
QEHEIASTNPVGTEGYGVMASTLQHGDV

SEQ ID NO: 139575 - protein, 38 aa, Artificial Sequence
  Description of Artificial Sequence: Synthetic polypeptide
DEEEIRTTNPVATEQYGVVSTTVNTNLQQGTNDEDEDE

SEQ ID NO: 139576 - protein, 38 aa, Artificial Sequence
  Description of Artificial Sequence: Synthetic polypeptide
DEEEIRTTNPVATEQYGVVSTTVNTNLQQGNNTEDEDD

SEQ ID NO: 139577 - protein, 38 aa, Artificial Sequence
  Description of Artificial Sequence: Synthetic polypeptide
DEEEIRTTNPVATEQYGVVSTTVNTNLQAGNQENTEDT

SEQ ID NO: 139578 - protein, 28 aa, Artificial Sequence
  Description of Artificial Sequence: Synthetic peptide
QEHEIASTNPVGTEMYGVMASTLQHGDI

SEQ ID NO: 139579 - protein, 38 aa, Artificial Sequence
  Description of Artificial Sequence: Synthetic polypeptide
DEEEIRTTNPVATEQYGVVSTTVNTNLQQGNNNQDEQD

SEQ ID NO: 139580 - protein, 33 aa, Artificial Sequence
  Description of Artificial Sequence: Synthetic polypeptide
DEMEIATTNPVATEQYGTVSTTDLEDHEGSEDL

SEQ ID NO: 139581 - protein, 30 aa, Artificial Sequence
  Description of Artificial Sequence: Synthetic polypeptide
DEMEIATTNPVATEQYGVMAATDGPEHGDD

SEQ ID NO: 139582 - protein, 28 aa, Artificial Sequence
  Description of Artificial Sequence: Synthetic peptide
QEHEIATTNPVATEQYGDAPEVCQHEEK

SEQ ID NO: 139583 - protein, 28 aa, Artificial Sequence
  Description of Artificial Sequence: Synthetic peptide
QEHEIATTNPVATEQYGEAPEACQHEEK

SEQ ID NO: 139584 - protein, 28 aa, Artificial Sequence
  Description of Artificial Sequence: Synthetic peptide
QEHEIATTNPVATEQYGEAPEVCQHEEK

SEQ ID NO: 139585 - protein, 35 aa, Artificial Sequence
  Description of Artificial Sequence: Synthetic polypeptide
DEEEIRTTNPVATEQYGSVCSPLMGPQARNEEPSS

SEQ ID NO: 139586 - protein, 33 aa, Artificial Sequence
  Description of Artificial Sequence: Synthetic polypeptide
DCGEIRTTNPVATEQYGCVSEVSENGANQDHEQ

SEQ ID NO: 139587 - protein, 34 aa, Artificial Sequence
  Description of Artificial Sequence: Synthetic polypeptide
QEGETRTTNPVATEQYGSVSATGDDGDQTGGNGA

SEQ ID NO: 139588 - protein, 29 aa, Artificial Sequence
  Description of Artificial Sequence: Synthetic peptide
QEGETIAPTNPCSSEPYGIVSCNLQSGTR

SEQ ID NO: 139589 - protein, 35 aa, Artificial Sequence
  Description of Artificial Sequence: Synthetic polypeptide
DEEEIATTNPVATEQYGSVCAAMNHLNMGGENGTV

SEQ ID NO: 139590 - protein, 38 aa, Artificial Sequence
  Description of Artificial Sequence: Synthetic polypeptide
DEEEIRTTNPVATEQYGVVSTTVTTNLQQGNNQEDEDE

SEQ ID NO: 139591 - protein, 38 aa, Artificial Sequence
  Description of Artificial Sequence: Synthetic polypeptide
DEEEIRTTNPVATEQYGVVSTTVTTNLQQGNNAEDEDE

SEQ ID NO: 139592 - protein, 35 aa, Artificial Sequence
  Description of Artificial Sequence: Synthetic polypeptide
DEEEIATTNPVAYEQWGSVSGNNLPGEDRGGDDND

SEQ ID NO: 139593 - protein, 38 aa, Artificial Sequence
  Description of Artificial Sequence: Synthetic polypeptide
DEEEIRTTNPVATEQYGVVSTVVNNLQQGNNNVEQGED

SEQ ID NO: 139594 - protein, 31 aa, Artificial Sequence
  Description of Artificial Sequence: Synthetic polypeptide
QEGEIRTTNPCSTEQYGIISMDLQQQSNGTR

SEQ ID NO: 139595 - protein, 33 aa, Artificial Sequence
  Description of Artificial Sequence: Synthetic polypeptide
DCEEIRTTNPVATEPWGKVPCTPNASQEGGNTL

SEQ ID NO: 139596 - protein, 37 aa, Artificial Sequence
  Description of Artificial Sequence: Synthetic polypeptide
DEEEIRTTNPVATEQYGVVSTVVNNLQQGTDEEETED

SEQ ID NO: 139597 - protein, 32 aa, Artificial Sequence
  Description of Artificial Sequence: Synthetic polypeptide
QEGEIRTTNPVATECWGIVSCINEPQDSEGNG

SEQ ID NO: 139598 - protein, 37 aa, Artificial Sequence
  Description of Artificial Sequence: Synthetic polypeptide
DEEEIRTTNPVATEQYGVVSTVVNNLQQGTEQGEEDE

SEQ ID NO: 139599 - protein, 32 aa, Artificial Sequence
  Description of Artificial Sequence: Synthetic polypeptide
DEMEIATTNPVATEQYGTVCSDDGPVESEGND

SEQ ID NO: 139600 - protein, 34 aa, Artificial Sequence
  Description of Artificial Sequence: Synthetic polypeptide
DCEEIRTTNPVATEQYGSVSDWANIETTLMNNES

SEQ ID NO: 139601 - protein, 34 aa, Artificial Sequence
  Description of Artificial Sequence: Synthetic polypeptide
DCEEIRTTNPVATEQYGSVSDWINIETTLEENES

SEQ ID NO: 139602 - protein, 35 aa, Artificial Sequence
  Description of Artificial Sequence: Synthetic polypeptide
DCEEIRTTNPVATEQYGSVSDWSVNGETTLEENNE

SEQ ID NO: 139603 - protein, 35 aa, Artificial Sequence
  Description of Artificial Sequence: Synthetic polypeptide
DEEEIRTTNPVATEQYGSVCSTADDEQQVVMSFSE

SEQ ID NO: 139604 - protein, 35 aa, Artificial Sequence
  Description of Artificial Sequence: Synthetic polypeptide
DCEEIRTTNPVATEQYGSVSDWVNIETTLETQNEY

SEQ ID NO: 139605 - protein, 31 aa, Artificial Sequence
  Description of Artificial Sequence: Synthetic polypeptide
QEGEIRTTNPCSSEQWGSVSCINLQDSEGTG

SEQ ID NO: 139606 - protein, 33 aa, Artificial Sequence
  Description of Artificial Sequence: Synthetic polypeptide
DEMEIATTNPVATEQYGTVCSATNGGVEPEIND

SEQ ID NO: 139607 - protein, 38 aa, Artificial Sequence
  Description of Artificial Sequence: Synthetic polypeptide
DEEEIRTTNPVATEQYGVVSTVVNLQQGNQAGTEQGSE

SEQ ID NO: 139608 - protein, 38 aa, Artificial Sequence
  Description of Artificial Sequence: Synthetic polypeptide
DEEEIRTTNPVATEQYGVVSTVVNLQQGNQQGNANTDD

SEQ ID NO: 139609 - protein, 33 aa, Artificial Sequence
  Description of Artificial Sequence: Synthetic polypeptide
DEMEIATTNPVATEQYGTVCSATDTIVEFVGND

SEQ ID NO: 139610 - protein, 38 aa, Artificial Sequence
  Description of Artificial Sequence: Synthetic polypeptide
DEEEIRTTNPVATEQYGVVSTVVNLQQGNQQGNNNDDE

SEQ ID NO: 139611 - protein, 33 aa, Artificial Sequence
  Description of Artificial Sequence: Synthetic polypeptide
DEMEIATTNPVATEQYGTVCSATEGPSEFEGND

SEQ ID NO: 139612 - protein, 33 aa, Artificial Sequence
  Description of Artificial Sequence: Synthetic polypeptide
DEMEIATTNPVATEQYGTVCSATEGPVDFEGND

SEQ ID NO: 139613 - protein, 38 aa, Artificial Sequence
  Description of Artificial Sequence: Synthetic polypeptide
DEEEIRTTNPVATEQYGVVSTVVNNLNQQGTTNNDEES

SEQ ID NO: 139614 - protein, 32 aa, Artificial Sequence
  Description of Artificial Sequence: Synthetic polypeptide
DEEEIATTNPVAYEQWGSVSGGNGNSGQGDGS

SEQ ID NO: 139615 - protein, 36 aa, Artificial Sequence
  Description of Artificial Sequence: Synthetic polypeptide
AEEEIRTTNPVATEQYGSVSTVVTDGNGNNLGGNDD

SEQ ID NO: 139616 - protein, 33 aa, Artificial Sequence
  Description of Artificial Sequence: Synthetic polypeptide
DEEEIATTNPVAYEQWGSVSGGNGNSTGEGNTE

SEQ ID NO: 139617 - protein, 28 aa, Artificial Sequence
  Description of Artificial Sequence: Synthetic peptide
QEGEIRTTNPCSSEPYGIISMDLQSGTH

SEQ ID NO: 139618 - protein, 36 aa, Artificial Sequence
  Description of Artificial Sequence: Synthetic polypeptide
DEEEIATTNPVATEQYGSVCAAMNHLQAMADDNDRP

SEQ ID NO: 139619 - protein, 33 aa, Artificial Sequence
  Description of Artificial Sequence: Synthetic polypeptide
DEEEIATTNPVAYEQWGSVSGGNGNWSGENDTS

SEQ ID NO: 139620 - protein, 37 aa, Artificial Sequence
  Description of Artificial Sequence: Synthetic polypeptide
DEEEIRTTNPVATEQYGVVSTVVNNLNQNQINEEDTD

SEQ ID NO: 139621 - protein, 34 aa, Artificial Sequence
  Description of Artificial Sequence: Synthetic polypeptide
QEGEIRTTNPCATEQYGIVSTTAGPNMRNGMNPR

SEQ ID NO: 139622 - protein, 38 aa, Artificial Sequence
  Description of Artificial Sequence: Synthetic polypeptide
DEEEIRTTNPVATEQYGVVSTVVNLQAGNQQGNTNNDD

SEQ ID NO: 139623 - protein, 34 aa, Artificial Sequence
  Description of Artificial Sequence: Synthetic polypeptide
DCEEIRTTNPVATEQYGSVSDWVNNETTPENNES

SEQ ID NO: 139624 - protein, 30 aa, Artificial Sequence
  Description of Artificial Sequence: Synthetic polypeptide
QEGEIRTTNPVATEQWGDVSEIEMNAAEDR

SEQ ID NO: 139625 - protein, 36 aa, Artificial Sequence
  Description of Artificial Sequence: Synthetic polypeptide
DEEEIRTTNPVATEQYGSVCSQTPNVQPTQMVQEPD

SEQ ID NO: 139626 - protein, 33 aa, Artificial Sequence
  Description of Artificial Sequence: Synthetic polypeptide
DCEEISTTNPVATEQWGKVSCTPNASQTGGSTQ

SEQ ID NO: 139627 - protein, 32 aa, Artificial Sequence
  Description of Artificial Sequence: Synthetic polypeptide
DEMEIATTNPVATEQYGTVCSTDGLVEFEEEL

SEQ ID NO: 139628 - protein, 34 aa, Artificial Sequence
  Description of Artificial Sequence: Synthetic polypeptide
DCEEISTTNPVATEQWGKVSCTPNEASQGGGNTQ

SEQ ID NO: 139629 - protein, 33 aa, Artificial Sequence
  Description of Artificial Sequence: Synthetic polypeptide
DCEEISTTNPVATEQWGKVSCTPNISQEGGTTQ

SEQ ID NO: 139630 - protein, 37 aa, Artificial Sequence
  Description of Artificial Sequence: Synthetic polypeptide
DEEEIRTTNPVATEQYGVVSTVVNNNNLQQGDEDEES

SEQ ID NO: 139631 - protein, 38 aa, Artificial Sequence
  Description of Artificial Sequence: Synthetic polypeptide
DEEEIRTTNPVATEQYGVVSTVVNNNLQAGNNDEEDED

SEQ ID NO: 139632 - protein, 33 aa, Artificial Sequence
  Description of Artificial Sequence: Synthetic polypeptide
DCEEISTTNPVATERWGKVSCTPNASQEGGNTG

SEQ ID NO: 139633 - protein, 36 aa, Artificial Sequence
  Description of Artificial Sequence: Synthetic polypeptide
DEEEIRTTNPVATEQYGSVCSPVDNNHNIDAMGMNN

SEQ ID NO: 139634 - protein, 35 aa, Artificial Sequence
  Description of Artificial Sequence: Synthetic polypeptide
QEEEIRTTNPVATEQYGSVNTDNMIETQGGGQEQN

SEQ ID NO: 139635 - protein, 35 aa, Artificial Sequence
  Description of Artificial Sequence: Synthetic polypeptide
QEEEIRTTNPVATEQYGSVNTDNMIETGGGNEQGN

SEQ ID NO: 139636 - protein, 34 aa, Artificial Sequence
  Description of Artificial Sequence: Synthetic polypeptide
QEEEIRTTNPVATEQYGSVNTDNMIETGGGEEID

SEQ ID NO: 139637 - protein, 34 aa, Artificial Sequence
  Description of Artificial Sequence: Synthetic polypeptide
DEMEIATTNPVATEQYGTVCSYTDGPNEFEGNED

SEQ ID NO: 139638 - protein, 38 aa, Artificial Sequence
  Description of Artificial Sequence: Synthetic polypeptide
DEEEIRTTNPVATEQYGVVSTVVNNNNNLQQGEENQES

SEQ ID NO: 139639 - protein, 35 aa, Artificial Sequence
  Description of Artificial Sequence: Synthetic polypeptide
DEEEIRTTNPVATEQYGSVCSPVDNNHQIDAMMDW

SEQ ID NO: 139640 - protein, 38 aa, Artificial Sequence
  Description of Artificial Sequence: Synthetic polypeptide
DEEEIRTTNPVATEQYGVVSTVVNNLQQGTEQGTNQEE

SEQ ID NO: 139641 - protein, 34 aa, Artificial Sequence
  Description of Artificial Sequence: Synthetic polypeptide
DCEEIRTTNPVAYEQWGKVPCTPNASQEFGGNTR

SEQ ID NO: 139642 - protein, 38 aa, Artificial Sequence
  Description of Artificial Sequence: Synthetic polypeptide
DEEEIRTTNPVATEQYGVVSTVVNNLVGNQQGNTEQGQ

SEQ ID NO: 139643 - protein, 30 aa, Artificial Sequence
  Description of Artificial Sequence: Synthetic polypeptide
QEGEIRTTNPVATEQWGDVSEIEQNAAEDA

SEQ ID NO: 139644 - protein, 35 aa, Artificial Sequence
  Description of Artificial Sequence: Synthetic polypeptide
QEEEIRTTNPVATEQYGSVNTDNMQETGGGQEQGQ

SEQ ID NO: 139645 - protein, 38 aa, Artificial Sequence
  Description of Artificial Sequence: Synthetic polypeptide
DEEEIRTTNPVATEQYGVVSTVVNNLQQGTEQGTTNSE

SEQ ID NO: 139646 - protein, 35 aa, Artificial Sequence
  Description of Artificial Sequence: Synthetic polypeptide
DCEEIRTTNPVATEQYGSVSDWYVNIETGLMNNES

SEQ ID NO: 139647 - protein, 33 aa, Artificial Sequence
  Description of Artificial Sequence: Synthetic polypeptide
DEMEIATTNPVATEQYGTVCSKTDGPPEFEGND

SEQ ID NO: 139648 - protein, 35 aa, Artificial Sequence
  Description of Artificial Sequence: Synthetic polypeptide
QEEEIRTTNPVATEQYGSVNTDNMQETGGGEEQDN

SEQ ID NO: 139649 - protein, 33 aa, Artificial Sequence
  Description of Artificial Sequence: Synthetic polypeptide
DEMEIATTNPVATEQYGTVCSRTDIPVEMEGND

SEQ ID NO: 139650 - protein, 36 aa, Artificial Sequence
  Description of Artificial Sequence: Synthetic polypeptide
DCEEIRTTNPVATEQYGSVSSTTPAGPNMRNGMNPV

SEQ ID NO: 139651 - protein, 36 aa, Artificial Sequence
  Description of Artificial Sequence: Synthetic polypeptide
DCEEIRTTNPVATEQYGSVSTWTVNIETTLETNNES

SEQ ID NO: 139652 - protein, 34 aa, Artificial Sequence
  Description of Artificial Sequence: Synthetic polypeptide
DCEEIRTTNPVATEQYGSVSVWVNIETTLESNES

SEQ ID NO: 139653 - protein, 34 aa, Artificial Sequence
  Description of Artificial Sequence: Synthetic polypeptide
QEEEIRTTNPVATEQYGSVNTDNMIITGGGQETG

SEQ ID NO: 139654 - protein, 35 aa, Artificial Sequence
  Description of Artificial Sequence: Synthetic polypeptide
DCEEIRTTNPVATEQYGSVSVWVNIETTQETNNES

SEQ ID NO: 139655 - protein, 34 aa, Artificial Sequence
  Description of Artificial Sequence: Synthetic polypeptide
QEGEIRTTNPVATEQYGSVSTPTNQANSDQEEHQ

SEQ ID NO: 139656 - protein, 38 aa, Artificial Sequence
  Description of Artificial Sequence: Synthetic polypeptide
DEEEIRTTNPVATEQYGVVSTVVNNLQSGTEENNDEDE

SEQ ID NO: 139657 - protein, 36 aa, Artificial Sequence
  Description of Artificial Sequence: Synthetic polypeptide
DCEEIRTTNPVATEQYGSVSSTTYAGPNMRNGMNPV

SEQ ID NO: 139658 - protein, 35 aa, Artificial Sequence
  Description of Artificial Sequence: Synthetic polypeptide
DEEEIRTTNPVATEQYGSVEHLNMNVIQPGSTVEN

SEQ ID NO: 139659 - protein, 35 aa, Artificial Sequence
  Description of Artificial Sequence: Synthetic polypeptide
DEHEIRTTNPVATESWGSVSGDNMLNGDRQGDNGK

SEQ ID NO: 139660 - protein, 34 aa, Artificial Sequence
  Description of Artificial Sequence: Synthetic polypeptide
DEEEIATTNPVATEQYGSVCAANNGEEMMGMPNG

SEQ ID NO: 139661 - protein, 31 aa, Artificial Sequence
  Description of Artificial Sequence: Synthetic polypeptide
DEEEIATTNPVATEQYGTVCPATDVPEFEEK

SEQ ID NO: 139662 - protein, 37 aa, Artificial Sequence
  Description of Artificial Sequence: Synthetic polypeptide
DEEEIRTTNPVATEQYGVVSTVNLQAGTEQGSTQDDD

SEQ ID NO: 139663 - protein, 31 aa, Artificial Sequence
  Description of Artificial Sequence: Synthetic polypeptide
DEEEIATTNPVATEQYGTVCPATDVPEFEED

SEQ ID NO: 139664 - protein, 34 aa, Artificial Sequence
  Description of Artificial Sequence: Synthetic polypeptide
DEHEIRTTNPVAYECWGSVSGDNLNGDRQGQNNK

SEQ ID NO: 139665 - protein, 32 aa, Artificial Sequence
  Description of Artificial Sequence: Synthetic polypeptide
DEMEIATTNPCAYEHWGSVSTNLNGNDGQNGA

SEQ ID NO: 139666 - protein, 33 aa, Artificial Sequence
  Description of Artificial Sequence: Synthetic polypeptide
DEHEIRTTNPVAYECWGSVSGGDNMGQRPGDDE

SEQ ID NO: 139667 - protein, 33 aa, Artificial Sequence
  Description of Artificial Sequence: Synthetic polypeptide
DEHEIRTTNPVAYECWGSVSGNDNMGNRRGDDE

SEQ ID NO: 139668 - protein, 31 aa, Artificial Sequence
  Description of Artificial Sequence: Synthetic polypeptide
QEEEIRTTNPVSTEQYGEISMEVCQQHNENH

SEQ ID NO: 139669 - protein, 32 aa, Artificial Sequence
  Description of Artificial Sequence: Synthetic polypeptide
QEEEIRTTNPVSTEQYGEISMEVCQQQHNGNH

SEQ ID NO: 139670 - protein, 30 aa, Artificial Sequence
  Description of Artificial Sequence: Synthetic polypeptide
DEEEIATTNPVATEQYGTACPTDVPEFEEK

SEQ ID NO: 139671 - protein, 33 aa, Artificial Sequence
  Description of Artificial Sequence: Synthetic polypeptide
DEEEIATTNPVATEQYGSVVAAAADLNNNGPPV

SEQ ID NO: 139672 - protein, 31 aa, Artificial Sequence
  Description of Artificial Sequence: Synthetic polypeptide
DEMEIASVNPVCTEQYGVVCSDDGLQSEGNQ

SEQ ID NO: 139673 - protein, 31 aa, Artificial Sequence
  Description of Artificial Sequence: Synthetic polypeptide
QEGEIAPTNPVSTEPYGTVSMEDLQQQNGNR

SEQ ID NO: 139674 - protein, 38 aa, Artificial Sequence
  Description of Artificial Sequence: Synthetic polypeptide
DEEEIRTTNPVATEQYGVVSTVNLQQGGNNQQGTEEAT

SEQ ID NO: 139675 - protein, 30 aa, Artificial Sequence
  Description of Artificial Sequence: Synthetic polypeptide
QEGEIAPTNPVSTEGYGIVACNIQSRVGQR

SEQ ID NO: 139676 - protein, 35 aa, Artificial Sequence
  Description of Artificial Sequence: Synthetic polypeptide
DEEEIATTNPVATEQYGSVTAIANNLPEMQENNES

SEQ ID NO: 139677 - protein, 34 aa, Artificial Sequence
  Description of Artificial Sequence: Synthetic polypeptide
DEEEIATTNPVATEQYGSVCAATGPEENADEQNN

SEQ ID NO: 139678 - protein, 35 aa, Artificial Sequence
  Description of Artificial Sequence: Synthetic polypeptide
DEEEIRTTNPVATEQYGSVENTALIQMIVSEEFQQ

SEQ ID NO: 139679 - protein, 30 aa, Artificial Sequence
  Description of Artificial Sequence: Synthetic polypeptide
DEMEIASTNPVGTEQYGVMCSTGPQHEGDI

SEQ ID NO: 139680 - protein, 32 aa, Artificial Sequence
  Description of Artificial Sequence: Synthetic polypeptide
DEMEIASTNPVGTEQYGVVCSATGLVEHEGND

SEQ ID NO: 139681 - protein, 33 aa, Artificial Sequence
  Description of Artificial Sequence: Synthetic polypeptide
DEMEIASTNPVSTEGYGNVCSANDGPQSRVGNR

SEQ ID NO: 139682 - protein, 36 aa, Artificial Sequence
  Description of Artificial Sequence: Synthetic polypeptide
DEEEIATTNPVATEQYGSVSSTWPAGPNMRNDGNPV

SEQ ID NO: 139683 - protein, 33 aa, Artificial Sequence
  Description of Artificial Sequence: Synthetic polypeptide
DEEEIATTNPVATEQYGSVCAATMDGANAADNN

SEQ ID NO: 139684 - protein, 31 aa, Artificial Sequence
  Description of Artificial Sequence: Synthetic polypeptide
QEEEIRTTNPVSTEQYGEASMEVCQQHNENH

SEQ ID NO: 139685 - protein, 36 aa, Artificial Sequence
  Description of Artificial Sequence: Synthetic polypeptide
DEEEIATTNPVATEQYGSVSSTWPHGPNMRMGGNPV

SEQ ID NO: 139686 - protein, 34 aa, Artificial Sequence
  Description of Artificial Sequence: Synthetic polypeptide
DEEEIATTNPVATEQYGSVCAATGVLPEDMENFM

SEQ ID NO: 139687 - protein, 34 aa, Artificial Sequence
  Description of Artificial Sequence: Synthetic polypeptide
QEEEIRTTNPVSYEPYGSVSCDPNLSQNHGGNND

SEQ ID NO: 139688 - protein, 34 aa, Artificial Sequence
  Description of Artificial Sequence: Synthetic polypeptide
DEHEIRTTNPVAYECWGSVYYTDNDTQGGDDPNR

SEQ ID NO: 139689 - protein, 32 aa, Artificial Sequence
  Description of Artificial Sequence: Synthetic polypeptide
QEEEIRTTNPVSTEQYGVVTDNGQGGGEEGTD

SEQ ID NO: 139690 - protein, 34 aa, Artificial Sequence
  Description of Artificial Sequence: Synthetic polypeptide
DEHEIRTTNPVAYECWGSVYSTPNQDEDQGGDER

SEQ ID NO: 139691 - protein, 32 aa, Artificial Sequence
  Description of Artificial Sequence: Synthetic polypeptide
DEMEIASVNPVATEQYGTVCSATDGLEFEGND

SEQ ID NO: 139692 - protein, 35 aa, Artificial Sequence
  Description of Artificial Sequence: Synthetic polypeptide
DEEEIATTNPVATEQYGSVSTTPAGPNDHEGMEPV

SEQ ID NO: 139693 - protein, 32 aa, Artificial Sequence
  Description of Artificial Sequence: Synthetic polypeptide
DEEEIATTNPVATEQYGTVCSEDVPVEHEGED

SEQ ID NO: 139694 - protein, 31 aa, Artificial Sequence
  Description of Artificial Sequence: Synthetic polypeptide
QEGEIAPTNPVSTEQYGIVSCNLPNSGMTPR

SEQ ID NO: 139695 - protein, 34 aa, Artificial Sequence
  Description of Artificial Sequence: Synthetic polypeptide
DEEEIATTNPVATEQYGTVVPTENDDRGEGGGQG

SEQ ID NO: 139696 - protein, 32 aa, Artificial Sequence
  Description of Artificial Sequence: Synthetic polypeptide
DEMEIATTNPVATCQYGCVCSSAHQNFGSNQA

SEQ ID NO: 139697 - protein, 34 aa, Artificial Sequence
  Description of Artificial Sequence: Synthetic polypeptide
DEEEIATTNPVATEQYGSVCAATGEEPAAEQNGN

SEQ ID NO: 139698 - protein, 38 aa, Artificial Sequence
  Description of Artificial Sequence: Synthetic polypeptide
DEEEIRTTNPVATEQYGVVSTVNLQAGNTEQGTNDEQQ

SEQ ID NO: 139699 - protein, 34 aa, Artificial Sequence
  Description of Artificial Sequence: Synthetic polypeptide
QEEEIRTTNPVGTEGYGSVNIMDNLQNEGGNDGD

SEQ ID NO: 139700 - protein, 35 aa, Artificial Sequence
  Description of Artificial Sequence: Synthetic polypeptide
QEEEIRTTNPVCYEPYGSVSCHPNLSQNRNGGNNE

SEQ ID NO: 139701 - protein, 35 aa, Artificial Sequence
  Description of Artificial Sequence: Synthetic polypeptide
DEEEIATTNPVAWEQYGSVSCTGQAQAVRTVAMNE

SEQ ID NO: 139702 - protein, 34 aa, Artificial Sequence
  Description of Artificial Sequence: Synthetic polypeptide
DEEEIATTNPVAWECYGSVSCTGQAQVRTVTNEG

SEQ ID NO: 139703 - protein, 35 aa, Artificial Sequence
  Description of Artificial Sequence: Synthetic polypeptide
DEEEIATTNPVAWEQYGSVSCTGQAQVNRTVASNE

SEQ ID NO: 139704 - protein, 38 aa, Artificial Sequence
  Description of Artificial Sequence: Synthetic polypeptide
DEEEIRTTNPVATEQYGVVSTVTNQLQAGNQQGTEEEE

SEQ ID NO: 139705 - protein, 28 aa, Artificial Sequence
  Description of Artificial Sequence: Synthetic peptide
QEGEIASTNPVGTEGYGVMASNLQHGDI

SEQ ID NO: 139706 - protein, 35 aa, Artificial Sequence
  Description of Artificial Sequence: Synthetic polypeptide
DEEEIATTNPVAWEQYGSVSCTGQAQVRTVAPNEW

SEQ ID NO: 139707 - protein, 32 aa, Artificial Sequence
  Description of Artificial Sequence: Synthetic polypeptide
DEHEIRTTNPVAYEAYGCVVSQIISFPVGNNR

SEQ ID NO: 139708 - protein, 28 aa, Artificial Sequence
  Description of Artificial Sequence: Synthetic peptide
QEGEIASTNPVGTEGYGVMASTLQHGDI

SEQ ID NO: 139709 - protein, 34 aa, Artificial Sequence
  Description of Artificial Sequence: Synthetic polypeptide
DEMEIATTNPVATCQYGCVCSTGALQNFGSNNQA

SEQ ID NO: 139710 - protein, 37 aa, Artificial Sequence
  Description of Artificial Sequence: Synthetic polypeptide
DEEEIRTTNPVATEQYGVVSTVTNQLGNQGNNNNQEE

SEQ ID NO: 139711 - protein, 36 aa, Artificial Sequence
  Description of Artificial Sequence: Synthetic polypeptide
DEEEIATTNPVATEQYGSVSSTWPAGPNMRMGDNPA

SEQ ID NO: 139712 - protein, 33 aa, Artificial Sequence
  Description of Artificial Sequence: Synthetic polypeptide
DEEEIATTNPVATTCYGTVSTGNGNEGAGNGNS

SEQ ID NO: 139713 - protein, 33 aa, Artificial Sequence
  Description of Artificial Sequence: Synthetic polypeptide
DEEEIATTNPVATEQYGSVCAATGEEPADEQNH

SEQ ID NO: 139714 - protein, 30 aa, Artificial Sequence
  Description of Artificial Sequence: Synthetic polypeptide
QEEEIRTTNPVSTEPYGTISEDCQQQQENK

SEQ ID NO: 139715 - protein, 35 aa, Artificial Sequence
  Description of Artificial Sequence: Synthetic polypeptide
DEHEIRTTNPVAYECWGSVCSTDNDGQEREGGNHS

SEQ ID NO: 139716 - protein, 38 aa, Artificial Sequence
  Description of Artificial Sequence: Synthetic polypeptide
DEEEIRTTNPVATEQYGVVSTVNLQAGNTEQGTTQQGN

SEQ ID NO: 139717 - protein, 38 aa, Artificial Sequence
  Description of Artificial Sequence: Synthetic polypeptide
DEEEIRTTNPVATEQYGVVSTVNLQAGNTEQGTTQEED

SEQ ID NO: 139718 - protein, 37 aa, Artificial Sequence
  Description of Artificial Sequence: Synthetic polypeptide
DEEEIRTTNPVATEQYGVVSTVTNQGQLAGNNDEQQD

SEQ ID NO: 139719 - protein, 37 aa, Artificial Sequence
  Description of Artificial Sequence: Synthetic polypeptide
DEEEIRTTNPVATEQYGVVSTVTNQLGNQGNNNEQQD

SEQ ID NO: 139720 - protein, 34 aa, Artificial Sequence
  Description of Artificial Sequence: Synthetic polypeptide
DEEEIATTNPVATETYGCVSTGGPAGLTNGGNAM

SEQ ID NO: 139721 - protein, 33 aa, Artificial Sequence
  Description of Artificial Sequence: Synthetic polypeptide
DEEEIATTNPVATERWGSICCNMVSQNEGGNNR

SEQ ID NO: 139722 - protein, 32 aa, Artificial Sequence
  Description of Artificial Sequence: Synthetic polypeptide
DEHEIRTTNPVAYECWGEVSHPNDDRQNMNGR

SEQ ID NO: 139723 - protein, 34 aa, Artificial Sequence
  Description of Artificial Sequence: Synthetic polypeptide
DEEEIATTNPVATERWGSICCNMVSQYRAGGNNR

SEQ ID NO: 139724 - protein, 33 aa, Artificial Sequence
  Description of Artificial Sequence: Synthetic polypeptide
DEEEIATTNPVATERWGSICCPAVSQRQGGNNR

SEQ ID NO: 139725 - protein, 34 aa, Artificial Sequence
  Description of Artificial Sequence: Synthetic polypeptide
DEEEIATTNPVATERWGSICVCNMWSQRQGGNNR

SEQ ID NO: 139726 - protein, 36 aa, Artificial Sequence
  Description of Artificial Sequence: Synthetic polypeptide
DEEEIATTNPVATESYGISVPTAGMNLQDQMIGNVD

SEQ ID NO: 139727 - protein, 28 aa, Artificial Sequence
  Description of Artificial Sequence: Synthetic peptide
QEGEIASTNPCGTEGYGVMSCTLQSGTR

SEQ ID NO: 139728 - protein, 33 aa, Artificial Sequence
  Description of Artificial Sequence: Synthetic polypeptide
DEEEIATTNPVATERWGSICCNMVSQRPGGNNT

SEQ ID NO: 139729 - protein, 36 aa, Artificial Sequence
  Description of Artificial Sequence: Synthetic polypeptide
DEEEIATTNPVATEQYGSVSSTWPAGPNMQNGGMPV

SEQ ID NO: 139730 - protein, 35 aa, Artificial Sequence
  Description of Artificial Sequence: Synthetic polypeptide
DEEEIRTTNPVATEQYGSVENPTTPLQGIEVEVMI

SEQ ID NO: 139731 - protein, 36 aa, Artificial Sequence
  Description of Artificial Sequence: Synthetic polypeptide
DEEEIATTNPVATEQYGSVSSTWPAGPNARMGGNPM

SEQ ID NO: 139732 - protein, 34 aa, Artificial Sequence
  Description of Artificial Sequence: Synthetic polypeptide
DEEEIRTTNPVATEQYGSVELPFNIPTLVEQSQV

SEQ ID NO: 139733 - protein, 34 aa, Artificial Sequence
  Description of Artificial Sequence: Synthetic polypeptide
DEEEIRTTNPVATEQYGSVELPINISTQVEQFQV

SEQ ID NO: 139734 - protein, 36 aa, Artificial Sequence
  Description of Artificial Sequence: Synthetic polypeptide
DEEEIATTNPVATEQYGSVSSTGEAGINPLDGMNPV

SEQ ID NO: 139735 - protein, 29 aa, Artificial Sequence
  Description of Artificial Sequence: Synthetic peptide
QEGEIAPTNPVASEQYGIVSCDLEDSGTL

SEQ ID NO: 139736 - protein, 37 aa, Artificial Sequence
  Description of Artificial Sequence: Synthetic polypeptide
DEEEIRTTNPVATEQYGVVSTVTNNNNQQGNNATEDE

SEQ ID NO: 139737 - protein, 37 aa, Artificial Sequence
  Description of Artificial Sequence: Synthetic polypeptide
DEEEIRTTNPVATEQYGVVSTVTNNNNQQGNNNTTTE

SEQ ID NO: 139738 - protein, 30 aa, Artificial Sequence
  Description of Artificial Sequence: Synthetic polypeptide
QEEEIVTTNPVATEQYGAVAGPEGGQGEET

SEQ ID NO: 139739 - protein, 36 aa, Artificial Sequence
  Description of Artificial Sequence: Synthetic polypeptide
DEEEIATTNPVATEQYGSVSSTGEAGINPRDGMNAD

SEQ ID NO: 139740 - protein, 36 aa, Artificial Sequence
  Description of Artificial Sequence: Synthetic polypeptide
DEEEIATTNPVATEQYGSVSSTGPAGPGMRAGMNPH

SEQ ID NO: 139741 - protein, 36 aa, Artificial Sequence
  Description of Artificial Sequence: Synthetic polypeptide
DEEEIATTNPVATEQYGSVSSTGPAGPNMRAGENPV

SEQ ID NO: 139742 - protein, 32 aa, Artificial Sequence
  Description of Artificial Sequence: Synthetic polypeptide
DAHEIRTTNPVAYEAYGQVSQANISFPVGNNR

SEQ ID NO: 139743 - protein, 30 aa, Artificial Sequence
  Description of Artificial Sequence: Synthetic polypeptide
QEEEISTTNPVATEQYGECPSEVEGQMTEQ

SEQ ID NO: 139744 - protein, 37 aa, Artificial Sequence
  Description of Artificial Sequence: Synthetic polypeptide
DEEEIRTTNPVATEQYGVVSTVTNNNNQQQGNNTNQE

SEQ ID NO: 139745 - protein, 37 aa, Artificial Sequence
  Description of Artificial Sequence: Synthetic polypeptide
DEEEIRTTNPVATEQYGVVSTVTNNNQQAGNNDEEDD

SEQ ID NO: 139746 - protein, 36 aa, Artificial Sequence
  Description of Artificial Sequence: Synthetic polypeptide
DEEEIRTTNPVATEQYGSVELPMTFLQPNSGVEDLI

SEQ ID NO: 139747 - protein, 36 aa, Artificial Sequence
  Description of Artificial Sequence: Synthetic polypeptide
DEEEIATTNPVATEQYGSVSSTPPAGPNMRNGMNPT

SEQ ID NO: 139748 - protein, 35 aa, Artificial Sequence
  Description of Artificial Sequence: Synthetic polypeptide
DEEEIATTNPVATEQYGSVSSTEPAGPNMREMNPV

SEQ ID NO: 139749 - protein, 36 aa, Artificial Sequence
  Description of Artificial Sequence: Synthetic polypeptide
DEEEIATTNPVATEQYGSVSSPWPAGPNEQMGGNPV

SEQ ID NO: 139750 - protein, 28 aa, Artificial Sequence
  Description of Artificial Sequence: Synthetic peptide
QEEELATTNPVATEQYGEAPEVCQHEEK

SEQ ID NO: 139751 - protein, 36 aa, Artificial Sequence
  Description of Artificial Sequence: Synthetic polypeptide
DEEEIATTNPVATEQYGSVSATWGAGPDAQNGGNPV

SEQ ID NO: 139752 - protein, 34 aa, Artificial Sequence
  Description of Artificial Sequence: Synthetic polypeptide
DEHEIRTTNPVAYEPWGSVSGDNLNGDRQGENGK

SEQ ID NO: 139753 - protein, 33 aa, Artificial Sequence
  Description of Artificial Sequence: Synthetic polypeptide
DEEEIRTTNPVATEQYGSVELCNIPTVTEEQTV

SEQ ID NO: 139754 - protein, 32 aa, Artificial Sequence
  Description of Artificial Sequence: Synthetic polypeptide
QEGEIAPTNPIATEQYGAVWSCENLQEPGTYR

SEQ ID NO: 139755 - protein, 35 aa, Artificial Sequence
  Description of Artificial Sequence: Synthetic polypeptide
DEEEIATTNPVATEQYGSVSGTGNPDNSEHNGDSE

SEQ ID NO: 139756 - protein, 34 aa, Artificial Sequence
  Description of Artificial Sequence: Synthetic polypeptide
DEEEIRTTNPVATEQYGSVELGTIPVTVVEEQRV

SEQ ID NO: 139757 - protein, 36 aa, Artificial Sequence
  Description of Artificial Sequence: Synthetic polypeptide
DEEEIATTNPVATEQYGSVSGTGNPTQPDDLMGAQD

SEQ ID NO: 139758 - protein, 33 aa, Artificial Sequence
  Description of Artificial Sequence: Synthetic polypeptide
DEEEIRTTNPVATEQYGSVELGMIPTVTEEQPV

SEQ ID NO: 139759 - protein, 28 aa, Artificial Sequence
  Description of Artificial Sequence: Synthetic peptide
QEGEIAPTNPVASEQWGIVSCILMSEDR

SEQ ID NO: 139760 - protein, 35 aa, Artificial Sequence
  Description of Artificial Sequence: Synthetic polypeptide
DEEEIRTTNPVATEQYGSVELGMTFLAPNSGVELV

SEQ ID NO: 139761 - protein, 32 aa, Artificial Sequence
  Description of Artificial Sequence: Synthetic polypeptide
DAGEIATTNPVAYEQWGSVCTENHQDDLGMGR

SEQ ID NO: 139762 - protein, 36 aa, Artificial Sequence
  Description of Artificial Sequence: Synthetic polypeptide
DEEEIATTNPVATEQYGSVSSMTPAIPNMRNGMNPV

SEQ ID NO: 139763 - protein, 33 aa, Artificial Sequence
  Description of Artificial Sequence: Synthetic polypeptide
DEEEIRTTNPVATEQYGSVELGPIPTVVEEQRL

SEQ ID NO: 139764 - protein, 36 aa, Artificial Sequence
  Description of Artificial Sequence: Synthetic polypeptide
DEEEIATTNPVATEQYGSVSPTGEAGINPRNGMNPV

SEQ ID NO: 139765 - protein, 28 aa, Artificial Sequence
  Description of Artificial Sequence: Synthetic peptide
QEGEIASTNPVGTEGYGVMSCTLQSGTI

SEQ ID NO: 139766 - protein, 28 aa, Artificial Sequence
  Description of Artificial Sequence: Synthetic peptide
QEGEIAPTNPVATEQYGIASCVCQHETK

SEQ ID NO: 139767 - protein, 36 aa, Artificial Sequence
  Description of Artificial Sequence: Synthetic polypeptide
DEEEIATTNPVATEQYGSVSSTTPAGPEGRNGENPV

SEQ ID NO: 139768 - protein, 36 aa, Artificial Sequence
  Description of Artificial Sequence: Synthetic polypeptide
DEEEIATTNPVATEQYGSVSSTTPAGPNMRNGMNPV

SEQ ID NO: 139769 - protein, 29 aa, Artificial Sequence
  Description of Artificial Sequence: Synthetic peptide
DEMEIASTNPVGTEQYGVMASGPEFEGND

SEQ ID NO: 139770 - protein, 36 aa, Artificial Sequence
  Description of Artificial Sequence: Synthetic polypeptide
DEEEIATTNPVATEQYGSVSSTTPAGPNMRVGMNPV

SEQ ID NO: 139771 - protein, 28 aa, Artificial Sequence
  Description of Artificial Sequence: Synthetic peptide
QEGEIAPTNPVSSEQYGEVSEVLQHETK

SEQ ID NO: 139772 - protein, 29 aa, Artificial Sequence
  Description of Artificial Sequence: Synthetic peptide
QEGEIAPTNPVSSEQYGIVSACDLQSGTL

SEQ ID NO: 139773 - protein, 30 aa, Artificial Sequence
  Description of Artificial Sequence: Synthetic polypeptide
QEGEIAPTNPVSSEQYGIVSCDLQHEGTDR

SEQ ID NO: 139774 - protein, 36 aa, Artificial Sequence
  Description of Artificial Sequence: Synthetic polypeptide
DEEEIATTNPVATEQYGSVSSTTPAGPNMRNGMNPL

SEQ ID NO: 139775 - protein, 30 aa, Artificial Sequence
  Description of Artificial Sequence: Synthetic polypeptide
QEGEIAPTNPVSSEQYGIVSCDLQSEGTDR

SEQ ID NO: 139776 - protein, 36 aa, Artificial Sequence
  Description of Artificial Sequence: Synthetic polypeptide
DEEEIATTNPVATEQYGSVSSTTPALPEMHNGMNDV

SEQ ID NO: 139777 - protein, 36 aa, Artificial Sequence
  Description of Artificial Sequence: Synthetic polypeptide
DEEEIATTNPVATEQYGSVSSTTPALPEMHNGMNPV

SEQ ID NO: 139778 - protein, 36 aa, Artificial Sequence
  Description of Artificial Sequence: Synthetic polypeptide
DEEEIATTNPVATEQYGSVSSTTPALPNMHNGMNPV

SEQ ID NO: 139779 - protein, 36 aa, Artificial Sequence
  Description of Artificial Sequence: Synthetic polypeptide
DEEEIATTNPVATEQYGSVSSTTPCGPNMHNGMNPV

SEQ ID NO: 139780 - protein, 36 aa, Artificial Sequence
  Description of Artificial Sequence: Synthetic polypeptide
DEEEIATTNPVATEQYGSVSSTWPAGMNMRNGMNPV

SEQ ID NO: 139781 - protein, 36 aa, Artificial Sequence
  Description of Artificial Sequence: Synthetic polypeptide
DEEEIATTNPVATEQYGSVSSTWPAGPDDQNGGNPV

SEQ ID NO: 139782 - protein, 29 aa, Artificial Sequence
  Description of Artificial Sequence: Synthetic peptide
QEGEIAPTNPVSSEQYGIVSCGPQSEGTR

SEQ ID NO: 139783 - protein, 36 aa, Artificial Sequence
  Description of Artificial Sequence: Synthetic polypeptide
DEEEIATTNPVATEQYGSVSSTTGAGPNMRNGMNPV

SEQ ID NO: 139784 - protein, 36 aa, Artificial Sequence
  Description of Artificial Sequence: Synthetic polypeptide
DEEEIATTNPVATEQYGSVSSTTPAGPNMRNGMNDV

SEQ ID NO: 139785 - protein, 35 aa, Artificial Sequence
  Description of Artificial Sequence: Synthetic polypeptide
DEEEIATTNPVATEQYGSVSSTTPAGPNMRNGEPV

SEQ ID NO: 139786 - protein, 36 aa, Artificial Sequence
  Description of Artificial Sequence: Synthetic polypeptide
DEEEIATTNPVATEQYGSVSSTTPAGPNARAGDNPV

SEQ ID NO: 139787 - protein, 29 aa, Artificial Sequence
  Description of Artificial Sequence: Synthetic peptide
QEEEISTTNPVATEQYGEAPEVICQHEEK

SEQ ID NO: 139788 - protein, 31 aa, Artificial Sequence
  Description of Artificial Sequence: Synthetic polypeptide
DEMEIAPTNPCASEQYGTVCSCDNPVQFGTR

SEQ ID NO: 139789 - protein, 29 aa, Artificial Sequence
  Description of Artificial Sequence: Synthetic peptide
QEEEISTTNPVATEQYGEAPEVCQHYEEK

SEQ ID NO: 139790 - protein, 30 aa, Artificial Sequence
  Description of Artificial Sequence: Synthetic polypeptide
QEGEIAPTNPVSSECYGIVSCNLQDSGETR

SEQ ID NO: 139791 - protein, 32 aa, Artificial Sequence
  Description of Artificial Sequence: Synthetic polypeptide
DEMEIASTNPVATEQYGTVCSATDGPVESGND

SEQ ID NO: 139792 - protein, 35 aa, Artificial Sequence
  Description of Artificial Sequence: Synthetic polypeptide
DEEEIATTNPVATEQYGSVSSTTPAGPNMRNGGPV

SEQ ID NO: 139793 - protein, 32 aa, Artificial Sequence
  Description of Artificial Sequence: Synthetic polypeptide
DEMEIASTNPVATEQYGVMCSATGPVQHEGND

SEQ ID NO: 139794 - protein, 30 aa, Artificial Sequence
  Description of Artificial Sequence: Synthetic polypeptide
QEEEISTTNPVATEQYGDVAGPEVGQGEEQ

SEQ ID NO: 139795 - protein, 29 aa, Artificial Sequence
  Description of Artificial Sequence: Synthetic peptide
QEGEIAPTNPVSSEGYGIVACNIQSRGTR

SEQ ID NO: 139796 - protein, 31 aa, Artificial Sequence
  Description of Artificial Sequence: Synthetic polypeptide
DEMEIASTNPVCTEQYGTVCSTDGPVESGND

SEQ ID NO: 139797 - protein, 28 aa, Artificial Sequence
  Description of Artificial Sequence: Synthetic peptide
QEGEIAPTNPVSSEPYGIISCNIQQGTR

SEQ ID NO: 139798 - protein, 28 aa, Artificial Sequence
  Description of Artificial Sequence: Synthetic peptide
QEGEIAPTNPVSSEPYGIISCNIQSGTR

SEQ ID NO: 139799 - protein, 31 aa, Artificial Sequence
  Description of Artificial Sequence: Synthetic polypeptide
DEMEIASTNPVCTEQYGVVCSDDGPQSEGND

SEQ ID NO: 139800 - protein, 32 aa, Artificial Sequence
  Description of Artificial Sequence: Synthetic polypeptide
DEMEIASTNPVATEQYGVMCSATGPVQHEGNI

SEQ ID NO: 139801 - protein, 36 aa, Artificial Sequence
  Description of Artificial Sequence: Synthetic polypeptide
QEEEIRTTNPVATEQYGSVSSTTPAGPNMRNGMNPV

SEQ ID NO: 139802 - protein, 34 aa, Artificial Sequence
  Description of Artificial Sequence: Synthetic polypeptide
DEHEIRTTNPVAYEAWGVVSTTNLAQGDTGGNKS

SEQ ID NO: 139803 - protein, 34 aa, Artificial Sequence
  Description of Artificial Sequence: Synthetic polypeptide
QEEEIRTTNPVCYEPYGSVACDPNLSQNRGGNNE

SEQ ID NO: 139804 - protein, 34 aa, Artificial Sequence
  Description of Artificial Sequence: Synthetic polypeptide
DEEEIRTTNPVATEQYGSVEPTPMPSEPLNVELQ

SEQ ID NO: 139805 - protein, 35 aa, Artificial Sequence
  Description of Artificial Sequence: Synthetic polypeptide
DEEEIRTTNPVATEQYGSVEPTPMMHQESGEEEVM

SEQ ID NO: 139806 - protein, 38 aa, Artificial Sequence
  Description of Artificial Sequence: Synthetic polypeptide
DEEEIRTTNPVATEQYGVVSTVTNTNLQAGTNVTEDED

SEQ ID NO: 139807 - protein, 36 aa, Artificial Sequence
  Description of Artificial Sequence: Synthetic polypeptide
DEEEIRTTNPVATEQYGSVEPTPIMPQEPGLNVLLA

SEQ ID NO: 139808 - protein, 35 aa, Artificial Sequence
  Description of Artificial Sequence: Synthetic polypeptide
DEEEIRTTNPVATEQYGSVEPTPIMPQEPANVQLQ

SEQ ID NO: 139809 - protein, 35 aa, Artificial Sequence
  Description of Artificial Sequence: Synthetic polypeptide
DEEEIRTTNPVATEQYGSVEPTPIMPEEPENVRLN

SEQ ID NO: 139810 - protein, 30 aa, Artificial Sequence
  Description of Artificial Sequence: Synthetic polypeptide
QEGEIATTNPCSTEQYGIISCDLQQSNGTR

SEQ ID NO: 139811 - protein, 28 aa, Artificial Sequence
  Description of Artificial Sequence: Synthetic peptide
QEGEIATTNPCSTECYGIVSECLQSETL

SEQ ID NO: 139812 - protein, 36 aa, Artificial Sequence
  Description of Artificial Sequence: Synthetic polypeptide
DEEEIRTTNPVATEQYGSVEPTPIMHQEPGLNVNLQ

SEQ ID NO: 139813 - protein, 28 aa, Artificial Sequence
  Description of Artificial Sequence: Synthetic peptide
QEGEIATTNPCSTECYGIVSECLQHETL

SEQ ID NO: 139814 - protein, 37 aa, Artificial Sequence
  Description of Artificial Sequence: Synthetic polypeptide
AEEEIRTTNPVATEQYGSVSTVVVNNNNQNDNGTNVE

SEQ ID NO: 139815 - protein, 36 aa, Artificial Sequence
  Description of Artificial Sequence: Synthetic polypeptide
DEEEIRTTNPVATEQYGSVCSTEVLLDTTENVEDNA

SEQ ID NO: 139816 - protein, 29 aa, Artificial Sequence
  Description of Artificial Sequence: Synthetic peptide
QEGEIATTNPCSSEQYGTISCNIQQNGNH

SEQ ID NO: 139817 - protein, 34 aa, Artificial Sequence
  Description of Artificial Sequence: Synthetic polypeptide
DEEEIATTNPVAYEPQWGQSVANNDGLQTDGITR

SEQ ID NO: 139818 - protein, 34 aa, Artificial Sequence
  Description of Artificial Sequence: Synthetic polypeptide
DEEEIATTNPVATEQYGSVCAAPQQDAGEGNNDD

SEQ ID NO: 139819 - protein, 35 aa, Artificial Sequence
  Description of Artificial Sequence: Synthetic polypeptide
DEEEIATTNPVATEQYGSVCAAQANGDQDMPGENN

SEQ ID NO: 139820 - protein, 34 aa, Artificial Sequence
  Description of Artificial Sequence: Synthetic polypeptide
DEMEIATTNPVATEQYGCVCSTTDLNEDHEGENQ

SEQ ID NO: 139821 - protein, 35 aa, Artificial Sequence
  Description of Artificial Sequence: Synthetic polypeptide
QEEEIRTTNPVATEQYGSVVGFTNMTQDEFDNGGF

SEQ ID NO: 139822 - protein, 35 aa, Artificial Sequence
  Description of Artificial Sequence: Synthetic polypeptide
QEEEIRTTNPVATEQYGSVTTDTMDDNIGGQGGFG

SEQ ID NO: 139823 - protein, 28 aa, Artificial Sequence
  Description of Artificial Sequence: Synthetic peptide
QEGEIATTNPCSSEQYGIVSCCLQHETL

SEQ ID NO: 139824 - protein, 33 aa, Artificial Sequence
  Description of Artificial Sequence: Synthetic polypeptide
DASEIRTTNPDATECWGSVSCINEPQDREGENG

SEQ ID NO: 139825 - protein, 33 aa, Artificial Sequence
  Description of Artificial Sequence: Synthetic polypeptide
DASEIRTTNPVATECWGSVACINEPQDREGENG

SEQ ID NO: 139826 - protein, 33 aa, Artificial Sequence
  Description of Artificial Sequence: Synthetic polypeptide
DASEIRTTNPVATECWGSVFCINEPQDREGENG

SEQ ID NO: 139827 - protein, 38 aa, Artificial Sequence
  Description of Artificial Sequence: Synthetic polypeptide
DEEEIRTTNPVATEQYGVVSTVTNTNLQQGTNNEDESN

SEQ ID NO: 139828 - protein, 30 aa, Artificial Sequence
  Description of Artificial Sequence: Synthetic polypeptide
QEGEIATTNPCSSEQYGIVSCENLQSNGTH

SEQ ID NO: 139829 - protein, 35 aa, Artificial Sequence
  Description of Artificial Sequence: Synthetic polypeptide
DEEEIATTNPVATEQYGSVCAATAHLASAAENNRQ

SEQ ID NO: 139830 - protein, 31 aa, Artificial Sequence
  Description of Artificial Sequence: Synthetic polypeptide
QEGEIATTNPCSSEQYGIVSCINLQDSEGTR

SEQ ID NO: 139831 - protein, 31 aa, Artificial Sequence
  Description of Artificial Sequence: Synthetic polypeptide
QEGEIATTNPCSSEQYGIVSCINLQDSGETR

SEQ ID NO: 139832 - protein, 34 aa, Artificial Sequence
  Description of Artificial Sequence: Synthetic polypeptide
DEEEIATTNPVATEQYGSVCAATAHDQDMPGEDN

SEQ ID NO: 139833 - protein, 35 aa, Artificial Sequence
  Description of Artificial Sequence: Synthetic polypeptide
DEEEIATTNPVATEQYGSVCAATAGVLPEDGENDQ

SEQ ID NO: 139834 - protein, 29 aa, Artificial Sequence
  Description of Artificial Sequence: Synthetic peptide
QEGEIATTNPCSSEQYGIVSCNLESGEDL

SEQ ID NO: 139835 - protein, 36 aa, Artificial Sequence
  Description of Artificial Sequence: Synthetic polypeptide
QEEEIRTTNPVATEQYGSVTDTDNMDQGGGGETNTE

SEQ ID NO: 139836 - protein, 35 aa, Artificial Sequence
  Description of Artificial Sequence: Synthetic polypeptide
DEEEIATTNPVATEQYGSVCAANNPLQGDVQNDDY

SEQ ID NO: 139837 - protein, 37 aa, Artificial Sequence
  Description of Artificial Sequence: Synthetic polypeptide
DEEEIRTTNPVATEQYGVVSTVTNTNQQAGNNDEEQE

SEQ ID NO: 139838 - protein, 37 aa, Artificial Sequence
  Description of Artificial Sequence: Synthetic polypeptide
DEEEIRTTNPVATEQYGVVSTVTNTQAGNQQGTNEDN

SEQ ID NO: 139839 - protein, 29 aa, Artificial Sequence
  Description of Artificial Sequence: Synthetic peptide
DEMEIATTNPVATEQYGEACPEVPEHGEK

SEQ ID NO: 139840 - protein, 33 aa, Artificial Sequence
  Description of Artificial Sequence: Synthetic polypeptide
DEEEIRTTNPVATEQYGSVEQPNIPTVVEEQDV

SEQ ID NO: 139841 - protein, 30 aa, Artificial Sequence
  Description of Artificial Sequence: Synthetic polypeptide
QEGEIATTNPVASEQYGIVSACDLEDSGTL

SEQ ID NO: 139842 - protein, 37 aa, Artificial Sequence
  Description of Artificial Sequence: Synthetic polypeptide
DEEEIRTTNPVATEQYGSVEQPSPAYPNMQNGMNDVV

SEQ ID NO: 139843 - protein, 38 aa, Artificial Sequence
  Description of Artificial Sequence: Synthetic polypeptide
DEEEIRTTNPVATEQYGVVSTVNLEQGNTEQGTNNDEE

SEQ ID NO: 139844 - protein, 38 aa, Artificial Sequence
  Description of Artificial Sequence: Synthetic polypeptide
DEEEIRTTNPVATEQYGVVSTVNLEQGNTEQGTNDEED

SEQ ID NO: 139845 - protein, 36 aa, Artificial Sequence
  Description of Artificial Sequence: Synthetic polypeptide
QEEEIRTTNPVATEQYGSVSTGNGGGDGEEGNEEAN

SEQ ID NO: 139846 - protein, 37 aa, Artificial Sequence
  Description of Artificial Sequence: Synthetic polypeptide
DEEEIRTTNPVATEQYGSVEQPTWAGPNEQNGMNDVV

SEQ ID NO: 139847 - protein, 29 aa, Artificial Sequence
  Description of Artificial Sequence: Synthetic peptide
DEMEIATTNPVATEQYGEVPAEVCEHEEK

SEQ ID NO: 139848 - protein, 37 aa, Artificial Sequence
  Description of Artificial Sequence: Synthetic polypeptide
DEEEIRTTNPVATEQYGSVESTIVVLQQITEENNSTG

SEQ ID NO: 139849 - protein, 35 aa, Artificial Sequence
  Description of Artificial Sequence: Synthetic polypeptide
DEEEIATTNPVATEQYGSVCAANNLDEAANEGTRS

SEQ ID NO: 139850 - protein, 32 aa, Artificial Sequence
  Description of Artificial Sequence: Synthetic polypeptide
QEGEIATTNPVASEQYGIVSATDGPVESEGNR

SEQ ID NO: 139851 - protein, 37 aa, Artificial Sequence
  Description of Artificial Sequence: Synthetic polypeptide
AEEEIRTTNPVATEQYGSVSTVVTQGNNQDEGNNNSD

SEQ ID NO: 139852 - protein, 37 aa, Artificial Sequence
  Description of Artificial Sequence: Synthetic polypeptide
AEEEIRTTNPVATEQYGSVSTVVTQGNNNQLGGNDDE

SEQ ID NO: 139853 - protein, 31 aa, Artificial Sequence
  Description of Artificial Sequence: Synthetic polypeptide
DEMEIATTNPVATEQYGEVCSTDVCEFEEEK

SEQ ID NO: 139854 - protein, 35 aa, Artificial Sequence
  Description of Artificial Sequence: Synthetic polypeptide
DEEEIRTTNPVATEQYGSVEPTLGDEILNGEVQRA

SEQ ID NO: 139855 - protein, 37 aa, Artificial Sequence
  Description of Artificial Sequence: Synthetic polypeptide
AEEEIRTTNPVATEQYGSVSTVVTTDNNQQIGTNGTD

SEQ ID NO: 139856 - protein, 38 aa, Artificial Sequence
  Description of Artificial Sequence: Synthetic polypeptide
DEEEIRTTNPVATEQYGVVSTVNLNGNNNNQQGTDEND

SEQ ID NO: 139857 - protein, 34 aa, Artificial Sequence
  Description of Artificial Sequence: Synthetic polypeptide
DEEEIATTNPVAYEQWGCVAMTNLNPRDGMGDRH

SEQ ID NO: 139858 - protein, 35 aa, Artificial Sequence
  Description of Artificial Sequence: Synthetic polypeptide
DEEEIATTNPVATEQYGSVCAANNNLEQDPENNAE

SEQ ID NO: 139859 - protein, 34 aa, Artificial Sequence
  Description of Artificial Sequence: Synthetic polypeptide
DEMEIATTNPVATEQYGCVSNTDLNEDHFGENLA

SEQ ID NO: 139860 - protein, 38 aa, Artificial Sequence
  Description of Artificial Sequence: Synthetic polypeptide
AEEEIRTTNPVATEQYGSVSTVVTVNLQSNEQGTNTNN

SEQ ID NO: 139861 - protein, 36 aa, Artificial Sequence
  Description of Artificial Sequence: Synthetic polypeptide
DEEEIRTTNPVATEQYGSVEPVLIIMQEQTIENTRM

SEQ ID NO: 139862 - protein, 33 aa, Artificial Sequence
  Description of Artificial Sequence: Synthetic polypeptide
DEMEIATTNPVATEQYGCVSNTELNEDHEGETL

SEQ ID NO: 139863 - protein, 37 aa, Artificial Sequence
  Description of Artificial Sequence: Synthetic polypeptide
AEEEIRTTNPVATEQYGSVSTVVTTDTNNQQQGTNTD

SEQ ID NO: 139864 - protein, 33 aa, Artificial Sequence
  Description of Artificial Sequence: Synthetic polypeptide
DEEEIATTNPVAYEQWGEVSGGNGLNSGEGNTS

SEQ ID NO: 139865 - protein, 29 aa, Artificial Sequence
  Description of Artificial Sequence: Synthetic peptide
QEGEIATTNPVASEQWGDVSCILMSAEDR

SEQ ID NO: 139866 - protein, 34 aa, Artificial Sequence
  Description of Artificial Sequence: Synthetic polypeptide
DEEEIRTTNPVATEQYGSVEPWEGDNQRTLVTES

SEQ ID NO: 139867 - protein, 38 aa, Artificial Sequence
  Description of Artificial Sequence: Synthetic polypeptide
AEEEIRTTNPVATEQYGSVSTVVTTNQLGNQQGNNNVD

SEQ ID NO: 139868 - protein, 35 aa, Artificial Sequence
  Description of Artificial Sequence: Synthetic polypeptide
DEEEIRTTNPVATEQYGSVEPWYNFDNQRLLVTES

SEQ ID NO: 139869 - protein, 36 aa, Artificial Sequence
  Description of Artificial Sequence: Synthetic polypeptide
DEEEIRTTNPVATEQYGSVEQAVNTMVQVRGEQADE

SEQ ID NO: 139870 - protein, 37 aa, Artificial Sequence
  Description of Artificial Sequence: Synthetic polypeptide
DEEEIRTTNPVATEQYGVVSTVNLNNLQAGTTTEEEE

SEQ ID NO: 139871 - protein, 34 aa, Artificial Sequence
  Description of Artificial Sequence: Synthetic polypeptide
DEEEIRTTNPVATEQYGSVEPWATPGEPVISNTS

SEQ ID NO: 139872 - protein, 29 aa, Artificial Sequence
  Description of Artificial Sequence: Synthetic peptide
QEGEIATTNPCSSEQYGIVSACNLESGTL

SEQ ID NO: 139873 - protein, 29 aa, Artificial Sequence
  Description of Artificial Sequence: Synthetic peptide
QEGEIATTNPCSSEQYGIVSACNLEHGTL

SEQ ID NO: 139874 - protein, 29 aa, Artificial Sequence
  Description of Artificial Sequence: Synthetic peptide
QEGEIATTNPCSSEQYGIVSACNLEHGEL

SEQ ID NO: 139875 - protein, 33 aa, Artificial Sequence
  Description of Artificial Sequence: Synthetic polypeptide
DEEEIATTNPVATEQYGSVCAATGEEAADEMNM

SEQ ID NO: 139876 - protein, 28 aa, Artificial Sequence
  Description of Artificial Sequence: Synthetic peptide
QEGEIATTNPCATEQYGEAPENCQHEEK

SEQ ID NO: 139877 - protein, 35 aa, Artificial Sequence
  Description of Artificial Sequence: Synthetic polypeptide
DEEEIATTNPVAYEAYGWTVSYTNSLPQFPLGSRR

SEQ ID NO: 139878 - protein, 34 aa, Artificial Sequence
  Description of Artificial Sequence: Synthetic polypeptide
DEEEIATTNPVAYEAYGYTVSYTNLPGFPLGERR

SEQ ID NO: 139879 - protein, 32 aa, Artificial Sequence
  Description of Artificial Sequence: Synthetic polypeptide
QEEEIRTTNPVATSMYGCVYATVALDQGGRGF

SEQ ID NO: 139880 - protein, 37 aa, Artificial Sequence
  Description of Artificial Sequence: Synthetic polypeptide
DEEEIRTTNPVATEQYGVVSTVTNQQAGNQQGNQTEE

SEQ ID NO: 139881 - protein, 33 aa, Artificial Sequence
  Description of Artificial Sequence: Synthetic polypeptide
DEMEIATTNPVATECYGTVCSATDCLVEFEGNL

SEQ ID NO: 139882 - protein, 35 aa, Artificial Sequence
  Description of Artificial Sequence: Synthetic polypeptide
QEEEIRTTNPVATEYYGSVNDDTGNLGEEQGEENT

SEQ ID NO: 139883 - protein, 37 aa, Artificial Sequence
  Description of Artificial Sequence: Synthetic polypeptide
DEEEIRTTNPVATEQYGVVSTVTNQQANNQQGTNVTE

SEQ ID NO: 139884 - protein, 34 aa, Artificial Sequence
  Description of Artificial Sequence: Synthetic polypeptide
DEEEIATTNPVAYECWGVVSTNLNQGNAGENDGM

SEQ ID NO: 139885 - protein, 36 aa, Artificial Sequence
  Description of Artificial Sequence: Synthetic polypeptide
DEEEIRTTNPVATEQYGVVSTVTNQQGNQAGTEETE

SEQ ID NO: 139886 - protein, 37 aa, Artificial Sequence
  Description of Artificial Sequence: Synthetic polypeptide
AEEEIRTTNPVATEQYGSVSTVVVTNQNQQQGTNQDE

SEQ ID NO: 139887 - protein, 38 aa, Artificial Sequence
  Description of Artificial Sequence: Synthetic polypeptide
DEEEIRTTNPVATEQYGVVSTVNLQAGNNNNEQGEEDD

SEQ ID NO: 139888 - protein, 37 aa, Artificial Sequence
  Description of Artificial Sequence: Synthetic polypeptide
DEEEIRTTNPVATEQYGVVSTVTNQQGNQQGTNTTTD

SEQ ID NO: 139889 - protein, 37 aa, Artificial Sequence
  Description of Artificial Sequence: Synthetic polypeptide
DEEEIRTTNPVATEQYGVVSTVTNQQAGNQQGTNQEQ

SEQ ID NO: 139890 - protein, 37 aa, Artificial Sequence
  Description of Artificial Sequence: Synthetic polypeptide
AEEEIRTTNPVATEQYGSVSTVVVNTNQQGNGNNQTD

SEQ ID NO: 139891 - protein, 33 aa, Artificial Sequence
  Description of Artificial Sequence: Synthetic polypeptide
DEEEIATTNPVAYEAWGEVATNLNQGDVGQNQS

SEQ ID NO: 139892 - protein, 34 aa, Artificial Sequence
  Description of Artificial Sequence: Synthetic polypeptide
QEEEIRTTNPVAYEQYGITTPSTNEHSNRGGNNM

SEQ ID NO: 139893 - protein, 31 aa, Artificial Sequence
  Description of Artificial Sequence: Synthetic polypeptide
QEGEIATTNPCASEQWGIVSCINEQDRGETR

SEQ ID NO: 139894 - protein, 33 aa, Artificial Sequence
  Description of Artificial Sequence: Synthetic polypeptide
DAQEIATTNPVATEQYGSVSATDYLEDHEGEDL

SEQ ID NO: 139895 - protein, 33 aa, Artificial Sequence
  Description of Artificial Sequence: Synthetic polypeptide
DEEEIATTNPVATEQYGSVCAATGEEFADESNN

SEQ ID NO: 139896 - protein, 31 aa, Artificial Sequence
  Description of Artificial Sequence: Synthetic polypeptide
QEGEIATTNPCASEQYGIVSATNLEDHEGTL

SEQ ID NO: 139897 - protein, 31 aa, Artificial Sequence
  Description of Artificial Sequence: Synthetic polypeptide
QEGEIATTNPCASEQYGIVSATNLEDSEGTL

SEQ ID NO: 139898 - protein, 34 aa, Artificial Sequence
  Description of Artificial Sequence: Synthetic polypeptide
DEHEIRTTNPVAYEAWGSVATTNLNQGDHGNGKS

SEQ ID NO: 139899 - protein, 34 aa, Artificial Sequence
  Description of Artificial Sequence: Synthetic polypeptide
QEEEIRTTNPVAYEQYGCVASCTNLSGKGGDSTY

SEQ ID NO: 139900 - protein, 34 aa, Artificial Sequence
  Description of Artificial Sequence: Synthetic polypeptide
DEEEIATTNPVATEQYGSVCAATGEEAGDSMNNH

SEQ ID NO: 139901 - protein, 35 aa, Artificial Sequence
  Description of Artificial Sequence: Synthetic polypeptide
DEEEIRTTNPVATEQYGSVCSTGPGVPAEDPNENN

SEQ ID NO: 139902 - protein, 33 aa, Artificial Sequence
  Description of Artificial Sequence: Synthetic polypeptide
DEHEIRTTNPVAYEAWGSVATNLNQGDVGEGKS

SEQ ID NO: 139903 - protein, 31 aa, Artificial Sequence
  Description of Artificial Sequence: Synthetic polypeptide
QEGEIATTNPCASEQYGIVSCINEQDSGETR

SEQ ID NO: 139904 - protein, 34 aa, Artificial Sequence
  Description of Artificial Sequence: Synthetic polypeptide
DEEEIATTNPVATEQYGSVCAATGEEAGDNMGNN

SEQ ID NO: 139905 - protein, 33 aa, Artificial Sequence
  Description of Artificial Sequence: Synthetic polypeptide
DEHEIRTTNPVAYEAWGEVSTNNAQGDAGGNKS

SEQ ID NO: 139906 - protein, 33 aa, Artificial Sequence
  Description of Artificial Sequence: Synthetic polypeptide
DEEEIATTNPVATEQYGSVCAATGEEAADNLNN

SEQ ID NO: 139907 - protein, 33 aa, Artificial Sequence
  Description of Artificial Sequence: Synthetic polypeptide
DEHEIRTTNPVAYEAWGSVATNPNQGDAGGNKS

SEQ ID NO: 139908 - protein, 30 aa, Artificial Sequence
  Description of Artificial Sequence: Synthetic polypeptide
QEGEIASTNPVSTEGYGIVACNIQSRVGQR

SEQ ID NO: 139909 - protein, 34 aa, Artificial Sequence
  Description of Artificial Sequence: Synthetic polypeptide
DEEEIATTNPVATEQYGSVCAATAQLDAAEGAGE

SEQ ID NO: 139910 - protein, 34 aa, Artificial Sequence
  Description of Artificial Sequence: Synthetic polypeptide
DEEEIATTNPVATEQYGSVCAATAQLDAAAENGM

SEQ ID NO: 139911 - protein, 37 aa, Artificial Sequence
  Description of Artificial Sequence: Synthetic polypeptide
DEEEIRTTNPVATEQYGVVSTVTNQQQGNNNNQEDEE

SEQ ID NO: 139912 - protein, 33 aa, Artificial Sequence
  Description of Artificial Sequence: Synthetic polypeptide
DEEEIATTNPVAYEGWGSVATNPQPGEDGNNTN

SEQ ID NO: 139913 - protein, 34 aa, Artificial Sequence
  Description of Artificial Sequence: Synthetic polypeptide
DEHEIRTTNPVAWEQWGSVSCWNISQTAVGNPSF

SEQ ID NO: 139914 - protein, 34 aa, Artificial Sequence
  Description of Artificial Sequence: Synthetic polypeptide
DEHEIRTTNPVAWEQWGSVSCWNISQTAGGGNSF

SEQ ID NO: 139915 - protein, 33 aa, Artificial Sequence
  Description of Artificial Sequence: Synthetic polypeptide
DEEEIATTNPVAYEHWGSVATGMLGDHQGGNAS

SEQ ID NO: 139916 - protein, 33 aa, Artificial Sequence
  Description of Artificial Sequence: Synthetic polypeptide
DEEEIRTTNPVATEQYGSVEPQPQDPEAQEVPN

SEQ ID NO: 139917 - protein, 34 aa, Artificial Sequence
  Description of Artificial Sequence: Synthetic polypeptide
DEHEIRTTNPVAYDAYGSTVNCTGQLQRTGGNGD

SEQ ID NO: 139918 - protein, 34 aa, Artificial Sequence
  Description of Artificial Sequence: Synthetic polypeptide
QEEEIRTTNPVATEQYGSVYTDNNMNMEEGGQTE

SEQ ID NO: 139919 - protein, 37 aa, Artificial Sequence
  Description of Artificial Sequence: Synthetic polypeptide
DEEEIRTTNPVATEQYGVVSTVTNQQQGNNQETEEEE

SEQ ID NO: 139920 - protein, 35 aa, Artificial Sequence
  Description of Artificial Sequence: Synthetic polypeptide
DEEEIATTNPVATEQYGSVCAATANDQDLPDENGN

SEQ ID NO: 139921 - protein, 36 aa, Artificial Sequence
  Description of Artificial Sequence: Synthetic polypeptide
DEEEIRTTNPVATEQYGSVEPTGNLLLDRQMPEFEY

SEQ ID NO: 139922 - protein, 34 aa, Artificial Sequence
  Description of Artificial Sequence: Synthetic polypeptide
QEEEIRTTNPVATEQYGSVVTTDNTMDNGGGGFG

SEQ ID NO: 139923 - protein, 35 aa, Artificial Sequence
  Description of Artificial Sequence: Synthetic polypeptide
DEEEIATTNPVAYEHYGSVCSHDNSLFTVRYGNEF

SEQ ID NO: 139924 - protein, 35 aa, Artificial Sequence
  Description of Artificial Sequence: Synthetic polypeptide
QEEEIRTTNPVATEQYGSVVTGGDLEQNEEGGEII

SEQ ID NO: 139925 - protein, 35 aa, Artificial Sequence
  Description of Artificial Sequence: Synthetic polypeptide
DEEEIRTTNPVATEQYGSVEPTDMTLDQINIEHDQ

SEQ ID NO: 139926 - protein, 34 aa, Artificial Sequence
  Description of Artificial Sequence: Synthetic polypeptide
DEHEIRTTNPVAYDQYGSTVNCTGQLQQRTGGSD

SEQ ID NO: 139927 - protein, 37 aa, Artificial Sequence
  Description of Artificial Sequence: Synthetic polypeptide
DEEEIRTTNPVATEQYGVVSTVTNQQQGNNNEEEEDE

SEQ ID NO: 139928 - protein, 33 aa, Artificial Sequence
  Description of Artificial Sequence: Synthetic polypeptide
DEEEIATTNPVATEQYGSVCAATANEEMMMPDG

SEQ ID NO: 139929 - protein, 37 aa, Artificial Sequence
  Description of Artificial Sequence: Synthetic polypeptide
AEEEIRTTNPVATEQYGSVSTVVVNQQNGDEAGNEDE

SEQ ID NO: 139930 - protein, 28 aa, Artificial Sequence
  Description of Artificial Sequence: Synthetic peptide
QEGEIATTNPCSSECYGIVSCCLQSGTL

SEQ ID NO: 139931 - protein, 37 aa, Artificial Sequence
  Description of Artificial Sequence: Synthetic polypeptide
DEEEIRTTNPVATEQYGVVSTVTNQQNNQQGNNNTTD

SEQ ID NO: 139932 - protein, 34 aa, Artificial Sequence
  Description of Artificial Sequence: Synthetic polypeptide
QEEEIRTTNPVATEQYGVVVSITNGMGGDEQGGT

SEQ ID NO: 139933 - protein, 33 aa, Artificial Sequence
  Description of Artificial Sequence: Synthetic polypeptide
DEEEIATTNPVAYECYGMSVSSNNEMNQFQNHS

SEQ ID NO: 139934 - protein, 34 aa, Artificial Sequence
  Description of Artificial Sequence: Synthetic polypeptide
QEEEIRTTNPVATEQYGVVSTMQDGFEGGGENIN

SEQ ID NO: 139935 - protein, 32 aa, Artificial Sequence
  Description of Artificial Sequence: Synthetic polypeptide
DEHEIRTTNPVAYDQWGCTVNCTQETQRVGND

SEQ ID NO: 139936 - protein, 34 aa, Artificial Sequence
  Description of Artificial Sequence: Synthetic polypeptide
DEEEIRTTNPVATEQYGSVEPMNMVVTNNVENPS

SEQ ID NO: 139937 - protein, 33 aa, Artificial Sequence
  Description of Artificial Sequence: Synthetic polypeptide
QEEEIRTTNPVATEQYGVVMGTNDNGGGQDEIE

SEQ ID NO: 139938 - protein, 33 aa, Artificial Sequence
  Description of Artificial Sequence: Synthetic polypeptide
QEEEIRTTNPVATEQYGVMSSTTPAGPNRGMDV

SEQ ID NO: 139939 - protein, 34 aa, Artificial Sequence
  Description of Artificial Sequence: Synthetic polypeptide
DEEEIATTNPVATEQYGSVCAATANEEMMNMPES

SEQ ID NO: 139940 - protein, 33 aa, Artificial Sequence
  Description of Artificial Sequence: Synthetic polypeptide
DEHEIRTTNPVAYDQWGSTVNTGELSQEVGNDG

SEQ ID NO: 139941 - protein, 33 aa, Artificial Sequence
  Description of Artificial Sequence: Synthetic polypeptide
DEHEIRTTNPVAYDQWGNTVNTQELSQRVGNTD

SEQ ID NO: 139942 - protein, 33 aa, Artificial Sequence
  Description of Artificial Sequence: Synthetic polypeptide
DEHEIRTTNPVAYDQWGCTVNTQELSQRVGNDS

SEQ ID NO: 139943 - protein, 33 aa, Artificial Sequence
  Description of Artificial Sequence: Synthetic polypeptide
DEHEIRTTNPVAYDQWGSVCTWEDMQRHGDNDH

SEQ ID NO: 139944 - protein, 28 aa, Artificial Sequence
  Description of Artificial Sequence: Synthetic peptide
QEEEIATTNPVAYEQYGEAYEVCQHEDK

SEQ ID NO: 139945 - protein, 34 aa, Artificial Sequence
  Description of Artificial Sequence: Synthetic polypeptide
QEEEIRTTNPCSTEQYGSVSSTPAGPQMRNGTPV

SEQ ID NO: 139946 - protein, 34 aa, Artificial Sequence
  Description of Artificial Sequence: Synthetic polypeptide
DEAEIATTNPVATEQYGSVCSDNDNNSEAGQNEH

SEQ ID NO: 139947 - protein, 30 aa, Artificial Sequence
  Description of Artificial Sequence: Synthetic polypeptide
DEEEIATTNPVATEQYGEAPEEVCQEHEEK

SEQ ID NO: 139948 - protein, 36 aa, Artificial Sequence
  Description of Artificial Sequence: Synthetic polypeptide
DEEEIRTTNPVATEQYGSVHPEPNAQAARDGVVPEI

SEQ ID NO: 139949 - protein, 30 aa, Artificial Sequence
  Description of Artificial Sequence: Synthetic polypeptide
DEEEIATTNPVATEQYGEAPEDLEDHEEEK

SEQ ID NO: 139950 - protein, 36 aa, Artificial Sequence
  Description of Artificial Sequence: Synthetic polypeptide
DEEEIRTTNPVATEQYGVVSGTMNDGDQEEGGGEQT

SEQ ID NO: 139951 - protein, 33 aa, Artificial Sequence
  Description of Artificial Sequence: Synthetic polypeptide
DAAEIATTNPVATEQWGSVSGEGPPDNQGGNPR

SEQ ID NO: 139952 - protein, 29 aa, Artificial Sequence
  Description of Artificial Sequence: Synthetic peptide
QENEIATTNPVAYEPYGKTVSEHLQHEEL

SEQ ID NO: 139953 - protein, 30 aa, Artificial Sequence
  Description of Artificial Sequence: Synthetic polypeptide
QENEIRTTNPVSSEQYGTISCDIQQQQGNH

SEQ ID NO: 139954 - protein, 38 aa, Artificial Sequence
  Description of Artificial Sequence: Synthetic polypeptide
DEEEIRTTNPVATEQYGVVSTVVTNLEQGNNNVEEGND

SEQ ID NO: 139955 - protein, 29 aa, Artificial Sequence
  Description of Artificial Sequence: Synthetic peptide
DEEEIATTNPVATEQYGEAPEDCEHEEEK

SEQ ID NO: 139956 - protein, 36 aa, Artificial Sequence
  Description of Artificial Sequence: Synthetic polypeptide
DEEEIRTTNPVATEQYGSVHPEGNDLQAMVQGMPIV

SEQ ID NO: 139957 - protein, 36 aa, Artificial Sequence
  Description of Artificial Sequence: Synthetic polypeptide
AEEEIRTTNPVATEQYGSVVTTNNQLGGTEQGVNQN

SEQ ID NO: 139958 - protein, 33 aa, Artificial Sequence
  Description of Artificial Sequence: Synthetic polypeptide
DEHEIATTNPVATETYGCVSTGGAGLTNGGNAN

SEQ ID NO: 139959 - protein, 34 aa, Artificial Sequence
  Description of Artificial Sequence: Synthetic polypeptide
DEAEIATTNPVATEQYGSVSMTDLNEDHEGSEDQ

SEQ ID NO: 139960 - protein, 38 aa, Artificial Sequence
  Description of Artificial Sequence: Synthetic polypeptide
DEEEIRTTNPVATEQYGVVSTVVTNLENQIGTNQEEDE

SEQ ID NO: 139961 - protein, 34 aa, Artificial Sequence
  Description of Artificial Sequence: Synthetic polypeptide
QEEEIATTNPVATEQYGSVATNLVATAADINGAE

SEQ ID NO: 139962 - protein, 31 aa, Artificial Sequence
  Description of Artificial Sequence: Synthetic polypeptide
QEEEIATTNPVATEQYGEVAAEVCQSRVEEK

SEQ ID NO: 139963 - protein, 34 aa, Artificial Sequence
  Description of Artificial Sequence: Synthetic polypeptide
QEEEIATTNPVATEQYGSVCSTGPGQQDSINPEQ

SEQ ID NO: 139964 - protein, 34 aa, Artificial Sequence
  Description of Artificial Sequence: Synthetic polypeptide
DEEEIRTTNPVATEQYGSVIETTILGTPIVDPLI

SEQ ID NO: 139965 - protein, 36 aa, Artificial Sequence
  Description of Artificial Sequence: Synthetic polypeptide
DEEEIKTTNPVATEQYGSVSETTPSGPNMRNGMNPV

SEQ ID NO: 139966 - protein, 35 aa, Artificial Sequence
  Description of Artificial Sequence: Synthetic polypeptide
DEMEIRTTNPVATEQYGSVCTTYVDLQERDDDQMH

SEQ ID NO: 139967 - protein, 35 aa, Artificial Sequence
  Description of Artificial Sequence: Synthetic polypeptide
DEMEIRTTNPVATEQYGSVCTWTYVDIQERDNDQM

SEQ ID NO: 139968 - protein, 37 aa, Artificial Sequence
  Description of Artificial Sequence: Synthetic polypeptide
DEEEIRTTNPVATEQYGSVIQSPFNLVIQPEQQLLNL

SEQ ID NO: 139969 - protein, 33 aa, Artificial Sequence
  Description of Artificial Sequence: Synthetic polypeptide
DEMEIRTTNPVATEQYGSVCWPEDLEERQDDEQ

SEQ ID NO: 139970 - protein, 34 aa, Artificial Sequence
  Description of Artificial Sequence: Synthetic polypeptide
DEAEIATTNPVATEVWGSVCFTNENHDQGGGNTR

SEQ ID NO: 139971 - protein, 28 aa, Artificial Sequence
  Description of Artificial Sequence: Synthetic peptide
QENEIATTNPVATEQYGKAPEVCQHEEK

SEQ ID NO: 139972 - protein, 30 aa, Artificial Sequence
  Description of Artificial Sequence: Synthetic polypeptide
QENEIRTTNPVSSEPYGTISCDIQQQNGNR

SEQ ID NO: 139973 - protein, 37 aa, Artificial Sequence
  Description of Artificial Sequence: Synthetic polypeptide
DEEEIRTTNPVATEQYGSRVSSTTPAGPNERNGMNPV

SEQ ID NO: 139974 - protein, 36 aa, Artificial Sequence
  Description of Artificial Sequence: Synthetic polypeptide
DEEEIKTTNPVATEQYGSVSMTTPAGPNMRNGMNPV

SEQ ID NO: 139975 - protein, 29 aa, Artificial Sequence
  Description of Artificial Sequence: Synthetic peptide
QEEEIATTNPVATEQYGMIAPEVDQFEEQ

SEQ ID NO: 139976 - protein, 29 aa, Artificial Sequence
  Description of Artificial Sequence: Synthetic peptide
QENEIATTNPVATEPYGTISEDLQQQEEL

SEQ ID NO: 139977 - protein, 33 aa, Artificial Sequence
  Description of Artificial Sequence: Synthetic polypeptide
DEMEIRTTNPVATEQYGSVCWPMFLENRSEDQE

SEQ ID NO: 139978 - protein, 35 aa, Artificial Sequence
  Description of Artificial Sequence: Synthetic polypeptide
DEEEIRTTNPVATEQYGSVHPGNYMNQLGMEVTEI

SEQ ID NO: 139979 - protein, 28 aa, Artificial Sequence
  Description of Artificial Sequence: Synthetic peptide
QEEEIATTNPVATEVYGEAPQVCQHEEK

SEQ ID NO: 139980 - protein, 29 aa, Artificial Sequence
  Description of Artificial Sequence: Synthetic peptide
QENEIATTNPVAYEPYGCVSEDLSQHEEL

SEQ ID NO: 139981 - protein, 35 aa, Artificial Sequence
  Description of Artificial Sequence: Synthetic polypeptide
DEHEIATTNPVATESYGSVCQTNDQHDQRGQDNAQ

SEQ ID NO: 139982 - protein, 28 aa, Artificial Sequence
  Description of Artificial Sequence: Synthetic peptide
QEEEIATTNPVATEWYGEAPEQCQHEEK

SEQ ID NO: 139983 - protein, 38 aa, Artificial Sequence
  Description of Artificial Sequence: Synthetic polypeptide
DEEEIRTTNPVATEQYGVVSTVVTNLQGNQQGNGNEEN

SEQ ID NO: 139984 - protein, 35 aa, Artificial Sequence
  Description of Artificial Sequence: Synthetic polypeptide
DEEEIRTTNPVATEQYGVVSMTTGMGEFIGGENDD

SEQ ID NO: 139985 - protein, 29 aa, Artificial Sequence
  Description of Artificial Sequence: Synthetic peptide
QENEIATTNPVATEPYGTISECIQQHENL

SEQ ID NO: 139986 - protein, 30 aa, Artificial Sequence
  Description of Artificial Sequence: Synthetic polypeptide
QENEIRTTNPVSTEPYGTISMCLQQHNGEL

SEQ ID NO: 139987 - protein, 38 aa, Artificial Sequence
  Description of Artificial Sequence: Synthetic polypeptide
DEEEIRTTNPVATEQYGVVSTVVTNLAGNQQGNNEQGQ

SEQ ID NO: 139988 - protein, 34 aa, Artificial Sequence
  Description of Artificial Sequence: Synthetic polypeptide
DEMEIRTTNPVATEQYGSASDVWLNNQDGQESMI

SEQ ID NO: 139989 - protein, 36 aa, Artificial Sequence
  Description of Artificial Sequence: Synthetic polypeptide
DEEEIRTTNPVATEQYGVVSNMTSNMDQTGEGGQGT

SEQ ID NO: 139990 - protein, 35 aa, Artificial Sequence
  Description of Artificial Sequence: Synthetic polypeptide
DDEEIATTNPVSTEQYGNVSSTNPAGQSRNGMNPV

SEQ ID NO: 139991 - protein, 38 aa, Artificial Sequence
  Description of Artificial Sequence: Synthetic polypeptide
DEEEIRTTNPVATEQYGVVSTVVTNNNLQQGTNAEDED

SEQ ID NO: 139992 - protein, 34 aa, Artificial Sequence
  Description of Artificial Sequence: Synthetic polypeptide
DEMEIRTTNPVATEQYGSVGVTWDNTEEPQNQIQ

SEQ ID NO: 139993 - protein, 37 aa, Artificial Sequence
  Description of Artificial Sequence: Synthetic polypeptide
DEEEIRTTNPVATEQYGSVIRVMNSLEQELPGFLSRS

SEQ ID NO: 139994 - protein, 34 aa, Artificial Sequence
  Description of Artificial Sequence: Synthetic polypeptide
DEAEIATTNPVATEQYGSVCAMTGLAPGEQMEGR

SEQ ID NO: 139995 - protein, 35 aa, Artificial Sequence
  Description of Artificial Sequence: Synthetic polypeptide
DEAEIATTNPVATEQYGSVSGGNNDDRQTNGNDMG

SEQ ID NO: 139996 - protein, 29 aa, Artificial Sequence
  Description of Artificial Sequence: Synthetic peptide
QEEEIATTNPVATEQYGETPEVCQFHEEK

SEQ ID NO: 139997 - protein, 31 aa, Artificial Sequence
  Description of Artificial Sequence: Synthetic polypeptide
QENEIATTNPVATEPYGNVSGEPLQHMNELN

SEQ ID NO: 139998 - protein, 34 aa, Artificial Sequence
  Description of Artificial Sequence: Synthetic polypeptide
DEAEIATTNPVATEQYGSVATSNQLDTNPNPPLH

SEQ ID NO: 139999 - protein, 38 aa, Artificial Sequence
  Description of Artificial Sequence: Synthetic polypeptide
DEEEIRTTNPVATEQYGVVSTVVTNLENLQIGTNEQGQ

SEQ ID NO: 140000 - protein, 37 aa, Artificial Sequence
  Description of Artificial Sequence: Synthetic polypeptide
AEEEIRTTNPVATEQYGSVSTVVNNQNNQQEGNNTED

SEQ ID NO: 140001 - protein, 29 aa, Artificial Sequence
  Description of Artificial Sequence: Synthetic peptide
QENEIATTNPVAYECYGKVSESLSQHVEL

SEQ ID NO: 140002 - protein, 36 aa, Artificial Sequence
  Description of Artificial Sequence: Synthetic polypeptide
DEMEIRTTNPVATEQYGSVSPTASDQEGLPEDNIET

SEQ ID NO: 140003 - protein, 29 aa, Artificial Sequence
  Description of Artificial Sequence: Synthetic peptide
QENEIATTNPVAYECYGVVSECLQHNEDS

SEQ ID NO: 140004 - protein, 36 aa, Artificial Sequence
  Description of Artificial Sequence: Synthetic polypeptide
DEMEIRTTNPVATEQYGSVFYTTTNNQDSIAGNQIN

SEQ ID NO: 140005 - protein, 33 aa, Artificial Sequence
  Description of Artificial Sequence: Synthetic polypeptide
DEAEIATTNPVATEQYGSVSMTDDEDHFGSEDL

SEQ ID NO: 140006 - protein, 29 aa, Artificial Sequence
  Description of Artificial Sequence: Synthetic peptide
QEEEIATTNPVATEQYGETPEVCQPEEYK

SEQ ID NO: 140007 - protein, 31 aa, Artificial Sequence
  Description of Artificial Sequence: Synthetic polypeptide
QENEIRTTNPVSTEPYGIISMDIQQQSNGNR

SEQ ID NO: 140008 - protein, 33 aa, Artificial Sequence
  Description of Artificial Sequence: Synthetic polypeptide
DEMEIRTTNPVATEQYGSVGQSALEAAENVNFP

SEQ ID NO: 140009 - protein, 31 aa, Artificial Sequence
  Description of Artificial Sequence: Synthetic polypeptide
QENEIRTTNPVSTEPYGIISMDLQQQSNGTR

SEQ ID NO: 140010 - protein, 29 aa, Artificial Sequence
  Description of Artificial Sequence: Synthetic peptide
QEEEIATTNPVATEQYGETPEVCQHEEYK

SEQ ID NO: 140011 - protein, 36 aa, Artificial Sequence
  Description of Artificial Sequence: Synthetic polypeptide
DEEEIRTTNPVATEQYGSQVWSTNIDEWNEGIQAEW

SEQ ID NO: 140012 - protein, 28 aa, Artificial Sequence
  Description of Artificial Sequence: Synthetic peptide
QEEEIATTNPVATEWYGEAPEVCQHEEK

SEQ ID NO: 140013 - protein, 35 aa, Artificial Sequence
  Description of Artificial Sequence: Synthetic polypeptide
DEMEIRTTNPVATEQYGSVSPSDNLTQTSSPDDMG

SEQ ID NO: 140014 - protein, 30 aa, Artificial Sequence
  Description of Artificial Sequence: Synthetic polypeptide
QENEIRTTNPVSTEPYGTISMCLQQHNGEH

SEQ ID NO: 140015 - protein, 34 aa, Artificial Sequence
  Description of Artificial Sequence: Synthetic polypeptide
DEMEIRTTNPVATEQYGSVSPPQLEKPNSENSQF

SEQ ID NO: 140016 - protein, 33 aa, Artificial Sequence
  Description of Artificial Sequence: Synthetic polypeptide
DEAEIATTNPVATEQYGSVSMAPDGDGHQVDNP

SEQ ID NO: 140017 - protein, 34 aa, Artificial Sequence
  Description of Artificial Sequence: Synthetic polypeptide
DEHEIATTNPVATEVWGSVCYTNDHQDQRGQNDS

SEQ ID NO: 140018 - protein, 29 aa, Artificial Sequence
  Description of Artificial Sequence: Synthetic peptide
QEEEIATTNPVATEQYGMTAPGVDQHEDT

SEQ ID NO: 140019 - protein, 36 aa, Artificial Sequence
  Description of Artificial Sequence: Synthetic polypeptide
DEEEIRTTNPVATEQYGSVIQPTVLDQNMIEPNNIL

SEQ ID NO: 140020 - protein, 33 aa, Artificial Sequence
  Description of Artificial Sequence: Synthetic polypeptide
DAAEIATTNPVATEQWGSVSTDPLQDHQDGMHW

SEQ ID NO: 140021 - protein, 36 aa, Artificial Sequence
  Description of Artificial Sequence: Synthetic polypeptide
DEAEIATTNPVATEQYGSVSWTDNHQQQDRQGGDDD

SEQ ID NO: 140022 - protein, 35 aa, Artificial Sequence
  Description of Artificial Sequence: Synthetic polypeptide
DEEEIRTTNPVATEQYGSVIEPTLSHMSNDNVVND

SEQ ID NO: 140023 - protein, 30 aa, Artificial Sequence
  Description of Artificial Sequence: Synthetic polypeptide
QENEIRTTNPVATEQYGDVAEILMNAAEDA

SEQ ID NO: 140024 - protein, 35 aa, Artificial Sequence
  Description of Artificial Sequence: Synthetic polypeptide
DEMEIRTTNPVATEQYGSCSEQVEQYDRIGSNNQE

SEQ ID NO: 140025 - protein, 35 aa, Artificial Sequence
  Description of Artificial Sequence: Synthetic polypeptide
QENEIRTTNPVATEQYGDVSSTPAGPQMRNGMNPL

SEQ ID NO: 140026 - protein, 33 aa, Artificial Sequence
  Description of Artificial Sequence: Synthetic polypeptide
DEHEIATTNPVATEQYGTVCSATDGPVEFGDND

SEQ ID NO: 140027 - protein, 28 aa, Artificial Sequence
  Description of Artificial Sequence: Synthetic peptide
QENEIATTNPVGTECYGVMAETLQHGDI

SEQ ID NO: 140028 - protein, 28 aa, Artificial Sequence
  Description of Artificial Sequence: Synthetic peptide
QENEIATTNPVATEQWGDASEVEQHEEA

SEQ ID NO: 140029 - protein, 30 aa, Artificial Sequence
  Description of Artificial Sequence: Synthetic polypeptide
QEEEIATTNPVATEQYGEVAPEVMQHEMEK

SEQ ID NO: 140030 - protein, 31 aa, Artificial Sequence
  Description of Artificial Sequence: Synthetic polypeptide
QEEEIATTNPVATEQYGEVAPEVDSQHEGEK

SEQ ID NO: 140031 - protein, 35 aa, Artificial Sequence
  Description of Artificial Sequence: Synthetic polypeptide
DDEEIRATNPVATEQYGSVSTGQGDQDQGGEGNDD

SEQ ID NO: 140032 - protein, 35 aa, Artificial Sequence
  Description of Artificial Sequence: Synthetic polypeptide
DEEEIRTTNPVATEQYGSVIEPTNNLNMPVEIEDP

SEQ ID NO: 140033 - protein, 28 aa, Artificial Sequence
  Description of Artificial Sequence: Synthetic peptide
QEEEIATTNPVATESYGEAPEVCQHEEK

SEQ ID NO: 140034 - protein, 36 aa, Artificial Sequence
  Description of Artificial Sequence: Synthetic polypeptide
DEEEIRTTNPVATEQYGSVIQPNLVIHLEQQALSNL

SEQ ID NO: 140035 - protein, 34 aa, Artificial Sequence
  Description of Artificial Sequence: Synthetic polypeptide
QENEIRTTNPVATEQYGDVSSTPCGPQRNGMEPL

SEQ ID NO: 140036 - protein, 32 aa, Artificial Sequence
  Description of Artificial Sequence: Synthetic polypeptide
DAAEIATTNPVATEQYGCVAANNLTNAHNDRL

SEQ ID NO: 140037 - protein, 34 aa, Artificial Sequence
  Description of Artificial Sequence: Synthetic polypeptide
DDEEIRATNPVATEQYGSVSTQGDQDQGGGGEEQ

SEQ ID NO: 140038 - protein, 35 aa, Artificial Sequence
  Description of Artificial Sequence: Synthetic polypeptide
DEAEIATTNPVATEQYGSVCAMMNDGLTGSGNPRE

SEQ ID NO: 140039 - protein, 29 aa, Artificial Sequence
  Description of Artificial Sequence: Synthetic peptide
QENEIRTTNPVATEQWGEVSEICMAAEEA

SEQ ID NO: 140040 - protein, 29 aa, Artificial Sequence
  Description of Artificial Sequence: Synthetic peptide
QEEEIATTNPVATEQYGKAPEGVCQHEEK

SEQ ID NO: 140041 - protein, 35 aa, Artificial Sequence
  Description of Artificial Sequence: Synthetic polypeptide
DEEEIRTTNPVATEQYGSVIEPLVQEEQIGEVPST

SEQ ID NO: 140042 - protein, 29 aa, Artificial Sequence
  Description of Artificial Sequence: Synthetic peptide
QENEIRTTNPVATEQWGEVSEIEMAAEEA

SEQ ID NO: 140043 - protein, 35 aa, Artificial Sequence
  Description of Artificial Sequence: Synthetic polypeptide
DEEEIRTTNPVATEQYGSVIEPTLIMNRNNNVVND

SEQ ID NO: 140044 - protein, 28 aa, Artificial Sequence
  Description of Artificial Sequence: Synthetic peptide
QEEEIATTNPVATERYGEAPEVVQHEEK

SEQ ID NO: 140045 - protein, 35 aa, Artificial Sequence
  Description of Artificial Sequence: Synthetic polypeptide
DAAEIATTNPVATEQYGSVCSTNDQQEHQDGTARK

SEQ ID NO: 140046 - protein, 30 aa, Artificial Sequence
  Description of Artificial Sequence: Synthetic polypeptide
QENEIATTNPVATEQWGDVSECLQNAAEDL

SEQ ID NO: 140047 - protein, 34 aa, Artificial Sequence
  Description of Artificial Sequence: Synthetic polypeptide
DEMEIRTTNPVATEQYGSCSSTYGLEDSMGQPQV

SEQ ID NO: 140048 - protein, 34 aa, Artificial Sequence
  Description of Artificial Sequence: Synthetic polypeptide
DEMEIRTTNPVATEQYGSVCSTPPQWEVHSPETI

SEQ ID NO: 140049 - protein, 31 aa, Artificial Sequence
  Description of Artificial Sequence: Synthetic polypeptide
QEEEIATTNPVATEQYGEVCPATVCVQHEEK

SEQ ID NO: 140050 - protein, 35 aa, Artificial Sequence
  Description of Artificial Sequence: Synthetic polypeptide
DEEEIRTTNPVATEQYGSVHPVPSLMARDGVVQEI

SEQ ID NO: 140051 - protein, 38 aa, Artificial Sequence
  Description of Artificial Sequence: Synthetic polypeptide
DEEEIRTTNPVATEQYGVVSTNLQAGTEQGTNNEEQEE

SEQ ID NO: 140052 - protein, 34 aa, Artificial Sequence
  Description of Artificial Sequence: Synthetic polypeptide
DEAEIATTNPVATEQYGSVCAGNGLLTMMDNQRN

SEQ ID NO: 140053 - protein, 38 aa, Artificial Sequence
  Description of Artificial Sequence: Synthetic polypeptide
DEEEIRTTNPVATEQYGVVSTNLLQAGNTEEGVTTEDQ

SEQ ID NO: 140054 - protein, 34 aa, Artificial Sequence
  Description of Artificial Sequence: Synthetic polypeptide
DEEEIRTTNPVATEQYGVVCSWEHQENFISENQS

SEQ ID NO: 140055 - protein, 34 aa, Artificial Sequence
  Description of Artificial Sequence: Synthetic polypeptide
DEMEIRTTNPVATEQYGSVCTTVNSEESGGDGED

SEQ ID NO: 140056 - protein, 34 aa, Artificial Sequence
  Description of Artificial Sequence: Synthetic polypeptide
DEEEIRTTNPVATEQYGSVIEPTTDINNIINHEI

SEQ ID NO: 140057 - protein, 37 aa, Artificial Sequence
  Description of Artificial Sequence: Synthetic polypeptide
AEEEIRTTNPVATEQYGSVVTTNNNLEQGTEGGNTTQ

SEQ ID NO: 140058 - protein, 34 aa, Artificial Sequence
  Description of Artificial Sequence: Synthetic polypeptide
DEEEIATTNPVATEQYGSACAANPLAEAAIGDHR

SEQ ID NO: 140059 - protein, 31 aa, Artificial Sequence
  Description of Artificial Sequence: Synthetic polypeptide
QENEIATTNPVATEPYGTVSEECLQQQNENL

SEQ ID NO: 140060 - protein, 35 aa, Artificial Sequence
  Description of Artificial Sequence: Synthetic polypeptide
DDEEIRATNPVATEQYGSVSSTQGPGQGQGGNNEG

SEQ ID NO: 140061 - protein, 38 aa, Artificial Sequence
  Description of Artificial Sequence: Synthetic polypeptide
DEEEIRTTNPVATEQYGVVSTVVTNLQGNQQIGNNEGG

SEQ ID NO: 140062 - protein, 38 aa, Artificial Sequence
  Description of Artificial Sequence: Synthetic polypeptide
DEEEIRTTNPVATEQYGVVSTVVTNLQQNTEQGTNTEE

SEQ ID NO: 140063 - protein, 30 aa, Artificial Sequence
  Description of Artificial Sequence: Synthetic polypeptide
QENEIATTNPVAYEPYGTVSEGLSQNEGEL

SEQ ID NO: 140064 - protein, 33 aa, Artificial Sequence
  Description of Artificial Sequence: Synthetic polypeptide
DEGHIRATNPVATDQYGFVSMTVLNQTGNENEG

SEQ ID NO: 140065 - protein, 30 aa, Artificial Sequence
  Description of Artificial Sequence: Synthetic polypeptide
DEHCIATTNPVAYEQYSEEVTTGDNHNGNR

SEQ ID NO: 140066 - protein, 30 aa, Artificial Sequence
  Description of Artificial Sequence: Synthetic polypeptide
QENEIATTNPVAYEPYGNVSGHLQHWDENL

SEQ ID NO: 140067 - protein, 29 aa, Artificial Sequence
  Description of Artificial Sequence: Synthetic peptide
QENEIRTTNPVGTEQWGDVSSILMNAEDA

SEQ ID NO: 140068 - protein, 29 aa, Artificial Sequence
  Description of Artificial Sequence: Synthetic peptide
QEEEIATTNPVATEQYGMAPREVCQHEEK

SEQ ID NO: 140069 - protein, 29 aa, Artificial Sequence
  Description of Artificial Sequence: Synthetic peptide
DEGEVASTNPCSTEGYGIVANNIQSRGQR

SEQ ID NO: 140070 - protein, 30 aa, Artificial Sequence
  Description of Artificial Sequence: Synthetic polypeptide
QEEEIATTNPVATEQYGEVAGPEVGQVEEM

SEQ ID NO: 140071 - protein, 33 aa, Artificial Sequence
  Description of Artificial Sequence: Synthetic polypeptide
DAAEIATTNPVATEQWGSVSTDPLTAHQDGMHN

SEQ ID NO: 140072 - protein, 35 aa, Artificial Sequence
  Description of Artificial Sequence: Synthetic polypeptide
AEEEIRTTNPVATEQYGSVSTVVNNTNQADEQISE

SEQ ID NO: 140073 - protein, 36 aa, Artificial Sequence
  Description of Artificial Sequence: Synthetic polypeptide
QENEIRTTNPVATEQYGSVSSTTPAGPQMRNGMNPL

SEQ ID NO: 140074 - protein, 36 aa, Artificial Sequence
  Description of Artificial Sequence: Synthetic polypeptide
DDEEIRATNPVATEQYGSVSSTTQNGDEDQGGGGNE

SEQ ID NO: 140075 - protein, 34 aa, Artificial Sequence
  Description of Artificial Sequence: Synthetic polypeptide
DEAEIATTNPVATESYGSVCQTNDQQDRDGDDDK

SEQ ID NO: 140076 - protein, 33 aa, Artificial Sequence
  Description of Artificial Sequence: Synthetic polypeptide
DEHEIATTNPVATEQYGCVAATPNLDALAEGRA

SEQ ID NO: 140077 - protein, 36 aa, Artificial Sequence
  Description of Artificial Sequence: Synthetic polypeptide
DEEEIRTTNPVATEQYGSVIEPTWLHEMRQNNVVND

SEQ ID NO: 140078 - protein, 28 aa, Artificial Sequence
  Description of Artificial Sequence: Synthetic peptide
QENEIATTNPVGTECYGDVAECLQHEEL

SEQ ID NO: 140079 - protein, 30 aa, Artificial Sequence
  Description of Artificial Sequence: Synthetic polypeptide
QENEIATTNPVATEQYGEISMDCQQQNGEH

SEQ ID NO: 140080 - protein, 37 aa, Artificial Sequence
  Description of Artificial Sequence: Synthetic polypeptide
AEEEIRTTNPVATEQYGSVSTVVNNNNQEDNGTNNVE

SEQ ID NO: 140081 - protein, 34 aa, Artificial Sequence
  Description of Artificial Sequence: Synthetic polypeptide
DEHEIATTNPVATEQYGCVAATNNLEARNQQDRV

SEQ ID NO: 140082 - protein, 34 aa, Artificial Sequence
  Description of Artificial Sequence: Synthetic polypeptide
DEAEIATTNPVATEQYGSVSTTGDLNEDHFGEDL

SEQ ID NO: 140083 - protein, 30 aa, Artificial Sequence
  Description of Artificial Sequence: Synthetic polypeptide
QEEEIATTNPVATEQYGEVAPEECHQHEEK

SEQ ID NO: 140084 - protein, 32 aa, Artificial Sequence
  Description of Artificial Sequence: Synthetic polypeptide
DEAEIATTNPVATESYGSVANNNLNTDHGTEH

SEQ ID NO: 140085 - protein, 37 aa, Artificial Sequence
  Description of Artificial Sequence: Synthetic polypeptide
DEEEIRTTNPVATEQYGSNVSSDTPAGPNHRNGMNMV

SEQ ID NO: 140086 - protein, 38 aa, Artificial Sequence
  Description of Artificial Sequence: Synthetic polypeptide
DEEEIRTTNPVATEQYGVVSTVVTNLQAGNEQGTEEQT

SEQ ID NO: 140087 - protein, 34 aa, Artificial Sequence
  Description of Artificial Sequence: Synthetic polypeptide
DEHEIATTNPVATEQYGCVAATEGLDALAEGNRE

SEQ ID NO: 140088 - protein, 35 aa, Artificial Sequence
  Description of Artificial Sequence: Synthetic polypeptide
DEMEIRTTNPVATEQYGSVCTPPQLETGYMEDMND

SEQ ID NO: 140089 - protein, 29 aa, Artificial Sequence
  Description of Artificial Sequence: Synthetic peptide
QEEEIATTNPVATEQYGKAPEVCQHEEKS

SEQ ID NO: 140090 - protein, 37 aa, Artificial Sequence
  Description of Artificial Sequence: Synthetic polypeptide
DEEEIRTTNPVATEQYGSNVSSTTPAGPNMRNGMNPV

SEQ ID NO: 140091 - protein, 28 aa, Artificial Sequence
  Description of Artificial Sequence: Synthetic peptide
QENEIATTNPVGTECYGDVAETLQHEEL

SEQ ID NO: 140092 - protein, 28 aa, Artificial Sequence
  Description of Artificial Sequence: Synthetic peptide
QEEEIATTNPVATERYGEAPEVCQHEEK

SEQ ID NO: 140093 - protein, 34 aa, Artificial Sequence
  Description of Artificial Sequence: Synthetic polypeptide
DEEEIRTTNPVATEQYGSVIGVSFKENQEVVVVG

SEQ ID NO: 140094 - protein, 38 aa, Artificial Sequence
  Description of Artificial Sequence: Synthetic polypeptide
DEEEIRTTNPVATEQYGVVSTVVTNLQAGNQAGTEGSE

SEQ ID NO: 140095 - protein, 29 aa, Artificial Sequence
  Description of Artificial Sequence: Synthetic peptide
QENEIATTNPVATEPYGDVSMCIQQHEEL

SEQ ID NO: 140096 - protein, 29 aa, Artificial Sequence
  Description of Artificial Sequence: Synthetic peptide
QENEIATTNPVATEQYGTASMVIQHNEEH

SEQ ID NO: 140097 - protein, 31 aa, Artificial Sequence
  Description of Artificial Sequence: Synthetic polypeptide
QENEIATTNPVATEPYGDVSEECLQQQNENL

SEQ ID NO: 140098 - protein, 30 aa, Artificial Sequence
  Description of Artificial Sequence: Synthetic polypeptide
QENEIATTNPVATEPYGDVSECIQQHNENL

SEQ ID NO: 140099 - protein, 28 aa, Artificial Sequence
  Description of Artificial Sequence: Synthetic peptide
QENEIATTNPVATHCYGDVSECSQHEEL

SEQ ID NO: 140100 - protein, 36 aa, Artificial Sequence
  Description of Artificial Sequence: Synthetic polypeptide
DEEEIHTTNPVATEQYGSVSSTTPAGVNMRNGMNPV

SEQ ID NO: 140101 - protein, 30 aa, Artificial Sequence
  Description of Artificial Sequence: Synthetic polypeptide
QENEIATTNPVATEPYGDVSMDIQQHNENL

SEQ ID NO: 140102 - protein, 38 aa, Artificial Sequence
  Description of Artificial Sequence: Synthetic polypeptide
DEEEIRTTNPVATEQYGVVSTSNNLQAGNSEQGVTTTQ

SEQ ID NO: 140103 - protein, 29 aa, Artificial Sequence
  Description of Artificial Sequence: Synthetic peptide
QEEEIATTNPVATEQYGEIPWADQHEEQM

SEQ ID NO: 140104 - protein, 28 aa, Artificial Sequence
  Description of Artificial Sequence: Synthetic peptide
QENEIATTNPVATGCYGDVSECWQDEEL

SEQ ID NO: 140105 - protein, 37 aa, Artificial Sequence
  Description of Artificial Sequence: Synthetic polypeptide
DEEEIRTTNPVATEQYGVVSTVVTNNNQQGTNNEEDE

SEQ ID NO: 140106 - protein, 36 aa, Artificial Sequence
  Description of Artificial Sequence: Synthetic polypeptide
AEEEIRTTNPVATEQYGSVVTTTNLLGGNEQGNNNE

SEQ ID NO: 140107 - protein, 37 aa, Artificial Sequence
  Description of Artificial Sequence: Synthetic polypeptide
DEEEIRTTNPVATEQYGVVSTSNQNLQQQATNNATEI

SEQ ID NO: 140108 - protein, 37 aa, Artificial Sequence
  Description of Artificial Sequence: Synthetic polypeptide
DEEEIRTTNPVATEQYGSLVSSTTPAGPNMRNGMNTV

SEQ ID NO: 140109 - protein, 32 aa, Artificial Sequence
  Description of Artificial Sequence: Synthetic polypeptide
DEMEIRTTNPVATEQYGDVSAEDIPMNAAENA

SEQ ID NO: 140110 - protein, 35 aa, Artificial Sequence
  Description of Artificial Sequence: Synthetic polypeptide
DEMEIRTTNPVATEQYGSVNSEDPSLQQDDENIEN

SEQ ID NO: 140111 - protein, 35 aa, Artificial Sequence
  Description of Artificial Sequence: Synthetic polypeptide
DEEEIRTTNPVATEQYGSVISGNNMDENGEGGDEG

SEQ ID NO: 140112 - protein, 28 aa, Artificial Sequence
  Description of Artificial Sequence: Synthetic peptide
QENEIATTNPVATSCYGDVSECVQHEEL

SEQ ID NO: 140113 - protein, 36 aa, Artificial Sequence
  Description of Artificial Sequence: Synthetic polypeptide
DEEEIRTTNPVATEQYGVVSSTSPAGPNMRNGMNPV

SEQ ID NO: 140114 - protein, 34 aa, Artificial Sequence
  Description of Artificial Sequence: Synthetic polypeptide
DEMEIRTTNPVATEQYGSVSNTEDNEITTDEMDN

SEQ ID NO: 140115 - protein, 29 aa, Artificial Sequence
  Description of Artificial Sequence: Synthetic peptide
QENEITTTNPVATECYGQAVSVVIQHEEL

SEQ ID NO: 140116 - protein, 33 aa, Artificial Sequence
  Description of Artificial Sequence: Synthetic polypeptide
DEEEIGTTNPVATEQYGCVCSTEHQENFFSEQS

SEQ ID NO: 140117 - protein, 33 aa, Artificial Sequence
  Description of Artificial Sequence: Synthetic polypeptide
DEEEIRTTNPVATEQYGSVIGPWVAVEIGMVEE

SEQ ID NO: 140118 - protein, 36 aa, Artificial Sequence
  Description of Artificial Sequence: Synthetic polypeptide
DEEEIKTTNPVATEQYGSVSSWTPAGPNMRNGMNPV

SEQ ID NO: 140119 - protein, 36 aa, Artificial Sequence
  Description of Artificial Sequence: Synthetic polypeptide
DEEEIRTTNPVATEQYGSNVWVTTENEDEQDDGSIE

SEQ ID NO: 140120 - protein, 36 aa, Artificial Sequence
  Description of Artificial Sequence: Synthetic polypeptide
DEEEIRTTNPVATEQYGSVISEINNGLIRQVLEPSL

SEQ ID NO: 140121 - protein, 29 aa, Artificial Sequence
  Description of Artificial Sequence: Synthetic peptide
QENEIATTNPVATEQYGTASMVCQHNEEK

SEQ ID NO: 140122 - protein, 34 aa, Artificial Sequence
  Description of Artificial Sequence: Synthetic polypeptide
DEEEIRTTNPVATEQYGSVHHTTEDHNDENLEEE

SEQ ID NO: 140123 - protein, 38 aa, Artificial Sequence
  Description of Artificial Sequence: Synthetic polypeptide
DEEEIRTTNPVATEQYGVVSSTTNLQQGTEQGTTEENE

SEQ ID NO: 140124 - protein, 30 aa, Artificial Sequence
  Description of Artificial Sequence: Synthetic polypeptide
QENEIATTNPVATEPYGDVSMECIQQHGEL

SEQ ID NO: 140125 - protein, 35 aa, Artificial Sequence
  Description of Artificial Sequence: Synthetic polypeptide
DEAEIATTNPVATEQYGSVCAMTNHGEQNAEGNDN

SEQ ID NO: 140126 - protein, 29 aa, Artificial Sequence
  Description of Artificial Sequence: Synthetic peptide
QEEEIATTNPVATEQYGEMAAEVCQHEEK

SEQ ID NO: 140127 - protein, 28 aa, Artificial Sequence
  Description of Artificial Sequence: Synthetic peptide
QEEEIATTNPVATEQYGELPEVCWHEEK

SEQ ID NO: 140128 - protein, 29 aa, Artificial Sequence
  Description of Artificial Sequence: Synthetic peptide
QENEIATTNPVATEPYGDVSECIQQHEEL

SEQ ID NO: 140129 - protein, 36 aa, Artificial Sequence
  Description of Artificial Sequence: Synthetic polypeptide
DEEEIKTTNPVATEQYGSVSSTTPDGPNMRNGMNPV

SEQ ID NO: 140130 - protein, 34 aa, Artificial Sequence
  Description of Artificial Sequence: Synthetic polypeptide
DEEEIGTTNPVATEQYGCVCSTEEPDQNFGSEQS

SEQ ID NO: 140131 - protein, 30 aa, Artificial Sequence
  Description of Artificial Sequence: Synthetic polypeptide
QENEIATTNPVATEQYGTIPEEVIQQHGNH

SEQ ID NO: 140132 - protein, 36 aa, Artificial Sequence
  Description of Artificial Sequence: Synthetic polypeptide
DEEEIRTTNPVATEQYGSVIGPTNLLLQMPLEIEDL

SEQ ID NO: 140133 - protein, 36 aa, Artificial Sequence
  Description of Artificial Sequence: Synthetic polypeptide
DEEEIRTTNPVATEQYGSVISGTPAGPNMRNIMNPV

SEQ ID NO: 140134 - protein, 37 aa, Artificial Sequence
  Description of Artificial Sequence: Synthetic polypeptide
AEEEIRTTNPVATEQYGSVVTTTNNLEQGTEGGNTTE

SEQ ID NO: 140135 - protein, 35 aa, Artificial Sequence
  Description of Artificial Sequence: Synthetic polypeptide
DEMEIRTTNPVATEQYGSVNSTSDDQQYEGEHEDG

SEQ ID NO: 140136 - protein, 32 aa, Artificial Sequence
  Description of Artificial Sequence: Synthetic polypeptide
DEAEIATTNPVAYECWGCVTSGDNDQRGGNQH

SEQ ID NO: 140137 - protein, 30 aa, Artificial Sequence
  Description of Artificial Sequence: Synthetic polypeptide
QEEEIATTNPVATEQYGNAPEVCQSHVGQK

SEQ ID NO: 140138 - protein, 31 aa, Artificial Sequence
  Description of Artificial Sequence: Synthetic polypeptide
DAAEIACTNPVATEQWGGCSATNGQSDGNNQ

SEQ ID NO: 140139 - protein, 29 aa, Artificial Sequence
  Description of Artificial Sequence: Synthetic peptide
QEEEIATTNPVATEQYGEIPEVCQFHEEK

SEQ ID NO: 140140 - protein, 28 aa, Artificial Sequence
  Description of Artificial Sequence: Synthetic peptide
QENEVASTNPVATECYGNVSETLQHEEL

SEQ ID NO: 140141 - protein, 35 aa, Artificial Sequence
  Description of Artificial Sequence: Synthetic polypeptide
DEEEIRTTNPVATEQYGSVIGPWQALVQIGMVEEQ

SEQ ID NO: 140142 - protein, 38 aa, Artificial Sequence
  Description of Artificial Sequence: Synthetic polypeptide
DEEEIRTTNPVATEQYGVVSTSVNTNLQQGNNNQEEDD

SEQ ID NO: 140143 - protein, 38 aa, Artificial Sequence
  Description of Artificial Sequence: Synthetic polypeptide
DEEEIRTTNPVATEQYGVVSTSVTTNLQQGNNQQGEDE

SEQ ID NO: 140144 - protein, 28 aa, Artificial Sequence
  Description of Artificial Sequence: Synthetic peptide
QENEVASTNPVSTECYGNVSETLQREQL

SEQ ID NO: 140145 - protein, 30 aa, Artificial Sequence
  Description of Artificial Sequence: Synthetic polypeptide
QEEEIATTNPVATEQYGEIPEEVCQQHGEH

SEQ ID NO: 140146 - protein, 30 aa, Artificial Sequence
  Description of Artificial Sequence: Synthetic polypeptide
QENEIATTNPVATEYYGCVSWYLQHESELS

SEQ ID NO: 140147 - protein, 36 aa, Artificial Sequence
  Description of Artificial Sequence: Synthetic polypeptide
DEEEIRTTNPVATEQYGVVSSTTPAGPNMRNGMNPV

SEQ ID NO: 140148 - protein, 34 aa, Artificial Sequence
  Description of Artificial Sequence: Synthetic polypeptide
DEEEIRTTNPVATEQYGSTPMNGWEQVEEVTERQ

SEQ ID NO: 140149 - protein, 32 aa, Artificial Sequence
  Description of Artificial Sequence: Synthetic polypeptide
DAAEIACTNPVATEQWGGCSATNGVQRDGNNN

SEQ ID NO: 140150 - protein, 32 aa, Artificial Sequence
  Description of Artificial Sequence: Synthetic polypeptide
DEHEIATTNPVAYECWGSVATNMNRGEGQNQS

SEQ ID NO: 140151 - protein, 29 aa, Artificial Sequence
  Description of Artificial Sequence: Synthetic peptide
QENEIATTNPVATEQYGTISMVIQHNEEH

SEQ ID NO: 140152 - protein, 38 aa, Artificial Sequence
  Description of Artificial Sequence: Synthetic polypeptide
DEEEIRTTNPVATEQYGVVSTSVNTNLQAGNNDETEDE

SEQ ID NO: 140153 - protein, 33 aa, Artificial Sequence
  Description of Artificial Sequence: Synthetic polypeptide
DEHEIATTNPVAYECWGSVATTNQGQDAGDNER

SEQ ID NO: 140154 - protein, 29 aa, Artificial Sequence
  Description of Artificial Sequence: Synthetic peptide
QEEEIATTNPVATEQYGEIPEVECQHEED

SEQ ID NO: 140155 - protein, 33 aa, Artificial Sequence
  Description of Artificial Sequence: Synthetic polypeptide
DAAEIACTNPVATEQWGSVSATNPLTHQDGMHW

SEQ ID NO: 140156 - protein, 28 aa, Artificial Sequence
  Description of Artificial Sequence: Synthetic peptide
QENEIATTNPVATGCYGDVSECTQHEEL

SEQ ID NO: 140157 - protein, 36 aa, Artificial Sequence
  Description of Artificial Sequence: Synthetic polypeptide
DEEEIRTTNPVATEQYGVVSSTTPAGPNFRNGMNPV

SEQ ID NO: 140158 - protein, 36 aa, Artificial Sequence
  Description of Artificial Sequence: Synthetic polypeptide
DEEEIRTTNPVATEQYGVVSSTTPAGPNMRMGMNPV

SEQ ID NO: 140159 - protein, 28 aa, Artificial Sequence
  Description of Artificial Sequence: Synthetic peptide
QENEIATTNPVATGCYGDVCECLQHEEL

SEQ ID NO: 140160 - protein, 37 aa, Artificial Sequence
  Description of Artificial Sequence: Synthetic polypeptide
DEEEIRTTNPVATEQYGSLVSSTTPAGPNMRNGMNPV

SEQ ID NO: 140161 - protein, 33 aa, Artificial Sequence
  Description of Artificial Sequence: Synthetic polypeptide
DEEEIRTTNPVATEQYGSTPMNGEQPEEVTESQ

SEQ ID NO: 140162 - protein, 37 aa, Artificial Sequence
  Description of Artificial Sequence: Synthetic polypeptide
DEEEIRTTNPVATEQYGVVSTVVTNNNQQGTNQQGTE

SEQ ID NO: 140163 - protein, 38 aa, Artificial Sequence
  Description of Artificial Sequence: Synthetic polypeptide
DEEEIRTTNPVATEQYGVVSTSVNTNLQQGNNDEDEND

SEQ ID NO: 140164 - protein, 36 aa, Artificial Sequence
  Description of Artificial Sequence: Synthetic polypeptide
DEEEIRTTNPVATEQYGVVSSTTPAGPNMRNGMNIV

SEQ ID NO: 140165 - protein, 30 aa, Artificial Sequence
  Description of Artificial Sequence: Synthetic polypeptide
QENEIATTNPVATEPYGDVSASLQHEDELA

SEQ ID NO: 140166 - protein, 28 aa, Artificial Sequence
  Description of Artificial Sequence: Synthetic peptide
QEEEIATTNPVATEWYGEAPVVCQHESK

SEQ ID NO: 140167 - protein, 35 aa, Artificial Sequence
  Description of Artificial Sequence: Synthetic polypeptide
DEEEIRTTNPVATEQYGVVCSTGEHNQENFGSDQS

SEQ ID NO: 140168 - protein, 34 aa, Artificial Sequence
  Description of Artificial Sequence: Synthetic polypeptide
DEMEIRTTNPVATEQYGSVSTPDHENQYTASPQS

SEQ ID NO: 140169 - protein, 28 aa, Artificial Sequence
  Description of Artificial Sequence: Synthetic peptide
QEEEIATTNPVATSQYGEAPEVCQHEES

SEQ ID NO: 140170 - protein, 33 aa, Artificial Sequence
  Description of Artificial Sequence: Synthetic polypeptide
DEGEIVTTNPVATEQYGTVCSATDGWVEFEGND

SEQ ID NO: 140171 - protein, 29 aa, Artificial Sequence
  Description of Artificial Sequence: Synthetic peptide
QEEEIATTNPVATEQYGNAPETCQSHEEK

SEQ ID NO: 140172 - protein, 29 aa, Artificial Sequence
  Description of Artificial Sequence: Synthetic peptide
QEEEIATTNPVATEQYGETAPESCQHEEK

SEQ ID NO: 140173 - protein, 38 aa, Artificial Sequence
  Description of Artificial Sequence: Synthetic polypeptide
DEEEIRTTNPVATEQYGVVSSTNLQAGNEQGTTETGSE

SEQ ID NO: 140174 - protein, 38 aa, Artificial Sequence
  Description of Artificial Sequence: Synthetic polypeptide
DEEEIRTTNPVATEQYGVVSSTNLQAGNQQGTTEEGTQ

SEQ ID NO: 140175 - protein, 32 aa, Artificial Sequence
  Description of Artificial Sequence: Synthetic polypeptide
DAAEIATTNPVATAQWGSVSGTGNPDPDGPGR

SEQ ID NO: 140176 - protein, 30 aa, Artificial Sequence
  Description of Artificial Sequence: Synthetic polypeptide
QENEIRTTNPVSTEPYGTISMEDLQQNGEH

SEQ ID NO: 140177 - protein, 32 aa, Artificial Sequence
  Description of Artificial Sequence: Synthetic polypeptide
DEHEIATTNPVAYDQWGSVPTWQDDHQREGND

SEQ ID NO: 140178 - protein, 29 aa, Artificial Sequence
  Description of Artificial Sequence: Synthetic peptide
QEEEIATTNPVATEQYGETAAEVCQHEEI

SEQ ID NO: 140179 - protein, 28 aa, Artificial Sequence
  Description of Artificial Sequence: Synthetic peptide
QEEEIATTNPVATYQYGEAPEVCQHEEK

SEQ ID NO: 140180 - protein, 36 aa, Artificial Sequence
  Description of Artificial Sequence: Synthetic polypeptide
DEMEIRTTNPVATEQYGSVITWTYVDLQERDNDQMS

SEQ ID NO: 140181 - protein, 37 aa, Artificial Sequence
  Description of Artificial Sequence: Synthetic polypeptide
DEEEIRTTNPVATEQYGVVSTVVTNNNNQQGNNQQQD

SEQ ID NO: 140182 - protein, 34 aa, Artificial Sequence
  Description of Artificial Sequence: Synthetic polypeptide
DEEEIRTTNPVATEQYGSLYSVMLDVERQLPMDG

SEQ ID NO: 140183 - protein, 34 aa, Artificial Sequence
  Description of Artificial Sequence: Synthetic polypeptide
DEAEIATTNPVATEVWGSVCYTNEQQDDDGSNNR

SEQ ID NO: 140184 - protein, 36 aa, Artificial Sequence
  Description of Artificial Sequence: Synthetic polypeptide
DEMEIRTTNPVATEQYGSVISTTPAGPNMRNGMNPV

SEQ ID NO: 140185 - protein, 36 aa, Artificial Sequence
  Description of Artificial Sequence: Synthetic polypeptide
DEMEIRTTNPVATEQYGSVSPADNLTTQTSSPDDRS

SEQ ID NO: 140186 - protein, 29 aa, Artificial Sequence
  Description of Artificial Sequence: Synthetic peptide
QEEEIATTNPVATEQYGETAPETCQHEEK

SEQ ID NO: 140187 - protein, 35 aa, Artificial Sequence
  Description of Artificial Sequence: Synthetic polypeptide
DEEEIGTTNPVATEQYGSVPSRTDPGPIQFNPNAM

SEQ ID NO: 140188 - protein, 35 aa, Artificial Sequence
  Description of Artificial Sequence: Synthetic polypeptide
DEEEIGTTNPVATEQYGSVQCTRASSNNAGGNNET

SEQ ID NO: 140189 - protein, 33 aa, Artificial Sequence
  Description of Artificial Sequence: Synthetic polypeptide
DDEEIKTTNPVATEQYGTVSTNVGTDGGQGEGT

SEQ ID NO: 140190 - protein, 29 aa, Artificial Sequence
  Description of Artificial Sequence: Synthetic peptide
QEEEIATTNPVATEQYGETPEVCKQHEEK

SEQ ID NO: 140191 - protein, 28 aa, Artificial Sequence
  Description of Artificial Sequence: Synthetic peptide
QEEEIATTNPVATEYYGEAPEVCQHEEK

SEQ ID NO: 140192 - protein, 37 aa, Artificial Sequence
  Description of Artificial Sequence: Synthetic polypeptide
AEEEIRTTNPVATEQYGSVSTVVNNQLNGDEAGNEDS

SEQ ID NO: 140193 - protein, 28 aa, Artificial Sequence
  Description of Artificial Sequence: Synthetic peptide
QEEEIATTNPVATFQYGEAPVVCQHEEK

SEQ ID NO: 140194 - protein, 33 aa, Artificial Sequence
  Description of Artificial Sequence: Synthetic polypeptide
DEMEIRTTNPVATEQYGQCVCSWELAHFNSDQS

SEQ ID NO: 140195 - protein, 35 aa, Artificial Sequence
  Description of Artificial Sequence: Synthetic polypeptide
DEEEIRTTNPVATEQYGSVISCGVAVSQGTGGSQQ

SEQ ID NO: 140196 - protein, 28 aa, Artificial Sequence
  Description of Artificial Sequence: Synthetic peptide
QEEEIATTNPVATQQYGEACEVCQHEEK

SEQ ID NO: 140197 - protein, 28 aa, Artificial Sequence
  Description of Artificial Sequence: Synthetic peptide
QEEEIATTNPVATSQYGEAPEVCQHEEK

SEQ ID NO: 140198 - protein, 29 aa, Artificial Sequence
  Description of Artificial Sequence: Synthetic peptide
QEEEIATTNPVATEQYGETAPEVTQHEEK

SEQ ID NO: 140199 - protein, 29 aa, Artificial Sequence
  Description of Artificial Sequence: Synthetic peptide
QEEEIATTNPVATEQYGETAPEVCQHEEK

SEQ ID NO: 140200 - protein, 29 aa, Artificial Sequence
  Description of Artificial Sequence: Synthetic peptide
QENEIATTNPVAYECYGDVSECLQHEEQL

SEQ ID NO: 140201 - protein, 29 aa, Artificial Sequence
  Description of Artificial Sequence: Synthetic peptide
QENEIATTNPVAYECYGDVSECLQHEEML

SEQ ID NO: 140202 - protein, 38 aa, Artificial Sequence
  Description of Artificial Sequence: Synthetic polypeptide
DEEEIRTTNPVATEQYGVVSTVVTNLQAGNQEGTNNTE

SEQ ID NO: 140203 - protein, 29 aa, Artificial Sequence
  Description of Artificial Sequence: Synthetic peptide
QENEIATTNPVATEQYGTASMVCQHNEEH

SEQ ID NO: 140204 - protein, 35 aa, Artificial Sequence
  Description of Artificial Sequence: Synthetic polypeptide
DEMEIRTTNPVATEQYGSVIVMNLHEQDRFESIME

SEQ ID NO: 140205 - protein, 33 aa, Artificial Sequence
  Description of Artificial Sequence: Synthetic polypeptide
DEGEIVTTNPVATEQYGTVCSATDGPVEFEGND

SEQ ID NO: 140206 - protein, 38 aa, Artificial Sequence
  Description of Artificial Sequence: Synthetic polypeptide
DEEEIRTTNPVATEQYGVVSTVVTNLQGNQAGNINEGT

SEQ ID NO: 140207 - protein, 33 aa, Artificial Sequence
  Description of Artificial Sequence: Synthetic polypeptide
DEGEIVTTNPVATEQYGTVCSATDGHVEFEGND

SEQ ID NO: 140208 - protein, 36 aa, Artificial Sequence
  Description of Artificial Sequence: Synthetic polypeptide
DEEEIKTTNPVATEQYGSVSSTTPAGPNMRNGMRPV

SEQ ID NO: 140209 - protein, 36 aa, Artificial Sequence
  Description of Artificial Sequence: Synthetic polypeptide
DEEEIKTTNPVATEQYGSVSSTTPAGPNMRVGMNPV

SEQ ID NO: 140210 - protein, 29 aa, Artificial Sequence
  Description of Artificial Sequence: Synthetic peptide
QEEEIATTNPVATEQYGEMPEVFCQHEEK

SEQ ID NO: 140211 - protein, 37 aa, Artificial Sequence
  Description of Artificial Sequence: Synthetic polypeptide
AEEEIRTTNPVATEQYGSVVTTTDGGNNLQQGTNDEN

SEQ ID NO: 140212 - protein, 34 aa, Artificial Sequence
  Description of Artificial Sequence: Synthetic polypeptide
DEMEIRTTNPVATEQYGSVNCVLDLGDDEGNNNI

SEQ ID NO: 140213 - protein, 35 aa, Artificial Sequence
  Description of Artificial Sequence: Synthetic polypeptide
DEEEIRTTNPVATEQYGSVIFVLNDNEQRIVEEQN

SEQ ID NO: 140214 - protein, 38 aa, Artificial Sequence
  Description of Artificial Sequence: Synthetic polypeptide
DEEEIRTTNPVATEQYGVVSSTNLQQGNEQGTTEQGAE

SEQ ID NO: 140215 - protein, 36 aa, Artificial Sequence
  Description of Artificial Sequence: Synthetic polypeptide
DEEEIGTTNPVATEQYGSVSSTTPAGPNMRNGMNPV

SEQ ID NO: 140216 - protein, 36 aa, Artificial Sequence
  Description of Artificial Sequence: Synthetic polypeptide
DEMEIRTTNPVATEQYGSVSNTEDNTEITTGNEMDN

SEQ ID NO: 140217 - protein, 29 aa, Artificial Sequence
  Description of Artificial Sequence: Synthetic peptide
QEEEIATTNPVATEQYGNAPEVCQHEKEK

SEQ ID NO: 140218 - protein, 29 aa, Artificial Sequence
  Description of Artificial Sequence: Synthetic peptide
QENEIATTNPVAWECYGDVSECLQHETEL

SEQ ID NO: 140219 - protein, 37 aa, Artificial Sequence
  Description of Artificial Sequence: Synthetic polypeptide
DEEEIRTTNPVATEQYGVVSSTNPEEGPNMRNGMNPV

SEQ ID NO: 140220 - protein, 28 aa, Artificial Sequence
  Description of Artificial Sequence: Synthetic peptide
QENEIATTNPVAYECWGVVSDCLQHEES

SEQ ID NO: 140221 - protein, 33 aa, Artificial Sequence
  Description of Artificial Sequence: Synthetic polypeptide
DEGEIVTTNPVATEQYGTVCSATDGIVEFEGND

SEQ ID NO: 140222 - protein, 35 aa, Artificial Sequence
  Description of Artificial Sequence: Synthetic polypeptide
DEAEIATTNPVATEQYGSVCAMTNHGEQEMGNDNL

SEQ ID NO: 140223 - protein, 28 aa, Artificial Sequence
  Description of Artificial Sequence: Synthetic peptide
QEEEIATTNPVAWEQYGEAPMVCQHEEK

SEQ ID NO: 140224 - protein, 28 aa, Artificial Sequence
  Description of Artificial Sequence: Synthetic peptide
QEEEIATTNPVAWEQYGEAPEVCQHEEK

SEQ ID NO: 140225 - protein, 36 aa, Artificial Sequence
  Description of Artificial Sequence: Synthetic polypeptide
DEEEIGTTNPVATEQYGSVSSTIPAGPNMRNGMNPV

SEQ ID NO: 140226 - protein, 35 aa, Artificial Sequence
  Description of Artificial Sequence: Synthetic polypeptide
DEAEIATTNPVATEQYGSVCAMTGVLPEQDGENDQ

SEQ ID NO: 140227 - protein, 38 aa, Artificial Sequence
  Description of Artificial Sequence: Synthetic polypeptide
DEEEIRTTNPVATEQYGVVSSTNLQAGNTEQGTTEQGQ

SEQ ID NO: 140228 - protein, 36 aa, Artificial Sequence
  Description of Artificial Sequence: Synthetic polypeptide
DEEEIRTTNPVATEQYGSVISDLSSQEITVGNVDSQ

SEQ ID NO: 140229 - protein, 30 aa, Artificial Sequence
  Description of Artificial Sequence: Synthetic polypeptide
QEEEIATTNPVATEQYGESACPEVCQHEEK

SEQ ID NO: 140230 - protein, 29 aa, Artificial Sequence
  Description of Artificial Sequence: Synthetic peptide
QEEEIATTNPVAWEQYGEAPEVCQHEEKR

SEQ ID NO: 140231 - protein, 28 aa, Artificial Sequence
  Description of Artificial Sequence: Synthetic peptide
QENEIATTNPVAYECWGVVSECLQHMET

SEQ ID NO: 140232 - protein, 29 aa, Artificial Sequence
  Description of Artificial Sequence: Synthetic peptide
QEEEIATTNPVAWEQYGEAPEVCQHGEEK

SEQ ID NO: 140233 - protein, 38 aa, Artificial Sequence
  Description of Artificial Sequence: Synthetic polypeptide
DEEEIRTTNPVATEQYGVVSSTNLQAGTEQGTTEQGNQ

SEQ ID NO: 140234 - protein, 36 aa, Artificial Sequence
  Description of Artificial Sequence: Synthetic polypeptide
DEEEIRTTNPVATEQYGSVISDTASDEQNQAAQVER

SEQ ID NO: 140235 - protein, 36 aa, Artificial Sequence
  Description of Artificial Sequence: Synthetic polypeptide
DEEEIRTTNPVATEQYGSVISDTSNGGNETGGGGQT

SEQ ID NO: 140236 - protein, 35 aa, Artificial Sequence
  Description of Artificial Sequence: Synthetic polypeptide
DEAEIATTNPVATEQYGSVCAMTNHGEQDMPGDND

SEQ ID NO: 140237 - protein, 35 aa, Artificial Sequence
  Description of Artificial Sequence: Synthetic polypeptide
DEEEIRTTNPVATEQYGSVISEANNEQLAPHVDVN

SEQ ID NO: 140238 - protein, 36 aa, Artificial Sequence
  Description of Artificial Sequence: Synthetic polypeptide
DEEEIKTTNPVATEQYGSVSSTTPAGPNMRNGMNPV

SEQ ID NO: 140239 - protein, 29 aa, Artificial Sequence
  Description of Artificial Sequence: Synthetic peptide
QEEEIATTNPVATEQYGETAAEDCQHEEI

SEQ ID NO: 140240 - protein, 36 aa, Artificial Sequence
  Description of Artificial Sequence: Synthetic polypeptide
DEEEIRTTNPVATEQYGVVSSTTPAGPNMRNRMNPV

SEQ ID NO: 140241 - protein, 28 aa, Artificial Sequence
  Description of Artificial Sequence: Synthetic peptide
QEEEIATTNPVATERYGEAPELCQHEEK

SEQ ID NO: 140242 - protein, 38 aa, Artificial Sequence
  Description of Artificial Sequence: Synthetic polypeptide
DEEEIRTTNPVATEQYGVVSTNVNTNLQAGNNQEDEDE

SEQ ID NO: 140243 - protein, 30 aa, Artificial Sequence
  Description of Artificial Sequence: Synthetic polypeptide
QENEIATTNPVATEQYGDVSECLEDHEEDL

SEQ ID NO: 140244 - protein, 34 aa, Artificial Sequence
  Description of Artificial Sequence: Synthetic polypeptide
DEGTIRTTNPVATEQYGDIVSIMNNDQGGGGNDQ

SEQ ID NO: 140245 - protein, 30 aa, Artificial Sequence
  Description of Artificial Sequence: Synthetic polypeptide
QENEIATTNPVATEQYGDVSECEQNHAEEA

SEQ ID NO: 140246 - protein, 30 aa, Artificial Sequence
  Description of Artificial Sequence: Synthetic polypeptide
QENEIRTTNPCSTEPYGIVSCDIQQQQGNH

SEQ ID NO: 140247 - protein, 36 aa, Artificial Sequence
  Description of Artificial Sequence: Synthetic polypeptide
DEEEIRTTNPVATEQYGSNSSTTTAGPNMRNGMNPV

SEQ ID NO: 140248 - protein, 35 aa, Artificial Sequence
  Description of Artificial Sequence: Synthetic polypeptide
DEEEIATTNPVATEQYGNVSSTTAGPNSRNGMNPV

SEQ ID NO: 140249 - protein, 29 aa, Artificial Sequence
  Description of Artificial Sequence: Synthetic peptide
QEEEIATTNPVATEQYGTAPEVCQQHEEK

SEQ ID NO: 140250 - protein, 33 aa, Artificial Sequence
  Description of Artificial Sequence: Synthetic polypeptide
DEMEIRTTNPVATEQYGSVSQSAIAMENVVPLD

SEQ ID NO: 140251 - protein, 32 aa, Artificial Sequence
  Description of Artificial Sequence: Synthetic polypeptide
DEGTIGTTNPVATEQYGVADTNLIGIGENGDE

SEQ ID NO: 140252 - protein, 30 aa, Artificial Sequence
  Description of Artificial Sequence: Synthetic polypeptide
QENEIATTNPVATEQYGDVSEVEQNAAEDK

SEQ ID NO: 140253 - protein, 30 aa, Artificial Sequence
  Description of Artificial Sequence: Synthetic polypeptide
QENEIATTNPVATEQYGDVSECEQNAAEEA

SEQ ID NO: 140254 - protein, 33 aa, Artificial Sequence
  Description of Artificial Sequence: Synthetic polypeptide
DEGTIGTTNPVATEQYGSVADTQLIGGGENGDG

SEQ ID NO: 140255 - protein, 36 aa, Artificial Sequence
  Description of Artificial Sequence: Synthetic polypeptide
DEMEIRTTNPVATEQYGSVCNTTPLEQLEIGENEKN

SEQ ID NO: 140256 - protein, 29 aa, Artificial Sequence
  Description of Artificial Sequence: Synthetic peptide
QEEEIATTNPVATEQYGTAPEVWCQHEEK

SEQ ID NO: 140257 - protein, 34 aa, Artificial Sequence
  Description of Artificial Sequence: Synthetic polypeptide
DEMEIRTTNPVATEQYGSVCMDYNDLEEHQINDI

SEQ ID NO: 140258 - protein, 35 aa, Artificial Sequence
  Description of Artificial Sequence: Synthetic polypeptide
DEEEIRTTNPVATEQYGSTATPLALSLTNEIQLDN

SEQ ID NO: 140259 - protein, 29 aa, Artificial Sequence
  Description of Artificial Sequence: Synthetic peptide
QENEIRTTNPCSTEPYGIVSCDIQQQGTH

SEQ ID NO: 140260 - protein, 36 aa, Artificial Sequence
  Description of Artificial Sequence: Synthetic polypeptide
DEEEIRTTNPVATEQYGSTASTTPAGPNMRQEMNPV

SEQ ID NO: 140261 - protein, 35 aa, Artificial Sequence
  Description of Artificial Sequence: Synthetic polypeptide
DEMEIRTTNPVATEQYGSVASPTDLLERNDELVPD

SEQ ID NO: 140262 - protein, 34 aa, Artificial Sequence
  Description of Artificial Sequence: Synthetic polypeptide
DEEEIGTTNPVATEQYGCVCSWEDHNQENFGSNL

SEQ ID NO: 140263 - protein, 30 aa, Artificial Sequence
  Description of Artificial Sequence: Synthetic polypeptide
QEEEIATTNPVATEQYGEVPEVEQNHAEEK

SEQ ID NO: 140264 - protein, 30 aa, Artificial Sequence
  Description of Artificial Sequence: Synthetic polypeptide
QEEEIATTNPVATEQYGEVPEVCQNAAEEA

SEQ ID NO: 140265 - protein, 33 aa, Artificial Sequence
  Description of Artificial Sequence: Synthetic polypeptide
DEEEIRTTNPVATEQYGSVIAVDLVHSFSQEEQ

SEQ ID NO: 140266 - protein, 34 aa, Artificial Sequence
  Description of Artificial Sequence: Synthetic polypeptide
DEEEIATTNPVATEQYGEASPTPAGPNMRNGMNV

SEQ ID NO: 140267 - protein, 34 aa, Artificial Sequence
  Description of Artificial Sequence: Synthetic polypeptide
DEMEIRTTNPVATEQYGSSSCTWQLVEEQNEDII

SEQ ID NO: 140268 - protein, 37 aa, Artificial Sequence
  Description of Artificial Sequence: Synthetic polypeptide
AEEEIRTTNPVATEQYGSVSTVVNNGNQQGNGNNDTP

SEQ ID NO: 140269 - protein, 34 aa, Artificial Sequence
  Description of Artificial Sequence: Synthetic polypeptide
DEAEIATTNPVATEQYGSVCAAMSHGSQDSDINR

SEQ ID NO: 140270 - protein, 29 aa, Artificial Sequence
  Description of Artificial Sequence: Synthetic peptide
QEEEIATTNPVATEQYGTAPEVCQHEEEK

SEQ ID NO: 140271 - protein, 29 aa, Artificial Sequence
  Description of Artificial Sequence: Synthetic peptide
QEEEIATTNPVATEQYGTAPEVCQHEEKD

SEQ ID NO: 140272 - protein, 35 aa, Artificial Sequence
  Description of Artificial Sequence: Synthetic polypeptide
DEEEIRTTNPVATEQYGVVMGNDENDIQNEGNGGT

SEQ ID NO: 140273 - protein, 30 aa, Artificial Sequence
  Description of Artificial Sequence: Synthetic polypeptide
QENEIATTNPVATEQYGDVSEPAGQHNEEL

SEQ ID NO: 140274 - protein, 33 aa, Artificial Sequence
  Description of Artificial Sequence: Synthetic polypeptide
DEEEIRTTNPVATEQYGSVIAYWPVTQQTPVEQ

SEQ ID NO: 140275 - protein, 34 aa, Artificial Sequence
  Description of Artificial Sequence: Synthetic polypeptide
DEMEIRTTNPVATEQYGSNNWTEDETQPEGEDNM

SEQ ID NO: 140276 - protein, 31 aa, Artificial Sequence
  Description of Artificial Sequence: Synthetic polypeptide
QENEIRTTNPIATECYGAVSNEEDLQEHGEL

SEQ ID NO: 140277 - protein, 29 aa, Artificial Sequence
  Description of Artificial Sequence: Synthetic peptide
QEEEIATTNPVATEQYGTAPEVCQHEEED

SEQ ID NO: 140278 - protein, 33 aa, Artificial Sequence
  Description of Artificial Sequence: Synthetic polypeptide
DEMEIRTTNPVATEQYGSVSQSAEGATENVNNF

SEQ ID NO: 140279 - protein, 35 aa, Artificial Sequence
  Description of Artificial Sequence: Synthetic polypeptide
DEEEIATTNPVATEQYGNVSSTTAGPNMRNGMNPV

SEQ ID NO: 140280 - protein, 33 aa, Artificial Sequence
  Description of Artificial Sequence: Synthetic polypeptide
DEAEIATTNPVATEQYGSVCAAMNPLNDMDPNN

SEQ ID NO: 140281 - protein, 35 aa, Artificial Sequence
  Description of Artificial Sequence: Synthetic polypeptide
DEEEIRTTNPVATEQYGSVILPTMNQGINGELSVE

SEQ ID NO: 140282 - protein, 29 aa, Artificial Sequence
  Description of Artificial Sequence: Synthetic peptide
QENEIATTNPVATEQYGDVSECEMAAEDA

SEQ ID NO: 140283 - protein, 34 aa, Artificial Sequence
  Description of Artificial Sequence: Synthetic polypeptide
DEEEIRTTNPVATEQYGSVHWTIDPYVEQEEDGD

SEQ ID NO: 140284 - protein, 35 aa, Artificial Sequence
  Description of Artificial Sequence: Synthetic polypeptide
DEEEIGTTNPVATEQYGCVCSTNDHNQEYFGSELA

SEQ ID NO: 140285 - protein, 35 aa, Artificial Sequence
  Description of Artificial Sequence: Synthetic polypeptide
DEEEIRTTNPVATEQYGSSSTWNEPPQVSQSTQQY

SEQ ID NO: 140286 - protein, 29 aa, Artificial Sequence
  Description of Artificial Sequence: Synthetic peptide
QENEIATTNPVATEQYGDVSECEMAAEEA

SEQ ID NO: 140287 - protein, 28 aa, Artificial Sequence
  Description of Artificial Sequence: Synthetic peptide
QENEIATTNPVATEQYGEAPECCQHEEK

SEQ ID NO: 140288 - protein, 34 aa, Artificial Sequence
  Description of Artificial Sequence: Synthetic polypeptide
DEMEIRTTNPVATEQYGSVSTDVNDTHESDEPIP

SEQ ID NO: 140289 - protein, 34 aa, Artificial Sequence
  Description of Artificial Sequence: Synthetic polypeptide
DEMEIRTTNPVATEQYGSVSTDYLTTTEETQEDK

SEQ ID NO: 140290 - protein, 34 aa, Artificial Sequence
  Description of Artificial Sequence: Synthetic polypeptide
DEEEIATTNPVATEQYGNTIATNPLENGMMGSTR

SEQ ID NO: 140291 - protein, 35 aa, Artificial Sequence
  Description of Artificial Sequence: Synthetic polypeptide
DEMEIRTTNPVATEQYGSVSTDYLTTTEETQQDDL

SEQ ID NO: 140292 - protein, 29 aa, Artificial Sequence
  Description of Artificial Sequence: Synthetic peptide
QENEIATTNPVSTECYGDVAANCIQREEL

SEQ ID NO: 140293 - protein, 34 aa, Artificial Sequence
  Description of Artificial Sequence: Synthetic polypeptide
DEMEIRTTNPVATEQYGSVSTEDYTQHETQDMAF

SEQ ID NO: 140294 - protein, 32 aa, Artificial Sequence
  Description of Artificial Sequence: Synthetic polypeptide
DEGTIATTNPVATEQYGDVDDSNGQGGGNGQE

SEQ ID NO: 140295 - protein, 35 aa, Artificial Sequence
  Description of Artificial Sequence: Synthetic polypeptide
DEEEIRTTNPVATEQYGVVDTDNNMQGQEGIEGED

SEQ ID NO: 140296 - protein, 29 aa, Artificial Sequence
  Description of Artificial Sequence: Synthetic peptide
QENEIATTNPVATEQYGDVSECEMHAEEA

SEQ ID NO: 140297 - protein, 38 aa, Artificial Sequence
  Description of Artificial Sequence: Synthetic polypeptide
DEEEIRTTNPVATEQYGVVSTVVTNLNGNQQQGNNEEN

SEQ ID NO: 140298 - protein, 28 aa, Artificial Sequence
  Description of Artificial Sequence: Synthetic peptide
QENEIATTNPVSTECYGDVSECIQHEEL

SEQ ID NO: 140299 - protein, 36 aa, Artificial Sequence
  Description of Artificial Sequence: Synthetic polypeptide
AEEEIRTTNPVATEQYGSVSTVVNNGNNLDEENNSD

SEQ ID NO: 140300 - protein, 35 aa, Artificial Sequence
  Description of Artificial Sequence: Synthetic polypeptide
DEEEIATTNPVATEQYGNTIATNPLEQGMPMGERN

SEQ ID NO: 140301 - protein, 34 aa, Artificial Sequence
  Description of Artificial Sequence: Synthetic polypeptide
DEHEIATTNPVATEQYGSVDSATDLEDHEGEDLT

SEQ ID NO: 140302 - protein, 29 aa, Artificial Sequence
  Description of Artificial Sequence: Synthetic peptide
QENEIATTNPVSTECYGDVAANCLQHEEL

SEQ ID NO: 140303 - protein, 29 aa, Artificial Sequence
  Description of Artificial Sequence: Synthetic peptide
QEEEIATTNPVATEQYGTASEVCEHEEED

SEQ ID NO: 140304 - protein, 33 aa, Artificial Sequence
  Description of Artificial Sequence: Synthetic polypeptide
DEMEIRTTNPVATEQYGSLYSDVNQTIETNDVE

SEQ ID NO: 140305 - protein, 33 aa, Artificial Sequence
  Description of Artificial Sequence: Synthetic polypeptide
DEEEIATTNPVATEQYGEASSEPAGNMHNGNPV

SEQ ID NO: 140306 - protein, 38 aa, Artificial Sequence
  Description of Artificial Sequence: Synthetic polypeptide
DEEEIRTTNPVATEQYGVVSTVVTNLQQGTEQGTNEED

SEQ ID NO: 140307 - protein, 35 aa, Artificial Sequence
  Description of Artificial Sequence: Synthetic polypeptide
DEHEIATTNPVATEQYGSVCYNNDDQDQQGQNGSR

SEQ ID NO: 140308 - protein, 35 aa, Artificial Sequence
  Description of Artificial Sequence: Synthetic polypeptide
DEEEIRTTNPVATEQYGSVILTENMMIVAGEVEFL

SEQ ID NO: 140309 - protein, 38 aa, Artificial Sequence
  Description of Artificial Sequence: Synthetic polypeptide
DEEEIRTTNPVATEQYGVVSTVVTNLNGNQQGTTNEEN

SEQ ID NO: 140310 - protein, 30 aa, Artificial Sequence
  Description of Artificial Sequence: Synthetic polypeptide
QEEEIATTNPVATEQYGTIPEEVCQQHGEH

SEQ ID NO: 140311 - protein, 32 aa, Artificial Sequence
  Description of Artificial Sequence: Synthetic polypeptide
QENEIATTNPVATEQYGDVSSEPCGPQRGEPL

SEQ ID NO: 140312 - protein, 30 aa, Artificial Sequence
  Description of Artificial Sequence: Synthetic polypeptide
QEEEIATTNPVATEQYGTIPEEVIQQHGEH

SEQ ID NO: 140313 - protein, 36 aa, Artificial Sequence
  Description of Artificial Sequence: Synthetic polypeptide
DEEEIRTTNPVATEQYGSNSSVTPAGPNMRNGMNPV

SEQ ID NO: 140314 - protein, 30 aa, Artificial Sequence
  Description of Artificial Sequence: Synthetic polypeptide
QENEIRTTNPVATECWGDVSECLQNHAEEA

SEQ ID NO: 140315 - protein, 36 aa, Artificial Sequence
  Description of Artificial Sequence: Synthetic polypeptide
DEEEIRTTNPVATEQYGSNSSTTPAGPNMRNGMNPV

SEQ ID NO: 140316 - protein, 29 aa, Artificial Sequence
  Description of Artificial Sequence: Synthetic peptide
QEEEIATTNPVATEQYGTAPEVCQHEAEK

SEQ ID NO: 140317 - protein, 37 aa, Artificial Sequence
  Description of Artificial Sequence: Synthetic polypeptide
DEEEIRTTNPVATEQYGSSVSSTTPAGPNMRNGMNPY

SEQ ID NO: 140318 - protein, 35 aa, Artificial Sequence
  Description of Artificial Sequence: Synthetic polypeptide
DEMEIRTTNPVATEQYGSVSSTTDAGVEFEGMNPV

SEQ ID NO: 140319 - protein, 35 aa, Artificial Sequence
  Description of Artificial Sequence: Synthetic polypeptide
DEEEIRTTNPVATEQYGSVHYTIDPYGVEGEEDRQ

SEQ ID NO: 140320 - protein, 29 aa, Artificial Sequence
  Description of Artificial Sequence: Synthetic peptide
DEEEIATTNPVATEQYGEAPEVWAEHEEK

SEQ ID NO: 140321 - protein, 37 aa, Artificial Sequence
  Description of Artificial Sequence: Synthetic polypeptide
AEEEIRTTNPVATEQYGSVSTVVNNLQQIGTTQQGED

SEQ ID NO: 140322 - protein, 38 aa, Artificial Sequence
  Description of Artificial Sequence: Synthetic polypeptide
DEEEIRTTNPVATEQYGVVSTVVTNLQQGTEAGTNQES

SEQ ID NO: 140323 - protein, 35 aa, Artificial Sequence
  Description of Artificial Sequence: Synthetic polypeptide
DEEEIRTTNPVATEQYGVVINDNQGDQDEGGNDEN

SEQ ID NO: 140324 - protein, 34 aa, Artificial Sequence
  Description of Artificial Sequence: Synthetic polypeptide
DEEEIRTTNPVATEQYGVVGSGMGQGDEGTGETA

SEQ ID NO: 140325 - protein, 38 aa, Artificial Sequence
  Description of Artificial Sequence: Synthetic polypeptide
DEEEIRTTNPVATEQYGVVSTVVTNLNGNQQGNENQEN

SEQ ID NO: 140326 - protein, 35 aa, Artificial Sequence
  Description of Artificial Sequence: Synthetic polypeptide
DEEEIRTTNPVATEQYGSVHYTIDPQYVEGEEDFD

SEQ ID NO: 140327 - protein, 37 aa, Artificial Sequence
  Description of Artificial Sequence: Synthetic polypeptide
AEEEIRTTNPVATEQYGSVVTVANLGNQQGEIGNNVD

SEQ ID NO: 140328 - protein, 33 aa, Artificial Sequence
  Description of Artificial Sequence: Synthetic polypeptide
DEGVEIATTNPVAYEAWGTVSTNLNRGDTNDSS

SEQ ID NO: 140329 - protein, 35 aa, Artificial Sequence
  Description of Artificial Sequence: Synthetic polypeptide
DEEEIRTTNPVATEQYGSVINCPSPNDTQTNVDFP

SEQ ID NO: 140330 - protein, 36 aa, Artificial Sequence
  Description of Artificial Sequence: Synthetic polypeptide
DEEEIRTTNPVATEQYGSVINTTGGLGQGEMDGEFE

SEQ ID NO: 140331 - protein, 36 aa, Artificial Sequence
  Description of Artificial Sequence: Synthetic polypeptide
DEMEIRTTNPVATEQYGSVSSTTDAGPNMREGMNPV

SEQ ID NO: 140332 - protein, 30 aa, Artificial Sequence
  Description of Artificial Sequence: Synthetic polypeptide
QENEIATTNPVSTEQYGEISMDIQQQNGNH

SEQ ID NO: 140333 - protein, 34 aa, Artificial Sequence
  Description of Artificial Sequence: Synthetic polypeptide
DEEEIATTNPVATEQYGSACAAAHLEQDEQGDRD

SEQ ID NO: 140334 - protein, 30 aa, Artificial Sequence
  Description of Artificial Sequence: Synthetic polypeptide
QENEIATTNPVSTEQYGEISMDCQQQNGNH

SEQ ID NO: 140335 - protein, 36 aa, Artificial Sequence
  Description of Artificial Sequence: Synthetic polypeptide
DEMEIRTTNPVATEQYGSVSSTTPAGPNMRNGMNPV

SEQ ID NO: 140336 - protein, 38 aa, Artificial Sequence
  Description of Artificial Sequence: Synthetic polypeptide
DEEEIRTTNPVATEQYGVVSTVVTNLQQGTEQGNEEEQ

SEQ ID NO: 140337 - protein, 38 aa, Artificial Sequence
  Description of Artificial Sequence: Synthetic polypeptide
DEEEIRTTNPVATEQYGVVSTVVTNLNGNQQGNNNEEE

SEQ ID NO: 140338 - protein, 29 aa, Artificial Sequence
  Description of Artificial Sequence: Synthetic peptide
QENEIATTNPVSTEPYGTASMDIQHNGNH

SEQ ID NO: 140339 - protein, 30 aa, Artificial Sequence
  Description of Artificial Sequence: Synthetic polypeptide
QENEIATTNPVSTEPYGTVSMECLQQNGEH

SEQ ID NO: 140340 - protein, 30 aa, Artificial Sequence
  Description of Artificial Sequence: Synthetic polypeptide
QENEIATTNPVSTEPYGTVSMEDLQQNGEH

SEQ ID NO: 140341 - protein, 37 aa, Artificial Sequence
  Description of Artificial Sequence: Synthetic polypeptide
DEEEIRTTNPVATEQYGSSVSSTTPAGPNMRNGMNPV

SEQ ID NO: 140342 - protein, 36 aa, Artificial Sequence
  Description of Artificial Sequence: Synthetic polypeptide
AEEEIRTTNPVATEQYGSVSTVVNNNDELQGTDEDT

SEQ ID NO: 140343 - protein, 33 aa, Artificial Sequence
  Description of Artificial Sequence: Synthetic polypeptide
DEMEIRTTNPVATEQYGSVADTPHNGETMESMN

SEQ ID NO: 140344 - protein, 33 aa, Artificial Sequence
  Description of Artificial Sequence: Synthetic polypeptide
DEAEIATTNPVATEQYGTVASATDGPAEAEGND

SEQ ID NO: 140345 - protein, 35 aa, Artificial Sequence
  Description of Artificial Sequence: Synthetic polypeptide
DEMEIRTTNPVATEQYGSVSSTTDAGVNFEGMNPV

SEQ ID NO: 140346 - protein, 34 aa, Artificial Sequence
  Description of Artificial Sequence: Synthetic polypeptide
DEMEIRTTNPVATEQYGSVACPTDLLERNDEPVM

SEQ ID NO: 140347 - protein, 33 aa, Artificial Sequence
  Description of Artificial Sequence: Synthetic polypeptide
DDEEIKTTNPVATEQYGAVSTVPGTDGGNGQGI

SEQ ID NO: 140348 - protein, 29 aa, Artificial Sequence
  Description of Artificial Sequence: Synthetic peptide
QENEIATTNPVSTEPYGDISMCIQQQGNL

SEQ ID NO: 140349 - protein, 35 aa, Artificial Sequence
  Description of Artificial Sequence: Synthetic polypeptide
DEMEIRTTNPVATEQYGSVAEPTDLLERNDENVMQ

SEQ ID NO: 140350 - protein, 28 aa, Artificial Sequence
  Description of Artificial Sequence: Synthetic peptide
QENEIATVNPVATECYGDVPECLQHEEL

SEQ ID NO: 140351 - protein, 36 aa, Artificial Sequence
  Description of Artificial Sequence: Synthetic polypeptide
DEEEIRTTNPVATEQYGSNSSTPPAGPNMRNGMNPV

SEQ ID NO: 140352 - protein, 37 aa, Artificial Sequence
  Description of Artificial Sequence: Synthetic polypeptide
DEEEIRTTNPVATEQYGSSVSSTTPAGPYMRNGMNPV

SEQ ID NO: 140353 - protein, 37 aa, Artificial Sequence
  Description of Artificial Sequence: Synthetic polypeptide
DEEEIRTTNPVATEQYGSSVSSWTPAGPNMRNGMNPV

SEQ ID NO: 140354 - protein, 37 aa, Artificial Sequence
  Description of Artificial Sequence: Synthetic polypeptide
DEEEIRTTNPVATEQYGSVIMCMTNEDLEIQMETNHQ

SEQ ID NO: 140355 - protein, 36 aa, Artificial Sequence
  Description of Artificial Sequence: Synthetic polypeptide
DEMEIRTTNPVATEQYGSVASPTDLLEGRNDENVMI

SEQ ID NO: 140356 - protein, 36 aa, Artificial Sequence
  Description of Artificial Sequence: Synthetic polypeptide
AEEEIRTTNPVATEQYGSVSTVVNQGNNDEGTNNAD

SEQ ID NO: 140357 - protein, 29 aa, Artificial Sequence
  Description of Artificial Sequence: Synthetic peptide
QEEEIATTNPVATEQYGTAPEDVCQHEEK

SEQ ID NO: 140358 - protein, 32 aa, Artificial Sequence
  Description of Artificial Sequence: Synthetic polypeptide
QEEEIATTNPVATEQYGEVPTPACPQMHNEEK

SEQ ID NO: 140359 - protein, 35 aa, Artificial Sequence
  Description of Artificial Sequence: Synthetic polypeptide
DEMEIRTTNPVATEQYGSSSWLWNDLNQQDNMSIQ

SEQ ID NO: 140360 - protein, 36 aa, Artificial Sequence
  Description of Artificial Sequence: Synthetic polypeptide
DEMEIRTTNPVATEQYGSVSSTTVDGPNMRNGMNVV

SEQ ID NO: 140361 - protein, 29 aa, Artificial Sequence
  Description of Artificial Sequence: Synthetic peptide
QEEEIATTNPVATEQYGTAPEGCQHEEEK

SEQ ID NO: 140362 - protein, 35 aa, Artificial Sequence
  Description of Artificial Sequence: Synthetic polypeptide
DEEEIRTTNPVATEQYGVVDVDTNEMGQGGEDDEF

SEQ ID NO: 140363 - protein, 30 aa, Artificial Sequence
  Description of Artificial Sequence: Synthetic polypeptide
DEEEIATTNPVATEQYGEAPEVCQDHEEEK

SEQ ID NO: 140364 - protein, 34 aa, Artificial Sequence
  Description of Artificial Sequence: Synthetic polypeptide
DEEEIGTTNPVATEQYGCVCSWEDHQEYMGSNQA

SEQ ID NO: 140365 - protein, 28 aa, Artificial Sequence
  Description of Artificial Sequence: Synthetic peptide
QENEIATTNPVSTEPYGDISECIQHGEL

SEQ ID NO: 140366 - protein, 37 aa, Artificial Sequence
  Description of Artificial Sequence: Synthetic polypeptide
DEEEIRTTNPVATEQYGSSVSSTTPAGPNMCNGMNPV

SEQ ID NO: 140367 - protein, 30 aa, Artificial Sequence
  Description of Artificial Sequence: Synthetic polypeptide
DEEEIATTNPVATEQYGEAPEVCQDHEEDL

SEQ ID NO: 140368 - protein, 34 aa, Artificial Sequence
  Description of Artificial Sequence: Synthetic polypeptide
DEEEIGTTNPVATEQYGCVCSWEDLQENSGSDQS

SEQ ID NO: 140369 - protein, 36 aa, Artificial Sequence
  Description of Artificial Sequence: Synthetic polypeptide
DEMEIRTTNPVATEQYGSVSSPTPAGPNMRNGMNVM

SEQ ID NO: 140370 - protein, 29 aa, Artificial Sequence
  Description of Artificial Sequence: Synthetic peptide
QEEEIATTNPVATEQYGTACPEVPQHEEK

SEQ ID NO: 140371 - protein, 38 aa, Artificial Sequence
  Description of Artificial Sequence: Synthetic polypeptide
AEEEIRTTNPVATEQYGSVSTVVNNLNNQNQEGTNNVE

SEQ ID NO: 140372 - protein, 33 aa, Artificial Sequence
  Description of Artificial Sequence: Synthetic polypeptide
QEEEIATTNPVATEQYGEVSCINEPQDHEEENG

SEQ ID NO: 140373 - protein, 29 aa, Artificial Sequence
  Description of Artificial Sequence: Synthetic peptide
QENEICSTNPVCTEIYGVVNNSTLQNGDI

SEQ ID NO: 140374 - protein, 30 aa, Artificial Sequence
  Description of Artificial Sequence: Synthetic polypeptide
QENEIATTNPVATEQYGDVSEIEQNAAEEA

SEQ ID NO: 140375 - protein, 29 aa, Artificial Sequence
  Description of Artificial Sequence: Synthetic peptide
QEEEIATTNPVATEQYGTACPEVCQHEED

SEQ ID NO: 140376 - protein, 30 aa, Artificial Sequence
  Description of Artificial Sequence: Synthetic polypeptide
QENEIATTNPVATEQYGDVSEIEQNAAEDA

SEQ ID NO: 140377 - protein, 33 aa, Artificial Sequence
  Description of Artificial Sequence: Synthetic polypeptide
DEEEIGTTNPVATEQYGCVCSWEEHQFFGSDQS

SEQ ID NO: 140378 - protein, 29 aa, Artificial Sequence
  Description of Artificial Sequence: Synthetic peptide
QEEEIATTNPVATEQYGTACPEVCQHEEK

SEQ ID NO: 140379 - protein, 37 aa, Artificial Sequence
  Description of Artificial Sequence: Synthetic polypeptide
DEEEIRTTNPVATEQYGVVSTVVTNLQQGTEAGEETQ

SEQ ID NO: 140380 - protein, 37 aa, Artificial Sequence
  Description of Artificial Sequence: Synthetic polypeptide
DEMEIRTTNPVATEQYGSVSSTTPARGPNMRNGMNPV

SEQ ID NO: 140381 - protein, 38 aa, Artificial Sequence
  Description of Artificial Sequence: Synthetic polypeptide
DEEEIRTTNPVATEQYGVVSTVVTNLNGNQDEGTNEEN

SEQ ID NO: 140382 - protein, 38 aa, Artificial Sequence
  Description of Artificial Sequence: Synthetic polypeptide
DEEEIRTTNPVATEQYGVVSTVVTNLNGNQAGNVEQGQ

SEQ ID NO: 140383 - protein, 33 aa, Artificial Sequence
  Description of Artificial Sequence: Synthetic polypeptide
DDEEIRCTNPVATEQYGCSCSTEDNQNFNSDQA

SEQ ID NO: 140384 - protein, 30 aa, Artificial Sequence
  Description of Artificial Sequence: Synthetic polypeptide
QENEIGTTNPVATECYGQKVSECLQHEELD

SEQ ID NO: 140385 - protein, 36 aa, Artificial Sequence
  Description of Artificial Sequence: Synthetic polypeptide
DEMEIRTTNPVATEQYGSVASPTDLGLERNDENVMF

SEQ ID NO: 140386 - protein, 37 aa, Artificial Sequence
  Description of Artificial Sequence: Synthetic polypeptide
AEEEIRTTNPVATEQYGSVSTVVNNLNQQGTTQQAED

SEQ ID NO: 140387 - protein, 33 aa, Artificial Sequence
  Description of Artificial Sequence: Synthetic polypeptide
QEEEIATTNPVATEQYGEVSCINEPQDHEEENK

SEQ ID NO: 140388 - protein, 29 aa, Artificial Sequence
  Description of Artificial Sequence: Synthetic peptide
QENEIRTTNPVATEQWGEASEICQNAEEK

SEQ ID NO: 140389 - protein, 36 aa, Artificial Sequence
  Description of Artificial Sequence: Synthetic polypeptide
AEEEIRTTNPVATEQYGSVSTVVNNGNNDEGNNNSD

SEQ ID NO: 140390 - protein, 34 aa, Artificial Sequence
  Description of Artificial Sequence: Synthetic polypeptide
DEEEIRTTNPVATEQYGSVHVMMNTEVIALEVGE

SEQ ID NO: 140391 - protein, 36 aa, Artificial Sequence
  Description of Artificial Sequence: Synthetic polypeptide
DEEEIRTTNPVATEQYGSVIQPFNLVHQPEQQLSNL

SEQ ID NO: 140392 - protein, 33 aa, Artificial Sequence
  Description of Artificial Sequence: Synthetic polypeptide
DAAEIATTNPVAYEQYGSVAATNLQNPMGTDAQ

SEQ ID NO: 140393 - protein, 29 aa, Artificial Sequence
  Description of Artificial Sequence: Synthetic peptide
QENEIRTTNPVATEQWGDVSEIEMAAEDA

SEQ ID NO: 140394 - protein, 36 aa, Artificial Sequence
  Description of Artificial Sequence: Synthetic polypeptide
DEEEIRTTNPVATEQYGSMSSTTPAGPNMRNGDNPV

SEQ ID NO: 140395 - protein, 35 aa, Artificial Sequence
  Description of Artificial Sequence: Synthetic polypeptide
DDEEIRATNPVATEQYGSVVDLTDLQARNGGQGEG

SEQ ID NO: 140396 - protein, 35 aa, Artificial Sequence
  Description of Artificial Sequence: Synthetic polypeptide
DDEEIRATNPVATEQYGSVVDLNNLQARNGGQGEI

SEQ ID NO: 140397 - protein, 35 aa, Artificial Sequence
  Description of Artificial Sequence: Synthetic polypeptide
DEMEIRTTNPVATEQYGSFCTYVLNDERAMGDENP

SEQ ID NO: 140398 - protein, 28 aa, Artificial Sequence
  Description of Artificial Sequence: Synthetic peptide
QENEIATTNPVATEQYGDAPEVCQHEEK

SEQ ID NO: 140399 - protein, 35 aa, Artificial Sequence
  Description of Artificial Sequence: Synthetic polypeptide
DEEEIRTTNPVATEQYGSVIEPHHSSHQRELNEVE

SEQ ID NO: 140400 - protein, 34 aa, Artificial Sequence
  Description of Artificial Sequence: Synthetic polypeptide
DEMEIRTTNPVATEQYGSCWSTYGNNEDIDLNQP

SEQ ID NO: 140401 - protein, 30 aa, Artificial Sequence
  Description of Artificial Sequence: Synthetic polypeptide
QENEIRTTNPVATEQWGDVSEIEMNAAGDA

SEQ ID NO: 140402 - protein, 38 aa, Artificial Sequence
  Description of Artificial Sequence: Synthetic polypeptide
DEEEIRTTNPVATEQYGVVSTVVTNLQQLQQGTEGENE

SEQ ID NO: 140403 - protein, 37 aa, Artificial Sequence
  Description of Artificial Sequence: Synthetic polypeptide
DEEEIRTTNPVATEQYGSVHTNEGVEEQQRMMVEVRY

SEQ ID NO: 140404 - protein, 34 aa, Artificial Sequence
  Description of Artificial Sequence: Synthetic polypeptide
DDEEIRCTNPVATEQYGCVCSTNTNQENSGSQQA

SEQ ID NO: 140405 - protein, 35 aa, Artificial Sequence
  Description of Artificial Sequence: Synthetic polypeptide
DEEEIRTTNPVATEQYGSVIEPAWLHMRNNNVVND

SEQ ID NO: 140406 - protein, 37 aa, Artificial Sequence
  Description of Artificial Sequence: Synthetic polypeptide
DEEEIRTTNPVATEQYGVVSTVVTNLEQGTEQGEETE

SEQ ID NO: 140407 - protein, 35 aa, Artificial Sequence
  Description of Artificial Sequence: Synthetic polypeptide
DEEEIRTTNPVATEQYGSVIENSNAVIQETLENDS

SEQ ID NO: 140408 - protein, 36 aa, Artificial Sequence
  Description of Artificial Sequence: Synthetic polypeptide
DDEEIRATNPVATEQYGSVVDLTDNLQARNGDGQGE

SEQ ID NO: 140409 - protein, 35 aa, Artificial Sequence
  Description of Artificial Sequence: Synthetic polypeptide
DEEEIRTTNPVATEQYGSVIELPTNIPTVVEEQRV

SEQ ID NO: 140410 - protein, 34 aa, Artificial Sequence
  Description of Artificial Sequence: Synthetic polypeptide
DEEEIATTNPVATEQYGSACAANNGLVDDGNPQW

SEQ ID NO: 140411 - protein, 38 aa, Artificial Sequence
  Description of Artificial Sequence: Synthetic polypeptide
DEEEIRTTNPVATEQYGVVSTVVTNLNQLQQGTEQGNE

SEQ ID NO: 140412 - protein, 33 aa, Artificial Sequence
  Description of Artificial Sequence: Synthetic polypeptide
DEMEIRTTNPVATEQYGSIISWPNSDELGDDHQ

SEQ ID NO: 140413 - protein, 36 aa, Artificial Sequence
  Description of Artificial Sequence: Synthetic polypeptide
DEEEIRTTNPVATEQYGSMSSTTPAGPNMRNGMNPV

SEQ ID NO: 140414 - protein, 30 aa, Artificial Sequence
  Description of Artificial Sequence: Synthetic polypeptide
DAAEIATTNPVAYEQYGSVAMHGQDSGQAE

SEQ ID NO: 140415 - protein, 34 aa, Artificial Sequence
  Description of Artificial Sequence: Synthetic polypeptide
DEHEIATTNPVATEQYGSVYCGENDQDHDGKGDR

SEQ ID NO: 140416 - protein, 31 aa, Artificial Sequence
  Description of Artificial Sequence: Synthetic polypeptide
QEEEIATTNPVATEQYGVVAGPEVGQGNEED

SEQ ID NO: 140417 - protein, 36 aa, Artificial Sequence
  Description of Artificial Sequence: Synthetic polypeptide
DDEEIRATNPVATEQYGSVVDTQNNLQARNGGQTGQ

SEQ ID NO: 140418 - protein, 34 aa, Artificial Sequence
  Description of Artificial Sequence: Synthetic polypeptide
DEEEIRTTNPVATEQYGSVIHVIVAENEQQQEEG

SEQ ID NO: 140419 - protein, 28 aa, Artificial Sequence
  Description of Artificial Sequence: Synthetic peptide
QENEIATTNPVATEQYGDAPEVCQHEEL

SEQ ID NO: 140420 - protein, 37 aa, Artificial Sequence
  Description of Artificial Sequence: Synthetic polypeptide
DEEEIRTTNPVATEQYGVVSTNQQQQNGNNQQGTVED

SEQ ID NO: 140421 - protein, 34 aa, Artificial Sequence
  Description of Artificial Sequence: Synthetic polypeptide
DEMEIRTTNPVATEQYGSFVTTYVDLEREDVQMD

SEQ ID NO: 140422 - protein, 38 aa, Artificial Sequence
  Description of Artificial Sequence: Synthetic polypeptide
DEEEIRTTNPVATEQYGVVSTVVTNLNQQEIGTNEQGQ

SEQ ID NO: 140423 - protein, 34 aa, Artificial Sequence
  Description of Artificial Sequence: Synthetic polypeptide
DEAEIATTNPVATEQYGSVCAGMNDGDTDGGENR

SEQ ID NO: 140424 - protein, 29 aa, Artificial Sequence
  Description of Artificial Sequence: Synthetic peptide
QENEIRTTNPVATEQWGDVSEIEMNHEEA

SEQ ID NO: 140425 - protein, 34 aa, Artificial Sequence
  Description of Artificial Sequence: Synthetic polypeptide
DAAEIATTNPVATEQYGSVCATNPMQQRNQNQTV

SEQ ID NO: 140426 - protein, 35 aa, Artificial Sequence
  Description of Artificial Sequence: Synthetic polypeptide
DDEEIKTTNPVATEQYGSVVSDDQNLQAGEGQGEQ

SEQ ID NO: 140427 - protein, 28 aa, Artificial Sequence
  Description of Artificial Sequence: Synthetic peptide
QENEIATTNPVATEQYGDAPEVCQHEDK

SEQ ID NO: 140428 - protein, 36 aa, Artificial Sequence
  Description of Artificial Sequence: Synthetic polypeptide
DEEEIRTTNPVATEQYGSVIQPFNLVIQPEQQTENT

SEQ ID NO: 140429 - protein, 35 aa, Artificial Sequence
  Description of Artificial Sequence: Synthetic polypeptide
DEMEIRTTNPVATEQYGSVSTLDYLTNTMSTQNDG

SEQ ID NO: 140430 - protein, 36 aa, Artificial Sequence
  Description of Artificial Sequence: Synthetic polypeptide
DEEEIRTTNPVATEQYGVVDFDTNEMGQEGEDNQEF

SEQ ID NO: 140431 - protein, 37 aa, Artificial Sequence
  Description of Artificial Sequence: Synthetic polypeptide
AEEEIRTTNPVATEQYGSVVTTVTNNLQAGTTEGNSE

SEQ ID NO: 140432 - protein, 29 aa, Artificial Sequence
  Description of Artificial Sequence: Synthetic peptide
QENEIATTNPVATEQWGDVSEIEQNAEDA

SEQ ID NO: 140433 - protein, 36 aa, Artificial Sequence
  Description of Artificial Sequence: Synthetic polypeptide
DEEEIRTTNPVATEQYGSSSSTTPAGPNMRNGMNPV

SEQ ID NO: 140434 - protein, 38 aa, Artificial Sequence
  Description of Artificial Sequence: Synthetic polypeptide
DEEEIRTTNPVATEQYGVVSTNLQAGTEQGTTNEETTE

SEQ ID NO: 140435 - protein, 37 aa, Artificial Sequence
  Description of Artificial Sequence: Synthetic polypeptide
DEEEIRTTNPVATEQYGSVHSTTPAGPNMRNGMNPVL

SEQ ID NO: 140436 - protein, 36 aa, Artificial Sequence
  Description of Artificial Sequence: Synthetic polypeptide
DEEEIRTTNPVATEQYGVVSTNVATEQYGSTQQQDE

SEQ ID NO: 140437 - protein, 36 aa, Artificial Sequence
  Description of Artificial Sequence: Synthetic polypeptide
DEEEIRTTNPVATEQYGSSSSTTPAFPNMRNGMNPV

SEQ ID NO: 140438 - protein, 37 aa, Artificial Sequence
  Description of Artificial Sequence: Synthetic polypeptide
DEEEIRTTNPVATEQYGVVSTNVATEQYGSVTQNDQT

SEQ ID NO: 140439 - protein, 30 aa, Artificial Sequence
  Description of Artificial Sequence: Synthetic polypeptide
QENEIRTTNPVATEQWGDVSEVEQNAAEDK

SEQ ID NO: 140440 - protein, 28 aa, Artificial Sequence
  Description of Artificial Sequence: Synthetic peptide
QENEIATTNPVATEQYGEAWEVCQHEEK

SEQ ID NO: 140441 - protein, 29 aa, Artificial Sequence
  Description of Artificial Sequence: Synthetic peptide
QEEEIATTNPVATEQYWGEAPEVGQHEEK

SEQ ID NO: 140442 - protein, 36 aa, Artificial Sequence
  Description of Artificial Sequence: Synthetic polypeptide
DEEEIRTTNPVATEQYGVVSTNVATEQYGSTDQQQD

SEQ ID NO: 140443 - protein, 36 aa, Artificial Sequence
  Description of Artificial Sequence: Synthetic polypeptide
DEEEIRTTNPVATEQYGSSSSTTPFGPNMRNGMNPV

SEQ ID NO: 140444 - protein, 28 aa, Artificial Sequence
  Description of Artificial Sequence: Synthetic peptide
QENEIATTNPVGTECYGVVAETLQHEDI

SEQ ID NO: 140445 - protein, 30 aa, Artificial Sequence
  Description of Artificial Sequence: Synthetic polypeptide
QENEIATTNPVATEQWGDVSSIEQNHAGDA

SEQ ID NO: 140446 - protein, 28 aa, Artificial Sequence
  Description of Artificial Sequence: Synthetic peptide
QENEIATTNPVATEQYGDAPECCQHEEL

SEQ ID NO: 140447 - protein, 36 aa, Artificial Sequence
  Description of Artificial Sequence: Synthetic polypeptide
DEEEIRTTNPVATEQYGSMSSTTIAGPNMRNGMNPV

SEQ ID NO: 140448 - protein, 35 aa, Artificial Sequence
  Description of Artificial Sequence: Synthetic polypeptide
DEEEIATTNPVATEQYGSACAANNLPQDSDGNDHH

SEQ ID NO: 140449 - protein, 35 aa, Artificial Sequence
  Description of Artificial Sequence: Synthetic polypeptide
DEEEIRTTNPVATEQYGSVIEPHPGSHHQRENEVE

SEQ ID NO: 140450 - protein, 35 aa, Artificial Sequence
  Description of Artificial Sequence: Synthetic polypeptide
DEEEIRTTNPVATEQYGVVQSITGMGEGNDDEQED

SEQ ID NO: 140451 - protein, 34 aa, Artificial Sequence
  Description of Artificial Sequence: Synthetic polypeptide
DAAEIATTNPVATEQYGSVCSDGTGNEAAGGNNE

SEQ ID NO: 140452 - protein, 33 aa, Artificial Sequence
  Description of Artificial Sequence: Synthetic polypeptide
DEMEIRTTNPVATEQYGSCTPMNWLENRSEDQE

SEQ ID NO: 140453 - protein, 30 aa, Artificial Sequence
  Description of Artificial Sequence: Synthetic polypeptide
QENEIRTTNPVATEQWGDVSEILMNHAEDA

SEQ ID NO: 140454 - protein, 35 aa, Artificial Sequence
  Description of Artificial Sequence: Synthetic polypeptide
DEMEIRTTNPVATEQYGSVSTISMEELRNSQNEHF

SEQ ID NO: 140455 - protein, 36 aa, Artificial Sequence
  Description of Artificial Sequence: Synthetic polypeptide
DDEEIKTTNPVATEQYGSVVSDDQNLQQGEDGGNGQ

SEQ ID NO: 140456 - protein, 36 aa, Artificial Sequence
  Description of Artificial Sequence: Synthetic polypeptide
DEEEIRTTNPVATEQYGSVIHTIVAENEEQQSGVEG

SEQ ID NO: 140457 - protein, 35 aa, Artificial Sequence
  Description of Artificial Sequence: Synthetic polypeptide
QEEEIATTNPVATEQYGSVSANPLPIEAGEENNEN

SEQ ID NO: 140458 - protein, 38 aa, Artificial Sequence
  Description of Artificial Sequence: Synthetic polypeptide
DEEEIRTTNPVATEQYGVVSTVVTNLQNNQAGNNNEGS

SEQ ID NO: 140459 - protein, 30 aa, Artificial Sequence
  Description of Artificial Sequence: Synthetic polypeptide
QENEIATTNPVATEQYGEASEEVIQQQGEH

SEQ ID NO: 140460 - protein, 34 aa, Artificial Sequence
  Description of Artificial Sequence: Synthetic polypeptide
DEHEIATTNPVATEQYGSCAAATNVQDDPENGRN

SEQ ID NO: 140461 - protein, 28 aa, Artificial Sequence
  Description of Artificial Sequence: Synthetic peptide
QENEIATTNPVGTECYGVVAETLQHEEI

SEQ ID NO: 140462 - protein, 35 aa, Artificial Sequence
  Description of Artificial Sequence: Synthetic polypeptide
DEMEIRTTNPVATEQYGSLLTMTNENQQEGNFEIA

SEQ ID NO: 140463 - protein, 32 aa, Artificial Sequence
  Description of Artificial Sequence: Synthetic polypeptide
QENEIATTNPVATEQYGDVCSAEDGPQHEGNL

SEQ ID NO: 140464 - protein, 29 aa, Artificial Sequence
  Description of Artificial Sequence: Synthetic peptide
QEEEIATTNPVATEQYGVIAPEVDQNEEE

SEQ ID NO: 140465 - protein, 34 aa, Artificial Sequence
  Description of Artificial Sequence: Synthetic polypeptide
DDEEIRCTNPVATEQYGCVCSTNHQEYSGSQTQA

SEQ ID NO: 140466 - protein, 35 aa, Artificial Sequence
  Description of Artificial Sequence: Synthetic polypeptide
DEEEIRTTNPVATEQYGVVDTDNGDETQGEGQEGE

SEQ ID NO: 140467 - protein, 34 aa, Artificial Sequence
  Description of Artificial Sequence: Synthetic polypeptide
DEGSIIRTTNPVATECWGSVSCINEPQDREGENG

SEQ ID NO: 140468 - protein, 34 aa, Artificial Sequence
  Description of Artificial Sequence: Synthetic polypeptide
DEEEIRTTNPVATEQYGSVHTYMGLGETAEELEH

SEQ ID NO: 140469 - protein, 34 aa, Artificial Sequence
  Description of Artificial Sequence: Synthetic polypeptide
DEMEIRTTNPVATEQYGSVCSDAWENTQEWQEHT

SEQ ID NO: 140470 - protein, 37 aa, Artificial Sequence
  Description of Artificial Sequence: Synthetic polypeptide
DEEEIRTTNPVATEQYGSMVSSTTPAGPNMRNGMNPV

SEQ ID NO: 140471 - protein, 29 aa, Artificial Sequence
  Description of Artificial Sequence: Synthetic peptide
QENEIATTNPVATEQYGDVPEVEQNHEDK

SEQ ID NO: 140472 - protein, 35 aa, Artificial Sequence
  Description of Artificial Sequence: Synthetic polypeptide
DEMEIRTTNPVATEQYGSVSPTVLHTNIEWSEENM

SEQ ID NO: 140473 - protein, 34 aa, Artificial Sequence
  Description of Artificial Sequence: Synthetic polypeptide
DEEEIRTTNPVATEQYGVVMGTNDNGGGDDEEGG

SEQ ID NO: 140474 - protein, 38 aa, Artificial Sequence
  Description of Artificial Sequence: Synthetic polypeptide
DEEEIRTTNPVATEQYGVVSTNLQQGGNNNNEQGEEQQ

SEQ ID NO: 140475 - protein, 29 aa, Artificial Sequence
  Description of Artificial Sequence: Synthetic peptide
QENEIATTNPVATEQYGDVPEVCQNHEDK

SEQ ID NO: 140476 - protein, 34 aa, Artificial Sequence
  Description of Artificial Sequence: Synthetic polypeptide
DEEEIRTTNPVATEQYGVVMGTNDNGGGDDEIEL

SEQ ID NO: 140477 - protein, 32 aa, Artificial Sequence
  Description of Artificial Sequence: Synthetic polypeptide
QENEIRTTNPVATECYGDVSSTCLNRNEMEPL

SEQ ID NO: 140478 - protein, 34 aa, Artificial Sequence
  Description of Artificial Sequence: Synthetic polypeptide
DEEEIRTTNPVATEQYGSVHTYDKHSDERPMSSF

SEQ ID NO: 140479 - protein, 34 aa, Artificial Sequence
  Description of Artificial Sequence: Synthetic polypeptide
DEEEIRTTNPVATEQYGVVMGTNDNEEGGDDEFE

SEQ ID NO: 140480 - protein, 34 aa, Artificial Sequence
  Description of Artificial Sequence: Synthetic polypeptide
DAAEIATTNPVAYEQYGSVCSVNLQDSMGDNAEM

SEQ ID NO: 140481 - protein, 34 aa, Artificial Sequence
  Description of Artificial Sequence: Synthetic polypeptide
DEMEIRTTNPVATEQYGSITVTMIQQGNGNNIIE

SEQ ID NO: 140482 - protein, 36 aa, Artificial Sequence
  Description of Artificial Sequence: Synthetic polypeptide
DEEEIRTTNPVATEQYGSVHVENSLEQVQPGVPEDQ

SEQ ID NO: 140483 - protein, 34 aa, Artificial Sequence
  Description of Artificial Sequence: Synthetic polypeptide
DEEEIATTNPVATEQYGEASSTPAGPNMRNGMNV

SEQ ID NO: 140484 - protein, 36 aa, Artificial Sequence
  Description of Artificial Sequence: Synthetic polypeptide
DEEEIGTTNPVATEQYGCVCSTNDHNQENFGSNNLA

SEQ ID NO: 140485 - protein, 36 aa, Artificial Sequence
  Description of Artificial Sequence: Synthetic polypeptide
AEEEIRTTNPVATEQYGSVSTVVNNEQGTNNNNEAN

SEQ ID NO: 140486 - protein, 35 aa, Artificial Sequence
  Description of Artificial Sequence: Synthetic polypeptide
DEEEIRTTNPVATEQYGSVIDPPSLQQNTEVPVRL

SEQ ID NO: 140487 - protein, 28 aa, Artificial Sequence
  Description of Artificial Sequence: Synthetic peptide
QENEIATTNPVATEQYGEAPEVCQHEDK

SEQ ID NO: 140488 - protein, 37 aa, Artificial Sequence
  Description of Artificial Sequence: Synthetic polypeptide
DEEEIRTTNPVATEQYGSVHVEPNSLEQVQPGVPERD

SEQ ID NO: 140489 - protein, 36 aa, Artificial Sequence
  Description of Artificial Sequence: Synthetic polypeptide
DEMEIRTTNPVATEQYGSVSPTYGPLAEQGGDQVEK

SEQ ID NO: 140490 - protein, 29 aa, Artificial Sequence
  Description of Artificial Sequence: Synthetic peptide
QENEIATTNPVGTEGYGTMASETLQHGDI

SEQ ID NO: 140491 - protein, 34 aa, Artificial Sequence
  Description of Artificial Sequence: Synthetic polypeptide
DEMEIRTTNPVATEQYGSVSTEGYTQEETQDTHN

SEQ ID NO: 140492 - protein, 34 aa, Artificial Sequence
  Description of Artificial Sequence: Synthetic polypeptide
DEEEIGTTNPVATEQYGCVCSTGEHDQGFGSEQS

SEQ ID NO: 140493 - protein, 35 aa, Artificial Sequence
  Description of Artificial Sequence: Synthetic polypeptide
DEMEIRTTNPVATEQYGSIVSWPNCSDEYGIDINQ

SEQ ID NO: 140494 - protein, 34 aa, Artificial Sequence
  Description of Artificial Sequence: Synthetic polypeptide
DAAEIATTNPVATEQYGSVAATANLNQDSENHNN

SEQ ID NO: 140495 - protein, 37 aa, Artificial Sequence
  Description of Artificial Sequence: Synthetic polypeptide
DEEEIRTTNPVATEQYGSMVSSTTPAGPNMRNGMNTV

SEQ ID NO: 140496 - protein, 37 aa, Artificial Sequence
  Description of Artificial Sequence: Synthetic polypeptide
DEEEIRTTNPVATEQYGSVIDPTMQKVQVRVGQVFRN

SEQ ID NO: 140497 - protein, 36 aa, Artificial Sequence
  Description of Artificial Sequence: Synthetic polypeptide
DEEEIRTTNPVATEQYGSVHVENSLEQVQPPVPERV

SEQ ID NO: 140498 - protein, 36 aa, Artificial Sequence
  Description of Artificial Sequence: Synthetic polypeptide
DEEEIRTTNPVATEQYGVVMGVTDNFNEQDIGNEMT

SEQ ID NO: 140499 - protein, 36 aa, Artificial Sequence
  Description of Artificial Sequence: Synthetic polypeptide
DEEEIKTTNPVATEQYGNVSGTDQNNGQGGNDDGQT

SEQ ID NO: 140500 - protein, 38 aa, Artificial Sequence
  Description of Artificial Sequence: Synthetic polypeptide
DEEEIRTTNPVATEQYGVVSTNNNTNLQQGNNDEDEDT

SEQ ID NO: 140501 - protein, 38 aa, Artificial Sequence
  Description of Artificial Sequence: Synthetic polypeptide
DEEEIRTTNPVATEQYGVVSTVVTNLQQGTEQGTNQQQ

SEQ ID NO: 140502 - protein, 33 aa, Artificial Sequence
  Description of Artificial Sequence: Synthetic polypeptide
DEAEIATTNPVATEQYGTVCSATDGKVEFEGND

SEQ ID NO: 140503 - protein, 38 aa, Artificial Sequence
  Description of Artificial Sequence: Synthetic polypeptide
DEEEIRTTNPVATEQYGVVSTVVTNLNQGNIGNNEQGQ

SEQ ID NO: 140504 - protein, 33 aa, Artificial Sequence
  Description of Artificial Sequence: Synthetic polypeptide
DEGQIRCTNPVATEQYGVSVSTLESELRGQDTP

SEQ ID NO: 140505 - protein, 37 aa, Artificial Sequence
  Description of Artificial Sequence: Synthetic polypeptide
DEEEIRTTNPVATEQYGVVSTVVTNLQQGTESGEDTE

SEQ ID NO: 140506 - protein, 36 aa, Artificial Sequence
  Description of Artificial Sequence: Synthetic polypeptide
DEMEIRTTNPVATEQYGSVSTGNDDLQQLEDEEDKF

SEQ ID NO: 140507 - protein, 34 aa, Artificial Sequence
  Description of Artificial Sequence: Synthetic polypeptide
DEEEIRTTNPVATEQYGSVIIAVTEIEETPGQPF

SEQ ID NO: 140508 - protein, 29 aa, Artificial Sequence
  Description of Artificial Sequence: Synthetic peptide
QEEEIATTNPVATEQYGVACPEVGQSEQK

SEQ ID NO: 140509 - protein, 37 aa, Artificial Sequence
  Description of Artificial Sequence: Synthetic polypeptide
AEEEIRTTNPVATEQYGSVVTVANLGNQQGETGTNVE

SEQ ID NO: 140510 - protein, 38 aa, Artificial Sequence
  Description of Artificial Sequence: Synthetic polypeptide
DEEEIRTTNPVATEQYGVVSTVVTNLQQLGNQDEENTD

SEQ ID NO: 140511 - protein, 35 aa, Artificial Sequence
  Description of Artificial Sequence: Synthetic polypeptide
DEEEIRTTNPVATEQYGVVDQTNGLGEEEQEDEGQ

SEQ ID NO: 140512 - protein, 33 aa, Artificial Sequence
  Description of Artificial Sequence: Synthetic polypeptide
DEEEIATTNPVATEQYGSACAANNGDQTDNDNN

SEQ ID NO: 140513 - protein, 35 aa, Artificial Sequence
  Description of Artificial Sequence: Synthetic polypeptide
DEEEIRTTNPVATEQYGSNVPILNGENRQGSEEPP

SEQ ID NO: 140514 - protein, 36 aa, Artificial Sequence
  Description of Artificial Sequence: Synthetic polypeptide
DEEEIKTTNPVATEQYGIAVVPSTNLSDPQVGSPAV

SEQ ID NO: 140515 - protein, 33 aa, Artificial Sequence
  Description of Artificial Sequence: Synthetic polypeptide
DEGQIATTNPVATEQWGCVATNNLEQGMGVNDM

SEQ ID NO: 140516 - protein, 36 aa, Artificial Sequence
  Description of Artificial Sequence: Synthetic polypeptide
AEEEIRTTNPVATEQYGSVSTVVNNDEQGSTEENSD

SEQ ID NO: 140517 - protein, 35 aa, Artificial Sequence
  Description of Artificial Sequence: Synthetic polypeptide
DEEEIRTTNPVATEQYGVVNVTDGFGQNNDGNNEM

SEQ ID NO: 140518 - protein, 35 aa, Artificial Sequence
  Description of Artificial Sequence: Synthetic polypeptide
DEHEIATTNPVATEQYGSVAITDNQDDQRQGGGTE

SEQ ID NO: 140519 - protein, 30 aa, Artificial Sequence
  Description of Artificial Sequence: Synthetic polypeptide
QEEEIATTNPVATEQYGTVPTDVCVEHEEK

SEQ ID NO: 140520 - protein, 29 aa, Artificial Sequence
  Description of Artificial Sequence: Synthetic peptide
QEEEIATTNPVATEQYGEYPWEDQHNEQS

SEQ ID NO: 140521 - protein, 34 aa, Artificial Sequence
  Description of Artificial Sequence: Synthetic polypeptide
DEEEIATTNPVATEQYGSACAAANNLDEAGENVN

SEQ ID NO: 140522 - protein, 38 aa, Artificial Sequence
  Description of Artificial Sequence: Synthetic polypeptide
DEEEIRTTNPVATEQYGVVSTVVTNLGGNQIGNNEQGT

SEQ ID NO: 140523 - protein, 28 aa, Artificial Sequence
  Description of Artificial Sequence: Synthetic peptide
QENEIATTNPVATEQYGEAPEVCQHEEK

SEQ ID NO: 140524 - protein, 38 aa, Artificial Sequence
  Description of Artificial Sequence: Synthetic polypeptide
DEEEIRTTNPVATEQYGVVSTVVTNLQQGTEQGTNQTN

SEQ ID NO: 140525 - protein, 33 aa, Artificial Sequence
  Description of Artificial Sequence: Synthetic polypeptide
DEAEIATTNPVATEQYGTVCSANDGPVEAEGND

SEQ ID NO: 140526 - protein, 36 aa, Artificial Sequence
  Description of Artificial Sequence: Synthetic polypeptide
DEMEIRTTNPVATEQYGSVCSPEDQLEERQGGDERI

SEQ ID NO: 140527 - protein, 28 aa, Artificial Sequence
  Description of Artificial Sequence: Synthetic peptide
QENEIATTNPVATEQYGEAPEVCQHEEL

SEQ ID NO: 140528 - protein, 37 aa, Artificial Sequence
  Description of Artificial Sequence: Synthetic polypeptide
DEEEIRTTNPVATEQYGSVIPVSTVVPNTPVQNVNTN

SEQ ID NO: 140529 - protein, 35 aa, Artificial Sequence
  Description of Artificial Sequence: Synthetic polypeptide
DEEEIRTTNPVATEQYGVVMTGTDQLIQGGGGEGG

SEQ ID NO: 140530 - protein, 34 aa, Artificial Sequence
  Description of Artificial Sequence: Synthetic polypeptide
DEAEIATTNPVATEQYGSVCAAMNHGLTMPGEER

SEQ ID NO: 140531 - protein, 35 aa, Artificial Sequence
  Description of Artificial Sequence: Synthetic polypeptide
DEAEIATTNPVATEQYGSVVSGAANLGGEDTGNTL

SEQ ID NO: 140532 - protein, 34 aa, Artificial Sequence
  Description of Artificial Sequence: Synthetic polypeptide
DDEEIKTTNPVATEQYGSVSTMGIEEGQGGGEEQ

SEQ ID NO: 140533 - protein, 36 aa, Artificial Sequence
  Description of Artificial Sequence: Synthetic polypeptide
DEMEIRTTNPVATEQYGSVCSPNKLHQHRSQEESFD

SEQ ID NO: 140534 - protein, 33 aa, Artificial Sequence
  Description of Artificial Sequence: Synthetic polypeptide
DEMEIRTTNPVATEQYGSVCSQSAIATENVVLI

SEQ ID NO: 140535 - protein, 36 aa, Artificial Sequence
  Description of Artificial Sequence: Synthetic polypeptide
DEEEIRTTNPVATEQYGSVIPVSPVHTNTPQNEIVG

SEQ ID NO: 140536 - protein, 31 aa, Artificial Sequence
  Description of Artificial Sequence: Synthetic polypeptide
DAAEIACTNPVATEQWGGCSATGGQSRDGNN

SEQ ID NO: 140537 - protein, 29 aa, Artificial Sequence
  Description of Artificial Sequence: Synthetic peptide
QEEEIATTNPVATEQYGETCPEVCQHEEK

SEQ ID NO: 140538 - protein, 35 aa, Artificial Sequence
  Description of Artificial Sequence: Synthetic polypeptide
DEEEIRTTNPVATEQYGSVIGPTVEIIERQNQPQG

SEQ ID NO: 140539 - protein, 38 aa, Artificial Sequence
  Description of Artificial Sequence: Synthetic polypeptide
DEEEIRTTNPVATEQYGVVSTVVTNLQAGNQQGTEDTE

SEQ ID NO: 140540 - protein, 30 aa, Artificial Sequence
  Description of Artificial Sequence: Synthetic polypeptide
QENEIATTNPVATESYGCVSGEALQHDDEM

SEQ ID NO: 140541 - protein, 35 aa, Artificial Sequence
  Description of Artificial Sequence: Synthetic polypeptide
DEMEIRTTNPVATEQYGSVSTTIMEELRNSQFEVF

SEQ ID NO: 140542 - protein, 38 aa, Artificial Sequence
  Description of Artificial Sequence: Synthetic polypeptide
DEEEIRTTNPVATEQYGVVSTTNLQQGNQQGTTEQGQE

SEQ ID NO: 140543 - protein, 30 aa, Artificial Sequence
  Description of Artificial Sequence: Synthetic polypeptide
QEQEIAPTNPCSYEQWGQVSCNLQSGDTNR

SEQ ID NO: 140544 - protein, 30 aa, Artificial Sequence
  Description of Artificial Sequence: Synthetic polypeptide
DEHEIATTNPVATAQWGCVATALTAADGDD

SEQ ID NO: 140545 - protein, 36 aa, Artificial Sequence
  Description of Artificial Sequence: Synthetic polypeptide
DEEEIRTTNPVATEQYGSTTSSTAPAWNMRKGMNPV

SEQ ID NO: 140546 - protein, 36 aa, Artificial Sequence
  Description of Artificial Sequence: Synthetic polypeptide
DEEEIRTTNPVATEQYGVVSSTTPAGPNMSNGMNPV

SEQ ID NO: 140547 - protein, 37 aa, Artificial Sequence
  Description of Artificial Sequence: Synthetic polypeptide
AEEEIRTTNPVATEQYGSVVTTTNNNLQGTEGGNNTD

SEQ ID NO: 140548 - protein, 34 aa, Artificial Sequence
  Description of Artificial Sequence: Synthetic polypeptide
CTGEIRTTNPVATEQYGSVSTQNNGQSDGEMEGD

SEQ ID NO: 140549 - protein, 34 aa, Artificial Sequence
  Description of Artificial Sequence: Synthetic polypeptide
DEAEIATTNPVATEQYGSVCSTTDLNEDHFGETL

SEQ ID NO: 140550 - protein, 38 aa, Artificial Sequence
  Description of Artificial Sequence: Synthetic polypeptide
DEEEIRTTNPVATEQYGVVSTVVTNLQAGNQQGTEDED

SEQ ID NO: 140551 - protein, 30 aa, Artificial Sequence
  Description of Artificial Sequence: Synthetic polypeptide
QENEIATTNPVATEYYGCVCSWELQHDELA

SEQ ID NO: 140552 - protein, 30 aa, Artificial Sequence
  Description of Artificial Sequence: Synthetic polypeptide
QEEEIATTNPVATEQYGSAPCIVCQDHEEG

SEQ ID NO: 140553 - protein, 28 aa, Artificial Sequence
  Description of Artificial Sequence: Synthetic peptide
QEEEIATTNPVAYEQYGEAAEACQHEEK

SEQ ID NO: 140554 - protein, 31 aa, Artificial Sequence
  Description of Artificial Sequence: Synthetic polypeptide
DEHEIATTNPVATAQWGCVATALTADGDNDM

SEQ ID NO: 140555 - protein, 37 aa, Artificial Sequence
  Description of Artificial Sequence: Synthetic polypeptide
DEEEIRTTNPVATEQYGSQSQPTPAGPNEQNGLNDVV

SEQ ID NO: 140556 - protein, 35 aa, Artificial Sequence
  Description of Artificial Sequence: Synthetic polypeptide
DEEEIRTTNPVATEQYGSLPPTNIGLNVFGQAQGE

SEQ ID NO: 140557 - protein, 29 aa, Artificial Sequence
  Description of Artificial Sequence: Synthetic peptide
QENEIATTNPVATESYGVVSNALNHEELM

SEQ ID NO: 140558 - protein, 29 aa, Artificial Sequence
  Description of Artificial Sequence: Synthetic peptide
QEEEIATTNPVATEQYGECAPEVCQHEEK

SEQ ID NO: 140559 - protein, 36 aa, Artificial Sequence
  Description of Artificial Sequence: Synthetic polypeptide
DEEEIHTTNPVATEQYGSVSSTTPAGPNMRNGMNPM

SEQ ID NO: 140560 - protein, 30 aa, Artificial Sequence
  Description of Artificial Sequence: Synthetic polypeptide
QEQEIAPTNPCSSEQYGQVSCNLQSGGTDR

SEQ ID NO: 140561 - protein, 35 aa, Artificial Sequence
  Description of Artificial Sequence: Synthetic polypeptide
DEEEIRTTNPVATEQYGSQSTMMMMEEHRQEVNLV

SEQ ID NO: 140562 - protein, 33 aa, Artificial Sequence
  Description of Artificial Sequence: Synthetic polypeptide
DEEEIATTNPVATEQYGCVCSTEEHANFNSNQD

SEQ ID NO: 140563 - protein, 28 aa, Artificial Sequence
  Description of Artificial Sequence: Synthetic peptide
QEEEIATTNPVAYEQYGEAPEVHQHEED

SEQ ID NO: 140564 - protein, 30 aa, Artificial Sequence
  Description of Artificial Sequence: Synthetic polypeptide
QENEIATTNPVATECYGVVSEHLNQNHEEL

SEQ ID NO: 140565 - protein, 34 aa, Artificial Sequence
  Description of Artificial Sequence: Synthetic polypeptide
DEMEIRTTNPVATEQYGCVSVTYEPEVTGEQMNE

SEQ ID NO: 140566 - protein, 35 aa, Artificial Sequence
  Description of Artificial Sequence: Synthetic polypeptide
DEEEIRTTNPVATEQYGSTTSSTAPDWNMRKGPPI

SEQ ID NO: 140567 - protein, 32 aa, Artificial Sequence
  Description of Artificial Sequence: Synthetic polypeptide
QEEEIATTNPVATEQYGSASATVCEDHEGEDL

SEQ ID NO: 140568 - protein, 28 aa, Artificial Sequence
  Description of Artificial Sequence: Synthetic peptide
QEPEIATTNPVATEQYGEAPEVCQHEQK

SEQ ID NO: 140569 - protein, 29 aa, Artificial Sequence
  Description of Artificial Sequence: Synthetic peptide
QEEEIATTNPVATEQYGEIAPEVHQHEEK

SEQ ID NO: 140570 - protein, 37 aa, Artificial Sequence
  Description of Artificial Sequence: Synthetic polypeptide
DEEEIRTTNPVATEQYGVVSTVVTNQQGNQAGNNEES

SEQ ID NO: 140571 - protein, 34 aa, Artificial Sequence
  Description of Artificial Sequence: Synthetic polypeptide
DEHEIATTNPVAYEQWGEVCSTNDLQGEDGNNNS

SEQ ID NO: 140572 - protein, 29 aa, Artificial Sequence
  Description of Artificial Sequence: Synthetic peptide
QEEEIATTNPVAYEQYGEACTEVCQHEEK

SEQ ID NO: 140573 - protein, 31 aa, Artificial Sequence
  Description of Artificial Sequence: Synthetic polypeptide
QENEIATTNPVATECYGSVSSEPALQHNEEL

SEQ ID NO: 140574 - protein, 38 aa, Artificial Sequence
  Description of Artificial Sequence: Synthetic polypeptide
DEEEIRTTNPVATEQYGVVSTVVTNLQAGNQQGTEEED

SEQ ID NO: 140575 - protein, 34 aa, Artificial Sequence
  Description of Artificial Sequence: Synthetic polypeptide
DEEEIRTTNPVATEQYGSVIGPTVEIIEIGQPQI

SEQ ID NO: 140576 - protein, 35 aa, Artificial Sequence
  Description of Artificial Sequence: Synthetic polypeptide
QEEEIATTNPVATEQYGSVANANNLPQEAPGEGAR

SEQ ID NO: 140577 - protein, 34 aa, Artificial Sequence
  Description of Artificial Sequence: Synthetic polypeptide
DEMEIRTTNPVATEQYGSVPTTDTLEYSTENMQG

SEQ ID NO: 140578 - protein, 30 aa, Artificial Sequence
  Description of Artificial Sequence: Synthetic polypeptide
QENEIATTNPVATEGYGCVSWPLQHSISEL

SEQ ID NO: 140579 - protein, 29 aa, Artificial Sequence
  Description of Artificial Sequence: Synthetic peptide
QEEEIATTNPVATEQYGEAWPEVCQHEPK

SEQ ID NO: 140580 - protein, 30 aa, Artificial Sequence
  Description of Artificial Sequence: Synthetic polypeptide
QENEIATTNPVATEGYGCVSWYLQHESEQA

SEQ ID NO: 140581 - protein, 30 aa, Artificial Sequence
  Description of Artificial Sequence: Synthetic polypeptide
QENEIATTNPVATEGYGDVAAECLQHVEER

SEQ ID NO: 140582 - protein, 35 aa, Artificial Sequence
  Description of Artificial Sequence: Synthetic polypeptide
DEAEIATTNPVATEQYGSVCSWADNNQDPDGNNEA

SEQ ID NO: 140583 - protein, 28 aa, Artificial Sequence
  Description of Artificial Sequence: Synthetic peptide
QEPEIASTNPVGTEGYGVMASTLQHGDF

SEQ ID NO: 140584 - protein, 30 aa, Artificial Sequence
  Description of Artificial Sequence: Synthetic polypeptide
QENEIATTNPVATECYGTVLSVEGLQHEEQ

SEQ ID NO: 140585 - protein, 36 aa, Artificial Sequence
  Description of Artificial Sequence: Synthetic polypeptide
DEEEIRTTNPVATEQYGSTSSTTPAGPNMRNGMNPV

SEQ ID NO: 140586 - protein, 34 aa, Artificial Sequence
  Description of Artificial Sequence: Synthetic polypeptide
DEMEIRTTNPVATEQYGCVTTLLLTQFNGLQDDS

SEQ ID NO: 140587 - protein, 34 aa, Artificial Sequence
  Description of Artificial Sequence: Synthetic polypeptide
QEEEIATTNPVATEQYGSVAITSLPQDANNPTNS

SEQ ID NO: 140588 - protein, 37 aa, Artificial Sequence
  Description of Artificial Sequence: Synthetic polypeptide
AEEEIRTTNPVATEQYGSVVTTTNNLEQGTEQGNTTT

SEQ ID NO: 140589 - protein, 36 aa, Artificial Sequence
  Description of Artificial Sequence: Synthetic polypeptide
DEEEIRTTNPVATEQYGSTSSTTPAGPNMRNGMNPI

SEQ ID NO: 140590 - protein, 37 aa, Artificial Sequence
  Description of Artificial Sequence: Synthetic polypeptide
AEEEIRTTNPVATEQYGSVSTVVNQNQQGEEGNNDET

SEQ ID NO: 140591 - protein, 29 aa, Artificial Sequence
  Description of Artificial Sequence: Synthetic peptide
QEEEIATTNPVATEQYGEAYEVNQHMEEA

SEQ ID NO: 140592 - protein, 30 aa, Artificial Sequence
  Description of Artificial Sequence: Synthetic polypeptide
QENEIATTNPVATEGYGCVSWELQHFISEQ

SEQ ID NO: 140593 - protein, 35 aa, Artificial Sequence
  Description of Artificial Sequence: Synthetic polypeptide
DEAEIATTNPVATEQYGSVCSVGDDLNPDAQMGQR

SEQ ID NO: 140594 - protein, 32 aa, Artificial Sequence
  Description of Artificial Sequence: Synthetic polypeptide
DEHEIATTNPCAYEQWGMVSTNLQGDHGGDAD

SEQ ID NO: 140595 - protein, 32 aa, Artificial Sequence
  Description of Artificial Sequence: Synthetic polypeptide
DEGEIRTTNPVSTEPYGTVSMEDIQQQSNGNH

SEQ ID NO: 140596 - protein, 37 aa, Artificial Sequence
  Description of Artificial Sequence: Synthetic polypeptide
DEEEIRTTNPVATEQYGSIVSSTTPAGPNMRNGMNPV

SEQ ID NO: 140597 - protein, 29 aa, Artificial Sequence
  Description of Artificial Sequence: Synthetic peptide
QENEIATTNPVATEGYGCVSWELAHISEL

SEQ ID NO: 140598 - protein, 38 aa, Artificial Sequence
  Description of Artificial Sequence: Synthetic polypeptide
DEEEIRTTNPVATEQYGVVSTTNLQQGNQQGTTEQGTE

SEQ ID NO: 140599 - protein, 35 aa, Artificial Sequence
  Description of Artificial Sequence: Synthetic polypeptide
DEEEIRTTNPVATEQYGSVIGPTNNLNNPHEIEVT

SEQ ID NO: 140600 - protein, 36 aa, Artificial Sequence
  Description of Artificial Sequence: Synthetic polypeptide
DEEEIMTTNPVATEQYGSVSSTTPAGPNMSNGMNPV

SEQ ID NO: 140601 - protein, 31 aa, Artificial Sequence
  Description of Artificial Sequence: Synthetic polypeptide
DEGEIRTTNPVSTEPYGTVSCDIQQQQNGTH

SEQ ID NO: 140602 - protein, 29 aa, Artificial Sequence
  Description of Artificial Sequence: Synthetic peptide
QENEIATTNPVATECYGVVSEHLNHEELD

SEQ ID NO: 140603 - protein, 32 aa, Artificial Sequence
  Description of Artificial Sequence: Synthetic polypeptide
DEGEIRTTNPVSTEPYGTVSCEDIQQQSNGNH

SEQ ID NO: 140604 - protein, 32 aa, Artificial Sequence
  Description of Artificial Sequence: Synthetic polypeptide
DEHEIATTNPCAYEQWGSTVTNLQGDHGNDAD

SEQ ID NO: 140605 - protein, 34 aa, Artificial Sequence
  Description of Artificial Sequence: Synthetic polypeptide
DEMEIRTTNPVATEQYGSVSTTGEQEVELEEAQQ

SEQ ID NO: 140606 - protein, 37 aa, Artificial Sequence
  Description of Artificial Sequence: Synthetic polypeptide
DEEEIRTTNPVATEQYGSIVSSTTPAGPNMCNGMNPV

SEQ ID NO: 140607 - protein, 28 aa, Artificial Sequence
  Description of Artificial Sequence: Synthetic peptide
QEPEIATTNPVATEQYGEMPEVCQHEEK

SEQ ID NO: 140608 - protein, 30 aa, Artificial Sequence
  Description of Artificial Sequence: Synthetic polypeptide
QENEIATTNPVATESYGVVSEALQQHEELM

SEQ ID NO: 140609 - protein, 32 aa, Artificial Sequence
  Description of Artificial Sequence: Synthetic polypeptide
DEGEIRTTNPVAYEQWGYCQTLDNGIREMNNR

SEQ ID NO: 140610 - protein, 28 aa, Artificial Sequence
  Description of Artificial Sequence: Synthetic peptide
QENPIATTNPVATECYGDVAECLQHEEL

SEQ ID NO: 140611 - protein, 30 aa, Artificial Sequence
  Description of Artificial Sequence: Synthetic polypeptide
QENEIATTNPVATESYGCVSGEALPQHEEG

SEQ ID NO: 140612 - protein, 28 aa, Artificial Sequence
  Description of Artificial Sequence: Synthetic peptide
QEPEIATTNPVATEFYGDVAEGGQGEEL

SEQ ID NO: 140613 - protein, 38 aa, Artificial Sequence
  Description of Artificial Sequence: Synthetic polypeptide
DEEEIRTTNPVATEQYGVVSTVVTNLQAGNQQGTNQTN

SEQ ID NO: 140614 - protein, 31 aa, Artificial Sequence
  Description of Artificial Sequence: Synthetic polypeptide
QEEEIATTNPVATEQYGSASATVCEHEEEDL

SEQ ID NO: 140615 - protein, 38 aa, Artificial Sequence
  Description of Artificial Sequence: Synthetic polypeptide
DEEEIRTTNPVATEQYGVVSTVVTNLQAGTQNGTDEDE

SEQ ID NO: 140616 - protein, 31 aa, Artificial Sequence
  Description of Artificial Sequence: Synthetic polypeptide
DEGEIRTTNPVSSEPYGTISMENIQQQQGNH

SEQ ID NO: 140617 - protein, 28 aa, Artificial Sequence
  Description of Artificial Sequence: Synthetic peptide
QEEEIATTNPVAYEQYGEAPEVCQTEEC

SEQ ID NO: 140618 - protein, 28 aa, Artificial Sequence
  Description of Artificial Sequence: Synthetic peptide
QEPEIATTNPVATEQYGEAPEVCQHEEK

SEQ ID NO: 140619 - protein, 38 aa, Artificial Sequence
  Description of Artificial Sequence: Synthetic polypeptide
DEEEIRTTNPVATEQYGVVSTTNLQAGNNNQQGTNEDE

SEQ ID NO: 140620 - protein, 31 aa, Artificial Sequence
  Description of Artificial Sequence: Synthetic polypeptide
DEHEIATTNPVAYEPYGSVASNDQNNDDNDK

SEQ ID NO: 140621 - protein, 38 aa, Artificial Sequence
  Description of Artificial Sequence: Synthetic polypeptide
DEEEIRTTNPVATEQYGVVSTTNLAYGNNNQQGTNQDT

SEQ ID NO: 140622 - protein, 30 aa, Artificial Sequence
  Description of Artificial Sequence: Synthetic polypeptide
QENEIATTNPVATESYGCVSEANLNNHHEL

SEQ ID NO: 140623 - protein, 32 aa, Artificial Sequence
  Description of Artificial Sequence: Synthetic polypeptide
QENEIATTNPVATESYGCVSENHLQHQEDENL

SEQ ID NO: 140624 - protein, 31 aa, Artificial Sequence
  Description of Artificial Sequence: Synthetic polypeptide
DEGEIRTTNPVSTEPYGTISMDIQQQQNGNH

SEQ ID NO: 140625 - protein, 34 aa, Artificial Sequence
  Description of Artificial Sequence: Synthetic polypeptide
DEMEIRTTNPVATEQYGSVSVMYEVEQSGFESIE

SEQ ID NO: 140626 - protein, 37 aa, Artificial Sequence
  Description of Artificial Sequence: Synthetic polypeptide
DEEEIRTTNPVATEQYGSVISPPNLGVITDNQVANLN

SEQ ID NO: 140627 - protein, 35 aa, Artificial Sequence
  Description of Artificial Sequence: Synthetic polypeptide
DEAEIATTNPVATEQYGSVCATNPQLNPDDGGQRD

SEQ ID NO: 140628 - protein, 29 aa, Artificial Sequence
  Description of Artificial Sequence: Synthetic peptide
QEEEIATTNPVAYEQYGEAPEGCQHEGEK

SEQ ID NO: 140629 - protein, 34 aa, Artificial Sequence
  Description of Artificial Sequence: Synthetic polypeptide
CTGEIRTTNPVATEQYGSVSTQNNGQSEGQGGGE

SEQ ID NO: 140630 - protein, 29 aa, Artificial Sequence
  Description of Artificial Sequence: Synthetic peptide
QEEEIATTNPVATEQYGEAWNEVCQHEEK

SEQ ID NO: 140631 - protein, 37 aa, Artificial Sequence
  Description of Artificial Sequence: Synthetic polypeptide
DEEEIRTTNPVATEQYGVVSTVVTNLQAGTDEETTTD

SEQ ID NO: 140632 - protein, 30 aa, Artificial Sequence
  Description of Artificial Sequence: Synthetic polypeptide
QENEIATTNPVATECYGTVSEALQPHEEGL

SEQ ID NO: 140633 - protein, 29 aa, Artificial Sequence
  Description of Artificial Sequence: Synthetic peptide
QEEEIATTNPVATEQYGECPEVCQHELEK

SEQ ID NO: 140634 - protein, 30 aa, Artificial Sequence
  Description of Artificial Sequence: Synthetic polypeptide
QEEEIATTNPVATEQYGEAYPNEVCQHEEK

SEQ ID NO: 140635 - protein, 31 aa, Artificial Sequence
  Description of Artificial Sequence: Synthetic polypeptide
DEHEIATTNPVATAQWGCVATALTAMGNEDA

SEQ ID NO: 140636 - protein, 34 aa, Artificial Sequence
  Description of Artificial Sequence: Synthetic polypeptide
DEAEIATTNPVATEQYGSVCSPANNGQEPQNEHT

SEQ ID NO: 140637 - protein, 34 aa, Artificial Sequence
  Description of Artificial Sequence: Synthetic polypeptide
DEMEIRTTNPVATEQYGSVNTMYVDLLERDDVQM

SEQ ID NO: 140638 - protein, 33 aa, Artificial Sequence
  Description of Artificial Sequence: Synthetic polypeptide
DEMEIRTTNPVATEQYGCVSVENYTQTETDTSM

SEQ ID NO: 140639 - protein, 36 aa, Artificial Sequence
  Description of Artificial Sequence: Synthetic polypeptide
DEEEIRTTNPVATEQYGSVIGPTVLEIIERGDQPQG

SEQ ID NO: 140640 - protein, 34 aa, Artificial Sequence
  Description of Artificial Sequence: Synthetic polypeptide
DEEEIGTTNPVATEQYGCVCSNTEEHQYFNSDQD

SEQ ID NO: 140641 - protein, 30 aa, Artificial Sequence
  Description of Artificial Sequence: Synthetic polypeptide
QEEEIATTNPVATEQYGSAPEVCPQMHEEK

SEQ ID NO: 140642 - protein, 37 aa, Artificial Sequence
  Description of Artificial Sequence: Synthetic polypeptide
DEEEIRTTNPVATEQYGVVSTVVTNQQGNQAGNDEGN

SEQ ID NO: 140643 - protein, 29 aa, Artificial Sequence
  Description of Artificial Sequence: Synthetic peptide
QEEEIATTNPVATEQYGEAVEVCQNHEEK

SEQ ID NO: 140644 - protein, 29 aa, Artificial Sequence
  Description of Artificial Sequence: Synthetic peptide
QEEEIATTNPVATEQYGEAYPEVCQHEEK

SEQ ID NO: 140645 - protein, 33 aa, Artificial Sequence
  Description of Artificial Sequence: Synthetic polypeptide
DEAEIATTNPVATEQYGSVCATHDEAMPGEDDR

SEQ ID NO: 140646 - protein, 35 aa, Artificial Sequence
  Description of Artificial Sequence: Synthetic polypeptide
DEAEIATTNPVATEQYGSVCSATLALQNHSDDAND

SEQ ID NO: 140647 - protein, 34 aa, Artificial Sequence
  Description of Artificial Sequence: Synthetic polypeptide
DEMEIRTTNPVATEQYGSVNSWVDQADEGGDQDD

SEQ ID NO: 140648 - protein, 35 aa, Artificial Sequence
  Description of Artificial Sequence: Synthetic polypeptide
QEEEIATTNPVATEQYGSVAITHNMLTNANGNMEQ

SEQ ID NO: 140649 - protein, 35 aa, Artificial Sequence
  Description of Artificial Sequence: Synthetic polypeptide
DEEEIRTTNPVATEQYGSVISNGFNGDQDEDDDGD

SEQ ID NO: 140650 - protein, 38 aa, Artificial Sequence
  Description of Artificial Sequence: Synthetic polypeptide
DEEEIRTTNPVATEQYGVVSTVVTNLQAGNQQGTTNEE

SEQ ID NO: 140651 - protein, 38 aa, Artificial Sequence
  Description of Artificial Sequence: Synthetic polypeptide
DEEEIRTTNPVATEQYGVVSTTNLQNGNQQGTTEQGSE

SEQ ID NO: 140652 - protein, 30 aa, Artificial Sequence
  Description of Artificial Sequence: Synthetic polypeptide
QENEIATTNPVATEFYGDVSVEADQHGEEL

SEQ ID NO: 140653 - protein, 30 aa, Artificial Sequence
  Description of Artificial Sequence: Synthetic polypeptide
DEHEIATTNPVATAQWGCVATALTAGGDED

SEQ ID NO: 140654 - protein, 29 aa, Artificial Sequence
  Description of Artificial Sequence: Synthetic peptide
QEEEIATTNPVATEQYGEHAQEVCQHEEK

SEQ ID NO: 140655 - protein, 33 aa, Artificial Sequence
  Description of Artificial Sequence: Synthetic polypeptide
DEEEIATTNPVATEQYGCVCSWGEHQSFNSEQP

SEQ ID NO: 140656 - protein, 34 aa, Artificial Sequence
  Description of Artificial Sequence: Synthetic polypeptide
DEAEIATTNPVAYECWGSVSNTNLGEERGENSED

SEQ ID NO: 140657 - protein, 29 aa, Artificial Sequence
  Description of Artificial Sequence: Synthetic peptide
QENEIATTNPVATECYGTVSATCPEHEEL

SEQ ID NO: 140658 - protein, 35 aa, Artificial Sequence
  Description of Artificial Sequence: Synthetic polypeptide
DEEEIRTTNPVATEQYGSVIGPTVEIIERVGVPQG

SEQ ID NO: 140659 - protein, 36 aa, Artificial Sequence
  Description of Artificial Sequence: Synthetic polypeptide
DEEEIRTTNPVATEQYGSQCSSTAWLEQNEMGEMDP

SEQ ID NO: 140660 - protein, 35 aa, Artificial Sequence
  Description of Artificial Sequence: Synthetic polypeptide
DEEEIATTNPVATEQYGCVCLTNELSGKTGGNNFG

SEQ ID NO: 140661 - protein, 29 aa, Artificial Sequence
  Description of Artificial Sequence: Synthetic peptide
QEEEIATTNPVATEQYGECPEVCQHEEKT

SEQ ID NO: 140662 - protein, 34 aa, Artificial Sequence
  Description of Artificial Sequence: Synthetic polypeptide
DEEEIGTTNPVATEQYGCVCSMTEHQNFGSETQS

SEQ ID NO: 140663 - protein, 30 aa, Artificial Sequence
  Description of Artificial Sequence: Synthetic polypeptide
QEEEIATTNPVATEQYGSAPCIVCQDHEEK

SEQ ID NO: 140664 - protein, 34 aa, Artificial Sequence
  Description of Artificial Sequence: Synthetic polypeptide
DEEEIGTTNPVATEQYGCVCSNTEHDQSFGSEQS

SEQ ID NO: 140665 - protein, 34 aa, Artificial Sequence
  Description of Artificial Sequence: Synthetic polypeptide
DEMEIRTTNPVATEQYGSVQTVDALEEPNNSQEI

SEQ ID NO: 140666 - protein, 29 aa, Artificial Sequence
  Description of Artificial Sequence: Synthetic peptide
QEEEIATTNPVATEQYGEIAPEVCQHEEK

SEQ ID NO: 140667 - protein, 34 aa, Artificial Sequence
  Description of Artificial Sequence: Synthetic polypeptide
CTGEIRTTNPVATEQYGSVSTGNNGQELGEMTGG

SEQ ID NO: 140668 - protein, 36 aa, Artificial Sequence
  Description of Artificial Sequence: Synthetic polypeptide
DEEEIRTTNPVATEQYGSQNVAATLEIQRMGEEVSE

SEQ ID NO: 140669 - protein, 30 aa, Artificial Sequence
  Description of Artificial Sequence: Synthetic polypeptide
QENEIATTNPVATEFYGDVVEGGQDEGENL

SEQ ID NO: 140670 - protein, 34 aa, Artificial Sequence
  Description of Artificial Sequence: Synthetic polypeptide
DEAEIATTNPVATEQYGSVCSPANAHTEADGNEN

SEQ ID NO: 140671 - protein, 35 aa, Artificial Sequence
  Description of Artificial Sequence: Synthetic polypeptide
DEMEIRTTNPVATEQYGSVSANPDEHTEGSEENHL

SEQ ID NO: 140672 - protein, 29 aa, Artificial Sequence
  Description of Artificial Sequence: Synthetic peptide
QEEEIATTNPVATEQYGEHAAEVCQHEEK

SEQ ID NO: 140673 - protein, 33 aa, Artificial Sequence
  Description of Artificial Sequence: Synthetic polypeptide
DEGEIRTTNPVCTEQYGCVAFNLQDGMGPQSTA

SEQ ID NO: 140674 - protein, 29 aa, Artificial Sequence
  Description of Artificial Sequence: Synthetic peptide
QENEIATTNPVATEFYGDVADGNGQGEEL

SEQ ID NO: 140675 - protein, 30 aa, Artificial Sequence
  Description of Artificial Sequence: Synthetic polypeptide
QENEIATTNPVATEGYGCVCSWGPLQHIEL

SEQ ID NO: 140676 - protein, 35 aa, Artificial Sequence
  Description of Artificial Sequence: Synthetic polypeptide
DEMEIRTTNPVATEQYGCVSWTVHHGMEENNQDGN

SEQ ID NO: 140677 - protein, 35 aa, Artificial Sequence
  Description of Artificial Sequence: Synthetic polypeptide
DEEEIRTTNPVATEQYGSTTSSTAPAWNMRKGPPI

SEQ ID NO: 140678 - protein, 37 aa, Artificial Sequence
  Description of Artificial Sequence: Synthetic polypeptide
DEEEIRTTNPVATEQYGSIVSSTTPAGPNMRNGMNWV

SEQ ID NO: 140679 - protein, 31 aa, Artificial Sequence
  Description of Artificial Sequence: Synthetic polypeptide
QEEEIATTNPVATEQYGSASATVCEHEEEDK

SEQ ID NO: 140680 - protein, 38 aa, Artificial Sequence
  Description of Artificial Sequence: Synthetic polypeptide
DEEEIRTTNPVATEQYGVVSTTNLQAGNNEQGTTQEQD

SEQ ID NO: 140681 - protein, 34 aa, Artificial Sequence
  Description of Artificial Sequence: Synthetic polypeptide
DEMEIRTTNPVATEQYGSVNSWVDQADEESNQDD

SEQ ID NO: 140682 - protein, 37 aa, Artificial Sequence
  Description of Artificial Sequence: Synthetic polypeptide
DEEEIRTTNPVATEQYGVVSTTLQAGNNNQQGTNPTT

SEQ ID NO: 140683 - protein, 29 aa, Artificial Sequence
  Description of Artificial Sequence: Synthetic peptide
QEEEIATTNPVATEQYGEAWPEVCQHEEK

SEQ ID NO: 140684 - protein, 29 aa, Artificial Sequence
  Description of Artificial Sequence: Synthetic peptide
QEEEIATTNPVATEQYGEAWEEVCQHEEK

SEQ ID NO: 140685 - protein, 33 aa, Artificial Sequence
  Description of Artificial Sequence: Synthetic polypeptide
DEMEIRTTNPVATEQYGSVSAPDEHEGSEETHT

SEQ ID NO: 140686 - protein, 34 aa, Artificial Sequence
  Description of Artificial Sequence: Synthetic polypeptide
DEMEIRTTNPVATEQYGSVPTAMLENSIGEEVQN

SEQ ID NO: 140687 - protein, 36 aa, Artificial Sequence
  Description of Artificial Sequence: Synthetic polypeptide
DEEEIHTTNPVATEQYGSVSSTTPAGPNMRNGENPV

SEQ ID NO: 140688 - protein, 28 aa, Artificial Sequence
  Description of Artificial Sequence: Synthetic peptide
QENNIASTNPVATECYGDVSECLQHEEL

SEQ ID NO: 140689 - protein, 35 aa, Artificial Sequence
  Description of Artificial Sequence: Synthetic polypeptide
DEAEIATTNPVATEQYGSVCSPTNGHEVDDGGQNN

SEQ ID NO: 140690 - protein, 29 aa, Artificial Sequence
  Description of Artificial Sequence: Synthetic peptide
QEEEIATTNPVATEQYGEAYEVECQHEEK

SEQ ID NO: 140691 - protein, 33 aa, Artificial Sequence
  Description of Artificial Sequence: Synthetic polypeptide
DEHEIATTNPVAYEQWGSVCSTMGPQGDGNDGK

SEQ ID NO: 140692 - protein, 35 aa, Artificial Sequence
  Description of Artificial Sequence: Synthetic polypeptide
DEMEIRTTNPVATEQYGCVSYTVNHMEETNNQDGN

SEQ ID NO: 140693 - protein, 37 aa, Artificial Sequence
  Description of Artificial Sequence: Synthetic polypeptide
DEEEIRTTNPVATEQYGVVSTTLQAGNTNEQGTTEEN

SEQ ID NO: 140694 - protein, 36 aa, Artificial Sequence
  Description of Artificial Sequence: Synthetic polypeptide
DEEEIMTTNPVATEQYGSVSSITPAGPNMRNGMNPV

SEQ ID NO: 140695 - protein, 29 aa, Artificial Sequence
  Description of Artificial Sequence: Synthetic peptide
QEQEIASTNPVATEGYGVMSTTLEHEGDI

SEQ ID NO: 140696 - protein, 35 aa, Artificial Sequence
  Description of Artificial Sequence: Synthetic polypeptide
DEAEIATTNPVATEQYGSVCSPTNHLFNQADESED

SEQ ID NO: 140697 - protein, 34 aa, Artificial Sequence
  Description of Artificial Sequence: Synthetic polypeptide
DEMEIRTTNPVATEQYGSVSAENYDQFETQDEAM

SEQ ID NO: 140698 - protein, 37 aa, Artificial Sequence
  Description of Artificial Sequence: Synthetic polypeptide
DEEEIRTTNPVATEQYGVVSTVVTNQQGNQQGNDEEA

SEQ ID NO: 140699 - protein, 34 aa, Artificial Sequence
  Description of Artificial Sequence: Synthetic polypeptide
DEMEIRTTNPVATEQYGCVSVSANSGEIGGSDQI

SEQ ID NO: 140700 - protein, 31 aa, Artificial Sequence
  Description of Artificial Sequence: Synthetic polypeptide
QENEIATTNPVATESYGCVSENHLQHEDELA

SEQ ID NO: 140701 - protein, 28 aa, Artificial Sequence
  Description of Artificial Sequence: Synthetic peptide
QEEEIATTNPVAYEQYGEAPEVCQGQEK

SEQ ID NO: 140702 - protein, 35 aa, Artificial Sequence
  Description of Artificial Sequence: Synthetic polypeptide
DEMEIRTTNPVATEQYGSVSTPNNLTAEEIVQISS

SEQ ID NO: 140703 - protein, 29 aa, Artificial Sequence
  Description of Artificial Sequence: Synthetic peptide
QEEEIATTNPVATEQYGEIPEDCQQQEEH

SEQ ID NO: 140704 - protein, 28 aa, Artificial Sequence
  Description of Artificial Sequence: Synthetic peptide
QEEEIATTNPVAYEQYGEAYEPCQHEEW

SEQ ID NO: 140705 - protein, 37 aa, Artificial Sequence
  Description of Artificial Sequence: Synthetic polypeptide
DEEEIRTTNPVATEQYGVVSTVVTNQQAGGNNQEQDT

SEQ ID NO: 140706 - protein, 35 aa, Artificial Sequence
  Description of Artificial Sequence: Synthetic polypeptide
DEMEIRTTNPVATEQYGCVSVSAPSGELIFGSDQR

SEQ ID NO: 140707 - protein, 36 aa, Artificial Sequence
  Description of Artificial Sequence: Synthetic polypeptide
DEEEIRTTNPVATEQYGSTSSTFPAGPNMRNGMNPV

SEQ ID NO: 140708 - protein, 38 aa, Artificial Sequence
  Description of Artificial Sequence: Synthetic polypeptide
DEEEIRTTNPVATEQYGVVSTVVTNLQAGTETGNEEDE

SEQ ID NO: 140709 - protein, 31 aa, Artificial Sequence
  Description of Artificial Sequence: Synthetic polypeptide
QEQEIAPTNPVSTEQYGSVSTDLEDSEGEDL

SEQ ID NO: 140710 - protein, 34 aa, Artificial Sequence
  Description of Artificial Sequence: Synthetic polypeptide
DEAEIATTNPVATEQYGSVCSMNQENDMVGDDQR

SEQ ID NO: 140711 - protein, 35 aa, Artificial Sequence
  Description of Artificial Sequence: Synthetic polypeptide
DEMEIRTTNPVATEQYGSVNSTVDDQQYEGEEEMG

SEQ ID NO: 140712 - protein, 37 aa, Artificial Sequence
  Description of Artificial Sequence: Synthetic polypeptide
DEEEIRTTNPVATEQYGVVSTVVTNQQAGNQNEEEDE

SEQ ID NO: 140713 - protein, 36 aa, Artificial Sequence
  Description of Artificial Sequence: Synthetic polypeptide
DEEEIRTTNPVATEQYGSVISPDENVAQPTNENDQQ

SEQ ID NO: 140714 - protein, 30 aa, Artificial Sequence
  Description of Artificial Sequence: Synthetic polypeptide
QENEIATTNPVATESYGCVSGEALNHFGEL

SEQ ID NO: 140715 - protein, 35 aa, Artificial Sequence
  Description of Artificial Sequence: Synthetic polypeptide
DEEEIRTTNPVATEQYGSTPPTIIGLNVFGQVQGN

SEQ ID NO: 140716 - protein, 37 aa, Artificial Sequence
  Description of Artificial Sequence: Synthetic polypeptide
DEEEIRTTNPVATEQYGVVSTVVTNQQAGNNEEDEDE

SEQ ID NO: 140717 - protein, 36 aa, Artificial Sequence
  Description of Artificial Sequence: Synthetic polypeptide
DEMEIRTTNPVATEQYGSVSVTFNHTDETFNGTIRE

SEQ ID NO: 140718 - protein, 32 aa, Artificial Sequence
  Description of Artificial Sequence: Synthetic polypeptide
DDEEIRSTNPVATEQYGCSCSSEHQNFGSDQA

SEQ ID NO: 140719 - protein, 38 aa, Artificial Sequence
  Description of Artificial Sequence: Synthetic polypeptide
DEEEIRTTNPVATEQYGVVSTTNLQQQNATEQGVTNED

SEQ ID NO: 140720 - protein, 33 aa, Artificial Sequence
  Description of Artificial Sequence: Synthetic polypeptide
DEEEIRTTNPVATEQYGSIWSDFQQFVSLMDED

SEQ ID NO: 140721 - protein, 34 aa, Artificial Sequence
  Description of Artificial Sequence: Synthetic polypeptide
DEMEIRTTNPVATEQYGSVSVMDIDTRPGEDGTM

SEQ ID NO: 140722 - protein, 36 aa, Artificial Sequence
  Description of Artificial Sequence: Synthetic polypeptide
DEEEIRTTNPVATEQYGSLSSTTPAGPRMRNGMNPV

SEQ ID NO: 140723 - protein, 38 aa, Artificial Sequence
  Description of Artificial Sequence: Synthetic polypeptide
DEEEIRTTNPVATEQYGVVSTTNLAGGNNNQQGTNPVE

SEQ ID NO: 140724 - protein, 31 aa, Artificial Sequence
  Description of Artificial Sequence: Synthetic polypeptide
QENEIATTNPVATECYGTVSEECLQQHNENH

SEQ ID NO: 140725 - protein, 35 aa, Artificial Sequence
  Description of Artificial Sequence: Synthetic polypeptide
DEMEIRTTNPVATEQYGSVSEANDEHWEGSEENHT

SEQ ID NO: 140726 - protein, 35 aa, Artificial Sequence
  Description of Artificial Sequence: Synthetic polypeptide
DEMEIRTTNPVATEQYGSVNSTSDDQQYENENEYG

SEQ ID NO: 140727 - protein, 35 aa, Artificial Sequence
  Description of Artificial Sequence: Synthetic polypeptide
DEMEIRTTNPVATEQYGSVSVTLMTEHSFGNNDFY

SEQ ID NO: 140728 - protein, 36 aa, Artificial Sequence
  Description of Artificial Sequence: Synthetic polypeptide
DEEEIRTTNPVATEQYGSVISPTFNEIASDPENLQD

SEQ ID NO: 140729 - protein, 36 aa, Artificial Sequence
  Description of Artificial Sequence: Synthetic polypeptide
DEGEIRTTNPVAYEQYGSVPSQTPAGSNQRNGGNPV

SEQ ID NO: 140730 - protein, 30 aa, Artificial Sequence
  Description of Artificial Sequence: Synthetic polypeptide
QENEVATTNPVATEGYGDVAAECLQHVGER

SEQ ID NO: 140731 - protein, 37 aa, Artificial Sequence
  Description of Artificial Sequence: Synthetic polypeptide
DEEEIRTTNPVATEQYGVVSTVVTNQQAGNQQETEDE

SEQ ID NO: 140732 - protein, 28 aa, Artificial Sequence
  Description of Artificial Sequence: Synthetic peptide
QEEEIATTNPVAYEQYGEAPEHDQHEEK

SEQ ID NO: 140733 - protein, 33 aa, Artificial Sequence
  Description of Artificial Sequence: Synthetic polypeptide
DEEEIRTTNPVATEQYGSTPMNHEQVEEVTEDV

SEQ ID NO: 140734 - protein, 34 aa, Artificial Sequence
  Description of Artificial Sequence: Synthetic polypeptide
DEEEIRTTNPVATEQYGSTSQYNNNQANVVVEIN

SEQ ID NO: 140735 - protein, 34 aa, Artificial Sequence
  Description of Artificial Sequence: Synthetic polypeptide
DEMEIRTTNPVATEQYGCVSVPDSMQTSGSNQSY

SEQ ID NO: 140736 - protein, 29 aa, Artificial Sequence
  Description of Artificial Sequence: Synthetic peptide
QENEIATTNPVATECYGTISEDLQQQEEL

SEQ ID NO: 140737 - protein, 30 aa, Artificial Sequence
  Description of Artificial Sequence: Synthetic polypeptide
QEQEIASTNPVATEGYGVVSTDLEDHEGDL

SEQ ID NO: 140738 - protein, 34 aa, Artificial Sequence
  Description of Artificial Sequence: Synthetic polypeptide
DEEEICTTNPVAYEQYGSVHATAETSQPTGGVRP

SEQ ID NO: 140739 - protein, 29 aa, Artificial Sequence
  Description of Artificial Sequence: Synthetic peptide
QEQEIAPTNPCSTEQYGIVSCNLESEGTL

SEQ ID NO: 140740 - protein, 36 aa, Artificial Sequence
  Description of Artificial Sequence: Synthetic polypeptide
DEEEIHTTNPVATEQYGSVSSTTPAGPNMRNGMNPV

SEQ ID NO: 140741 - protein, 34 aa, Artificial Sequence
  Description of Artificial Sequence: Synthetic polypeptide
DEEEICTTNPVAYEQYGSTVVFTAMTSQPGGKRD

SEQ ID NO: 140742 - protein, 35 aa, Artificial Sequence
  Description of Artificial Sequence: Synthetic polypeptide
DEEEIRTTNPVATEQYGSVISPTFSEIQSPEQLQD

SEQ ID NO: 140743 - protein, 37 aa, Artificial Sequence
  Description of Artificial Sequence: Synthetic polypeptide
DEEEIRTTNPVATEQYGSVISPTENIETERSMEQNVV

SEQ ID NO: 140744 - protein, 28 aa, Artificial Sequence
  Description of Artificial Sequence: Synthetic peptide
QEPEIASTNPVGTEGYGVMASTLQHGDI

SEQ ID NO: 140745 - protein, 35 aa, Artificial Sequence
  Description of Artificial Sequence: Synthetic polypeptide
DEEEIRTTNPVATEQYGSVIGPTNNLNMNIEIEDP

SEQ ID NO: 140746 - protein, 30 aa, Artificial Sequence
  Description of Artificial Sequence: Synthetic polypeptide
QENEIATTNPVATECYGTVSEDCPQHEGEL

SEQ ID NO: 140747 - protein, 29 aa, Artificial Sequence
  Description of Artificial Sequence: Synthetic peptide
QEEEIATTNPVATEQYGQAPEVCQHEEKL

SEQ ID NO: 140748 - protein, 31 aa, Artificial Sequence
  Description of Artificial Sequence: Synthetic polypeptide
DEHEIATTNPVATAQWGSVAAGNLFDNNMGN

SEQ ID NO: 140749 - protein, 29 aa, Artificial Sequence
  Description of Artificial Sequence: Synthetic peptide
QENHIATTNPVATECYGDVSTERDQHEAL

SEQ ID NO: 140750 - protein, 28 aa, Artificial Sequence
  Description of Artificial Sequence: Synthetic peptide
QEEEIATTNPVAYEQYGEAPEVCQHEEK

SEQ ID NO: 140751 - protein, 38 aa, Artificial Sequence
  Description of Artificial Sequence: Synthetic polypeptide
DEEEIRTTNPVATEQYGVVSTSVVTNLQQGNNTEDEDE

SEQ ID NO: 140752 - protein, 35 aa, Artificial Sequence
  Description of Artificial Sequence: Synthetic polypeptide
DEEEIRTTNPVATEQYGSVISPDFNEIQSPEALQT

SEQ ID NO: 140753 - protein, 30 aa, Artificial Sequence
  Description of Artificial Sequence: Synthetic polypeptide
QEQEIAPTNPCSTEQYGIVSTNLESEGEDL

SEQ ID NO: 140754 - protein, 29 aa, Artificial Sequence
  Description of Artificial Sequence: Synthetic peptide
QEEEIATTNPVATEQYGECAPEVCQYEEK

SEQ ID NO: 140755 - protein, 30 aa, Artificial Sequence
  Description of Artificial Sequence: Synthetic polypeptide
QEQEIASTNPVATEGYGVVSTDLEDHEGDI

SEQ ID NO: 140756 - protein, 34 aa, Artificial Sequence
  Description of Artificial Sequence: Synthetic polypeptide
DEHEIATTNPVAYEQWGSVCSTNDGNHQGGNNTT

SEQ ID NO: 140757 - protein, 30 aa, Artificial Sequence
  Description of Artificial Sequence: Synthetic polypeptide
QENEIATTNPVATEYYGCVSWELNQHISEL

SEQ ID NO: 140758 - protein, 36 aa, Artificial Sequence
  Description of Artificial Sequence: Synthetic polypeptide
DEEEIRTTNPVATEQYGSQSTTTPAGPNMRNGMNPV

SEQ ID NO: 140759 - protein, 38 aa, Artificial Sequence
  Description of Artificial Sequence: Synthetic polypeptide
DEEEIRTTNPVATEQYGVVSTSVTTNLQQGTNDEDEDE

SEQ ID NO: 140760 - protein, 37 aa, Artificial Sequence
  Description of Artificial Sequence: Synthetic polypeptide
DEAEIATTNPVATEQYGSVCSPTNGLVNQRNEEEGDE

SEQ ID NO: 140761 - protein, 36 aa, Artificial Sequence
  Description of Artificial Sequence: Synthetic polypeptide
DEEEIRTTNPVATEQYGVVSSTTPNGPNMSNGMNPQ

SEQ ID NO: 140762 - protein, 33 aa, Artificial Sequence
  Description of Artificial Sequence: Synthetic polypeptide
DEMEIRTTNPVATEQYGCVSTVLEETSAPDSSM

SEQ ID NO: 140763 - protein, 36 aa, Artificial Sequence
  Description of Artificial Sequence: Synthetic polypeptide
DEEEIETTNPVATEQYGSVSSTTPAGPNMRNGMNPV

SEQ ID NO: 140764 - protein, 31 aa, Artificial Sequence
  Description of Artificial Sequence: Synthetic polypeptide
DEGEIRTTNPVAYEQWGYCMQEDLIRGMDNN

SEQ ID NO: 140765 - protein, 35 aa, Artificial Sequence
  Description of Artificial Sequence: Synthetic polypeptide
DEEEIRTTNPVATEQYGSVIGPTNNLNMPFEIVDP

SEQ ID NO: 140766 - protein, 36 aa, Artificial Sequence
  Description of Artificial Sequence: Synthetic polypeptide
DEEEIRTTNPVATEQYGSVIGPTNNLITRFSEIEDY

SEQ ID NO: 140767 - protein, 36 aa, Artificial Sequence
  Description of Artificial Sequence: Synthetic polypeptide
DEEEIRTTNPVATEQYGSTSATAPAGPNERNGMNPI

SEQ ID NO: 140768 - protein, 30 aa, Artificial Sequence
  Description of Artificial Sequence: Synthetic polypeptide
QEPEIATTNPVATECYGDVISNMCLQHEEL

SEQ ID NO: 140769 - protein, 37 aa, Artificial Sequence
  Description of Artificial Sequence: Synthetic polypeptide
DEEEIRTTNPVATEQYGVVSTVVTNLQAGTTTEQGSE

SEQ ID NO: 140770 - protein, 31 aa, Artificial Sequence
  Description of Artificial Sequence: Synthetic polypeptide
QENEIATTNPVATESYGCVSGEANLQNHHET

SEQ ID NO: 140771 - protein, 30 aa, Artificial Sequence
  Description of Artificial Sequence: Synthetic polypeptide
QEEEIATTNPVATEQYGSAPEIVCQDHEEK

SEQ ID NO: 140772 - protein, 31 aa, Artificial Sequence
  Description of Artificial Sequence: Synthetic polypeptide
QENEIATTNPVATESYGCVSENALQNHEEEL

SEQ ID NO: 140773 - protein, 30 aa, Artificial Sequence
  Description of Artificial Sequence: Synthetic polypeptide
QENEIATTNPVATECYGTVFSECLQHEEIL

SEQ ID NO: 140774 - protein, 34 aa, Artificial Sequence
  Description of Artificial Sequence: Synthetic polypeptide
DEMEIRTTNPVATEQYGSVSDAADEHEGSEENHN

SEQ ID NO: 140775 - protein, 28 aa, Artificial Sequence
  Description of Artificial Sequence: Synthetic peptide
QENEIATTNPVATECYGVMAETLQHEEI

SEQ ID NO: 140776 - protein, 37 aa, Artificial Sequence
  Description of Artificial Sequence: Synthetic polypeptide
DEEEIRTTNPVATEQYGVVSTVVTNNQQGNNQEEDED

SEQ ID NO: 140777 - protein, 30 aa, Artificial Sequence
  Description of Artificial Sequence: Synthetic polypeptide
QENEIATTNPVATESYGCVSEALPQHEEEN

SEQ ID NO: 140778 - protein, 31 aa, Artificial Sequence
  Description of Artificial Sequence: Synthetic polypeptide
QENEIATTNPVATESYGCVSGEANLQHFELH

SEQ ID NO: 140779 - protein, 30 aa, Artificial Sequence
  Description of Artificial Sequence: Synthetic polypeptide
QENEIATTNPVATECYGTVCSAEGLEFEND

SEQ ID NO: 140780 - protein, 34 aa, Artificial Sequence
  Description of Artificial Sequence: Synthetic polypeptide
DEAEIATTNPVATEQYGSVCMDNLNPRDQTEGDN

SEQ ID NO: 140781 - protein, 37 aa, Artificial Sequence
  Description of Artificial Sequence: Synthetic polypeptide
DEEEIRTTNPVATEQYGSQVSSTTPAGPNMRNGMNPV

SEQ ID NO: 140782 - protein, 30 aa, Artificial Sequence
  Description of Artificial Sequence: Synthetic polypeptide
QEEEIATTNPVAYEQYGEAPTEVCQHGEEK

SEQ ID NO: 140783 - protein, 37 aa, Artificial Sequence
  Description of Artificial Sequence: Synthetic polypeptide
AEEEIRTTNPVATEQYGSVSTVVNNNQQGTNNNNQLF

SEQ ID NO: 140784 - protein, 37 aa, Artificial Sequence
  Description of Artificial Sequence: Synthetic polypeptide
DEEEIRTTNPVATEQYGVVSTVVTNLQAGTDEEETEE

SEQ ID NO: 140785 - protein, 34 aa, Artificial Sequence
  Description of Artificial Sequence: Synthetic polypeptide
DEEEIRTTNPVATEQYGSTSLYNNNQANVAVEQN

SEQ ID NO: 140786 - protein, 34 aa, Artificial Sequence
  Description of Artificial Sequence: Synthetic polypeptide
DEAEIATTNPVATEQYGSVCTIEGQDQQGQNNHA

SEQ ID NO: 140787 - protein, 29 aa, Artificial Sequence
  Description of Artificial Sequence: Synthetic peptide
QEEEIATTNPVATEQYGRAPEVCQHHEEK

SEQ ID NO: 140788 - protein, 31 aa, Artificial Sequence
  Description of Artificial Sequence: Synthetic polypeptide
QEEEIATTNPVATEQYGSAPEVGPQMHGEPV

SEQ ID NO: 140789 - protein, 37 aa, Artificial Sequence
  Description of Artificial Sequence: Synthetic polypeptide
DEEEIRTTNPVATEQYGSQVKSTTPAGPNMRNGMNPV

SEQ ID NO: 140790 - protein, 38 aa, Artificial Sequence
  Description of Artificial Sequence: Synthetic polypeptide
DEEEIRTTNPVATEQYGVVSTTNLQQGNTEQGTNEEED

SEQ ID NO: 140791 - protein, 29 aa, Artificial Sequence
  Description of Artificial Sequence: Synthetic peptide
QEEEIATTNPVATEQYGEIPCVCSQHEEK

SEQ ID NO: 140792 - protein, 37 aa, Artificial Sequence
  Description of Artificial Sequence: Synthetic polypeptide
DEEEIRTTNPVATEQYGSQVSGTTPAGPNMRNGMNPV

SEQ ID NO: 140793 - protein, 29 aa, Artificial Sequence
  Description of Artificial Sequence: Synthetic peptide
QEEEIATTNPVATEQYGRAPEVCQHEEIK

SEQ ID NO: 140794 - protein, 28 aa, Artificial Sequence
  Description of Artificial Sequence: Synthetic peptide
QEEEIATTNPVATEQYGEAYEVCVAEEK

SEQ ID NO: 140795 - protein, 33 aa, Artificial Sequence
  Description of Artificial Sequence: Synthetic polypeptide
DEGEIRTTNPVSTEQWGSVYTFDNHQNGGKQET

SEQ ID NO: 140796 - protein, 30 aa, Artificial Sequence
  Description of Artificial Sequence: Synthetic polypeptide
QENEIATTNPVATEGYGDVSVEQLQHEELQ

SEQ ID NO: 140797 - protein, 38 aa, Artificial Sequence
  Description of Artificial Sequence: Synthetic polypeptide
DEEEIRTTNPVATEQYGVVSTVVTNLQAGTEGNNVNDE

SEQ ID NO: 140798 - protein, 33 aa, Artificial Sequence
  Description of Artificial Sequence: Synthetic polypeptide
DEEEICTTNPVAYERYGHVSCLNSLSQPSGGEG

SEQ ID NO: 140799 - protein, 29 aa, Artificial Sequence
  Description of Artificial Sequence: Synthetic peptide
QEEEIATTNPVATEQYGEATEVCTQHEEK

SEQ ID NO: 140800 - protein, 36 aa, Artificial Sequence
  Description of Artificial Sequence: Synthetic polypeptide
DEEEIRTTNPVATEQYGVVSTTDQAGNTEQGTEEQE

SEQ ID NO: 140801 - protein, 37 aa, Artificial Sequence
  Description of Artificial Sequence: Synthetic polypeptide
DEEEIRTTNPVATEQYGVVSTVVTNNQAGNQQNEEDD

SEQ ID NO: 140802 - protein, 34 aa, Artificial Sequence
  Description of Artificial Sequence: Synthetic polypeptide
QEPEIRTTNPVATECWGSVSCINEPQDRCGENGG

SEQ ID NO: 140803 - protein, 36 aa, Artificial Sequence
  Description of Artificial Sequence: Synthetic polypeptide
DEMEIRTTNPVATEQYGSVNSTVYDDQQYEGEQENG

SEQ ID NO: 140804 - protein, 36 aa, Artificial Sequence
  Description of Artificial Sequence: Synthetic polypeptide
DEEEIRTTNPVATEQYGSLSSTTPAGPNMRNGMNPV

SEQ ID NO: 140805 - protein, 35 aa, Artificial Sequence
  Description of Artificial Sequence: Synthetic polypeptide
DEHEIATTNPVAYEQWGSVCSTGLNDMQRDGDNND

SEQ ID NO: 140806 - protein, 28 aa, Artificial Sequence
  Description of Artificial Sequence: Synthetic peptide
QEEEIATTNPVAYEQYGEAYECCQSEEK

SEQ ID NO: 140807 - protein, 29 aa, Artificial Sequence
  Description of Artificial Sequence: Synthetic peptide
QEEEIATTNPVATEQYGEIPEDCQHNEEH

SEQ ID NO: 140808 - protein, 33 aa, Artificial Sequence
  Description of Artificial Sequence: Synthetic polypeptide
DEAEIATTNPVAYEEWGSVCSGLNDLQDGDNAV

SEQ ID NO: 140809 - protein, 36 aa, Artificial Sequence
  Description of Artificial Sequence: Synthetic polypeptide
DEEEIRTTNPVATEQYGSVISPTEDMLHEAQGLLDI

SEQ ID NO: 140810 - protein, 30 aa, Artificial Sequence
  Description of Artificial Sequence: Synthetic polypeptide
QENEIATTNPVATESYGCVSEALPQHEELP

SEQ ID NO: 140811 - protein, 34 aa, Artificial Sequence
  Description of Artificial Sequence: Synthetic polypeptide
DEAEIATTNPVATEQYGSVCSPADTLQDAGEPKM

SEQ ID NO: 140812 - protein, 29 aa, Artificial Sequence
  Description of Artificial Sequence: Synthetic peptide
QEEEIATTNPVATEQYGEIPEDCQHNEEK

SEQ ID NO: 140813 - protein, 31 aa, Artificial Sequence
  Description of Artificial Sequence: Synthetic polypeptide
QEEEIATTNPVATEQYGSAPTVLEDHEEEDK

SEQ ID NO: 140814 - protein, 36 aa, Artificial Sequence
  Description of Artificial Sequence: Synthetic polypeptide
DEMEIRTTNPVATEQYGSVSTPNNLTEEEITQESRM

SEQ ID NO: 140815 - protein, 28 aa, Artificial Sequence
  Description of Artificial Sequence: Synthetic peptide
QENEIATTNPVATECYGVMAETLQHEDI

SEQ ID NO: 140816 - protein, 30 aa, Artificial Sequence
  Description of Artificial Sequence: Synthetic polypeptide
QENEIATTNPVATESYGCVSEALQHEDEAL

SEQ ID NO: 140817 - protein, 36 aa, Artificial Sequence
  Description of Artificial Sequence: Synthetic polypeptide
DEEEIRTTNPVATEQYGSTSSTTPAGPNERNGMNPI

SEQ ID NO: 140818 - protein, 34 aa, Artificial Sequence
  Description of Artificial Sequence: Synthetic polypeptide
DEEEIGTTNPVATEQYGCVCSTEEHQYFNSNTQD

SEQ ID NO: 140819 - protein, 30 aa, Artificial Sequence
  Description of Artificial Sequence: Synthetic polypeptide
QENEIATTNPVATESYGVVSEALQHEEELD

SEQ ID NO: 140820 - protein, 37 aa, Artificial Sequence
  Description of Artificial Sequence: Synthetic polypeptide
DEEEIRTTNPVATEQYGVVSTVVTNLQAGTDEDTEDE

SEQ ID NO: 140821 - protein, 29 aa, Artificial Sequence
  Description of Artificial Sequence: Synthetic peptide
QEEEIATTNPVATEQYGQAPEVCQVHEEK

SEQ ID NO: 140822 - protein, 34 aa, Artificial Sequence
  Description of Artificial Sequence: Synthetic polypeptide
DEAEIATTNPVATEQYGSVCSTTDLNEEHSGEDL

SEQ ID NO: 140823 - protein, 36 aa, Artificial Sequence
  Description of Artificial Sequence: Synthetic polypeptide
DEEEIRTTNPVATEQYGSLSSTTPAGPNMRNGMNPT

SEQ ID NO: 140824 - protein, 37 aa, Artificial Sequence
  Description of Artificial Sequence: Synthetic polypeptide
DEEEIRTTNPVATEQYGVVSTVVTNNNTQAGNTEQGS

SEQ ID NO: 140825 - protein, 33 aa, Artificial Sequence
  Description of Artificial Sequence: Synthetic polypeptide
QEPEIRTTNPVATEQYGSVIVGNNTGQGEGGQG

SEQ ID NO: 140826 - protein, 37 aa, Artificial Sequence
  Description of Artificial Sequence: Synthetic polypeptide
AEEEIRTTNPVATEQYGSVSTVVNNNQQNQEQGTNVD

SEQ ID NO: 140827 - protein, 30 aa, Artificial Sequence
  Description of Artificial Sequence: Synthetic polypeptide
QEEEIATTNPVATEQYGSAPEVLEHEEEDK

SEQ ID NO: 140828 - protein, 38 aa, Artificial Sequence
  Description of Artificial Sequence: Synthetic polypeptide
DEEEIRTTNPVATEQYGVVSTVVTNLQAGTEAGNSTNQ

SEQ ID NO: 140829 - protein, 30 aa, Artificial Sequence
  Description of Artificial Sequence: Synthetic polypeptide
QEEEIATTNPVATEQYGECAPEVCQHEENK

SEQ ID NO: 140830 - protein, 29 aa, Artificial Sequence
  Description of Artificial Sequence: Synthetic peptide
QEEEIATTNPVATEQYGEATEVCQHELEK

SEQ ID NO: 140831 - protein, 35 aa, Artificial Sequence
  Description of Artificial Sequence: Synthetic polypeptide
DEEEINTTNPVATEQYGETVVSTNEHSQESNGGSV

SEQ ID NO: 140832 - protein, 33 aa, Artificial Sequence
  Description of Artificial Sequence: Synthetic polypeptide
DESEIATTNPVATEGYGTVCSANDGPVEFEGND

SEQ ID NO: 140833 - protein, 31 aa, Artificial Sequence
  Description of Artificial Sequence: Synthetic polypeptide
CEDEIACTNPVATEQWGCVAGTGLAMMNEER

SEQ ID NO: 140834 - protein, 30 aa, Artificial Sequence
  Description of Artificial Sequence: Synthetic polypeptide
DESEIATTNPVGTEGYGVMASDLQDHEGDI

SEQ ID NO: 140835 - protein, 29 aa, Artificial Sequence
  Description of Artificial Sequence: Synthetic peptide
DESEIATTNPVGTEGYGVMASDLAEPGDI

SEQ ID NO: 140836 - protein, 33 aa, Artificial Sequence
  Description of Artificial Sequence: Synthetic polypeptide
TEEEICTTNPVAYERYGVVATNMDDQNGGNYPT

SEQ ID NO: 140837 - protein, 28 aa, Artificial Sequence
  Description of Artificial Sequence: Synthetic peptide
QEECIATTNPVAYEQYGTAYEVCQHEEK

SEQ ID NO: 140838 - protein, 34 aa, Artificial Sequence
  Description of Artificial Sequence: Synthetic polypeptide
TEEEICTTNPVAYEQYGVVAYTNMDSQNGGNYSF

SEQ ID NO: 140839 - protein, 34 aa, Artificial Sequence
  Description of Artificial Sequence: Synthetic polypeptide
TEEEICTTNPVAYEQYGVVATNMDSQNTGGNEST

SEQ ID NO: 140840 - protein, 33 aa, Artificial Sequence
  Description of Artificial Sequence: Synthetic polypeptide
DECEIATTNPVAYEQWGSVCDGDDRNNNQGGNA

SEQ ID NO: 140841 - protein, 32 aa, Artificial Sequence
  Description of Artificial Sequence: Synthetic polypeptide
DESEIATTNPVATEGYGTVCSANDGPEFEGQD

SEQ ID NO: 140842 - protein, 35 aa, Artificial Sequence
  Description of Artificial Sequence: Synthetic polypeptide
DESEIRTTNPVAYECWGSVVSCCGNIPQDREGQNG

SEQ ID NO: 140843 - protein, 36 aa, Artificial Sequence
  Description of Artificial Sequence: Synthetic polypeptide
DEEEIRTTNPVATEQYGSVILINMGEEQPEGEVPEN

SEQ ID NO: 140844 - protein, 33 aa, Artificial Sequence
  Description of Artificial Sequence: Synthetic polypeptide
TEDEIQTTNPVAYESYGCTVSCTNLSHTGDNYC

SEQ ID NO: 140845 - protein, 34 aa, Artificial Sequence
  Description of Artificial Sequence: Synthetic polypeptide
TEEEICTTNPVAYEQYGVVATNMDSQNMGGNYSM

SEQ ID NO: 140846 - protein, 33 aa, Artificial Sequence
  Description of Artificial Sequence: Synthetic polypeptide
DECEIATTNPVAYEQWGSVCDGDDLNNNRGNGA

SEQ ID NO: 140847 - protein, 33 aa, Artificial Sequence
  Description of Artificial Sequence: Synthetic polypeptide
DECEIATTNPVAYEQWGSVCDGDDLNNLRGNAG

SEQ ID NO: 140848 - protein, 34 aa, Artificial Sequence
  Description of Artificial Sequence: Synthetic polypeptide
QEEEIRTTNPVATESYGSVVDGLNFTGEGNDGTS

SEQ ID NO: 140849 - protein, 33 aa, Artificial Sequence
  Description of Artificial Sequence: Synthetic polypeptide
DESEIATTNPVATEGYGTVCSATDGPVEFEGND

SEQ ID NO: 140850 - protein, 34 aa, Artificial Sequence
  Description of Artificial Sequence: Synthetic polypeptide
TEDEICTTNPVGTAAWGSVVQSCTNMLSQSGNRV

SEQ ID NO: 140851 - protein, 32 aa, Artificial Sequence
  Description of Artificial Sequence: Synthetic polypeptide
DECEIATTNPVAYEQWGSVCPNNDQGENDEEQ

SEQ ID NO: 140852 - protein, 33 aa, Artificial Sequence
  Description of Artificial Sequence: Synthetic polypeptide
DECEIATTNPVAYEQWGSVCGDSGGQQGGNNQH

SEQ ID NO: 140853 - protein, 34 aa, Artificial Sequence
  Description of Artificial Sequence: Synthetic polypeptide
DECEIATTNPVAYEQWGSVAKTNDMQEQRQGQED

SEQ ID NO: 140854 - protein, 34 aa, Artificial Sequence
  Description of Artificial Sequence: Synthetic polypeptide
TEEEICTTNPVAYEQYGVVAYTNMDSQNGGNIDT

SEQ ID NO: 140855 - protein, 33 aa, Artificial Sequence
  Description of Artificial Sequence: Synthetic polypeptide
DEDEIATTNPVAYEQYGSVTSAANQLDNNPPPN

SEQ ID NO: 140856 - protein, 35 aa, Artificial Sequence
  Description of Artificial Sequence: Synthetic polypeptide
QEEEIRTTNPVATESYGSVAGMGENLVREGDGQGE

SEQ ID NO: 140857 - protein, 38 aa, Artificial Sequence
  Description of Artificial Sequence: Synthetic polypeptide
DEEEIRTTNPVATEAYGSVSTVVNNQQGNQAGTEQGND

SEQ ID NO: 140858 - protein, 36 aa, Artificial Sequence
  Description of Artificial Sequence: Synthetic polypeptide
DEEEIRTTNPVATEQYGCVCSSGEHNQENFGSDNQA

SEQ ID NO: 140859 - protein, 36 aa, Artificial Sequence
  Description of Artificial Sequence: Synthetic polypeptide
DEEEIRTTNPVATEQYGSVEPSPIMPAEPGLNVLLQ

SEQ ID NO: 140860 - protein, 35 aa, Artificial Sequence
  Description of Artificial Sequence: Synthetic polypeptide
DEEEIRTTNPVATEQYGCVCSSGEHNQEHFNSEQS

SEQ ID NO: 140861 - protein, 36 aa, Artificial Sequence
  Description of Artificial Sequence: Synthetic polypeptide
DEEEIRTTNPVATEQYGCVCSSGEHNQEGFNSDNQS

SEQ ID NO: 140862 - protein, 30 aa, Artificial Sequence
  Description of Artificial Sequence: Synthetic polypeptide
QEEEIATTNPVATEQYGEAPEVECQHEEQK

SEQ ID NO: 140863 - protein, 38 aa, Artificial Sequence
  Description of Artificial Sequence: Synthetic polypeptide
DESEIRTTNPVATEQYGSVDTNGDNGELQEEGNGNDDE

SEQ ID NO: 140864 - protein, 30 aa, Artificial Sequence
  Description of Artificial Sequence: Synthetic polypeptide
QEEEIATTNPVATEQYGEAPEVECQHEECK

SEQ ID NO: 140865 - protein, 33 aa, Artificial Sequence
  Description of Artificial Sequence: Synthetic polypeptide
TEDEVATTNPVAYEQWGSTCSTWEHNDERVGNR

SEQ ID NO: 140866 - protein, 33 aa, Artificial Sequence
  Description of Artificial Sequence: Synthetic polypeptide
CEDEIACTNPVATEQWGCNVATNLQAENAGMNA

SEQ ID NO: 140867 - protein, 34 aa, Artificial Sequence
  Description of Artificial Sequence: Synthetic polypeptide
TEEEICTTNPVAYEQWGCYVWQTNDHLQHRHDRR

SEQ ID NO: 140868 - protein, 35 aa, Artificial Sequence
  Description of Artificial Sequence: Synthetic polypeptide
DESEIRTTNPVAYECWGSVSWINGEPQDREGKNGS

SEQ ID NO: 140869 - protein, 34 aa, Artificial Sequence
  Description of Artificial Sequence: Synthetic polypeptide
DESEIRTTNPVAYECWGSVSWINPENQDREGESG

SEQ ID NO: 140870 - protein, 30 aa, Artificial Sequence
  Description of Artificial Sequence: Synthetic polypeptide
QEEEIATTNPVATEQYGEYPWVDQHSISEQ

SEQ ID NO: 140871 - protein, 33 aa, Artificial Sequence
  Description of Artificial Sequence: Synthetic polypeptide
CEEEIACTNPVATEQYGCVAGTNSHQEADMIRE

SEQ ID NO: 140872 - protein, 35 aa, Artificial Sequence
  Description of Artificial Sequence: Synthetic polypeptide
DEEEIRTTNPVATEPYGTISSMPDIQNMQNGMNPV

SEQ ID NO: 140873 - protein, 33 aa, Artificial Sequence
  Description of Artificial Sequence: Synthetic polypeptide
CEEEIACTNPVATEQYGCVAGTNSHQEADMMNH

SEQ ID NO: 140874 - protein, 35 aa, Artificial Sequence
  Description of Artificial Sequence: Synthetic polypeptide
DECEIATTNPVAYEQWGSVSKNNEQLDERPGDNQM

SEQ ID NO: 140875 - protein, 34 aa, Artificial Sequence
  Description of Artificial Sequence: Synthetic polypeptide
YEEEIRSVNPVATEQYGSVSSDPAGPQMSGMNPV

SEQ ID NO: 140876 - protein, 30 aa, Artificial Sequence
  Description of Artificial Sequence: Synthetic polypeptide
QEEEIATTNPVATEQYGEYPWVDQHNSETQ

SEQ ID NO: 140877 - protein, 31 aa, Artificial Sequence
  Description of Artificial Sequence: Synthetic polypeptide
DESEIATTNPVGTECYGVTTAAETLQPKGDI

SEQ ID NO: 140878 - protein, 37 aa, Artificial Sequence
  Description of Artificial Sequence: Synthetic polypeptide
AEEEIRTTNPVATEQYGSVVVSVATNQNQEQGETEDE

SEQ ID NO: 140879 - protein, 29 aa, Artificial Sequence
  Description of Artificial Sequence: Synthetic peptide
QEEEIATTNPVATEQYGEAPEVEAEHEEK

SEQ ID NO: 140880 - protein, 36 aa, Artificial Sequence
  Description of Artificial Sequence: Synthetic polypeptide
DESEIRTTNPVATEQYGSVFSTEDAEQPGFGQDDML

SEQ ID NO: 140881 - protein, 35 aa, Artificial Sequence
  Description of Artificial Sequence: Synthetic polypeptide
DESEIRTTNPVATEQYGSVFVWINGEQERKSSDDN

SEQ ID NO: 140882 - protein, 39 aa, Artificial Sequence
  Description of Artificial Sequence: Synthetic polypeptide
DEEEIRTTNPVATEAYGSVSVTVNNNNLQQGTNVTEDEE

SEQ ID NO: 140883 - protein, 36 aa, Artificial Sequence
  Description of Artificial Sequence: Synthetic polypeptide
QEEEIRTTNPVATEQYGSVVNMTMGLQSENEGQEGI

SEQ ID NO: 140884 - protein, 32 aa, Artificial Sequence
  Description of Artificial Sequence: Synthetic polypeptide
AEDEIACTNPVAYEQWGEASIENDHQRGNGER

SEQ ID NO: 140885 - protein, 31 aa, Artificial Sequence
  Description of Artificial Sequence: Synthetic polypeptide
QEEEIATTNPVATEQYGEAPEVEHSQHEGEV

SEQ ID NO: 140886 - protein, 35 aa, Artificial Sequence
  Description of Artificial Sequence: Synthetic polypeptide
QEEEIRTTNPVATEQYGSVVNMVGNGNDEGQTGEQ

SEQ ID NO: 140887 - protein, 31 aa, Artificial Sequence
  Description of Artificial Sequence: Synthetic polypeptide
DESEIATTNPVGTECWGVMACINEQDREGNI

SEQ ID NO: 140888 - protein, 38 aa, Artificial Sequence
  Description of Artificial Sequence: Synthetic polypeptide
DEEEIRTTNPVATEAYGSVSTVVNTQQLGGNTDEEEQD

SEQ ID NO: 140889 - protein, 34 aa, Artificial Sequence
  Description of Artificial Sequence: Synthetic polypeptide
DEEEIATTNPVATEQYGSVCAATANDADMPPDSN

SEQ ID NO: 140890 - protein, 35 aa, Artificial Sequence
  Description of Artificial Sequence: Synthetic polypeptide
DEEEIRTTNPVATEQYGCVCSSGEHNQEYFNSEQT

SEQ ID NO: 140891 - protein, 35 aa, Artificial Sequence
  Description of Artificial Sequence: Synthetic polypeptide
DEEEIRTTNPVATEQYGSVNNECHNDDDPSHGPQE

SEQ ID NO: 140892 - protein, 34 aa, Artificial Sequence
  Description of Artificial Sequence: Synthetic polypeptide
DESEIATTNPVATEQWGSVSATDEPQDHEGEEDL

SEQ ID NO: 140893 - protein, 35 aa, Artificial Sequence
  Description of Artificial Sequence: Synthetic polypeptide
DEEEIRTTNPVATEPYGTVSSMEAGPQQQNGMNPH

SEQ ID NO: 140894 - protein, 35 aa, Artificial Sequence
  Description of Artificial Sequence: Synthetic polypeptide
YEEEIRSTNPVCTEQYGVVSSTPNGPNMRNGMNPQ

SEQ ID NO: 140895 - protein, 35 aa, Artificial Sequence
  Description of Artificial Sequence: Synthetic polypeptide
DEEEIRTTNPVATEQYGCVCSSGEHNQENFNSDQN

SEQ ID NO: 140896 - protein, 34 aa, Artificial Sequence
  Description of Artificial Sequence: Synthetic polypeptide
DESEIATTNPVATEQWGSVSATDEPEDHEGENDL

SEQ ID NO: 140897 - protein, 33 aa, Artificial Sequence
  Description of Artificial Sequence: Synthetic polypeptide
DESEIATTNPVATEQWGSVSATDEPEDHEGEDL

SEQ ID NO: 140898 - protein, 35 aa, Artificial Sequence
  Description of Artificial Sequence: Synthetic polypeptide
DEEEIRTTNPVATEQYGCVCSSGEHNQENFGSDQP

SEQ ID NO: 140899 - protein, 36 aa, Artificial Sequence
  Description of Artificial Sequence: Synthetic polypeptide
QEEEIRTTNPVATEQYGSVYDNTDNINQNEGEGGEN

SEQ ID NO: 140900 - protein, 36 aa, Artificial Sequence
  Description of Artificial Sequence: Synthetic polypeptide
DEEEIRTTNPVATEQYGCVCSSGEHNQENFGSDNQN

SEQ ID NO: 140901 - protein, 38 aa, Artificial Sequence
  Description of Artificial Sequence: Synthetic polypeptide
DEEEIRTTNPVATEAYGSVSTVVNNQQLGNNGNEEEQE

SEQ ID NO: 140902 - protein, 35 aa, Artificial Sequence
  Description of Artificial Sequence: Synthetic polypeptide
DESEIRTTNPVATEQYGSVGDGNNDDEGEGNEIQD

SEQ ID NO: 140903 - protein, 36 aa, Artificial Sequence
  Description of Artificial Sequence: Synthetic polypeptide
DECEICTTNPVATEQYGSVSTTNQQLNGDEEETEDD

SEQ ID NO: 140904 - protein, 30 aa, Artificial Sequence
  Description of Artificial Sequence: Synthetic polypeptide
DESEIATTNPVATEGYGVTAADLAEPKGPI

SEQ ID NO: 140905 - protein, 35 aa, Artificial Sequence
  Description of Artificial Sequence: Synthetic polypeptide
DEEEIRTTNPVATEQYGSVIGPTNNVNMPHEQEDT

SEQ ID NO: 140906 - protein, 32 aa, Artificial Sequence
  Description of Artificial Sequence: Synthetic polypeptide
QEEEIATTNPVATEQYGSASATVCEDHEEEDL

SEQ ID NO: 140907 - protein, 36 aa, Artificial Sequence
  Description of Artificial Sequence: Synthetic polypeptide
DEEEIRTTNPVATEQYGCVCSSGEHFQESFGSENQG

SEQ ID NO: 140908 - protein, 35 aa, Artificial Sequence
  Description of Artificial Sequence: Synthetic polypeptide
DESEIATTNPVATEPYGSTVASCTVGLSAPGGNMF

SEQ ID NO: 140909 - protein, 34 aa, Artificial Sequence
  Description of Artificial Sequence: Synthetic polypeptide
AEDEICATNPVATEQYGVVATSENLLQLGIGNDD

SEQ ID NO: 140910 - protein, 30 aa, Artificial Sequence
  Description of Artificial Sequence: Synthetic polypeptide
QEEEIATTNPVATEQYGEYPWADQHFSSEQ

SEQ ID NO: 140911 - protein, 33 aa, Artificial Sequence
  Description of Artificial Sequence: Synthetic polypeptide
QEEEIRTTNPVATEQYGVVVSIEGMGGDEEVGI

SEQ ID NO: 140912 - protein, 36 aa, Artificial Sequence
  Description of Artificial Sequence: Synthetic polypeptide
DEEEIRTTNPVATEQYGSVSTEMNMVMPPVSEEPEC

SEQ ID NO: 140913 - protein, 34 aa, Artificial Sequence
  Description of Artificial Sequence: Synthetic polypeptide
QEEEIRTTNPVATEQYGVVVSINVGMGGDEEGGD

SEQ ID NO: 140914 - protein, 35 aa, Artificial Sequence
  Description of Artificial Sequence: Synthetic polypeptide
QEEEIRTTNPVATEQYGVVVSITGMGEGNDDGNED

SEQ ID NO: 140915 - protein, 37 aa, Artificial Sequence
  Description of Artificial Sequence: Synthetic polypeptide
DEEEIRTTNPVATEFYGSVSSTTPAWGPNMRNGMNPV

SEQ ID NO: 140916 - protein, 34 aa, Artificial Sequence
  Description of Artificial Sequence: Synthetic polypeptide
AEDEICATNPVATEQYGVVATSENLNQLGNGTDD

SEQ ID NO: 140917 - protein, 35 aa, Artificial Sequence
  Description of Artificial Sequence: Synthetic polypeptide
QEEEIRTTNPVATEQYGVVVSIVNGMEGGDEQEGN

SEQ ID NO: 140918 - protein, 36 aa, Artificial Sequence
  Description of Artificial Sequence: Synthetic polypeptide
DESEIATTNPVATEIYGSVCSNWNDGQDRQGDTNEI

SEQ ID NO: 140919 - protein, 37 aa, Artificial Sequence
  Description of Artificial Sequence: Synthetic polypeptide
DECEICTTNPVATEQYGSVSTTNQQQQGNQQGTNTTD

SEQ ID NO: 140920 - protein, 37 aa, Artificial Sequence
  Description of Artificial Sequence: Synthetic polypeptide
DECEICTTNPVATEQYGSVSTTNQQQQNNQQGTNTDE

SEQ ID NO: 140921 - protein, 31 aa, Artificial Sequence
  Description of Artificial Sequence: Synthetic polypeptide
AEDEIACTNPVAYEQWGEACENLQRGGTGER

SEQ ID NO: 140922 - protein, 33 aa, Artificial Sequence
  Description of Artificial Sequence: Synthetic polypeptide
TEEEICTTNPVAYEQYGVCITNMDSQNGGNYST

SEQ ID NO: 140923 - protein, 33 aa, Artificial Sequence
  Description of Artificial Sequence: Synthetic polypeptide
TEEEICTTNPVAYEQYGVVATHMDSQEGGNYST

SEQ ID NO: 140924 - protein, 33 aa, Artificial Sequence
  Description of Artificial Sequence: Synthetic polypeptide
TEEEICTTNPVAYEQYGVVATNMDDTAGGNYST

SEQ ID NO: 140925 - protein, 31 aa, Artificial Sequence
  Description of Artificial Sequence: Synthetic polypeptide
CEDEIACTNPVATEQWGCVAGTGLAMEMENR

SEQ ID NO: 140926 - protein, 33 aa, Artificial Sequence
  Description of Artificial Sequence: Synthetic polypeptide
TEEEICTTNPVAYEQYGVVATNMDSQNGGEDST

SEQ ID NO: 140927 - protein, 37 aa, Artificial Sequence
  Description of Artificial Sequence: Synthetic polypeptide
DEEEIRTTNPVATEAYGSVSTVNQQQQNATTNVATEE

SEQ ID NO: 140928 - protein, 35 aa, Artificial Sequence
  Description of Artificial Sequence: Synthetic polypeptide
QEEEIRTTNPVATEQYGVVSSTTPAGPNMRNGMDV

SEQ ID NO: 140929 - protein, 37 aa, Artificial Sequence
  Description of Artificial Sequence: Synthetic polypeptide
DEEEIRTTNPVATEQYGSVEPNWTNALMPSLTEEVRD

SEQ ID NO: 140930 - protein, 36 aa, Artificial Sequence
  Description of Artificial Sequence: Synthetic polypeptide
DESEIATTNPVATEQWGCVTAATANGLQPRDAGPNS

SEQ ID NO: 140931 - protein, 35 aa, Artificial Sequence
  Description of Artificial Sequence: Synthetic polypeptide
DEEEIATTNPVATEQYGSVCAAMNHDQAMPENDVH

SEQ ID NO: 140932 - protein, 36 aa, Artificial Sequence
  Description of Artificial Sequence: Synthetic polypeptide
DEEEIRTTNPVATEQYGSVEPNNNLHMMTEDVNQNE

SEQ ID NO: 140933 - protein, 33 aa, Artificial Sequence
  Description of Artificial Sequence: Synthetic polypeptide
QEEEIRTTNPVAYEEYGKISTHEESQNRVGTFC

SEQ ID NO: 140934 - protein, 31 aa, Artificial Sequence
  Description of Artificial Sequence: Synthetic polypeptide
QEEEIATTNPVATEQYGEYPWVDQHFNSEQG

SEQ ID NO: 140935 - protein, 34 aa, Artificial Sequence
  Description of Artificial Sequence: Synthetic polypeptide
TEEEICTTNPVAYEQYGMVATNMDDQNEGGNYST

SEQ ID NO: 140936 - protein, 35 aa, Artificial Sequence
  Description of Artificial Sequence: Synthetic polypeptide
YEEEIRSVNPVATEQYGSVSSTPAGPNMSNGMNPV

SEQ ID NO: 140937 - protein, 37 aa, Artificial Sequence
  Description of Artificial Sequence: Synthetic polypeptide
DEEEIRTTNPVATEQYGSVSTEMEMYMEPVSLEPDNE

SEQ ID NO: 140938 - protein, 36 aa, Artificial Sequence
  Description of Artificial Sequence: Synthetic polypeptide
DEEEIRTTNPVATEPYGSYRCFTTNSQHMRGGVVEV

SEQ ID NO: 140939 - protein, 30 aa, Artificial Sequence
  Description of Artificial Sequence: Synthetic polypeptide
QEEEIATTNPVATEQYGEYPWGVDQHMSEQ

SEQ ID NO: 140940 - protein, 35 aa, Artificial Sequence
  Description of Artificial Sequence: Synthetic polypeptide
DEEEIRTTNPVATEQYGSVNNIGGKDNDGSMQVGA

SEQ ID NO: 140941 - protein, 35 aa, Artificial Sequence
  Description of Artificial Sequence: Synthetic polypeptide
TEDEIRTTNPVAYEQWGSVCSTTDDQDHQGRNGER

SEQ ID NO: 140942 - protein, 35 aa, Artificial Sequence
  Description of Artificial Sequence: Synthetic polypeptide
DEEEIATTNPVATEQWGSVSGEGMNPGQAGPPGEP

SEQ ID NO: 140943 - protein, 35 aa, Artificial Sequence
  Description of Artificial Sequence: Synthetic polypeptide
DEEEIRTTNPVATEQYGSVNNLEVELEVLDNEHQD

SEQ ID NO: 140944 - protein, 30 aa, Artificial Sequence
  Description of Artificial Sequence: Synthetic polypeptide
QEEEIATTNPVATEQYGEAPEVDIQHHEEK

SEQ ID NO: 140945 - protein, 34 aa, Artificial Sequence
  Description of Artificial Sequence: Synthetic polypeptide
DEEEIRTTNPVATEQYGSVEPMTMSGFPMEEVVQ

SEQ ID NO: 140946 - protein, 36 aa, Artificial Sequence
  Description of Artificial Sequence: Synthetic polypeptide
DEEEIRTTNPVATEQYGSVNNLTLVELEVLDNENQD

SEQ ID NO: 140947 - protein, 35 aa, Artificial Sequence
  Description of Artificial Sequence: Synthetic polypeptide
AEEEIRTTNPVATEAYGVVSTSTQNGNVEQGTEES

SEQ ID NO: 140948 - protein, 34 aa, Artificial Sequence
  Description of Artificial Sequence: Synthetic polypeptide
QEEEIRTTNPVATEQYGVMSSTTPAGPNMRGMDV

SEQ ID NO: 140949 - protein, 35 aa, Artificial Sequence
  Description of Artificial Sequence: Synthetic polypeptide
DEEEIRTTNPVATEQYGCVCSSGEHNAFFNSDNQS

SEQ ID NO: 140950 - protein, 36 aa, Artificial Sequence
  Description of Artificial Sequence: Synthetic polypeptide
DEEEIRTTNPVATEPYGSYRCETTNSQHNRGGVHCV

SEQ ID NO: 140951 - protein, 33 aa, Artificial Sequence
  Description of Artificial Sequence: Synthetic polypeptide
QEEEIRTTNPVATEQYGVVDNEMNDTGGGGGGT

SEQ ID NO: 140952 - protein, 34 aa, Artificial Sequence
  Description of Artificial Sequence: Synthetic polypeptide
QEEEIRTTNPVATEQYGVVGGMGDNLNIEGMEFT

SEQ ID NO: 140953 - protein, 36 aa, Artificial Sequence
  Description of Artificial Sequence: Synthetic polypeptide
DESEIRTTNPVATEQYGSVCEMEGDVLQDQMEGNED

SEQ ID NO: 140954 - protein, 34 aa, Artificial Sequence
  Description of Artificial Sequence: Synthetic polypeptide
DEEEIATTNPVATEQWGSVSGEGNEPGDPQGPPV

SEQ ID NO: 140955 - protein, 34 aa, Artificial Sequence
  Description of Artificial Sequence: Synthetic polypeptide
QEEEIRTTNPVAYEQYGTIACCVNSLSQNRTVNP

SEQ ID NO: 140956 - protein, 38 aa, Artificial Sequence
  Description of Artificial Sequence: Synthetic polypeptide
DEEEIRTTNPVATEFYGSVSVMDTDNQIGQQRIINGDI

SEQ ID NO: 140957 - protein, 30 aa, Artificial Sequence
  Description of Artificial Sequence: Synthetic polypeptide
QEEEIATTNPVATEQYGEAPEVVCQDHEEK

SEQ ID NO: 140958 - protein, 31 aa, Artificial Sequence
  Description of Artificial Sequence: Synthetic polypeptide
AECEIATTNPVAYEQWGSLSCFEHDQRQGEA

SEQ ID NO: 140959 - protein, 33 aa, Artificial Sequence
  Description of Artificial Sequence: Synthetic polypeptide
AEDEICATNPVATEQYGVVATSENLQQLGIGTD

SEQ ID NO: 140960 - protein, 37 aa, Artificial Sequence
  Description of Artificial Sequence: Synthetic polypeptide
DEEEIRTTNPVATEFYGTVTSMTDNGEGQEGGENTEF

SEQ ID NO: 140961 - protein, 32 aa, Artificial Sequence
  Description of Artificial Sequence: Synthetic polypeptide
DESEIATTNPVATECYGSAPCINCPQDHEGEG

SEQ ID NO: 140962 - protein, 30 aa, Artificial Sequence
  Description of Artificial Sequence: Synthetic polypeptide
QEEEIRTTNPVSTEPYGTASEDCQQQQEEK

SEQ ID NO: 140963 - protein, 29 aa, Artificial Sequence
  Description of Artificial Sequence: Synthetic peptide
QEEAIATTNPVATEQYGEAPEVCQAHEEK

SEQ ID NO: 140964 - protein, 33 aa, Artificial Sequence
  Description of Artificial Sequence: Synthetic polypeptide
DEDEIATTNPVAYEQYGSVAIAHDEQTGEQNEN

SEQ ID NO: 140965 - protein, 36 aa, Artificial Sequence
  Description of Artificial Sequence: Synthetic polypeptide
AEEEIRTTNPVATEAYGSVSVTVTNNQLQQNEEEDG

SEQ ID NO: 140966 - protein, 30 aa, Artificial Sequence
  Description of Artificial Sequence: Synthetic polypeptide
QEEEIRTTNPVSTEPYGTISEDCQQQQEEK

SEQ ID NO: 140967 - protein, 32 aa, Artificial Sequence
  Description of Artificial Sequence: Synthetic polypeptide
DESEIATTNPVGTEGYGVVSSSAGPQRNGMDI

SEQ ID NO: 140968 - protein, 37 aa, Artificial Sequence
  Description of Artificial Sequence: Synthetic polypeptide
AEEEIRTTNPVATEAYGSVSVTTQLNNQQGATNVATE

SEQ ID NO: 140969 - protein, 35 aa, Artificial Sequence
  Description of Artificial Sequence: Synthetic polypeptide
DECEICTTNPVATEQYGSVSTTQQQLEGEEEEEDD

SEQ ID NO: 140970 - protein, 33 aa, Artificial Sequence
  Description of Artificial Sequence: Synthetic polypeptide
QEDIIRTTNPVATEQYGCVSTNTGQQTFPESLE

SEQ ID NO: 140971 - protein, 36 aa, Artificial Sequence
  Description of Artificial Sequence: Synthetic polypeptide
DEEEIRTTNPVATEQYGSVNNNEDVEEEVLDNKNQD

SEQ ID NO: 140972 - protein, 34 aa, Artificial Sequence
  Description of Artificial Sequence: Synthetic polypeptide
DESEIRTTNPVATEQYGCVSTEVNEIGIIVDFEH

SEQ ID NO: 140973 - protein, 34 aa, Artificial Sequence
  Description of Artificial Sequence: Synthetic polypeptide
QEEEIRTTNPVATEQYGSVNDDNMIETGGGQTTG

SEQ ID NO: 140974 - protein, 30 aa, Artificial Sequence
  Description of Artificial Sequence: Synthetic polypeptide
QEEEIATTNPVATEQYGEAPEVVCQHEEFK

SEQ ID NO: 140975 - protein, 34 aa, Artificial Sequence
  Description of Artificial Sequence: Synthetic polypeptide
AEDEICATNPVATEQYGVVATSENLQQLGNGNDD

SEQ ID NO: 140976 - protein, 38 aa, Artificial Sequence
  Description of Artificial Sequence: Synthetic polypeptide
DEEEIRTTNPVATEAYGSVSTVNDQQNNTQQGTNVATE

SEQ ID NO: 140977 - protein, 38 aa, Artificial Sequence
  Description of Artificial Sequence: Synthetic polypeptide
DEEEIRTTNPVATEAYGSVSTTVVNNNQQGNNDEEDEE

SEQ ID NO: 140978 - protein, 36 aa, Artificial Sequence
  Description of Artificial Sequence: Synthetic polypeptide
DEEEIRTTNPVATEQYGSVIMTTPDGPEMGNGENDG

SEQ ID NO: 140979 - protein, 35 aa, Artificial Sequence
  Description of Artificial Sequence: Synthetic polypeptide
AEEEIRTTNPVATEQYGCVCSNTGEDQFFNSNFQS

SEQ ID NO: 140980 - protein, 34 aa, Artificial Sequence
  Description of Artificial Sequence: Synthetic polypeptide
DESEIATTNPVATECYGSVSACIDEPQDREGEEG

SEQ ID NO: 140981 - protein, 33 aa, Artificial Sequence
  Description of Artificial Sequence: Synthetic polypeptide
DESEIRTTNPVAYEQWGSTCPTDNGDQQQSQRN

SEQ ID NO: 140982 - protein, 36 aa, Artificial Sequence
  Description of Artificial Sequence: Synthetic polypeptide
QEEEIRTTNPVATEQYGSVNGTDNNDQQEEGGFGEN

SEQ ID NO: 140983 - protein, 35 aa, Artificial Sequence
  Description of Artificial Sequence: Synthetic polypeptide
AEEEIRTTNPVATEAYGSVVTVTNNQQQNEEEEED

SEQ ID NO: 140984 - protein, 35 aa, Artificial Sequence
  Description of Artificial Sequence: Synthetic polypeptide
AEEEIRTTNPVATEAYGSVVTVTNNQQQGEEEEDD

SEQ ID NO: 140985 - protein, 34 aa, Artificial Sequence
  Description of Artificial Sequence: Synthetic polypeptide
DESEIRTTNPVAYEPWGSVVSCIHESQDRTGENG

SEQ ID NO: 140986 - protein, 35 aa, Artificial Sequence
  Description of Artificial Sequence: Synthetic polypeptide
DESEIRTTNPVAYEPYGKTVCSTSFSQNRGLNYEN

SEQ ID NO: 140987 - protein, 36 aa, Artificial Sequence
  Description of Artificial Sequence: Synthetic polypeptide
AEEEIRTTNPVATEAYGSVVTVTNNQLQQGEEEEQD

SEQ ID NO: 140988 - protein, 38 aa, Artificial Sequence
  Description of Artificial Sequence: Synthetic polypeptide
DEEEIRTTNPVATEAYGSVSTVNNNNNNLNQANNDEQD

SEQ ID NO: 140989 - protein, 33 aa, Artificial Sequence
  Description of Artificial Sequence: Synthetic polypeptide
DESEIRTTNPVAYEQWGCTCPTDNGDQRQSDQR

SEQ ID NO: 140990 - protein, 36 aa, Artificial Sequence
  Description of Artificial Sequence: Synthetic polypeptide
AEEEIRTTNPVATEAYGSVVTVTNNQLQQGEEEEDD

SEQ ID NO: 140991 - protein, 36 aa, Artificial Sequence
  Description of Artificial Sequence: Synthetic polypeptide
AEEEIRTTNPVATEAYGSVVTVTNNLQNQQGEEEED

SEQ ID NO: 140992 - protein, 38 aa, Artificial Sequence
  Description of Artificial Sequence: Synthetic polypeptide
DEEEIRTTNPVATEAYGSVSTVNNNNLQQNEEIGTTEQ

SEQ ID NO: 140993 - protein, 33 aa, Artificial Sequence
  Description of Artificial Sequence: Synthetic polypeptide
DESEIRTTNPVAYEQWGEVMWTEHDNRGGDSRD

SEQ ID NO: 140994 - protein, 35 aa, Artificial Sequence
  Description of Artificial Sequence: Synthetic polypeptide
AEEEIRTTNPVATEQYGCVCSNTEDQENFNSDTQS

SEQ ID NO: 140995 - protein, 32 aa, Artificial Sequence
  Description of Artificial Sequence: Synthetic polypeptide
DECEIATTNPVAYEKWGSVTGGNGNAGNDGQR

SEQ ID NO: 140996 - protein, 34 aa, Artificial Sequence
  Description of Artificial Sequence: Synthetic polypeptide
DEEEIATTNPVATEQYGSVCAATGEEPADEMNNN

SEQ ID NO: 140997 - protein, 37 aa, Artificial Sequence
  Description of Artificial Sequence: Synthetic polypeptide
AEEEIRTTNPVATEAYGSVTVVVTTNLQQGTDEENND

SEQ ID NO: 140998 - protein, 37 aa, Artificial Sequence
  Description of Artificial Sequence: Synthetic polypeptide
AEEEIRTTNPVATEAYGSVTVVTTNLNQQGNNTNNND

SEQ ID NO: 140999 - protein, 29 aa, Artificial Sequence
  Description of Artificial Sequence: Synthetic peptide
QEEEIATTNPVATEQYGEAPEVVCIHEEK

SEQ ID NO: 141000 - protein, 34 aa, Artificial Sequence
  Description of Artificial Sequence: Synthetic polypeptide
DEEEIATTNPVATEQYGSVCAATGEEPATEMMNN

SEQ ID NO: 141001 - protein, 37 aa, Artificial Sequence
  Description of Artificial Sequence: Synthetic polypeptide
DEEEIRTTNPVATEFYGSVYVDDTDNQDQQRIINGDG

SEQ ID NO: 141002 - protein, 36 aa, Artificial Sequence
  Description of Artificial Sequence: Synthetic polypeptide
DEEEIRTTNPVATEFYGTMTSMTTNGEGQEGGENTE

SEQ ID NO: 141003 - protein, 33 aa, Artificial Sequence
  Description of Artificial Sequence: Synthetic polypeptide
DESEIRTTNPVAYEQWGSTCPTDNGDQDRQSQH

SEQ ID NO: 141004 - protein, 33 aa, Artificial Sequence
  Description of Artificial Sequence: Synthetic polypeptide
DECEIATTNPVAYEHWGSVSGGNGNAGNDGQRN

SEQ ID NO: 141005 - protein, 34 aa, Artificial Sequence
  Description of Artificial Sequence: Synthetic polypeptide
DEDEIATTNPVAYEQYGSVAIANNDTQDDGNDTN

SEQ ID NO: 141006 - protein, 35 aa, Artificial Sequence
  Description of Artificial Sequence: Synthetic polypeptide
DEEEIRTTNPVATEQYGSVIMVHVNQQADLVEFGQ

SEQ ID NO: 141007 - protein, 36 aa, Artificial Sequence
  Description of Artificial Sequence: Synthetic polypeptide
QEEEIRTTNPVATEQYGSVMSGMNMDDGEGESINGD

SEQ ID NO: 141008 - protein, 29 aa, Artificial Sequence
  Description of Artificial Sequence: Synthetic peptide
DESEIATTNPVATECYGEAPEVCQHEEEK

SEQ ID NO: 141009 - protein, 34 aa, Artificial Sequence
  Description of Artificial Sequence: Synthetic polypeptide
QEEEIATTNPVATEQYGSASSTEPAGNMREMNPV

SEQ ID NO: 141010 - protein, 33 aa, Artificial Sequence
  Description of Artificial Sequence: Synthetic polypeptide
DEEEIRTTNPVATEFYGVVTVGNMDDGGGQEDD

SEQ ID NO: 141011 - protein, 34 aa, Artificial Sequence
  Description of Artificial Sequence: Synthetic polypeptide
DEEEIRTTNPVATEFYGVVVDDNFTMEEDGENGA

SEQ ID NO: 141012 - protein, 35 aa, Artificial Sequence
  Description of Artificial Sequence: Synthetic polypeptide
DEEEIRTTNPVATEQYGCVCSSEHNQENFNSDTQP

SEQ ID NO: 141013 - protein, 34 aa, Artificial Sequence
  Description of Artificial Sequence: Synthetic polypeptide
DEEEIRTTNPVATEFYGVVVDDNMTMEEDGENEI

SEQ ID NO: 141014 - protein, 36 aa, Artificial Sequence
  Description of Artificial Sequence: Synthetic polypeptide
DEEEIRTTNPVATEFYGVVVDGGGNATNLDEGGNGG

SEQ ID NO: 141015 - protein, 33 aa, Artificial Sequence
  Description of Artificial Sequence: Synthetic polypeptide
DESEIRTTNPVAYEQWGSVCVNWEHQEQDMDQR

SEQ ID NO: 141016 - protein, 34 aa, Artificial Sequence
  Description of Artificial Sequence: Synthetic polypeptide
DEEEIATTNPVATEQYGSVCAATGVEPEDEEGFP

SEQ ID NO: 141017 - protein, 33 aa, Artificial Sequence
  Description of Artificial Sequence: Synthetic polypeptide
TEAEIATTNPVVTEQYGEVSWNEGEGRQRGDTP

SEQ ID NO: 141018 - protein, 33 aa, Artificial Sequence
  Description of Artificial Sequence: Synthetic polypeptide
DECEIATTNPVAYEEWGSVSGGNQGNAGNDGDR

SEQ ID NO: 141019 - protein, 34 aa, Artificial Sequence
  Description of Artificial Sequence: Synthetic polypeptide
QEEEIRTTNPVATEQYGSVMNGFNGGGFGDTEGV

SEQ ID NO: 141020 - protein, 36 aa, Artificial Sequence
  Description of Artificial Sequence: Synthetic polypeptide
DEEEIRTTNPVATECYGTSTTTILTVNNQPLIVNRN

SEQ ID NO: 141021 - protein, 32 aa, Artificial Sequence
  Description of Artificial Sequence: Synthetic polypeptide
DECEIATTNPVAYEEWGSVSGGNGNAGNDNNN

SEQ ID NO: 141022 - protein, 32 aa, Artificial Sequence
  Description of Artificial Sequence: Synthetic polypeptide
TEAEIATTNPVATEQYGCVATNNNNVANENGE

SEQ ID NO: 141023 - protein, 35 aa, Artificial Sequence
  Description of Artificial Sequence: Synthetic polypeptide
TEAEIATTNPVATENYGCVSTGNGLNDTERGGGER

SEQ ID NO: 141024 - protein, 29 aa, Artificial Sequence
  Description of Artificial Sequence: Synthetic peptide
QEDEIATTNPVATEQYGEAPPEVCQHEEK

SEQ ID NO: 141025 - protein, 34 aa, Artificial Sequence
  Description of Artificial Sequence: Synthetic polypeptide
AEDEICATNPVATEQYGVVATSENNLQLGGNGDD

SEQ ID NO: 141026 - protein, 34 aa, Artificial Sequence
  Description of Artificial Sequence: Synthetic polypeptide
DESEIRTTNPVAYEQWGSVSGGNGNGDAGEGNTM

SEQ ID NO: 141027 - protein, 37 aa, Artificial Sequence
  Description of Artificial Sequence: Synthetic polypeptide
DEEEIRTTNPVATEPYGSVCVFTNYNLATNRIGQEVL

SEQ ID NO: 141028 - protein, 34 aa, Artificial Sequence
  Description of Artificial Sequence: Synthetic polypeptide
DESEIRTTNPVAYEQWGSVSGGNGNPAGEGNNEM

SEQ ID NO: 141029 - protein, 33 aa, Artificial Sequence
  Description of Artificial Sequence: Synthetic polypeptide
DEDEIATTNPVAYEQYGSVAATPHGENNRGEPE

SEQ ID NO: 141030 - protein, 32 aa, Artificial Sequence
  Description of Artificial Sequence: Synthetic polypeptide
DEEEIATTNPVATEQYGEAPTTVCPNHEMNPV

SEQ ID NO: 141031 - protein, 34 aa, Artificial Sequence
  Description of Artificial Sequence: Synthetic polypeptide
DEDEIATTNPVAYEQYGSVAATNLTGTPDGSAEN

SEQ ID NO: 141032 - protein, 35 aa, Artificial Sequence
  Description of Artificial Sequence: Synthetic polypeptide
TEACIRTTNPVATEQYGCVSCTLNEVSQFLGGNDC

SEQ ID NO: 141033 - protein, 38 aa, Artificial Sequence
  Description of Artificial Sequence: Synthetic polypeptide
DEEEIRTTNPVATEAYGSVSTTNNQQNNQQQGTNVATE

SEQ ID NO: 141034 - protein, 36 aa, Artificial Sequence
  Description of Artificial Sequence: Synthetic polypeptide
DEEEIATTNPVATEQWGSVSGTNGPTQPAAEANENE

SEQ ID NO: 141035 - protein, 35 aa, Artificial Sequence
  Description of Artificial Sequence: Synthetic polypeptide
DEEEIRTTNPVATEQYGSVSTETDDHADEASDLES

SEQ ID NO: 141036 - protein, 36 aa, Artificial Sequence
  Description of Artificial Sequence: Synthetic polypeptide
AEEEIRTTNPVATEAYGSVSTVVTTNNVEEGTNAQD

SEQ ID NO: 141037 - protein, 31 aa, Artificial Sequence
  Description of Artificial Sequence: Synthetic polypeptide
DESEIATTNPVATECYGDVSCICEPQHEEEL

SEQ ID NO: 141038 - protein, 34 aa, Artificial Sequence
  Description of Artificial Sequence: Synthetic polypeptide
CEDEIACTNPVATEQYGCVAGTNNLQAEAAGEND

SEQ ID NO: 141039 - protein, 36 aa, Artificial Sequence
  Description of Artificial Sequence: Synthetic polypeptide
DEEEIRTTNPVATEQYGSVNNNEEELEVLDSKNTQD

SEQ ID NO: 141040 - protein, 30 aa, Artificial Sequence
  Description of Artificial Sequence: Synthetic polypeptide
QEEEIATTNPVATEQYGEAPEVVCQHEEKI

SEQ ID NO: 141041 - protein, 36 aa, Artificial Sequence
  Description of Artificial Sequence: Synthetic polypeptide
DEEEIRTTNPVATEPYGSVSSTTPAGPNMRNGMEPV

SEQ ID NO: 141042 - protein, 35 aa, Artificial Sequence
  Description of Artificial Sequence: Synthetic polypeptide
QEDEIRTTNPVATEQYGSVSIAGLGDQGGGEIDET

SEQ ID NO: 141043 - protein, 35 aa, Artificial Sequence
  Description of Artificial Sequence: Synthetic polypeptide
DEEEIATTNPVATEQYGSVCAAMNHDNMGGENGHW

SEQ ID NO: 141044 - protein, 35 aa, Artificial Sequence
  Description of Artificial Sequence: Synthetic polypeptide
QEDEIRTTNPVATEQYGSVDTDDTMDDNGQGGGQG

SEQ ID NO: 141045 - protein, 30 aa, Artificial Sequence
  Description of Artificial Sequence: Synthetic polypeptide
QEEEIATTNPVATEQYGEAPEVVCQHEETK

SEQ ID NO: 141046 - protein, 35 aa, Artificial Sequence
  Description of Artificial Sequence: Synthetic polypeptide
DESEIRTTNPVATEQYGCVLSPWDPLNSPEGFENN

SEQ ID NO: 141047 - protein, 37 aa, Artificial Sequence
  Description of Artificial Sequence: Synthetic polypeptide
AEEEIRTTNPVATEAYGSVSVTTNLANQQEATNVATE

SEQ ID NO: 141048 - protein, 30 aa, Artificial Sequence
  Description of Artificial Sequence: Synthetic polypeptide
QEEEIATTNPVATEQYGEAPEVVCQNHEEK

SEQ ID NO: 141049 - protein, 33 aa, Artificial Sequence
  Description of Artificial Sequence: Synthetic polypeptide
DECEIATTNPVAYEGWGSVATSNGNQNDGNNSH

SEQ ID NO: 141050 - protein, 34 aa, Artificial Sequence
  Description of Artificial Sequence: Synthetic polypeptide
DECEIATTNPVAYEGWGSVATSNGNQANDGNNNR

SEQ ID NO: 141051 - protein, 37 aa, Artificial Sequence
  Description of Artificial Sequence: Synthetic polypeptide
QEEEIRTTNPVATEQYGSVMSGGNGGGQGENDGNGGV

SEQ ID NO: 141052 - protein, 32 aa, Artificial Sequence
  Description of Artificial Sequence: Synthetic polypeptide
QEEEIRTTNPVSTEQYGEISMEVCQQQHNENH

SEQ ID NO: 141053 - protein, 35 aa, Artificial Sequence
  Description of Artificial Sequence: Synthetic polypeptide
DESEIRTTNPVATEQYGCVCSTGEHNQENFGSEQA

SEQ ID NO: 141054 - protein, 34 aa, Artificial Sequence
  Description of Artificial Sequence: Synthetic polypeptide
DECEICTTNPVATEQYGSVSTTSQLNEDEEEETD

SEQ ID NO: 141055 - protein, 34 aa, Artificial Sequence
  Description of Artificial Sequence: Synthetic polypeptide
DEDEIATTNPVAYEQYGSVAGTGHGQDSDGNAQE

SEQ ID NO: 141056 - protein, 38 aa, Artificial Sequence
  Description of Artificial Sequence: Synthetic polypeptide
DEEEIRTTNPVATEAYGSVSTTNQNQQAGNQQGTTNEE

SEQ ID NO: 141057 - protein, 38 aa, Artificial Sequence
  Description of Artificial Sequence: Synthetic polypeptide
DEEEIRTTNPVATEAYGSVSTTNQAGNQQGNTEEGTTE

SEQ ID NO: 141058 - protein, 38 aa, Artificial Sequence
  Description of Artificial Sequence: Synthetic polypeptide
DEEEIRTTNPVATEAYGSVSTTNQAGGNNNQQGTNSDE

SEQ ID NO: 141059 - protein, 34 aa, Artificial Sequence
  Description of Artificial Sequence: Synthetic polypeptide
DESEIRTTNPVAYEQWGSVCSGENDQHDTNGHKD

SEQ ID NO: 141060 - protein, 35 aa, Artificial Sequence
  Description of Artificial Sequence: Synthetic polypeptide
YEEEIRTTNPVATEQYGAVNTDNMQETNGGGQEQG

SEQ ID NO: 141061 - protein, 36 aa, Artificial Sequence
  Description of Artificial Sequence: Synthetic polypeptide
DESEIRTTNPVATEQYGSCASPWNLPQETQIEDNGY

SEQ ID NO: 141062 - protein, 31 aa, Artificial Sequence
  Description of Artificial Sequence: Synthetic polypeptide
DESEIATTNPVGTEGYGVTTASETLQHKGDI

SEQ ID NO: 141063 - protein, 36 aa, Artificial Sequence
  Description of Artificial Sequence: Synthetic polypeptide
AEEEIRTTNPVATEAYGSVVVSVTNNNEQGNNNTNL

SEQ ID NO: 141064 - protein, 28 aa, Artificial Sequence
  Description of Artificial Sequence: Synthetic peptide
DESEIATTNPVGTEGYGVMASIEQAEDA

SEQ ID NO: 141065 - protein, 35 aa, Artificial Sequence
  Description of Artificial Sequence: Synthetic polypeptide
DEEEIRTTNPVATEQYGCVCSSGEHAEFFGSDNQA

SEQ ID NO: 141066 - protein, 34 aa, Artificial Sequence
  Description of Artificial Sequence: Synthetic polypeptide
AEEEIRTTNPVATEQYGCVCSDWGEHQNFNSDQS

SEQ ID NO: 141067 - protein, 32 aa, Artificial Sequence
  Description of Artificial Sequence: Synthetic polypeptide
DESEIATTNPVATEGYGNVAATDLESHVGEDL

SEQ ID NO: 141068 - protein, 35 aa, Artificial Sequence
  Description of Artificial Sequence: Synthetic polypeptide
DEEEIRTTNPVATEQYGCVCSSGEDQESFNSDNQS

SEQ ID NO: 141069 - protein, 35 aa, Artificial Sequence
  Description of Artificial Sequence: Synthetic polypeptide
TEAEISTTNPVAYEQYGVSVSNNALSHHGDGGNNR

SEQ ID NO: 141070 - protein, 35 aa, Artificial Sequence
  Description of Artificial Sequence: Synthetic polypeptide
TEAEISTTNPVAYEQYGSVWVTNALSHHRDGGNNA

SEQ ID NO: 141071 - protein, 34 aa, Artificial Sequence
  Description of Artificial Sequence: Synthetic polypeptide
DECEICTTNPVATEQYGSVSTTQLGEDEEETEDD

SEQ ID NO: 141072 - protein, 35 aa, Artificial Sequence
  Description of Artificial Sequence: Synthetic polypeptide
TEAEISTTNPVAYEQYGSVWITNAASHHRDGGNNR

SEQ ID NO: 141073 - protein, 36 aa, Artificial Sequence
  Description of Artificial Sequence: Synthetic polypeptide
TEAEISTTNPVAYEQYGSVSTINALSHHRDGGNNYE

SEQ ID NO: 141074 - protein, 30 aa, Artificial Sequence
  Description of Artificial Sequence: Synthetic polypeptide
QEEEIATTNPVATEQYGEAPEVDCQHVEEK

SEQ ID NO: 141075 - protein, 36 aa, Artificial Sequence
  Description of Artificial Sequence: Synthetic polypeptide
TEAEISTTNPVAYEQYGQSVSYGNALSHHRDGGNNR

SEQ ID NO: 141076 - protein, 29 aa, Artificial Sequence
  Description of Artificial Sequence: Synthetic peptide
QEECIATTNPVATEQYGEAPEVCFQHEEK

SEQ ID NO: 141077 - protein, 32 aa, Artificial Sequence
  Description of Artificial Sequence: Synthetic polypeptide
DESEIATTNPVATEGYGNVAATDLEDHVGEDL

SEQ ID NO: 141078 - protein, 34 aa, Artificial Sequence
  Description of Artificial Sequence: Synthetic polypeptide
DEEEIATTNPVATEQYGSVCAATGEEAIDNMNNN

SEQ ID NO: 141079 - protein, 34 aa, Artificial Sequence
  Description of Artificial Sequence: Synthetic polypeptide
DEEEIATTNPVATEQYGSVCAATGEEATDEMENN

SEQ ID NO: 141080 - protein, 30 aa, Artificial Sequence
  Description of Artificial Sequence: Synthetic polypeptide
QEEEIATTNPVATEQYGEAPEVSSQHETEK

SEQ ID NO: 141081 - protein, 34 aa, Artificial Sequence
  Description of Artificial Sequence: Synthetic polypeptide
AEDEICATNPVATEQYGVVATSENLNQLNGGNDD

SEQ ID NO: 141082 - protein, 34 aa, Artificial Sequence
  Description of Artificial Sequence: Synthetic polypeptide
QEEEIAPTNPCATEQYGIVSSCNGPQMSNGMNPR

SEQ ID NO: 141083 - protein, 33 aa, Artificial Sequence
  Description of Artificial Sequence: Synthetic polypeptide
DEDEIATTNPVAYEQYGSVATHGTGAPDGNDVH

SEQ ID NO: 141084 - protein, 34 aa, Artificial Sequence
  Description of Artificial Sequence: Synthetic polypeptide
QEEEIRTTNPVATEQYGSVVMGVGIEDEGGDENI

SEQ ID NO: 141085 - protein, 31 aa, Artificial Sequence
  Description of Artificial Sequence: Synthetic polypeptide
DECEIATTNPVAYEQWGCTYTNLMMEDGGTQ

SEQ ID NO: 141086 - protein, 35 aa, Artificial Sequence
  Description of Artificial Sequence: Synthetic polypeptide
DEEEIRTTNPVATEQYGCVCSSGEDIQENFGSQQS

SEQ ID NO: 141087 - protein, 35 aa, Artificial Sequence
  Description of Artificial Sequence: Synthetic polypeptide
DEEEIRTTNPVATEFYGSVVDGNMTMEFDGNGNGS

SEQ ID NO: 141088 - protein, 34 aa, Artificial Sequence
  Description of Artificial Sequence: Synthetic polypeptide
DEEEIRTTNPVATEFYGSVVDDNMTMEFDSENGN

SEQ ID NO: 141089 - protein, 36 aa, Artificial Sequence
  Description of Artificial Sequence: Synthetic polypeptide
AEEEIRTTNPVATEQYGSVVTVVTDGNNNLGGTNDD

SEQ ID NO: 141090 - protein, 33 aa, Artificial Sequence
  Description of Artificial Sequence: Synthetic polypeptide
TEDEICTTNPVGTAAWGCVVSCTNMLSQSGNRW

SEQ ID NO: 141091 - protein, 34 aa, Artificial Sequence
  Description of Artificial Sequence: Synthetic polypeptide
DEEEIATTNPVATEQYGSVCAATGEEAADEMGEN

SEQ ID NO: 141092 - protein, 32 aa, Artificial Sequence
  Description of Artificial Sequence: Synthetic polypeptide
DECEIATTNPVAYEQWGSTSKTLEDRQNMQSD

SEQ ID NO: 141093 - protein, 33 aa, Artificial Sequence
  Description of Artificial Sequence: Synthetic polypeptide
TEEEICTTNPVGTAAWGCVVSCTNMLSQSGNSV

SEQ ID NO: 141094 - protein, 35 aa, Artificial Sequence
  Description of Artificial Sequence: Synthetic polypeptide
DESEIRTTNPVATEQYGQCVCSTEHNQENFNSDQG

SEQ ID NO: 141095 - protein, 33 aa, Artificial Sequence
  Description of Artificial Sequence: Synthetic polypeptide
DECEIATTNPVAYEQWGSTMSKTLNEDRQNMQP

SEQ ID NO: 141096 - protein, 34 aa, Artificial Sequence
  Description of Artificial Sequence: Synthetic polypeptide
TEEEICTTNPVGTAAWGQVVQSCTNMLSQSGNRW

SEQ ID NO: 141097 - protein, 31 aa, Artificial Sequence
  Description of Artificial Sequence: Synthetic polypeptide
DECEIATTNPVAYEQWGSISKTLEDTQNMQH

SEQ ID NO: 141098 - protein, 34 aa, Artificial Sequence
  Description of Artificial Sequence: Synthetic polypeptide
TEEEICTTNPVGTAAWGSTVSCTNMISQSGNYRV

SEQ ID NO: 141099 - protein, 34 aa, Artificial Sequence
  Description of Artificial Sequence: Synthetic polypeptide
TEEEICTTNPVGTAAWGSVVSCTNMLSLSGNYRH

SEQ ID NO: 141100 - protein, 37 aa, Artificial Sequence
  Description of Artificial Sequence: Synthetic polypeptide
DEEEIRTTNPVATEQYGSVILPPKNLVIVPEQQLSNL

SEQ ID NO: 141101 - protein, 33 aa, Artificial Sequence
  Description of Artificial Sequence: Synthetic polypeptide
DECEIATTNPVAYEQWGSCSATDNNDHEGMNDS

SEQ ID NO: 141102 - protein, 33 aa, Artificial Sequence
  Description of Artificial Sequence: Synthetic polypeptide
TECEICTTNPVAYEQYGVVATNMDDQDGGNYST

SEQ ID NO: 141103 - protein, 34 aa, Artificial Sequence
  Description of Artificial Sequence: Synthetic polypeptide
TEEEICTTNPVGTAAWGSVVSCTNMLSQSGGNKW

SEQ ID NO: 141104 - protein, 34 aa, Artificial Sequence
  Description of Artificial Sequence: Synthetic polypeptide
TECEICTTNPCAYEQWGSVAPTDNQEQHRGGNGR

SEQ ID NO: 141105 - protein, 28 aa, Artificial Sequence
  Description of Artificial Sequence: Synthetic peptide
QEECIATTNPVATEQYGEAPEVCIPEEK

SEQ ID NO: 141106 - protein, 35 aa, Artificial Sequence
  Description of Artificial Sequence: Synthetic polypeptide
DEEEIATTNPVATEQYGSVCAATGEEAGDEMGFNN

SEQ ID NO: 141107 - protein, 34 aa, Artificial Sequence
  Description of Artificial Sequence: Synthetic polypeptide
TEEEICTTNPVGTAAWGSVVSCTNMLSQSGMDRW

SEQ ID NO: 141108 - protein, 35 aa, Artificial Sequence
  Description of Artificial Sequence: Synthetic polypeptide
DEEEIRTTNPVATEFYGSVVDDNMTFEFDGGENGS

SEQ ID NO: 141109 - protein, 34 aa, Artificial Sequence
  Description of Artificial Sequence: Synthetic polypeptide
TEEEICTTNPVGTAAWGSVVSCTNMLSQSGNDVV

SEQ ID NO: 141110 - protein, 34 aa, Artificial Sequence
  Description of Artificial Sequence: Synthetic polypeptide
TEEEICTTNPVGTAAWGSVVSYTNMDSQSGNYRV

SEQ ID NO: 141111 - protein, 33 aa, Artificial Sequence
  Description of Artificial Sequence: Synthetic polypeptide
TEEEICTTNPVGTAAWGTVVSCTNMLSQSGNKM

SEQ ID NO: 141112 - protein, 34 aa, Artificial Sequence
  Description of Artificial Sequence: Synthetic polypeptide
TEEEICTTNPVGTQAWGSVVSCTNMLSASGNYRV

SEQ ID NO: 141113 - protein, 36 aa, Artificial Sequence
  Description of Artificial Sequence: Synthetic polypeptide
DEEEIRTTNPVATEQYGSVIGPTNNTLMTPLEIMDL

SEQ ID NO: 141114 - protein, 35 aa, Artificial Sequence
  Description of Artificial Sequence: Synthetic polypeptide
DESEIRTTNPVAYECWGSVVSCINAHSQDRTGENG

SEQ ID NO: 141115 - protein, 34 aa, Artificial Sequence
  Description of Artificial Sequence: Synthetic polypeptide
DEEEIATTNPVATEQYGSVCAATGEEATDNMNNP

SEQ ID NO: 141116 - protein, 34 aa, Artificial Sequence
  Description of Artificial Sequence: Synthetic polypeptide
DECEICTTNPVATEQYGSVSTTQQLEDEEEEEDE

SEQ ID NO: 141117 - protein, 34 aa, Artificial Sequence
  Description of Artificial Sequence: Synthetic polypeptide
DESEIATTNPVATECYGSVSTINEPEDHEGEEDG

SEQ ID NO: 141118 - protein, 34 aa, Artificial Sequence
  Description of Artificial Sequence: Synthetic polypeptide
TEEEIQTTNPVATEQYGSVRCTEESSNNGGNNEV

SEQ ID NO: 141119 - protein, 33 aa, Artificial Sequence
  Description of Artificial Sequence: Synthetic polypeptide
DESEIRTTNPVAYECWGSVYWINEIQDREGEGG

SEQ ID NO: 141120 - protein, 35 aa, Artificial Sequence
  Description of Artificial Sequence: Synthetic polypeptide
AEEEIRTTNPVATEQYGCVCSMTEDHNQNFGSEQS

SEQ ID NO: 141121 - protein, 33 aa, Artificial Sequence
  Description of Artificial Sequence: Synthetic polypeptide
DESEIRTTNPVAYECWGTVYRINENQDGRGEND

SEQ ID NO: 141122 - protein, 35 aa, Artificial Sequence
  Description of Artificial Sequence: Synthetic polypeptide
DEEEIATTNPVATEQYGSVCAAMNHDQAMAPNQDE

SEQ ID NO: 141123 - protein, 33 aa, Artificial Sequence
  Description of Artificial Sequence: Synthetic polypeptide
DESEIRTTNPVAYECWGTVYRINENQDRAGENG

SEQ ID NO: 141124 - protein, 34 aa, Artificial Sequence
  Description of Artificial Sequence: Synthetic polypeptide
DESEIRTTNPVAYEEWGSVATGPPLGDHQGGGAR

SEQ ID NO: 141125 - protein, 31 aa, Artificial Sequence
  Description of Artificial Sequence: Synthetic polypeptide
ANNEIACTNPVATEQYGEASEEVLQRGDGQD

SEQ ID NO: 141126 - protein, 34 aa, Artificial Sequence
  Description of Artificial Sequence: Synthetic polypeptide
AEEEIRTTNPVATEAYGSVVVTVTNQQQQEEEED

SEQ ID NO: 141127 - protein, 34 aa, Artificial Sequence
  Description of Artificial Sequence: Synthetic polypeptide
DESEIRTTNPVAYEHWGISVSHANHSSDREGGNV

SEQ ID NO: 141128 - protein, 32 aa, Artificial Sequence
  Description of Artificial Sequence: Synthetic polypeptide
DECEIATTNPVAYEPWGSVTGGNGNTGNDGDR

SEQ ID NO: 141129 - protein, 36 aa, Artificial Sequence
  Description of Artificial Sequence: Synthetic polypeptide
DEEEIRTTNPVATEFYGSVVQFDDNIQGGEFTNGDE

SEQ ID NO: 141130 - protein, 31 aa, Artificial Sequence
  Description of Artificial Sequence: Synthetic polypeptide
DESEIATTNPVGTEGYGVMWASEDLQEHGDI

SEQ ID NO: 141131 - protein, 36 aa, Artificial Sequence
  Description of Artificial Sequence: Synthetic polypeptide
QEEEIRTTNPVATEQYGSVNMNLNGDDQDQEDNDGN

SEQ ID NO: 141132 - protein, 34 aa, Artificial Sequence
  Description of Artificial Sequence: Synthetic polypeptide
DESEIRTTNPVAYENWGSVSCANMSSDDREGGNV

SEQ ID NO: 141133 - protein, 31 aa, Artificial Sequence
  Description of Artificial Sequence: Synthetic polypeptide
DESEIATTNPVGTEGYGVMWASEDLQEHGPI

SEQ ID NO: 141134 - protein, 31 aa, Artificial Sequence
  Description of Artificial Sequence: Synthetic polypeptide
DESEIATTNPVGTEGYGVTMASETLQHKGDI

SEQ ID NO: 141135 - protein, 31 aa, Artificial Sequence
  Description of Artificial Sequence: Synthetic polypeptide
DESEIATTNPVGTEGYGVTTAAETLQHKGDI

SEQ ID NO: 141136 - protein, 31 aa, Artificial Sequence
  Description of Artificial Sequence: Synthetic polypeptide
DESEIATTNPVGTEGYGVTTAAETLQPKGDI

SEQ ID NO: 141137 - protein, 35 aa, Artificial Sequence
  Description of Artificial Sequence: Synthetic polypeptide
DEEEIRTTNPVATEQYGCVCSSENHEEHFNSDNQA

SEQ ID NO: 141138 - protein, 36 aa, Artificial Sequence
  Description of Artificial Sequence: Synthetic polypeptide
QEEEIRTTNPVATEQYGSVNMGTQNIEGQENDNGQT

SEQ ID NO: 141139 - protein, 32 aa, Artificial Sequence
  Description of Artificial Sequence: Synthetic polypeptide
DEDEIATTNPVAYEQYGSVAMHGQDSGGSFQH

SEQ ID NO: 141140 - protein, 34 aa, Artificial Sequence
  Description of Artificial Sequence: Synthetic polypeptide
DESEIRTTNPVAYECWGSVYRPNEEPQDRRGENG

SEQ ID NO: 141141 - protein, 29 aa, Artificial Sequence
  Description of Artificial Sequence: Synthetic peptide
QEEAIATTNPVATEQYGEAPEVCSQHEEK

SEQ ID NO: 141142 - protein, 34 aa, Artificial Sequence
  Description of Artificial Sequence: Synthetic polypeptide
DESEIRTTNPVAYECWGSVYRINENQDRRGENHN

SEQ ID NO: 141143 - protein, 35 aa, Artificial Sequence
  Description of Artificial Sequence: Synthetic polypeptide
TEAEISTTNPVAYEQYGQSVHTNALSHHGDGGNLR

SEQ ID NO: 141144 - protein, 36 aa, Artificial Sequence
  Description of Artificial Sequence: Synthetic polypeptide
DEEEIRTTNPVATEFYGSVVMENFNNIQGEQGNGGT

SEQ ID NO: 141145 - protein, 29 aa, Artificial Sequence
  Description of Artificial Sequence: Synthetic peptide
DESEIATTNPVATEGWGVMAETLMNAGDA

SEQ ID NO: 141146 - protein, 31 aa, Artificial Sequence
  Description of Artificial Sequence: Synthetic polypeptide
DECEIATTNPVAYEQWGCTVTNHMMNDGNTQ

SEQ ID NO: 141147 - protein, 31 aa, Artificial Sequence
  Description of Artificial Sequence: Synthetic polypeptide
DECEIATTNPVAYEQWGCTPTNHMMEDGNNQ

SEQ ID NO: 141148 - protein, 28 aa, Artificial Sequence
  Description of Artificial Sequence: Synthetic peptide
QEEAIATVNPVATEQYGEALEVCQHEEK

SEQ ID NO: 141149 - protein, 35 aa, Artificial Sequence
  Description of Artificial Sequence: Synthetic polypeptide
QEEEIRTTNPVCYEPYGSVSCDLNFSQNRPGGGND

SEQ ID NO: 141150 - protein, 34 aa, Artificial Sequence
  Description of Artificial Sequence: Synthetic polypeptide
DESEIRTTNPVAYECWGSVWYINENQDREGENGI

SEQ ID NO: 141151 - protein, 35 aa, Artificial Sequence
  Description of Artificial Sequence: Synthetic polypeptide
DEEEIRTTNPVATEQYGCVCSSGEDHQEFFGSDQA

SEQ ID NO: 141152 - protein, 32 aa, Artificial Sequence
  Description of Artificial Sequence: Synthetic polypeptide
AEDEIAATNPVAYEQWGEACSIENDQRGNGER

SEQ ID NO: 141153 - protein, 34 aa, Artificial Sequence
  Description of Artificial Sequence: Synthetic polypeptide
DESEIRTTNPVAYECWGSVWYINNEQQDREGENG

SEQ ID NO: 141154 - protein, 34 aa, Artificial Sequence
  Description of Artificial Sequence: Synthetic polypeptide
DESEIRTTNPVAYECWGSVYRINENQDERGENMG

SEQ ID NO: 141155 - protein, 37 aa, Artificial Sequence
  Description of Artificial Sequence: Synthetic polypeptide
AEEEIRTTNPVATEAYGSVVVVVTTNLQQGENQETEE

SEQ ID NO: 141156 - protein, 30 aa, Artificial Sequence
  Description of Artificial Sequence: Synthetic polypeptide
QEEEIATTNPVATEQYGEAPEVTCQHCEEK

SEQ ID NO: 141157 - protein, 35 aa, Artificial Sequence
  Description of Artificial Sequence: Synthetic polypeptide
DESEIATTNPVATEFYGSVSATGDGGDQEGNEDGD

SEQ ID NO: 141158 - protein, 36 aa, Artificial Sequence
  Description of Artificial Sequence: Synthetic polypeptide
TEAEISTTNPVAYEQYGQSVSWTNALSPHGDGGNNR

SEQ ID NO: 141159 - protein, 31 aa, Artificial Sequence
  Description of Artificial Sequence: Synthetic polypeptide
DESEIATTNPVATECYGVTANADLAEPKGPI

SEQ ID NO: 141160 - protein, 35 aa, Artificial Sequence
  Description of Artificial Sequence: Synthetic polypeptide
DEEEIRTTNPVATEQYGCVCSSGEDHNQGFGSEQG

SEQ ID NO: 141161 - protein, 32 aa, Artificial Sequence
  Description of Artificial Sequence: Synthetic polypeptide
CEDEIACTNPVATEQYGCANSANNLLMDPGQR

SEQ ID NO: 141162 - protein, 32 aa, Artificial Sequence
  Description of Artificial Sequence: Synthetic polypeptide
DESEIATTNPVGTEGYGVMSATPTGNRGMNPI

SEQ ID NO: 141163 - protein, 29 aa, Artificial Sequence
  Description of Artificial Sequence: Synthetic peptide
QEEAIATTNPVATEQYGEAPEVCWQHEEK

SEQ ID NO: 141164 - protein, 34 aa, Artificial Sequence
  Description of Artificial Sequence: Synthetic polypeptide
AEDEICATNPVATEQYGVVATSENLQLLGNGEDD

SEQ ID NO: 141165 - protein, 37 aa, Artificial Sequence
  Description of Artificial Sequence: Synthetic polypeptide
DEEEIRTTNPVATEQYGSVIGPTNNLSGNPVLEIEDT

SEQ ID NO: 141166 - protein, 36 aa, Artificial Sequence
  Description of Artificial Sequence: Synthetic polypeptide
TEAEISTTNPVAYEQYGQSVSTNALSHHRDGGNNPL

SEQ ID NO: 141167 - protein, 33 aa, Artificial Sequence
  Description of Artificial Sequence: Synthetic polypeptide
TEAEISTTNPVAYEQWGVTISPNEGDQDRKGNR

SEQ ID NO: 141168 - protein, 37 aa, Artificial Sequence
  Description of Artificial Sequence: Synthetic polypeptide
QEEEIRTTNPVATEQYGSVVIDDTMDNIGQSGGNSGD

SEQ ID NO: 141169 - protein, 33 aa, Artificial Sequence
  Description of Artificial Sequence: Synthetic polypeptide
TEECIRTTNPVATEQYGCVCSNWNLANFLSDQA

SEQ ID NO: 141170 - protein, 35 aa, Artificial Sequence
  Description of Artificial Sequence: Synthetic polypeptide
DEEEIATTNPVATEQYGSVCAATANDADMPPDNAN

SEQ ID NO: 141171 - protein, 35 aa, Artificial Sequence
  Description of Artificial Sequence: Synthetic polypeptide
DESEIATTNPVATEQYGSVSACIDEPQDREGEEDG

SEQ ID NO: 141172 - protein, 34 aa, Artificial Sequence
  Description of Artificial Sequence: Synthetic polypeptide
DESEIATTNPVATEQYGSVSACIDEPEDREGEDG

SEQ ID NO: 141173 - protein, 36 aa, Artificial Sequence
  Description of Artificial Sequence: Synthetic polypeptide
DEEEIRTTNPVATEFYGSVMGFTDNEGEGGEGNTTE

SEQ ID NO: 141174 - protein, 35 aa, Artificial Sequence
  Description of Artificial Sequence: Synthetic polypeptide
TEEEIATTNPVATEQYGVVPCWDNHDQDRQGGGNE

SEQ ID NO: 141175 - protein, 38 aa, Artificial Sequence
  Description of Artificial Sequence: Synthetic polypeptide
AEEEIRTTNPVATEQYGSVVTVVTNLQAGNQQGNNNGD

SEQ ID NO: 141176 - protein, 33 aa, Artificial Sequence
  Description of Artificial Sequence: Synthetic polypeptide
DEDEIATTNPVAYEQYGSVSAANGGTDSGGSSK

SEQ ID NO: 141177 - protein, 34 aa, Artificial Sequence
  Description of Artificial Sequence: Synthetic polypeptide
CAEEIATTNPVATEQWGCNVATNNLENGMGENDR

SEQ ID NO: 141178 - protein, 35 aa, Artificial Sequence
  Description of Artificial Sequence: Synthetic polypeptide
TEEEIATTNPVAWEQYGQSVSCTGDAQVRTVANNE

SEQ ID NO: 141179 - protein, 30 aa, Artificial Sequence
  Description of Artificial Sequence: Synthetic polypeptide
QEEEIATTNPVATEQYGEAPEVMCQHEEKE

SEQ ID NO: 141180 - protein, 35 aa, Artificial Sequence
  Description of Artificial Sequence: Synthetic polypeptide
DEEEIRTTNPVATEFYGSVMGFTDSEGEGGEGNTV

SEQ ID NO: 141181 - protein, 35 aa, Artificial Sequence
  Description of Artificial Sequence: Synthetic polypeptide
DEEEIRTTNPVATEFYGSVMGIMTDLGGGEDEIGV

SEQ ID NO: 141182 - protein, 34 aa, Artificial Sequence
  Description of Artificial Sequence: Synthetic polypeptide
TEEEIATTNPVAWEQYGSCSCTGIAQVRTVANNE

SEQ ID NO: 141183 - protein, 35 aa, Artificial Sequence
  Description of Artificial Sequence: Synthetic polypeptide
DEEEIATTNPVATEQYGSVCAANMGEAPDGMENSM

SEQ ID NO: 141184 - protein, 30 aa, Artificial Sequence
  Description of Artificial Sequence: Synthetic polypeptide
AEDEIACTNPVAYEQWGYATIENDQRGGER

SEQ ID NO: 141185 - protein, 36 aa, Artificial Sequence
  Description of Artificial Sequence: Synthetic polypeptide
DEDEIATTNPVAYEQYGSVSAAISLGQPRDQGITNM

SEQ ID NO: 141186 - protein, 31 aa, Artificial Sequence
  Description of Artificial Sequence: Synthetic polypeptide
AEDEIAVTNPVAYEQWGEASIELNDQRGGER

SEQ ID NO: 141187 - protein, 34 aa, Artificial Sequence
  Description of Artificial Sequence: Synthetic polypeptide
DECEICTTNPVATEQYGSVSTTNANDEDTEEEDD

SEQ ID NO: 141188 - protein, 31 aa, Artificial Sequence
  Description of Artificial Sequence: Synthetic polypeptide
AEDEIACTNPVAYEQWGWAYIENLQRGGGDR

SEQ ID NO: 141189 - protein, 35 aa, Artificial Sequence
  Description of Artificial Sequence: Synthetic polypeptide
TEEEIATTNPVAWEQYGSTVSCTFQAQTRTVANYE

SEQ ID NO: 141190 - protein, 35 aa, Artificial Sequence
  Description of Artificial Sequence: Synthetic polypeptide
DECEICTTNPVATEQYGSVSTTNANLEDTEEEDES

SEQ ID NO: 141191 - protein, 35 aa, Artificial Sequence
  Description of Artificial Sequence: Synthetic polypeptide
TEEEIATTNPVAWEQYGSTVSCTGHDQTRTVANNE

SEQ ID NO: 141192 - protein, 36 aa, Artificial Sequence
  Description of Artificial Sequence: Synthetic polypeptide
DECEICTTNPVATEQYGSVSTTNANLEDTEGTEDEE

SEQ ID NO: 141193 - protein, 34 aa, Artificial Sequence
  Description of Artificial Sequence: Synthetic polypeptide
DEEEIATTNPVATEQYGSVCAAMNHGPADSGEGH

SEQ ID NO: 141194 - protein, 35 aa, Artificial Sequence
  Description of Artificial Sequence: Synthetic polypeptide
DEEEIRTTNPVATEQYGSVETLGVIIPTVTEEQRV

SEQ ID NO: 141195 - protein, 35 aa, Artificial Sequence
  Description of Artificial Sequence: Synthetic polypeptide
DESEIATTNPVATEQYGSVSACINEPQDHEGEEDG

SEQ ID NO: 141196 - protein, 28 aa, Artificial Sequence
  Description of Artificial Sequence: Synthetic peptide
QEEEIACTNPVATEQYGEAPEVCMHEEK

SEQ ID NO: 141197 - protein, 34 aa, Artificial Sequence
  Description of Artificial Sequence: Synthetic polypeptide
DEEEIATTNPVATEQYGSVCAANMGEAPDAGMEN

SEQ ID NO: 141198 - protein, 35 aa, Artificial Sequence
  Description of Artificial Sequence: Synthetic polypeptide
DEEEIRTTNPVATEQYGCVCSTEEAHQENFMSDQA

SEQ ID NO: 141199 - protein, 37 aa, Artificial Sequence
  Description of Artificial Sequence: Synthetic polypeptide
DEEEIRTTNPVATEQFGSVSSTTPAGPNMRNGMNPVW

SEQ ID NO: 141200 - protein, 35 aa, Artificial Sequence
  Description of Artificial Sequence: Synthetic polypeptide
DEEEIRTTNPVATEQYGSVIGPWVAVVNQIGMVEQ

SEQ ID NO: 141201 - protein, 36 aa, Artificial Sequence
  Description of Artificial Sequence: Synthetic polypeptide
DEEEIATTNPVATEQWGSVSGTGNPPDNSEHGTDNE

SEQ ID NO: 141202 - protein, 35 aa, Artificial Sequence
  Description of Artificial Sequence: Synthetic polypeptide
DEEEIRTTNPVATEFYGSVMGFFDNEGEGGEGNTA

SEQ ID NO: 141203 - protein, 30 aa, Artificial Sequence
  Description of Artificial Sequence: Synthetic polypeptide
QEEEIATTNPVATEQYGSAPAEVCEHEEEL

SEQ ID NO: 141204 - protein, 37 aa, Artificial Sequence
  Description of Artificial Sequence: Synthetic polypeptide
DEEEIRTTNPVATEQYGSVIGPTVNLLGMPNLEIEDT

SEQ ID NO: 141205 - protein, 34 aa, Artificial Sequence
  Description of Artificial Sequence: Synthetic polypeptide
QEEEIACTNPVATEQYGSVAAANNLNIDNPNGRP

SEQ ID NO: 141206 - protein, 36 aa, Artificial Sequence
  Description of Artificial Sequence: Synthetic polypeptide
DEEEIRTTNPVATEFYGSVMGFFTDNEGGGGEGNTL

SEQ ID NO: 141207 - protein, 35 aa, Artificial Sequence
  Description of Artificial Sequence: Synthetic polypeptide
DECEICTTNPVATEQYGSVSTTNALNEDTEEEDET

SEQ ID NO: 141208 - protein, 36 aa, Artificial Sequence
  Description of Artificial Sequence: Synthetic polypeptide
DEEEIRTTNPVATEQYGSVNGFGDDEQDEGEGNNQQ

SEQ ID NO: 141209 - protein, 34 aa, Artificial Sequence
  Description of Artificial Sequence: Synthetic polypeptide
DEEEIATTNPVATEQYGSVCAANMGEEANDGMEG

SEQ ID NO: 141210 - protein, 29 aa, Artificial Sequence
  Description of Artificial Sequence: Synthetic peptide
QEEEIACTNPVATEQYGEIPEVCQHEREK

SEQ ID NO: 141211 - protein, 37 aa, Artificial Sequence
  Description of Artificial Sequence: Synthetic polypeptide
DEEEIRTTNPVATEQYGCVCSTEEDHNQENFGSQNQS

SEQ ID NO: 141212 - protein, 34 aa, Artificial Sequence
  Description of Artificial Sequence: Synthetic polypeptide
DEEEIRTTNPVATEEYGQCVCSTEHTEFFGSDQS

SEQ ID NO: 141213 - protein, 34 aa, Artificial Sequence
  Description of Artificial Sequence: Synthetic polypeptide
DEDEIATTNPVAYEQYGSVSANDTGENPMDQTNH

SEQ ID NO: 141214 - protein, 36 aa, Artificial Sequence
  Description of Artificial Sequence: Synthetic polypeptide
DEEEIRTTNPVATEQYGCVCSTEEDHNQEYFNSDQT

SEQ ID NO: 141215 - protein, 32 aa, Artificial Sequence
  Description of Artificial Sequence: Synthetic polypeptide
YEEEIATVNPVCTEQYGVVSDPNGPNSNGMNQ

SEQ ID NO: 141216 - protein, 38 aa, Artificial Sequence
  Description of Artificial Sequence: Synthetic polypeptide
AEEEIRTTNPVATEAYGVVSVSVVTNLQQGNNGNNEQD

SEQ ID NO: 141217 - protein, 35 aa, Artificial Sequence
  Description of Artificial Sequence: Synthetic polypeptide
DEEEIATTNPVATEQYGSVCAAMNHLNAMMPDDRP

SEQ ID NO: 141218 - protein, 35 aa, Artificial Sequence
  Description of Artificial Sequence: Synthetic polypeptide
DEEEIATTNPVATEQYGSVCAANGQEATDSGGSDM

SEQ ID NO: 141219 - protein, 36 aa, Artificial Sequence
  Description of Artificial Sequence: Synthetic polypeptide
DEEEIRTTNPVATEQYGCVCSTEEDHQENFGSQFQG

SEQ ID NO: 141220 - protein, 35 aa, Artificial Sequence
  Description of Artificial Sequence: Synthetic polypeptide
DEEEIATTNPVATEQYGSVCAANHIENIDDGDERH

SEQ ID NO: 141221 - protein, 35 aa, Artificial Sequence
  Description of Artificial Sequence: Synthetic polypeptide
DEEEIRTTNPVATEFYGSVMGFTDFENEGGEGFTL

SEQ ID NO: 141222 - protein, 34 aa, Artificial Sequence
  Description of Artificial Sequence: Synthetic polypeptide
DEEEIRTTNPVATEEYGQCVCSTGEHQNFSSEQA

SEQ ID NO: 141223 - protein, 34 aa, Artificial Sequence
  Description of Artificial Sequence: Synthetic polypeptide
AEEEIRTTNPVATEEYGCSCSWEHNQNSGSDNQA

SEQ ID NO: 141224 - protein, 34 aa, Artificial Sequence
  Description of Artificial Sequence: Synthetic polypeptide
DEDEICTTNPVAYEQWGSVCSTDNNDGHRGTGDM

SEQ ID NO: 141225 - protein, 34 aa, Artificial Sequence
  Description of Artificial Sequence: Synthetic polypeptide
DESEIATTNPVATEQYGSVCAAMMHGQNEMGNSQ

SEQ ID NO: 141226 - protein, 32 aa, Artificial Sequence
  Description of Artificial Sequence: Synthetic polypeptide
DECEIATTNPVAYEQYGVCSTIDQQGHQHGDN

SEQ ID NO: 141227 - protein, 34 aa, Artificial Sequence
  Description of Artificial Sequence: Synthetic polypeptide
DEEEIATTNPVATEQWGSVSGQGPPQEAPDGTHN

SEQ ID NO: 141228 - protein, 33 aa, Artificial Sequence
  Description of Artificial Sequence: Synthetic polypeptide
DECEIATTNPVAYEQYGVCSTIDQHRQPNNQDN

SEQ ID NO: 141229 - protein, 33 aa, Artificial Sequence
  Description of Artificial Sequence: Synthetic polypeptide
DECEIATTNPVAYEQYGVCSTIDQHLQPQNMDN

SEQ ID NO: 141230 - protein, 35 aa, Artificial Sequence
  Description of Artificial Sequence: Synthetic polypeptide
DEDEIATTNPVAYEQYGSVCSTNPELNEHDDNEAG

SEQ ID NO: 141231 - protein, 33 aa, Artificial Sequence
  Description of Artificial Sequence: Synthetic polypeptide
TEECISTTNPVATEQYGCVCSWEEHQNFGSNQA

SEQ ID NO: 141232 - protein, 33 aa, Artificial Sequence
  Description of Artificial Sequence: Synthetic polypeptide
TEECIRTTNPVAYEWYGQTVSCTQNVSQSGIEN

SEQ ID NO: 141233 - protein, 34 aa, Artificial Sequence
  Description of Artificial Sequence: Synthetic polypeptide
DEDEICTTNPVAYEQYGSVCAANLQAMPGDLTAM

SEQ ID NO: 141234 - protein, 35 aa, Artificial Sequence
  Description of Artificial Sequence: Synthetic polypeptide
DEEEIRTTNPVATEQWGATWSTTPDGPNMPKGNYI

SEQ ID NO: 141235 - protein, 33 aa, Artificial Sequence
  Description of Artificial Sequence: Synthetic polypeptide
DEDEICTTNPVAYEQYGTVCSATDGPSEFEGND

SEQ ID NO: 141236 - protein, 33 aa, Artificial Sequence
  Description of Artificial Sequence: Synthetic polypeptide
QEEEIACTNPVATEQYGCVATNLVATAADNGAE

SEQ ID NO: 141237 - protein, 34 aa, Artificial Sequence
  Description of Artificial Sequence: Synthetic polypeptide
TEEEIATTNPVAWEQYGSVSCLGQAQSRTVANNE

SEQ ID NO: 141238 - protein, 33 aa, Artificial Sequence
  Description of Artificial Sequence: Synthetic polypeptide
CDEEISTTNPVATEQYGCVCSTEEHQNFGSDVS

SEQ ID NO: 141239 - protein, 35 aa, Artificial Sequence
  Description of Artificial Sequence: Synthetic polypeptide
TEEEIATTNPVAWEQYGSVSCTGCAQVRTVANNEF

SEQ ID NO: 141240 - protein, 32 aa, Artificial Sequence
  Description of Artificial Sequence: Synthetic polypeptide
TEECIRTTNPVAYESYGWTVSCTQNVSQSLEN

SEQ ID NO: 141241 - protein, 35 aa, Artificial Sequence
  Description of Artificial Sequence: Synthetic polypeptide
DEEEIRTTNPVATEFYGSVMGQNMEDEGGEENVAI

SEQ ID NO: 141242 - protein, 31 aa, Artificial Sequence
  Description of Artificial Sequence: Synthetic polypeptide
AEDEIACTNPVAYEQWGHASIENDDQRGGER

SEQ ID NO: 141243 - protein, 34 aa, Artificial Sequence
  Description of Artificial Sequence: Synthetic polypeptide
QEEEIRTTNPVATEQYGSVSPEPVGPNMHNEMEV

SEQ ID NO: 141244 - protein, 35 aa, Artificial Sequence
  Description of Artificial Sequence: Synthetic polypeptide
DESEIATTNPVATEQYGSTVPSCTGELEDHEGEDL

SEQ ID NO: 141245 - protein, 31 aa, Artificial Sequence
  Description of Artificial Sequence: Synthetic polypeptide
QEEEIATTNPVATEQYGMTANEVDQHGEEDQ

SEQ ID NO: 141246 - protein, 34 aa, Artificial Sequence
  Description of Artificial Sequence: Synthetic polypeptide
TEEEIATTNPVAWEQYGSVSCTGMAQVNTVANNE

SEQ ID NO: 141247 - protein, 35 aa, Artificial Sequence
  Description of Artificial Sequence: Synthetic polypeptide
DEEEIRTTNPVATEQYGCVCSTEEHIEFFNSDNQS

SEQ ID NO: 141248 - protein, 35 aa, Artificial Sequence
  Description of Artificial Sequence: Synthetic polypeptide
TEEEIATTNPVAWEQYGSVSCTGQAQVRTVANNGG

SEQ ID NO: 141249 - protein, 32 aa, Artificial Sequence
  Description of Artificial Sequence: Synthetic polypeptide
TEECISTTNPVATEQYGCVCSWEHQNFGSDTQ

SEQ ID NO: 141250 - protein, 34 aa, Artificial Sequence
  Description of Artificial Sequence: Synthetic polypeptide
TEEEIATTNPVAWEQYGSVPCTGQAQVRTVENNE

SEQ ID NO: 141251 - protein, 35 aa, Artificial Sequence
  Description of Artificial Sequence: Synthetic polypeptide
DEEEIRTTNPVATEQYGSVIGPTVMEIIERSQPQG

SEQ ID NO: 141252 - protein, 34 aa, Artificial Sequence
  Description of Artificial Sequence: Synthetic polypeptide
DESEIRTTNPVATVCWGQSVFCINEPQDREGENG

SEQ ID NO: 141253 - protein, 33 aa, Artificial Sequence
  Description of Artificial Sequence: Synthetic polypeptide
DESEIRTTNPVAYEQWGSVSGGNGNSAGEGDTE

SEQ ID NO: 141254 - protein, 34 aa, Artificial Sequence
  Description of Artificial Sequence: Synthetic polypeptide
DEEEIATTNPVATEQYGSVCAANMGEEPADEPNN

SEQ ID NO: 141255 - protein, 35 aa, Artificial Sequence
  Description of Artificial Sequence: Synthetic polypeptide
TEEEIATTNPVAWEQYGSTVSCTGQAQTRTVANSG

SEQ ID NO: 141256 - protein, 35 aa, Artificial Sequence
  Description of Artificial Sequence: Synthetic polypeptide
TEEEIATTNPVAWEQYGSTVSCTGQAQTRTVLNNE

SEQ ID NO: 141257 - protein, 35 aa, Artificial Sequence
  Description of Artificial Sequence: Synthetic polypeptide
DESEIATTNPVATEQYGSVCAADNGLEATRAMERH

SEQ ID NO: 141258 - protein, 36 aa, Artificial Sequence
  Description of Artificial Sequence: Synthetic polypeptide
DESEIRTTNPVATEQYGSVYTGDNGENTEEGNGNGS

SEQ ID NO: 141259 - protein, 34 aa, Artificial Sequence
  Description of Artificial Sequence: Synthetic polypeptide
DESEIATTNPVATEQYGSVCAADNGLEARVMILH

SEQ ID NO: 141260 - protein, 35 aa, Artificial Sequence
  Description of Artificial Sequence: Synthetic polypeptide
TEEEIATTNPVAWEQYGSTVSCTQTAQTRTVANNE

SEQ ID NO: 141261 - protein, 35 aa, Artificial Sequence
  Description of Artificial Sequence: Synthetic polypeptide
TEEEIATTNPVAWEQYGSTVSTTGQAQVRTVANNL

SEQ ID NO: 141262 - protein, 37 aa, Artificial Sequence
  Description of Artificial Sequence: Synthetic polypeptide
DEEEIRTTNPVATEQYGSVIGPTVNIGEPRAVVNTAF

SEQ ID NO: 141263 - protein, 35 aa, Artificial Sequence
  Description of Artificial Sequence: Synthetic polypeptide
DEEEIATTNPVATEQWGSVSGTGPPDNSEHGTDHQ

SEQ ID NO: 141264 - protein, 35 aa, Artificial Sequence
  Description of Artificial Sequence: Synthetic polypeptide
DECEICTTNPVATEQYGSVSTTNANLNEDTEDEDE

SEQ ID NO: 141265 - protein, 35 aa, Artificial Sequence
  Description of Artificial Sequence: Synthetic polypeptide
DEDEIATTNPVAYEQYGSVCTNAQTQAHGGDNAPM

SEQ ID NO: 141266 - protein, 35 aa, Artificial Sequence
  Description of Artificial Sequence: Synthetic polypeptide
TEEEIATTNPVAWEQYGSVISCTGQAQMRTVANNE

SEQ ID NO: 141267 - protein, 34 aa, Artificial Sequence
  Description of Artificial Sequence: Synthetic polypeptide
DEDEICTTNPVAYEQWGSVCSTDNNDHHGGDGDR

SEQ ID NO: 141268 - protein, 33 aa, Artificial Sequence
  Description of Artificial Sequence: Synthetic polypeptide
CDEEIRTTNPVATEQYGCVCSWEHQNFNSNPDS

SEQ ID NO: 141269 - protein, 35 aa, Artificial Sequence
  Description of Artificial Sequence: Synthetic polypeptide
DEEEIRTTNPVATEQFGQCVCSNTGYDLHFGSDQS

SEQ ID NO: 141270 - protein, 35 aa, Artificial Sequence
  Description of Artificial Sequence: Synthetic polypeptide
DEDEIATTNPVAYEQYGSVCSVDNLPQDSDGMAQW

SEQ ID NO: 141271 - protein, 35 aa, Artificial Sequence
  Description of Artificial Sequence: Synthetic polypeptide
DEEEIRTTNPVATEFYGSVMGNINQGLQEEQIEEG

SEQ ID NO: 141272 - protein, 36 aa, Artificial Sequence
  Description of Artificial Sequence: Synthetic polypeptide
DESEIATTNPVATEQYGSVAITNHDEQTGEQGQPRD

SEQ ID NO: 141273 - protein, 37 aa, Artificial Sequence
  Description of Artificial Sequence: Synthetic polypeptide
DEEEIRTTNPVATEQYGSVNGPTFNQHEEPIGEENMS

SEQ ID NO: 141274 - protein, 36 aa, Artificial Sequence
  Description of Artificial Sequence: Synthetic polypeptide
DEEEIRTTNPVATEQYGSVSTEFDDEQADEASDLEP

SEQ ID NO: 141275 - protein, 32 aa, Artificial Sequence
  Description of Artificial Sequence: Synthetic polypeptide
TEECISTTNPVATEQYGCVCSWEHQNFISNQS

SEQ ID NO: 141276 - protein, 33 aa, Artificial Sequence
  Description of Artificial Sequence: Synthetic polypeptide
DEDEICTTNPVAYEQWGSVCSTTDQGDTQDGGA

SEQ ID NO: 141277 - protein, 35 aa, Artificial Sequence
  Description of Artificial Sequence: Synthetic polypeptide
TEEEIATTNPVAWEQYGSVHSCTGTAQVRTVANNE

SEQ ID NO: 141278 - protein, 35 aa, Artificial Sequence
  Description of Artificial Sequence: Synthetic polypeptide
DESEIATTNPVATEQYGSMSSTTPTGPNMRGMNPV

SEQ ID NO: 141279 - protein, 32 aa, Artificial Sequence
  Description of Artificial Sequence: Synthetic polypeptide
DESEIATTNPVAYEQYGSVAAANNEQDITMTD

SEQ ID NO: 141280 - protein, 36 aa, Artificial Sequence
  Description of Artificial Sequence: Synthetic polypeptide
DEEEIRTTNPVATEFYGSVMEFFTDNEGEGGEGNTV

SEQ ID NO: 141281 - protein, 35 aa, Artificial Sequence
  Description of Artificial Sequence: Synthetic polypeptide
DEDEIATTNPVAYEQYGVCSTDPGNHQMGRGDNNN

SEQ ID NO: 141282 - protein, 35 aa, Artificial Sequence
  Description of Artificial Sequence: Synthetic polypeptide
DEEEIRTTNPVATEFYGMVSIMNGEMQEGGGEQGG

SEQ ID NO: 141283 - protein, 34 aa, Artificial Sequence
  Description of Artificial Sequence: Synthetic polypeptide
DESEIATTNPVAYEQWGSVCPTDQGQDQRGNNQE

SEQ ID NO: 141284 - protein, 31 aa, Artificial Sequence
  Description of Artificial Sequence: Synthetic polypeptide
AEDEIATTNPVAYEPWGEVSTTNRGDGNLGQ

SEQ ID NO: 141285 - protein, 33 aa, Artificial Sequence
  Description of Artificial Sequence: Synthetic polypeptide
DESEIATTNPVAYEQWGSVCSGENDQHLVNDHK

SEQ ID NO: 141286 - protein, 29 aa, Artificial Sequence
  Description of Artificial Sequence: Synthetic peptide
TEEEIATTNPVATEQWGEAPEVCSQHEEK

SEQ ID NO: 141287 - protein, 31 aa, Artificial Sequence
  Description of Artificial Sequence: Synthetic polypeptide
TEEEIASVNPVCYEQYGVVSINLSQSTVNNQ

SEQ ID NO: 141288 - protein, 34 aa, Artificial Sequence
  Description of Artificial Sequence: Synthetic polypeptide
AEEEIRTTNPVATEEYGCSCSNWENHQYFGSDQS

SEQ ID NO: 141289 - protein, 35 aa, Artificial Sequence
  Description of Artificial Sequence: Synthetic polypeptide
DEEEIATTNPVATEQWGSVSGTGGPLENHEDNSAE

SEQ ID NO: 141290 - protein, 32 aa, Artificial Sequence
  Description of Artificial Sequence: Synthetic polypeptide
TEEEIASVNPVCYEQYGVVSINALSQSGGNNQ

SEQ ID NO: 141291 - protein, 37 aa, Artificial Sequence
  Description of Artificial Sequence: Synthetic polypeptide
DEEEIRTTNPVATEQYGSVNDMQDNTGQAEGGNQDGQ

SEQ ID NO: 141292 - protein, 32 aa, Artificial Sequence
  Description of Artificial Sequence: Synthetic polypeptide
TEEEIASVNPVCYEQYGVVSIGNLSQSVGNNQ

SEQ ID NO: 141293 - protein, 34 aa, Artificial Sequence
  Description of Artificial Sequence: Synthetic polypeptide
DESEIATTNPVAWTSEEYGSVSATDLEDHEGEDL

SEQ ID NO: 141294 - protein, 35 aa, Artificial Sequence
  Description of Artificial Sequence: Synthetic polypeptide
DESEIRTTNPVATEVYGETNSCTNNAHSQQRGGDS

SEQ ID NO: 141295 - protein, 35 aa, Artificial Sequence
  Description of Artificial Sequence: Synthetic polypeptide
DESEIATTNPVATEWYGETTSCTNFAHSQRGGDNS

SEQ ID NO: 141296 - protein, 34 aa, Artificial Sequence
  Description of Artificial Sequence: Synthetic polypeptide
DESEIATTNPVATEVWGSVCYTNDHQDQGGQNDK

SEQ ID NO: 141297 - protein, 30 aa, Artificial Sequence
  Description of Artificial Sequence: Synthetic polypeptide
AEDEIASTNPVAYEQWGEAYENDQRGGDRQ

SEQ ID NO: 141298 - protein, 34 aa, Artificial Sequence
  Description of Artificial Sequence: Synthetic polypeptide
DESEIRTTNPVATEVYGETTMSCTNAHSQQGGDS

SEQ ID NO: 141299 - protein, 34 aa, Artificial Sequence
  Description of Artificial Sequence: Synthetic polypeptide
DESEIATTNPVATEQYGVVPCWDNHGQRQGGDGA

SEQ ID NO: 141300 - protein, 34 aa, Artificial Sequence
  Description of Artificial Sequence: Synthetic polypeptide
DESEIRTTNPVATEVYGETTSCTNNAHSQGGGDA

SEQ ID NO: 141301 - protein, 36 aa, Artificial Sequence
  Description of Artificial Sequence: Synthetic polypeptide
AEEEIRTTNPVATEQYGSVVVNTTNDESGTVNNATE

SEQ ID NO: 141302 - protein, 33 aa, Artificial Sequence
  Description of Artificial Sequence: Synthetic polypeptide
DESEIATTNPVAYEQWGSVCSGENDQVDTNDQK

SEQ ID NO: 141303 - protein, 33 aa, Artificial Sequence
  Description of Artificial Sequence: Synthetic polypeptide
DESEIATTNPVAYEQWGSVCSGENNQHDTNDAK

SEQ ID NO: 141304 - protein, 35 aa, Artificial Sequence
  Description of Artificial Sequence: Synthetic polypeptide
AEEEIRTTNPVATEQYGSVVTVVTTNQNSEAGTIF

SEQ ID NO: 141305 - protein, 34 aa, Artificial Sequence
  Description of Artificial Sequence: Synthetic polypeptide
DESEIATTNPVAYEEWGSVATGNMLGDAQGGNKE

SEQ ID NO: 141306 - protein, 34 aa, Artificial Sequence
  Description of Artificial Sequence: Synthetic polypeptide
DEDEIATTNPVAYEQYGTVVSGDNQQGEHGNGKA

SEQ ID NO: 141307 - protein, 34 aa, Artificial Sequence
  Description of Artificial Sequence: Synthetic polypeptide
DESEIATTNPVAYEHYGSVISYTALSTPGGPLRK

SEQ ID NO: 141308 - protein, 32 aa, Artificial Sequence
  Description of Artificial Sequence: Synthetic polypeptide
DESEIATTNPVAYEQWGSTCPTDNRDQGQSQR

SEQ ID NO: 141309 - protein, 35 aa, Artificial Sequence
  Description of Artificial Sequence: Synthetic polypeptide
DESEIRTTNPVATEQYGVVSYAVSNNQNEGQQDTL

SEQ ID NO: 141310 - protein, 35 aa, Artificial Sequence
  Description of Artificial Sequence: Synthetic polypeptide
TEEEIATTNPCAYEQYGISVSTINEHQPFPGGNNT

SEQ ID NO: 141311 - protein, 37 aa, Artificial Sequence
  Description of Artificial Sequence: Synthetic polypeptide
DEEEIRTTNPVATEFYGAVTSMTGNGEGQNEGGNGEE

SEQ ID NO: 141312 - protein, 34 aa, Artificial Sequence
  Description of Artificial Sequence: Synthetic polypeptide
DEEEIRTTNPVATEFYGAVVTTDGQDEGFDEEQI

SEQ ID NO: 141313 - protein, 36 aa, Artificial Sequence
  Description of Artificial Sequence: Synthetic polypeptide
DEEEIRTTNPVATEFYGCATSMTGNGQGQDEGGNEE

SEQ ID NO: 141314 - protein, 32 aa, Artificial Sequence
  Description of Artificial Sequence: Synthetic polypeptide
TEEEIASVNPVSYEQYGVVSIENELSQSGGNQ

SEQ ID NO: 141315 - protein, 31 aa, Artificial Sequence
  Description of Artificial Sequence: Synthetic polypeptide
DESEIATTNPVAYEQWGETSKTLEDRQSEDR

SEQ ID NO: 141316 - protein, 36 aa, Artificial Sequence
  Description of Artificial Sequence: Synthetic polypeptide
TEEEIATTNPVATEAWGSVCSKTNDDLDQRNANDLM

SEQ ID NO: 141317 - protein, 31 aa, Artificial Sequence
  Description of Artificial Sequence: Synthetic polypeptide
TEEEIASVNPVSYEAYGKVSDNALSQSGGNQ

SEQ ID NO: 141318 - protein, 36 aa, Artificial Sequence
  Description of Artificial Sequence: Synthetic polypeptide
TEEEIATTNPVATEAWGSVCSKTNDDLDQRNNAGDY

SEQ ID NO: 141319 - protein, 34 aa, Artificial Sequence
  Description of Artificial Sequence: Synthetic polypeptide
DESEIATTNPVATEQYGVMSATTPTGNMRGMNPI

SEQ ID NO: 141320 - protein, 36 aa, Artificial Sequence
  Description of Artificial Sequence: Synthetic polypeptide
DEEEIRTTNPVATEFYGCVGNGDGNLNLQIEGENDG

SEQ ID NO: 141321 - protein, 36 aa, Artificial Sequence
  Description of Artificial Sequence: Synthetic polypeptide
QEEEIRTTNPVATEQYGSVQNGDPNDQGEGEEGNIG

SEQ ID NO: 141322 - protein, 33 aa, Artificial Sequence
  Description of Artificial Sequence: Synthetic polypeptide
DEEEIATTNPVATEGWGSVCSGDNDRNDGGQGL

SEQ ID NO: 141323 - protein, 35 aa, Artificial Sequence
  Description of Artificial Sequence: Synthetic polypeptide
AEEEIRTTNPVATEEYGCSCSSGELNQNFGSNNQS

SEQ ID NO: 141324 - protein, 34 aa, Artificial Sequence
  Description of Artificial Sequence: Synthetic polypeptide
DEEEIATTNPVATEQWGSVSGQGPPQHPMGMQHW

SEQ ID NO: 141325 - protein, 36 aa, Artificial Sequence
  Description of Artificial Sequence: Synthetic polypeptide
DEEEIRTTNPVATEQYGCVCSTEDHNEENFGSDTQA

SEQ ID NO: 141326 - protein, 34 aa, Artificial Sequence
  Description of Artificial Sequence: Synthetic polypeptide
DECEICTTNPVATEQYGSVSTTAQLEDEEEEEDD

SEQ ID NO: 141327 - protein, 37 aa, Artificial Sequence
  Description of Artificial Sequence: Synthetic polypeptide
DEEEIRTTNPVATEFYGAVTSMTGNGEGQNEGGGNAE

SEQ ID NO: 141328 - protein, 36 aa, Artificial Sequence
  Description of Artificial Sequence: Synthetic polypeptide
DEEEIRTTNPVATEQYGCVCSTEDHNEENFGSDTQS

SEQ ID NO: 141329 - protein, 36 aa, Artificial Sequence
  Description of Artificial Sequence: Synthetic polypeptide
DEEEIRTTNPVATEQYGCVCSTEDHNQEFFNSDTQA

SEQ ID NO: 141330 - protein, 36 aa, Artificial Sequence
  Description of Artificial Sequence: Synthetic polypeptide
DEEEIRTTNPVATEQFGYVSSTTPAGPNMRNGMNPV

SEQ ID NO: 141331 - protein, 37 aa, Artificial Sequence
  Description of Artificial Sequence: Synthetic polypeptide
DEEEIRTTNPVATEQYGSVNDDTDNGEDQGNNGQGEV

SEQ ID NO: 141332 - protein, 29 aa, Artificial Sequence
  Description of Artificial Sequence: Synthetic peptide
TEEEIATTNPVATEAYGEAPCEVCQHEEK

SEQ ID NO: 141333 - protein, 37 aa, Artificial Sequence
  Description of Artificial Sequence: Synthetic polypeptide
AEEEIRTTNPVATEAYGVVSVTVVTNLQQGNNQNDTD

SEQ ID NO: 141334 - protein, 34 aa, Artificial Sequence
  Description of Artificial Sequence: Synthetic polypeptide
DEEEIATTNPVATEQYGSVCAAMNPDNDMDPNEN

SEQ ID NO: 141335 - protein, 32 aa, Artificial Sequence
  Description of Artificial Sequence: Synthetic polypeptide
TEEEIASVNPVCYEQYGVVSCINELQSGGNNQ

SEQ ID NO: 141336 - protein, 34 aa, Artificial Sequence
  Description of Artificial Sequence: Synthetic polypeptide
DESEIATTNPVAYEQWGSVSGGNGLNSAGEGNTM

SEQ ID NO: 141337 - protein, 36 aa, Artificial Sequence
  Description of Artificial Sequence: Synthetic polypeptide
DEEEIRTTNPVATEQYGSVNGACNNEYDSRSEENFI

SEQ ID NO: 141338 - protein, 36 aa, Artificial Sequence
  Description of Artificial Sequence: Synthetic polypeptide
DEEEIRTTNPVATEQYGSVNGACNNEYDSRSFENEE

SEQ ID NO: 141339 - protein, 35 aa, Artificial Sequence
  Description of Artificial Sequence: Synthetic polypeptide
DEEEIATTNPVATEQWGSVSGTGNPDNSEHNTPMV

SEQ ID NO: 141340 - protein, 34 aa, Artificial Sequence
  Description of Artificial Sequence: Synthetic polypeptide
DEEEIRTTNPVATEQYGSVNGATQEDEMYVEQEQ

SEQ ID NO: 141341 - protein, 30 aa, Artificial Sequence
  Description of Artificial Sequence: Synthetic polypeptide
TEEEIATTNPVATEQYGEAPEVMCQHTEEK

SEQ ID NO: 141342 - protein, 37 aa, Artificial Sequence
  Description of Artificial Sequence: Synthetic polypeptide
AEEEIRTTNPVATEQYGSVVTVVTNNNLQQNDENNNS

SEQ ID NO: 141343 - protein, 35 aa, Artificial Sequence
  Description of Artificial Sequence: Synthetic polypeptide
DEEEIRTTNPVATEFYGAVDDTEMGQEGGNGEAED

SEQ ID NO: 141344 - protein, 33 aa, Artificial Sequence
  Description of Artificial Sequence: Synthetic polypeptide
TEEEIASVNPVCTEQYGVVSCINELSQSTGGNQ

SEQ ID NO: 141345 - protein, 29 aa, Artificial Sequence
  Description of Artificial Sequence: Synthetic peptide
QEEEIATTNPVATEQYGQAYPEVCLHEEK

SEQ ID NO: 141346 - protein, 35 aa, Artificial Sequence
  Description of Artificial Sequence: Synthetic polypeptide
DEEEIATTNPVATECYGSVSSTTPCGPNHNGMNPV

SEQ ID NO: 141347 - protein, 34 aa, Artificial Sequence
  Description of Artificial Sequence: Synthetic polypeptide
DESEIATTNPVAYEQWGSVSWGNNMQDSGGNNDG

SEQ ID NO: 141348 - protein, 33 aa, Artificial Sequence
  Description of Artificial Sequence: Synthetic polypeptide
DESEIATTNPVAYEQWGSVTGPNGNQGAGNGQQ

SEQ ID NO: 141349 - protein, 33 aa, Artificial Sequence
  Description of Artificial Sequence: Synthetic polypeptide
DEDEIATVNPVATEQYGCVAGTGLFAEPGDNVH

SEQ ID NO: 141350 - protein, 36 aa, Artificial Sequence
  Description of Artificial Sequence: Synthetic polypeptide
DEEEIRTTNPVATEFYGAVDDDTMNLEETGQNVQII

SEQ ID NO: 141351 - protein, 30 aa, Artificial Sequence
  Description of Artificial Sequence: Synthetic polypeptide
TEEEIATTNPVATEQYGIAPEVQQHHEEGK

SEQ ID NO: 141352 - protein, 32 aa, Artificial Sequence
  Description of Artificial Sequence: Synthetic polypeptide
TEEEIASVNPVCTEQYGVVACINALSQSGGNQ

SEQ ID NO: 141353 - protein, 36 aa, Artificial Sequence
  Description of Artificial Sequence: Synthetic polypeptide
DEEEIRTTNPVATEFYGSVDIMNGDEQITGGGNGNG

SEQ ID NO: 141354 - protein, 34 aa, Artificial Sequence
  Description of Artificial Sequence: Synthetic polypeptide
DEEEIRTTNPVATEFYGSVGDFGQGNNDDEGGAG

SEQ ID NO: 141355 - protein, 36 aa, Artificial Sequence
  Description of Artificial Sequence: Synthetic polypeptide
TEEEIATTNPVATEQYGIAVVPSTNLSDPRVGSPEW

SEQ ID NO: 141356 - protein, 35 aa, Artificial Sequence
  Description of Artificial Sequence: Synthetic polypeptide
DEEEIATTNPVATECYGSVSSTTPAGPQHNEMNPV

SEQ ID NO: 141357 - protein, 32 aa, Artificial Sequence
  Description of Artificial Sequence: Synthetic polypeptide
DESEIATTNPVAYEQWGVVSGGNLGDHPNQGS

SEQ ID NO: 141358 - protein, 35 aa, Artificial Sequence
  Description of Artificial Sequence: Synthetic polypeptide
DEEEIRTTNPVATEQYGSVITLVGFFGEGGGQDGE

SEQ ID NO: 141359 - protein, 35 aa, Artificial Sequence
  Description of Artificial Sequence: Synthetic polypeptide
DECEICTTNPMAYEQWGSVAPTDNQEQHREGGNGR

SEQ ID NO: 141360 - protein, 38 aa, Artificial Sequence
  Description of Artificial Sequence: Synthetic polypeptide
AEEEIRTTNPVATEQYGSVVTVVTNNNLQSNEEGNNNQ

SEQ ID NO: 141361 - protein, 32 aa, Artificial Sequence
  Description of Artificial Sequence: Synthetic polypeptide
DESEIATTNPVAYEQWGSVSGGGNHGADNENM

SEQ ID NO: 141362 - protein, 35 aa, Artificial Sequence
  Description of Artificial Sequence: Synthetic polypeptide
DEEEIRTTNPVATEFYGQVSGTMTDGGEGEGQNIF

SEQ ID NO: 141363 - protein, 31 aa, Artificial Sequence
  Description of Artificial Sequence: Synthetic polypeptide
AEDEIASTNPVAYEQWGEASIENDVQRGGER

SEQ ID NO: 141364 - protein, 36 aa, Artificial Sequence
  Description of Artificial Sequence: Synthetic polypeptide
AEEEIRTTNPVATEQYGSVVVNTTNDESGTVNNETT

SEQ ID NO: 141365 - protein, 34 aa, Artificial Sequence
  Description of Artificial Sequence: Synthetic polypeptide
DEEEIATTNPVATEQYGSVCAAMNPENDMDGGEN

SEQ ID NO: 141366 - protein, 34 aa, Artificial Sequence
  Description of Artificial Sequence: Synthetic polypeptide
DESEIRTTNPVATEYWGCVCSWMNENQDSFGSNQ

SEQ ID NO: 141367 - protein, 32 aa, Artificial Sequence
  Description of Artificial Sequence: Synthetic polypeptide
TEEEIASVNPVCYEQYGVVPSINLSQSTGGNQ

SEQ ID NO: 141368 - protein, 35 aa, Artificial Sequence
  Description of Artificial Sequence: Synthetic polypeptide
DESEIRTTNPVATEYWGQCVCSWMNENQDREGSNQ

SEQ ID NO: 141369 - protein, 33 aa, Artificial Sequence
  Description of Artificial Sequence: Synthetic polypeptide
DESEIATTNPVAYEQWGSVCSQNIDNHNGDNMG

SEQ ID NO: 141370 - protein, 31 aa, Artificial Sequence
  Description of Artificial Sequence: Synthetic polypeptide
TEEEIASVNPVCYEQYGVVAINELSQSGGNQ

SEQ ID NO: 141371 - protein, 32 aa, Artificial Sequence
  Description of Artificial Sequence: Synthetic polypeptide
TEEEIASVNPVCYEQYGVTVSCQNLAQSGGNQ

SEQ ID NO: 141372 - protein, 34 aa, Artificial Sequence
  Description of Artificial Sequence: Synthetic polypeptide
DESEIATTNPVATEQYGTVCSATDGHGVEAEGND

SEQ ID NO: 141373 - protein, 34 aa, Artificial Sequence
  Description of Artificial Sequence: Synthetic polypeptide
DESEIATTNPVATEQYGTVCSATDGEPSETTGND

SEQ ID NO: 141374 - protein, 34 aa, Artificial Sequence
  Description of Artificial Sequence: Synthetic polypeptide
DESEIRTTNPVATEYWGCVCSWGNENQDRFGSDQ

SEQ ID NO: 141375 - protein, 31 aa, Artificial Sequence
  Description of Artificial Sequence: Synthetic polypeptide
TEEEIATTNPVATEQYGEAPCEVDSQHEGEK

SEQ ID NO: 141376 - protein, 36 aa, Artificial Sequence
  Description of Artificial Sequence: Synthetic polypeptide
DEEEIATTNPVATEQWGSVSGTGGPLGQNHMDNSAE

SEQ ID NO: 141377 - protein, 35 aa, Artificial Sequence
  Description of Artificial Sequence: Synthetic polypeptide
DEEEIRTTNPVATEQYGSVNEPTYGMEQAAQVPLF

SEQ ID NO: 141378 - protein, 35 aa, Artificial Sequence
  Description of Artificial Sequence: Synthetic polypeptide
DEEEIRTTNPVATEAYGSVYSETDMAAGVTVQEEP

SEQ ID NO: 141379 - protein, 35 aa, Artificial Sequence
  Description of Artificial Sequence: Synthetic polypeptide
DESEIRTTNPVATFCWGSVYSCINKGPQDREGENG

SEQ ID NO: 141380 - protein, 31 aa, Artificial Sequence
  Description of Artificial Sequence: Synthetic polypeptide
TEEEIASVNPVCYEQWGCVSINELSQAGGNQ

SEQ ID NO: 141381 - protein, 34 aa, Artificial Sequence
  Description of Artificial Sequence: Synthetic polypeptide
DEEEIRTTNPVATEFYGAVDTTNDGENEEGEGGG

SEQ ID NO: 141382 - protein, 35 aa, Artificial Sequence
  Description of Artificial Sequence: Synthetic polypeptide
DESEIATTNPVATEQYGSVVSCTDELEDHEGGEDL

SEQ ID NO: 141383 - protein, 35 aa, Artificial Sequence
  Description of Artificial Sequence: Synthetic polypeptide
DEEEIATTNPVATEQYGSVCAAMNPLFNDMDGGHN

SEQ ID NO: 141384 - protein, 34 aa, Artificial Sequence
  Description of Artificial Sequence: Synthetic polypeptide
DESEIATTNPVAYEQWGSVCSTTDNGDDQGQNVD

SEQ ID NO: 141385 - protein, 35 aa, Artificial Sequence
  Description of Artificial Sequence: Synthetic polypeptide
DEEEIATTNPVATEQWGSVSGTGNPDNSEHGTDTV

SEQ ID NO: 141386 - protein, 33 aa, Artificial Sequence
  Description of Artificial Sequence: Synthetic polypeptide
DESEIATTNPVAYEQWGSVSGENGNESGNGDTS

SEQ ID NO: 141387 - protein, 32 aa, Artificial Sequence
  Description of Artificial Sequence: Synthetic polypeptide
TEEEIASVNPVCYEQYGVTVSCINLSQSGGNG

SEQ ID NO: 141388 - protein, 35 aa, Artificial Sequence
  Description of Artificial Sequence: Synthetic polypeptide
DEEEIRTTNPVATEQYGCVCSSGEHNQGFNSDTQA

SEQ ID NO: 141389 - protein, 35 aa, Artificial Sequence
  Description of Artificial Sequence: Synthetic polypeptide
DESEIATTNPVATEQYGSMSATTPTGPNMRGMNPV

SEQ ID NO: 141390 - protein, 37 aa, Artificial Sequence
  Description of Artificial Sequence: Synthetic polypeptide
DEEEIRTTNPVATEFYGSVMGVDENLGDQGEGENIVT

SEQ ID NO: 141391 - protein, 36 aa, Artificial Sequence
  Description of Artificial Sequence: Synthetic polypeptide
DEEEIRTTNPVATEPYGVSVCFQTNAGSTDTGGNPT

SEQ ID NO: 141392 - protein, 36 aa, Artificial Sequence
  Description of Artificial Sequence: Synthetic polypeptide
DEEEIRTTNPVATEQYGSVEPTPIMPAAPGLNVPLN

SEQ ID NO: 141393 - protein, 34 aa, Artificial Sequence
  Description of Artificial Sequence: Synthetic polypeptide
TEECIRTTNPVATEQYGCVCSTGEHNAHFLSNQA

SEQ ID NO: 141394 - protein, 35 aa, Artificial Sequence
  Description of Artificial Sequence: Synthetic polypeptide
DEEEIRTTNPVATEQYGCVCSSGEHNTENFNSDQQ

SEQ ID NO: 141395 - protein, 35 aa, Artificial Sequence
  Description of Artificial Sequence: Synthetic polypeptide
DEEEIRTTNPVATEQWGDVSSTEPIEPMNRNENPV

SEQ ID NO: 141396 - protein, 36 aa, Artificial Sequence
  Description of Artificial Sequence: Synthetic polypeptide
AEEEIRTTNPVATEAYGVVSTVVSTNNNEEGTNAQD

SEQ ID NO: 141397 - protein, 34 aa, Artificial Sequence
  Description of Artificial Sequence: Synthetic polypeptide
QEEEIACTNPVATEQYGCVAATTNLAEAPGEMRH

SEQ ID NO: 141398 - protein, 32 aa, Artificial Sequence
  Description of Artificial Sequence: Synthetic polypeptide
DECEIATTNPVAYEQWGVTSTPDLGNHGQNDS

SEQ ID NO: 141399 - protein, 33 aa, Artificial Sequence
  Description of Artificial Sequence: Synthetic polypeptide
TEECIRTTNPVATEQYGCVCSTEDAYFLSDTQS

SEQ ID NO: 141400 - protein, 31 aa, Artificial Sequence
  Description of Artificial Sequence: Synthetic polypeptide
AEDEIACTNPVAYEQWGEAYENLQRGGGDRQ

SEQ ID NO: 141401 - protein, 36 aa, Artificial Sequence
  Description of Artificial Sequence: Synthetic polypeptide
DEEEIRTTNPVATEQYGSVIHTIVAEGEEQQMGVDG

SEQ ID NO: 141402 - protein, 33 aa, Artificial Sequence
  Description of Artificial Sequence: Synthetic polypeptide
TEECIRTTNPVATEQYGCVCSTEDAEYFLSNQS

SEQ ID NO: 141403 - protein, 35 aa, Artificial Sequence
  Description of Artificial Sequence: Synthetic polypeptide
DEEEIRTTNPVATEQYGCVCSSGEHNQNFNSQFQS

SEQ ID NO: 141404 - protein, 35 aa, Artificial Sequence
  Description of Artificial Sequence: Synthetic polypeptide
QEEEIRTTNPVATEQYGSVNTDNMIETGEGQEQGY

SEQ ID NO: 141405 - protein, 33 aa, Artificial Sequence
  Description of Artificial Sequence: Synthetic polypeptide
DEDEIATTNPVAYEQYGSVCAAVPLQAADPNDN

SEQ ID NO: 141406 - protein, 35 aa, Artificial Sequence
  Description of Artificial Sequence: Synthetic polypeptide
DEEEIRTTNPVATEQWGDVSSTEPIGPMNRNENPV

SEQ ID NO: 141407 - protein, 36 aa, Artificial Sequence
  Description of Artificial Sequence: Synthetic polypeptide
DEEEIRTTNPVATEPYGTVSSTTPAGPNMRNGMNPV

SEQ ID NO: 141408 - protein, 35 aa, Artificial Sequence
  Description of Artificial Sequence: Synthetic polypeptide
QEEEIRTTNPVATEQYGSVNTDNMIETAGGGQETT

SEQ ID NO: 141409 - protein, 36 aa, Artificial Sequence
  Description of Artificial Sequence: Synthetic polypeptide
DEEEIRTTNPVATEQYGSVEPTPHHPQEPELNVQLD

SEQ ID NO: 141410 - protein, 34 aa, Artificial Sequence
  Description of Artificial Sequence: Synthetic polypeptide
AEDEICATNPVATEQYGVVATNENNNLQLGGNDD

SEQ ID NO: 141411 - protein, 36 aa, Artificial Sequence
  Description of Artificial Sequence: Synthetic polypeptide
TEECIRTTNPVATEQYGCTVSCTLNEVSQKLGGNDC

SEQ ID NO: 141412 - protein, 34 aa, Artificial Sequence
  Description of Artificial Sequence: Synthetic polypeptide
DEDEIATTNPVAYEQYGSVCAANNLQEAGGTDHN

SEQ ID NO: 141413 - protein, 37 aa, Artificial Sequence
  Description of Artificial Sequence: Synthetic polypeptide
DEEEIRTTNPVATEQYGSVEPTNPIMPAEPGLNVPAQ

SEQ ID NO: 141414 - protein, 36 aa, Artificial Sequence
  Description of Artificial Sequence: Synthetic polypeptide
DEEEIRTTNPVATEQYGSVEPTPIMPAEPGLNVIGQ

SEQ ID NO: 141415 - protein, 35 aa, Artificial Sequence
  Description of Artificial Sequence: Synthetic polypeptide
DEEEIATTNPVATEQWGSVSGEGPPPQQHQGGNHN

SEQ ID NO: 141416 - protein, 36 aa, Artificial Sequence
  Description of Artificial Sequence: Synthetic polypeptide
DEEEIRTTNPVATEQYGSVEPTPIMPDEPGLNVPEM

SEQ ID NO: 141417 - protein, 30 aa, Artificial Sequence
  Description of Artificial Sequence: Synthetic polypeptide
QEEEIATTNPVATEQYGEAPEVQCQHEEKD

SEQ ID NO: 141418 - protein, 34 aa, Artificial Sequence
  Description of Artificial Sequence: Synthetic polypeptide
CEEEIACTNPVATEQYGCVAATNNLENGMGENDN

SEQ ID NO: 141419 - protein, 36 aa, Artificial Sequence
  Description of Artificial Sequence: Synthetic polypeptide
DEEEIRTTNPVATEQYGSVEPTPIMPVEGGLNVPLQ

SEQ ID NO: 141420 - protein, 36 aa, Artificial Sequence
  Description of Artificial Sequence: Synthetic polypeptide
DEEEIRTTNPVATEQYGSVEPTPIMPTEPGLNVPLD

SEQ ID NO: 141421 - protein, 35 aa, Artificial Sequence
  Description of Artificial Sequence: Synthetic polypeptide
QEEEIRTTNPVATEQYGSVNTDNMIETGGGQEQDM

SEQ ID NO: 141422 - protein, 37 aa, Artificial Sequence
  Description of Artificial Sequence: Synthetic polypeptide
DEEEIRTTNPVATEQYGSVNMNLNGDDQDQEDDDENG

SEQ ID NO: 141423 - protein, 35 aa, Artificial Sequence
  Description of Artificial Sequence: Synthetic polypeptide
DEEEIRTTNPVATEQYGCVCSTEEWHAENFNSDQG

SEQ ID NO: 141424 - protein, 35 aa, Artificial Sequence
  Description of Artificial Sequence: Synthetic polypeptide
QEEEIRTTNPVATEQYGSVNTDNMIETGGGQEDGS

SEQ ID NO: 141425 - protein, 34 aa, Artificial Sequence
  Description of Artificial Sequence: Synthetic polypeptide
DEEEIRTTNPVATEQYGCVCSSGEHQNFTSETQS

SEQ ID NO: 141426 - protein, 28 aa, Artificial Sequence
  Description of Artificial Sequence: Synthetic peptide
QEEEIAPTNPCASEQYGEAPCNCQSEEK

SEQ ID NO: 141427 - protein, 34 aa, Artificial Sequence
  Description of Artificial Sequence: Synthetic polypeptide
DESEIRTTNPVAYECWGCVSCANGESQDRPGGNG

SEQ ID NO: 141428 - protein, 34 aa, Artificial Sequence
  Description of Artificial Sequence: Synthetic polypeptide
DEEEIRTTNPVATEQYGCVCSSGEHQFFISDTQA

SEQ ID NO: 141429 - protein, 37 aa, Artificial Sequence
  Description of Artificial Sequence: Synthetic polypeptide
DECEICTTNPVATEQYGSVSTTNNQNNNQQQGTNVTD

SEQ ID NO: 141430 - protein, 36 aa, Artificial Sequence
  Description of Artificial Sequence: Synthetic polypeptide
DEEEIRTTNPVATEFYGSVSDGVGEGQGNVGGNMNE

SEQ ID NO: 141431 - protein, 33 aa, Artificial Sequence
  Description of Artificial Sequence: Synthetic polypeptide
DESEIRTTNPVAYECWGSVACINESQDSEGGNG

SEQ ID NO: 141432 - protein, 33 aa, Artificial Sequence
  Description of Artificial Sequence: Synthetic polypeptide
DESEIRTTNPVAYECWGSVCVINEPQDHEGENG

SEQ ID NO: 141433 - protein, 34 aa, Artificial Sequence
  Description of Artificial Sequence: Synthetic polypeptide
DESEIRTTNPVAYECWGSVPSCLNFSDDREGGNV

SEQ ID NO: 141434 - protein, 33 aa, Artificial Sequence
  Description of Artificial Sequence: Synthetic polypeptide
DESEIRTTNPVAYECWGSVRCINEPQDREGEGG

SEQ ID NO: 141435 - protein, 34 aa, Artificial Sequence
  Description of Artificial Sequence: Synthetic polypeptide
DESEIRTTNPVAYECWGSVSCANASSDDREGGNH

SEQ ID NO: 141436 - protein, 33 aa, Artificial Sequence
  Description of Artificial Sequence: Synthetic polypeptide
DESEIRTTNPVAYECWGSVSCANDSDDREGGDV

SEQ ID NO: 141437 - protein, 31 aa, Artificial Sequence
  Description of Artificial Sequence: Synthetic polypeptide
AEDEIACTNPVAYEQWGEAYIENLQRGEGER

SEQ ID NO: 141438 - protein, 30 aa, Artificial Sequence
  Description of Artificial Sequence: Synthetic polypeptide
QEEEIATTNPVATEQYGEAPEVEQNHAEEK

SEQ ID NO: 141439 - protein, 34 aa, Artificial Sequence
  Description of Artificial Sequence: Synthetic polypeptide
DESEIRTTNPVAYECWGSVSCANGSDDREGGNGY

SEQ ID NO: 141440 - protein, 36 aa, Artificial Sequence
  Description of Artificial Sequence: Synthetic polypeptide
DEEEIRTTNPVATEQYGSVEPTPIMPEEPGLNVGLQ

SEQ ID NO: 141441 - protein, 36 aa, Artificial Sequence
  Description of Artificial Sequence: Synthetic polypeptide
DEEEIRTTNPVATEQWGDVSSTEPAGPMNRNGMNPV

SEQ ID NO: 141442 - protein, 36 aa, Artificial Sequence
  Description of Artificial Sequence: Synthetic polypeptide
DEEEIRTTNPVATEQYGSVIHTIVAEGEDQVQGVEG

SEQ ID NO: 141443 - protein, 34 aa, Artificial Sequence
  Description of Artificial Sequence: Synthetic polypeptide
DEEEIRTTNPVATEFYGSVSDGFGGEGQGEEQGL

SEQ ID NO: 141444 - protein, 33 aa, Artificial Sequence
  Description of Artificial Sequence: Synthetic polypeptide
DESEIATTNPVATEQWGSVSCIDEPQDHEGEEL

SEQ ID NO: 141445 - protein, 35 aa, Artificial Sequence
  Description of Artificial Sequence: Synthetic polypeptide
DEEEIRTTNPVATEQYGCVCSTEHDQENFISDTQS

SEQ ID NO: 141446 - protein, 32 aa, Artificial Sequence
  Description of Artificial Sequence: Synthetic polypeptide
AEDEIACTNPVAYEQWGEASIENDLQRNGGER

SEQ ID NO: 141447 - protein, 36 aa, Artificial Sequence
  Description of Artificial Sequence: Synthetic polypeptide
AEEEIRTTNPVATEAYGVVSTTQQQLQNGNQQTTDE

SEQ ID NO: 141448 - protein, 33 aa, Artificial Sequence
  Description of Artificial Sequence: Synthetic polypeptide
AEDEICATNPVATEQYGVVATSDENLQLGGTDG

SEQ ID NO: 141449 - protein, 32 aa, Artificial Sequence
  Description of Artificial Sequence: Synthetic polypeptide
TEECIATTNPVAYEQYSEEVTTGDNHQGGGGR

SEQ ID NO: 141450 - protein, 35 aa, Artificial Sequence
  Description of Artificial Sequence: Synthetic polypeptide
DEEEIRTTNPVATEQWGDVSSTTPIEPNNRNGMDV

SEQ ID NO: 141451 - protein, 36 aa, Artificial Sequence
  Description of Artificial Sequence: Synthetic polypeptide
AEEEIRTTNPVATEAYGVVSTTNQQAGNNQQGEIDE

SEQ ID NO: 141452 - protein, 35 aa, Artificial Sequence
  Description of Artificial Sequence: Synthetic polypeptide
DECEICTTNPVATEQYGSVSTTNQLLNNDTEEEDD

SEQ ID NO: 141453 - protein, 38 aa, Artificial Sequence
  Description of Artificial Sequence: Synthetic polypeptide
DEEEIRTTNPVATEAYGSVSVTVNQQNNQQQGTNVATE

SEQ ID NO: 141454 - protein, 36 aa, Artificial Sequence
  Description of Artificial Sequence: Synthetic polypeptide
AEEEIRTTNPVATEAYGVVSTTNNQQQGNQQGTNLQ

SEQ ID NO: 141455 - protein, 35 aa, Artificial Sequence
  Description of Artificial Sequence: Synthetic polypeptide
QEEEIRTTNPVATEQYGSVVDGLNFTGEGENDGES

SEQ ID NO: 141456 - protein, 34 aa, Artificial Sequence
  Description of Artificial Sequence: Synthetic polypeptide
DESEIRTTNPVAYECWGSVSWINEIQDRRGEGGQ

SEQ ID NO: 141457 - protein, 36 aa, Artificial Sequence
  Description of Artificial Sequence: Synthetic polypeptide
AEEEIRTTNPVATEAYGVVSTTNLQQQQEATNVATE

SEQ ID NO: 141458 - protein, 36 aa, Artificial Sequence
  Description of Artificial Sequence: Synthetic polypeptide
QEEEIRTTNPVATEQYGSVVDGQTNMEDEGNGNNEV

SEQ ID NO: 141459 - protein, 33 aa, Artificial Sequence
  Description of Artificial Sequence: Synthetic polypeptide
TEECIATTNPVAYEQWGSVSKTNPEDNMGKNEQ

SEQ ID NO: 141460 - protein, 34 aa, Artificial Sequence
  Description of Artificial Sequence: Synthetic polypeptide
DESEIRTTNPVAYECWGSVSWINENQDREGEGDG

SEQ ID NO: 141461 - protein, 35 aa, Artificial Sequence
  Description of Artificial Sequence: Synthetic polypeptide
QEEEIRTTNPVATEQYGSVVDNAGDEQEEMGQMDD

SEQ ID NO: 141462 - protein, 34 aa, Artificial Sequence
  Description of Artificial Sequence: Synthetic polypeptide
TEECIATTNPVAYEQWGSVSKTNNPEDQMGKNQS

SEQ ID NO: 141463 - protein, 35 aa, Artificial Sequence
  Description of Artificial Sequence: Synthetic polypeptide
QEEEIRTTNPVATEQYGSVVGNDTTGQTQEGDTGE

SEQ ID NO: 141464 - protein, 36 aa, Artificial Sequence
  Description of Artificial Sequence: Synthetic polypeptide
DEEEIRTTNPVATEQYGSVNAPTTNDDENSGQEEIS

SEQ ID NO: 141465 - protein, 33 aa, Artificial Sequence
  Description of Artificial Sequence: Synthetic polypeptide
TEECIATTNPVAYEQWGSVSKTNNPEDGNGKNQ

SEQ ID NO: 141466 - protein, 35 aa, Artificial Sequence
  Description of Artificial Sequence: Synthetic polypeptide
DEEEIRTTNPVATEQWGDVSSTTPIGPNNRNGMDV

SEQ ID NO: 141467 - protein, 38 aa, Artificial Sequence
  Description of Artificial Sequence: Synthetic polypeptide
DEEEIRTTNPVATEQYGSVNANVTMGQDLEQDGGGNEE

SEQ ID NO: 141468 - protein, 30 aa, Artificial Sequence
  Description of Artificial Sequence: Synthetic polypeptide
QEEEIATTNPVATEQYGEAPEVRCIQHEEK

SEQ ID NO: 141469 - protein, 36 aa, Artificial Sequence
  Description of Artificial Sequence: Synthetic polypeptide
DEEEIRTTNPVATEQYGSVEPTMIIMQEATVEITRM

SEQ ID NO: 141470 - protein, 36 aa, Artificial Sequence
  Description of Artificial Sequence: Synthetic polypeptide
DEEEIRTTNPVATEQWGDVSSTTPAGPMNRNGMNPV

SEQ ID NO: 141471 - protein, 37 aa, Artificial Sequence
  Description of Artificial Sequence: Synthetic polypeptide
DECEICTTNPVATEQYGSVSTTNNQQAGNQQGTNTTE

SEQ ID NO: 141472 - protein, 34 aa, Artificial Sequence
  Description of Artificial Sequence: Synthetic polypeptide
DESEIRTTNPVAYECWGSVSICANFSQDDEGGNE

SEQ ID NO: 141473 - protein, 38 aa, Artificial Sequence
  Description of Artificial Sequence: Synthetic polypeptide
DEEEIRTTNPVATEQYGSVNMSGTMNGQGEFGDQDDDI

SEQ ID NO: 141474 - protein, 36 aa, Artificial Sequence
  Description of Artificial Sequence: Synthetic polypeptide
DEEEIRTTNPVATEPYGTVSSTMEAGPQQQNGMNPV

SEQ ID NO: 141475 - protein, 34 aa, Artificial Sequence
  Description of Artificial Sequence: Synthetic polypeptide
AEEEIRTTNPVATEHYGSVICTEESSFNGGNNED

SEQ ID NO: 141476 - protein, 35 aa, Artificial Sequence
  Description of Artificial Sequence: Synthetic polypeptide
AEEEIRTTNPVATEAYGVVSTVTNNQQLQAEEEDE

SEQ ID NO: 141477 - protein, 33 aa, Artificial Sequence
  Description of Artificial Sequence: Synthetic polypeptide
TEECIRCTNPVAYEQYGSVVSMNEFSTRGTPLM

SEQ ID NO: 141478 - protein, 34 aa, Artificial Sequence
  Description of Artificial Sequence: Synthetic polypeptide
DEEEIATTNPVATEQYGSVCAATAGEEATDEMNN

SEQ ID NO: 141479 - protein, 36 aa, Artificial Sequence
  Description of Artificial Sequence: Synthetic polypeptide
AEEEIRTTNPVATEHYGSVSSTTPAGPNMRNGMNPV

SEQ ID NO: 141480 - protein, 36 aa, Artificial Sequence
  Description of Artificial Sequence: Synthetic polypeptide
YEEEIRSTNPVATEQYGVVSSTTPNGPNMRNGMNPQ

SEQ ID NO: 141481 - protein, 35 aa, Artificial Sequence
  Description of Artificial Sequence: Synthetic polypeptide
DEEEIRTTNPVATEQYGCVCSSGEHNQNFNSNFQP

SEQ ID NO: 141482 - protein, 31 aa, Artificial Sequence
  Description of Artificial Sequence: Synthetic polypeptide
AEDEIACTNPVAYEQWGEASKENDGQRGGER

SEQ ID NO: 141483 - protein, 34 aa, Artificial Sequence
  Description of Artificial Sequence: Synthetic polypeptide
DEEEIATTNPVATEQYGSVCAATAGEEMADEQNN

SEQ ID NO: 141484 - protein, 35 aa, Artificial Sequence
  Description of Artificial Sequence: Synthetic polypeptide
DEEEIATTNPVATEQYGSVCAAPMNLENDDLGAQA

SEQ ID NO: 141485 - protein, 33 aa, Artificial Sequence
  Description of Artificial Sequence: Synthetic polypeptide
DESEIATTNPVAYEQYGTVCSATDGPVEHEGND

SEQ ID NO: 141486 - protein, 35 aa, Artificial Sequence
  Description of Artificial Sequence: Synthetic polypeptide
QEEEIRTTNPVATEQYGSVNTDNMFETIGGGQEQA

SEQ ID NO: 141487 - protein, 33 aa, Artificial Sequence
  Description of Artificial Sequence: Synthetic polypeptide
DESEIATTNPVATEQWGSVSATIDEEDHEGEDL

SEQ ID NO: 141488 - protein, 34 aa, Artificial Sequence
  Description of Artificial Sequence: Synthetic polypeptide
TEEEIATTNPVGTAAWGSVVSCTNMLSQTGEYRV

SEQ ID NO: 141489 - protein, 33 aa, Artificial Sequence
  Description of Artificial Sequence: Synthetic polypeptide
DEDEIATTNPVAYEQYGSVCAAANSLQPAMDID

SEQ ID NO: 141490 - protein, 33 aa, Artificial Sequence
  Description of Artificial Sequence: Synthetic polypeptide
DESEIATTNPVATEQWGSVSATIDEEDHEGEDG

SEQ ID NO: 141491 - protein, 28 aa, Artificial Sequence
  Description of Artificial Sequence: Synthetic peptide
QEEEIAPTNPCATEQYGEAPCVCQHEEK

SEQ ID NO: 141492 - protein, 34 aa, Artificial Sequence
  Description of Artificial Sequence: Synthetic polypeptide
DESEIRTTNPVAYECWGSVSCINKEPQDREGESG

SEQ ID NO: 141493 - protein, 36 aa, Artificial Sequence
  Description of Artificial Sequence: Synthetic polypeptide
DEEEIRTTNPVATEQYGSVIGPTPVEEIIERGQPQG

SEQ ID NO: 141494 - protein, 37 aa, Artificial Sequence
  Description of Artificial Sequence: Synthetic polypeptide
QEEEIRTTNPVATEQYGSVTFTGSGNFDQDEGGNQQQ

SEQ ID NO: 141495 - protein, 34 aa, Artificial Sequence
  Description of Artificial Sequence: Synthetic polypeptide
DESEIRTTNPVAYECWGSVSGENQGNQDRQNNQP

SEQ ID NO: 141496 - protein, 35 aa, Artificial Sequence
  Description of Artificial Sequence: Synthetic polypeptide
DEEEIRTTNPVATEQYGCVCSSGEHNQNFISNNQS

SEQ ID NO: 141497 - protein, 31 aa, Artificial Sequence
  Description of Artificial Sequence: Synthetic polypeptide
AEDEIACTNPVAYEQWGEASIENGDQRKGER

SEQ ID NO: 141498 - protein, 30 aa, Artificial Sequence
  Description of Artificial Sequence: Synthetic polypeptide
QEEEIATTNPVATEQYGEAPEVPCQHEEKY

SEQ ID NO: 141499 - protein, 34 aa, Artificial Sequence
  Description of Artificial Sequence: Synthetic polypeptide
DESEIATTNPVATEQWGSVSTIDEPQDHEGEEDL

SEQ ID NO: 141500 - protein, 33 aa, Artificial Sequence
  Description of Artificial Sequence: Synthetic polypeptide
DEDEIATTNPVAYEQYGSVCAGNNLADDPGGDM

SEQ ID NO: 141501 - protein, 36 aa, Artificial Sequence
  Description of Artificial Sequence: Synthetic polypeptide
QEEEIRTTNPVATEQYGSVSSTTPAGPNMRNEMNPV

SEQ ID NO: 141502 - protein, 32 aa, Artificial Sequence
  Description of Artificial Sequence: Synthetic polypeptide
TEECIRTTNPVAYEGYGTTVPCTQNESQSGEN

SEQ ID NO: 141503 - protein, 29 aa, Artificial Sequence
  Description of Artificial Sequence: Synthetic peptide
DEEEIATTNPVATECYGETAEDCAHEEYI

SEQ ID NO: 141504 - protein, 35 aa, Artificial Sequence
  Description of Artificial Sequence: Synthetic polypeptide
DEEEIRTTNPVATEQWGCVAGEADTQNHQDDNAAQ

SEQ ID NO: 141505 - protein, 32 aa, Artificial Sequence
  Description of Artificial Sequence: Synthetic polypeptide
DESEIATTNPVATEQYGEVPEIVEQDHEGEEG

SEQ ID NO: 141506 - protein, 35 aa, Artificial Sequence
  Description of Artificial Sequence: Synthetic polypeptide
TEEEIATTNPVAYEQDGSVVSTAYELSHQGDNYRN

SEQ ID NO: 141507 - protein, 28 aa, Artificial Sequence
  Description of Artificial Sequence: Synthetic peptide
TEEEIATTNPVAYEQWGEAPEACQHEEK

SEQ ID NO: 141508 - protein, 35 aa, Artificial Sequence
  Description of Artificial Sequence: Synthetic polypeptide
DESEIRTTNPVAWEQWGSVSCWNISQDTAGGNNSF

SEQ ID NO: 141509 - protein, 32 aa, Artificial Sequence
  Description of Artificial Sequence: Synthetic polypeptide
TEEEIATTNPVAYEQWGSLSCFEHNQRQQGEH

SEQ ID NO: 141510 - protein, 33 aa, Artificial Sequence
  Description of Artificial Sequence: Synthetic polypeptide
DESEIATTNPVATEQYGEVPEIVEPQDREGEEG

SEQ ID NO: 141511 - protein, 36 aa, Artificial Sequence
  Description of Artificial Sequence: Synthetic polypeptide
QEEEIRTTNPVATEQYGSVSSTTPAGPNMRNGMDPV

SEQ ID NO: 141512 - protein, 36 aa, Artificial Sequence
  Description of Artificial Sequence: Synthetic polypeptide
DEEEIRTTNPVATEQYGSVSTELGLSETVPHFVLVA

SEQ ID NO: 141513 - protein, 33 aa, Artificial Sequence
  Description of Artificial Sequence: Synthetic polypeptide
DEDEIRATNPVAYEQWGSVSGGGNHAGEQGGEQ

SEQ ID NO: 141514 - protein, 35 aa, Artificial Sequence
  Description of Artificial Sequence: Synthetic polypeptide
DEDEIATTNPVAYEQYGSVCATNPMQQRNQTEGTD

SEQ ID NO: 141515 - protein, 37 aa, Artificial Sequence
  Description of Artificial Sequence: Synthetic polypeptide
QEEEIRTTNPVATEQYGSVSSTTPAGPNMRNGMNPVF

SEQ ID NO: 141516 - protein, 33 aa, Artificial Sequence
  Description of Artificial Sequence: Synthetic polypeptide
AEEEIRTTNPVATEEYGCYCSWENHQYFGSDQA

SEQ ID NO: 141517 - protein, 33 aa, Artificial Sequence
  Description of Artificial Sequence: Synthetic polypeptide
YEEEIRCTNPAATEQYGSVVSEGGMGGGEGGNG

SEQ ID NO: 141518 - protein, 31 aa, Artificial Sequence
  Description of Artificial Sequence: Synthetic polypeptide
ASAEIACTNPVAYEQYGEASCENLSQMVGGR

SEQ ID NO: 141519 - protein, 36 aa, Artificial Sequence
  Description of Artificial Sequence: Synthetic polypeptide
DEEEIRTTNPVATEQYGSVIHFIVAENEHQFQGVDG

SEQ ID NO: 141520 - protein, 36 aa, Artificial Sequence
  Description of Artificial Sequence: Synthetic polypeptide
DEEEIRTTNPVATEQYGCVCSSMELEQENFNSENQS

SEQ ID NO: 141521 - protein, 32 aa, Artificial Sequence
  Description of Artificial Sequence: Synthetic polypeptide
DESEIATTNPVATEQYGEVPEIVCQDHEGEEK

SEQ ID NO: 141522 - protein, 36 aa, Artificial Sequence
  Description of Artificial Sequence: Synthetic polypeptide
QEEEIRTTNPVATEQYGSVSSTTPAGPNMRNGMTPV

SEQ ID NO: 141523 - protein, 33 aa, Artificial Sequence
  Description of Artificial Sequence: Synthetic polypeptide
DEDEIRATNPVAYEQYGTVATTGGGAQNDDNSR

SEQ ID NO: 141524 - protein, 34 aa, Artificial Sequence
  Description of Artificial Sequence: Synthetic polypeptide
DEEEIATTNPVATEQYGSVCAANNGEEAGMEMEN

SEQ ID NO: 141525 - protein, 32 aa, Artificial Sequence
  Description of Artificial Sequence: Synthetic polypeptide
DESEIATTNPVATEQYGEVPEIVEQDHEGEEK

SEQ ID NO: 141526 - protein, 34 aa, Artificial Sequence
  Description of Artificial Sequence: Synthetic polypeptide
DEEEIATTNPVATECYGSVCAANEGLEADDNLGP

SEQ ID NO: 141527 - protein, 35 aa, Artificial Sequence
  Description of Artificial Sequence: Synthetic polypeptide
DEEEIATTNPVATEQYGSVCAANNGEEAGDEMGNN

SEQ ID NO: 141528 - protein, 36 aa, Artificial Sequence
  Description of Artificial Sequence: Synthetic polypeptide
DEEEIRTTNPVATEFYGSVMSGDLNEFTDGQGENIF

SEQ ID NO: 141529 - protein, 32 aa, Artificial Sequence
  Description of Artificial Sequence: Synthetic polypeptide
DECEIATTNPVAYEQYGVCSITIDQHQQHGAN

SEQ ID NO: 141530 - protein, 36 aa, Artificial Sequence
  Description of Artificial Sequence: Synthetic polypeptide
DEEEIRTTNPVATEFYGSVMSGDQNEEFTDGNGENI

SEQ ID NO: 141531 - protein, 35 aa, Artificial Sequence
  Description of Artificial Sequence: Synthetic polypeptide
DEEEIATTNPVATEQWGSVSGQGPPQEAGDGMNNN

SEQ ID NO: 141532 - protein, 35 aa, Artificial Sequence
  Description of Artificial Sequence: Synthetic polypeptide
DEDEIATTNPVAYEQYGSVCSANPALQEHNDLTAM

SEQ ID NO: 141533 - protein, 36 aa, Artificial Sequence
  Description of Artificial Sequence: Synthetic polypeptide
DEEEIRTTNPVATEFYGSVMSGMFNNDDQEEFVNDI

SEQ ID NO: 141534 - protein, 34 aa, Artificial Sequence
  Description of Artificial Sequence: Synthetic polypeptide
TEEEIATTNPVAWEQYGVVSCTGQAQFRTVANNE

SEQ ID NO: 141535 - protein, 35 aa, Artificial Sequence
  Description of Artificial Sequence: Synthetic polypeptide
TEEEIATTNPVAYAQDGVTVSTANELSQQGDNYRN

SEQ ID NO: 141536 - protein, 36 aa, Artificial Sequence
  Description of Artificial Sequence: Synthetic polypeptide
DEEEIRTTNPVATEQYGCVCSTEEHNEESFNSENQA

SEQ ID NO: 141537 - protein, 33 aa, Artificial Sequence
  Description of Artificial Sequence: Synthetic polypeptide
DEEEIRTTNPVATEEYGCVCSWEHEENFNSDQP

SEQ ID NO: 141538 - protein, 35 aa, Artificial Sequence
  Description of Artificial Sequence: Synthetic polypeptide
DEEEIATTNPVATEGYGSVAAANNDTQDNNTEGRN

SEQ ID NO: 141539 - protein, 33 aa, Artificial Sequence
  Description of Artificial Sequence: Synthetic polypeptide
DESEIATTNPVATEQYGEVPCIVEPQDREGEEG

SEQ ID NO: 141540 - protein, 36 aa, Artificial Sequence
  Description of Artificial Sequence: Synthetic polypeptide
DEEEIRTTNPVATEQYGSVNGTINPDDEGSGQEEIQ

SEQ ID NO: 141541 - protein, 36 aa, Artificial Sequence
  Description of Artificial Sequence: Synthetic polypeptide
DEEEIRTTNPVATEQYGSVISVTVPNDMAIDIQELM

SEQ ID NO: 141542 - protein, 36 aa, Artificial Sequence
  Description of Artificial Sequence: Synthetic polypeptide
AEEEIRTTNPVATEQYGSVVTVVTNGNNNLGGNDDE

SEQ ID NO: 141543 - protein, 31 aa, Artificial Sequence
  Description of Artificial Sequence: Synthetic polypeptide
DECEIATTNPVAYEQYGVCSIIDQAMPNTDN

SEQ ID NO: 141544 - protein, 37 aa, Artificial Sequence
  Description of Artificial Sequence: Synthetic polypeptide
DEEEIRTTNPVATEFYGSVNIMGTDNQDQQRIINGDD

SEQ ID NO: 141545 - protein, 36 aa, Artificial Sequence
  Description of Artificial Sequence: Synthetic polypeptide
DESEIRTTNPVATEQYGSVSSTTPAGPNMRNGMDPI

SEQ ID NO: 141546 - protein, 33 aa, Artificial Sequence
  Description of Artificial Sequence: Synthetic polypeptide
TEEEIATTNPVAYEEWGSVATNLNGNAGEHGNQ

SEQ ID NO: 141547 - protein, 30 aa, Artificial Sequence
  Description of Artificial Sequence: Synthetic polypeptide
DEDEIRATNPVATEQWGDVSEIEMNAAEDA

SEQ ID NO: 141548 - protein, 35 aa, Artificial Sequence
  Description of Artificial Sequence: Synthetic polypeptide
DEEEIATTNPVATEQYGSVCAANNGEAPDDGMENS

SEQ ID NO: 141549 - protein, 36 aa, Artificial Sequence
  Description of Artificial Sequence: Synthetic polypeptide
DEEEIRTTNPVATEQYGCVCSTEEHNQEYFNSDTQG

SEQ ID NO: 141550 - protein, 34 aa, Artificial Sequence
  Description of Artificial Sequence: Synthetic polypeptide
TEEEIATTNPVAYEPDGSVSTAQELSHQGDNYRN

SEQ ID NO: 141551 - protein, 35 aa, Artificial Sequence
  Description of Artificial Sequence: Synthetic polypeptide
DEEEIATTNPVATEQYGSVCAANNGEAPDQMENSN

SEQ ID NO: 141552 - protein, 36 aa, Artificial Sequence
  Description of Artificial Sequence: Synthetic polypeptide
DEEEIRTTNPVATEQYGCVCSTEEHNQENFGSDTQM

SEQ ID NO: 141553 - protein, 35 aa, Artificial Sequence
  Description of Artificial Sequence: Synthetic polypeptide
QEEEIRTTNPVATEQYGSVNTDNMIETGGGQETIG

SEQ ID NO: 141554 - protein, 34 aa, Artificial Sequence
  Description of Artificial Sequence: Synthetic polypeptide
DEEEIATTNPVATEQYGSVCAANNGENPDDQNSL

SEQ ID NO: 141555 - protein, 32 aa, Artificial Sequence
  Description of Artificial Sequence: Synthetic polypeptide
YEEEIRCTNPAATEQYGSVVSEGGMGGQGTGG

SEQ ID NO: 141556 - protein, 35 aa, Artificial Sequence
  Description of Artificial Sequence: Synthetic polypeptide
DEEEIRTTNPVATEQYGCVCSTEEPHNTNFNSEQA

SEQ ID NO: 141557 - protein, 37 aa, Artificial Sequence
  Description of Artificial Sequence: Synthetic polypeptide
DESEIRTTNPVATEQYGSVSNMNLVGDDQDQEDDTGN

SEQ ID NO: 141558 - protein, 35 aa, Artificial Sequence
  Description of Artificial Sequence: Synthetic polypeptide
DEEEIATTNPVATEQWGSVSGPGPEPQEHGDNSAA

SEQ ID NO: 141559 - protein, 36 aa, Artificial Sequence
  Description of Artificial Sequence: Synthetic polypeptide
DEEEIRTTNPVATEQYGSVEPVPNAMAARDGVVPEI

SEQ ID NO: 141560 - protein, 33 aa, Artificial Sequence
  Description of Artificial Sequence: Synthetic polypeptide
DESEIATTNPVATEQWGTVCSCTDGPSESEGND

SEQ ID NO: 141561 - protein, 36 aa, Artificial Sequence
  Description of Artificial Sequence: Synthetic polypeptide
DEEEIRTTNPVATEQYGSVEPTVNTITGHELESQEG

SEQ ID NO: 141562 - protein, 37 aa, Artificial Sequence
  Description of Artificial Sequence: Synthetic polypeptide
DESEIRTTNPVATEQYGSVSNMNLVDDDEDQEDDDGN

SEQ ID NO: 141563 - protein, 34 aa, Artificial Sequence
  Description of Artificial Sequence: Synthetic polypeptide
CEEEIACTNPVATEQYGCNVATNNLENGMHENDN

SEQ ID NO: 141564 - protein, 35 aa, Artificial Sequence
  Description of Artificial Sequence: Synthetic polypeptide
TEECIRTTNPVATEQYGCVSCTLNEQSQFLGGELD

SEQ ID NO: 141565 - protein, 36 aa, Artificial Sequence
  Description of Artificial Sequence: Synthetic polypeptide
TEEEIATTNPVAYEQYGISLVSTINEHQPHPGGNNV

SEQ ID NO: 141566 - protein, 36 aa, Artificial Sequence
  Description of Artificial Sequence: Synthetic polypeptide
QEEEIRTTNPVATEQYGSVNTDNMIETTGGGQNQGV

SEQ ID NO: 141567 - protein, 35 aa, Artificial Sequence
  Description of Artificial Sequence: Synthetic polypeptide
DEEEIRTTNPVATEQYGSVNMDYLTTTEVTQNDDY

SEQ ID NO: 141568 - protein, 36 aa, Artificial Sequence
  Description of Artificial Sequence: Synthetic polypeptide
TEEEIATTNPVAYEQYGISVSTINEHQVHPGGNENT

SEQ ID NO: 141569 - protein, 35 aa, Artificial Sequence
  Description of Artificial Sequence: Synthetic polypeptide
TEECIRTTNPVATEQYGCVSCILNEVSQFLGGNYD

SEQ ID NO: 141570 - protein, 31 aa, Artificial Sequence
  Description of Artificial Sequence: Synthetic polypeptide
AEDEIACTNPVAYEQWGEFSIENDQRGGERQ

SEQ ID NO: 141571 - protein, 36 aa, Artificial Sequence
  Description of Artificial Sequence: Synthetic polypeptide
DEEEIRTTNPVATEQYGSVIHTIVAEDEHQQDGVEG

SEQ ID NO: 141572 - protein, 34 aa, Artificial Sequence
  Description of Artificial Sequence: Synthetic polypeptide
TEECIRTTNPVATEQYGCVCSWGNLNAYFNSNQS

SEQ ID NO: 141573 - protein, 31 aa, Artificial Sequence
  Description of Artificial Sequence: Synthetic polypeptide
QEEEIATTNPVATEQYGSAPEVCPQMHEEPK

SEQ ID NO: 141574 - protein, 35 aa, Artificial Sequence
  Description of Artificial Sequence: Synthetic polypeptide
TEEEIATTNPVAYEQYGISVSTITAHQPHPGGNNT

SEQ ID NO: 141575 - protein, 34 aa, Artificial Sequence
  Description of Artificial Sequence: Synthetic polypeptide
DEEEIRTTNPVATEAYGSVSWDDPPVSMVFLNED

SEQ ID NO: 141576 - protein, 35 aa, Artificial Sequence
  Description of Artificial Sequence: Synthetic polypeptide
QEEEIRTTNPVATEQYGSVNTDNMIETTGGGQEEG

SEQ ID NO: 141577 - protein, 33 aa, Artificial Sequence
  Description of Artificial Sequence: Synthetic polypeptide
DESEIRTTNPVAYEAWGVVATELNRGEDQNMGS

SEQ ID NO: 141578 - protein, 36 aa, Artificial Sequence
  Description of Artificial Sequence: Synthetic polypeptide
DEEEIRTTNPVATEQYGSVEPTPTMPAEPGLNVPVM

SEQ ID NO: 141579 - protein, 31 aa, Artificial Sequence
  Description of Artificial Sequence: Synthetic polypeptide
AEDEIACTNPVAYEQWGESYIINDQDRKGER

SEQ ID NO: 141580 - protein, 30 aa, Artificial Sequence
  Description of Artificial Sequence: Synthetic polypeptide
TEEEIATTNPVAYEQYGEVAPCEVHQHEEK

SEQ ID NO: 141581 - protein, 34 aa, Artificial Sequence
  Description of Artificial Sequence: Synthetic polypeptide
DEEEIATTNPVATEQWGSVSGQGPPQEADGQEHH

SEQ ID NO: 141582 - protein, 35 aa, Artificial Sequence
  Description of Artificial Sequence: Synthetic polypeptide
DEEEIRTTNPVATEQYGSVEPWATSGEMVIPNTSV

SEQ ID NO: 141583 - protein, 34 aa, Artificial Sequence
  Description of Artificial Sequence: Synthetic polypeptide
DEDEIATTNPVAYEQYGSVCATNPLADAGMGDAH

SEQ ID NO: 141584 - protein, 35 aa, Artificial Sequence
  Description of Artificial Sequence: Synthetic polypeptide
DEEEIRTTNPVATEQYGSVESQPQQGEAQPQLVTG

SEQ ID NO: 141585 - protein, 36 aa, Artificial Sequence
  Description of Artificial Sequence: Synthetic polypeptide
DECEIATTNPVAYEQYGTVCSYTDGLVEEQRGNGNP

SEQ ID NO: 141586 - protein, 36 aa, Artificial Sequence
  Description of Artificial Sequence: Synthetic polypeptide
DEDEIATTNPVAYEQYGSVCATNPELQEHQDGNQHQ

SEQ ID NO: 141587 - protein, 34 aa, Artificial Sequence
  Description of Artificial Sequence: Synthetic polypeptide
DEEEIRTTNPVATEQYGSVEQWQQGEAQPELFEM

SEQ ID NO: 141588 - protein, 33 aa, Artificial Sequence
  Description of Artificial Sequence: Synthetic polypeptide
DEDEIATTNPVAYEQYGSVCATNNEQDATPTGD

SEQ ID NO: 141589 - protein, 34 aa, Artificial Sequence
  Description of Artificial Sequence: Synthetic polypeptide
DEEEIRTTNPVATEQYGSVNGTTPDFDYMSQEIF

SEQ ID NO: 141590 - protein, 31 aa, Artificial Sequence
  Description of Artificial Sequence: Synthetic polypeptide
ANPEIRTTNPVATEEFGCCWNIVLQRGDNQE

SEQ ID NO: 141591 - protein, 34 aa, Artificial Sequence
  Description of Artificial Sequence: Synthetic polypeptide
YEEEIRCTNPAATEQYGSVVSEGGMNGQGQGGGT

SEQ ID NO: 141592 - protein, 35 aa, Artificial Sequence
  Description of Artificial Sequence: Synthetic polypeptide
DESEIRTTNPVAYDQYGSVSCTGNQSQWTPTKNGV

SEQ ID NO: 141593 - protein, 36 aa, Artificial Sequence
  Description of Artificial Sequence: Synthetic polypeptide
DEEEIRTTNPVATEQYGCVCSSMEDHQENFGSNNQP

SEQ ID NO: 141594 - protein, 35 aa, Artificial Sequence
  Description of Artificial Sequence: Synthetic polypeptide
DEEEIRTTNPVATEQWGCVAGTGELQTAETPNGDE

SEQ ID NO: 141595 - protein, 33 aa, Artificial Sequence
  Description of Artificial Sequence: Synthetic polypeptide
DESEIRTTNPVAYEAWGEVATGDMDQRNGDNGQ

SEQ ID NO: 141596 - protein, 36 aa, Artificial Sequence
  Description of Artificial Sequence: Synthetic polypeptide
DESEIATTNPVATEQYGCVTAATANGLQPADDPGNN

SEQ ID NO: 141597 - protein, 30 aa, Artificial Sequence
  Description of Artificial Sequence: Synthetic polypeptide
CEEEIACTNPVATEQYGCLPMHGQDSEGED

SEQ ID NO: 141598 - protein, 30 aa, Artificial Sequence
  Description of Artificial Sequence: Synthetic polypeptide
QEEEIATTNPVATEQYGSAPEVCEHEEEDK

SEQ ID NO: 141599 - protein, 37 aa, Artificial Sequence
  Description of Artificial Sequence: Synthetic polypeptide
DEEEIRTTNPVATEQYGSVIHPTYNQETELSDEQNVT

SEQ ID NO: 141600 - protein, 35 aa, Artificial Sequence
  Description of Artificial Sequence: Synthetic polypeptide
DESEIATTNPVATEQYGCVCTIEGNQDQRDQGQSG

SEQ ID NO: 141601 - protein, 32 aa, Artificial Sequence
  Description of Artificial Sequence: Synthetic polypeptide
DEDEIATTNPVAYEQYGSVCAPLQAHIDLTAM

SEQ ID NO: 141602 - protein, 34 aa, Artificial Sequence
  Description of Artificial Sequence: Synthetic polypeptide
DESEIATTNPVATEQYGCVAATAGLTATMNGNDV

SEQ ID NO: 141603 - protein, 36 aa, Artificial Sequence
  Description of Artificial Sequence: Synthetic polypeptide
TEEEIATTNPVAYEQWGTSVSTANELSQDQGGNYMN

SEQ ID NO: 141604 - protein, 36 aa, Artificial Sequence
  Description of Artificial Sequence: Synthetic polypeptide
DEEEIRTTNPVATEQYGSVIGPTVEIIERIGDEPQG

SEQ ID NO: 141605 - protein, 32 aa, Artificial Sequence
  Description of Artificial Sequence: Synthetic polypeptide
DEEEIATTNPVATECWGEVSEIVCPQREEEEK

SEQ ID NO: 141606 - protein, 30 aa, Artificial Sequence
  Description of Artificial Sequence: Synthetic polypeptide
TEEEIATTNPVAYEQYGEAPEVEQQHEGEK

SEQ ID NO: 141607 - protein, 33 aa, Artificial Sequence
  Description of Artificial Sequence: Synthetic polypeptide
YEEEIRCTNPAATEQYGSVVSIGGQMGGQGGGT

SEQ ID NO: 141608 - protein, 34 aa, Artificial Sequence
  Description of Artificial Sequence: Synthetic polypeptide
DEEEIRTTNPVATEFYGVVVDINMTMEEDGENGS

SEQ ID NO: 141609 - protein, 37 aa, Artificial Sequence
  Description of Artificial Sequence: Synthetic polypeptide
DEEEIRTTNPVATEAYGVVSTVNNQNQQGNGNNQEDE

SEQ ID NO: 141610 - protein, 37 aa, Artificial Sequence
  Description of Artificial Sequence: Synthetic polypeptide
DEEEIRTTNPVATEQYGSVNNNELELDEVLGNKNPQD

SEQ ID NO: 141611 - protein, 35 aa, Artificial Sequence
  Description of Artificial Sequence: Synthetic polypeptide
DEEEIRTTNPVATEQYGSVDNPRVLNNNNFVAEMI

SEQ ID NO: 141612 - protein, 30 aa, Artificial Sequence
  Description of Artificial Sequence: Synthetic polypeptide
YENEIRTTNPVATEQWGVVSEIEMNAAEDA

SEQ ID NO: 141613 - protein, 34 aa, Artificial Sequence
  Description of Artificial Sequence: Synthetic polypeptide
DEEEIRTTNPVATEQYGSVDNPRVLDNNFVLEVI

SEQ ID NO: 141614 - protein, 35 aa, Artificial Sequence
  Description of Artificial Sequence: Synthetic polypeptide
DEEEIRTTNPVATEQYGCVCSTSEEHQFFQSEFQE

SEQ ID NO: 141615 - protein, 32 aa, Artificial Sequence
  Description of Artificial Sequence: Synthetic polypeptide
SEQEIATTNPVATVPYGSVSATDLEDYEGEDL

SEQ ID NO: 141616 - protein, 31 aa, Artificial Sequence
  Description of Artificial Sequence: Synthetic polypeptide
DESEVASTNPVATEGYGNTANNTWQSRVGQR

SEQ ID NO: 141617 - protein, 30 aa, Artificial Sequence
  Description of Artificial Sequence: Synthetic polypeptide
QEEEIATTNPVATEQYGEAPVECGCFHEEK

SEQ ID NO: 141618 - protein, 36 aa, Artificial Sequence
  Description of Artificial Sequence: Synthetic polypeptide
DEEEIRTTNPVATEQYGCVCSTSGEDNQENFNSDQA

SEQ ID NO: 141619 - protein, 34 aa, Artificial Sequence
  Description of Artificial Sequence: Synthetic polypeptide
DEEEIATTNPVATEQYGCVSGGNGNEAGGEGMAS

SEQ ID NO: 141620 - protein, 32 aa, Artificial Sequence
  Description of Artificial Sequence: Synthetic polypeptide
DESEVASTNPVATEGYGNVAANPTIQMRVGQR

SEQ ID NO: 141621 - protein, 33 aa, Artificial Sequence
  Description of Artificial Sequence: Synthetic polypeptide
DEAVIRTTNPVATEQYGQCVCETEPQYFGSDQA

SEQ ID NO: 141622 - protein, 31 aa, Artificial Sequence
  Description of Artificial Sequence: Synthetic polypeptide
YENEIRTTNPVSTEPYGTISMEDIQQQQGNH

SEQ ID NO: 141623 - protein, 36 aa, Artificial Sequence
  Description of Artificial Sequence: Synthetic polypeptide
DEEEIRTTNPVATEQYGCVCSTSGEHNAENFNSDQS

SEQ ID NO: 141624 - protein, 35 aa, Artificial Sequence
  Description of Artificial Sequence: Synthetic polypeptide
DEEEIRTTNPVATEQYGSVDNPRIVLNSNFQAERI

SEQ ID NO: 141625 - protein, 35 aa, Artificial Sequence
  Description of Artificial Sequence: Synthetic polypeptide
DEDEIRTTNPVATEAWGSVSTVVNNNNQNDEDENG

SEQ ID NO: 141626 - protein, 34 aa, Artificial Sequence
  Description of Artificial Sequence: Synthetic polypeptide
DEEEIATTNPVATEQYGCSAANNPAQPSGAEPGH

SEQ ID NO: 141627 - protein, 32 aa, Artificial Sequence
  Description of Artificial Sequence: Synthetic polypeptide
YENEIRTTNPVSTEPYGTISMEDLQQQQNGNH

SEQ ID NO: 141628 - protein, 35 aa, Artificial Sequence
  Description of Artificial Sequence: Synthetic polypeptide
DEDEIRTTNPVATEAWGSVSTVVNNNQQGTEDEEG

SEQ ID NO: 141629 - protein, 32 aa, Artificial Sequence
  Description of Artificial Sequence: Synthetic polypeptide
YENEIRTTNPVSTEPYGVISDEDLQQQSNGNH

SEQ ID NO: 141630 - protein, 32 aa, Artificial Sequence
  Description of Artificial Sequence: Synthetic polypeptide
YENEIRTTNPVSTEPYGTISMEDLQQQSNGNH

SEQ ID NO: 141631 - protein, 36 aa, Artificial Sequence
  Description of Artificial Sequence: Synthetic polypeptide
DEEEIATTNPVATEQYGCVSATWPGGPDMQNGGNPV

SEQ ID NO: 141632 - protein, 34 aa, Artificial Sequence
  Description of Artificial Sequence: Synthetic polypeptide
DEEEIRTTNPVATEQYGSVNNYSELDEVYDTEVG

SEQ ID NO: 141633 - protein, 37 aa, Artificial Sequence
  Description of Artificial Sequence: Synthetic polypeptide
DEEEIRTTNPVATEQYGCVCSTSMAHNAERSGSDPVS

SEQ ID NO: 141634 - protein, 35 aa, Artificial Sequence
  Description of Artificial Sequence: Synthetic polypeptide
DEEEIRTTNPVATEQYGSVDNPRVNQTNNFVNEVI

SEQ ID NO: 141635 - protein, 33 aa, Artificial Sequence
  Description of Artificial Sequence: Synthetic polypeptide
DESEVASTNPVATEGYGNVSAATAGQMRVGQPR

SEQ ID NO: 141636 - protein, 33 aa, Artificial Sequence
  Description of Artificial Sequence: Synthetic polypeptide
DESEVASTNPVATEGYGNVSAANTIQSRVGQPR

SEQ ID NO: 141637 - protein, 33 aa, Artificial Sequence
  Description of Artificial Sequence: Synthetic polypeptide
DESEVASTNPVATEGYGNVSAANTGQMRVGQPR

SEQ ID NO: 141638 - protein, 33 aa, Artificial Sequence
  Description of Artificial Sequence: Synthetic polypeptide
DESEVASTNPVATEGYGNVSAANAGQMRVGQPR

SEQ ID NO: 141639 - protein, 34 aa, Artificial Sequence
  Description of Artificial Sequence: Synthetic polypeptide
SEQEIATTNPVATEQWGSVSATGDLEDHQGGEDH

SEQ ID NO: 141640 - protein, 33 aa, Artificial Sequence
  Description of Artificial Sequence: Synthetic polypeptide
SEQEIATTNPVATEQYGFVSATDLEDHEGEDLQ

SEQ ID NO: 141641 - protein, 35 aa, Artificial Sequence
  Description of Artificial Sequence: Synthetic polypeptide
DEEEIATTNPVATEQYGCTACATNPLQAAPPDNHH

SEQ ID NO: 141642 - protein, 36 aa, Artificial Sequence
  Description of Artificial Sequence: Synthetic polypeptide
DEEEIRTTNPVATEQYGCVCSTSGEHQEFFGSDTQG

SEQ ID NO: 141643 - protein, 35 aa, Artificial Sequence
  Description of Artificial Sequence: Synthetic polypeptide
DEEEIRTTNPVATEQYGSVDNPSIVLNNNTVAEDD

SEQ ID NO: 141644 - protein, 36 aa, Artificial Sequence
  Description of Artificial Sequence: Synthetic polypeptide
DEEEIATTNPVATEQYGCNVAGNGGLQDNTEGNNQD

SEQ ID NO: 141645 - protein, 34 aa, Artificial Sequence
  Description of Artificial Sequence: Synthetic polypeptide
DEEEIRTTNPMAYEGWGSCSCTNELSGRGGDQVS

SEQ ID NO: 141646 - protein, 37 aa, Artificial Sequence
  Description of Artificial Sequence: Synthetic polypeptide
DEEEIRTTNPVATEQYGCVCSTPEDHEQENFGSDNQY

SEQ ID NO: 141647 - protein, 29 aa, Artificial Sequence
  Description of Artificial Sequence: Synthetic peptide
QEAEIATTNPVAYECWGVVSECLQHESES

SEQ ID NO: 141648 - protein, 32 aa, Artificial Sequence
  Description of Artificial Sequence: Synthetic polypeptide
SEQEIRTTNPVATEQYGCYAPCYLGPEGQFVR

SEQ ID NO: 141649 - protein, 35 aa, Artificial Sequence
  Description of Artificial Sequence: Synthetic polypeptide
SEQEIRTTNPVATEQYGSVNSTNPDDEGSGQEEIP

SEQ ID NO: 141650 - protein, 34 aa, Artificial Sequence
  Description of Artificial Sequence: Synthetic polypeptide
DEEEIRTTNPSATEQYGCVCCTEESSNNGGNNED

SEQ ID NO: 141651 - protein, 30 aa, Artificial Sequence
  Description of Artificial Sequence: Synthetic polypeptide
YENEIATVNPVCTEPYGVISMDLQQQNGNQ

SEQ ID NO: 141652 - protein, 35 aa, Artificial Sequence
  Description of Artificial Sequence: Synthetic polypeptide
DEDEIRTTNPVATEAWGSVSTVVNNNNGNLEGENG

SEQ ID NO: 141653 - protein, 34 aa, Artificial Sequence
  Description of Artificial Sequence: Synthetic polypeptide
DESETIRTTNPVATECWGSVGCINEPQAREVENG

SEQ ID NO: 141654 - protein, 35 aa, Artificial Sequence
  Description of Artificial Sequence: Synthetic polypeptide
SEQEIRTTNPVAYEQWGQVVSSCTNMQSADPGNRM

SEQ ID NO: 141655 - protein, 30 aa, Artificial Sequence
  Description of Artificial Sequence: Synthetic polypeptide
YENEIATVNPVATEQYGVVSDIEMNSAGDA

SEQ ID NO: 141656 - protein, 34 aa, Artificial Sequence
  Description of Artificial Sequence: Synthetic polypeptide
DEAVIRTTNPVATEQYGSVYDLKLEFPNGSQNDS

SEQ ID NO: 141657 - protein, 32 aa, Artificial Sequence
  Description of Artificial Sequence: Synthetic polypeptide
QEEEIATTNPVATEQYGEAPTEVGPNREMNPK

SEQ ID NO: 141658 - protein, 35 aa, Artificial Sequence
  Description of Artificial Sequence: Synthetic polypeptide
DEDEIRTTNPVATEAWGSVSTVVNNNNADEGENGD

SEQ ID NO: 141659 - protein, 30 aa, Artificial Sequence
  Description of Artificial Sequence: Synthetic polypeptide
DEEEIATTNPVATEQYGAAPEEVCAEHEEK

SEQ ID NO: 141660 - protein, 34 aa, Artificial Sequence
  Description of Artificial Sequence: Synthetic polypeptide
DEEEIATTNPVATAQWGSVSATGAGGQPMGGSFD

SEQ ID NO: 141661 - protein, 35 aa, Artificial Sequence
  Description of Artificial Sequence: Synthetic polypeptide
DESEGIRTTNPVATECWGSVSMCINEPQDVEGENG

SEQ ID NO: 141662 - protein, 31 aa, Artificial Sequence
  Description of Artificial Sequence: Synthetic polypeptide
YENEIATVNPVSTEPYGTVSMEDLQQSNGNH

SEQ ID NO: 141663 - protein, 34 aa, Artificial Sequence
  Description of Artificial Sequence: Synthetic polypeptide
DEEEIATTNPVATEQYGCNAPTIEPLQAPMENNQ

SEQ ID NO: 141664 - protein, 31 aa, Artificial Sequence
  Description of Artificial Sequence: Synthetic polypeptide
DESEVASTNPVATECWGNVAANTIQDREGQR

SEQ ID NO: 141665 - protein, 30 aa, Artificial Sequence
  Description of Artificial Sequence: Synthetic polypeptide
YENEIRTTNPVATEQWGDVSEIEMNAAEDA

SEQ ID NO: 141666 - protein, 30 aa, Artificial Sequence
  Description of Artificial Sequence: Synthetic polypeptide
YENEIRTTNPVATEQWGDVSEIEANAAEDA

SEQ ID NO: 141667 - protein, 34 aa, Artificial Sequence
  Description of Artificial Sequence: Synthetic polypeptide
SEQEIRGTNPVATECYGSVVDTNLDQDGGGQDQG

SEQ ID NO: 141668 - protein, 30 aa, Artificial Sequence
  Description of Artificial Sequence: Synthetic polypeptide
DESEVAPTNPVSTEGYGNVAANTIQSVGQR

SEQ ID NO: 141669 - protein, 36 aa, Artificial Sequence
  Description of Artificial Sequence: Synthetic polypeptide
ADEEIRTTNPVATEQYGSVSSTTPAGPNMRNGMNPV

SEQ ID NO: 141670 - protein, 33 aa, Artificial Sequence
  Description of Artificial Sequence: Synthetic polypeptide
DESETRTTNPVATECWGSVSCINEPHDREGEWG

SEQ ID NO: 141671 - protein, 31 aa, Artificial Sequence
  Description of Artificial Sequence: Synthetic polypeptide
DESEVAPTNPCSTEGYGIVSACNLQSSVGQR

SEQ ID NO: 141672 - protein, 36 aa, Artificial Sequence
  Description of Artificial Sequence: Synthetic polypeptide
DEEEIRTTNPMAYEQYGSVIAKDNMLPQRFEYNIAD

SEQ ID NO: 141673 - protein, 31 aa, Artificial Sequence
  Description of Artificial Sequence: Synthetic polypeptide
YENEIRSTNPVSTEPYGVISDEDLQQSNGNH

SEQ ID NO: 141674 - protein, 34 aa, Artificial Sequence
  Description of Artificial Sequence: Synthetic polypeptide
DEDEIRTTNPVATEAWGSVSTVVNNNNGTEGEQG

SEQ ID NO: 141675 - protein, 34 aa, Artificial Sequence
  Description of Artificial Sequence: Synthetic polypeptide
DEAVIRTTNPVATEQYGSVSSLFLEFPNYSQNMD

SEQ ID NO: 141676 - protein, 37 aa, Artificial Sequence
  Description of Artificial Sequence: Synthetic polypeptide
AEEEIRTTNPVATEQYGSVSTDNNNQLGSEEGTTEDE

SEQ ID NO: 141677 - protein, 34 aa, Artificial Sequence
  Description of Artificial Sequence: Synthetic polypeptide
DEAVIRTTNPVATEQYGSVSSYSLEFPNYSQNTD

SEQ ID NO: 141678 - protein, 31 aa, Artificial Sequence
  Description of Artificial Sequence: Synthetic polypeptide
DESEVACTNPVSTEGYGNVAAETIQSRVGNR

SEQ ID NO: 141679 - protein, 34 aa, Artificial Sequence
  Description of Artificial Sequence: Synthetic polypeptide
DEAVIRTTNPVATEQYGSVYSLLEFPNSSQNTRQ

SEQ ID NO: 141680 - protein, 36 aa, Artificial Sequence
  Description of Artificial Sequence: Synthetic polypeptide
DEEEIRTTNPVATEQYGSVNPNGPLHEMTEHVNQNE

SEQ ID NO: 141681 - protein, 36 aa, Artificial Sequence
  Description of Artificial Sequence: Synthetic polypeptide
DEDEIRTTNPVATEAWGSVSTVVNNQQGTNAEQYGN

SEQ ID NO: 141682 - protein, 35 aa, Artificial Sequence
  Description of Artificial Sequence: Synthetic polypeptide
DEEEIRTTNPVATEQYGCVCSTTGEHNANFNSDQS

SEQ ID NO: 141683 - protein, 36 aa, Artificial Sequence
  Description of Artificial Sequence: Synthetic polypeptide
DEEEIRTTNPVATEQYGSVISLLLGLGEHEQVEADD

SEQ ID NO: 141684 - protein, 33 aa, Artificial Sequence
  Description of Artificial Sequence: Synthetic polypeptide
DEAVIRTTNPVATEQYGCVINAANMQTFIQNAP

SEQ ID NO: 141685 - protein, 35 aa, Artificial Sequence
  Description of Artificial Sequence: Synthetic polypeptide
SENEIRTTNPVATEQYGCVITTDNDIQRDNSSQQH

SEQ ID NO: 141686 - protein, 37 aa, Artificial Sequence
  Description of Artificial Sequence: Synthetic polypeptide
DEEEIRTTNPVATEQYGCVCSTTGEHNQENFGSDNQS

SEQ ID NO: 141687 - protein, 30 aa, Artificial Sequence
  Description of Artificial Sequence: Synthetic polypeptide
SENEIRTTNPVATEQWGDVSEIRMNAAEDA

SEQ ID NO: 141688 - protein, 30 aa, Artificial Sequence
  Description of Artificial Sequence: Synthetic polypeptide
DESEVASTNPVSTECYGNVAECIQSRVGER

SEQ ID NO: 141689 - protein, 29 aa, Artificial Sequence
  Description of Artificial Sequence: Synthetic peptide
QEEEIATTNPVATEQYGEIAPEVCCHEEK

SEQ ID NO: 141690 - protein, 30 aa, Artificial Sequence
  Description of Artificial Sequence: Synthetic polypeptide
SENEIRTTNPVATEQWGDVSEIFMNAAEDA

SEQ ID NO: 141691 - protein, 36 aa, Artificial Sequence
  Description of Artificial Sequence: Synthetic polypeptide
DEEEIRTTNPVATEQYGCVCSTTGEHNQESFGSEQG

SEQ ID NO: 141692 - protein, 32 aa, Artificial Sequence
  Description of Artificial Sequence: Synthetic polypeptide
DESEVASTNPVSTECYGNVSACNIQSREGEQR

SEQ ID NO: 141693 - protein, 36 aa, Artificial Sequence
  Description of Artificial Sequence: Synthetic polypeptide
DEEEIRTTNPVATEQYGSVNPWPNSQLVVNAGVFQE

SEQ ID NO: 141694 - protein, 30 aa, Artificial Sequence
  Description of Artificial Sequence: Synthetic polypeptide
SENEIRTTNPVATEQWGDVSEIEMNAAEDA

SEQ ID NO: 141695 - protein, 31 aa, Artificial Sequence
  Description of Artificial Sequence: Synthetic polypeptide
QEEEIATTNPVATEQYGEASATVCEHEEEDK

SEQ ID NO: 141696 - protein, 36 aa, Artificial Sequence
  Description of Artificial Sequence: Synthetic polypeptide
DEEEIRTTNPVATEQYGCVCSTTGEHNQEYFNSEQA

SEQ ID NO: 141697 - protein, 34 aa, Artificial Sequence
  Description of Artificial Sequence: Synthetic polypeptide
DESEVASTNPVSTECYGSVSANINEPQDREGENR

SEQ ID NO: 141698 - protein, 33 aa, Artificial Sequence
  Description of Artificial Sequence: Synthetic polypeptide
DESEVASTNPVSTECYGSVSANTEPQDREGEQR

SEQ ID NO: 141699 - protein, 31 aa, Artificial Sequence
  Description of Artificial Sequence: Synthetic polypeptide
DESEVASTNPVSTEGYGNVAANIIQSRVGQR

SEQ ID NO: 141700 - protein, 31 aa, Artificial Sequence
  Description of Artificial Sequence: Synthetic polypeptide
DESEVASTNPVSTEGYGNVAANDTIQRVGQR

SEQ ID NO: 141701 - protein, 31 aa, Artificial Sequence
  Description of Artificial Sequence: Synthetic polypeptide
DESEVASTNPVSTEGYGNVAANDIQSRVGQR

SEQ ID NO: 141702 - protein, 34 aa, Artificial Sequence
  Description of Artificial Sequence: Synthetic polypeptide
DEAVIRTTNPVATEQYGCVCETTNPQEYFGSDQS

SEQ ID NO: 141703 - protein, 29 aa, Artificial Sequence
  Description of Artificial Sequence: Synthetic peptide
QEAEIACTNPVGTEGWGVSASTLQHGDGM

SEQ ID NO: 141704 - protein, 31 aa, Artificial Sequence
  Description of Artificial Sequence: Synthetic polypeptide
DESEVASTNPVSTEGYGNVAANDIQSRVGER

SEQ ID NO: 141705 - protein, 34 aa, Artificial Sequence
  Description of Artificial Sequence: Synthetic polypeptide
SENEIRTTNPVATEQYGCVTTLNDIARDNSNQQS

SEQ ID NO: 141706 - protein, 31 aa, Artificial Sequence
  Description of Artificial Sequence: Synthetic polypeptide
DESEVASTNPVSTEGYGNVAANDGIQRVGQR

SEQ ID NO: 141707 - protein, 31 aa, Artificial Sequence
  Description of Artificial Sequence: Synthetic polypeptide
DESEVASTNPVSTEGYGNISANTIQSRVGQR

SEQ ID NO: 141708 - protein, 31 aa, Artificial Sequence
  Description of Artificial Sequence: Synthetic polypeptide
DESEVASTNPVSTEGYGEVAANTIQSRVGQR

SEQ ID NO: 141709 - protein, 34 aa, Artificial Sequence
  Description of Artificial Sequence: Synthetic polypeptide
DEEEIATTNPVATEQYGCVAAGAQPTEAEGPNGE

SEQ ID NO: 141710 - protein, 31 aa, Artificial Sequence
  Description of Artificial Sequence: Synthetic polypeptide
DESEVASTNPVSTEGYGEVAANTCQSRVGQR

SEQ ID NO: 141711 - protein, 33 aa, Artificial Sequence
  Description of Artificial Sequence: Synthetic polypeptide
DESEVASTNPVSTECYGSVSANTIPQDRVGEQR

SEQ ID NO: 141712 - protein, 32 aa, Artificial Sequence
  Description of Artificial Sequence: Synthetic polypeptide
YENVVEATNPVATEQYGEVASELNLQRVGGGG

SEQ ID NO: 141713 - protein, 32 aa, Artificial Sequence
  Description of Artificial Sequence: Synthetic polypeptide
YENVVEATNPVATEQYGEVASELNLQRVGGQG

SEQ ID NO: 141714 - protein, 35 aa, Artificial Sequence
  Description of Artificial Sequence: Synthetic polypeptide
DEEEIRTTNPVATEQYGCVCSTTGEHEEYFGSDQA

SEQ ID NO: 141715 - protein, 32 aa, Artificial Sequence
  Description of Artificial Sequence: Synthetic polypeptide
YENVVEATNPVATEQYGEVASELNLDQRGQGN

SEQ ID NO: 141716 - protein, 28 aa, Artificial Sequence
  Description of Artificial Sequence: Synthetic peptide
QEGEIAPTNPCSSEPYGIISCNIQSGTR

SEQ ID NO: 141717 - protein, 35 aa, Artificial Sequence
  Description of Artificial Sequence: Synthetic polypeptide
SENEIRTTNPVATEQYGSVSVDVVSLEVRYTDNIH

SEQ ID NO: 141718 - protein, 34 aa, Artificial Sequence
  Description of Artificial Sequence: Synthetic polypeptide
DEAVIRTTNPVATEQYGCVINATNDQTFISNNAP

SEQ ID NO: 141719 - protein, 34 aa, Artificial Sequence
  Description of Artificial Sequence: Synthetic polypeptide
DEAVIRTTNPVATEQYGCVINATNMQETFIDNAP

SEQ ID NO: 141720 - protein, 30 aa, Artificial Sequence
  Description of Artificial Sequence: Synthetic polypeptide
QEEEIATTNPVATEQYGEIAPIVCQHEEEK

SEQ ID NO: 141721 - protein, 29 aa, Artificial Sequence
  Description of Artificial Sequence: Synthetic peptide
QEAEIASTNPVGTEGWGVSASTLQQHGDI

SEQ ID NO: 141722 - protein, 33 aa, Artificial Sequence
  Description of Artificial Sequence: Synthetic polypeptide
DESEVASTNPVATEQYGTVCSANDGIQSFVGND

SEQ ID NO: 141723 - protein, 30 aa, Artificial Sequence
  Description of Artificial Sequence: Synthetic polypeptide
DESEVASTNPVCTEGYGVVSDNIQSSVGQQ

SEQ ID NO: 141724 - protein, 32 aa, Artificial Sequence
  Description of Artificial Sequence: Synthetic polypeptide
YENEIRTTNPVSTEPYGVISMEDLQQQSNGNH

SEQ ID NO: 141725 - protein, 33 aa, Artificial Sequence
  Description of Artificial Sequence: Synthetic polypeptide
SENEIRTTNPVATEQYGVVSTWPAEYETNDEQQ

SEQ ID NO: 141726 - protein, 31 aa, Artificial Sequence
  Description of Artificial Sequence: Synthetic polypeptide
QEEEIATTNPVATEQYGEIPCEVHSQHVGEK

SEQ ID NO: 141727 - protein, 34 aa, Artificial Sequence
  Description of Artificial Sequence: Synthetic polypeptide
DEAVIRTTNPVATEQYGCVINATNPQNTFISNAP

SEQ ID NO: 141728 - protein, 31 aa, Artificial Sequence
  Description of Artificial Sequence: Synthetic polypeptide
SENEIRTTNPVSTEPYGTISEEDIQQQNGNH

SEQ ID NO: 141729 - protein, 32 aa, Artificial Sequence
  Description of Artificial Sequence: Synthetic polypeptide
SENEIRTTNPVSTEPYGTISMTDIQQQQNGNH

SEQ ID NO: 141730 - protein, 36 aa, Artificial Sequence
  Description of Artificial Sequence: Synthetic polypeptide
DEEEIRTTNPVATEQYGCVCSTTEHNQENFNSDTQY

SEQ ID NO: 141731 - protein, 28 aa, Artificial Sequence
  Description of Artificial Sequence: Synthetic peptide
QEAEIATTNPVAIEQYGEAPEVCQHEEK

SEQ ID NO: 141732 - protein, 32 aa, Artificial Sequence
  Description of Artificial Sequence: Synthetic polypeptide
DESEVASTNPVATEGYGNVWAANTIQSRVGQR

SEQ ID NO: 141733 - protein, 30 aa, Artificial Sequence
  Description of Artificial Sequence: Synthetic polypeptide
QEAEIAPTNPCSYEQWGIVSCNLQSAGDTR

SEQ ID NO: 141734 - protein, 36 aa, Artificial Sequence
  Description of Artificial Sequence: Synthetic polypeptide
SENEIRTTNPVATEQYGSVSFTPDMHNSRQEVSNED

SEQ ID NO: 141735 - protein, 35 aa, Artificial Sequence
  Description of Artificial Sequence: Synthetic polypeptide
DEEEIRTTNPVATEQYGSVDNPLITLNNNFVAEDI

SEQ ID NO: 141736 - protein, 35 aa, Artificial Sequence
  Description of Artificial Sequence: Synthetic polypeptide
DEEEIRTTNPVATEQYGSVDNPLPVLNNNFVLEPI

SEQ ID NO: 141737 - protein, 30 aa, Artificial Sequence
  Description of Artificial Sequence: Synthetic polypeptide
DESEVASTNPVSSEGYGNVAANTLQSVGQR

SEQ ID NO: 141738 - protein, 36 aa, Artificial Sequence
  Description of Artificial Sequence: Synthetic polypeptide
DEEEIRTTNPVATEQYGCVCSTTGEDNQNFNSEFQA

SEQ ID NO: 141739 - protein, 36 aa, Artificial Sequence
  Description of Artificial Sequence: Synthetic polypeptide
DEEEIRTTNPVATEQYGCVCSTTGEDHQNFGSQFQG

SEQ ID NO: 141740 - protein, 29 aa, Artificial Sequence
  Description of Artificial Sequence: Synthetic peptide
DESEVASTNPVGTEGYGVMAANTIQHGQR

SEQ ID NO: 141741 - protein, 34 aa, Artificial Sequence
  Description of Artificial Sequence: Synthetic polypeptide
SENEIRTTNPVATEQYGSVSPMDMTQMETMQISN

SEQ ID NO: 141742 - protein, 36 aa, Artificial Sequence
  Description of Artificial Sequence: Synthetic polypeptide
DEDEIRTTNPVATEAWGSVSTVVNNQQGTNNEQQGT

SEQ ID NO: 141743 - protein, 31 aa, Artificial Sequence
  Description of Artificial Sequence: Synthetic polypeptide
DESEVASTNPVGTEGYGNVAANTIQSRVGQR

SEQ ID NO: 141744 - protein, 36 aa, Artificial Sequence
  Description of Artificial Sequence: Synthetic polypeptide
DEEEIRTTNPVATEQYGSVDNPRIVINLNNFVAENE

SEQ ID NO: 141745 - protein, 35 aa, Artificial Sequence
  Description of Artificial Sequence: Synthetic polypeptide
DEEEIRTTNPVATEQYGCVCSTTGEDEENFGSDQP

SEQ ID NO: 141746 - protein, 37 aa, Artificial Sequence
  Description of Artificial Sequence: Synthetic polypeptide
DEEEIRTTNPVATEQYGSVNPTTMAMGPNMRNGMNPV

SEQ ID NO: 141747 - protein, 32 aa, Artificial Sequence
  Description of Artificial Sequence: Synthetic polypeptide
YENEIRTVNPVSTEPYGTVSMEDLQQQSNGNH

SEQ ID NO: 141748 - protein, 36 aa, Artificial Sequence
  Description of Artificial Sequence: Synthetic polypeptide
SENEIRTTNPVATEQYGSVSENTYDNQMESTQDNRN

SEQ ID NO: 141749 - protein, 36 aa, Artificial Sequence
  Description of Artificial Sequence: Synthetic polypeptide
DEEEIRTTNPVATEQYGCVCSTTGEDHNQNFGSDQS

SEQ ID NO: 141750 - protein, 34 aa, Artificial Sequence
  Description of Artificial Sequence: Synthetic polypeptide
DEEEIATTNPVATEQWGVVSAIPPLEAMGGNADE

SEQ ID NO: 141751 - protein, 35 aa, Artificial Sequence
  Description of Artificial Sequence: Synthetic polypeptide
DEAVIRTTNPVATEQYGSVYSLLLEWPNGSQNTSG

SEQ ID NO: 141752 - protein, 30 aa, Artificial Sequence
  Description of Artificial Sequence: Synthetic polypeptide
YENEIASVNPVSTEPYGTVSMEDLQQSGNH

SEQ ID NO: 141753 - protein, 36 aa, Artificial Sequence
  Description of Artificial Sequence: Synthetic polypeptide
DEEEIRTTNPVATEKYGSVSSTTPAGPNMRNGMAPV

SEQ ID NO: 141754 - protein, 35 aa, Artificial Sequence
  Description of Artificial Sequence: Synthetic polypeptide
DEEEIRTTNPVATEGYGMVNNDEFNDLEFEMGNGA

SEQ ID NO: 141755 - protein, 35 aa, Artificial Sequence
  Description of Artificial Sequence: Synthetic polypeptide
SESEIRCTNPVAYEQYGISVVPCTNELQPHGGNLN

SEQ ID NO: 141756 - protein, 34 aa, Artificial Sequence
  Description of Artificial Sequence: Synthetic polypeptide
SESEIRCTNPVAYEAYGSVPCTNELAQHHGGNQN

SEQ ID NO: 141757 - protein, 31 aa, Artificial Sequence
  Description of Artificial Sequence: Synthetic polypeptide
DESEIASTNPVATEQYGDVSAETIMNAAEQA

SEQ ID NO: 141758 - protein, 35 aa, Artificial Sequence
  Description of Artificial Sequence: Synthetic polypeptide
SESEIRCTNPVATEQYGSVYCTWNDQHHQGQNEEE

SEQ ID NO: 141759 - protein, 34 aa, Artificial Sequence
  Description of Artificial Sequence: Synthetic polypeptide
SESEIRCTNPVATEQYGSVYCTWNDQHHQGKSEQ

SEQ ID NO: 141760 - protein, 31 aa, Artificial Sequence
  Description of Artificial Sequence: Synthetic polypeptide
DESEIASTNPVATEQYGDVAAETIQNAAEQR

SEQ ID NO: 141761 - protein, 36 aa, Artificial Sequence
  Description of Artificial Sequence: Synthetic polypeptide
DEEEIRTTNPVAFEQYGSVVSTGGDTGQEEEGEGGA

SEQ ID NO: 141762 - protein, 31 aa, Artificial Sequence
  Description of Artificial Sequence: Synthetic polypeptide
DESEIASTNPVATEQYGDVAAEIIQNAAEQR

SEQ ID NO: 141763 - protein, 35 aa, Artificial Sequence
  Description of Artificial Sequence: Synthetic polypeptide
DEEEIATTNPVATEAWGSVCSNDNHDQPGQGGNTH

SEQ ID NO: 141764 - protein, 36 aa, Artificial Sequence
  Description of Artificial Sequence: Synthetic polypeptide
DEEEIRTTNPVAFEQYGSVVSTGGDLGQEEQDEQGF

SEQ ID NO: 141765 - protein, 35 aa, Artificial Sequence
  Description of Artificial Sequence: Synthetic polypeptide
DESEIVTTNPVATEQYGTVVSATDGDDQEGEGNGQ

SEQ ID NO: 141766 - protein, 36 aa, Artificial Sequence
  Description of Artificial Sequence: Synthetic polypeptide
DEEEIRTTNPVATEQYGSVISEEVGWPQDPVINENE

SEQ ID NO: 141767 - protein, 37 aa, Artificial Sequence
  Description of Artificial Sequence: Synthetic polypeptide
DEEEIRTTNPVAFEQYGSVVSSTGGDLGQEEQGEGGI

SEQ ID NO: 141768 - protein, 36 aa, Artificial Sequence
  Description of Artificial Sequence: Synthetic polypeptide
DEEEIRTTNPVATEGYGMVNNQDTNELDENNGGNGQ

SEQ ID NO: 141769 - protein, 35 aa, Artificial Sequence
  Description of Artificial Sequence: Synthetic polypeptide
DEEEIRTTNPVATEGYGMVNNQDTNMENNGGENGQ

SEQ ID NO: 141770 - protein, 37 aa, Artificial Sequence
  Description of Artificial Sequence: Synthetic polypeptide
DEEEIRTTNPVATEGYGMVNNSGMGNNLQENNGGNLD

SEQ ID NO: 141771 - protein, 34 aa, Artificial Sequence
  Description of Artificial Sequence: Synthetic polypeptide
DESEIVTTNPVATEQYGVVVSATDGEGEEGEGND

SEQ ID NO: 141772 - protein, 37 aa, Artificial Sequence
  Description of Artificial Sequence: Synthetic polypeptide
DEEEIRTTNPVAFEQYGSVTVSTGGDLGQEEQGEGGS

SEQ ID NO: 141773 - protein, 37 aa, Artificial Sequence
  Description of Artificial Sequence: Synthetic polypeptide
DEEEIRTTNPVAFEQYGSVVANGLNDLGQQIGQRFDQ

SEQ ID NO: 141774 - protein, 37 aa, Artificial Sequence
  Description of Artificial Sequence: Synthetic polypeptide
DEEEIATTNPVATEQYGSVCAMNNGVLNQTAGPMNSD

SEQ ID NO: 141775 - protein, 31 aa, Artificial Sequence
  Description of Artificial Sequence: Synthetic polypeptide
DESEIASTNPVATEQWGDVSAEIIQNAAEQR

SEQ ID NO: 141776 - protein, 32 aa, Artificial Sequence
  Description of Artificial Sequence: Synthetic polypeptide
DESEIASTNPVATEQYGNVSANDIESHEGEDL

SEQ ID NO: 141777 - protein, 36 aa, Artificial Sequence
  Description of Artificial Sequence: Synthetic polypeptide
DEEEIRTTNPVAFEQYGSVVDNGENELGQTGQTGEQ

SEQ ID NO: 141778 - protein, 36 aa, Artificial Sequence
  Description of Artificial Sequence: Synthetic polypeptide
DEDEIRTTNPVATEAWGSVSTVTNNQQGTNNEQYGS

SEQ ID NO: 141779 - protein, 34 aa, Artificial Sequence
  Description of Artificial Sequence: Synthetic polypeptide
DESEIVTTNPVATEQYGTVVSTGDGEDEGGEGND

SEQ ID NO: 141780 - protein, 34 aa, Artificial Sequence
  Description of Artificial Sequence: Synthetic polypeptide
DECEIATTNPCAYEQWGSVCSTNLEQGDHPNDAD

SEQ ID NO: 141781 - protein, 30 aa, Artificial Sequence
  Description of Artificial Sequence: Synthetic polypeptide
QEEEIATTNPVATEQYGEAPSEDQEHFEEQ

SEQ ID NO: 141782 - protein, 35 aa, Artificial Sequence
  Description of Artificial Sequence: Synthetic polypeptide
DEEEIRTTNPVATEGYGMVNNQGTFGQEGGGQNIG

SEQ ID NO: 141783 - protein, 36 aa, Artificial Sequence
  Description of Artificial Sequence: Synthetic polypeptide
DEDEIRTTNPVATEAWGSVSTVNNNQQGTNNEQIGE

SEQ ID NO: 141784 - protein, 37 aa, Artificial Sequence
  Description of Artificial Sequence: Synthetic polypeptide
DEEEIRTTNPVAFEQYGSVVDNGEPELGQQRGQTDEQ

SEQ ID NO: 141785 - protein, 37 aa, Artificial Sequence
  Description of Artificial Sequence: Synthetic polypeptide
DEEEIRTTNPVAFEQYGSVVVDGQANDLGQRGQTDEQ

SEQ ID NO: 141786 - protein, 35 aa, Artificial Sequence
  Description of Artificial Sequence: Synthetic polypeptide
DEEEIRTTNPVATEQYGSVISDPVGLIETSVQTVD

SEQ ID NO: 141787 - protein, 32 aa, Artificial Sequence
  Description of Artificial Sequence: Synthetic polypeptide
DECEIATTNPCAYERWGEVSTNLQGDHGGDAD

SEQ ID NO: 141788 - protein, 29 aa, Artificial Sequence
  Description of Artificial Sequence: Synthetic peptide
QEEEIATTNPVATEQYGEAPQEVCHHEEK

SEQ ID NO: 141789 - protein, 36 aa, Artificial Sequence
  Description of Artificial Sequence: Synthetic polypeptide
DEEEIRTTNPVATELYGSISSTTPAGPNMRNGMNPV

SEQ ID NO: 141790 - protein, 35 aa, Artificial Sequence
  Description of Artificial Sequence: Synthetic polypeptide
DEEEIRTTNPVATEGYGMVNGQGTGQNEGGGGNTG

SEQ ID NO: 141791 - protein, 38 aa, Artificial Sequence
  Description of Artificial Sequence: Synthetic polypeptide
AEEEIRTTNPVATEQYGSVSVSVTNNLLAGSEEGNNQT

SEQ ID NO: 141792 - protein, 35 aa, Artificial Sequence
  Description of Artificial Sequence: Synthetic polypeptide
DEEEIRTTNPVATEGYGMVNGQGTFGQEGGGQNET

SEQ ID NO: 141793 - protein, 36 aa, Artificial Sequence
  Description of Artificial Sequence: Synthetic polypeptide
DEEEIRTTNPVAHEQYGSVSSTTPAGPNMRNMMNPV

SEQ ID NO: 141794 - protein, 32 aa, Artificial Sequence
  Description of Artificial Sequence: Synthetic polypeptide
DEEEIATTNPVATEQWGTNCSAAALMNNSGDS

SEQ ID NO: 141795 - protein, 35 aa, Artificial Sequence
  Description of Artificial Sequence: Synthetic polypeptide
DEEEIRTTNPVATEQYGSVDSPHQELEDVPIMQLE

SEQ ID NO: 141796 - protein, 35 aa, Artificial Sequence
  Description of Artificial Sequence: Synthetic polypeptide
DEEEIRTTNPVATEGYGMVNGQGTDNQEGGGNQGQ

SEQ ID NO: 141797 - protein, 35 aa, Artificial Sequence
  Description of Artificial Sequence: Synthetic polypeptide
DEDEIRTTNPVATEAWGSVSTNNNNNNQNNEEENG

SEQ ID NO: 141798 - protein, 37 aa, Artificial Sequence
  Description of Artificial Sequence: Synthetic polypeptide
DEEEIRTTNPVAMEQYGSCVSSTTPAGPNMRNGMNPV

SEQ ID NO: 141799 - protein, 35 aa, Artificial Sequence
  Description of Artificial Sequence: Synthetic polypeptide
DEEEIRTTNPVATEGYGMVDIMQTNEDNDTGDGNL

SEQ ID NO: 141800 - protein, 35 aa, Artificial Sequence
  Description of Artificial Sequence: Synthetic polypeptide
DEDEIRTTNPVATEAWGSVSTNNNNNNDNEGENGG

SEQ ID NO: 141801 - protein, 30 aa, Artificial Sequence
  Description of Artificial Sequence: Synthetic polypeptide
DESEIASTNPVGTEGYGAMANSTLQHGPYI

SEQ ID NO: 141802 - protein, 29 aa, Artificial Sequence
  Description of Artificial Sequence: Synthetic peptide
DESEIASTNPVGTEGWGVMASTLQDHGDI

SEQ ID NO: 141803 - protein, 31 aa, Artificial Sequence
  Description of Artificial Sequence: Synthetic polypeptide
YEMEIASTNPVCTEQYGVVSADDGLVESGNQ

SEQ ID NO: 141804 - protein, 36 aa, Artificial Sequence
  Description of Artificial Sequence: Synthetic polypeptide
DEEEIRTTNPVAGEKYGSVSSTTPAGPNMRNGMNPV

SEQ ID NO: 141805 - protein, 33 aa, Artificial Sequence
  Description of Artificial Sequence: Synthetic polypeptide
DECEIATTNPVATEAWGVVSGGNAGNAGNDNQR

SEQ ID NO: 141806 - protein, 30 aa, Artificial Sequence
  Description of Artificial Sequence: Synthetic polypeptide
QEEEIATTNPVATEQYGEAPREVCQHEEEK

SEQ ID NO: 141807 - protein, 36 aa, Artificial Sequence
  Description of Artificial Sequence: Synthetic polypeptide
DEEEIRTTNPVAFEQYGSVVVEGGDLGQEEQGNGGI

SEQ ID NO: 141808 - protein, 36 aa, Artificial Sequence
  Description of Artificial Sequence: Synthetic polypeptide
DEEEIRTTNPVATEKYGSVSSTTPAGPNMRNGMPPV

SEQ ID NO: 141809 - protein, 36 aa, Artificial Sequence
  Description of Artificial Sequence: Synthetic polypeptide
DEDEIRTTNPVATEAWGSVSTNNNNNQNNEGENLGD

SEQ ID NO: 141810 - protein, 36 aa, Artificial Sequence
  Description of Artificial Sequence: Synthetic polypeptide
DEEEIRTTNPVATEGYGMVNGSGMGNEQENAGGQNQ

SEQ ID NO: 141811 - protein, 37 aa, Artificial Sequence
  Description of Artificial Sequence: Synthetic polypeptide
DEEEIRTTNPVAFEQYGTVVDGGQTNDGNQQRGIRGG

SEQ ID NO: 141812 - protein, 36 aa, Artificial Sequence
  Description of Artificial Sequence: Synthetic polypeptide
DEEEIRTTNPVAGEHYGSVSSTTPAGPNMRNGMNPV

SEQ ID NO: 141813 - protein, 37 aa, Artificial Sequence
  Description of Artificial Sequence: Synthetic polypeptide
DEEEIRTTNPVAFEQYGVVVNGGQTNDLDQQRGIFGG

SEQ ID NO: 141814 - protein, 30 aa, Artificial Sequence
  Description of Artificial Sequence: Synthetic polypeptide
QEEEIATTNPVATEQYGETAAEDCQEPEPI

SEQ ID NO: 141815 - protein, 33 aa, Artificial Sequence
  Description of Artificial Sequence: Synthetic polypeptide
DESEIVTTNPVATEQYGTVSACDGEVEFEGENG

SEQ ID NO: 141816 - protein, 34 aa, Artificial Sequence
  Description of Artificial Sequence: Synthetic polypeptide
DECEIATTNPVATEAWGSVSGMNPGQDRQMNGQP

SEQ ID NO: 141817 - protein, 34 aa, Artificial Sequence
  Description of Artificial Sequence: Synthetic polypeptide
DECEIATTNPVATEAWGVVAWTDNHLEQQNGGNA

SEQ ID NO: 141818 - protein, 34 aa, Artificial Sequence
  Description of Artificial Sequence: Synthetic polypeptide
DEEEIRTTNPVATEGYGMVNGQGTNQEGGGDEGG

SEQ ID NO: 141819 - protein, 29 aa, Artificial Sequence
  Description of Artificial Sequence: Synthetic peptide
QECEICATNPCTTEIYGVVSNGELQNGDI

SEQ ID NO: 141820 - protein, 36 aa, Artificial Sequence
  Description of Artificial Sequence: Synthetic polypeptide
DEEEIRTTNPVATEQYGSVISDLINQEATVGGVDSD

SEQ ID NO: 141821 - protein, 33 aa, Artificial Sequence
  Description of Artificial Sequence: Synthetic polypeptide
DESEIVTTNPVATEQYGVVVSATDGPEEGEGED

SEQ ID NO: 141822 - protein, 36 aa, Artificial Sequence
  Description of Artificial Sequence: Synthetic polypeptide
DEEEIRTTNPVAFEQYGSVTVNGLNDLGQGGQGFDQ

SEQ ID NO: 141823 - protein, 36 aa, Artificial Sequence
  Description of Artificial Sequence: Synthetic polypeptide
DEEEIRTTNPVATEQYGSVDSITMGAEQVMLTEDLS

SEQ ID NO: 141824 - protein, 30 aa, Artificial Sequence
  Description of Artificial Sequence: Synthetic polypeptide
QECEIAPTNPCSYEQWGNVSCNLQSGGDTR

SEQ ID NO: 141825 - protein, 32 aa, Artificial Sequence
  Description of Artificial Sequence: Synthetic polypeptide
DESEIASTNPVATEGYGVMASITEPQDHEGNI

SEQ ID NO: 141826 - protein, 36 aa, Artificial Sequence
  Description of Artificial Sequence: Synthetic polypeptide
DEEEIRTTNPVATEGYGMVSNNDEFDLEFEMGGNGG

SEQ ID NO: 141827 - protein, 31 aa, Artificial Sequence
  Description of Artificial Sequence: Synthetic polypeptide
DECEIASTNPVAYEQWGSTSKTLEDRQNMDP

SEQ ID NO: 141828 - protein, 36 aa, Artificial Sequence
  Description of Artificial Sequence: Synthetic polypeptide
DEEEIRTTNPVACEQYGSVSSTTPAHPNERNHMNPV

SEQ ID NO: 141829 - protein, 37 aa, Artificial Sequence
  Description of Artificial Sequence: Synthetic polypeptide
DEEEIRTTNPVATEQYGSVDQSWVLTSEPLGFLVNQQ

SEQ ID NO: 141830 - protein, 35 aa, Artificial Sequence
  Description of Artificial Sequence: Synthetic polypeptide
DEDEIRTTNPVATEAWGSVSTVVNNNATDEGENGV

SEQ ID NO: 141831 - protein, 36 aa, Artificial Sequence
  Description of Artificial Sequence: Synthetic polypeptide
DEEEIRTTNPVATEQYGSVDSDMNNGTFVNEGGDGQ

SEQ ID NO: 141832 - protein, 35 aa, Artificial Sequence
  Description of Artificial Sequence: Synthetic polypeptide
DEEEIATTNPVATEQYGSVCAMNNGVLPEDLENAQ

SEQ ID NO: 141833 - protein, 33 aa, Artificial Sequence
  Description of Artificial Sequence: Synthetic polypeptide
QEGEIAPTNPCATEQYGIVSCNGPQMSNGMNPR

SEQ ID NO: 141834 - protein, 29 aa, Artificial Sequence
  Description of Artificial Sequence: Synthetic peptide
QECEIASTNPVGTEGYGVMASTLQHLGDI

SEQ ID NO: 141835 - protein, 31 aa, Artificial Sequence
  Description of Artificial Sequence: Synthetic polypeptide
QEEEIATTNPVATEQYGEAPTEVCPNHEMNV

SEQ ID NO: 141836 - protein, 31 aa, Artificial Sequence
  Description of Artificial Sequence: Synthetic polypeptide
QEEEIATTNPVATEQYGEAPTEVCPNHEMNK

SEQ ID NO: 141837 - protein, 32 aa, Artificial Sequence
  Description of Artificial Sequence: Synthetic polypeptide
SESEIATTNPVAYEQYGSVAGTGLVADATNWS

SEQ ID NO: 141838 - protein, 35 aa, Artificial Sequence
  Description of Artificial Sequence: Synthetic polypeptide
DEEEIRTTNPVACEQYGSVTHTTEDHNDENGEEIQ

SEQ ID NO: 141839 - protein, 32 aa, Artificial Sequence
  Description of Artificial Sequence: Synthetic polypeptide
SESEICCTNPIAYEQYGSVVSENAHSMRGGNH

SEQ ID NO: 141840 - protein, 32 aa, Artificial Sequence
  Description of Artificial Sequence: Synthetic polypeptide
QEEEIATTNPVATEQYGEAPTEVCPNREMNPK

SEQ ID NO: 141841 - protein, 36 aa, Artificial Sequence
  Description of Artificial Sequence: Synthetic polypeptide
DEEEIRTTNPTATEQYGYVSSTTPAGPNMRNGMNPV

SEQ ID NO: 141842 - protein, 29 aa, Artificial Sequence
  Description of Artificial Sequence: Synthetic peptide
DESEIASTNPIGTEGYGVTMASTLQHGDI

SEQ ID NO: 141843 - protein, 36 aa, Artificial Sequence
  Description of Artificial Sequence: Synthetic polypeptide
DEEEIRTTNPVATEHYGSWSSTTPAGPNMRNGMNPV

SEQ ID NO: 141844 - protein, 31 aa, Artificial Sequence
  Description of Artificial Sequence: Synthetic polypeptide
QEEEIATTNPVATEQYGEAPTEVCPQHEMEK

SEQ ID NO: 141845 - protein, 30 aa, Artificial Sequence
  Description of Artificial Sequence: Synthetic polypeptide
DESEIASTNPVATEGWGVTANSDLQEHGDI

SEQ ID NO: 141846 - protein, 36 aa, Artificial Sequence
  Description of Artificial Sequence: Synthetic polypeptide
DEEEIRTTNPTATAQYGSVSSTTPAGPNMRNGMNPV

SEQ ID NO: 141847 - protein, 33 aa, Artificial Sequence
  Description of Artificial Sequence: Synthetic polypeptide
DEEEIATTNPVATAQWGSVSATGAGGQPQDIMM

SEQ ID NO: 141848 - protein, 36 aa, Artificial Sequence
  Description of Artificial Sequence: Synthetic polypeptide
DEEEIRTTNPVACEQYGHVSSTTPAGPNMRNGMNPV

SEQ ID NO: 141849 - protein, 34 aa, Artificial Sequence
  Description of Artificial Sequence: Synthetic polypeptide
DESESRTTNPVATECWGSVSCINEPNDREGENHG

SEQ ID NO: 141850 - protein, 30 aa, Artificial Sequence
  Description of Artificial Sequence: Synthetic polypeptide
YENEIASVNPVCTEPYGVVSMEDLQQSGNQ

SEQ ID NO: 141851 - protein, 35 aa, Artificial Sequence
  Description of Artificial Sequence: Synthetic polypeptide
DEEEIRTTNPVATEIYGCVCSTEEHQENFGSDTQS

SEQ ID NO: 141852 - protein, 33 aa, Artificial Sequence
  Description of Artificial Sequence: Synthetic polypeptide
DEEEIATTNPVATAQWGSVSATGAGGTHQDAFG

SEQ ID NO: 141853 - protein, 35 aa, Artificial Sequence
  Description of Artificial Sequence: Synthetic polypeptide
DEEEIRTTNPVATEIYGCVCSTGEHQENFGSETQS

SEQ ID NO: 141854 - protein, 35 aa, Artificial Sequence
  Description of Artificial Sequence: Synthetic polypeptide
DEDEIRTTNPVATEAWGSVSTVVNNNGNNEGENGT

SEQ ID NO: 141855 - protein, 37 aa, Artificial Sequence
  Description of Artificial Sequence: Synthetic polypeptide
DEEEIRTTNPTATEQYGSVVSSTTPAGPNMRNPGNPV

SEQ ID NO: 141856 - protein, 35 aa, Artificial Sequence
  Description of Artificial Sequence: Synthetic polypeptide
DEEEIATTNPVATEQYGSVCAMNNHGDEAGDVNNA

SEQ ID NO: 141857 - protein, 36 aa, Artificial Sequence
  Description of Artificial Sequence: Synthetic polypeptide
DEEEIRTTNPVATEQYGCVCSTTGEHNQNFNSDNQY

SEQ ID NO: 141858 - protein, 29 aa, Artificial Sequence
  Description of Artificial Sequence: Synthetic peptide
SESEICSTNPCTTEIYGVVNASTLQNGTI

SEQ ID NO: 141859 - protein, 35 aa, Artificial Sequence
  Description of Artificial Sequence: Synthetic polypeptide
DEDEIRTTNPVATEAWGSVSTVVNNEQGTTTEQNG

SEQ ID NO: 141860 - protein, 29 aa, Artificial Sequence
  Description of Artificial Sequence: Synthetic peptide
QECEIATTNPVATEQYGEAPEVECQHEEK

SEQ ID NO: 141861 - protein, 36 aa, Artificial Sequence
  Description of Artificial Sequence: Synthetic polypeptide
DEEEIATTNPVATEQYGSVCAMNNGVLPEDEHGNDQ

SEQ ID NO: 141862 - protein, 29 aa, Artificial Sequence
  Description of Artificial Sequence: Synthetic peptide
QECEIATTNPVATEQYGEAPLEVCQHEEK

SEQ ID NO: 141863 - protein, 37 aa, Artificial Sequence
  Description of Artificial Sequence: Synthetic polypeptide
DEEEIRTTNPVAFEQYGSVISTGGDLGQEEQGEGIGI

SEQ ID NO: 141864 - protein, 36 aa, Artificial Sequence
  Description of Artificial Sequence: Synthetic polypeptide
DEEEIRTTNPVATEQYGSVISGNNMDNGEGGEDSEG

SEQ ID NO: 141865 - protein, 31 aa, Artificial Sequence
  Description of Artificial Sequence: Synthetic polypeptide
YEMEIASTNPVCTEQYGVVSADDNPVESGNQ

SEQ ID NO: 141866 - protein, 34 aa, Artificial Sequence
  Description of Artificial Sequence: Synthetic polypeptide
DEDEIRTTNPVATEAWGSVSTVVNNEQGTEDEQT

SEQ ID NO: 141867 - protein, 36 aa, Artificial Sequence
  Description of Artificial Sequence: Synthetic polypeptide
DEEEIATTNPVATEQYGSVCAMNNGVLPEDDNGNPQ

SEQ ID NO: 141868 - protein, 32 aa, Artificial Sequence
  Description of Artificial Sequence: Synthetic polypeptide
SESEIRCTNPIAYEQYGSVVHENAHSMPGGNR

SEQ ID NO: 141869 - protein, 33 aa, Artificial Sequence
  Description of Artificial Sequence: Synthetic polypeptide
SESEIRCTNPIAYEQYGSVVSENAHSTEYGGNR

SEQ ID NO: 141870 - protein, 37 aa, Artificial Sequence
  Description of Artificial Sequence: Synthetic polypeptide
DEEEIRTTNPVATEGYGMVNNSGMGNNLQNNNGANQS

SEQ ID NO: 141871 - protein, 35 aa, Artificial Sequence
  Description of Artificial Sequence: Synthetic polypeptide
DEDEIRTTNPVATEAWGSVSTVVNNEQGSNNEQGE

SEQ ID NO: 141872 - protein, 33 aa, Artificial Sequence
  Description of Artificial Sequence: Synthetic polypeptide
SESEIRCTNPIAYEQYGSVVSYEEAHSMRGGNR

SEQ ID NO: 141873 - protein, 36 aa, Artificial Sequence
  Description of Artificial Sequence: Synthetic polypeptide
DEDEIRTTNPVATEAWGSVSTVVNGNQQGTNVEQGN

SEQ ID NO: 141874 - protein, 36 aa, Artificial Sequence
  Description of Artificial Sequence: Synthetic polypeptide
DEEEIRTTNPVATEQYGSVDSITMGAEQVFLMMDVS

SEQ ID NO: 141875 - protein, 34 aa, Artificial Sequence
  Description of Artificial Sequence: Synthetic polypeptide
DEDEIRTTNPVATEAWGSVSTVVNNNANDEGEQG

SEQ ID NO: 141876 - protein, 30 aa, Artificial Sequence
  Description of Artificial Sequence: Synthetic polypeptide
DESEIASTNPVATEQWGDMAETLQNAAGDI

SEQ ID NO: 141877 - protein, 28 aa, Artificial Sequence
  Description of Artificial Sequence: Synthetic peptide
QECEIATTNPVATEKYGEAPEVCQHEEK

SEQ ID NO: 141878 - protein, 35 aa, Artificial Sequence
  Description of Artificial Sequence: Synthetic polypeptide
DEDEIRTTNPVATEAWGSVSTVVNNEQGTTNEQGD

SEQ ID NO: 141879 - protein, 28 aa, Artificial Sequence
  Description of Artificial Sequence: Synthetic peptide
QECEIATTNPCATEQYGEAPEVCQHEEK

SEQ ID NO: 141880 - protein, 36 aa, Artificial Sequence
  Description of Artificial Sequence: Synthetic polypeptide
DEEEIATTNPVATEQWGTVSATANALDTAHQGNQAD

SEQ ID NO: 141881 - protein, 35 aa, Artificial Sequence
  Description of Artificial Sequence: Synthetic polypeptide
DEEEIRTTNPVAFEQYGAVVNGLNDLGQIGQGFDQ

SEQ ID NO: 141882 - protein, 28 aa, Artificial Sequence
  Description of Artificial Sequence: Synthetic peptide
QEGEIAPTNPCATEQYGIASCVCQHETK

SEQ ID NO: 141883 - protein, 36 aa, Artificial Sequence
  Description of Artificial Sequence: Synthetic polypeptide
DEEEIRTTNPVAFEQYGAVVSTGGDLGQEEQGEEGF

SEQ ID NO: 141884 - protein, 34 aa, Artificial Sequence
  Description of Artificial Sequence: Synthetic polypeptide
DEDEIRTTNPVATEAWGSVSTVVNNEQGTEEEEG

SEQ ID NO: 141885 - protein, 32 aa, Artificial Sequence
  Description of Artificial Sequence: Synthetic polypeptide
DEEEIATTNPVATASWGCIATNAEQDTDGNEN

SEQ ID NO: 141886 - protein, 36 aa, Artificial Sequence
  Description of Artificial Sequence: Synthetic polypeptide
DEEEIATTNPVATEQYGSVCAMNNGVLPEDHENGNQ

SEQ ID NO: 141887 - protein, 37 aa, Artificial Sequence
  Description of Artificial Sequence: Synthetic polypeptide
DEEEIRTTNPVAFEQYGDVVAGGQTNDGLQQRGIFGG

SEQ ID NO: 141888 - protein, 36 aa, Artificial Sequence
  Description of Artificial Sequence: Synthetic polypeptide
DEEEIRTTNPVAFEQYGDVVGGNGNDNDQQRGIRGD

SEQ ID NO: 141889 - protein, 37 aa, Artificial Sequence
  Description of Artificial Sequence: Synthetic polypeptide
DEEEIRTTNPVAFEQYGDVVTGGQGNDTDQQRGIRGI

SEQ ID NO: 141890 - protein, 35 aa, Artificial Sequence
  Description of Artificial Sequence: Synthetic polypeptide
DEDEIRTTNPVATEAWGSVSTVVNNEQGTNDEQND

SEQ ID NO: 141891 - protein, 35 aa, Artificial Sequence
  Description of Artificial Sequence: Synthetic polypeptide
DEDEIRTTNPVATEAWGSVSTVVNNEQGTNDEEQG

SEQ ID NO: 141892 - protein, 35 aa, Artificial Sequence
  Description of Artificial Sequence: Synthetic polypeptide
DEDEIRTTNPVATEAWGSVSTVVNNEQGTNVEQGS

SEQ ID NO: 141893 - protein, 36 aa, Artificial Sequence
  Description of Artificial Sequence: Synthetic polypeptide
DEEEIRTTNPVATEQYGCVCSTTGEHNQNFNSQTQS

SEQ ID NO: 141894 - protein, 33 aa, Artificial Sequence
  Description of Artificial Sequence: Synthetic polypeptide
DEEEIATTNPVATEQYGCVAAKGGHDEEMEGNH

SEQ ID NO: 141895 - protein, 32 aa, Artificial Sequence
  Description of Artificial Sequence: Synthetic polypeptide
YEQEIASVNPVATEQYGSVSATDLEDHEGEDL

SEQ ID NO: 141896 - protein, 37 aa, Artificial Sequence
  Description of Artificial Sequence: Synthetic polypeptide
DEDEIRTTNPVATEAYGSVSTVVTNLNNQQQGTTTTE

SEQ ID NO: 141897 - protein, 32 aa, Artificial Sequence
  Description of Artificial Sequence: Synthetic polypeptide
DEAVIRTTNPVATEQYGCCINTNPMTFINNAP

SEQ ID NO: 141898 - protein, 33 aa, Artificial Sequence
  Description of Artificial Sequence: Synthetic polypeptide
DESEVVTTNPVSTEQYGTVCAATTPVQSREGND

SEQ ID NO: 141899 - protein, 33 aa, Artificial Sequence
  Description of Artificial Sequence: Synthetic polypeptide
DESEVVTTNPVSTEQYGTVCAATTPVQSRVGND

SEQ ID NO: 141900 - protein, 35 aa, Artificial Sequence
  Description of Artificial Sequence: Synthetic polypeptide
DEEEIRTTNPVATEQYGCVCSWEEDDQNFNSENQP

SEQ ID NO: 141901 - protein, 34 aa, Artificial Sequence
  Description of Artificial Sequence: Synthetic polypeptide
DEEEIRTTNPVATEGYGSVMGQFVGGQNNGQGQG

SEQ ID NO: 141902 - protein, 35 aa, Artificial Sequence
  Description of Artificial Sequence: Synthetic polypeptide
DEEEIRTTNPVATEQYGCVCSWEEDHINFGSDNQA

SEQ ID NO: 141903 - protein, 28 aa, Artificial Sequence
  Description of Artificial Sequence: Synthetic peptide
QDSEIASTNPVSTEGYGVMASTLQHGDI

SEQ ID NO: 141904 - protein, 30 aa, Artificial Sequence
  Description of Artificial Sequence: Synthetic polypeptide
SEMEIACTNPCSYEQYGCVSWGNLQSGSQQ

SEQ ID NO: 141905 - protein, 35 aa, Artificial Sequence
  Description of Artificial Sequence: Synthetic polypeptide
DEEEIRTTNPVATEGYGSVMGQFVNGEQNNGGGQN

SEQ ID NO: 141906 - protein, 30 aa, Artificial Sequence
  Description of Artificial Sequence: Synthetic polypeptide
SEMEIACTNPCSYEQYGCVCSWNLQSGSDV

SEQ ID NO: 141907 - protein, 30 aa, Artificial Sequence
  Description of Artificial Sequence: Synthetic polypeptide
SEMEIACTNPCSYEQYGCVCSSNLQSGSEA

SEQ ID NO: 141908 - protein, 35 aa, Artificial Sequence
  Description of Artificial Sequence: Synthetic polypeptide
DEEEIRTTNPVATEQYGCVCSWEEDHNAHFGSQQS

SEQ ID NO: 141909 - protein, 37 aa, Artificial Sequence
  Description of Artificial Sequence: Synthetic polypeptide
DEEEIRTTNPVATEQYGSVISPEYNQETEGSDEQNVT

SEQ ID NO: 141910 - protein, 35 aa, Artificial Sequence
  Description of Artificial Sequence: Synthetic polypeptide
DEEEIRTTNPVATEGYGSVMGQIVQGGQNNGGGNN

SEQ ID NO: 141911 - protein, 36 aa, Artificial Sequence
  Description of Artificial Sequence: Synthetic polypeptide
DEEEIRTTNPVATEQYGCVCSWEEDHNENFGSDNQA

SEQ ID NO: 141912 - protein, 35 aa, Artificial Sequence
  Description of Artificial Sequence: Synthetic polypeptide
DEEEIRTTNPVATEGYGSVMGQNMEDEGGEENEGE

SEQ ID NO: 141913 - protein, 34 aa, Artificial Sequence
  Description of Artificial Sequence: Synthetic polypeptide
DEEEIRTTNPVATEQYGCVCSWEEHANFGSETQL

SEQ ID NO: 141914 - protein, 37 aa, Artificial Sequence
  Description of Artificial Sequence: Synthetic polypeptide
DEEEIRTTNPVATEQYGSVISPPIWLGVIDNQVANLN

SEQ ID NO: 141915 - protein, 34 aa, Artificial Sequence
  Description of Artificial Sequence: Synthetic polypeptide
DEREISTTNPVATEQYGQCVCSTEDHQNFISNQS

SEQ ID NO: 141916 - protein, 34 aa, Artificial Sequence
  Description of Artificial Sequence: Synthetic polypeptide
DEREISTTNPVATEQYGQCVCSTEELQNFISDQS

SEQ ID NO: 141917 - protein, 34 aa, Artificial Sequence
  Description of Artificial Sequence: Synthetic polypeptide
DEREISTTNPVATEQYGQCVCSTEHQNFISDNQA

SEQ ID NO: 141918 - protein, 37 aa, Artificial Sequence
  Description of Artificial Sequence: Synthetic polypeptide
DEEEIRTTNPVATEQYGSVISPNYNQETEPSMEQNVV

SEQ ID NO: 141919 - protein, 36 aa, Artificial Sequence
  Description of Artificial Sequence: Synthetic polypeptide
DEDEIRTTNPVATEAYGSVSTVVNNQQQQNATTTTE

SEQ ID NO: 141920 - protein, 35 aa, Artificial Sequence
  Description of Artificial Sequence: Synthetic polypeptide
DEEEIRTTNPVATEQYGCVCSWEEDQENFNSETQS

SEQ ID NO: 141921 - protein, 35 aa, Artificial Sequence
  Description of Artificial Sequence: Synthetic polypeptide
DEEEIATTNPVATEQYGCVCAMTNHGEATLDGERN

SEQ ID NO: 141922 - protein, 35 aa, Artificial Sequence
  Description of Artificial Sequence: Synthetic polypeptide
DEEEIRTTNPVATEQYGCVCSWEEDNQNFNSENQA

SEQ ID NO: 141923 - protein, 32 aa, Artificial Sequence
  Description of Artificial Sequence: Synthetic polypeptide
SEHEIATTNPVATEYYGSVSATDLEDHEKEDL

SEQ ID NO: 141924 - protein, 35 aa, Artificial Sequence
  Description of Artificial Sequence: Synthetic polypeptide
DEEEIRTTNPVATEQYGCVCSWEEDHQNFGSDTQV

SEQ ID NO: 141925 - protein, 36 aa, Artificial Sequence
  Description of Artificial Sequence: Synthetic polypeptide
DEEEIRTTNPVATEQYGCVCSWEEDHNQNFGSDNQS

SEQ ID NO: 141926 - protein, 33 aa, Artificial Sequence
  Description of Artificial Sequence: Synthetic polypeptide
SEHEIRTTNPVAYEAYGSVCSQIISLPVGGNQC

SEQ ID NO: 141927 - protein, 35 aa, Artificial Sequence
  Description of Artificial Sequence: Synthetic polypeptide
DESIIRTTNPVATECWGSVHSCINMEPQDREGENG

SEQ ID NO: 141928 - protein, 34 aa, Artificial Sequence
  Description of Artificial Sequence: Synthetic polypeptide
DEEEIRTTNPVATEGYGSVMGQFVGGQNIGGGEQ

SEQ ID NO: 141929 - protein, 35 aa, Artificial Sequence
  Description of Artificial Sequence: Synthetic polypeptide
DEEEIRTTNPVATEQYGCVCSWEDHQENFGSQTQS

SEQ ID NO: 141930 - protein, 32 aa, Artificial Sequence
  Description of Artificial Sequence: Synthetic polypeptide
DESEVVSTNPVATEGYGNVSATDTIESREGQR

SEQ ID NO: 141931 - protein, 35 aa, Artificial Sequence
  Description of Artificial Sequence: Synthetic polypeptide
DEEEIRTTNPVATEGYGSVMGQFNDDEQNNGGGQQ

SEQ ID NO: 141932 - protein, 35 aa, Artificial Sequence
  Description of Artificial Sequence: Synthetic polypeptide
DEEEIRTTNPVATEGYGSVMGQFNAGEQNQGGGQG

SEQ ID NO: 141933 - protein, 35 aa, Artificial Sequence
  Description of Artificial Sequence: Synthetic polypeptide
DESCIRTTNPVATEQWGSVATGNMESIANGGNNRN

SEQ ID NO: 141934 - protein, 33 aa, Artificial Sequence
  Description of Artificial Sequence: Synthetic polypeptide
DEAVIRTTNPVATEQYGCVCETEDPQEYGSDQS

SEQ ID NO: 141935 - protein, 35 aa, Artificial Sequence
  Description of Artificial Sequence: Synthetic polypeptide
DESCIRTTNPVATEQYGKTVSVGNISQPTGTNTAI

SEQ ID NO: 141936 - protein, 34 aa, Artificial Sequence
  Description of Artificial Sequence: Synthetic polypeptide
DESCIRTTNPVATEQYGKVPSDTGNISQPVSTFP

SEQ ID NO: 141937 - protein, 32 aa, Artificial Sequence
  Description of Artificial Sequence: Synthetic polypeptide
DEAVIRTTNPVATEQYGCVCESEPQYSGSDQA

SEQ ID NO: 141938 - protein, 35 aa, Artificial Sequence
  Description of Artificial Sequence: Synthetic polypeptide
DEEEIRTTNPVATEQYGCVCSWEDHETENFGSDQS

SEQ ID NO: 141939 - protein, 35 aa, Artificial Sequence
  Description of Artificial Sequence: Synthetic polypeptide
DEEEIRTTNPVATEQYGCVCSWEDHDQEFFGSEQA

SEQ ID NO: 141940 - protein, 30 aa, Artificial Sequence
  Description of Artificial Sequence: Synthetic polypeptide
QDSEIATTNPVATEQYGNAPANVCQRVEQK

SEQ ID NO: 141941 - protein, 35 aa, Artificial Sequence
  Description of Artificial Sequence: Synthetic polypeptide
DEEEIRTTNPVATEGYGSVMGQFDNGEQNNGGGDQ

SEQ ID NO: 141942 - protein, 38 aa, Artificial Sequence
  Description of Artificial Sequence: Synthetic polypeptide
AEEEIRTTNPVATEQYGSVVTVANLNNQQGENGTNNVE

SEQ ID NO: 141943 - protein, 35 aa, Artificial Sequence
  Description of Artificial Sequence: Synthetic polypeptide
DEEEIRTTNPVATEGYGSVMGLFQIQNDDEGGNEA

SEQ ID NO: 141944 - protein, 29 aa, Artificial Sequence
  Description of Artificial Sequence: Synthetic peptide
QEGEIAPTNPCSSEQYGIVACNLQEPGPI

SEQ ID NO: 141945 - protein, 33 aa, Artificial Sequence
  Description of Artificial Sequence: Synthetic polypeptide
DESEVRTTNPVSTECWGSVSCITEPQSREGEQG

SEQ ID NO: 141946 - protein, 35 aa, Artificial Sequence
  Description of Artificial Sequence: Synthetic polypeptide
DEREISTTNPVATEQYGCVCSMTEEHNQNFGSNQA

SEQ ID NO: 141947 - protein, 31 aa, Artificial Sequence
  Description of Artificial Sequence: Synthetic polypeptide
DESEVRTTNPVSTEGWGNVSACTIQSREGQG

SEQ ID NO: 141948 - protein, 35 aa, Artificial Sequence
  Description of Artificial Sequence: Synthetic polypeptide
DEEEIRTTNPVATEGYGSVMGQFNDGEQANNGGGQ

SEQ ID NO: 141949 - protein, 28 aa, Artificial Sequence
  Description of Artificial Sequence: Synthetic peptide
QDSEIATTNPVATEGYGNAANVIQHGQK

SEQ ID NO: 141950 - protein, 34 aa, Artificial Sequence
  Description of Artificial Sequence: Synthetic polypeptide
DEEEIRTTNPVATEGYGSVMGQFVGGQDENGGGQ

SEQ ID NO: 141951 - protein, 36 aa, Artificial Sequence
  Description of Artificial Sequence: Synthetic polypeptide
DEEEIRTTNPVATEQYGSVISPEMIELTVEGIVEME

SEQ ID NO: 141952 - protein, 30 aa, Artificial Sequence
  Description of Artificial Sequence: Synthetic polypeptide
QEGEIAPTNPCSSEQYGIVACNLQSSVGTR

SEQ ID NO: 141953 - protein, 35 aa, Artificial Sequence
  Description of Artificial Sequence: Synthetic polypeptide
DEEEIRTTNPVATEGYGSVMGQFQNGEQENNGGGQ

SEQ ID NO: 141954 - protein, 36 aa, Artificial Sequence
  Description of Artificial Sequence: Synthetic polypeptide
DEEEIRTTNPVATEGYGSVMGQFNGGEQNNGGGNQQ

SEQ ID NO: 141955 - protein, 31 aa, Artificial Sequence
  Description of Artificial Sequence: Synthetic polypeptide
DESEVRTTNPVSTEGWGNVSACTIQSRVGQG

SEQ ID NO: 141956 - protein, 32 aa, Artificial Sequence
  Description of Artificial Sequence: Synthetic polypeptide
DESEVRTTNPVSTEPYGTISMEDIQQQRNGNH

SEQ ID NO: 141957 - protein, 35 aa, Artificial Sequence
  Description of Artificial Sequence: Synthetic polypeptide
DEEEIRTTNPVATEGYGSVMGQFNGEQDNNGGGQQ

SEQ ID NO: 141958 - protein, 34 aa, Artificial Sequence
  Description of Artificial Sequence: Synthetic polypeptide
DEEEIRTTNPVATEGYGSVMGQFNGEEDNGGGQQ

SEQ ID NO: 141959 - protein, 37 aa, Artificial Sequence
  Description of Artificial Sequence: Synthetic polypeptide
DEDEIRTTNPVATEAYGSVSTVVNNLQNQQIGTTTTE

SEQ ID NO: 141960 - protein, 32 aa, Artificial Sequence
  Description of Artificial Sequence: Synthetic polypeptide
DESEVRTTNPVSTEGYGTISMEDIQQSQVGNR

SEQ ID NO: 141961 - protein, 34 aa, Artificial Sequence
  Description of Artificial Sequence: Synthetic polypeptide
DEAVIRTTNPVATEQYGCVCENTNDPQYFGSDQA

SEQ ID NO: 141962 - protein, 34 aa, Artificial Sequence
  Description of Artificial Sequence: Synthetic polypeptide
CEEEIACTNPVATEQYGSACAATNHGQDSDGNND

SEQ ID NO: 141963 - protein, 34 aa, Artificial Sequence
  Description of Artificial Sequence: Synthetic polypeptide
DEEEIRTTNPVATEQYGSVNQVIEPDFIGIDEQG

SEQ ID NO: 141964 - protein, 35 aa, Artificial Sequence
  Description of Artificial Sequence: Synthetic polypeptide
DEEEIRTTNPVATEQYGCVCSWEEHIENFGSQNQS

SEQ ID NO: 141965 - protein, 28 aa, Artificial Sequence
  Description of Artificial Sequence: Synthetic peptide
QDSEIASTNPVGTEGYGVMASTLQHGDI

SEQ ID NO: 141966 - protein, 35 aa, Artificial Sequence
  Description of Artificial Sequence: Synthetic polypeptide
DEEEIRTTNPVATEGYGSVMNDLNDGGGQTTGEGE

SEQ ID NO: 141967 - protein, 35 aa, Artificial Sequence
  Description of Artificial Sequence: Synthetic polypeptide
DEEEIRTTNPVATEQYGCVCSWEHNAENFNSETQS

SEQ ID NO: 141968 - protein, 36 aa, Artificial Sequence
  Description of Artificial Sequence: Synthetic polypeptide
DEEEIRTTNPVATEGYGSVNMNLNGIDQDQEDEFGN

SEQ ID NO: 141969 - protein, 30 aa, Artificial Sequence
  Description of Artificial Sequence: Synthetic polypeptide
QEGEIAPTNPCSSEQYGIVSCMNGLQSGTG

SEQ ID NO: 141970 - protein, 34 aa, Artificial Sequence
  Description of Artificial Sequence: Synthetic polypeptide
DESQIRTTNPVATECWGSVHSCINIPQDREKENT

SEQ ID NO: 141971 - protein, 34 aa, Artificial Sequence
  Description of Artificial Sequence: Synthetic polypeptide
DEREIRTTNPVATEQYGCVCSWEEHQNFNSDTQA

SEQ ID NO: 141972 - protein, 29 aa, Artificial Sequence
  Description of Artificial Sequence: Synthetic peptide
QEGEIAPTNPCSSEQYGIVSCGPQSEGTR

SEQ ID NO: 141973 - protein, 35 aa, Artificial Sequence
  Description of Artificial Sequence: Synthetic polypeptide
DEEEIATTNPVATEQYGSVCAMTGVEPMGDEENFP

SEQ ID NO: 141974 - protein, 34 aa, Artificial Sequence
  Description of Artificial Sequence: Synthetic polypeptide
DEEEIRTTNPLAYEPYGSVPSYCVNIFTTGGQND

SEQ ID NO: 141975 - protein, 34 aa, Artificial Sequence
  Description of Artificial Sequence: Synthetic polypeptide
DESPIRTTNPVATHCWGSLVSGINEPQDREGENG

SEQ ID NO: 141976 - protein, 35 aa, Artificial Sequence
  Description of Artificial Sequence: Synthetic polypeptide
DEEEIRTTNPVATEQYGCVCSWEEHTENFISDTQS

SEQ ID NO: 141977 - protein, 35 aa, Artificial Sequence
  Description of Artificial Sequence: Synthetic polypeptide
DEEEIATTNPVATEQYGSVCAMTGVEPEDGENDNP

SEQ ID NO: 141978 - protein, 36 aa, Artificial Sequence
  Description of Artificial Sequence: Synthetic polypeptide
DEREIRTTNPVATEQYGDVSSTTPAGPNMRNGMNPV

SEQ ID NO: 141979 - protein, 34 aa, Artificial Sequence
  Description of Artificial Sequence: Synthetic polypeptide
DESPIRTTNPVATECWGCVSCINCEPQDREGENG

SEQ ID NO: 141980 - protein, 35 aa, Artificial Sequence
  Description of Artificial Sequence: Synthetic polypeptide
DEEEIRTTNPVATEQYGCVCSWEEHQESFGSDTQT

SEQ ID NO: 141981 - protein, 35 aa, Artificial Sequence
  Description of Artificial Sequence: Synthetic polypeptide
DEEEIRTTNPVATEQYGCVCSWEEHTENFPSDTQS

SEQ ID NO: 141982 - protein, 28 aa, Artificial Sequence
  Description of Artificial Sequence: Synthetic peptide
QDSEIACTNPVGTEGYGVMASTLQHGDI

SEQ ID NO: 141983 - protein, 34 aa, Artificial Sequence
  Description of Artificial Sequence: Synthetic polypeptide
DEEEIATTNPVATEQYGCVATNNLNTMAPMESTM

SEQ ID NO: 141984 - protein, 34 aa, Artificial Sequence
  Description of Artificial Sequence: Synthetic polypeptide
DEEEIRTTNPVATEQYGCVCSWEHNQENFISEQS

SEQ ID NO: 141985 - protein, 33 aa, Artificial Sequence
  Description of Artificial Sequence: Synthetic polypeptide
QEEEIATTNPVATEQYGEASSEPVCNMHNGNPV

SEQ ID NO: 141986 - protein, 32 aa, Artificial Sequence
  Description of Artificial Sequence: Synthetic polypeptide
DEAVIGTTNPVATEQWGCVCSTEDHQYFGSDQ

SEQ ID NO: 141987 - protein, 33 aa, Artificial Sequence
  Description of Artificial Sequence: Synthetic polypeptide
DEAVIGTTNPVATEQWGCVCSTEDTQYFGSNQA

SEQ ID NO: 141988 - protein, 35 aa, Artificial Sequence
  Description of Artificial Sequence: Synthetic polypeptide
DEEEIATTNPVATEQYGCVAGTGHTADTMGGDNRW

SEQ ID NO: 141989 - protein, 35 aa, Artificial Sequence
  Description of Artificial Sequence: Synthetic polypeptide
DEEEIATTNPVATEQYGSVCAMTGVGPEDDGGNDQ

SEQ ID NO: 141990 - protein, 36 aa, Artificial Sequence
  Description of Artificial Sequence: Synthetic polypeptide
SEGEEIRTTNPVAYEQWGQVVSSCTNMQSADAGNRA

SEQ ID NO: 141991 - protein, 35 aa, Artificial Sequence
  Description of Artificial Sequence: Synthetic polypeptide
DEEEIRTTNPVATEQYGCVCSWEHNQENFGSETQS

SEQ ID NO: 141992 - protein, 36 aa, Artificial Sequence
  Description of Artificial Sequence: Synthetic polypeptide
DEEEIRTTNPVATEGYGSVQDNTNMTNIMGNGENQT

SEQ ID NO: 141993 - protein, 35 aa, Artificial Sequence
  Description of Artificial Sequence: Synthetic polypeptide
DEEEIRTTNPVATEQYGCVCSWEHNQEYFNSENQS

SEQ ID NO: 141994 - protein, 35 aa, Artificial Sequence
  Description of Artificial Sequence: Synthetic polypeptide
DEEEIRTTNPVATEQYGCVCSWEHNQENFNSQNQS

SEQ ID NO: 141995 - protein, 35 aa, Artificial Sequence
  Description of Artificial Sequence: Synthetic polypeptide
DEEEIRTTNPVATEQYGCVCSWEHNQENFNSENQV

SEQ ID NO: 141996 - protein, 35 aa, Artificial Sequence
  Description of Artificial Sequence: Synthetic polypeptide
DEREIRTTNPVATEQYGCVCSNTGEHNQNFNSDQS

SEQ ID NO: 141997 - protein, 35 aa, Artificial Sequence
  Description of Artificial Sequence: Synthetic polypeptide
DEEEIRTTNPVATEQYGCVCSWEHNQENFNSDNQP

SEQ ID NO: 141998 - protein, 34 aa, Artificial Sequence
  Description of Artificial Sequence: Synthetic polypeptide
DESQIRTTNPVATEQYGSVRCTEASSNNGGNNED

SEQ ID NO: 141999 - protein, 34 aa, Artificial Sequence
  Description of Artificial Sequence: Synthetic polypeptide
DEREIRTTNPVATEQYGCVCSNSGEHQNFGSDQL

SEQ ID NO: 142000 - protein, 35 aa, Artificial Sequence
  Description of Artificial Sequence: Synthetic polypeptide
DESEVRTTNPVATEQYGNVSATTPAGPNSRNGMNV

SEQ ID NO: 142001 - protein, 35 aa, Artificial Sequence
  Description of Artificial Sequence: Synthetic polypeptide
DEEEIRTTNPVATEQYGCVCSWEEHQENFGSDTQI

SEQ ID NO: 142002 - protein, 35 aa, Artificial Sequence
  Description of Artificial Sequence: Synthetic polypeptide
DEREIRTTNPVATEQYGSVSCVVDLNQPNSQIDEQ

SEQ ID NO: 142003 - protein, 33 aa, Artificial Sequence
  Description of Artificial Sequence: Synthetic polypeptide
DEREIRTTNPVCYEHYGSVGMPNALTQTLGLLK

SEQ ID NO: 142004 - protein, 34 aa, Artificial Sequence
  Description of Artificial Sequence: Synthetic polypeptide
DEREIRTTNPVCYEHYGSVSMPDALRQTLGNPLK

SEQ ID NO: 142005 - protein, 34 aa, Artificial Sequence
  Description of Artificial Sequence: Synthetic polypeptide
DEREIRTTNPVCYEHYGSVSMPDALTQTLGGNGK

SEQ ID NO: 142006 - protein, 36 aa, Artificial Sequence
  Description of Artificial Sequence: Synthetic polypeptide
DEEEIRTTNPVATEGYGSVMSDENGDTDDQTENEGN

SEQ ID NO: 142007 - protein, 36 aa, Artificial Sequence
  Description of Artificial Sequence: Synthetic polypeptide
DEEEIRTTNPVATEQYGCVCSWEEHNQENFGSDNQY

SEQ ID NO: 142008 - protein, 36 aa, Artificial Sequence
  Description of Artificial Sequence: Synthetic polypeptide
DEEEIRTTNPVATEQYGCVCSWEEHNQENFGSDNQA

SEQ ID NO: 142009 - protein, 33 aa, Artificial Sequence
  Description of Artificial Sequence: Synthetic polypeptide
CEEEIACTNPVATEQYGSACSADGLQDSDDNDA

SEQ ID NO: 142010 - protein, 35 aa, Artificial Sequence
  Description of Artificial Sequence: Synthetic polypeptide
DEREIRTTNPVCYEHYGSVSMPNALTQTLGGNDDK

SEQ ID NO: 142011 - protein, 34 aa, Artificial Sequence
  Description of Artificial Sequence: Synthetic polypeptide
DEEEIRTTNPVATEQYGCVCSWEEHNIFFNSDQE

SEQ ID NO: 142012 - protein, 35 aa, Artificial Sequence
  Description of Artificial Sequence: Synthetic polypeptide
DEEEIRTTNPVATEQYGCVCSWEEHNAENFNSQQM

SEQ ID NO: 142013 - protein, 37 aa, Artificial Sequence
  Description of Artificial Sequence: Synthetic polypeptide
DEDEIRTTNPVATEAYGVVSTVVNNLQNQEQGTTNTE

SEQ ID NO: 142014 - protein, 34 aa, Artificial Sequence
  Description of Artificial Sequence: Synthetic polypeptide
DEAVIGTTNPVATEQWGQCVCSTDDLQYFGSNQF

SEQ ID NO: 142015 - protein, 35 aa, Artificial Sequence
  Description of Artificial Sequence: Synthetic polypeptide
SEGEIRTTNPVATEQYGSVCVNVMLSEIGPNQEHT

SEQ ID NO: 142016 - protein, 32 aa, Artificial Sequence
  Description of Artificial Sequence: Synthetic polypeptide
DEREIRTTNPVSTEPYGTISMEDIQQQQNGNH

SEQ ID NO: 142017 - protein, 36 aa, Artificial Sequence
  Description of Artificial Sequence: Synthetic polypeptide
DEEEIRTTNPVATEQYGCVCSWEEHNQEGFNSDTQS

SEQ ID NO: 142018 - protein, 31 aa, Artificial Sequence
  Description of Artificial Sequence: Synthetic polypeptide
QDSEIASTNPVATEGYGNVAANVCQSRVGER

SEQ ID NO: 142019 - protein, 36 aa, Artificial Sequence
  Description of Artificial Sequence: Synthetic polypeptide
DEEEIRTTNPVATEGYGSVMSDMEMGQDNGEENIVF

SEQ ID NO: 142020 - protein, 37 aa, Artificial Sequence
  Description of Artificial Sequence: Synthetic polypeptide
DEREIRTTNPVATEQYGSVSSTTPAPGPNMRNGMNPV

SEQ ID NO: 142021 - protein, 34 aa, Artificial Sequence
  Description of Artificial Sequence: Synthetic polypeptide
DESPIRTTNPVATDCWGSVSCINEPQDREGENYG

SEQ ID NO: 142022 - protein, 34 aa, Artificial Sequence
  Description of Artificial Sequence: Synthetic polypeptide
DEEEIRTTNPVATEQYGCVCSWEEHQEHFISDQA

SEQ ID NO: 142023 - protein, 35 aa, Artificial Sequence
  Description of Artificial Sequence: Synthetic polypeptide
DEEEIRTTNPVATEQYGCVCSWEEHQEHFGSDTQS

SEQ ID NO: 142024 - protein, 33 aa, Artificial Sequence
  Description of Artificial Sequence: Synthetic polypeptide
DESNIRTTNTVATECWGSVSCINEPQDREGEWG

SEQ ID NO: 142025 - protein, 35 aa, Artificial Sequence
  Description of Artificial Sequence: Synthetic polypeptide
DEEEIRTTNPVATEGYGSVMSDNAEFGVGTEDEIG

SEQ ID NO: 142026 - protein, 35 aa, Artificial Sequence
  Description of Artificial Sequence: Synthetic polypeptide
DEEEIRTTNPVATEQYGCVCSWEEHNTENFNSDQS

SEQ ID NO: 142027 - protein, 31 aa, Artificial Sequence
  Description of Artificial Sequence: Synthetic polypeptide
QDSEIASTNPVGTEGYGNVAANTLQSRVGQR

SEQ ID NO: 142028 - protein, 33 aa, Artificial Sequence
  Description of Artificial Sequence: Synthetic polypeptide
DESNIRTTNCVATECWGSVQCINEPQDREGENG

SEQ ID NO: 142029 - protein, 37 aa, Artificial Sequence
  Description of Artificial Sequence: Synthetic polypeptide
DEDEIRTTNPVATEAYGVVSTVVTNLQQQQGNTTTDD

SEQ ID NO: 142030 - protein, 35 aa, Artificial Sequence
  Description of Artificial Sequence: Synthetic polypeptide
DEEEIRTTNPVATEQYGCVCSWEEHNQNFISNNQS

SEQ ID NO: 142031 - protein, 35 aa, Artificial Sequence
  Description of Artificial Sequence: Synthetic polypeptide
DEEEIRTTNPVATEQYGCVCSWEEHNQNFGSETQS

SEQ ID NO: 142032 - protein, 35 aa, Artificial Sequence
  Description of Artificial Sequence: Synthetic polypeptide
DEEEIRTTNPVATEQYGCVCSWEEHNQNFGSETQA

SEQ ID NO: 142033 - protein, 35 aa, Artificial Sequence
  Description of Artificial Sequence: Synthetic polypeptide
DEEEIRTTNPVATEQYGCVCSWEEHNQNFGSDTQS

SEQ ID NO: 142034 - protein, 35 aa, Artificial Sequence
  Description of Artificial Sequence: Synthetic polypeptide
DEEEIRTTNPVATEQYGCVCSWEEHNQFFGSETQP

SEQ ID NO: 142035 - protein, 33 aa, Artificial Sequence
  Description of Artificial Sequence: Synthetic polypeptide
DESNIATTNPVAYEQWGCVETWNDPQDRGGNHP

SEQ ID NO: 142036 - protein, 30 aa, Artificial Sequence
  Description of Artificial Sequence: Synthetic polypeptide
QEEEIATTNPVATEQYGEAPPEGVGQHEEK

SEQ ID NO: 142037 - protein, 37 aa, Artificial Sequence
  Description of Artificial Sequence: Synthetic polypeptide
DEEEIRTTNPVATEQYGSVISPTYGQETEESDEQNVT

SEQ ID NO: 142038 - protein, 34 aa, Artificial Sequence
  Description of Artificial Sequence: Synthetic polypeptide
DEEEIATTNPVATEQYGSVCAMTGVEPDDEENNP

SEQ ID NO: 142039 - protein, 34 aa, Artificial Sequence
  Description of Artificial Sequence: Synthetic polypeptide
DEEEIRTTNPVATEGYGVVDGLGGQGDEGENGET

SEQ ID NO: 142040 - protein, 31 aa, Artificial Sequence
  Description of Artificial Sequence: Synthetic polypeptide
DESEVASTNPVSTEGYGNVSANDIQSHEGER

SEQ ID NO: 142041 - protein, 32 aa, Artificial Sequence
  Description of Artificial Sequence: Synthetic polypeptide
YESEIASVNPVATECYGVVSCINEQDREGENG

SEQ ID NO: 142042 - protein, 32 aa, Artificial Sequence
  Description of Artificial Sequence: Synthetic polypeptide
DESEVASTNPVSTEGYGNVSANTIQSREGEQR

SEQ ID NO: 142043 - protein, 37 aa, Artificial Sequence
  Description of Artificial Sequence: Synthetic polypeptide
DEEEIRTTNPVATEQYGCVCSTTPAPNNENFGGNPVI

SEQ ID NO: 142044 - protein, 30 aa, Artificial Sequence
  Description of Artificial Sequence: Synthetic polypeptide
QEGEIAPTNPCSSEQYGAVSCNFLQGSGTG

SEQ ID NO: 142045 - protein, 29 aa, Artificial Sequence
  Description of Artificial Sequence: Synthetic peptide
QDSEVASTNPVGTEGYGVVAANTLQRGDI

SEQ ID NO: 142046 - protein, 35 aa, Artificial Sequence
  Description of Artificial Sequence: Synthetic polypeptide
DEEEIATTNPTATEQYGSVPPTVTQDHIQGQNVSL

SEQ ID NO: 142047 - protein, 30 aa, Artificial Sequence
  Description of Artificial Sequence: Synthetic polypeptide
QEGEIAPTNPCSSEQYGAVSCNLPQSGHTG

SEQ ID NO: 142048 - protein, 37 aa, Artificial Sequence
  Description of Artificial Sequence: Synthetic polypeptide
DEEEIRTTNPVATEGYGSVCGFTNYQLATQLIGQEIG

SEQ ID NO: 142049 - protein, 31 aa, Artificial Sequence
  Description of Artificial Sequence: Synthetic polypeptide
DESEVASTNPVSTEGYGTVAAMTIQSRVGNR

SEQ ID NO: 142050 - protein, 35 aa, Artificial Sequence
  Description of Artificial Sequence: Synthetic polypeptide
DEEEIRTTNPVATEGYGSVYTTQDEMQGEGETTDF

SEQ ID NO: 142051 - protein, 37 aa, Artificial Sequence
  Description of Artificial Sequence: Synthetic polypeptide
DEEEIRTTNPVATEGYGSVCVFTLYELATQRAGQEVV

SEQ ID NO: 142052 - protein, 36 aa, Artificial Sequence
  Description of Artificial Sequence: Synthetic polypeptide
DEEEIRTTNPVATEQYGCVCSTWEEHDQEHFNSDQS

SEQ ID NO: 142053 - protein, 36 aa, Artificial Sequence
  Description of Artificial Sequence: Synthetic polypeptide
DEEEIRTTNPVATEQYGCVCSTWEEHNAENFGSQQS

SEQ ID NO: 142054 - protein, 32 aa, Artificial Sequence
  Description of Artificial Sequence: Synthetic polypeptide
DESEVASTNPVSTEGYGTVANETIQQQRNGNR

SEQ ID NO: 142055 - protein, 32 aa, Artificial Sequence
  Description of Artificial Sequence: Synthetic polypeptide
DESEVASTNPVSTEGYGTVSAMTIQQQRVGNH

SEQ ID NO: 142056 - protein, 35 aa, Artificial Sequence
  Description of Artificial Sequence: Synthetic polypeptide
DEEEIRTTNPVATEGYGSVVMNGQNGGGFGGGEGV

SEQ ID NO: 142057 - protein, 31 aa, Artificial Sequence
  Description of Artificial Sequence: Synthetic polypeptide
DESEVASTNPVSTEQYGNVAATTPQSRVGQD

SEQ ID NO: 142058 - protein, 36 aa, Artificial Sequence
  Description of Artificial Sequence: Synthetic polypeptide
DEEEIRTTNPVATEQYGCVCSTWGEDHQEGFGSDQS

SEQ ID NO: 142059 - protein, 30 aa, Artificial Sequence
  Description of Artificial Sequence: Synthetic polypeptide
DESEVASTNPVSTEQYGNAANTIQSRVGQR

SEQ ID NO: 142060 - protein, 36 aa, Artificial Sequence
  Description of Artificial Sequence: Synthetic polypeptide
DEEEIRTTNPVATEQYGCVCSTWEHNQENFNSENQS

SEQ ID NO: 142061 - protein, 34 aa, Artificial Sequence
  Description of Artificial Sequence: Synthetic polypeptide
DESDIRTTNPAATECWGSVSFCINEPQDREGENG

SEQ ID NO: 142062 - protein, 37 aa, Artificial Sequence
  Description of Artificial Sequence: Synthetic polypeptide
DEEEIRTTNPVATEQYGCVCSTTPAHNNERSNSDPVS

SEQ ID NO: 142063 - protein, 30 aa, Artificial Sequence
  Description of Artificial Sequence: Synthetic polypeptide
DESEVASTNPVSTEGYGVMAASTIQSRGQR

SEQ ID NO: 142064 - protein, 31 aa, Artificial Sequence
  Description of Artificial Sequence: Synthetic polypeptide
DESEVASTNPVSTEGYGTVSANTIESRVGQR

SEQ ID NO: 142065 - protein, 35 aa, Artificial Sequence
  Description of Artificial Sequence: Synthetic polypeptide
DEEEIRTTNPVATEGYGSVVTTDGMNNETGEEGGE

SEQ ID NO: 142066 - protein, 36 aa, Artificial Sequence
  Description of Artificial Sequence: Synthetic polypeptide
DEEEIRTTNPVATEGYGSVVYDNIIQGGQGEEEENN

SEQ ID NO: 142067 - protein, 36 aa, Artificial Sequence
  Description of Artificial Sequence: Synthetic polypeptide
DEEEIRTTNPVATEQYGCVCSTWEEHNTSFNSENQS

SEQ ID NO: 142068 - protein, 36 aa, Artificial Sequence
  Description of Artificial Sequence: Synthetic polypeptide
DEEEIRTTNPVATEQYGSVDNFDLNGEIQGEGEEFT

SEQ ID NO: 142069 - protein, 35 aa, Artificial Sequence
  Description of Artificial Sequence: Synthetic polypeptide
DEEEIRTTNPVATEGYGSVYDNEIQGGQGEEEDEG

SEQ ID NO: 142070 - protein, 29 aa, Artificial Sequence
  Description of Artificial Sequence: Synthetic peptide
QDSEIATTNPVSTEGYGEVAEVCQRVEQR

SEQ ID NO: 142071 - protein, 28 aa, Artificial Sequence
  Description of Artificial Sequence: Synthetic peptide
QEGEIAPTNPCSSEQYGAVSADWQSGTI

SEQ ID NO: 142072 - protein, 36 aa, Artificial Sequence
  Description of Artificial Sequence: Synthetic polypeptide
DEEEIRTTNPVATEQYGCVCSTTPAGETENFGSNPV

SEQ ID NO: 142073 - protein, 33 aa, Artificial Sequence
  Description of Artificial Sequence: Synthetic polypeptide
DEAVIRTTNPVATEQYGCVCETNPAEYFNSDQS

SEQ ID NO: 142074 - protein, 35 aa, Artificial Sequence
  Description of Artificial Sequence: Synthetic polypeptide
DEEEIRTTNPVATEGYGQCVCSTGEHTEGFNSDQS

SEQ ID NO: 142075 - protein, 30 aa, Artificial Sequence
  Description of Artificial Sequence: Synthetic polypeptide
SENEIRTTNPIATEQWGSVSEIEMNAAEDA

SEQ ID NO: 142076 - protein, 31 aa, Artificial Sequence
  Description of Artificial Sequence: Synthetic polypeptide
DESEVASTNPVSTEGYGNVAANTIQSRVGTR

SEQ ID NO: 142077 - protein, 31 aa, Artificial Sequence
  Description of Artificial Sequence: Synthetic polypeptide
DESEVASTNPVSTEGYGNVAANTIQSRVGQR

SEQ ID NO: 142078 - protein, 35 aa, Artificial Sequence
  Description of Artificial Sequence: Synthetic polypeptide
DEEEIRTTNPVATEGYGQCVCSTEHQENFGSDFQA

SEQ ID NO: 142079 - protein, 31 aa, Artificial Sequence
  Description of Artificial Sequence: Synthetic polypeptide
DESEVASTNPVSTEGYGNVAANTIQSRVGPR

SEQ ID NO: 142080 - protein, 30 aa, Artificial Sequence
  Description of Artificial Sequence: Synthetic polypeptide
DESEVASTNPVSTEGYGNVAASTIQRVGQI

SEQ ID NO: 142081 - protein, 30 aa, Artificial Sequence
  Description of Artificial Sequence: Synthetic polypeptide
DESEVASTNPVSTEGYGNVAANTIQSRGQI

SEQ ID NO: 142082 - protein, 36 aa, Artificial Sequence
  Description of Artificial Sequence: Synthetic polypeptide
DEEEIRTTNPVATEQYGCVCSTTGEPQENFGSETQS

SEQ ID NO: 142083 - protein, 28 aa, Artificial Sequence
  Description of Artificial Sequence: Synthetic peptide
QEAEIACTNPVGTEGWGVSASGLQGGDH

SEQ ID NO: 142084 - protein, 35 aa, Artificial Sequence
  Description of Artificial Sequence: Synthetic polypeptide
DEEEIRTTNPVATEQYGCVCSTTGEHQENFTSDQA

SEQ ID NO: 142085 - protein, 30 aa, Artificial Sequence
  Description of Artificial Sequence: Synthetic polypeptide
DESEVASTNPVSTEGYGNVAANTIQHVGQR

SEQ ID NO: 142086 - protein, 31 aa, Artificial Sequence
  Description of Artificial Sequence: Synthetic polypeptide
DESEVASTNPVSTEGYGNVAANTIQERVGPR

SEQ ID NO: 142087 - protein, 36 aa, Artificial Sequence
  Description of Artificial Sequence: Synthetic polypeptide
DEEEIRTTNPVATEQYGCVCSTTGEHQENFLSDNQS

SEQ ID NO: 142088 - protein, 36 aa, Artificial Sequence
  Description of Artificial Sequence: Synthetic polypeptide
DEEEIRTTNPVATEQYGCVCSTTGETIENFGSENQS

SEQ ID NO: 142089 - protein, 37 aa, Artificial Sequence
  Description of Artificial Sequence: Synthetic polypeptide
DEEEIRTTNPVATEQYGCVCSTWGEDHQENGNSDNQL

SEQ ID NO: 142090 - protein, 34 aa, Artificial Sequence
  Description of Artificial Sequence: Synthetic polypeptide
DEEEIATTNPVATEQYGCVAANNGDTTTDDGNHQ

SEQ ID NO: 142091 - protein, 30 aa, Artificial Sequence
  Description of Artificial Sequence: Synthetic polypeptide
SENEIRTTNPIATEQWGDVSEIEMNAAGDA

SEQ ID NO: 142092 - protein, 36 aa, Artificial Sequence
  Description of Artificial Sequence: Synthetic polypeptide
DEEEIRTTNPVATEQYGCVCSTTPADPAEGSGSNPV

SEQ ID NO: 142093 - protein, 31 aa, Artificial Sequence
  Description of Artificial Sequence: Synthetic polypeptide
QEAEIACTNPCSYEQYGCVSWNLQSFGSQRA

SEQ ID NO: 142094 - protein, 37 aa, Artificial Sequence
  Description of Artificial Sequence: Synthetic polypeptide
DEEEIRTTNPVATEQYGCVCSTTPADNTEYFGMNPQA

SEQ ID NO: 142095 - protein, 35 aa, Artificial Sequence
  Description of Artificial Sequence: Synthetic polypeptide
DEEEIATTNPVATEQYGCVAATAGLTATMNGNDTQ

SEQ ID NO: 142096 - protein, 37 aa, Artificial Sequence
  Description of Artificial Sequence: Synthetic polypeptide
DEEEIRTTNPVATEQYGCVCSTTPADNNESFGSNPVL

SEQ ID NO: 142097 - protein, 36 aa, Artificial Sequence
  Description of Artificial Sequence: Synthetic polypeptide
DEEEIRTTNPVATEQYGCVCSTTPADNIEYFGGDPV

SEQ ID NO: 142098 - protein, 34 aa, Artificial Sequence
  Description of Artificial Sequence: Synthetic polypeptide
DEEEIRTTNPVATEGYGQCVCSWEHEQNFGSEQS

SEQ ID NO: 142099 - protein, 35 aa, Artificial Sequence
  Description of Artificial Sequence: Synthetic polypeptide
DEDEIRTTNPVATEAWGSVSTVVNVNNGNDEGEDG

SEQ ID NO: 142100 - protein, 31 aa, Artificial Sequence
  Description of Artificial Sequence: Synthetic polypeptide
QEGEIAPTNPCSSEQWGSVSCNLPQSEGETR

SEQ ID NO: 142101 - protein, 30 aa, Artificial Sequence
  Description of Artificial Sequence: Synthetic polypeptide
DESEVASTNPVSTEGYGNVANTLQSRVGQL

SEQ ID NO: 142102 - protein, 34 aa, Artificial Sequence
  Description of Artificial Sequence: Synthetic polypeptide
DEEEIATTNPVATEQYGCVAANQGLATMNPENNH

SEQ ID NO: 142103 - protein, 35 aa, Artificial Sequence
  Description of Artificial Sequence: Synthetic polypeptide
YEQEICTTNPVATEQYGSVSTTGDLQEDQEGGEDG

SEQ ID NO: 142104 - protein, 37 aa, Artificial Sequence
  Description of Artificial Sequence: Synthetic polypeptide
DEEEIRTTNPVATEQYGSVDNMNLNGDDQDQEDDDGN

SEQ ID NO: 142105 - protein, 30 aa, Artificial Sequence
  Description of Artificial Sequence: Synthetic polypeptide
DESEVASTNPVSTEGYGNVAETIQSRVGQR

SEQ ID NO: 142106 - protein, 37 aa, Artificial Sequence
  Description of Artificial Sequence: Synthetic polypeptide
DEEEIRTTNPVATEQYGSVNQPNPINLQANEMGGGQG

SEQ ID NO: 142107 - protein, 32 aa, Artificial Sequence
  Description of Artificial Sequence: Synthetic polypeptide
DESEVASTNPVSTEQYGNVCSANGIQSFVGND

SEQ ID NO: 142108 - protein, 32 aa, Artificial Sequence
  Description of Artificial Sequence: Synthetic polypeptide
DESEVASTNPVSTEQYGNVCSANGIQSRVGQD

SEQ ID NO: 142109 - protein, 32 aa, Artificial Sequence
  Description of Artificial Sequence: Synthetic polypeptide
DESEVASTNPVSTEQYGNVCSANTIQSRVGQD

SEQ ID NO: 142110 - protein, 37 aa, Artificial Sequence
  Description of Artificial Sequence: Synthetic polypeptide
DEEEIRTTNPVATEQYGSVISPDNNLGIEAVPENNMH

SEQ ID NO: 142111 - protein, 31 aa, Artificial Sequence
  Description of Artificial Sequence: Synthetic polypeptide
DESEVRSTNPVATEGWGNVAANIIMSRVGQR

SEQ ID NO: 142112 - protein, 37 aa, Artificial Sequence
  Description of Artificial Sequence: Synthetic polypeptide
AEEEIRTTNPVATEQYGSVSTNFNNENATETGTNVTE

SEQ ID NO: 142113 - protein, 31 aa, Artificial Sequence
  Description of Artificial Sequence: Synthetic polypeptide
DESEVATTNPVSTEQYGNVAAEVIQSRVEQR

SEQ ID NO: 142114 - protein, 31 aa, Artificial Sequence
  Description of Artificial Sequence: Synthetic polypeptide
DESEVATTNPVSTEQYGNVAAEVIQSRVEER

SEQ ID NO: 142115 - protein, 34 aa, Artificial Sequence
  Description of Artificial Sequence: Synthetic polypeptide
DESCIRTTNPVAYEQWGEAYLNEDLHGQRGDNPR

SEQ ID NO: 142116 - protein, 34 aa, Artificial Sequence
  Description of Artificial Sequence: Synthetic polypeptide
SENAIRTTNPVATEQYGSTVSVTVLEFEGGDDQN

SEQ ID NO: 142117 - protein, 31 aa, Artificial Sequence
  Description of Artificial Sequence: Synthetic polypeptide
DESEVATTNPVSTEQYGNVAAETIQSRVEQR

SEQ ID NO: 142118 - protein, 33 aa, Artificial Sequence
  Description of Artificial Sequence: Synthetic polypeptide
DESCIRTTNPVAYEQWGESYNVDQHGQRGENPM

SEQ ID NO: 142119 - protein, 33 aa, Artificial Sequence
  Description of Artificial Sequence: Synthetic polypeptide
YESEIRTTNPVATECWGSVSCINEYQDREFEGG

SEQ ID NO: 142120 - protein, 31 aa, Artificial Sequence
  Description of Artificial Sequence: Synthetic polypeptide
DESEVATTNPVSTEGYGNVSACTIQSRVGQG

SEQ ID NO: 142121 - protein, 33 aa, Artificial Sequence
  Description of Artificial Sequence: Synthetic polypeptide
DESCIRTTNPVAYEQWGESYPEDLHGQRGDNPA

SEQ ID NO: 142122 - protein, 31 aa, Artificial Sequence
  Description of Artificial Sequence: Synthetic polypeptide
DESEVATTNPVSTEGYGNVANITIQSRVGQR

SEQ ID NO: 142123 - protein, 31 aa, Artificial Sequence
  Description of Artificial Sequence: Synthetic polypeptide
DESEVATTNPVSTEGYGNVANITEQSRVGQR

SEQ ID NO: 142124 - protein, 32 aa, Artificial Sequence
  Description of Artificial Sequence: Synthetic polypeptide
DESEVATTNPVSTEPYGTISANEDIQQRNGNH

SEQ ID NO: 142125 - protein, 37 aa, Artificial Sequence
  Description of Artificial Sequence: Synthetic polypeptide
DEEEIRTTNPVATEGYGSVISTTPDGPNMGNGENDGD

SEQ ID NO: 142126 - protein, 35 aa, Artificial Sequence
  Description of Artificial Sequence: Synthetic polypeptide
DESCIRTTNPVATEQYGSVWMTNNTTQPEENQDDD

SEQ ID NO: 142127 - protein, 32 aa, Artificial Sequence
  Description of Artificial Sequence: Synthetic polypeptide
DESEVRSTNPVATEGYGNVWAANTIQSRVGQI

SEQ ID NO: 142128 - protein, 33 aa, Artificial Sequence
  Description of Artificial Sequence: Synthetic polypeptide
DESEVRTTNPVATEGWGNVSACNEPQSRVGEQG

SEQ ID NO: 142129 - protein, 35 aa, Artificial Sequence
  Description of Artificial Sequence: Synthetic polypeptide
DESCIRTTNPVATEQYGSVITPTNLETRFEDTYQI

SEQ ID NO: 142130 - protein, 34 aa, Artificial Sequence
  Description of Artificial Sequence: Synthetic polypeptide
SEMEIRTTNPVATEQYGCVISTVNYLDEFDEDQE

SEQ ID NO: 142131 - protein, 38 aa, Artificial Sequence
  Description of Artificial Sequence: Synthetic polypeptide
DEEEIRTTNPVATEQYGSVISPTYNSETEERSDEQNVT

SEQ ID NO: 142132 - protein, 36 aa, Artificial Sequence
  Description of Artificial Sequence: Synthetic polypeptide
DEEEIRTTNPVATEQYGSVISPWDNTPAAFEGTTSE

SEQ ID NO: 142133 - protein, 30 aa, Artificial Sequence
  Description of Artificial Sequence: Synthetic polypeptide
QEEEIATTNPVATEQYGEAWPEVHCQHEEK

SEQ ID NO: 142134 - protein, 33 aa, Artificial Sequence
  Description of Artificial Sequence: Synthetic polypeptide
SEMEIVTTNPVATEQYGTVCSATDGPVEFGGND

SEQ ID NO: 142135 - protein, 28 aa, Artificial Sequence
  Description of Artificial Sequence: Synthetic peptide
QEGEIAPTNPCSSEQYGIASCNLQSEEK

SEQ ID NO: 142136 - protein, 36 aa, Artificial Sequence
  Description of Artificial Sequence: Synthetic polypeptide
DEEEIRTTNPVATEQYGCVCSVSGEHNQNFSSNNQA

SEQ ID NO: 142137 - protein, 35 aa, Artificial Sequence
  Description of Artificial Sequence: Synthetic polypeptide
DEEEIRTTNPVATEQYGCVCSVSGEHNQNFISEQS

SEQ ID NO: 142138 - protein, 36 aa, Artificial Sequence
  Description of Artificial Sequence: Synthetic polypeptide
DEEEIRTTNPVATEQYGCVCSVSGEHNQNFISDNIA

SEQ ID NO: 142139 - protein, 32 aa, Artificial Sequence
  Description of Artificial Sequence: Synthetic polypeptide
SEMEIVTTNPIATEQYGTVCSATDGPMFEGND

SEQ ID NO: 142140 - protein, 35 aa, Artificial Sequence
  Description of Artificial Sequence: Synthetic polypeptide
DEEEIRTTNPVATEQYGCVCSVSGEHNANFNSDIS

SEQ ID NO: 142141 - protein, 33 aa, Artificial Sequence
  Description of Artificial Sequence: Synthetic polypeptide
SEMEIVTTNPVATEQYGTVCSATDGPVEFEGND

SEQ ID NO: 142142 - protein, 35 aa, Artificial Sequence
  Description of Artificial Sequence: Synthetic polypeptide
SEMEIRTTNPVATEQYGSVSELPAEQMEGLMEERN

SEQ ID NO: 142143 - protein, 37 aa, Artificial Sequence
  Description of Artificial Sequence: Synthetic polypeptide
DEEEIRTTNPVATEQYGSVISPDSNYYQPTENEVDNQ

SEQ ID NO: 142144 - protein, 28 aa, Artificial Sequence
  Description of Artificial Sequence: Synthetic peptide
QEGEIAPTNPCSSEQYGEASCNLQSEEK

SEQ ID NO: 142145 - protein, 34 aa, Artificial Sequence
  Description of Artificial Sequence: Synthetic polypeptide
DEEEIRTTNPVATEQYGSVDICHNNNEVILEVYE

SEQ ID NO: 142146 - protein, 36 aa, Artificial Sequence
  Description of Artificial Sequence: Synthetic polypeptide
DEEEIRTTNPVATEQYGCVCSTWGEHNQENFNSEQS

SEQ ID NO: 142147 - protein, 34 aa, Artificial Sequence
  Description of Artificial Sequence: Synthetic polypeptide
DESDEIATTNPVAYEQWGSVSGTNGENQGQMNGA

SEQ ID NO: 142148 - protein, 30 aa, Artificial Sequence
  Description of Artificial Sequence: Synthetic polypeptide
QEEEIATTNPVATEQYGEAYMEVQMQHEEK

SEQ ID NO: 142149 - protein, 32 aa, Artificial Sequence
  Description of Artificial Sequence: Synthetic polypeptide
DESEVATTNPVATECYGNVSACITIQDRVGQG

SEQ ID NO: 142150 - protein, 36 aa, Artificial Sequence
  Description of Artificial Sequence: Synthetic polypeptide
DEEEIRTTNPVATEQYGCVCSTWGEHNQENFNSDQS

SEQ ID NO: 142151 - protein, 37 aa, Artificial Sequence
  Description of Artificial Sequence: Synthetic polypeptide
DEEEIRTTNPVATEQYGCVCSTWGEHNQEGFNSDNQA

SEQ ID NO: 142152 - protein, 35 aa, Artificial Sequence
  Description of Artificial Sequence: Synthetic polypeptide
DEEEIATTNPVATEQYGSVCAMNPEEAPDNQGENH

SEQ ID NO: 142153 - protein, 30 aa, Artificial Sequence
  Description of Artificial Sequence: Synthetic polypeptide
SENEIATTNPVATECYGDVSSECPQHETLI

SEQ ID NO: 142154 - protein, 31 aa, Artificial Sequence
  Description of Artificial Sequence: Synthetic polypeptide
DESEVASVNPVSTEQYGVVSANNLQSSVGQQ

SEQ ID NO: 142155 - protein, 36 aa, Artificial Sequence
  Description of Artificial Sequence: Synthetic polypeptide
DEEEIRTTNPVATEQYGCVCSTWGEHNEENFGSDQS

SEQ ID NO: 142156 - protein, 35 aa, Artificial Sequence
  Description of Artificial Sequence: Synthetic polypeptide
DESDEICTTNPVAYEHWGSVSTGGQLGDHQGGNQR

SEQ ID NO: 142157 - protein, 34 aa, Artificial Sequence
  Description of Artificial Sequence: Synthetic polypeptide
DESDEICTTNPVAYEHWGSVSTGQLGDIQGGNTS

SEQ ID NO: 142158 - protein, 31 aa, Artificial Sequence
  Description of Artificial Sequence: Synthetic polypeptide
DESEVASVNPVSTEQYGNVSANNLQSSVGQQ

SEQ ID NO: 142159 - protein, 35 aa, Artificial Sequence
  Description of Artificial Sequence: Synthetic polypeptide
DEEEIRTTNPVATEQYGCVCSTWGEHESFGSETQT

SEQ ID NO: 142160 - protein, 36 aa, Artificial Sequence
  Description of Artificial Sequence: Synthetic polypeptide
DEEEIRTTNPVATEQYGCVCSTWGEHNIENFNSDQS

SEQ ID NO: 142161 - protein, 32 aa, Artificial Sequence
  Description of Artificial Sequence: Synthetic polypeptide
DESEVATTNPVSTEGYGNVAACTEPQSRVGQR

SEQ ID NO: 142162 - protein, 31 aa, Artificial Sequence
  Description of Artificial Sequence: Synthetic polypeptide
DESEVATTNPVATEGWGNVAACTEQDRVGQR

SEQ ID NO: 142163 - protein, 36 aa, Artificial Sequence
  Description of Artificial Sequence: Synthetic polypeptide
DEEEIRTTNPVATEGYGSVDPVGIMGELDQQGNGGQ

SEQ ID NO: 142164 - protein, 32 aa, Artificial Sequence
  Description of Artificial Sequence: Synthetic polypeptide
DESEVATTNPVSTEGYGNVAACTEPQSREGQR

SEQ ID NO: 142165 - protein, 31 aa, Artificial Sequence
  Description of Artificial Sequence: Synthetic polypeptide
DESEVATTNPVSTEGYGEAAANTCQSRVGQR

SEQ ID NO: 142166 - protein, 29 aa, Artificial Sequence
  Description of Artificial Sequence: Synthetic peptide
QDSEIATTNPVSTEGYGEVAETCQRVEQR

SEQ ID NO: 142167 - protein, 35 aa, Artificial Sequence
  Description of Artificial Sequence: Synthetic polypeptide
DESEVATTNPVATEQYGNVSATNPAGPNSRNGMNV

SEQ ID NO: 142168 - protein, 37 aa, Artificial Sequence
  Description of Artificial Sequence: Synthetic polypeptide
DEEEIRTTNPVATEQYGCVCSTWPADNAERFGSEPVL

SEQ ID NO: 142169 - protein, 35 aa, Artificial Sequence
  Description of Artificial Sequence: Synthetic polypeptide
DEDEIRTTNPVATEAWGVVSTVVNNQQGTNNEQGS

SEQ ID NO: 142170 - protein, 31 aa, Artificial Sequence
  Description of Artificial Sequence: Synthetic polypeptide
DESEVATTNPVATEGWGNVAACTEQSRVGQR

SEQ ID NO: 142171 - protein, 36 aa, Artificial Sequence
  Description of Artificial Sequence: Synthetic polypeptide
DEEEIRTTNPVATEQYGCVCSTWMEHNAEYFNSQQA

SEQ ID NO: 142172 - protein, 33 aa, Artificial Sequence
  Description of Artificial Sequence: Synthetic polypeptide
DESCIRTTNPVAYEQWGESYSVDEHGQRGDNPG

SEQ ID NO: 142173 - protein, 32 aa, Artificial Sequence
  Description of Artificial Sequence: Synthetic polypeptide
DESEVATTNPVATEGWGSVACTEPQSREGEQG

SEQ ID NO: 142174 - protein, 34 aa, Artificial Sequence
  Description of Artificial Sequence: Synthetic polypeptide
DEEEIATTNPVATEQYGCVAATNDATPSPMENWQ

SEQ ID NO: 142175 - protein, 37 aa, Artificial Sequence
  Description of Artificial Sequence: Synthetic polypeptide
DEEEIRTTNPVATEGYGSVTDGEGNLNQNNEGGNIQG

SEQ ID NO: 142176 - protein, 33 aa, Artificial Sequence
  Description of Artificial Sequence: Synthetic polypeptide
DESEVATTNPVATEGWGSVACINEPQSREGENG

SEQ ID NO: 142177 - protein, 33 aa, Artificial Sequence
  Description of Artificial Sequence: Synthetic polypeptide
DESEVATTNPVATEGWGSVAACTEPQSREGEQR

SEQ ID NO: 142178 - protein, 32 aa, Artificial Sequence
  Description of Artificial Sequence: Synthetic polypeptide
YESEIRSVNPVATECWGVVSCINEQDREGENG

SEQ ID NO: 142179 - protein, 35 aa, Artificial Sequence
  Description of Artificial Sequence: Synthetic polypeptide
DEEEIATTNPVATEQWGSVSMNGGGEPGGNGMEVV

SEQ ID NO: 142180 - protein, 29 aa, Artificial Sequence
  Description of Artificial Sequence: Synthetic peptide
DESEIASTNPVGTEGYGNMAANTIQHGQI

SEQ ID NO: 142181 - protein, 32 aa, Artificial Sequence
  Description of Artificial Sequence: Synthetic polypeptide
DESEIASTNPVGTEGYGSMACINEQDREGENG

SEQ ID NO: 142182 - protein, 33 aa, Artificial Sequence
  Description of Artificial Sequence: Synthetic polypeptide
SSEEIRTTNPVATHQYGCVCSNTEHNQNFGSDQ

SEQ ID NO: 142183 - protein, 30 aa, Artificial Sequence
  Description of Artificial Sequence: Synthetic polypeptide
QEEEIATTNPVATEQYGEAPFEVICQHEEK

SEQ ID NO: 142184 - protein, 36 aa, Artificial Sequence
  Description of Artificial Sequence: Synthetic polypeptide
DEEEIRTTNPVATEQYGCVCSTGEDHQEHFGSETQP

SEQ ID NO: 142185 - protein, 28 aa, Artificial Sequence
  Description of Artificial Sequence: Synthetic peptide
QEEGIATVNPVATEQYGEAPEVCQHEEK

SEQ ID NO: 142186 - protein, 36 aa, Artificial Sequence
  Description of Artificial Sequence: Synthetic polypeptide
DEEEIRTTNPVATEQYGCVCSTGEDPNQENFGSEQS

SEQ ID NO: 142187 - protein, 34 aa, Artificial Sequence
  Description of Artificial Sequence: Synthetic polypeptide
SSEEIRTTNPVATDQYGSVYSPWIVEQRGQTDIF

SEQ ID NO: 142188 - protein, 35 aa, Artificial Sequence
  Description of Artificial Sequence: Synthetic polypeptide
DEEEIRTTNPVATEPYGSISSMPDGPNMRNGMNPV

SEQ ID NO: 142189 - protein, 36 aa, Artificial Sequence
  Description of Artificial Sequence: Synthetic polypeptide
AEEEIRTTNPVATEQYGMVSSTTPAGPNMRNGMNPV

SEQ ID NO: 142190 - protein, 36 aa, Artificial Sequence
  Description of Artificial Sequence: Synthetic polypeptide
DEEEIRTTNPVATEQYGCVCSTGEDPQEFFNSDTQA

SEQ ID NO: 142191 - protein, 34 aa, Artificial Sequence
  Description of Artificial Sequence: Synthetic polypeptide
QECEICTTNPVATEAYGVVSTEQQLQSGNEEQGQ

SEQ ID NO: 142192 - protein, 33 aa, Artificial Sequence
  Description of Artificial Sequence: Synthetic polypeptide
SSEEIRTTNPVATDQYGSVVDQGIGQGGQGNEQ

SEQ ID NO: 142193 - protein, 33 aa, Artificial Sequence
  Description of Artificial Sequence: Synthetic polypeptide
QECEICTTNPVATEAYGVVSTEQQLQQQGEEQA

SEQ ID NO: 142194 - protein, 35 aa, Artificial Sequence
  Description of Artificial Sequence: Synthetic polypeptide
DEEEIRTTNPVATEQYGSVDYPTPTLANNIIPFEI

SEQ ID NO: 142195 - protein, 33 aa, Artificial Sequence
  Description of Artificial Sequence: Synthetic polypeptide
QECEICTTNPVATEAYGVVSTEQQLQQGTEEQL

SEQ ID NO: 142196 - protein, 38 aa, Artificial Sequence
  Description of Artificial Sequence: Synthetic polypeptide
DEEEIRTTNPVATEQYGSVDYPSSNMLEQERDTPSQDF

SEQ ID NO: 142197 - protein, 34 aa, Artificial Sequence
  Description of Artificial Sequence: Synthetic polypeptide
SSEEIRTTNPVATDQYGSVSTGDGQQEEGQGEGQ

SEQ ID NO: 142198 - protein, 33 aa, Artificial Sequence
  Description of Artificial Sequence: Synthetic polypeptide
QEEGIRTTNPAATEQYGSVSTGGGDQNDDQEDD

SEQ ID NO: 142199 - protein, 33 aa, Artificial Sequence
  Description of Artificial Sequence: Synthetic polypeptide
DECEIATTNPVATEPYGSVCYNNDHDTGHNDHE

SEQ ID NO: 142200 - protein, 36 aa, Artificial Sequence
  Description of Artificial Sequence: Synthetic polypeptide
DEEEIRTTNPVATEQYGSVDTVMQMNGGDDEEDGQE

SEQ ID NO: 142201 - protein, 36 aa, Artificial Sequence
  Description of Artificial Sequence: Synthetic polypeptide
YEEEIRTTNPVCTEQYGSVSSTTPAGPNMRNGMNPV

SEQ ID NO: 142202 - protein, 37 aa, Artificial Sequence
  Description of Artificial Sequence: Synthetic polypeptide
DEEEIRTTNPVATEQYGSVDTVMTGQGGDEDNEDGQF

SEQ ID NO: 142203 - protein, 35 aa, Artificial Sequence
  Description of Artificial Sequence: Synthetic polypeptide
SSEEIRTTNPVATDQYGSVCSPWWEVEQRGQNDIF

SEQ ID NO: 142204 - protein, 33 aa, Artificial Sequence
  Description of Artificial Sequence: Synthetic polypeptide
QECEICTTNPVATEAYGVVSTEQQLQQGEEQET

SEQ ID NO: 142205 - protein, 36 aa, Artificial Sequence
  Description of Artificial Sequence: Synthetic polypeptide
DEEEIRTTNPVATEPYGSISSTTEAIPNMRNGMNPH

SEQ ID NO: 142206 - protein, 33 aa, Artificial Sequence
  Description of Artificial Sequence: Synthetic polypeptide
SSEEIRTTNPVATDQYGSVIVDEGGQDGQGNEQ

SEQ ID NO: 142207 - protein, 34 aa, Artificial Sequence
  Description of Artificial Sequence: Synthetic polypeptide
QECEICTTNPVATEAYGVVSTEQQLQQGNEEQLG

SEQ ID NO: 142208 - protein, 34 aa, Artificial Sequence
  Description of Artificial Sequence: Synthetic polypeptide
DEDEIRTTNPCATECYGSVSTGNPNGNAGEHGQE

SEQ ID NO: 142209 - protein, 37 aa, Artificial Sequence
  Description of Artificial Sequence: Synthetic polypeptide
DEEEIRTTNPVATEQYGSVDTVMTGQGGDEDTEDGNN

SEQ ID NO: 142210 - protein, 36 aa, Artificial Sequence
  Description of Artificial Sequence: Synthetic polypeptide
QEEGIRTTNPVATEQYGSVSTDNGLGEVGEQEDQGQ

SEQ ID NO: 142211 - protein, 38 aa, Artificial Sequence
  Description of Artificial Sequence: Synthetic polypeptide
DEEEIRTTNPVATEQYGSVDVPSLNMLEQERDIPSQDE

SEQ ID NO: 142212 - protein, 34 aa, Artificial Sequence
  Description of Artificial Sequence: Synthetic polypeptide
SSEEIRTTNPVATDQYGSVSTGDGDQENGQGEGQ

SEQ ID NO: 142213 - protein, 35 aa, Artificial Sequence
  Description of Artificial Sequence: Synthetic polypeptide
DEEEIRTTNPVATEQYGCVCSTGEHAEHFISENQS

SEQ ID NO: 142214 - protein, 36 aa, Artificial Sequence
  Description of Artificial Sequence: Synthetic polypeptide
DEEEIRTTNPVATEQYGCVCSTGEDHQEFFNSDFQS

SEQ ID NO: 142215 - protein, 33 aa, Artificial Sequence
  Description of Artificial Sequence: Synthetic polypeptide
DESEIATTNPCASECWGSVSCINEPQDREGENG

SEQ ID NO: 142216 - protein, 33 aa, Artificial Sequence
  Description of Artificial Sequence: Synthetic polypeptide
SSEEIRTTNPVATHQYGCVCSSGELQNFGSDQS

SEQ ID NO: 142217 - protein, 30 aa, Artificial Sequence
  Description of Artificial Sequence: Synthetic polypeptide
QEEEIATTNPVATEQYGEAPEWVYCQHEEK

SEQ ID NO: 142218 - protein, 37 aa, Artificial Sequence
  Description of Artificial Sequence: Synthetic polypeptide
DEEEIRTTNPVATEQYGCVCSTGEDHNQENFGSQNQS

SEQ ID NO: 142219 - protein, 37 aa, Artificial Sequence
  Description of Artificial Sequence: Synthetic polypeptide
DEEEIRTTNPVATEQYGCVCSTGEDHNQENFGSNTQS

SEQ ID NO: 142220 - protein, 36 aa, Artificial Sequence
  Description of Artificial Sequence: Synthetic polypeptide
DEEEIRTTNPVATEQYGCVCSTGEDHNQENFGSEQS

SEQ ID NO: 142221 - protein, 34 aa, Artificial Sequence
  Description of Artificial Sequence: Synthetic polypeptide
QECEICTTNPVATEAYGVVSTNQQQLQQGTEEDE

SEQ ID NO: 142222 - protein, 36 aa, Artificial Sequence
  Description of Artificial Sequence: Synthetic polypeptide
DEEEIRTTNPVATEQYGCVCSTGEDHNQEGFGSDQP

SEQ ID NO: 142223 - protein, 34 aa, Artificial Sequence
  Description of Artificial Sequence: Synthetic polypeptide
AEEEIRTTNPVATEQYGCVCSWGEHNQNFNSDQS

SEQ ID NO: 142224 - protein, 34 aa, Artificial Sequence
  Description of Artificial Sequence: Synthetic polypeptide
AEEEIRTTNPVATEQYGCVCSWEHQENFGSDTQS

SEQ ID NO: 142225 - protein, 33 aa, Artificial Sequence
  Description of Artificial Sequence: Synthetic polypeptide
DESEIATTNPVATAAWGSVSGANEPQDKGGENG

SEQ ID NO: 142226 - protein, 33 aa, Artificial Sequence
  Description of Artificial Sequence: Synthetic polypeptide
DEDEIRTTNPCATECYGSVATGNTGNAGEDGDS

SEQ ID NO: 142227 - protein, 33 aa, Artificial Sequence
  Description of Artificial Sequence: Synthetic polypeptide
DESEIATTNPVATAAWGSVSGINEPQDNGDENG

SEQ ID NO: 142228 - protein, 34 aa, Artificial Sequence
  Description of Artificial Sequence: Synthetic polypeptide
DESEIATTNPVATAAWGSVSGINEPQDRGGENGN

SEQ ID NO: 142229 - protein, 35 aa, Artificial Sequence
  Description of Artificial Sequence: Synthetic polypeptide
AEEEIRTTNPVATEQYGCVCSWEEHNANFGSQNQS

SEQ ID NO: 142230 - protein, 35 aa, Artificial Sequence
  Description of Artificial Sequence: Synthetic polypeptide
DESEIRTTNPVGTEQYGVVSSTTPAGPNRNGMNPV

SEQ ID NO: 142231 - protein, 33 aa, Artificial Sequence
  Description of Artificial Sequence: Synthetic polypeptide
DEEEIRTTNPVATEGYGCVCFTEDDTYFGSDQS

SEQ ID NO: 142232 - protein, 32 aa, Artificial Sequence
  Description of Artificial Sequence: Synthetic polypeptide
SSEEIRTTNPVATCQYGCVCSWEHNQNFGSDQ

SEQ ID NO: 142233 - protein, 33 aa, Artificial Sequence
  Description of Artificial Sequence: Synthetic polypeptide
SSEEIRTTNPVATHQYGQCVCSWELQNFGSDQS

SEQ ID NO: 142234 - protein, 34 aa, Artificial Sequence
  Description of Artificial Sequence: Synthetic polypeptide
AEEEIRTTNPVATEQYGCVCSWGEHQNFNSDTQS

SEQ ID NO: 142235 - protein, 36 aa, Artificial Sequence
  Description of Artificial Sequence: Synthetic polypeptide
DEEEIRTTNPVATEPYGSISSTTPAIPNMRNGMNPH

SEQ ID NO: 142236 - protein, 36 aa, Artificial Sequence
  Description of Artificial Sequence: Synthetic polypeptide
DEEEIRTTNPVATEQYGSVEDPTTPQQQRIEVEVMI

SEQ ID NO: 142237 - protein, 35 aa, Artificial Sequence
  Description of Artificial Sequence: Synthetic polypeptide
DEEEIATTNPVATEQYGSVCAATMHGEQTIDGEQH

SEQ ID NO: 142238 - protein, 35 aa, Artificial Sequence
  Description of Artificial Sequence: Synthetic polypeptide
TEEEIRSTNPVAYEQYGSTVSCTGEMQIDMGENNA

SEQ ID NO: 142239 - protein, 35 aa, Artificial Sequence
  Description of Artificial Sequence: Synthetic polypeptide
DEDEIRTTNPCATECYGSVSTGNEANGNAGEHDAE

SEQ ID NO: 142240 - protein, 32 aa, Artificial Sequence
  Description of Artificial Sequence: Synthetic polypeptide
QECEICTTNPVATEAYGVVSTEQTLQGTEEQL

SEQ ID NO: 142241 - protein, 34 aa, Artificial Sequence
  Description of Artificial Sequence: Synthetic polypeptide
AEEEIRTTNPVATEQYGCVCSWGEHQEGFGSEQN

SEQ ID NO: 142242 - protein, 30 aa, Artificial Sequence
  Description of Artificial Sequence: Synthetic polypeptide
QEEEIATTNPVATEQYGEAPEYVCQEHEEK

SEQ ID NO: 142243 - protein, 36 aa, Artificial Sequence
  Description of Artificial Sequence: Synthetic polypeptide
DEEEIRTTNPVATEQYGCVCSTGEDHNQNFFSDNQS

SEQ ID NO: 142244 - protein, 34 aa, Artificial Sequence
  Description of Artificial Sequence: Synthetic polypeptide
DEEEIRTTNPVATEQYGSVEGWNGMDIPMFFLSQ

SEQ ID NO: 142245 - protein, 34 aa, Artificial Sequence
  Description of Artificial Sequence: Synthetic polypeptide
DEEEIRTTNPVATEGYGCVCFTENHNTNGGSDQS

SEQ ID NO: 142246 - protein, 36 aa, Artificial Sequence
  Description of Artificial Sequence: Synthetic polypeptide
DEEEIRTTNPVATEQYGCVCSTGEDHNQFFNSEFQS

SEQ ID NO: 142247 - protein, 34 aa, Artificial Sequence
  Description of Artificial Sequence: Synthetic polypeptide
DEDEIRTTNPCATECYGSVATTGNTGNAGETDNS

SEQ ID NO: 142248 - protein, 35 aa, Artificial Sequence
  Description of Artificial Sequence: Synthetic polypeptide
DEEEIRTTNPVATEQYGSVIPTAMVIQPVVEMMLV

SEQ ID NO: 142249 - protein, 35 aa, Artificial Sequence
  Description of Artificial Sequence: Synthetic polypeptide
DEEEIRTTNPVATEQYGSVEGWNGMDGIPMEFESG

SEQ ID NO: 142250 - protein, 30 aa, Artificial Sequence
  Description of Artificial Sequence: Synthetic polypeptide
QEEEVASTNPVATEQYGNVAETCQSHVGQK

SEQ ID NO: 142251 - protein, 33 aa, Artificial Sequence
  Description of Artificial Sequence: Synthetic polypeptide
DECEIATTNPVATEPYGSVCYNNDHDTGGDDRS

SEQ ID NO: 142252 - protein, 33 aa, Artificial Sequence
  Description of Artificial Sequence: Synthetic polypeptide
SSEEIRTTNPVATCQYGCVCSTEHQNFGSDTFA

SEQ ID NO: 142253 - protein, 32 aa, Artificial Sequence
  Description of Artificial Sequence: Synthetic polypeptide
YEEEIRTVNPVSTEPYGVVSDEDIQQQSNGNH

SEQ ID NO: 142254 - protein, 30 aa, Artificial Sequence
  Description of Artificial Sequence: Synthetic polypeptide
DESEIASTNPVSTEGYGTMSMDIQQHNGNI

SEQ ID NO: 142255 - protein, 35 aa, Artificial Sequence
  Description of Artificial Sequence: Synthetic polypeptide
SQEEIRTTNPVAYEQWGVVSSCTNMQSADPGNYRA

SEQ ID NO: 142256 - protein, 34 aa, Artificial Sequence
  Description of Artificial Sequence: Synthetic polypeptide
AEEEIRTTNPVATEQYGQCVCSWEEHQFFGSDQA

SEQ ID NO: 142257 - protein, 32 aa, Artificial Sequence
  Description of Artificial Sequence: Synthetic polypeptide
DESEIRTTNPVSTEPWGTISCINIQQDQNGNG

SEQ ID NO: 142258 - protein, 32 aa, Artificial Sequence
  Description of Artificial Sequence: Synthetic polypeptide
DESEIRTTNPVSTEPWGTISMINIQQDQNGNG

SEQ ID NO: 142259 - protein, 34 aa, Artificial Sequence
  Description of Artificial Sequence: Synthetic polypeptide
AEEEIRTTNPVATEQYGQCVCSWEHQENFGSEQM

SEQ ID NO: 142260 - protein, 30 aa, Artificial Sequence
  Description of Artificial Sequence: Synthetic polypeptide
SQEEIRTTNPVATTRWGTYSWNLTEEPINI

SEQ ID NO: 142261 - protein, 35 aa, Artificial Sequence
  Description of Artificial Sequence: Synthetic polypeptide
DEEEIATTNPVATEQYGSVCAATNPEEAEAEIQNN

SEQ ID NO: 142262 - protein, 32 aa, Artificial Sequence
  Description of Artificial Sequence: Synthetic polypeptide
DESEIRTTNPVSTEPYGFISMEDIQQQQNGNH

SEQ ID NO: 142263 - protein, 35 aa, Artificial Sequence
  Description of Artificial Sequence: Synthetic polypeptide
DEEEIATTNPVATEQYGSVCAATNPEEAEAEMNFE

SEQ ID NO: 142264 - protein, 35 aa, Artificial Sequence
  Description of Artificial Sequence: Synthetic polypeptide
DEEEIATTNPVATEQYGSVCAATNPEEAEAEMNGN

SEQ ID NO: 142265 - protein, 36 aa, Artificial Sequence
  Description of Artificial Sequence: Synthetic polypeptide
DEEEIRTTNPVATEQYGCVCSTGEHNQENFGSDFQI

SEQ ID NO: 142266 - protein, 31 aa, Artificial Sequence
  Description of Artificial Sequence: Synthetic polypeptide
AEAEIACTNPVAYEWYGEASCENLSQRVGSS

SEQ ID NO: 142267 - protein, 33 aa, Artificial Sequence
  Description of Artificial Sequence: Synthetic polypeptide
SQEEIRTTNPVATEQYGCVWNTSVLELRPETKE

SEQ ID NO: 142268 - protein, 34 aa, Artificial Sequence
  Description of Artificial Sequence: Synthetic polypeptide
QECEICTTNPVATEAYGVVSTEQLQQGNEGEQLT

SEQ ID NO: 142269 - protein, 32 aa, Artificial Sequence
  Description of Artificial Sequence: Synthetic polypeptide
AEAEIACTNPVAYEQYGQASCENLSQRVGGTS

SEQ ID NO: 142270 - protein, 32 aa, Artificial Sequence
  Description of Artificial Sequence: Synthetic polypeptide
DESEIRTTNPVSTEPYGTISCEDIQQQQNGNH

SEQ ID NO: 142271 - protein, 32 aa, Artificial Sequence
  Description of Artificial Sequence: Synthetic polypeptide
DESEIRTTNPVSTEPYGTISCEDEQQQQNGNH

SEQ ID NO: 142272 - protein, 29 aa, Artificial Sequence
  Description of Artificial Sequence: Synthetic peptide
QEEHIATTNPVATEQYGEAPEVCQHEEKW

SEQ ID NO: 142273 - protein, 34 aa, Artificial Sequence
  Description of Artificial Sequence: Synthetic polypeptide
AEEEIRTTNPVATEQYGQCVCSWGEHQNFGSDQF

SEQ ID NO: 142274 - protein, 29 aa, Artificial Sequence
  Description of Artificial Sequence: Synthetic peptide
DESEIASTNPVSTEGYGTMAMETIQHGNI

SEQ ID NO: 142275 - protein, 29 aa, Artificial Sequence
  Description of Artificial Sequence: Synthetic peptide
QEEHIATTNPVATEQYGEAPAVCQHEEKT

SEQ ID NO: 142276 - protein, 36 aa, Artificial Sequence
  Description of Artificial Sequence: Synthetic polypeptide
DEEEIRTTNPVATEQYGCVCSTGEHNQEFFNSETQE

SEQ ID NO: 142277 - protein, 30 aa, Artificial Sequence
  Description of Artificial Sequence: Synthetic polypeptide
DESEIASTNPVSTEGYGTMASDIQQHNGNI

SEQ ID NO: 142278 - protein, 36 aa, Artificial Sequence
  Description of Artificial Sequence: Synthetic polypeptide
DEEEIRTTNPVATEQYGSVIQANMGEEQPEGEVPEI

SEQ ID NO: 142279 - protein, 32 aa, Artificial Sequence
  Description of Artificial Sequence: Synthetic polypeptide
SQEEIRTTNPVATEQWGTYSWNALIENEPINK

SEQ ID NO: 142280 - protein, 35 aa, Artificial Sequence
  Description of Artificial Sequence: Synthetic polypeptide
DEEEIRTTNPVATEQYGCVCSTGEHNQENFTSEQA

SEQ ID NO: 142281 - protein, 35 aa, Artificial Sequence
  Description of Artificial Sequence: Synthetic polypeptide
QEEGIRTTNPVATEQYGSVSTTGGEEGGNQGNGGN

SEQ ID NO: 142282 - protein, 33 aa, Artificial Sequence
  Description of Artificial Sequence: Synthetic polypeptide
DECEIATTNPVATEPYGSVCYNNDDQDQDNNDP

SEQ ID NO: 142283 - protein, 33 aa, Artificial Sequence
  Description of Artificial Sequence: Synthetic polypeptide
SQEEIRTTNPVATEQYGCMATSVLETRPENKEA

SEQ ID NO: 142284 - protein, 36 aa, Artificial Sequence
  Description of Artificial Sequence: Synthetic polypeptide
QEEGIRTTNPVATEQYGSVSVTNGGEETGGQGNQEN

SEQ ID NO: 142285 - protein, 36 aa, Artificial Sequence
  Description of Artificial Sequence: Synthetic polypeptide
DEEEIRTTNPVATEQYGCVCSTGEHNQEFFNSDTQS

SEQ ID NO: 142286 - protein, 32 aa, Artificial Sequence
  Description of Artificial Sequence: Synthetic polypeptide
YEEEIRTVNPVSTEPYGTVSDEDIQQQSNGNH

SEQ ID NO: 142287 - protein, 33 aa, Artificial Sequence
  Description of Artificial Sequence: Synthetic polypeptide
SQGEIRTTNPVATEQYGSVNCVNELELMFGQQE

SEQ ID NO: 142288 - protein, 34 aa, Artificial Sequence
  Description of Artificial Sequence: Synthetic polypeptide
QECEICTTNPVATEAYGVVSTEQQLQNGNDEQLN

SEQ ID NO: 142289 - protein, 32 aa, Artificial Sequence
  Description of Artificial Sequence: Synthetic polypeptide
DESEIRTTNPVSTECWGTISCENIPQQQNGNH

SEQ ID NO: 142290 - protein, 32 aa, Artificial Sequence
  Description of Artificial Sequence: Synthetic polypeptide
DESEIRTTNPVSTECWGTISCENIPQQQEGNH

SEQ ID NO: 142291 - protein, 33 aa, Artificial Sequence
  Description of Artificial Sequence: Synthetic polypeptide
SSEEIATTNPVAYCQYGSVVSCVHSQRGGVNFE

SEQ ID NO: 142292 - protein, 33 aa, Artificial Sequence
  Description of Artificial Sequence: Synthetic polypeptide
DESEIRTTNPVSTECWGTISCENEPQQRNGENH

SEQ ID NO: 142293 - protein, 36 aa, Artificial Sequence
  Description of Artificial Sequence: Synthetic polypeptide
DEEEIRTTNPVATEQYGCVCSTGEHEQENFNSDTQY

SEQ ID NO: 142294 - protein, 33 aa, Artificial Sequence
  Description of Artificial Sequence: Synthetic polypeptide
QECEICTTNPVATEAYGVVSTEQQLQGNEGEQL

SEQ ID NO: 142295 - protein, 33 aa, Artificial Sequence
  Description of Artificial Sequence: Synthetic polypeptide
QECEICTTNPVATEAYGVVSTEQQLQQGEDELQ

SEQ ID NO: 142296 - protein, 35 aa, Artificial Sequence
  Description of Artificial Sequence: Synthetic polypeptide
DEEEIRTTNPVATEQYGCVCSTGEHEEYFNSDTQA

SEQ ID NO: 142297 - protein, 36 aa, Artificial Sequence
  Description of Artificial Sequence: Synthetic polypeptide
DEEEIRTTNPVATEQYGSVIPVSPVHPNTPQNKLVN

SEQ ID NO: 142298 - protein, 36 aa, Artificial Sequence
  Description of Artificial Sequence: Synthetic polypeptide
DEEEIRTTNPVATEQYGSVIPVSFVHPNTPQNMKVN

SEQ ID NO: 142299 - protein, 35 aa, Artificial Sequence
  Description of Artificial Sequence: Synthetic polypeptide
DEDEIRTTNPCATECYGSVSTGNQLGPNAGEGTTE

SEQ ID NO: 142300 - protein, 34 aa, Artificial Sequence
  Description of Artificial Sequence: Synthetic polypeptide
SSEEIRSTNPVAYHQYGSVVSTVHSQRTGGNNFQ

SEQ ID NO: 142301 - protein, 32 aa, Artificial Sequence
  Description of Artificial Sequence: Synthetic polypeptide
DESEIASTNPVSTEQYGNVSANDIQSHEGEDL

SEQ ID NO: 142302 - protein, 35 aa, Artificial Sequence
  Description of Artificial Sequence: Synthetic polypeptide
DEEEIRTTNPVATEQYGCVCSTGEHEIENFGSDQY

SEQ ID NO: 142303 - protein, 32 aa, Artificial Sequence
  Description of Artificial Sequence: Synthetic polypeptide
AEAEISTTNPVATEQYGCVCSWELAYFGSDQS

SEQ ID NO: 142304 - protein, 35 aa, Artificial Sequence
  Description of Artificial Sequence: Synthetic polypeptide
DEEEIRTTNPVATEQYGSVDTVMIGNGGDDEEDQT

SEQ ID NO: 142305 - protein, 35 aa, Artificial Sequence
  Description of Artificial Sequence: Synthetic polypeptide
DEEEIRTTNPVATEQYGCVCSTGEHIENFNSNPQS

SEQ ID NO: 142306 - protein, 33 aa, Artificial Sequence
  Description of Artificial Sequence: Synthetic polypeptide
YEEEIRTVNPVCTEQYGVVSDPNGPNMSNGMNQ

SEQ ID NO: 142307 - protein, 33 aa, Artificial Sequence
  Description of Artificial Sequence: Synthetic polypeptide
DESEIRTTNPVSTEPWGSISCINIQQDQNGENG

SEQ ID NO: 142308 - protein, 33 aa, Artificial Sequence
  Description of Artificial Sequence: Synthetic polypeptide
DESEIRTTNPVSTEPWGSISCINIQQDQEGENG

SEQ ID NO: 142309 - protein, 35 aa, Artificial Sequence
  Description of Artificial Sequence: Synthetic polypeptide
DEEEIATTNPVATEQYGSVCAATNGEEAEDEMNNV

SEQ ID NO: 142310 - protein, 30 aa, Artificial Sequence
  Description of Artificial Sequence: Synthetic polypeptide
DESEIASTNPVSTEQWGNVANIIQSAVGQR

SEQ ID NO: 142311 - protein, 36 aa, Artificial Sequence
  Description of Artificial Sequence: Synthetic polypeptide
YEEEIRTVNPVATEQYGSVSSTTPAGPNMRNGMNPV

SEQ ID NO: 142312 - protein, 30 aa, Artificial Sequence
  Description of Artificial Sequence: Synthetic polypeptide
QEEEIATTNPVATEQYGEAPGEVECQHEEK

SEQ ID NO: 142313 - protein, 33 aa, Artificial Sequence
  Description of Artificial Sequence: Synthetic polypeptide
DECEIATTNPVATEPYGSVCYNNDHDDLGDDDR

SEQ ID NO: 142314 - protein, 36 aa, Artificial Sequence
  Description of Artificial Sequence: Synthetic polypeptide
DEEEIRTTNPVATEQYGCVCSTGEHNEESFNSNTQS

SEQ ID NO: 142315 - protein, 32 aa, Artificial Sequence
  Description of Artificial Sequence: Synthetic polypeptide
QECEICTTNPVATEAYGVVSTEQQLEQGEELQ

SEQ ID NO: 142316 - protein, 31 aa, Artificial Sequence
  Description of Artificial Sequence: Synthetic polypeptide
DESEIASTNPVSTEQYGNAAANTCQSRVEER

SEQ ID NO: 142317 - protein, 34 aa, Artificial Sequence
  Description of Artificial Sequence: Synthetic polypeptide
DEDEIRTTNPCATECYGSVSTGNTNGNAGEDKAE

SEQ ID NO: 142318 - protein, 31 aa, Artificial Sequence
  Description of Artificial Sequence: Synthetic polypeptide
DESEIASTNPVSTEQYGNVAANTEMSAVGDR

SEQ ID NO: 142319 - protein, 32 aa, Artificial Sequence
  Description of Artificial Sequence: Synthetic polypeptide
QECEICTTNPVATEAYGVVSTEQQLQGEQEQL

SEQ ID NO: 142320 - protein, 35 aa, Artificial Sequence
  Description of Artificial Sequence: Synthetic polypeptide
DEEEIATTNPVATEQYGSVCAATNGEEAADEQNNM

SEQ ID NO: 142321 - protein, 35 aa, Artificial Sequence
  Description of Artificial Sequence: Synthetic polypeptide
AEEEIRTTNPVATEQYGCVCSTTGETQENFGSEQS

SEQ ID NO: 142322 - protein, 35 aa, Artificial Sequence
  Description of Artificial Sequence: Synthetic polypeptide
DEEEIRTTNPVATEQYGCVCSTGEDHNANFNSDQA

SEQ ID NO: 142323 - protein, 33 aa, Artificial Sequence
  Description of Artificial Sequence: Synthetic polypeptide
DEDEIRTTNPCATECYGEVSTGNTGNAGEDDSE

SEQ ID NO: 142324 - protein, 38 aa, Artificial Sequence
  Description of Artificial Sequence: Synthetic polypeptide
DEEEIRTTNPVATEAYGSVSTTNNGNQQGNGQEDEEDE

SEQ ID NO: 142325 - protein, 29 aa, Artificial Sequence
  Description of Artificial Sequence: Synthetic peptide
QEDEIASTNPVGTEGYGVMASTLGQHGDI

SEQ ID NO: 142326 - protein, 28 aa, Artificial Sequence
  Description of Artificial Sequence: Synthetic peptide
QEDEIASTNPVGTDGYGVMASTLQHGDI

SEQ ID NO: 142327 - protein, 33 aa, Artificial Sequence
  Description of Artificial Sequence: Synthetic polypeptide
DEDEIRTTNCVATEAWGSVSAINGGEDGEGENG

SEQ ID NO: 142328 - protein, 35 aa, Artificial Sequence
  Description of Artificial Sequence: Synthetic polypeptide
DEEEIRTTNPVATEGWGHSRYSYTDTYLQERPDEF

SEQ ID NO: 142329 - protein, 36 aa, Artificial Sequence
  Description of Artificial Sequence: Synthetic polypeptide
YEEEIRTTNPVATEQYGSVDNGTNMNPGIGGGGNIT

SEQ ID NO: 142330 - protein, 33 aa, Artificial Sequence
  Description of Artificial Sequence: Synthetic polypeptide
TCEEICTTNPVAYEQYGVVATNMDDQNGGNYSS

SEQ ID NO: 142331 - protein, 34 aa, Artificial Sequence
  Description of Artificial Sequence: Synthetic polypeptide
DEEEIRTTNPVATEQYGSVINWHAVIVPVVEERQ

SEQ ID NO: 142332 - protein, 35 aa, Artificial Sequence
  Description of Artificial Sequence: Synthetic polypeptide
DECEIATTNPVATEQYGSVSWNEGDNQMGGQKGEA

SEQ ID NO: 142333 - protein, 35 aa, Artificial Sequence
  Description of Artificial Sequence: Synthetic polypeptide
DEEEIRTTNPVATEGYGCSCSTGEPNQEYFNSDFA

SEQ ID NO: 142334 - protein, 34 aa, Artificial Sequence
  Description of Artificial Sequence: Synthetic polypeptide
AEEEIRTTNPVATEQYGCVCSSEDHNQNFGSEQS

SEQ ID NO: 142335 - protein, 34 aa, Artificial Sequence
  Description of Artificial Sequence: Synthetic polypeptide
AEEEIRTTNPVATEQYGCVCSSEHNQENFNSDQD

SEQ ID NO: 142336 - protein, 35 aa, Artificial Sequence
  Description of Artificial Sequence: Synthetic polypeptide
TAEEIATTNPVATEAWGSVCSKTNDDLDQRNANDS

SEQ ID NO: 142337 - protein, 30 aa, Artificial Sequence
  Description of Artificial Sequence: Synthetic polypeptide
QEEEISTTNPVATEQYGEAISEVEGMMSEQ

SEQ ID NO: 142338 - protein, 38 aa, Artificial Sequence
  Description of Artificial Sequence: Synthetic polypeptide
DEEEIRTTNPVATEAYGSVSTSVTNQQGTNEQGNNNVD

SEQ ID NO: 142339 - protein, 35 aa, Artificial Sequence
  Description of Artificial Sequence: Synthetic polypeptide
YEEEIRTTNPVATEQYGSVSCSVDLNQPNSQIDEQ

SEQ ID NO: 142340 - protein, 37 aa, Artificial Sequence
  Description of Artificial Sequence: Synthetic polypeptide
DEEEIRTTNPVATEAYGSVSTSQQANTEQGTNANNDQ

SEQ ID NO: 142341 - protein, 36 aa, Artificial Sequence
  Description of Artificial Sequence: Synthetic polypeptide
DEEEIRTTNPVATEQYGSVNNNEVELYEVLDNKDQD

SEQ ID NO: 142342 - protein, 29 aa, Artificial Sequence
  Description of Artificial Sequence: Synthetic peptide
QEDCIATTNPVATEQYGEVDEVCNQHEEK

SEQ ID NO: 142343 - protein, 31 aa, Artificial Sequence
  Description of Artificial Sequence: Synthetic polypeptide
QEEEISTTNPVATEQYGEAPSEVEGHQMSEQ

SEQ ID NO: 142344 - protein, 30 aa, Artificial Sequence
  Description of Artificial Sequence: Synthetic polypeptide
QEEEIATTNPVATEQYGEAPEVYQIMSVEQ

SEQ ID NO: 142345 - protein, 35 aa, Artificial Sequence
  Description of Artificial Sequence: Synthetic polypeptide
DEEEIRTTNPVATEQYGSVIPPLLEEATMGPLEQV

SEQ ID NO: 142346 - protein, 36 aa, Artificial Sequence
  Description of Artificial Sequence: Synthetic polypeptide
DEEEIRTTNPVATEQYGSVIPISFGEEQPEGHVPEI

SEQ ID NO: 142347 - protein, 33 aa, Artificial Sequence
  Description of Artificial Sequence: Synthetic polypeptide
DEDEIRGTNPVSTEQYGSVTDNVGQGQGGQSGE

SEQ ID NO: 142348 - protein, 35 aa, Artificial Sequence
  Description of Artificial Sequence: Synthetic polypeptide
AEEEIRTTNPVATEQYGCVCSTEEHNQEGFGSDQS

SEQ ID NO: 142349 - protein, 31 aa, Artificial Sequence
  Description of Artificial Sequence: Synthetic polypeptide
QEEEISTTNPVATEQYGEAPSEPVEQMSEQN

SEQ ID NO: 142350 - protein, 31 aa, Artificial Sequence
  Description of Artificial Sequence: Synthetic polypeptide
SVCEIAPTNPTATEQYGAVAVEMNGMRGNDR

SEQ ID NO: 142351 - protein, 34 aa, Artificial Sequence
  Description of Artificial Sequence: Synthetic polypeptide
AEEEIRTTNPVATEQYGCVCSTEDAEYFNSDFQI

SEQ ID NO: 142352 - protein, 35 aa, Artificial Sequence
  Description of Artificial Sequence: Synthetic polypeptide
DEEEIRTTNPVATEGYGCSCSTWEHNAEYFNSDQA

SEQ ID NO: 142353 - protein, 36 aa, Artificial Sequence
  Description of Artificial Sequence: Synthetic polypeptide
DEEEIRTTNPVATEQYGSVNNNEVELEVLTNKDTQD

SEQ ID NO: 142354 - protein, 34 aa, Artificial Sequence
  Description of Artificial Sequence: Synthetic polypeptide
DECEIATTNPVATEQYGCVCTIEGNQDQGGQEQE

SEQ ID NO: 142355 - protein, 31 aa, Artificial Sequence
  Description of Artificial Sequence: Synthetic polypeptide
QEEEISTTNPVATEQYGEAPSEVAEGQMSEQ

SEQ ID NO: 142356 - protein, 35 aa, Artificial Sequence
  Description of Artificial Sequence: Synthetic polypeptide
DEEEIATTNPVATEQYGSVCAATMGEEAGDNMENP

SEQ ID NO: 142357 - protein, 34 aa, Artificial Sequence
  Description of Artificial Sequence: Synthetic polypeptide
DEDEIRGTNPVGTEQYGSVCTDNTGQGEGGQGEQ

SEQ ID NO: 142358 - protein, 33 aa, Artificial Sequence
  Description of Artificial Sequence: Synthetic polypeptide
DESEIRTTNPVAYQQYGCVCLWNDDERQGHNQA

SEQ ID NO: 142359 - protein, 36 aa, Artificial Sequence
  Description of Artificial Sequence: Synthetic polypeptide
DEEEIRTTNPVATEFYGVVVSDGMTDGQGEGEDNEL

SEQ ID NO: 142360 - protein, 37 aa, Artificial Sequence
  Description of Artificial Sequence: Synthetic polypeptide
DEEEIRTTNPVATEPYGSVCGFTNYQLAAQPIGQEEG

SEQ ID NO: 142361 - protein, 33 aa, Artificial Sequence
  Description of Artificial Sequence: Synthetic polypeptide
DESEIRTTNPVAYEQWGVVTGGNGNQGNGNADD

SEQ ID NO: 142362 - protein, 32 aa, Artificial Sequence
  Description of Artificial Sequence: Synthetic polypeptide
DESEIRTTNPVAYEQWGVTCPTENGDQRQSQN

SEQ ID NO: 142363 - protein, 32 aa, Artificial Sequence
  Description of Artificial Sequence: Synthetic polypeptide
DESEIATTNPVATECWGSVSCICEPQREEEEL

SEQ ID NO: 142364 - protein, 36 aa, Artificial Sequence
  Description of Artificial Sequence: Synthetic polypeptide
AEYEIRTTNPVATEQYGSVMPTNGSDETTQSGQDNQ

SEQ ID NO: 142365 - protein, 34 aa, Artificial Sequence
  Description of Artificial Sequence: Synthetic polypeptide
DESEIRTTNPVAYEQWGVVVPTDNGDDQAGNSAN

SEQ ID NO: 142366 - protein, 31 aa, Artificial Sequence
  Description of Artificial Sequence: Synthetic polypeptide
DESEIRTTNPVAYEQWGTVSKEIEMNNAEDA

SEQ ID NO: 142367 - protein, 35 aa, Artificial Sequence
  Description of Artificial Sequence: Synthetic polypeptide
DESEIRTTNPVAYEQWGSVSTTNQGNQNIDMNGDA

SEQ ID NO: 142368 - protein, 34 aa, Artificial Sequence
  Description of Artificial Sequence: Synthetic polypeptide
DEDEIRGTNPVATEFWGSVSAINEGQDGQGENGQ

SEQ ID NO: 142369 - protein, 34 aa, Artificial Sequence
  Description of Artificial Sequence: Synthetic polypeptide
DEDEIRGTNPVATEFWGSVSAINEGQDGQGENED

SEQ ID NO: 142370 - protein, 28 aa, Artificial Sequence
  Description of Artificial Sequence: Synthetic peptide
QEDEIATTNPVATEIYGEAPEVCQHEEK

SEQ ID NO: 142371 - protein, 35 aa, Artificial Sequence
  Description of Artificial Sequence: Synthetic polypeptide
DEEEIRTTNPVATEFYGVVVSDGDTGQGEGENDED

SEQ ID NO: 142372 - protein, 37 aa, Artificial Sequence
  Description of Artificial Sequence: Synthetic polypeptide
DEEEIRTTNPVATEPYGSVCPFQNYELATQRAGQVVV

SEQ ID NO: 142373 - protein, 35 aa, Artificial Sequence
  Description of Artificial Sequence: Synthetic polypeptide
DEEEIRTTNPVATEFYGVVVSDGDTNQGEGEDVEQ

SEQ ID NO: 142374 - protein, 34 aa, Artificial Sequence
  Description of Artificial Sequence: Synthetic polypeptide
DEEEIRTTNPVATEQYGSVEMPQIHPTYVEELRV

SEQ ID NO: 142375 - protein, 33 aa, Artificial Sequence
  Description of Artificial Sequence: Synthetic polypeptide
DECEIATTNPVATEVWGSVCYNNDDQDHGGTDR

SEQ ID NO: 142376 - protein, 35 aa, Artificial Sequence
  Description of Artificial Sequence: Synthetic polypeptide
DEEEIRTTNPVATEFYGVVVSDGMTVGQLEGEDEQ

SEQ ID NO: 142377 - protein, 33 aa, Artificial Sequence
  Description of Artificial Sequence: Synthetic polypeptide
DESEIRTTNPVAYQQYGCVCLWNDDERGHDNQN

SEQ ID NO: 142378 - protein, 35 aa, Artificial Sequence
  Description of Artificial Sequence: Synthetic polypeptide
DESEIRTTNPVAYQQYGCVCCWTNDQEERQGHNNG

SEQ ID NO: 142379 - protein, 38 aa, Artificial Sequence
  Description of Artificial Sequence: Synthetic polypeptide
DEEEIRTTNPVATEAYGSVSTTNNGNQQGNNDENNEDE

SEQ ID NO: 142380 - protein, 31 aa, Artificial Sequence
  Description of Artificial Sequence: Synthetic polypeptide
QEEEIATTNPVATEQYGEAPEVWCQHGEEKK

SEQ ID NO: 142381 - protein, 34 aa, Artificial Sequence
  Description of Artificial Sequence: Synthetic polypeptide
DEEEIRTTNPVATEFYGVVVSDIMTGQGEGEDEN

SEQ ID NO: 142382 - protein, 35 aa, Artificial Sequence
  Description of Artificial Sequence: Synthetic polypeptide
DESEIRTTNPVAYEQYGTVVCIEQDPHNDQRGNVN

SEQ ID NO: 142383 - protein, 35 aa, Artificial Sequence
  Description of Artificial Sequence: Synthetic polypeptide
DEEEIRTTNPVATEFYGVVVSDGMTQNQGEGEDEQ

SEQ ID NO: 142384 - protein, 31 aa, Artificial Sequence
  Description of Artificial Sequence: Synthetic polypeptide
AETEIRTTNPVATECWGETWANEDLARKGPI

SEQ ID NO: 142385 - protein, 33 aa, Artificial Sequence
  Description of Artificial Sequence: Synthetic polypeptide
DECEIATTNPVATESYGSVCYNNEDRDTGGDDA

SEQ ID NO: 142386 - protein, 36 aa, Artificial Sequence
  Description of Artificial Sequence: Synthetic polypeptide
YEEEIRTTNPVATEQYGDVDTGIQNDGDQTGNGNEI

SEQ ID NO: 142387 - protein, 33 aa, Artificial Sequence
  Description of Artificial Sequence: Synthetic polypeptide
AETEIRTTNPVATEQWGATAANAEDWQERGPYR

SEQ ID NO: 142388 - protein, 32 aa, Artificial Sequence
  Description of Artificial Sequence: Synthetic polypeptide
AETEIRTTNPVATEQYGEAWANEENLAEPGGI

SEQ ID NO: 142389 - protein, 38 aa, Artificial Sequence
  Description of Artificial Sequence: Synthetic polypeptide
DEEEIRTTNPVATEAYGSVSTTNNGNQQGNNNGGNEDE

SEQ ID NO: 142390 - protein, 35 aa, Artificial Sequence
  Description of Artificial Sequence: Synthetic polypeptide
DESEIRTTNPVAYEQYGSTVVACSGNALQVVTDSY

SEQ ID NO: 142391 - protein, 36 aa, Artificial Sequence
  Description of Artificial Sequence: Synthetic polypeptide
DEEEIRTTNPVATEQYGSVNNNEVELEALGQDETQD

SEQ ID NO: 142392 - protein, 36 aa, Artificial Sequence
  Description of Artificial Sequence: Synthetic polypeptide
DEEEIRTTNPVATEQYGSVNNNEVEYEVLGNDETQQ

SEQ ID NO: 142393 - protein, 33 aa, Artificial Sequence
  Description of Artificial Sequence: Synthetic polypeptide
QEEEIATTNPVATEQYGEVPTEVGPNMREMNPV

SEQ ID NO: 142394 - protein, 35 aa, Artificial Sequence
  Description of Artificial Sequence: Synthetic polypeptide
AEEEIRTTNPVATEQYGCVCSTEHNAEYFNSETQA

SEQ ID NO: 142395 - protein, 33 aa, Artificial Sequence
  Description of Artificial Sequence: Synthetic polypeptide
DESEIATTNPVATAHWGSVCTWEDQQRQTGNMS

SEQ ID NO: 142396 - protein, 36 aa, Artificial Sequence
  Description of Artificial Sequence: Synthetic polypeptide
DEEEIRTTNPVATEQYGCVCSTGEDDNQENFNSEQA

SEQ ID NO: 142397 - protein, 34 aa, Artificial Sequence
  Description of Artificial Sequence: Synthetic polypeptide
DECEIATTNPVATEPYGSVCYNNDHQDQGMEDRL

SEQ ID NO: 142398 - protein, 34 aa, Artificial Sequence
  Description of Artificial Sequence: Synthetic polypeptide
DESEIATTNPVATASWGSVSAANTEPQDRGDDNG

SEQ ID NO: 142399 - protein, 33 aa, Artificial Sequence
  Description of Artificial Sequence: Synthetic polypeptide
DESEIATTNPVATASWGSVSGNNEPQDNGGENG

SEQ ID NO: 142400 - protein, 36 aa, Artificial Sequence
  Description of Artificial Sequence: Synthetic polypeptide
DEEEIRTTNPVATEQYGSVNNNLVELEVLDNKNTQL

SEQ ID NO: 142401 - protein, 36 aa, Artificial Sequence
  Description of Artificial Sequence: Synthetic polypeptide
DEEEIRTTNPVATEQYGSVEIAANEMVQVRSEQADM

SEQ ID NO: 142402 - protein, 35 aa, Artificial Sequence
  Description of Artificial Sequence: Synthetic polypeptide
AEEEIRTTNPVATEQYGCVCSTGEHAENFNSNNQL

SEQ ID NO: 142403 - protein, 35 aa, Artificial Sequence
  Description of Artificial Sequence: Synthetic polypeptide
SSEEIRTTNPVAYEQWGQVSSCTNMQSADGGNERN

SEQ ID NO: 142404 - protein, 35 aa, Artificial Sequence
  Description of Artificial Sequence: Synthetic polypeptide
DEEEIRTTNPVATEQYGSVNNNIWNESDSYNDSLI

SEQ ID NO: 142405 - protein, 34 aa, Artificial Sequence
  Description of Artificial Sequence: Synthetic polypeptide
DESEIATTNPVATASWGSVSVANNTGQDRGGENG

SEQ ID NO: 142406 - protein, 34 aa, Artificial Sequence
  Description of Artificial Sequence: Synthetic polypeptide
DEEEIRTTNPVATEGYGCVCFSEELNTNGGSDQS

SEQ ID NO: 142407 - protein, 33 aa, Artificial Sequence
  Description of Artificial Sequence: Synthetic polypeptide
DECEIATTNPVATEPYGSVCYNNDNQDDDNHDT

SEQ ID NO: 142408 - protein, 35 aa, Artificial Sequence
  Description of Artificial Sequence: Synthetic polypeptide
DEDEIRTTNPCATECYGEVSTGNQLNGNAGEHGRE

SEQ ID NO: 142409 - protein, 35 aa, Artificial Sequence
  Description of Artificial Sequence: Synthetic polypeptide
DEEEIRTTNPVATEQYGCVCSTGEDAENFNSETQS

SEQ ID NO: 142410 - protein, 34 aa, Artificial Sequence
  Description of Artificial Sequence: Synthetic polypeptide
CEEEIACTNPVATEQYGCVATNNLENGMNQEGDH

SEQ ID NO: 142411 - protein, 36 aa, Artificial Sequence
  Description of Artificial Sequence: Synthetic polypeptide
DEEEIRTTNPVATEQYGCVCSTGEDDQEHFGSDTQA

SEQ ID NO: 142412 - protein, 36 aa, Artificial Sequence
  Description of Artificial Sequence: Synthetic polypeptide
DEEEIRTTNPVATEQYGSVEHVSGKDNQTGQEVDVI

SEQ ID NO: 142413 - protein, 35 aa, Artificial Sequence
  Description of Artificial Sequence: Synthetic polypeptide
DEEEIRTTNPVATEQYGCVCSTGEDHNAFFNSDQE

SEQ ID NO: 142414 - protein, 34 aa, Artificial Sequence
  Description of Artificial Sequence: Synthetic polypeptide
AEEEIRTTNPVATEQYGCVCSTTEHANFNSQFQA

SEQ ID NO: 142415 - protein, 34 aa, Artificial Sequence
  Description of Artificial Sequence: Synthetic polypeptide
DEEEIRTTNPVATEGYGCVCFSGEHNTYFGSDQA

SEQ ID NO: 142416 - protein, 36 aa, Artificial Sequence
  Description of Artificial Sequence: Synthetic polypeptide
DEEEIRTTNPVATEQYGCVCSTGEDHNAEFFNSDQA

SEQ ID NO: 142417 - protein, 35 aa, Artificial Sequence
  Description of Artificial Sequence: Synthetic polypeptide
QECEICTTNPVATEAYGVVSTSNQQLQAGNEEQSE

SEQ ID NO: 142418 - protein, 34 aa, Artificial Sequence
  Description of Artificial Sequence: Synthetic polypeptide
DESEIATTNPVATAAWGSVVSGNNEPQDRGGENG

SEQ ID NO: 142419 - protein, 36 aa, Artificial Sequence
  Description of Artificial Sequence: Synthetic polypeptide
DEEEIRTTNPVATEQYGSVEIAAEEMVQVRGEQADL

SEQ ID NO: 142420 - protein, 36 aa, Artificial Sequence
  Description of Artificial Sequence: Synthetic polypeptide
DEEEIRTTNPVATEQYGCVCSTGEDHDQGFNSDTQG

SEQ ID NO: 142421 - protein, 29 aa, Artificial Sequence
  Description of Artificial Sequence: Synthetic peptide
QEEELATTNPVATEQYGEAPEVCQHDEEK

SEQ ID NO: 142422 - protein, 36 aa, Artificial Sequence
  Description of Artificial Sequence: Synthetic polypeptide
DEEEIRTTNPVATEQYGCVCSTGEDHAENGNSNNQL

SEQ ID NO: 142423 - protein, 36 aa, Artificial Sequence
  Description of Artificial Sequence: Synthetic polypeptide
DEEEIRTTNPVATEQYGSVEHPVNLAAIRPMMEVGQ

SEQ ID NO: 142424 - protein, 31 aa, Artificial Sequence
  Description of Artificial Sequence: Synthetic polypeptide
QEEEIVTTNPVATEQYGVVAGPEGGQGEEDG

SEQ ID NO: 142425 - protein, 35 aa, Artificial Sequence
  Description of Artificial Sequence: Synthetic polypeptide
AEEEIRTTNPVATEQYGCVCSTMELAEYFNSDFQA

SEQ ID NO: 142426 - protein, 33 aa, Artificial Sequence
  Description of Artificial Sequence: Synthetic polypeptide
DESEIATTNPVATACWGSVSAINEPQDNGGENG

SEQ ID NO: 142427 - protein, 35 aa, Artificial Sequence
  Description of Artificial Sequence: Synthetic polypeptide
DEEEIRTTNPVATEQYGCVCSTGEDHAFFNSNFQS

SEQ ID NO: 142428 - protein, 30 aa, Artificial Sequence
  Description of Artificial Sequence: Synthetic polypeptide
QEEEIATTNPVATEQYGEAPGVCQTHEEVK

SEQ ID NO: 142429 - protein, 33 aa, Artificial Sequence
  Description of Artificial Sequence: Synthetic polypeptide
SSEEIRTTNPVAYHQWGSVVSTVHSQKGGNNFQ

SEQ ID NO: 142430 - protein, 33 aa, Artificial Sequence
  Description of Artificial Sequence: Synthetic polypeptide
DEEEIRTTNPVATEGYGCVCFNWEDTYFGSDQS

SEQ ID NO: 142431 - protein, 32 aa, Artificial Sequence
  Description of Artificial Sequence: Synthetic polypeptide
DESEIRTTNPVGTECYGVTTANAETLAPKGDI

SEQ ID NO: 142432 - protein, 36 aa, Artificial Sequence
  Description of Artificial Sequence: Synthetic polypeptide
DEEEIRTTNPVATEQYGSVNNNIFVELEVLDNNVQD

SEQ ID NO: 142433 - protein, 34 aa, Artificial Sequence
  Description of Artificial Sequence: Synthetic polypeptide
DEEEIRTTNPVATEQYGSVELPIPIMTVVEQFQV

SEQ ID NO: 142434 - protein, 29 aa, Artificial Sequence
  Description of Artificial Sequence: Synthetic peptide
QEEEIATTNPVATEQYGEAPEWVCMHEEK

SEQ ID NO: 142435 - protein, 36 aa, Artificial Sequence
  Description of Artificial Sequence: Synthetic polypeptide
DEEEIRTTNPVATEQYGSVNNNEVSLEVPMNENTQW

SEQ ID NO: 142436 - protein, 36 aa, Artificial Sequence
  Description of Artificial Sequence: Synthetic polypeptide
DEEEIRTTNPVATEQYGSVNNNEVSLEVPEDSNTQP

SEQ ID NO: 142437 - protein, 30 aa, Artificial Sequence
  Description of Artificial Sequence: Synthetic polypeptide
STAEIACTNPVATEQWGCVAGTMLQHDDNP

SEQ ID NO: 142438 - protein, 31 aa, Artificial Sequence
  Description of Artificial Sequence: Synthetic polypeptide
QEEEISTTNPVATEQYGVVAGPEGGGQGEED

SEQ ID NO: 142439 - protein, 31 aa, Artificial Sequence
  Description of Artificial Sequence: Synthetic polypeptide
DESEIRTTNPVGTECYGVTTAAETLAPKGDI

SEQ ID NO: 142440 - protein, 31 aa, Artificial Sequence
  Description of Artificial Sequence: Synthetic polypeptide
AETEIRCTNPIATEQWGEAWSNEDLARKGPR

SEQ ID NO: 142441 - protein, 35 aa, Artificial Sequence
  Description of Artificial Sequence: Synthetic polypeptide
DEEEIATTNPVATEQYGSVCAATMHGEAADGMERH

SEQ ID NO: 142442 - protein, 36 aa, Artificial Sequence
  Description of Artificial Sequence: Synthetic polypeptide
DEEEIATTNPVATEQYGSVCAATMGGEATEDGMNRH

SEQ ID NO: 142443 - protein, 36 aa, Artificial Sequence
  Description of Artificial Sequence: Synthetic polypeptide
YEEEIRTTNPVATEQYGSVSSTTPAGPNMRNGMFPV

SEQ ID NO: 142444 - protein, 36 aa, Artificial Sequence
  Description of Artificial Sequence: Synthetic polypeptide
DEEEIRTTNPVATEQYGSVNNNEVPLEVLDNINTQY

SEQ ID NO: 142445 - protein, 34 aa, Artificial Sequence
  Description of Artificial Sequence: Synthetic polypeptide
DEEEIRTTNPVATEQYGSVELPVIFPTVVEELRV

SEQ ID NO: 142446 - protein, 34 aa, Artificial Sequence
  Description of Artificial Sequence: Synthetic polypeptide
CEEEIACTNPVATEQYGCVATNNLENGMGENDAQ

SEQ ID NO: 142447 - protein, 35 aa, Artificial Sequence
  Description of Artificial Sequence: Synthetic polypeptide
DEEEIRTTNPVATEQYGSVNNNINESADSYQDSFL

SEQ ID NO: 142448 - protein, 34 aa, Artificial Sequence
  Description of Artificial Sequence: Synthetic polypeptide
SSSEIRTTNPVATEQYGSVDMSLDTQEGQIENFG

SEQ ID NO: 142449 - protein, 35 aa, Artificial Sequence
  Description of Artificial Sequence: Synthetic polypeptide
DEEEIRTTNPVATEAYGSTFMTEAWLSQDTIGSQE

SEQ ID NO: 142450 - protein, 36 aa, Artificial Sequence
  Description of Artificial Sequence: Synthetic polypeptide
DESEIATTNPVATEAYGSTVASCTNMLSEYMGTNTN

SEQ ID NO: 142451 - protein, 34 aa, Artificial Sequence
  Description of Artificial Sequence: Synthetic polypeptide
SSEEIRTTNPVAYHQYGSVVSCHAHSQRGGVNFQ

SEQ ID NO: 142452 - protein, 33 aa, Artificial Sequence
  Description of Artificial Sequence: Synthetic polypeptide
SSEEIRTTNPVAYHQYGSVVSCVHSGRGGVNMQ

SEQ ID NO: 142453 - protein, 34 aa, Artificial Sequence
  Description of Artificial Sequence: Synthetic polypeptide
DEEEIRTTNPVATEQYGSVELPINIPTPVEQFTV

SEQ ID NO: 142454 - protein, 34 aa, Artificial Sequence
  Description of Artificial Sequence: Synthetic polypeptide
SSEEIRTTNPVAYHQYGSVVSCVHSQARVGVNFQ

SEQ ID NO: 142455 - protein, 34 aa, Artificial Sequence
  Description of Artificial Sequence: Synthetic polypeptide
SSSEIRTTNPVATEQYGSVIMSLDEQEGLIENFG

SEQ ID NO: 142456 - protein, 33 aa, Artificial Sequence
  Description of Artificial Sequence: Synthetic polypeptide
SSEEIRTTNPVAYHQYGSVVSQVHSQIGGNNEQ

SEQ ID NO: 142457 - protein, 34 aa, Artificial Sequence
  Description of Artificial Sequence: Synthetic polypeptide
DESEIRTTNPVGTEGYGVVSSTPTGPQRNGMDPV

SEQ ID NO: 142458 - protein, 34 aa, Artificial Sequence
  Description of Artificial Sequence: Synthetic polypeptide
DEEEIRTTNPVATEGYGCVCFNTEHNTNFGSDQS

SEQ ID NO: 142459 - protein, 35 aa, Artificial Sequence
  Description of Artificial Sequence: Synthetic polypeptide
DEEEIRTTNPVATEQYGSVNNNINESDNSNNDSLN

SEQ ID NO: 142460 - protein, 34 aa, Artificial Sequence
  Description of Artificial Sequence: Synthetic polypeptide
DESEIRTTNPVGTEGYGVVSSTPTGPNRNGMNPV

SEQ ID NO: 142461 - protein, 34 aa, Artificial Sequence
  Description of Artificial Sequence: Synthetic polypeptide
DESEIRTTNPVGTEGYGVVSSTPAGPNRNGMNPV

SEQ ID NO: 142462 - protein, 34 aa, Artificial Sequence
  Description of Artificial Sequence: Synthetic polypeptide
DESEIRTTNPVGTEGYGVVSSSPTGPQRNGMDPV

SEQ ID NO: 142463 - protein, 36 aa, Artificial Sequence
  Description of Artificial Sequence: Synthetic polypeptide
DESEIATTNPVATEAYGSTVLSCTNMLSADYGGNHF

SEQ ID NO: 142464 - protein, 29 aa, Artificial Sequence
  Description of Artificial Sequence: Synthetic peptide
QEEHIATTNPVATEQYGEAPEVCQHETEK

SEQ ID NO: 142465 - protein, 32 aa, Artificial Sequence
  Description of Artificial Sequence: Synthetic polypeptide
DESEIASTNPVSTEGYGTIANETIQQQRNGNR

SEQ ID NO: 142466 - protein, 37 aa, Artificial Sequence
  Description of Artificial Sequence: Synthetic polypeptide
AEEEIRTTNPVATEQYGSVATNLNNQNGTEAGTDEST

SEQ ID NO: 142467 - protein, 30 aa, Artificial Sequence
  Description of Artificial Sequence: Synthetic polypeptide
QEGEIAATNPCSYEQWGIVSKNLQSDGDTR

SEQ ID NO: 142468 - protein, 33 aa, Artificial Sequence
  Description of Artificial Sequence: Synthetic polypeptide
DESEIVTTNPVATECWGTVCSCINPPQDFEGNG

SEQ ID NO: 142469 - protein, 33 aa, Artificial Sequence
  Description of Artificial Sequence: Synthetic polypeptide
DESEIVTTNPVATECWGTVSACINPVQFEGENG

SEQ ID NO: 142470 - protein, 34 aa, Artificial Sequence
  Description of Artificial Sequence: Synthetic polypeptide
SEVEIACTNPVATEQYGSVYCTWNDQHHQGHNDH

SEQ ID NO: 142471 - protein, 35 aa, Artificial Sequence
  Description of Artificial Sequence: Synthetic polypeptide
DEEEIATTNPVATEQYGSVCAHNHHEAPDNQDENH

SEQ ID NO: 142472 - protein, 32 aa, Artificial Sequence
  Description of Artificial Sequence: Synthetic polypeptide
SETSIATTNPLAYEQFGSVSCFNLSTSGGNNR

SEQ ID NO: 142473 - protein, 33 aa, Artificial Sequence
  Description of Artificial Sequence: Synthetic polypeptide
DESEIVTTNPVATECWGTVSCINEVQDFEGENG

SEQ ID NO: 142474 - protein, 35 aa, Artificial Sequence
  Description of Artificial Sequence: Synthetic polypeptide
DEEEIRTTNPVATEAWGESVRTWNDDDQDQREKAM

SEQ ID NO: 142475 - protein, 33 aa, Artificial Sequence
  Description of Artificial Sequence: Synthetic polypeptide
DECEIATTNPVATEHYGSVCYNNDDQDHGDQDD

SEQ ID NO: 142476 - protein, 33 aa, Artificial Sequence
  Description of Artificial Sequence: Synthetic polypeptide
DESEIVTTNPVATECYGSVCSCDGPPEFEGEND

SEQ ID NO: 142477 - protein, 36 aa, Artificial Sequence
  Description of Artificial Sequence: Synthetic polypeptide
DEEEIATTNPVATEQYGSVCALANGLEPTDDGMNGV

SEQ ID NO: 142478 - protein, 30 aa, Artificial Sequence
  Description of Artificial Sequence: Synthetic polypeptide
QEEEIATTNPVATEQYGEAPMEVCQHEEKV

SEQ ID NO: 142479 - protein, 34 aa, Artificial Sequence
  Description of Artificial Sequence: Synthetic polypeptide
DECEIATTNPVATEHWGSVSGGNTGNAGNDNQRN

SEQ ID NO: 142480 - protein, 35 aa, Artificial Sequence
  Description of Artificial Sequence: Synthetic polypeptide
DEEEIATTNPVATEQYGSVCALANNLEPDDNMNGV

SEQ ID NO: 142481 - protein, 34 aa, Artificial Sequence
  Description of Artificial Sequence: Synthetic polypeptide
SETEIRTTNPIATEQYGSTTWSNAENLAERGPYI

SEQ ID NO: 142482 - protein, 32 aa, Artificial Sequence
  Description of Artificial Sequence: Synthetic polypeptide
SETEIRTTNPIATEQWGATTANEDWMRKGNYR

SEQ ID NO: 142483 - protein, 32 aa, Artificial Sequence
  Description of Artificial Sequence: Synthetic polypeptide
SETEIRTTNPIATEQWGATTANEDWARKGNYR

SEQ ID NO: 142484 - protein, 36 aa, Artificial Sequence
  Description of Artificial Sequence: Synthetic polypeptide
DEEEIRTTNPVATEGYGICVCSTVNHNQEYFISNQG

SEQ ID NO: 142485 - protein, 31 aa, Artificial Sequence
  Description of Artificial Sequence: Synthetic polypeptide
QEEEIATTNPVATEQYGEAPMEVIEQMSNEG

SEQ ID NO: 142486 - protein, 36 aa, Artificial Sequence
  Description of Artificial Sequence: Synthetic polypeptide
DEEEIATTNPVATEQYGSVCAMGLLGAPGNQMEGRH

SEQ ID NO: 142487 - protein, 33 aa, Artificial Sequence
  Description of Artificial Sequence: Synthetic polypeptide
DESEIVTTNPVATECYGTVCSACDNPPEFEGND

SEQ ID NO: 142488 - protein, 33 aa, Artificial Sequence
  Description of Artificial Sequence: Synthetic polypeptide
DEDEIRTTNPVATEAWGSVSAGFEGGDGQGENG

SEQ ID NO: 142489 - protein, 36 aa, Artificial Sequence
  Description of Artificial Sequence: Synthetic polypeptide
DEEEIRTTNPVATEGYGICVCSTVNDDQENFISNQA

SEQ ID NO: 142490 - protein, 30 aa, Artificial Sequence
  Description of Artificial Sequence: Synthetic polypeptide
QEGEIAATNPCSYEQWGIVSCNLQKGGDTR

SEQ ID NO: 142491 - protein, 36 aa, Artificial Sequence
  Description of Artificial Sequence: Synthetic polypeptide
DEEEIRTTNPVATEGYGICVCSTVELNQENFISNTQ

SEQ ID NO: 142492 - protein, 35 aa, Artificial Sequence
  Description of Artificial Sequence: Synthetic polypeptide
DEEEIRTTNPVATENYGSVAVCTRASSNNGGNNED

SEQ ID NO: 142493 - protein, 33 aa, Artificial Sequence
  Description of Artificial Sequence: Synthetic polypeptide
SETEIRTTNPIATECYGSTTWSEEDLARKGNYI

SEQ ID NO: 142494 - protein, 30 aa, Artificial Sequence
  Description of Artificial Sequence: Synthetic polypeptide
QEEEIATTNPVATEQYGEAPMEVCQQHEEH

SEQ ID NO: 142495 - protein, 30 aa, Artificial Sequence
  Description of Artificial Sequence: Synthetic polypeptide
ADNEIACTNPVATEGYGNAAAENIQRVGGR

SEQ ID NO: 142496 - protein, 37 aa, Artificial Sequence
  Description of Artificial Sequence: Synthetic polypeptide
DEEEIATTNPVATEQYGSVCAMANGLEPTRDGMNNGV

SEQ ID NO: 142497 - protein, 37 aa, Artificial Sequence
  Description of Artificial Sequence: Synthetic polypeptide
DEEEIATTNPVATEQYGSVCALANNLEPTRDGMENGN

SEQ ID NO: 142498 - protein, 36 aa, Artificial Sequence
  Description of Artificial Sequence: Synthetic polypeptide
DEEEIATTNPVATEQYGSVCAMANNDLQGDVQNDDN

SEQ ID NO: 142499 - protein, 29 aa, Artificial Sequence
  Description of Artificial Sequence: Synthetic peptide
DESEIASTNPVGTEGYGVMSASALNHGDV

SEQ ID NO: 142500 - protein, 35 aa, Artificial Sequence
  Description of Artificial Sequence: Synthetic polypeptide
DEEEIATTNPVATEQWGSVSVAGPLNDNEMNDNRW

SEQ ID NO: 142501 - protein, 35 aa, Artificial Sequence
  Description of Artificial Sequence: Synthetic polypeptide
DEEEIATTNPVATEQYGSVCAGTDPPTDDQMGQDQ

SEQ ID NO: 142502 - protein, 36 aa, Artificial Sequence
  Description of Artificial Sequence: Synthetic polypeptide
DEEEIRTTNPVATEGYGICVCSNTVNDQENFISNQS

SEQ ID NO: 142503 - protein, 31 aa, Artificial Sequence
  Description of Artificial Sequence: Synthetic polypeptide
QEEEIATTNPVATEQYGEVAPCEVGSQHEEK

SEQ ID NO: 142504 - protein, 33 aa, Artificial Sequence
  Description of Artificial Sequence: Synthetic polypeptide
SEYEIRCTNPVATEQYGCVCETELQEHFGSEQA

SEQ ID NO: 142505 - protein, 34 aa, Artificial Sequence
  Description of Artificial Sequence: Synthetic polypeptide
SEYEIRCTNPVATEQYGCVCETELQEHFGSNNQS

SEQ ID NO: 142506 - protein, 34 aa, Artificial Sequence
  Description of Artificial Sequence: Synthetic polypeptide
DEEEIRTTNPVATEPWGSVCFNNAWSSDTGGNPT

SEQ ID NO: 142507 - protein, 35 aa, Artificial Sequence
  Description of Artificial Sequence: Synthetic polypeptide
DEEEIATTNPVATEQYGSVCAGPDGLEQDDLGAQA

SEQ ID NO: 142508 - protein, 30 aa, Artificial Sequence
  Description of Artificial Sequence: Synthetic polypeptide
DESEIASTNPVGTEGYGVMSCTLQDHGEDI

SEQ ID NO: 142509 - protein, 33 aa, Artificial Sequence
  Description of Artificial Sequence: Synthetic polypeptide
DEDEIRTTNPVATEAWGSCSAINEGEDGEGENG

SEQ ID NO: 142510 - protein, 33 aa, Artificial Sequence
  Description of Artificial Sequence: Synthetic polypeptide
SEYEIRCTNPVATEQYGCVCETMEHQHFGSNQS

SEQ ID NO: 142511 - protein, 29 aa, Artificial Sequence
  Description of Artificial Sequence: Synthetic peptide
QEFEIASTNPVGTEGYGVMATSTLQHGDI

SEQ ID NO: 142512 - protein, 29 aa, Artificial Sequence
  Description of Artificial Sequence: Synthetic peptide
QEFEIASTNPVGTEGYGVMAASTLQHGDI

SEQ ID NO: 142513 - protein, 30 aa, Artificial Sequence
  Description of Artificial Sequence: Synthetic polypeptide
QEEEIATTNPVATEQYGEAPKEVCQFEETK

SEQ ID NO: 142514 - protein, 33 aa, Artificial Sequence
  Description of Artificial Sequence: Synthetic polypeptide
DESEITTTNPVATEQYGVVAANAGMEEGGENGG

SEQ ID NO: 142515 - protein, 36 aa, Artificial Sequence
  Description of Artificial Sequence: Synthetic polypeptide
DEEEIRTTNPVATEAYGDVVDDGNLNQQDEGENGTL

SEQ ID NO: 142516 - protein, 33 aa, Artificial Sequence
  Description of Artificial Sequence: Synthetic polypeptide
SEYEIRCTNPVATEQYGCVCETGNHQHFGSQQS

SEQ ID NO: 142517 - protein, 36 aa, Artificial Sequence
  Description of Artificial Sequence: Synthetic polypeptide
DEEEIATTNPVATEQYGSVCAMHNGVEQPDDQNGNP

SEQ ID NO: 142518 - protein, 29 aa, Artificial Sequence
  Description of Artificial Sequence: Synthetic peptide
QEFEIATTNPVATEQYGEFAPEVCQHEEK

SEQ ID NO: 142519 - protein, 33 aa, Artificial Sequence
  Description of Artificial Sequence: Synthetic polypeptide
DESEIVTTNPVATECWGSVSCINEPEDFEGENG

SEQ ID NO: 142520 - protein, 34 aa, Artificial Sequence
  Description of Artificial Sequence: Synthetic polypeptide
DEEEIATTNPVATEQYGSVCAGTDPPTDDGGPDQ

SEQ ID NO: 142521 - protein, 32 aa, Artificial Sequence
  Description of Artificial Sequence: Synthetic polypeptide
DESEIVTTNPVATECWGTVCSCDGPPQFEGNG

SEQ ID NO: 142522 - protein, 28 aa, Artificial Sequence
  Description of Artificial Sequence: Synthetic peptide
QEFWIATTNPVATEQYGEAPEVCQHEEK

SEQ ID NO: 142523 - protein, 36 aa, Artificial Sequence
  Description of Artificial Sequence: Synthetic polypeptide
DEEEIATTNPVATEQYGSVCAGTDGPQPDDEMGNGH

SEQ ID NO: 142524 - protein, 28 aa, Artificial Sequence
  Description of Artificial Sequence: Synthetic peptide
QEFEISSTNPVGTEGYGVMASTLEHGDI

SEQ ID NO: 142525 - protein, 36 aa, Artificial Sequence
  Description of Artificial Sequence: Synthetic polypeptide
DEEEIRTTNPVATEGYGICVCSTGNLNQENFISDQA

SEQ ID NO: 142526 - protein, 33 aa, Artificial Sequence
  Description of Artificial Sequence: Synthetic polypeptide
DESEIVTTNPVATECWGSVSCDNEPEDFEGENG

SEQ ID NO: 142527 - protein, 32 aa, Artificial Sequence
  Description of Artificial Sequence: Synthetic polypeptide
QECEICTTNPVATEAYGVVSTELQLNQDEEIL

SEQ ID NO: 142528 - protein, 36 aa, Artificial Sequence
  Description of Artificial Sequence: Synthetic polypeptide
DEEEIRTTNPVATEQYGCVCSTLFGLPEGDEESIQD

SEQ ID NO: 142529 - protein, 31 aa, Artificial Sequence
  Description of Artificial Sequence: Synthetic polypeptide
DESEIASTNPVGTEGYGVMSASTLPQHGMDI

SEQ ID NO: 142530 - protein, 33 aa, Artificial Sequence
  Description of Artificial Sequence: Synthetic polypeptide
QECEICTTNPVATEAYGVVSTELQLQAGEEILQ

SEQ ID NO: 142531 - protein, 36 aa, Artificial Sequence
  Description of Artificial Sequence: Synthetic polypeptide
DEEEIATTNPVATEQYGSVCAGTDGLQNDLAEAGPW

SEQ ID NO: 142532 - protein, 32 aa, Artificial Sequence
  Description of Artificial Sequence: Synthetic polypeptide
QEEEIATTNPVATEQYGEVAPCEVCSQHVGEK

SEQ ID NO: 142533 - protein, 31 aa, Artificial Sequence
  Description of Artificial Sequence: Synthetic polypeptide
DESEIASTNPVGTEGYGVMSCITLQDHGENG

SEQ ID NO: 142534 - protein, 35 aa, Artificial Sequence
  Description of Artificial Sequence: Synthetic polypeptide
DEEEIATTNPVATEQYGSVCAGTDGPLPEDMENFP

SEQ ID NO: 142535 - protein, 33 aa, Artificial Sequence
  Description of Artificial Sequence: Synthetic polypeptide
DESEIVTTNPVATECYGTVCSCINEPEDFEGND

SEQ ID NO: 142536 - protein, 34 aa, Artificial Sequence
  Description of Artificial Sequence: Synthetic polypeptide
DEEEIATTNPVATEQYGSVCAMMNPEEADNQENH

SEQ ID NO: 142537 - protein, 33 aa, Artificial Sequence
  Description of Artificial Sequence: Synthetic polypeptide
DESEIVTTNPVATECYGTVSATDGEVEFEGENG

SEQ ID NO: 142538 - protein, 33 aa, Artificial Sequence
  Description of Artificial Sequence: Synthetic polypeptide
DESEIVTTNPVATEQYGTVCSACDGPPEFEGND

SEQ ID NO: 142539 - protein, 29 aa, Artificial Sequence
  Description of Artificial Sequence: Synthetic peptide
DESEIASTNPVGTEGYGVIAMDLQQNGDH

SEQ ID NO: 142540 - protein, 35 aa, Artificial Sequence
  Description of Artificial Sequence: Synthetic polypeptide
DEEEIRTTNPVATEQYGSVDSPWQDLINVPIMQLE

SEQ ID NO: 142541 - protein, 29 aa, Artificial Sequence
  Description of Artificial Sequence: Synthetic peptide
DESEIASTNPVGTEGYGVIAMDLQQNGDI

SEQ ID NO: 142542 - protein, 37 aa, Artificial Sequence
  Description of Artificial Sequence: Synthetic polypeptide
SESEIRTTNPVATEQYGSSVCSVTNVLTQENGSDEDD

SEQ ID NO: 142543 - protein, 29 aa, Artificial Sequence
  Description of Artificial Sequence: Synthetic peptide
DESEIASTNPVGTEGYGVIASDLQHNGDI

SEQ ID NO: 142544 - protein, 29 aa, Artificial Sequence
  Description of Artificial Sequence: Synthetic peptide
DESEIASTNPVGTEGYGVIAMDLQHNGDI

SEQ ID NO: 142545 - protein, 31 aa, Artificial Sequence
  Description of Artificial Sequence: Synthetic polypeptide
DESEIASTNPVGTEGYGVISMEDLQQQNGNH

SEQ ID NO: 142546 - protein, 35 aa, Artificial Sequence
  Description of Artificial Sequence: Synthetic polypeptide
DEEEIRTTNPVATCQYGSVSCVVDLNNPNSQIDEQ

SEQ ID NO: 142547 - protein, 28 aa, Artificial Sequence
  Description of Artificial Sequence: Synthetic peptide
QEGEIAPTNPCASEQWGIVSCILMSEDR

SEQ ID NO: 142548 - protein, 35 aa, Artificial Sequence
  Description of Artificial Sequence: Synthetic polypeptide
SESEIRTTNPVATEQYGSVSWTLLDNINEELNEIL

SEQ ID NO: 142549 - protein, 29 aa, Artificial Sequence
  Description of Artificial Sequence: Synthetic peptide
DESEIASTNPVGTEGYGVMACTLQHGEDI

SEQ ID NO: 142550 - protein, 34 aa, Artificial Sequence
  Description of Artificial Sequence: Synthetic polypeptide
DESEIVTTNPVATEQYGQVVSATDGEDEGGEGND

SEQ ID NO: 142551 - protein, 34 aa, Artificial Sequence
  Description of Artificial Sequence: Synthetic polypeptide
SESEIRTTNPVAYEQWGQVSSCTTMQSADGGNRA

SEQ ID NO: 142552 - protein, 30 aa, Artificial Sequence
  Description of Artificial Sequence: Synthetic polypeptide
QEEEIATTNPVATEQYGEAPNAEVCQHEEK

SEQ ID NO: 142553 - protein, 29 aa, Artificial Sequence
  Description of Artificial Sequence: Synthetic peptide
QEGEIACTNPVGTEGYGVHASTLQHGDDI

SEQ ID NO: 142554 - protein, 37 aa, Artificial Sequence
  Description of Artificial Sequence: Synthetic polypeptide
DEEEIATTNPVATEQYGSVCAMNNGLLAPGNQMEGNH

SEQ ID NO: 142555 - protein, 29 aa, Artificial Sequence
  Description of Artificial Sequence: Synthetic peptide
QEGEIAPTNPCASEQYGIVSCNEMNSGDA

SEQ ID NO: 142556 - protein, 37 aa, Artificial Sequence
  Description of Artificial Sequence: Synthetic polypeptide
DEEEIRTTNPVAMEQYGSVSVITGGDLGQEEQGEGGF

SEQ ID NO: 142557 - protein, 36 aa, Artificial Sequence
  Description of Artificial Sequence: Synthetic polypeptide
DEEEIRTTNPVAMEQYGSVVSTGGDTGQEEQGEGGF

SEQ ID NO: 142558 - protein, 30 aa, Artificial Sequence
  Description of Artificial Sequence: Synthetic polypeptide
QECEICATNPCTTEIYGVVSTSTLQNGTDM

SEQ ID NO: 142559 - protein, 30 aa, Artificial Sequence
  Description of Artificial Sequence: Synthetic polypeptide
QEEEIATTNPVATEQYGEAPNEVACQHEEK

SEQ ID NO: 142560 - protein, 31 aa, Artificial Sequence
  Description of Artificial Sequence: Synthetic polypeptide
DESEIASTNPVGTEGYGSMACITLQREGEDG

SEQ ID NO: 142561 - protein, 30 aa, Artificial Sequence
  Description of Artificial Sequence: Synthetic polypeptide
QEEEIATTNPVATEQYGEAPNEEVCQHEEK

SEQ ID NO: 142562 - protein, 36 aa, Artificial Sequence
  Description of Artificial Sequence: Synthetic polypeptide
DEEEIATTNPVATEQYGSVCAMNNGLNQTAGPSESQ

SEQ ID NO: 142563 - protein, 31 aa, Artificial Sequence
  Description of Artificial Sequence: Synthetic polypeptide
DESEIASTNPVGTEGYGSMASITLQHEGEDI

SEQ ID NO: 142564 - protein, 37 aa, Artificial Sequence
  Description of Artificial Sequence: Synthetic polypeptide
DEEEIRTTNPVASEQYGSAVSSTTPAGPNMRNGMNPV

SEQ ID NO: 142565 - protein, 33 aa, Artificial Sequence
  Description of Artificial Sequence: Synthetic polypeptide
DESEIVTTNPVATEQYGTVCSATDGPVEFEGDD

SEQ ID NO: 142566 - protein, 34 aa, Artificial Sequence
  Description of Artificial Sequence: Synthetic polypeptide
DESEIVTTNPVATEQYGTVCSATDGEVEFEGEND

SEQ ID NO: 142567 - protein, 32 aa, Artificial Sequence
  Description of Artificial Sequence: Synthetic polypeptide
ADEELNTTNPVATECYGTCSKSINLENGGNVV

SEQ ID NO: 142568 - protein, 34 aa, Artificial Sequence
  Description of Artificial Sequence: Synthetic polypeptide
DESEIVTTNPVATEQYGTVCSATDGEPSTFEGND

SEQ ID NO: 142569 - protein, 35 aa, Artificial Sequence
  Description of Artificial Sequence: Synthetic polypeptide
DEEEIRTTNPVATEGYGMVDGGNMGQEGGEGNDEE

SEQ ID NO: 142570 - protein, 34 aa, Artificial Sequence
  Description of Artificial Sequence: Synthetic polypeptide
DESEIVTTNPVATEQYGTVCSATDGPVEFEGEND

SEQ ID NO: 142571 - protein, 28 aa, Artificial Sequence
  Description of Artificial Sequence: Synthetic peptide
QEFEIASTNPVGIEGYGVMASTLQHGDI

SEQ ID NO: 142572 - protein, 35 aa, Artificial Sequence
  Description of Artificial Sequence: Synthetic polypeptide
DEDEIRTTNPVATEAWGSVSAINNEGQNGEGENIG

SEQ ID NO: 142573 - protein, 30 aa, Artificial Sequence
  Description of Artificial Sequence: Synthetic polypeptide
SESEVACTNPVSTEGYGNVSAETIQRVGQR

SEQ ID NO: 142574 - protein, 35 aa, Artificial Sequence
  Description of Artificial Sequence: Synthetic polypeptide
DEEEIRTTNPVATDQYGVVNDNSIGQNGQEDENDD

SEQ ID NO: 142575 - protein, 35 aa, Artificial Sequence
  Description of Artificial Sequence: Synthetic polypeptide
DEEEIRTTNPVATDQYGVVNDNSIGQNGQEDNEND

SEQ ID NO: 142576 - protein, 28 aa, Artificial Sequence
  Description of Artificial Sequence: Synthetic peptide
DESEIASTNPVGTEGYGVMASTEQAEDI

SEQ ID NO: 142577 - protein, 34 aa, Artificial Sequence
  Description of Artificial Sequence: Synthetic polypeptide
DEDEIRTTNPVATEAWGSVSAGNEGGDGEGENGL

SEQ ID NO: 142578 - protein, 34 aa, Artificial Sequence
  Description of Artificial Sequence: Synthetic polypeptide
DEEEIRTTNPVATDQYGVVNDNSIGQNGQGDDET

SEQ ID NO: 142579 - protein, 35 aa, Artificial Sequence
  Description of Artificial Sequence: Synthetic polypeptide
DEEEIRTTNPVATDQYGVVNDNSIGQNGQGDNEDQ

SEQ ID NO: 142580 - protein, 35 aa, Artificial Sequence
  Description of Artificial Sequence: Synthetic polypeptide
DEEEIRTTNPVATDQYGVVNDNSIGQNEGQDDNGD

SEQ ID NO: 142581 - protein, 37 aa, Artificial Sequence
  Description of Artificial Sequence: Synthetic polypeptide
DEEEIATTNPVATEQYGSVCAMNAHALDQMAPGMQNN

SEQ ID NO: 142582 - protein, 34 aa, Artificial Sequence
  Description of Artificial Sequence: Synthetic polypeptide
DEDEIRTTNPVATEAWGSVSAGMEGQGGEGENEG

SEQ ID NO: 142583 - protein, 33 aa, Artificial Sequence
  Description of Artificial Sequence: Synthetic polypeptide
DEDEIRTTNPVATEAWGSVSAGMEGQDGEGEFG

SEQ ID NO: 142584 - protein, 35 aa, Artificial Sequence
  Description of Artificial Sequence: Synthetic polypeptide
DEEEIRTTNPVATDQYGVVNDNSIGQNGQGDQNDI

SEQ ID NO: 142585 - protein, 35 aa, Artificial Sequence
  Description of Artificial Sequence: Synthetic polypeptide
DEEEIRTTNPVATDQYGVVNDNSIGQNGQGDTNTD

SEQ ID NO: 142586 - protein, 35 aa, Artificial Sequence
  Description of Artificial Sequence: Synthetic polypeptide
DEEEIRTTNPVATDQYGVVNDQSIGQNGQGDNNED

SEQ ID NO: 142587 - protein, 33 aa, Artificial Sequence
  Description of Artificial Sequence: Synthetic polypeptide
DESEIVTTNPVATECYGTVSCINEPEDFEGENG

SEQ ID NO: 142588 - protein, 34 aa, Artificial Sequence
  Description of Artificial Sequence: Synthetic polypeptide
DESEIVTTNPVATEQWGSVCSCIGPVQDFEGENG

SEQ ID NO: 142589 - protein, 32 aa, Artificial Sequence
  Description of Artificial Sequence: Synthetic polypeptide
SESEIRTVNPVATDQWGSAVITPHGDRGENYG

SEQ ID NO: 142590 - protein, 35 aa, Artificial Sequence
  Description of Artificial Sequence: Synthetic polypeptide
DEEEIATTNPVATEQYGSVCAMNGNLEPADIPNGN

SEQ ID NO: 142591 - protein, 34 aa, Artificial Sequence
  Description of Artificial Sequence: Synthetic polypeptide
DEDEIRTTNPVATEAWGSVSAINEGGDGEGENME

SEQ ID NO: 142592 - protein, 31 aa, Artificial Sequence
  Description of Artificial Sequence: Synthetic polypeptide
QECEICTTNPVATEAYGVVSNEQLLLQDEEL

SEQ ID NO: 142593 - protein, 29 aa, Artificial Sequence
  Description of Artificial Sequence: Synthetic peptide
QEGEIACTNPVGTEGWGVSASTLQHGDDP

SEQ ID NO: 142594 - protein, 30 aa, Artificial Sequence
  Description of Artificial Sequence: Synthetic polypeptide
SESEVASTNPVSTEQYGNVAAETIQRVGQR

SEQ ID NO: 142595 - protein, 29 aa, Artificial Sequence
  Description of Artificial Sequence: Synthetic peptide
QEGEIACTNPVGTEGWGVSASTLQHGDDF

SEQ ID NO: 142596 - protein, 29 aa, Artificial Sequence
  Description of Artificial Sequence: Synthetic peptide
QEGEIACTNPVGTEGWGVSASTLQGGDEQ

SEQ ID NO: 142597 - protein, 28 aa, Artificial Sequence
  Description of Artificial Sequence: Synthetic peptide
QEGEIACTNPVGTEGWGVSASALQGGDS

SEQ ID NO: 142598 - protein, 36 aa, Artificial Sequence
  Description of Artificial Sequence: Synthetic polypeptide
DEEEIATTNPVATEQYGSVCAMNGNLEPGAGISNEA

SEQ ID NO: 142599 - protein, 31 aa, Artificial Sequence
  Description of Artificial Sequence: Synthetic polypeptide
SETAEIACTNPVAYEQYGCVATNLQAPPPPE

SEQ ID NO: 142600 - protein, 29 aa, Artificial Sequence
  Description of Artificial Sequence: Synthetic peptide
DESEIASTNPVGTEGYGVMASDLQHEGDI

SEQ ID NO: 142601 - protein, 35 aa, Artificial Sequence
  Description of Artificial Sequence: Synthetic polypeptide
DEEEIATTNPVATEQYGSVCAMNGVGNQTAGPMES

SEQ ID NO: 142602 - protein, 34 aa, Artificial Sequence
  Description of Artificial Sequence: Synthetic polypeptide
SETEIACTNPVATEQYGSVYCTWNDQHHQGHNIQ

SEQ ID NO: 142603 - protein, 34 aa, Artificial Sequence
  Description of Artificial Sequence: Synthetic polypeptide
DEEEIATTNPVATEQWGSVSVSGEGENTRGVEEF

SEQ ID NO: 142604 - protein, 34 aa, Artificial Sequence
  Description of Artificial Sequence: Synthetic polypeptide
SETEIACTNPVATEQYGSVYCTWNDQHHQGKNQH

SEQ ID NO: 142605 - protein, 30 aa, Artificial Sequence
  Description of Artificial Sequence: Synthetic polypeptide
DESEIASTNPVGTEGYGVMASETLQHKGDI

SEQ ID NO: 142606 - protein, 30 aa, Artificial Sequence
  Description of Artificial Sequence: Synthetic polypeptide
DESEIASTNPVGTEGYGVMAQSTLKQHGDI

SEQ ID NO: 142607 - protein, 36 aa, Artificial Sequence
  Description of Artificial Sequence: Synthetic polypeptide
DEEEIRTTNPVAMEQYGSVSSTTPAGPNMRNGMPPV

SEQ ID NO: 142608 - protein, 28 aa, Artificial Sequence
  Description of Artificial Sequence: Synthetic peptide
QEEYLATTNPVATEQYGEAPEVCQHEEK

SEQ ID NO: 142609 - protein, 35 aa, Artificial Sequence
  Description of Artificial Sequence: Synthetic polypeptide
DEEEIATTNPVATEQYGSVCAGMHGQDSMGDNSAM

SEQ ID NO: 142610 - protein, 32 aa, Artificial Sequence
  Description of Artificial Sequence: Synthetic polypeptide
AEAEIAATNPVAYEQYGEASCENLSQRVGGMK

SEQ ID NO: 142611 - protein, 28 aa, Artificial Sequence
  Description of Artificial Sequence: Synthetic peptide
QEENIATTNPIATEQYGEAPCVCQHEEK

SEQ ID NO: 142612 - protein, 35 aa, Artificial Sequence
  Description of Artificial Sequence: Synthetic polypeptide
DEEEIRTTNPVATEQYGCVCSTGEHQEHFISETQA

SEQ ID NO: 142613 - protein, 33 aa, Artificial Sequence
  Description of Artificial Sequence: Synthetic polypeptide
DESEIRTTNPVSTEPYGTVCSMQDIQQQQNGNH

SEQ ID NO: 142614 - protein, 33 aa, Artificial Sequence
  Description of Artificial Sequence: Synthetic polypeptide
DESEIRTTNPVSTEPYGTVISMEDHSQQQNGNH

SEQ ID NO: 142615 - protein, 33 aa, Artificial Sequence
  Description of Artificial Sequence: Synthetic polypeptide
QECEICTTNPVATEAYGVVSTEQLLQQGEEQQQ

SEQ ID NO: 142616 - protein, 31 aa, Artificial Sequence
  Description of Artificial Sequence: Synthetic polypeptide
DESEIASTNPVSTEGYGNVAANTIQSRVGQK

SEQ ID NO: 142617 - protein, 33 aa, Artificial Sequence
  Description of Artificial Sequence: Synthetic polypeptide
QEEEIATTNPVATEQYGEVPCINEPQDHEEENK

SEQ ID NO: 142618 - protein, 35 aa, Artificial Sequence
  Description of Artificial Sequence: Synthetic polypeptide
QECEICTTNPVATEAYGVVSTENQQLQNGNEEQGN

SEQ ID NO: 142619 - protein, 33 aa, Artificial Sequence
  Description of Artificial Sequence: Synthetic polypeptide
DESEIRTTNPVSTEQWGSCYTFDNQQNGGGKQS

SEQ ID NO: 142620 - protein, 35 aa, Artificial Sequence
  Description of Artificial Sequence: Synthetic polypeptide
QECEICTTNPVATEAYGVVSTENQNLQQGNEEQDD

SEQ ID NO: 142621 - protein, 32 aa, Artificial Sequence
  Description of Artificial Sequence: Synthetic polypeptide
SQEEIRTTNPVATEQWGTKYGSWNLTEEPINI

SEQ ID NO: 142622 - protein, 35 aa, Artificial Sequence
  Description of Artificial Sequence: Synthetic polypeptide
AEAAEIATTNPVAYEQWGSVCSTNDHQDRDGHNQQ

SEQ ID NO: 142623 - protein, 30 aa, Artificial Sequence
  Description of Artificial Sequence: Synthetic polypeptide
ADSEIASTNPVATEGYGNVANTIQSRVGQR

SEQ ID NO: 142624 - protein, 37 aa, Artificial Sequence
  Description of Artificial Sequence: Synthetic polypeptide
DEEEIRTTNPVATEQYGSVIQPFNLVIIPEQQPTSNL

SEQ ID NO: 142625 - protein, 34 aa, Artificial Sequence
  Description of Artificial Sequence: Synthetic polypeptide
SQEEIRTTNPVATEQWGQCVCSWELNQNFGSNQA

SEQ ID NO: 142626 - protein, 38 aa, Artificial Sequence
  Description of Artificial Sequence: Synthetic polypeptide
AEEEIRTTNPVATEQYGSVATTTNLQQGNNQQGNNNAN

SEQ ID NO: 142627 - protein, 34 aa, Artificial Sequence
  Description of Artificial Sequence: Synthetic polypeptide
DEEEIRTTNPVATEAYGSCCMTEAWLSATIGSQE

SEQ ID NO: 142628 - protein, 36 aa, Artificial Sequence
  Description of Artificial Sequence: Synthetic polypeptide
AEEEIRTTNPVATEQYGSVATVTNVNNNVEEGTNVA

SEQ ID NO: 142629 - protein, 34 aa, Artificial Sequence
  Description of Artificial Sequence: Synthetic polypeptide
DEDEIRTTNPCAYEQWGSVAWTENDQGQDGDGRS

SEQ ID NO: 142630 - protein, 37 aa, Artificial Sequence
  Description of Artificial Sequence: Synthetic polypeptide
AEEEIRTTNPVATEQYGSVATVTNTNLEAGTNEENTD

SEQ ID NO: 142631 - protein, 34 aa, Artificial Sequence
  Description of Artificial Sequence: Synthetic polypeptide
DEEEIATTNPVATEQYGSVCAGEGGGQNDLDGEM

SEQ ID NO: 142632 - protein, 30 aa, Artificial Sequence
  Description of Artificial Sequence: Synthetic polypeptide
QEEEIATTNPVATEQYGEAPIEVCQHEEEK

SEQ ID NO: 142633 - protein, 37 aa, Artificial Sequence
  Description of Artificial Sequence: Synthetic polypeptide
AEEEIRTTNPVATEQYGSVATTNQQQGNNQQGTNGAG

SEQ ID NO: 142634 - protein, 36 aa, Artificial Sequence
  Description of Artificial Sequence: Synthetic polypeptide
AEEEIRTTNPVATEQYGSVATVTNTEQGTNNVTTEE

SEQ ID NO: 142635 - protein, 36 aa, Artificial Sequence
  Description of Artificial Sequence: Synthetic polypeptide
DEEEIRTTNPVATEQYGSVIQPFTLVIEPEQQLSNL

SEQ ID NO: 142636 - protein, 34 aa, Artificial Sequence
  Description of Artificial Sequence: Synthetic polypeptide
QECEICTTNPVATEAYGVVSTENLQLQQGDEEEL

SEQ ID NO: 142637 - protein, 31 aa, Artificial Sequence
  Description of Artificial Sequence: Synthetic polypeptide
DESEIASTNPVSTEGYGNVAANDIQDRVGQL

SEQ ID NO: 142638 - protein, 29 aa, Artificial Sequence
  Description of Artificial Sequence: Synthetic peptide
AETEICATNPCTTEIYGVVNNSTLQNGTI

SEQ ID NO: 142639 - protein, 37 aa, Artificial Sequence
  Description of Artificial Sequence: Synthetic polypeptide
AEEEIRTTNPVATEQYGSVATTTNQQQGNNQTGNNAA

SEQ ID NO: 142640 - protein, 31 aa, Artificial Sequence
  Description of Artificial Sequence: Synthetic polypeptide
DESEIASTNPVSTEGYGNVAANTCQSRVEER

SEQ ID NO: 142641 - protein, 33 aa, Artificial Sequence
  Description of Artificial Sequence: Synthetic polypeptide
QECEICTTNPVATEAYGVVSTELQQLQQGETEL

SEQ ID NO: 142642 - protein, 31 aa, Artificial Sequence
  Description of Artificial Sequence: Synthetic polypeptide
DESEIASTNPVSTEGYGNVAANTIQSSVGTR

SEQ ID NO: 142643 - protein, 32 aa, Artificial Sequence
  Description of Artificial Sequence: Synthetic polypeptide
QECEICTTNPVATEAYGVVSTEQLNQGEDELQ

SEQ ID NO: 142644 - protein, 37 aa, Artificial Sequence
  Description of Artificial Sequence: Synthetic polypeptide
AEEEIRTTNPVATEQYGSVATTNQQQGNNQQGNNEQI

SEQ ID NO: 142645 - protein, 32 aa, Artificial Sequence
  Description of Artificial Sequence: Synthetic polypeptide
DESEIRTTNPVSTEPYGTISMEDIQQQQNGNH

SEQ ID NO: 142646 - protein, 32 aa, Artificial Sequence
  Description of Artificial Sequence: Synthetic polypeptide
DESEIRTTNPVSTEPYGTISMEDIQQQQAGNH

SEQ ID NO: 142647 - protein, 36 aa, Artificial Sequence
  Description of Artificial Sequence: Synthetic polypeptide
DEEEIRTTNPVATEQYGSVIQKPNLVIDPEQQLSEL

SEQ ID NO: 142648 - protein, 36 aa, Artificial Sequence
  Description of Artificial Sequence: Synthetic polypeptide
AEEEIRTTNPVATEQYGSVATNQNNQQGTIGTDESD

SEQ ID NO: 142649 - protein, 36 aa, Artificial Sequence
  Description of Artificial Sequence: Synthetic polypeptide
AEEEIRTTNPVATEQYGSVATNQNNQQGEAGTDEDE

SEQ ID NO: 142650 - protein, 32 aa, Artificial Sequence
  Description of Artificial Sequence: Synthetic polypeptide
DESEIRTTNPVSTEPYGTISMEDEQQQQNGNH

SEQ ID NO: 142651 - protein, 32 aa, Artificial Sequence
  Description of Artificial Sequence: Synthetic polypeptide
DESEIASTNPVSTEGYGNVSANDIQSRVGQDL

SEQ ID NO: 142652 - protein, 29 aa, Artificial Sequence
  Description of Artificial Sequence: Synthetic peptide
QEEIIATTNPVATEQYGEAPEVCQNHEEK

SEQ ID NO: 142653 - protein, 36 aa, Artificial Sequence
  Description of Artificial Sequence: Synthetic polypeptide
AEEEIRTTNPVATEQYGSVATNNNQNGTEAGEDEDA

SEQ ID NO: 142654 - protein, 30 aa, Artificial Sequence
  Description of Artificial Sequence: Synthetic polypeptide
QEEIIATTNPVATEQYGEAFEVCQPGHEKN

SEQ ID NO: 142655 - protein, 31 aa, Artificial Sequence
  Description of Artificial Sequence: Synthetic polypeptide
AEAEIACTNPVAYEQYGEASCENPSQGVGGR

SEQ ID NO: 142656 - protein, 36 aa, Artificial Sequence
  Description of Artificial Sequence: Synthetic polypeptide
DEEEIATTNPVATEQYGSVCADTNPGQEHQGDEDAE

SEQ ID NO: 142657 - protein, 28 aa, Artificial Sequence
  Description of Artificial Sequence: Synthetic peptide
QEEHIATTNPVATEWYGEAPEVCQHEEK

SEQ ID NO: 142658 - protein, 32 aa, Artificial Sequence
  Description of Artificial Sequence: Synthetic polypeptide
QECEICTTNPVATEAYGVVSTEQLQLQDTEEL

SEQ ID NO: 142659 - protein, 32 aa, Artificial Sequence
  Description of Artificial Sequence: Synthetic polypeptide
DESEIASTNPVSTEGYGSVAANTLEDREGQDL

SEQ ID NO: 142660 - protein, 34 aa, Artificial Sequence
  Description of Artificial Sequence: Synthetic polypeptide
QECEICTTNPVATEAYGVVSTELQQLQNGNEEQL

SEQ ID NO: 142661 - protein, 33 aa, Artificial Sequence
  Description of Artificial Sequence: Synthetic polypeptide
AEAEIACTNPVAYEQYGEASCENLSQNRVGGRD

SEQ ID NO: 142662 - protein, 32 aa, Artificial Sequence
  Description of Artificial Sequence: Synthetic polypeptide
DESEIRTTNPVSTEPYGTISMEDIQQQQVGNH

SEQ ID NO: 142663 - protein, 30 aa, Artificial Sequence
  Description of Artificial Sequence: Synthetic polypeptide
QEEEIATTNPVATEQYGEAPHEVCQTHEEK

SEQ ID NO: 142664 - protein, 28 aa, Artificial Sequence
  Description of Artificial Sequence: Synthetic peptide
QEEMIATTNPVATEQYGEAPEVCNHEEK

SEQ ID NO: 142665 - protein, 37 aa, Artificial Sequence
  Description of Artificial Sequence: Synthetic polypeptide
AEEEIRTTNPVATEQYGSVATTNQQQGNNQIGNNSAD

SEQ ID NO: 142666 - protein, 32 aa, Artificial Sequence
  Description of Artificial Sequence: Synthetic polypeptide
DESEIASTNPVSTEGYGNVAATDLQSHVGEDR

SEQ ID NO: 142667 - protein, 32 aa, Artificial Sequence
  Description of Artificial Sequence: Synthetic polypeptide
DESEIASTNPVSTEGYGNVAATTLQSHVGEDR

SEQ ID NO: 142668 - protein, 34 aa, Artificial Sequence
  Description of Artificial Sequence: Synthetic polypeptide
DEEEIRTTNPVATEGYGCVCSNWEEHQNFGSDQE

SEQ ID NO: 142669 - protein, 34 aa, Artificial Sequence
  Description of Artificial Sequence: Synthetic polypeptide
DECEIATTNPVATEPYGSVCYNNDDQDHNRNDHQ

SEQ ID NO: 142670 - protein, 30 aa, Artificial Sequence
  Description of Artificial Sequence: Synthetic polypeptide
QEEEIATTNPVATEQYGEAPHEVCQHEELK

SEQ ID NO: 142671 - protein, 35 aa, Artificial Sequence
  Description of Artificial Sequence: Synthetic polypeptide
DEEEIATTNPVATEQYGSVCAENNEEAPDNQENNH

SEQ ID NO: 142672 - protein, 33 aa, Artificial Sequence
  Description of Artificial Sequence: Synthetic polypeptide
AEAEIACTNPVAYEQYGEAPSCENLSQRVGGRK

SEQ ID NO: 142673 - protein, 32 aa, Artificial Sequence
  Description of Artificial Sequence: Synthetic polypeptide
DESEIRTTNPVSTEPYGTISMEDIQQQVNGNH

SEQ ID NO: 142674 - protein, 30 aa, Artificial Sequence
  Description of Artificial Sequence: Synthetic polypeptide
QEEEIATTNPVATEQYGEAPHEVCKQHEEK

SEQ ID NO: 142675 - protein, 36 aa, Artificial Sequence
  Description of Artificial Sequence: Synthetic polypeptide
DEEEIRTTNPVATEQYGSVIQLNNLVIQPEQQLSEL

SEQ ID NO: 142676 - protein, 32 aa, Artificial Sequence
  Description of Artificial Sequence: Synthetic polypeptide
AEAEIACTNPVAYEQYGEASCENALSNRVGGR

SEQ ID NO: 142677 - protein, 32 aa, Artificial Sequence
  Description of Artificial Sequence: Synthetic polypeptide
DESEIRTTNPVSTEPYGTISMEDISQQQNGNQ

SEQ ID NO: 142678 - protein, 35 aa, Artificial Sequence
  Description of Artificial Sequence: Synthetic polypeptide
DEDEIRTTNPCAYEQWGSVCSTNWNQGDTGQGNEH

SEQ ID NO: 142679 - protein, 29 aa, Artificial Sequence
  Description of Artificial Sequence: Synthetic peptide
QEEPIATTNPVATEQYGEAPCEVCQQEEK

SEQ ID NO: 142680 - protein, 32 aa, Artificial Sequence
  Description of Artificial Sequence: Synthetic polypeptide
QECEICTTNPVATEAYGVVSTELQLQVDEEEL

SEQ ID NO: 142681 - protein, 34 aa, Artificial Sequence
  Description of Artificial Sequence: Synthetic polypeptide
DESEISHTNPVATECWGSVSCINEPQDRIGENLG

SEQ ID NO: 142682 - protein, 30 aa, Artificial Sequence
  Description of Artificial Sequence: Synthetic polypeptide
QEEEIATTNPVATEQYGEAPIEVNQHMEEK

SEQ ID NO: 142683 - protein, 33 aa, Artificial Sequence
  Description of Artificial Sequence: Synthetic polypeptide
QECEICTTNPVATEAYGVVSTELQLQQGDEELD

SEQ ID NO: 142684 - protein, 35 aa, Artificial Sequence
  Description of Artificial Sequence: Synthetic polypeptide
AEEEIRTTNPVATEQYGSVSCVVDDLNQPNSQIIQ

SEQ ID NO: 142685 - protein, 33 aa, Artificial Sequence
  Description of Artificial Sequence: Synthetic polypeptide
QECEICTTNPVATEAYGVVSTELQLQQGDEEQL

SEQ ID NO: 142686 - protein, 35 aa, Artificial Sequence
  Description of Artificial Sequence: Synthetic polypeptide
DEEEIRTTNPVATEGYGCVCSTEDHNQENFGSEQS

SEQ ID NO: 142687 - protein, 35 aa, Artificial Sequence
  Description of Artificial Sequence: Synthetic polypeptide
DEEEIRTTNPVATEGYGCVCSTGEHDQENFGSDQS

SEQ ID NO: 142688 - protein, 33 aa, Artificial Sequence
  Description of Artificial Sequence: Synthetic polypeptide
DECEIATTNPVATENYGTVTGGNAGNAGNDNGR

SEQ ID NO: 142689 - protein, 34 aa, Artificial Sequence
  Description of Artificial Sequence: Synthetic polypeptide
SNEEIRTTNPVATEQWGCVSLLNTYQEGVQNVPH

SEQ ID NO: 142690 - protein, 35 aa, Artificial Sequence
  Description of Artificial Sequence: Synthetic polypeptide
DESEIRWTNPVATECWGSVESRCINEPQDREGENG

SEQ ID NO: 142691 - protein, 33 aa, Artificial Sequence
  Description of Artificial Sequence: Synthetic polypeptide
QEEVIACTNPVATEQYGSVSMNNSEQLAGPIES

SEQ ID NO: 142692 - protein, 34 aa, Artificial Sequence
  Description of Artificial Sequence: Synthetic polypeptide
QEEVIACTNPVATEQYGSVASNNNQTAGGPNGSK

SEQ ID NO: 142693 - protein, 34 aa, Artificial Sequence
  Description of Artificial Sequence: Synthetic polypeptide
DEEEIRTTNPVATEGYGCVCSSGEHQEFFGSDQE

SEQ ID NO: 142694 - protein, 31 aa, Artificial Sequence
  Description of Artificial Sequence: Synthetic polypeptide
QEEEIATTNPVATEQYGEAPIEVEQMSNEGY

SEQ ID NO: 142695 - protein, 33 aa, Artificial Sequence
  Description of Artificial Sequence: Synthetic polypeptide
QECEICTTNPVATEAYGVVSTELQLQQGEDELG

SEQ ID NO: 142696 - protein, 30 aa, Artificial Sequence
  Description of Artificial Sequence: Synthetic polypeptide
SNFEIRATNPVATEQWGCCSLNTEQEGQEP

SEQ ID NO: 142697 - protein, 29 aa, Artificial Sequence
  Description of Artificial Sequence: Synthetic peptide
QEEVIATTNPVATEQYGEAPWEVCQHEEK

SEQ ID NO: 142698 - protein, 32 aa, Artificial Sequence
  Description of Artificial Sequence: Synthetic polypeptide
SEYEISCTNPVATEQYGCVCETELQHFGSQQS

SEQ ID NO: 142699 - protein, 29 aa, Artificial Sequence
  Description of Artificial Sequence: Synthetic peptide
QEEEIATTNPVATEQYGEAPKEVCICEEK

SEQ ID NO: 142700 - protein, 37 aa, Artificial Sequence
  Description of Artificial Sequence: Synthetic polypeptide
DEEEIRTTNPVATEGYGCVCSTTPADNAERFGSNPVL

SEQ ID NO: 142701 - protein, 30 aa, Artificial Sequence
  Description of Artificial Sequence: Synthetic polypeptide
DESEIASTNPVGTEGYGVVSSSAGNHGMNV

SEQ ID NO: 142702 - protein, 36 aa, Artificial Sequence
  Description of Artificial Sequence: Synthetic polypeptide
DEEEIRTTNPVATEQYGSVIQPNLVIQPTQQSLSEL

SEQ ID NO: 142703 - protein, 36 aa, Artificial Sequence
  Description of Artificial Sequence: Synthetic polypeptide
DEDEIRTTNPVATDAYGSVVNQTNNGLGQRGDEEMT

SEQ ID NO: 142704 - protein, 34 aa, Artificial Sequence
  Description of Artificial Sequence: Synthetic polypeptide
SEYEIRMTNPVATEQYGSVETVNLTEEHIQSNQE

SEQ ID NO: 142705 - protein, 35 aa, Artificial Sequence
  Description of Artificial Sequence: Synthetic polypeptide
DESEISTTNPVATDQYGSVNDTRGLQNLEGGNGDT

SEQ ID NO: 142706 - protein, 31 aa, Artificial Sequence
  Description of Artificial Sequence: Synthetic polypeptide
DESEIASTNPVGTEGYGVVSSSAGPQRGMDI

SEQ ID NO: 142707 - protein, 34 aa, Artificial Sequence
  Description of Artificial Sequence: Synthetic polypeptide
DESEISTTNPVATEQYGTVVSATDGEDEEGEGND

SEQ ID NO: 142708 - protein, 34 aa, Artificial Sequence
  Description of Artificial Sequence: Synthetic polypeptide
DESEISTTNPVATEQYGTVPSATDGPSEFEGGND

SEQ ID NO: 142709 - protein, 31 aa, Artificial Sequence
  Description of Artificial Sequence: Synthetic polypeptide
AETEIATTNPIATECYGATANEENLAERGGR

SEQ ID NO: 142710 - protein, 32 aa, Artificial Sequence
  Description of Artificial Sequence: Synthetic polypeptide
QECEICTTNPVATEAYGVVSTELQLQQDETEL

SEQ ID NO: 142711 - protein, 34 aa, Artificial Sequence
  Description of Artificial Sequence: Synthetic polypeptide
DESEISTTNPVATEQYGITVCSATDGPSEFEGND

SEQ ID NO: 142712 - protein, 34 aa, Artificial Sequence
  Description of Artificial Sequence: Synthetic polypeptide
DEDEIRTTNPVATDAWGSVSAINEGQDGQGENNG

SEQ ID NO: 142713 - protein, 32 aa, Artificial Sequence
  Description of Artificial Sequence: Synthetic polypeptide
QECEICTTNPVATEAYGVVSTELQLQQDEEEL

SEQ ID NO: 142714 - protein, 34 aa, Artificial Sequence
  Description of Artificial Sequence: Synthetic polypeptide
SEYEIRMTNPVATEQYGSVEPVNLWEEHIGSNQQ

SEQ ID NO: 142715 - protein, 33 aa, Artificial Sequence
  Description of Artificial Sequence: Synthetic polypeptide
QEEVIACTNPVATEQYGSVAMNNSEQLAGPNEH

SEQ ID NO: 142716 - protein, 35 aa, Artificial Sequence
  Description of Artificial Sequence: Synthetic polypeptide
DEEEIRTTNPVATEGYGCVCSSEEHNQNFGSENQS

SEQ ID NO: 142717 - protein, 34 aa, Artificial Sequence
  Description of Artificial Sequence: Synthetic polypeptide
DEDEIRTTNPCAYEQWGSVYCGENGLQDGDGGNE

SEQ ID NO: 142718 - protein, 36 aa, Artificial Sequence
  Description of Artificial Sequence: Synthetic polypeptide
AEEEIRTTNPVATEQYGSVNNLTNHWDEEGNMEIGV

SEQ ID NO: 142719 - protein, 34 aa, Artificial Sequence
  Description of Artificial Sequence: Synthetic polypeptide
DESEIRTTNTVATECWGSVSCINECPDREGANEG

SEQ ID NO: 142720 - protein, 36 aa, Artificial Sequence
  Description of Artificial Sequence: Synthetic polypeptide
AEEEIRTTNPVATEQYGSVCVPTNNLEILNDDTQES

SEQ ID NO: 142721 - protein, 35 aa, Artificial Sequence
  Description of Artificial Sequence: Synthetic polypeptide
DEEEIRTTNPVATEQYGCVCSTGELEENFISETQP

SEQ ID NO: 142722 - protein, 31 aa, Artificial Sequence
  Description of Artificial Sequence: Synthetic polypeptide
SQEEIRTTNPVATEHWGTYLSWNLTEAPINK

SEQ ID NO: 142723 - protein, 31 aa, Artificial Sequence
  Description of Artificial Sequence: Synthetic polypeptide
DESEIASTNPVSTEGYGNIAANTIQSRVGQR

SEQ ID NO: 142724 - protein, 36 aa, Artificial Sequence
  Description of Artificial Sequence: Synthetic polypeptide
DEEEIRTTNPVATEQYGSVIQPGQLVIQPEQQLSNL

SEQ ID NO: 142725 - protein, 30 aa, Artificial Sequence
  Description of Artificial Sequence: Synthetic polypeptide
DESEIASTNPVSTEGYGNVAAETIQHVGQR

SEQ ID NO: 142726 - protein, 33 aa, Artificial Sequence
  Description of Artificial Sequence: Synthetic polypeptide
SQEEIRTTNPVATEQWGCVCSSGELQNFGSDQA

SEQ ID NO: 142727 - protein, 34 aa, Artificial Sequence
  Description of Artificial Sequence: Synthetic polypeptide
SQEEIRTTNPVATEQWGCVCSTEDDNQNFGSNQA

SEQ ID NO: 142728 - protein, 31 aa, Artificial Sequence
  Description of Artificial Sequence: Synthetic polypeptide
DESEIASTNPVSTEGYGNVAAMTIQSRVGNH

SEQ ID NO: 142729 - protein, 35 aa, Artificial Sequence
  Description of Artificial Sequence: Synthetic polypeptide
SQEEIRTTNPVATEQWGCVCSTTGNHNQNFGSNQA

SEQ ID NO: 142730 - protein, 29 aa, Artificial Sequence
  Description of Artificial Sequence: Synthetic peptide
QEEPIATTNPVAYEQYGEASPEVCQHEEK

SEQ ID NO: 142731 - protein, 35 aa, Artificial Sequence
  Description of Artificial Sequence: Synthetic polypeptide
DEDEIRTTNPCAYEQWGSVSGGDNPQQDRNGGGGR

SEQ ID NO: 142732 - protein, 36 aa, Artificial Sequence
  Description of Artificial Sequence: Synthetic polypeptide
SNNEIRTTNPVATEQYGSVSTPDNLWQEHIGSEDQM

SEQ ID NO: 142733 - protein, 33 aa, Artificial Sequence
  Description of Artificial Sequence: Synthetic polypeptide
QECEICTTNPVATEAYGVVSTELQLQQGSEEIS

SEQ ID NO: 142734 - protein, 34 aa, Artificial Sequence
  Description of Artificial Sequence: Synthetic polypeptide
SQAEIRTTNPVATEQYGSVSPWNNEEIRNGDTLQ

SEQ ID NO: 142735 - protein, 32 aa, Artificial Sequence
  Description of Artificial Sequence: Synthetic polypeptide
SQAEIRTTNPVATEQWGCAVETTNHLQEIFDS

SEQ ID NO: 142736 - protein, 34 aa, Artificial Sequence
  Description of Artificial Sequence: Synthetic polypeptide
DEDEIRTTNPCAYEQWGSVYYGDNQNEDRGGNAR

SEQ ID NO: 142737 - protein, 36 aa, Artificial Sequence
  Description of Artificial Sequence: Synthetic polypeptide
DEEEIRTTNPVATEQYGCVCSTGEPNQENFNSENQS

SEQ ID NO: 142738 - protein, 33 aa, Artificial Sequence
  Description of Artificial Sequence: Synthetic polypeptide
DECEIATTNPVATEPYGEVSWNENDQHGQGDSA

SEQ ID NO: 142739 - protein, 36 aa, Artificial Sequence
  Description of Artificial Sequence: Synthetic polypeptide
DEEEIRTTNPVATEQYGSVIQPKNLVIDPEQQLSTL

SEQ ID NO: 142740 - protein, 34 aa, Artificial Sequence
  Description of Artificial Sequence: Synthetic polypeptide
DEDEIRTTNPCAYEQWGSVYCGENGLQDGNGSNM

SEQ ID NO: 142741 - protein, 33 aa, Artificial Sequence
  Description of Artificial Sequence: Synthetic polypeptide
QECEICTTNPVATEAYGVVSTELQLQQGEQEEL

SEQ ID NO: 142742 - protein, 32 aa, Artificial Sequence
  Description of Artificial Sequence: Synthetic polypeptide
SQAEIRTTNPVATEQYGCCSIDVSQLGQISKQ

SEQ ID NO: 142743 - protein, 36 aa, Artificial Sequence
  Description of Artificial Sequence: Synthetic polypeptide
DEEEIRTTNPVATEQYGCVCSTGEPNQEHFNSENQS

SEQ ID NO: 142744 - protein, 31 aa, Artificial Sequence
  Description of Artificial Sequence: Synthetic polypeptide
SQAEIRTTNPVATEQYGCCSIVLQHPQDSIQ

SEQ ID NO: 142745 - protein, 36 aa, Artificial Sequence
  Description of Artificial Sequence: Synthetic polypeptide
QEETIRTTNPVATEQYGSVSVTNGGEEGGGQGEQGN

SEQ ID NO: 142746 - protein, 29 aa, Artificial Sequence
  Description of Artificial Sequence: Synthetic peptide
QEETIATTNPVATEQYGEAPVEVCQHEEK

SEQ ID NO: 142747 - protein, 30 aa, Artificial Sequence
  Description of Artificial Sequence: Synthetic polypeptide
QEEEIATTNPVATEQYGEAPIEVCQHHEEK

SEQ ID NO: 142748 - protein, 32 aa, Artificial Sequence
  Description of Artificial Sequence: Synthetic polypeptide
SQAEIRTTNPVATEQYGMCCSIVLQEGQDSSQ

SEQ ID NO: 142749 - protein, 32 aa, Artificial Sequence
  Description of Artificial Sequence: Synthetic polypeptide
SQAEIRTTNPVATEQYGCCSIVDQLGGQNSKQ

SEQ ID NO: 142750 - protein, 33 aa, Artificial Sequence
  Description of Artificial Sequence: Synthetic polypeptide
QECEICTTNPVATEAYGVVSTEQQQLQQGEEQL

SEQ ID NO: 142751 - protein, 36 aa, Artificial Sequence
  Description of Artificial Sequence: Synthetic polypeptide
AEEEIRTTNPVATEAYGSVSTTQQQGQEAGTNNTTE

SEQ ID NO: 142752 - protein, 34 aa, Artificial Sequence
  Description of Artificial Sequence: Synthetic polypeptide
TEEEIRSTNPVAYEWYGSTVSCTGEMLDMGESNA

SEQ ID NO: 142753 - protein, 30 aa, Artificial Sequence
  Description of Artificial Sequence: Synthetic polypeptide
QEEEIATTNPVATEQYGAAWPAVCQEHEPK

SEQ ID NO: 142754 - protein, 37 aa, Artificial Sequence
  Description of Artificial Sequence: Synthetic polypeptide
DEEEIRTTNPVATEAYGVVSTVVNNQQAGNQNNEENE

SEQ ID NO: 142755 - protein, 35 aa, Artificial Sequence
  Description of Artificial Sequence: Synthetic polypeptide
DEEEIRTTNPVATEQYGCVCSMSGEHQEFFGSEQD

SEQ ID NO: 142756 - protein, 36 aa, Artificial Sequence
  Description of Artificial Sequence: Synthetic polypeptide
DEEEIRTTNPVATEQYGCVCSMSGEHNQNFGSDNQS

SEQ ID NO: 142757 - protein, 34 aa, Artificial Sequence
  Description of Artificial Sequence: Synthetic polypeptide
DEDEIATTNPVATAAWGSVSNGINEPQDRGSEND

SEQ ID NO: 142758 - protein, 35 aa, Artificial Sequence
  Description of Artificial Sequence: Synthetic polypeptide
DEEEIRTTNPVATEQYGCVCSMSGEDQENFGSDQS

SEQ ID NO: 142759 - protein, 36 aa, Artificial Sequence
  Description of Artificial Sequence: Synthetic polypeptide
DEEEIATTNPVATEQYGSMSSTTPTGPQMHNGMNPV

SEQ ID NO: 142760 - protein, 34 aa, Artificial Sequence
  Description of Artificial Sequence: Synthetic polypeptide
DEDEIATTNPCAYEQWGSVSTNLNQGETGQDDEE

SEQ ID NO: 142761 - protein, 30 aa, Artificial Sequence
  Description of Artificial Sequence: Synthetic polypeptide
QEEEIATTNPVATEQYGAIAGPEMGQGEED

SEQ ID NO: 142762 - protein, 35 aa, Artificial Sequence
  Description of Artificial Sequence: Synthetic polypeptide
DECEICTTNPVAVEQYGSVSTNNTTNLEQGTTEGQ

SEQ ID NO: 142763 - protein, 32 aa, Artificial Sequence
  Description of Artificial Sequence: Synthetic polypeptide
QEEEIATTNPVATEQYGAVAGPEGGQGEEGQD

SEQ ID NO: 142764 - protein, 34 aa, Artificial Sequence
  Description of Artificial Sequence: Synthetic polypeptide
TSEEISTTNPTATEHYGSVCCINNMLSQGEGNRS

SEQ ID NO: 142765 - protein, 34 aa, Artificial Sequence
  Description of Artificial Sequence: Synthetic polypeptide
DEEEIRTTNPVATEQYGCVCSDWGEHINFGSDQS

SEQ ID NO: 142766 - protein, 33 aa, Artificial Sequence
  Description of Artificial Sequence: Synthetic polypeptide
DEDEIACTNPVAYEQYGSVATNLQGTPQDEDAH

SEQ ID NO: 142767 - protein, 35 aa, Artificial Sequence
  Description of Artificial Sequence: Synthetic polypeptide
DEEEIRTTNPVATEQYGCVCSMSEHNQEFFGSDQS

SEQ ID NO: 142768 - protein, 35 aa, Artificial Sequence
  Description of Artificial Sequence: Synthetic polypeptide
DEEEIRTTNPVATEQYGCVCSMTEDAENFNSETQA

SEQ ID NO: 142769 - protein, 30 aa, Artificial Sequence
  Description of Artificial Sequence: Synthetic polypeptide
QEEEIATTNPVATEQYGAAWAAVCQEHEPK

SEQ ID NO: 142770 - protein, 31 aa, Artificial Sequence
  Description of Artificial Sequence: Synthetic polypeptide
DEDEIATTNPVATAQWGCVAGTGLETPDQGN

SEQ ID NO: 142771 - protein, 32 aa, Artificial Sequence
  Description of Artificial Sequence: Synthetic polypeptide
AEEEIASVNPVCTEQWGCVVCSDNLDQSGNHQ

SEQ ID NO: 142772 - protein, 37 aa, Artificial Sequence
  Description of Artificial Sequence: Synthetic polypeptide
AEDEIRATNPVATEQYGSVSTTNQQLQQLQQGTNQEE

SEQ ID NO: 142773 - protein, 37 aa, Artificial Sequence
  Description of Artificial Sequence: Synthetic polypeptide
AEEEIRTTNPVATEQYGSVSVVSVNQQQGTNNNNQQD

SEQ ID NO: 142774 - protein, 34 aa, Artificial Sequence
  Description of Artificial Sequence: Synthetic polypeptide
TSEEIRTTNPTATEHYGSVACINNMLSQGEGNNM

SEQ ID NO: 142775 - protein, 35 aa, Artificial Sequence
  Description of Artificial Sequence: Synthetic polypeptide
TSEEIRTTNPTATEHYGSVSCINNMLSGNGEGNRE

SEQ ID NO: 142776 - protein, 37 aa, Artificial Sequence
  Description of Artificial Sequence: Synthetic polypeptide
DEEEIRTTNPVATEQYGSVGSPWNNLGNTTQTEELFQ

SEQ ID NO: 142777 - protein, 35 aa, Artificial Sequence
  Description of Artificial Sequence: Synthetic polypeptide
TSEEIRTTNPTATEHYGTHVSCINNMLSQGEGNRE

SEQ ID NO: 142778 - protein, 35 aa, Artificial Sequence
  Description of Artificial Sequence: Synthetic polypeptide
DEEEIRTTNPVATEQYGCVCSMTEHNQNFSSETQS

SEQ ID NO: 142779 - protein, 36 aa, Artificial Sequence
  Description of Artificial Sequence: Synthetic polypeptide
DEEEIRTTNPVATEQYGCVCSMTEHNQENFNSDNQS

SEQ ID NO: 142780 - protein, 37 aa, Artificial Sequence
  Description of Artificial Sequence: Synthetic polypeptide
AEDEIRATNPVATEQYGSVSTTNQQLTNLQQGTNQQD

SEQ ID NO: 142781 - protein, 36 aa, Artificial Sequence
  Description of Artificial Sequence: Synthetic polypeptide
DEEEIRTTNPVATEQYGCVCSMTEESHNQNFNSEQS

SEQ ID NO: 142782 - protein, 36 aa, Artificial Sequence
  Description of Artificial Sequence: Synthetic polypeptide
DEEEIRTTNPVATEQYGCVCSMTEEHNQYFNSETQS

SEQ ID NO: 142783 - protein, 36 aa, Artificial Sequence
  Description of Artificial Sequence: Synthetic polypeptide
DECEICTTNPVAVEQYGSVSTNNTTNLEQGTNNNGQ

SEQ ID NO: 142784 - protein, 36 aa, Artificial Sequence
  Description of Artificial Sequence: Synthetic polypeptide
DEEEIRTTNPVATEQYGSVMGLMVNNDQDEGGEPDE

SEQ ID NO: 142785 - protein, 34 aa, Artificial Sequence
  Description of Artificial Sequence: Synthetic polypeptide
AEEEIACTNPVATEQYGSVSTTAGPNMRNGMGPV

SEQ ID NO: 142786 - protein, 32 aa, Artificial Sequence
  Description of Artificial Sequence: Synthetic polypeptide
QEEEIATTNPVATEQYGAVAGPEGGQGGEEED

SEQ ID NO: 142787 - protein, 32 aa, Artificial Sequence
  Description of Artificial Sequence: Synthetic polypeptide
AEEEIASVNPVCTEQYGCVCSDNDQSFGSNQA

SEQ ID NO: 142788 - protein, 35 aa, Artificial Sequence
  Description of Artificial Sequence: Synthetic polypeptide
DEEEIRTTNPVATEQYGCVCSDWGEDHQGFGSDQS

SEQ ID NO: 142789 - protein, 29 aa, Artificial Sequence
  Description of Artificial Sequence: Synthetic peptide
QEEEIATTNPVATEWYGEAPEVCMQHEEK

SEQ ID NO: 142790 - protein, 35 aa, Artificial Sequence
  Description of Artificial Sequence: Synthetic polypeptide
DEEEIATTNPVATEQYGSCSGTGTPDNNSGMENGN

SEQ ID NO: 142791 - protein, 34 aa, Artificial Sequence
  Description of Artificial Sequence: Synthetic polypeptide
TTEEIRGTNPVATEQYGSVSNGINDGQEGGEGQG

SEQ ID NO: 142792 - protein, 38 aa, Artificial Sequence
  Description of Artificial Sequence: Synthetic polypeptide
DEEEIRTTNPVATEAYGVVSTVVNNNLQAGNDEDEEDT

SEQ ID NO: 142793 - protein, 31 aa, Artificial Sequence
  Description of Artificial Sequence: Synthetic polypeptide
QEEEIATTNPVATEQYGCAPEHGQDSEGEHQ

SEQ ID NO: 142794 - protein, 34 aa, Artificial Sequence
  Description of Artificial Sequence: Synthetic polypeptide
TTEEIRGTNPVATEQYGSVSNGINNGNLNGEGQG

SEQ ID NO: 142795 - protein, 29 aa, Artificial Sequence
  Description of Artificial Sequence: Synthetic peptide
QEEEIATTNPVATEQYGEAPEVCMHEEVK

SEQ ID NO: 142796 - protein, 35 aa, Artificial Sequence
  Description of Artificial Sequence: Synthetic polypeptide
DEEEIRTTNPVATEQYGCVCSDTGEDNENFNSEQS

SEQ ID NO: 142797 - protein, 34 aa, Artificial Sequence
  Description of Artificial Sequence: Synthetic polypeptide
TTEEIRGTNPVATEQYGSVVDGTENGQNTGEGQG

SEQ ID NO: 142798 - protein, 36 aa, Artificial Sequence
  Description of Artificial Sequence: Synthetic polypeptide
DEEEIRTTNPVATEQYGSVMGLLINDQEGGGQTTGQ

SEQ ID NO: 142799 - protein, 35 aa, Artificial Sequence
  Description of Artificial Sequence: Synthetic polypeptide
DECEICTTNPVAVEQYGSVSTNTTNDEQGTNNTGD

SEQ ID NO: 142800 - protein, 36 aa, Artificial Sequence
  Description of Artificial Sequence: Synthetic polypeptide
DEEEIRTTNPVATEQYGSVMGLLIDDQEGGGQTEDQ

SEQ ID NO: 142801 - protein, 29 aa, Artificial Sequence
  Description of Artificial Sequence: Synthetic peptide
QEEEIATTNPVATEQYGEAPEVCMHEESK

SEQ ID NO: 142802 - protein, 35 aa, Artificial Sequence
  Description of Artificial Sequence: Synthetic polypeptide
DEEEIRTTNPVATEQYGCVCSDTEHNQNFSSDTQM

SEQ ID NO: 142803 - protein, 38 aa, Artificial Sequence
  Description of Artificial Sequence: Synthetic polypeptide
DEEEIRTTNPVATEAYGVVSTVVNNLQQQDEGTNVATE

SEQ ID NO: 142804 - protein, 37 aa, Artificial Sequence
  Description of Artificial Sequence: Synthetic polypeptide
AEDEIRATNPVATEQYGSVSTTNQQNLQLQQGTNNQQ

SEQ ID NO: 142805 - protein, 34 aa, Artificial Sequence
  Description of Artificial Sequence: Synthetic polypeptide
TTEEIATTNPVATTQWGSVAWTENGDQDNGGNTR

SEQ ID NO: 142806 - protein, 29 aa, Artificial Sequence
  Description of Artificial Sequence: Synthetic peptide
QEEEIATTNPVATEQYGEAPEVCMMHEEK

SEQ ID NO: 142807 - protein, 36 aa, Artificial Sequence
  Description of Artificial Sequence: Synthetic polypeptide
TTEEAEIRTTNPVAYEQWGSVSWNNDGLQEQGGNMM

SEQ ID NO: 142808 - protein, 30 aa, Artificial Sequence
  Description of Artificial Sequence: Synthetic polypeptide
YEEEIASTNPVCTEPYGTISMEDIQQQGNH

SEQ ID NO: 142809 - protein, 35 aa, Artificial Sequence
  Description of Artificial Sequence: Synthetic polypeptide
TSVEISTTNPVAYEQYGQSVSTNALSVHGDGGNNR

SEQ ID NO: 142810 - protein, 35 aa, Artificial Sequence
  Description of Artificial Sequence: Synthetic polypeptide
DEEEIRTTNPVATEQYGCVCSDWEHQENFGSETQS

SEQ ID NO: 142811 - protein, 34 aa, Artificial Sequence
  Description of Artificial Sequence: Synthetic polypeptide
DEEEIATTNPVATEQYGSICAAMNPLNDMDGGAN

SEQ ID NO: 142812 - protein, 33 aa, Artificial Sequence
  Description of Artificial Sequence: Synthetic polypeptide
TTAEIATTNPVATECYGSVSGGLNDDRQEQGNQ

SEQ ID NO: 142813 - protein, 34 aa, Artificial Sequence
  Description of Artificial Sequence: Synthetic polypeptide
TTAEIATTNPVATECYGSVSGGLNDDRQERGNAM

SEQ ID NO: 142814 - protein, 34 aa, Artificial Sequence
  Description of Artificial Sequence: Synthetic polypeptide
TTAEIATTNPVATEQYGSVCTIEGQDQQGMNNTR

SEQ ID NO: 142815 - protein, 30 aa, Artificial Sequence
  Description of Artificial Sequence: Synthetic polypeptide
QEEEIATTNPVATEQYGCACPWVEQHIEQS

SEQ ID NO: 142816 - protein, 32 aa, Artificial Sequence
  Description of Artificial Sequence: Synthetic polypeptide
QEEEIATTNPVATEQYGCAPAMHGQDSEGMNK

SEQ ID NO: 142817 - protein, 36 aa, Artificial Sequence
  Description of Artificial Sequence: Synthetic polypeptide
DEEEIRTTNPVATEQYGCVCSDTGEPNQENFSSNQA

SEQ ID NO: 142818 - protein, 32 aa, Artificial Sequence
  Description of Artificial Sequence: Synthetic polypeptide
DEDEIACTNPVAYEQYGSCATNLQGAPMEKKN

SEQ ID NO: 142819 - protein, 32 aa, Artificial Sequence
  Description of Artificial Sequence: Synthetic polypeptide
QEEEIATTNPVATEQYGCAPDHGQDSEGENKM

SEQ ID NO: 142820 - protein, 35 aa, Artificial Sequence
  Description of Artificial Sequence: Synthetic polypeptide
DEEEIRTTNPVATEQYGCVCSDTGEHNQNFSSDFQ

SEQ ID NO: 142821 - protein, 35 aa, Artificial Sequence
  Description of Artificial Sequence: Synthetic polypeptide
DEEEIRTTNPVATEQYGCVCSDTGEHIEYFNSDQS

SEQ ID NO: 142822 - protein, 29 aa, Artificial Sequence
  Description of Artificial Sequence: Synthetic peptide
QEEEIATTNPVATEQYGCAPEHGADSEED

SEQ ID NO: 142823 - protein, 30 aa, Artificial Sequence
  Description of Artificial Sequence: Synthetic polypeptide
QEEEIATTNPVATEQYGEAPEVCMQIHEEK

SEQ ID NO: 142824 - protein, 36 aa, Artificial Sequence
  Description of Artificial Sequence: Synthetic polypeptide
AEDEIRATNPVATEQYGSVSTTNQQLQLQQGTTQEE

SEQ ID NO: 142825 - protein, 33 aa, Artificial Sequence
  Description of Artificial Sequence: Synthetic polypeptide
TSEEICTTNPVGTAAWGSVVSCTNMLSPSGNRW

SEQ ID NO: 142826 - protein, 37 aa, Artificial Sequence
  Description of Artificial Sequence: Synthetic polypeptide
DEEEIRTTNPVATEAYGVVSTVVNNQQNGNNQDEEQE

SEQ ID NO: 142827 - protein, 35 aa, Artificial Sequence
  Description of Artificial Sequence: Synthetic polypeptide
TNTEIATTNPVAYEQWGSVNKTDNLTQERSGNNNR

SEQ ID NO: 142828 - protein, 30 aa, Artificial Sequence
  Description of Artificial Sequence: Synthetic polypeptide
TQAEIATTNPVAYEQWGCCGTWDQGIGNAR

SEQ ID NO: 142829 - protein, 31 aa, Artificial Sequence
  Description of Artificial Sequence: Synthetic polypeptide
TQAEIATTNPVAYEQWGCCGTWNDAQGHGNR

SEQ ID NO: 142830 - protein, 31 aa, Artificial Sequence
  Description of Artificial Sequence: Synthetic polypeptide
QEEEIKTTNPVATEQYGAVAGPEGDGQGEED

SEQ ID NO: 142831 - protein, 36 aa, Artificial Sequence
  Description of Artificial Sequence: Synthetic polypeptide
TQAEIRTTNPVAYEQYGSVPSYDDNELAQYRGGNPS

SEQ ID NO: 142832 - protein, 33 aa, Artificial Sequence
  Description of Artificial Sequence: Synthetic polypeptide
TQCEIRTTNPVATEQYGVVSTKELEQPEIPEKD

SEQ ID NO: 142833 - protein, 38 aa, Artificial Sequence
  Description of Artificial Sequence: Synthetic polypeptide
DEEEIRTTNPVATEAYGVVSTVVNTNLQAGNANTEQGS

SEQ ID NO: 142834 - protein, 32 aa, Artificial Sequence
  Description of Artificial Sequence: Synthetic polypeptide
CEDVIACTNPVATEQYGCVATNLATMNPNARE

SEQ ID NO: 142835 - protein, 30 aa, Artificial Sequence
  Description of Artificial Sequence: Synthetic polypeptide
QEEEIATTNPVATEQWGEVSEIEMNHAEEA

SEQ ID NO: 142836 - protein, 30 aa, Artificial Sequence
  Description of Artificial Sequence: Synthetic polypeptide
DESEIRTTNPIGTEGYGATASEDLAEHGPI

SEQ ID NO: 142837 - protein, 34 aa, Artificial Sequence
  Description of Artificial Sequence: Synthetic polypeptide
DECEICTTNPVATTQYGVVSTTALQQGTEQGTIS

SEQ ID NO: 142838 - protein, 34 aa, Artificial Sequence
  Description of Artificial Sequence: Synthetic polypeptide
DECEICTTNPVATTQYGVVSTTALQQGTEQGTVY

SEQ ID NO: 142839 - protein, 34 aa, Artificial Sequence
  Description of Artificial Sequence: Synthetic polypeptide
DEEEIATTNPVATEQYGSVAANHSGDPAMNPAEH

SEQ ID NO: 142840 - protein, 35 aa, Artificial Sequence
  Description of Artificial Sequence: Synthetic polypeptide
DEEEIATTNPVATEQYGSVAAMNNNENTASPGSRT

SEQ ID NO: 142841 - protein, 33 aa, Artificial Sequence
  Description of Artificial Sequence: Synthetic polypeptide
AEEEIASVNPVCTEQYGCVCSWNLQSFGSQNQA

SEQ ID NO: 142842 - protein, 30 aa, Artificial Sequence
  Description of Artificial Sequence: Synthetic polypeptide
QEEEIATTNPVATEQWGEVSEICMNHAEEA

SEQ ID NO: 142843 - protein, 31 aa, Artificial Sequence
  Description of Artificial Sequence: Synthetic polypeptide
QEEEIKTTNPVATEQYGAVAGPEVGQGEEQV

SEQ ID NO: 142844 - protein, 30 aa, Artificial Sequence
  Description of Artificial Sequence: Synthetic polypeptide
QEEEIATTNPVATEQWGEVPEVCQNAAEEA

SEQ ID NO: 142845 - protein, 32 aa, Artificial Sequence
  Description of Artificial Sequence: Synthetic polypeptide
AEEEIASVNPVCTEQYGVVCSSELQSFGSNQN

SEQ ID NO: 142846 - protein, 32 aa, Artificial Sequence
  Description of Artificial Sequence: Synthetic polypeptide
AEEEIASVNPVCTEQYGVVCSNSNLQSFGSDQ

SEQ ID NO: 142847 - protein, 32 aa, Artificial Sequence
  Description of Artificial Sequence: Synthetic polypeptide
AEEEIASVNPVCTEQYGVVCSDGELQSFGSNQ

SEQ ID NO: 142848 - protein, 30 aa, Artificial Sequence
  Description of Artificial Sequence: Synthetic polypeptide
QEEEIATTNPVATEQWGETTPNEVCQHEEK

SEQ ID NO: 142849 - protein, 30 aa, Artificial Sequence
  Description of Artificial Sequence: Synthetic polypeptide
QEEEIATTNPVATEQWGETTPNEVWQHEEK

SEQ ID NO: 142850 - protein, 38 aa, Artificial Sequence
  Description of Artificial Sequence: Synthetic polypeptide
DEEEIRTTNPVATEAYGVVSTVVNTNLQAGNLEDEQSE

SEQ ID NO: 142851 - protein, 31 aa, Artificial Sequence
  Description of Artificial Sequence: Synthetic polypeptide
QEEEIATTNPVATEQWGETWANEEVWQHGEK

SEQ ID NO: 142852 - protein, 34 aa, Artificial Sequence
  Description of Artificial Sequence: Synthetic polypeptide
DECEICTTNPVATTQYGVVSTTALQQGTEGGVDD

SEQ ID NO: 142853 - protein, 33 aa, Artificial Sequence
  Description of Artificial Sequence: Synthetic polypeptide
DEDEIATTNPVATAQWGGCCATGALQQMGENRN

SEQ ID NO: 142854 - protein, 37 aa, Artificial Sequence
  Description of Artificial Sequence: Synthetic polypeptide
DEEEIRTTNPVATEQYGCVCSMTGNDHQENFGSETQA

SEQ ID NO: 142855 - protein, 38 aa, Artificial Sequence
  Description of Artificial Sequence: Synthetic polypeptide
DEEEIRTTNPVATEAYGVVSTVVNTNLQAGNINEEQGD

SEQ ID NO: 142856 - protein, 38 aa, Artificial Sequence
  Description of Artificial Sequence: Synthetic polypeptide
DEEEIRTTNPVATEAYGVVSTVVNTNLQAGNDNGEQED

SEQ ID NO: 142857 - protein, 38 aa, Artificial Sequence
  Description of Artificial Sequence: Synthetic polypeptide
DEEEIRTTNPVATEAYGVVSTVVNTNLQAGNATDEQGD

SEQ ID NO: 142858 - protein, 36 aa, Artificial Sequence
  Description of Artificial Sequence: Synthetic polypeptide
AEDEIRATNPVATEQYGSVSTTNQNQNQQNGTNQDD

SEQ ID NO: 142859 - protein, 36 aa, Artificial Sequence
  Description of Artificial Sequence: Synthetic polypeptide
DEEEIRTTNPVATEQYGCVCSMTGESHQENFNSEQA

SEQ ID NO: 142860 - protein, 34 aa, Artificial Sequence
  Description of Artificial Sequence: Synthetic polypeptide
DECEICTTNPVATTQYGVVSTTALQQGTEQGVAD

SEQ ID NO: 142861 - protein, 33 aa, Artificial Sequence
  Description of Artificial Sequence: Synthetic polypeptide
TQEEIKTTNPVAYEQYGQTVACTNLSQYHPMTR

SEQ ID NO: 142862 - protein, 33 aa, Artificial Sequence
  Description of Artificial Sequence: Synthetic polypeptide
TQEEINTTNPVAYEPYGSTVACTNLSQQHDMTR

SEQ ID NO: 142863 - protein, 37 aa, Artificial Sequence
  Description of Artificial Sequence: Synthetic polypeptide
DEEEIATTNPVATEQYGSVAAITTAPTQNHQDGDENN

SEQ ID NO: 142864 - protein, 33 aa, Artificial Sequence
  Description of Artificial Sequence: Synthetic polypeptide
TQEEIRTTNPVAYEAYGSVSNENEHSQIGGSPS

SEQ ID NO: 142865 - protein, 35 aa, Artificial Sequence
  Description of Artificial Sequence: Synthetic polypeptide
TQEEIRTTNPVAYEPYGSVSYDDNELAQYHGGNPS

SEQ ID NO: 142866 - protein, 33 aa, Artificial Sequence
  Description of Artificial Sequence: Synthetic polypeptide
TQEEIRTTNPVAYEQWGTTVSCTHTSQNEINRH

SEQ ID NO: 142867 - protein, 31 aa, Artificial Sequence
  Description of Artificial Sequence: Synthetic polypeptide
AEEEIASVNPVCTEQYGCVCSSNHQSFGSDQ

SEQ ID NO: 142868 - protein, 36 aa, Artificial Sequence
  Description of Artificial Sequence: Synthetic polypeptide
DEEEIRTTNPVATEQYGCVCSMTGEDHQENFGSEQS

SEQ ID NO: 142869 - protein, 34 aa, Artificial Sequence
  Description of Artificial Sequence: Synthetic polypeptide
DEEEIATTNPVATEQYGSACAANPLAEAEMNGQA

SEQ ID NO: 142870 - protein, 34 aa, Artificial Sequence
  Description of Artificial Sequence: Synthetic polypeptide
DEEEIATTNPVATEQYGSTFAGTGGPDNDDPGGN

SEQ ID NO: 142871 - protein, 36 aa, Artificial Sequence
  Description of Artificial Sequence: Synthetic polypeptide
TQEEIRTTNPVAYEQYGSVVPSDDNELAGYRGGNPS

SEQ ID NO: 142872 - protein, 37 aa, Artificial Sequence
  Description of Artificial Sequence: Synthetic polypeptide
AEEEIRTTNPVATEQYGSVVTVNTNNDQSGTVTNGTT

SEQ ID NO: 142873 - protein, 33 aa, Artificial Sequence
  Description of Artificial Sequence: Synthetic polypeptide
DEDEIATTNPVATAQWGCVATNAALTAAGNQDM

SEQ ID NO: 142874 - protein, 37 aa, Artificial Sequence
  Description of Artificial Sequence: Synthetic polypeptide
DEEEIRTTNPVATEQYGAVSGQGTDQLNDEGEGGNGT

SEQ ID NO: 142875 - protein, 35 aa, Artificial Sequence
  Description of Artificial Sequence: Synthetic polypeptide
DEEEIRTTNPVATEQYGSVHPHYNQFINTLELSEL

SEQ ID NO: 142876 - protein, 33 aa, Artificial Sequence
  Description of Artificial Sequence: Synthetic polypeptide
TQEEIVTTNPVAYEPYGSTVACTNLSQYHEMTR

SEQ ID NO: 142877 - protein, 38 aa, Artificial Sequence
  Description of Artificial Sequence: Synthetic polypeptide
DEEEIRTTNPVATEAYGVVSTVVNQQLQLQQGTNNTTD

SEQ ID NO: 142878 - protein, 36 aa, Artificial Sequence
  Description of Artificial Sequence: Synthetic polypeptide
TSAEIRSTNPVATEQYGSTVCSCTNELSQASNVQQR

SEQ ID NO: 142879 - protein, 35 aa, Artificial Sequence
  Description of Artificial Sequence: Synthetic polypeptide
TQEEIRTTNPVAYEAYGSVSDDNEHSQYRTGNQSC

SEQ ID NO: 142880 - protein, 38 aa, Artificial Sequence
  Description of Artificial Sequence: Synthetic polypeptide
AEEEIRTTNPVATEQYGSVSVVTTNNQQGNQNGTNPND

SEQ ID NO: 142881 - protein, 35 aa, Artificial Sequence
  Description of Artificial Sequence: Synthetic polypeptide
DEEEIATTNPVATEQYGSACAANPLAEAEMGNGNK

SEQ ID NO: 142882 - protein, 38 aa, Artificial Sequence
  Description of Artificial Sequence: Synthetic polypeptide
DEEEIRTTNPVATEQYGSVMGLTVNMQDEGEEFTNGQN

SEQ ID NO: 142883 - protein, 38 aa, Artificial Sequence
  Description of Artificial Sequence: Synthetic polypeptide
DEEEIRTTNPVATEAYGVVSTVVNTNLQAGNANDEQEQ

SEQ ID NO: 142884 - protein, 37 aa, Artificial Sequence
  Description of Artificial Sequence: Synthetic polypeptide
AEEEIRTTNPVATEQYGSVSVTVVTNQNQQQGTEEQD

SEQ ID NO: 142885 - protein, 34 aa, Artificial Sequence
  Description of Artificial Sequence: Synthetic polypeptide
DECEICTTNPVATTQYGVVSTTLALQQGTEQGTD

SEQ ID NO: 142886 - protein, 36 aa, Artificial Sequence
  Description of Artificial Sequence: Synthetic polypeptide
DEEEIRTTNPVATEQYGSVLGNFEDDEGGNQEAEIV

SEQ ID NO: 142887 - protein, 33 aa, Artificial Sequence
  Description of Artificial Sequence: Synthetic polypeptide
TQEEINTTNPVAYEQYGSTVACTNLSQNHPMTH

SEQ ID NO: 142888 - protein, 37 aa, Artificial Sequence
  Description of Artificial Sequence: Synthetic polypeptide
DEEEIRTTNPVATEAYGVVSTVVNTNEQLGNNDEQGE

SEQ ID NO: 142889 - protein, 33 aa, Artificial Sequence
  Description of Artificial Sequence: Synthetic polypeptide
TQEEINTTNPVAYEQYGSTVACTNLSQYHPPTE

SEQ ID NO: 142890 - protein, 35 aa, Artificial Sequence
  Description of Artificial Sequence: Synthetic polypeptide
TQEEIRCTNPVAYTEQYGYTVSCSNTSQESTGSNR

SEQ ID NO: 142891 - protein, 36 aa, Artificial Sequence
  Description of Artificial Sequence: Synthetic polypeptide
DEEEIRTTNPVATEQYGSVLGNFEDDEGGNQGEATV

SEQ ID NO: 142892 - protein, 31 aa, Artificial Sequence
  Description of Artificial Sequence: Synthetic polypeptide
AEEEIASVNPVCTEQYGCVCSWELQSFGSQQ

SEQ ID NO: 142893 - protein, 32 aa, Artificial Sequence
  Description of Artificial Sequence: Synthetic polypeptide
YEEEIASTNPVCTEQYGVTWSNDENLAEPGNQ

SEQ ID NO: 142894 - protein, 37 aa, Artificial Sequence
  Description of Artificial Sequence: Synthetic polypeptide
DEEEIRTTNPVATEQYGCVCSMTGEHNIENFGSDNQS

SEQ ID NO: 142895 - protein, 36 aa, Artificial Sequence
  Description of Artificial Sequence: Synthetic polypeptide
DEEEIRTTNPVATEQYGCVCSMTGEHNANFGSETQP

SEQ ID NO: 142896 - protein, 34 aa, Artificial Sequence
  Description of Artificial Sequence: Synthetic polypeptide
TQEEIRTTNPVAYEAYGSTVSNDNEHSQYRGSPS

SEQ ID NO: 142897 - protein, 32 aa, Artificial Sequence
  Description of Artificial Sequence: Synthetic polypeptide
DEDEIATTNPVATAQWGGCCASANDDTRGNDQ

SEQ ID NO: 142898 - protein, 34 aa, Artificial Sequence
  Description of Artificial Sequence: Synthetic polypeptide
TQEEIRTTNPVAYEAYGSVADDNEHSQQRNGNQS

SEQ ID NO: 142899 - protein, 33 aa, Artificial Sequence
  Description of Artificial Sequence: Synthetic polypeptide
TTEEIRGTNPVATEQYGSVVNGINGQENGEGQA

SEQ ID NO: 142900 - protein, 33 aa, Artificial Sequence
  Description of Artificial Sequence: Synthetic polypeptide
TTEEIRGTNPVATEQYGSVVNNINGQDNGEGQG

SEQ ID NO: 142901 - protein, 37 aa, Artificial Sequence
  Description of Artificial Sequence: Synthetic polypeptide
AEEEIRTTNPVATEQYGSVSVVVNNQQQGTNGTNNQD

SEQ ID NO: 142902 - protein, 34 aa, Artificial Sequence
  Description of Artificial Sequence: Synthetic polypeptide
DESEIRTTNPVATAAWGSVSCINEPQDHGGENTG

SEQ ID NO: 142903 - protein, 34 aa, Artificial Sequence
  Description of Artificial Sequence: Synthetic polypeptide
QEEEIATTNPVAYEAYGSVISYTHLSTPGGPLRK

SEQ ID NO: 142904 - protein, 34 aa, Artificial Sequence
  Description of Artificial Sequence: Synthetic polypeptide
DESEIRTTNPVATACWGSVSCINEPDDREGENYG

SEQ ID NO: 142905 - protein, 35 aa, Artificial Sequence
  Description of Artificial Sequence: Synthetic polypeptide
DEDEIACTNPVATEQYGSVCAGTNLADAHNDGERP

SEQ ID NO: 142906 - protein, 36 aa, Artificial Sequence
  Description of Artificial Sequence: Synthetic polypeptide
AEEEIRTTNPVATEQYGSVVTVNTNDESGTVNNATD

SEQ ID NO: 142907 - protein, 34 aa, Artificial Sequence
  Description of Artificial Sequence: Synthetic polypeptide
DESEIRTTNPVATACWGSVSCINEPQDHKGENMG

SEQ ID NO: 142908 - protein, 34 aa, Artificial Sequence
  Description of Artificial Sequence: Synthetic polypeptide
DEDEIACTNPVATEQYGSVCAGTNPANPDGDNQM

SEQ ID NO: 142909 - protein, 34 aa, Artificial Sequence
  Description of Artificial Sequence: Synthetic polypeptide
DEEEIATTNPVATEQYGSACSAPASQDDDSGAQE

SEQ ID NO: 142910 - protein, 35 aa, Artificial Sequence
  Description of Artificial Sequence: Synthetic polypeptide
DEEEIRTTNPVATEQYGCVCGSGEHNQNFNSDNQA

SEQ ID NO: 142911 - protein, 33 aa, Artificial Sequence
  Description of Artificial Sequence: Synthetic polypeptide
DESEIRTTNPVATECWGSVSCIDEPEDHEGENG

SEQ ID NO: 142912 - protein, 32 aa, Artificial Sequence
  Description of Artificial Sequence: Synthetic polypeptide
QEEEIATTNPVATEQYGCVAPIGHGQDSEGEH

SEQ ID NO: 142913 - protein, 36 aa, Artificial Sequence
  Description of Artificial Sequence: Synthetic polypeptide
DEEEIRTTNPVATEQYGSVMGGIDEFGQDDDDEGNN

SEQ ID NO: 142914 - protein, 34 aa, Artificial Sequence
  Description of Artificial Sequence: Synthetic polypeptide
DEEEIATTNPVATEQYGSACSAPASQDDDSDNQM

SEQ ID NO: 142915 - protein, 34 aa, Artificial Sequence
  Description of Artificial Sequence: Synthetic polypeptide
DEEEIATTNPVATEQYGSACSANPPPEAEAEARF

SEQ ID NO: 142916 - protein, 32 aa, Artificial Sequence
  Description of Artificial Sequence: Synthetic polypeptide
QEEEIATTNPVATEQYGCVAPEHGQDSEGEKM

SEQ ID NO: 142917 - protein, 36 aa, Artificial Sequence
  Description of Artificial Sequence: Synthetic polypeptide
DEEEIRTTNPVATEQYGSVMGGNNNLNSEEGEGEFT

SEQ ID NO: 142918 - protein, 34 aa, Artificial Sequence
  Description of Artificial Sequence: Synthetic polypeptide
DEEEIRTTNPVATEQYGCVCGWGEHQNFPSENQV

SEQ ID NO: 142919 - protein, 28 aa, Artificial Sequence
  Description of Artificial Sequence: Synthetic peptide
QEEEIATTNPVAYEAYGEAPEVQQHEEK

SEQ ID NO: 142920 - protein, 35 aa, Artificial Sequence
  Description of Artificial Sequence: Synthetic polypeptide
DEEEIRTTNPVATEQYGCVCPMTEDHQENFGSDQN

SEQ ID NO: 142921 - protein, 35 aa, Artificial Sequence
  Description of Artificial Sequence: Synthetic polypeptide
QEEEIATTNPVATEQYGCVAATNLTAPDDQMNSRM

SEQ ID NO: 142922 - protein, 29 aa, Artificial Sequence
  Description of Artificial Sequence: Synthetic peptide
QEEEIATTNPVAWEQYGEAPEVCQKHEEK

SEQ ID NO: 142923 - protein, 30 aa, Artificial Sequence
  Description of Artificial Sequence: Synthetic polypeptide
VEDEIACTNPVATEQYGCVAGTGLINMEMM

SEQ ID NO: 142924 - protein, 33 aa, Artificial Sequence
  Description of Artificial Sequence: Synthetic polypeptide
VEDEIACTNPVATEQYGCVAGTNLQAENANMDS

SEQ ID NO: 142925 - protein, 34 aa, Artificial Sequence
  Description of Artificial Sequence: Synthetic polypeptide
DESEIRTTNPVAQECWGSVSCINEPQDREPENGQ

SEQ ID NO: 142926 - protein, 32 aa, Artificial Sequence
  Description of Artificial Sequence: Synthetic polypeptide
VEDEIACTNPVATEQYGCVAGTNLQMHPEEGF

SEQ ID NO: 142927 - protein, 35 aa, Artificial Sequence
  Description of Artificial Sequence: Synthetic polypeptide
QEEEIATTNPVATEQYGCVAATNLTAPDSQDGSFP

SEQ ID NO: 142928 - protein, 32 aa, Artificial Sequence
  Description of Artificial Sequence: Synthetic polypeptide
VEDEIACTNPVATEQYGCVATNDQGPDEQGAE

SEQ ID NO: 142929 - protein, 29 aa, Artificial Sequence
  Description of Artificial Sequence: Synthetic peptide
QEEEIATTNPVAWEQYGEAPFEVCQHEEK

SEQ ID NO: 142930 - protein, 30 aa, Artificial Sequence
  Description of Artificial Sequence: Synthetic polypeptide
QEEEIATTNPVAWEQYGEQAPEVCQHGEEK

SEQ ID NO: 142931 - protein, 38 aa, Artificial Sequence
  Description of Artificial Sequence: Synthetic polypeptide
YEEAEIRSTMNPVATEQYGDSVVTVHGHNLQPRVSNRF

SEQ ID NO: 142932 - protein, 33 aa, Artificial Sequence
  Description of Artificial Sequence: Synthetic polypeptide
DEDEIACTNPVATEQYGSVCAGTNPAPDMPNQM

SEQ ID NO: 142933 - protein, 38 aa, Artificial Sequence
  Description of Artificial Sequence: Synthetic polypeptide
AEEEIRTTNPVATEQYGSVTVSVTNNLQAGSEGGVVQS

SEQ ID NO: 142934 - protein, 36 aa, Artificial Sequence
  Description of Artificial Sequence: Synthetic polypeptide
DEEEIRTTNPVATEAYGTVVDDTNFGQGEDGENSEG

SEQ ID NO: 142935 - protein, 35 aa, Artificial Sequence
  Description of Artificial Sequence: Synthetic polypeptide
DEEEIRTTNPVATEQYGCVCGSGEHNQENFNSDQS

SEQ ID NO: 142936 - protein, 33 aa, Artificial Sequence
  Description of Artificial Sequence: Synthetic polypeptide
DECEICTTNPVAYEGWGSVATSNGNANDGGNNR

SEQ ID NO: 142937 - protein, 34 aa, Artificial Sequence
  Description of Artificial Sequence: Synthetic polypeptide
DESEIRTTNPVATACWGSVSCINEPQDRKGETGM

SEQ ID NO: 142938 - protein, 37 aa, Artificial Sequence
  Description of Artificial Sequence: Synthetic polypeptide
AEDEIRTTNPVATEQYGSVSTVTNQQAGTEQGVSNVD

SEQ ID NO: 142939 - protein, 38 aa, Artificial Sequence
  Description of Artificial Sequence: Synthetic polypeptide
DEEEIRTTNPVATEAYGVVSTVSNLLQAGNQQGTNQDE

SEQ ID NO: 142940 - protein, 31 aa, Artificial Sequence
  Description of Artificial Sequence: Synthetic polypeptide
VEDEIATTNPVATEQWGCVAGTGLINMDMRE

SEQ ID NO: 142941 - protein, 36 aa, Artificial Sequence
  Description of Artificial Sequence: Synthetic polypeptide
DEEEIATTNPVATEQYGSACSANPGPLDSMGGEDNH

SEQ ID NO: 142942 - protein, 28 aa, Artificial Sequence
  Description of Artificial Sequence: Synthetic peptide
QEEEIATTNPVAYEQWGCAYYVEQHHRG

SEQ ID NO: 142943 - protein, 35 aa, Artificial Sequence
  Description of Artificial Sequence: Synthetic polypeptide
DEEEIATTNPVATEQYGSACSANPALDNMPEDDNN

SEQ ID NO: 142944 - protein, 33 aa, Artificial Sequence
  Description of Artificial Sequence: Synthetic polypeptide
VEDEIATTNPVATEQYGCTAGNGLQNDDGDNSD

SEQ ID NO: 142945 - protein, 36 aa, Artificial Sequence
  Description of Artificial Sequence: Synthetic polypeptide
DEEEIRTTNPVATEQYGSVMGFGDGQEDGNFQNEGA

SEQ ID NO: 142946 - protein, 28 aa, Artificial Sequence
  Description of Artificial Sequence: Synthetic peptide
QEEEIATTNPVAYEQWGEAPCCCQHEEK

SEQ ID NO: 142947 - protein, 37 aa, Artificial Sequence
  Description of Artificial Sequence: Synthetic polypeptide
AEDEIRTTNPVATEQYGVVSTTTTNNLQQQQGTTNVE

SEQ ID NO: 142948 - protein, 37 aa, Artificial Sequence
  Description of Artificial Sequence: Synthetic polypeptide
AEEEIRTTNPVATEQYGSVTVTVTTNAEQQIGTTNPE

SEQ ID NO: 142949 - protein, 30 aa, Artificial Sequence
  Description of Artificial Sequence: Synthetic polypeptide
QEEEIATTNPVATEQYGCYPWVDQHFSEQA

SEQ ID NO: 142950 - protein, 33 aa, Artificial Sequence
  Description of Artificial Sequence: Synthetic polypeptide
DEDEIACTNPVATEQYGCVATNLQGTPDEEDAQ

SEQ ID NO: 142951 - protein, 29 aa, Artificial Sequence
  Description of Artificial Sequence: Synthetic peptide
QEEEIATTNPVAYEQWGEAYMWEQHEGEG

SEQ ID NO: 142952 - protein, 31 aa, Artificial Sequence
  Description of Artificial Sequence: Synthetic polypeptide
DECEICTTNPVAYEQWGSVGWIEDDQNMDAR

SEQ ID NO: 142953 - protein, 35 aa, Artificial Sequence
  Description of Artificial Sequence: Synthetic polypeptide
VEDEIATTNPVATEQYGSVANANGLPQEAPGENAH

SEQ ID NO: 142954 - protein, 31 aa, Artificial Sequence
  Description of Artificial Sequence: Synthetic polypeptide
VEDEIATTNPVATEQWGCVAAKANLAMPGQT

SEQ ID NO: 142955 - protein, 36 aa, Artificial Sequence
  Description of Artificial Sequence: Synthetic polypeptide
DEEEIRTTNPVATEAYGTVTVVVTTNNQAGNQNTNE

SEQ ID NO: 142956 - protein, 35 aa, Artificial Sequence
  Description of Artificial Sequence: Synthetic polypeptide
DEEEIRTTNPVATEQYGCVCGNSGNHAENFGSDQG

SEQ ID NO: 142957 - protein, 32 aa, Artificial Sequence
  Description of Artificial Sequence: Synthetic polypeptide
VEDEIACTNPVAYEQYGSVATNLAGAPMEGTP

SEQ ID NO: 142958 - protein, 36 aa, Artificial Sequence
  Description of Artificial Sequence: Synthetic polypeptide
DEEEIATTNPVATEQYGSACSANPNLQDSPDEEARN

SEQ ID NO: 142959 - protein, 36 aa, Artificial Sequence
  Description of Artificial Sequence: Synthetic polypeptide
DEEEIRTTNPVATEQYGSVMGFNNINEDQDIEQGQE

SEQ ID NO: 142960 - protein, 36 aa, Artificial Sequence
  Description of Artificial Sequence: Synthetic polypeptide
DEEEIRTTNPVATEQYGCVCGNTGNLNIENFGSQQG

SEQ ID NO: 142961 - protein, 34 aa, Artificial Sequence
  Description of Artificial Sequence: Synthetic polypeptide
DESEIRTTNPVATACWGSVSCINEPQDRKVENDG

SEQ ID NO: 142962 - protein, 35 aa, Artificial Sequence
  Description of Artificial Sequence: Synthetic polypeptide
DEDEIACTNPVATEQYGSVCAANNLQEAQDGTDNN

SEQ ID NO: 142963 - protein, 28 aa, Artificial Sequence
  Description of Artificial Sequence: Synthetic peptide
QEEEIATTNPVAYEKYGEAPEVCQHEEK

SEQ ID NO: 142964 - protein, 29 aa, Artificial Sequence
  Description of Artificial Sequence: Synthetic peptide
QEEEIATTNPVATEQYGEAPEVCDHEEHK

SEQ ID NO: 142965 - protein, 36 aa, Artificial Sequence
  Description of Artificial Sequence: Synthetic polypeptide
DEEEIATTNPVATEQYGSACSANPNLNDSPDENARE

SEQ ID NO: 142966 - protein, 32 aa, Artificial Sequence
  Description of Artificial Sequence: Synthetic polypeptide
VEDEIACTNPVATESYGCASANNLQEAGGQRA

SEQ ID NO: 142967 - protein, 33 aa, Artificial Sequence
  Description of Artificial Sequence: Synthetic polypeptide
YEDEIRTTNPVATEQYGELCPGENGLQEGFDSA

SEQ ID NO: 142968 - protein, 33 aa, Artificial Sequence
  Description of Artificial Sequence: Synthetic polypeptide
DEDEIACTNPVATEQYGSVAANPPEEAGGNDHN

SEQ ID NO: 142969 - protein, 31 aa, Artificial Sequence
  Description of Artificial Sequence: Synthetic polypeptide
VEDEIACTNPVAYEQYGCVATNLQANPTEHQ

SEQ ID NO: 142970 - protein, 33 aa, Artificial Sequence
  Description of Artificial Sequence: Synthetic polypeptide
VEDEIACTNPVAYEQYGSVAITNLQGNPTEGDN

SEQ ID NO: 142971 - protein, 34 aa, Artificial Sequence
  Description of Artificial Sequence: Synthetic polypeptide
DEDEIACTNPVATEQYGSCAATNLQATPDENAGE

SEQ ID NO: 142972 - protein, 30 aa, Artificial Sequence
  Description of Artificial Sequence: Synthetic polypeptide
QEEEIATTNPVATEQYGEAPEVCCQHEEQK

SEQ ID NO: 142973 - protein, 30 aa, Artificial Sequence
  Description of Artificial Sequence: Synthetic polypeptide
QEEEIATTNPVATEQYGEAPEVCCQHEEKY

SEQ ID NO: 142974 - protein, 34 aa, Artificial Sequence
  Description of Artificial Sequence: Synthetic polypeptide
DEDEIATTNPVATAQWGGCVAATGALQQMGNVRN

SEQ ID NO: 142975 - protein, 38 aa, Artificial Sequence
  Description of Artificial Sequence: Synthetic polypeptide
AEEEIRTTNPVATEQYGSVTTVVTTNLQQGNTNEEEED

SEQ ID NO: 142976 - protein, 37 aa, Artificial Sequence
  Description of Artificial Sequence: Synthetic polypeptide
DEEEIRTTNPVATEAYGVVSTVTNNNNQQGNQNNDED

SEQ ID NO: 142977 - protein, 31 aa, Artificial Sequence
  Description of Artificial Sequence: Synthetic polypeptide
QEEEIATTNPVATEQYGCAPMHGQDSEGMKM

SEQ ID NO: 142978 - protein, 35 aa, Artificial Sequence
  Description of Artificial Sequence: Synthetic polypeptide
DEEEIRTTNPVATEQYGCVCQTGEHQENFNSETQT

SEQ ID NO: 142979 - protein, 34 aa, Artificial Sequence
  Description of Artificial Sequence: Synthetic polypeptide
DEEEIRTTNPVATEQYGCVCQTGEHQENFISDQA

SEQ ID NO: 142980 - protein, 36 aa, Artificial Sequence
  Description of Artificial Sequence: Synthetic polypeptide
DEEEIRTTNPVATEQYGCVCQTGEHNQENFGSENQS

SEQ ID NO: 142981 - protein, 32 aa, Artificial Sequence
  Description of Artificial Sequence: Synthetic polypeptide
DEDEIACTNPVATEQYGSVSAGPPDNMNPNHN

SEQ ID NO: 142982 - protein, 29 aa, Artificial Sequence
  Description of Artificial Sequence: Synthetic peptide
QEEEIATTNPVATEQYGEAPEVCINHEEK

SEQ ID NO: 142983 - protein, 29 aa, Artificial Sequence
  Description of Artificial Sequence: Synthetic peptide
QEEEIATTNPVATEWYGETPEVCQCEETK

SEQ ID NO: 142984 - protein, 36 aa, Artificial Sequence
  Description of Artificial Sequence: Synthetic polypeptide
AEDEIRATNPVATEQYGSVSVTTNNQGEQQGTNQQD

SEQ ID NO: 142985 - protein, 31 aa, Artificial Sequence
  Description of Artificial Sequence: Synthetic polypeptide
TTGEIATTNPCAYEEWGSVYFVDLTQREGNR

SEQ ID NO: 142986 - protein, 32 aa, Artificial Sequence
  Description of Artificial Sequence: Synthetic polypeptide
TTGSEIATTNPVAYEQWGMVSTNLGGDDGNTQ

SEQ ID NO: 142987 - protein, 37 aa, Artificial Sequence
  Description of Artificial Sequence: Synthetic polypeptide
DEEEIRTTNPVATEAYGVVSTVTNSNGQAGNNDEQQD

SEQ ID NO: 142988 - protein, 38 aa, Artificial Sequence
  Description of Artificial Sequence: Synthetic polypeptide
DEEEIRTTNPVATEAYGVVSTVTNQQQQLQQGTSNNTD

SEQ ID NO: 142989 - protein, 32 aa, Artificial Sequence
  Description of Artificial Sequence: Synthetic polypeptide
TTTEIATTNPVAYEQWGSVGHMNDLNQQGNHS

SEQ ID NO: 142990 - protein, 35 aa, Artificial Sequence
  Description of Artificial Sequence: Synthetic polypeptide
TTTEIATTNPVAYEQWGSVNKTDNLDQPRSGNNSR

SEQ ID NO: 142991 - protein, 31 aa, Artificial Sequence
  Description of Artificial Sequence: Synthetic polypeptide
QEEEIATTNPVATEQYGCAPMSHGQDSEGEF

SEQ ID NO: 142992 - protein, 34 aa, Artificial Sequence
  Description of Artificial Sequence: Synthetic polypeptide
DEEEIATTNPVATEQYGSCAAASNPMAMEMGNND

SEQ ID NO: 142993 - protein, 35 aa, Artificial Sequence
  Description of Artificial Sequence: Synthetic polypeptide
DEEEIRTTNPVATEQYGCVCQWGEHQENFGSDNQP

SEQ ID NO: 142994 - protein, 31 aa, Artificial Sequence
  Description of Artificial Sequence: Synthetic polypeptide
QEEEIATTNPVATEQYGCAPMHGQDSEGELE

SEQ ID NO: 142995 - protein, 34 aa, Artificial Sequence
  Description of Artificial Sequence: Synthetic polypeptide
TTEEIRGTNPVATEQYGSVVSGINGQENGEGEGV

SEQ ID NO: 142996 - protein, 30 aa, Artificial Sequence
  Description of Artificial Sequence: Synthetic polypeptide
QEEEIATTNPVATEQYGCAPIHGQDSEEDK

SEQ ID NO: 142997 - protein, 31 aa, Artificial Sequence
  Description of Artificial Sequence: Synthetic polypeptide
QEEEIATTNPVATEQYGCAPIHGQDSVEGEK

SEQ ID NO: 142998 - protein, 37 aa, Artificial Sequence
  Description of Artificial Sequence: Synthetic polypeptide
AEDEIRATNPVATEQYGSVSTTNQQNLQLQQGTNQND

SEQ ID NO: 142999 - protein, 36 aa, Artificial Sequence
  Description of Artificial Sequence: Synthetic polypeptide
DECEICTTNPVAVEQYGSVSTNVTTNLEQGTTNTGD

SEQ ID NO: 143000 - protein, 29 aa, Artificial Sequence
  Description of Artificial Sequence: Synthetic peptide
QEEEIATTNPVATEQYGEAPEVCMAAEDA

SEQ ID NO: 143001 - protein, 36 aa, Artificial Sequence
  Description of Artificial Sequence: Synthetic polypeptide
DEEEIRTTNPVATEQYGCVCSDTEDHNQENFNSQQS

SEQ ID NO: 143002 - protein, 38 aa, Artificial Sequence
  Description of Artificial Sequence: Synthetic polypeptide
DEEEIRTTNPVATEAYGVVSTVTVNNQLLQQGEDENTD

SEQ ID NO: 143003 - protein, 31 aa, Artificial Sequence
  Description of Artificial Sequence: Synthetic polypeptide
QEEEIATTNPVATEQYGCAPMHGQDSDGEFH

SEQ ID NO: 143004 - protein, 35 aa, Artificial Sequence
  Description of Artificial Sequence: Synthetic polypeptide
DEEEIRTTNPVATEQYGCVCSDSGEHQNFGSETQP

SEQ ID NO: 143005 - protein, 31 aa, Artificial Sequence
  Description of Artificial Sequence: Synthetic polypeptide
QEEEIATTNPVATEQYGCAPMHGQDSEEDNN

SEQ ID NO: 143006 - protein, 36 aa, Artificial Sequence
  Description of Artificial Sequence: Synthetic polypeptide
DEEEIRTTNPVATEQYGCVCSCTGEHNQEYFGSDQS

SEQ ID NO: 143007 - protein, 32 aa, Artificial Sequence
  Description of Artificial Sequence: Synthetic polypeptide
YEEEIASTNPIATEQYGAVADENLQESKGPYQ

SEQ ID NO: 143008 - protein, 34 aa, Artificial Sequence
  Description of Artificial Sequence: Synthetic polypeptide
DEEEIRTTNPVATEQYGCVCQWGEHQENFNSDQM

SEQ ID NO: 143009 - protein, 29 aa, Artificial Sequence
  Description of Artificial Sequence: Synthetic peptide
QEEEIATTNPVATEWYGEAPEVCQSHEEK

SEQ ID NO: 143010 - protein, 35 aa, Artificial Sequence
  Description of Artificial Sequence: Synthetic polypeptide
TTTEIATTNPVAYEQWGSVNKTDNLTQDRSGNHSR

SEQ ID NO: 143011 - protein, 35 aa, Artificial Sequence
  Description of Artificial Sequence: Synthetic polypeptide
DEDEIACTNPVATEQYGSVCATNPQQEHQDGNQHQ

SEQ ID NO: 143012 - protein, 36 aa, Artificial Sequence
  Description of Artificial Sequence: Synthetic polypeptide
DEDEIACTNPVATEQYGSVCATNPMLQEHQDGNAHQ

SEQ ID NO: 143013 - protein, 38 aa, Artificial Sequence
  Description of Artificial Sequence: Synthetic polypeptide
DEEEIRTTNPVATEAYGVVSTVTNQQLQLQQGTTTNVD

SEQ ID NO: 143014 - protein, 29 aa, Artificial Sequence
  Description of Artificial Sequence: Synthetic peptide
QEEEIATTNPVATEQYGEAPEVCHHCEEK

SEQ ID NO: 143015 - protein, 35 aa, Artificial Sequence
  Description of Artificial Sequence: Synthetic polypeptide
DEDEIACTNPVATEQYGSVCATNLTQPDNQAEGAD

SEQ ID NO: 143016 - protein, 29 aa, Artificial Sequence
  Description of Artificial Sequence: Synthetic peptide
QEEEIATTNPVATEQYGEAPEVCHFHEEK

SEQ ID NO: 143017 - protein, 30 aa, Artificial Sequence
  Description of Artificial Sequence: Synthetic polypeptide
QEEEIATTNPVATEQYGEAPEVCGQHEEKP

SEQ ID NO: 143018 - protein, 29 aa, Artificial Sequence
  Description of Artificial Sequence: Synthetic peptide
QEEEIATTNPVAWEQYGEAPEQVCQHEEK

SEQ ID NO: 143019 - protein, 29 aa, Artificial Sequence
  Description of Artificial Sequence: Synthetic peptide
QEEEIATTNPVATEQYGEAPEVCGHIEEK

SEQ ID NO: 143020 - protein, 36 aa, Artificial Sequence
  Description of Artificial Sequence: Synthetic polypeptide
DEEEIRTTNPVATEQYGCVCQNTGNLIENFGSQTQA

SEQ ID NO: 143021 - protein, 36 aa, Artificial Sequence
  Description of Artificial Sequence: Synthetic polypeptide
DEEEIRTTNPVATEQYGSVMGIFNNNNGQQGQGETL

SEQ ID NO: 143022 - protein, 29 aa, Artificial Sequence
  Description of Artificial Sequence: Synthetic peptide
QEEEIATTNPVAWEQYGEAPEVCKQHEEK

SEQ ID NO: 143023 - protein, 33 aa, Artificial Sequence
  Description of Artificial Sequence: Synthetic polypeptide
DESEIRTTNPVATECWGSVSCIEEPTDREGEES

SEQ ID NO: 143024 - protein, 33 aa, Artificial Sequence
  Description of Artificial Sequence: Synthetic polypeptide
VEDEIACTNPVATEQYGCNVATNLQAEAAGMDN

SEQ ID NO: 143025 - protein, 36 aa, Artificial Sequence
  Description of Artificial Sequence: Synthetic polypeptide
DEEEIATTNPVATEQYGSACSATNNIETEAEGGNDD

SEQ ID NO: 143026 - protein, 35 aa, Artificial Sequence
  Description of Artificial Sequence: Synthetic polypeptide
DEEEIRTTNPVATEQYGCVCQNTEEHNQSFNSDQS

SEQ ID NO: 143027 - protein, 38 aa, Artificial Sequence
  Description of Artificial Sequence: Synthetic polypeptide
AEEEIRTTNPVATEQYGSVTTVVTTNLQQGNNNQENEE

SEQ ID NO: 143028 - protein, 37 aa, Artificial Sequence
  Description of Artificial Sequence: Synthetic polypeptide
DEEEIRTTNPVATEAYGVVSTVTNNNQAGNQNNEEND

SEQ ID NO: 143029 - protein, 32 aa, Artificial Sequence
  Description of Artificial Sequence: Synthetic polypeptide
DESEIRTTNPVATECWGSVSCIIEMDAAEENG

SEQ ID NO: 143030 - protein, 38 aa, Artificial Sequence
  Description of Artificial Sequence: Synthetic polypeptide
DEEEIRTTNPVATEAYGVVSTVTNNNLGQNGNQNNDED

SEQ ID NO: 143031 - protein, 32 aa, Artificial Sequence
  Description of Artificial Sequence: Synthetic polypeptide
VEDEIACTNPVATEQYGCASANLQDAHPMGQF

SEQ ID NO: 143032 - protein, 38 aa, Artificial Sequence
  Description of Artificial Sequence: Synthetic polypeptide
DEEEIRTTNPVATEQYGSVMGINSEQGLQEDNGGNEQQ

SEQ ID NO: 143033 - protein, 36 aa, Artificial Sequence
  Description of Artificial Sequence: Synthetic polypeptide
DEEEIRTTNPVATEQYGSVMGLLIDDQEEGGQTTQE

SEQ ID NO: 143034 - protein, 29 aa, Artificial Sequence
  Description of Artificial Sequence: Synthetic peptide
QEEEIATTNPVATSQYGEAPEVCQSHTEK

SEQ ID NO: 143035 - protein, 38 aa, Artificial Sequence
  Description of Artificial Sequence: Synthetic polypeptide
DEEEIRTTNPVATEAYGVVSTVTNQQLQLQQGTGGNTD

SEQ ID NO: 143036 - protein, 37 aa, Artificial Sequence
  Description of Artificial Sequence: Synthetic polypeptide
AEDEIRTTNPVATEQYGSVSTTTVNNNQQQIGTTNVE

SEQ ID NO: 143037 - protein, 33 aa, Artificial Sequence
  Description of Artificial Sequence: Synthetic polypeptide
DESEIRTTNPVAIYCWGSVTCINEPQDREGENG

SEQ ID NO: 143038 - protein, 31 aa, Artificial Sequence
  Description of Artificial Sequence: Synthetic polypeptide
QEEEIATTNPVATEQYGCSCQWPDNQHISEQ

SEQ ID NO: 143039 - protein, 31 aa, Artificial Sequence
  Description of Artificial Sequence: Synthetic polypeptide
DEEEIATTNPVATEQYGSAPAEVCEHEEEDL

SEQ ID NO: 143040 - protein, 37 aa, Artificial Sequence
  Description of Artificial Sequence: Synthetic polypeptide
DEEEIATTNPVATEQYGSACSTNPLLPAEAEMGNGNF

SEQ ID NO: 143041 - protein, 31 aa, Artificial Sequence
  Description of Artificial Sequence: Synthetic polypeptide
VEDEIACTNPVATEQWGCTAGNGLQDDGDNS

SEQ ID NO: 143042 - protein, 32 aa, Artificial Sequence
  Description of Artificial Sequence: Synthetic polypeptide
VEDEIACTNPVATEQWGCTAGTNLQQGEDNSL

SEQ ID NO: 143043 - protein, 30 aa, Artificial Sequence
  Description of Artificial Sequence: Synthetic polypeptide
VEDEIACTNPVATEQWGCTATNLQGEDESM

SEQ ID NO: 143044 - protein, 36 aa, Artificial Sequence
  Description of Artificial Sequence: Synthetic polypeptide
DEEEIRTTNPVATEQYGSVMGLFQIQNDDEQGDNGA

SEQ ID NO: 143045 - protein, 36 aa, Artificial Sequence
  Description of Artificial Sequence: Synthetic polypeptide
DEEEIRTTNPVATEQYGSVMGLFQGQNDDEGGENGA

SEQ ID NO: 143046 - protein, 31 aa, Artificial Sequence
  Description of Artificial Sequence: Synthetic polypeptide
VEDEIACTNPVATEQYGCAASANNLNMPGQA

SEQ ID NO: 143047 - protein, 33 aa, Artificial Sequence
  Description of Artificial Sequence: Synthetic polypeptide
DESEIRTTNPVATECWGSVSCIIEPQDAAEENG

SEQ ID NO: 143048 - protein, 38 aa, Artificial Sequence
  Description of Artificial Sequence: Synthetic polypeptide
AEEEIRTTNPVATEQYGSVTTVTNLQLGNVEQGTNDEN

SEQ ID NO: 143049 - protein, 35 aa, Artificial Sequence
  Description of Artificial Sequence: Synthetic polypeptide
DEEEIRTTNPVATEQYGCVCSMTMEHQENFPSDQP

SEQ ID NO: 143050 - protein, 31 aa, Artificial Sequence
  Description of Artificial Sequence: Synthetic polypeptide
QEEEIATTNPVATEQWGETTPNADWQHGEYK

SEQ ID NO: 143051 - protein, 34 aa, Artificial Sequence
  Description of Artificial Sequence: Synthetic polypeptide
DECEICTTNPVATTQYGVVSTTALQQGTEEGTGD

SEQ ID NO: 143052 - protein, 32 aa, Artificial Sequence
  Description of Artificial Sequence: Synthetic polypeptide
DEDEIATTNPVATEQWGCVAGTEHLATRPDQD

SEQ ID NO: 143053 - protein, 36 aa, Artificial Sequence
  Description of Artificial Sequence: Synthetic polypeptide
DEEEIRTTNPVATEQYGAVMGNDENIEDTQGGNGGI

SEQ ID NO: 143054 - protein, 33 aa, Artificial Sequence
  Description of Artificial Sequence: Synthetic polypeptide
DEDEIATTNPVATEQWGCVAATANLERIATDEQ

SEQ ID NO: 143055 - protein, 29 aa, Artificial Sequence
  Description of Artificial Sequence: Synthetic peptide
QEEEIATTNPVATEKYGEAPEVCQHETEK

SEQ ID NO: 143056 - protein, 37 aa, Artificial Sequence
  Description of Artificial Sequence: Synthetic polypeptide
DEEEIRTTNPVATEQYGSVGPQSLSSQQTRLNVEIID

SEQ ID NO: 143057 - protein, 33 aa, Artificial Sequence
  Description of Artificial Sequence: Synthetic polypeptide
DEDEIATTNPVATEQWGCVAANGDGTATGGNPR

SEQ ID NO: 143058 - protein, 36 aa, Artificial Sequence
  Description of Artificial Sequence: Synthetic polypeptide
DECEICTTNPVATEQYGVVSTVTVGNDEQGEGTNND

SEQ ID NO: 143059 - protein, 34 aa, Artificial Sequence
  Description of Artificial Sequence: Synthetic polypeptide
AEEEIATTNPVATEQWGGCVAGNGELAQNASGNH

SEQ ID NO: 143060 - protein, 32 aa, Artificial Sequence
  Description of Artificial Sequence: Synthetic polypeptide
DEDEIATTNPVATEQWGCVAAKANLMMPGGTG

SEQ ID NO: 143061 - protein, 35 aa, Artificial Sequence
  Description of Artificial Sequence: Synthetic polypeptide
DEEEIRTTNPVATEQYGSVGPTATMVVQPQVMAQY

SEQ ID NO: 143062 - protein, 30 aa, Artificial Sequence
  Description of Artificial Sequence: Synthetic polypeptide
TEMEIACTNPCSYEQYGCVSWNLQSGSQQP

SEQ ID NO: 143063 - protein, 33 aa, Artificial Sequence
  Description of Artificial Sequence: Synthetic polypeptide
TEMEIATTNPVATEQYGTVCSCTDGPSEFPGND

SEQ ID NO: 143064 - protein, 33 aa, Artificial Sequence
  Description of Artificial Sequence: Synthetic polypeptide
TEMEIVTTNPVATEQYGTVCSATDGPVEFEGND

SEQ ID NO: 143065 - protein, 33 aa, Artificial Sequence
  Description of Artificial Sequence: Synthetic polypeptide
TEMEIVTTNPVATEQYGTVCSATDGPVETEGND

SEQ ID NO: 143066 - protein, 31 aa, Artificial Sequence
  Description of Artificial Sequence: Synthetic polypeptide
TEMEIACTNPCSYEQYGCVCSWNLQSGSDRS

SEQ ID NO: 143067 - protein, 36 aa, Artificial Sequence
  Description of Artificial Sequence: Synthetic polypeptide
DEEEIRTTNPVATEQYGSVGPLMNMEEQMIMNEEIL

SEQ ID NO: 143068 - protein, 32 aa, Artificial Sequence
  Description of Artificial Sequence: Synthetic polypeptide
DEDEIATTNPVATEQWGCVATNGLEAVAPMEF

SEQ ID NO: 143069 - protein, 35 aa, Artificial Sequence
  Description of Artificial Sequence: Synthetic polypeptide
DEEEIATTNPVATEQYGSACAANNGDQIDPDGNNG

SEQ ID NO: 143070 - protein, 30 aa, Artificial Sequence
  Description of Artificial Sequence: Synthetic polypeptide
QEEEIATTNPVATEQYGTVPEDVCVEHEEK

SEQ ID NO: 143071 - protein, 36 aa, Artificial Sequence
  Description of Artificial Sequence: Synthetic polypeptide
TEGEIRTTNPVATEQYGSVSTWVWVLENEQIGGDQE

SEQ ID NO: 143072 - protein, 35 aa, Artificial Sequence
  Description of Artificial Sequence: Synthetic polypeptide
DEEEIRTTNPVATEQYGCVCSNSGEHNQNFISNIS

SEQ ID NO: 143073 - protein, 34 aa, Artificial Sequence
  Description of Artificial Sequence: Synthetic polypeptide
DEDEIATTNPVATEQWGSVAIANNLDQGGGMPDE

SEQ ID NO: 143074 - protein, 35 aa, Artificial Sequence
  Description of Artificial Sequence: Synthetic polypeptide
DEEEIRTTNPVATEQYGCVCSNSGEHNQNFGSDQA

SEQ ID NO: 143075 - protein, 35 aa, Artificial Sequence
  Description of Artificial Sequence: Synthetic polypeptide
DEEEIRTTNPVATEQYGCVCSNSGEHNQHFNSNQL

SEQ ID NO: 143076 - protein, 33 aa, Artificial Sequence
  Description of Artificial Sequence: Synthetic polypeptide
TEHEICTTNPVAYEQYGVVATNMDTQNGGNYST

SEQ ID NO: 143077 - protein, 33 aa, Artificial Sequence
  Description of Artificial Sequence: Synthetic polypeptide
DEDEIATTNPVATEQWGGCCNATNHQAEGPMRN

SEQ ID NO: 143078 - protein, 32 aa, Artificial Sequence
  Description of Artificial Sequence: Synthetic polypeptide
YEEEIASVNPIATEQYGAVSDENLQESKGPYQ

SEQ ID NO: 143079 - protein, 31 aa, Artificial Sequence
  Description of Artificial Sequence: Synthetic polypeptide
DEDEIATTNPVATEQWGGCCATNHQAEPPGT

SEQ ID NO: 143080 - protein, 32 aa, Artificial Sequence
  Description of Artificial Sequence: Synthetic polypeptide
DEDEIATTNPVATEQWGGCCATGHQAEGPMRQ

SEQ ID NO: 143081 - protein, 36 aa, Artificial Sequence
  Description of Artificial Sequence: Synthetic polypeptide
QEEEIRGTNPVATEGYGSVSIDNNGLEDQEGEGGNP

SEQ ID NO: 143082 - protein, 32 aa, Artificial Sequence
  Description of Artificial Sequence: Synthetic polypeptide
YEEEIASVNPIATEQWGVTVSNDENLQSKGNI

SEQ ID NO: 143083 - protein, 30 aa, Artificial Sequence
  Description of Artificial Sequence: Synthetic polypeptide
AEEEIATTNPVATEQYGCAPWVDQHISEQM

SEQ ID NO: 143084 - protein, 34 aa, Artificial Sequence
  Description of Artificial Sequence: Synthetic polypeptide
DESEIRTTNPVATECWGSVSCINEPQDTEEENGE

SEQ ID NO: 143085 - protein, 33 aa, Artificial Sequence
  Description of Artificial Sequence: Synthetic polypeptide
TEMEIVTTNPVATEQYGTVCSCTDGHSEFEGND

SEQ ID NO: 143086 - protein, 36 aa, Artificial Sequence
  Description of Artificial Sequence: Synthetic polypeptide
DEEEIRTTNPVATEQYGAVMGNGENQEDTQGGNGGT

SEQ ID NO: 143087 - protein, 32 aa, Artificial Sequence
  Description of Artificial Sequence: Synthetic polypeptide
DEDEIATTNPVATEQWGCVAAKANLMGMPGFP

SEQ ID NO: 143088 - protein, 33 aa, Artificial Sequence
  Description of Artificial Sequence: Synthetic polypeptide
TENAIRTTNPVATEQYGSFSTLTLIEGGQISSQ

SEQ ID NO: 143089 - protein, 36 aa, Artificial Sequence
  Description of Artificial Sequence: Synthetic polypeptide
DEEEIRTTNPVATEQYGSVGQPTFVLQPEMDEAEEN

SEQ ID NO: 143090 - protein, 35 aa, Artificial Sequence
  Description of Artificial Sequence: Synthetic polypeptide
DEEEIRTTNPVATEQYGAVMSDMNFNEEGGGQTGL

SEQ ID NO: 143091 - protein, 36 aa, Artificial Sequence
  Description of Artificial Sequence: Synthetic polypeptide
DEEEIRTTNPVATEQYGSVGQPTMGLQPEMMEAELN

SEQ ID NO: 143092 - protein, 35 aa, Artificial Sequence
  Description of Artificial Sequence: Synthetic polypeptide
DEDEIATTNPVATECYGSVSWNDNHQQQDGHGGNH

SEQ ID NO: 143093 - protein, 37 aa, Artificial Sequence
  Description of Artificial Sequence: Synthetic polypeptide
AEEEIRTTNPVATEQYGSVSVTVNNNEQGTNNNDELG

SEQ ID NO: 143094 - protein, 34 aa, Artificial Sequence
  Description of Artificial Sequence: Synthetic polypeptide
DEEEIATTNPVATEQYGSACAANNIETEAGGNDT

SEQ ID NO: 143095 - protein, 32 aa, Artificial Sequence
  Description of Artificial Sequence: Synthetic polypeptide
TENEIRTTNPVATEPWGKVSEIESTNAAEGDA

SEQ ID NO: 143096 - protein, 30 aa, Artificial Sequence
  Description of Artificial Sequence: Synthetic polypeptide
YEEEIASVNPACTEQYPTVDVSDWLQSGNQ

SEQ ID NO: 143097 - protein, 37 aa, Artificial Sequence
  Description of Artificial Sequence: Synthetic polypeptide
AEEEIRTTNPVATEQYGSVSVTVNNNEQGTNNTNELD

SEQ ID NO: 143098 - protein, 37 aa, Artificial Sequence
  Description of Artificial Sequence: Synthetic polypeptide
DEEEIRTTNPVATEQYGAVMSDNNGLEENQGEGEGQV

SEQ ID NO: 143099 - protein, 37 aa, Artificial Sequence
  Description of Artificial Sequence: Synthetic polypeptide
AEEEIRTTNPVATEQYGSVSVTVNNNEQGTNQQNEEE

SEQ ID NO: 143100 - protein, 33 aa, Artificial Sequence
  Description of Artificial Sequence: Synthetic polypeptide
DESEIRTTNPCAFECWGSVSCINEPQDREGEMG

SEQ ID NO: 143101 - protein, 30 aa, Artificial Sequence
  Description of Artificial Sequence: Synthetic polypeptide
TENEIRTTNPVATEQWGDVSEIEMNAAEDA

SEQ ID NO: 143102 - protein, 30 aa, Artificial Sequence
  Description of Artificial Sequence: Synthetic polypeptide
TENEIRTTNPVATEQWGDVSEIEMNAAEDG

SEQ ID NO: 143103 - protein, 30 aa, Artificial Sequence
  Description of Artificial Sequence: Synthetic polypeptide
TENEIRTTNPVATEQWGDVSEIEMNAAEDT

SEQ ID NO: 143104 - protein, 36 aa, Artificial Sequence
  Description of Artificial Sequence: Synthetic polypeptide
DEEEIRTTNPVATEQYGAVMSDMNFGEEGGGQNGIM

SEQ ID NO: 143105 - protein, 35 aa, Artificial Sequence
  Description of Artificial Sequence: Synthetic polypeptide
DEDEIATTNPVATEQWGSVAIEPNHDQGAGNGQGR

SEQ ID NO: 143106 - protein, 31 aa, Artificial Sequence
  Description of Artificial Sequence: Synthetic polypeptide
TENEIATTNPVAYECYGKVSECSLSQKVGPL

SEQ ID NO: 143107 - protein, 36 aa, Artificial Sequence
  Description of Artificial Sequence: Synthetic polypeptide
DEEEIRTTNPVATEQYGSVGQGVTGLGGNEGGGQGD

SEQ ID NO: 143108 - protein, 33 aa, Artificial Sequence
  Description of Artificial Sequence: Synthetic polypeptide
TENEIACTNPVATEAYGEASCELNALSQRGGGR

SEQ ID NO: 143109 - protein, 30 aa, Artificial Sequence
  Description of Artificial Sequence: Synthetic polypeptide
QEEEIATTNPVATEQYGVIAGPEVDQMEEQ

SEQ ID NO: 143110 - protein, 38 aa, Artificial Sequence
  Description of Artificial Sequence: Synthetic polypeptide
DEEEIRTTNPVATEAYGVVSTVVNTNLQAGNNNDEQSD

SEQ ID NO: 143111 - protein, 35 aa, Artificial Sequence
  Description of Artificial Sequence: Synthetic polypeptide
DEEEIRTTNPVATEQYGAVMNDDTNGEFGGGEEEG

SEQ ID NO: 143112 - protein, 36 aa, Artificial Sequence
  Description of Artificial Sequence: Synthetic polypeptide
DEEEIRTTNPVATEQYGCVCSNSGEHNQEGFNSDQS

SEQ ID NO: 143113 - protein, 31 aa, Artificial Sequence
  Description of Artificial Sequence: Synthetic polypeptide
DEDEIATTNPVATEQWGCVAAKANDMMPGTP

SEQ ID NO: 143114 - protein, 35 aa, Artificial Sequence
  Description of Artificial Sequence: Synthetic polypeptide
DEEEIRTTNPVATEQYGAVMSDFNFGEGGEGQGTD

SEQ ID NO: 143115 - protein, 35 aa, Artificial Sequence
  Description of Artificial Sequence: Synthetic polypeptide
DEEEIRTTNPVATEQYGSVGPWINNEWDVVVNQNH

SEQ ID NO: 143116 - protein, 28 aa, Artificial Sequence
  Description of Artificial Sequence: Synthetic peptide
QEEEIATTNPVATEKYGEAPEVCVHEEK

SEQ ID NO: 143117 - protein, 28 aa, Artificial Sequence
  Description of Artificial Sequence: Synthetic peptide
QEEEIATTNPVATEKYGEAPEVCWHEEK

SEQ ID NO: 143118 - protein, 34 aa, Artificial Sequence
  Description of Artificial Sequence: Synthetic polypeptide
DEDEIATTNPVATEPYGSVCAGNNLTDAGGNEEG

SEQ ID NO: 143119 - protein, 36 aa, Artificial Sequence
  Description of Artificial Sequence: Synthetic polypeptide
DEEEIRTTNPVATEQYGSVGPWTPNVQPTMMVQEHD

SEQ ID NO: 143120 - protein, 34 aa, Artificial Sequence
  Description of Artificial Sequence: Synthetic polypeptide
DEDEIATTNPVATEPYGSVAANNDTQDNNTNGRP

SEQ ID NO: 143121 - protein, 36 aa, Artificial Sequence
  Description of Artificial Sequence: Synthetic polypeptide
DEEEIRTTNPVATEQYGSVGPWTPNWVQTQMVQQAD

SEQ ID NO: 143122 - protein, 37 aa, Artificial Sequence
  Description of Artificial Sequence: Synthetic polypeptide
AEEEIRTTNPVATEQYGSVVTVTNEQLGNEQGNNDEA

SEQ ID NO: 143123 - protein, 31 aa, Artificial Sequence
  Description of Artificial Sequence: Synthetic polypeptide
TENEIATTNPVAYECYGKVSECSLSQHEGEL

SEQ ID NO: 143124 - protein, 31 aa, Artificial Sequence
  Description of Artificial Sequence: Synthetic polypeptide
TENEIRTTNPVATEQWGDVSEIEMNAAEQDA

SEQ ID NO: 143125 - protein, 36 aa, Artificial Sequence
  Description of Artificial Sequence: Synthetic polypeptide
TEGEIRTTNPVATEQYGITVATVNELSDDWPGNNRW

SEQ ID NO: 143126 - protein, 34 aa, Artificial Sequence
  Description of Artificial Sequence: Synthetic polypeptide
DEEEIATTNPVATEQYGSVANTGHAGEYGAEGGN

SEQ ID NO: 143127 - protein, 34 aa, Artificial Sequence
  Description of Artificial Sequence: Synthetic polypeptide
TEGEEIATTNPVAYEQWGSVTGGNAGDLQEGNQQ

SEQ ID NO: 143128 - protein, 36 aa, Artificial Sequence
  Description of Artificial Sequence: Synthetic polypeptide
DECEICTTNPVATEQYGVVSTVTNGANDEQGEGNND

SEQ ID NO: 143129 - protein, 32 aa, Artificial Sequence
  Description of Artificial Sequence: Synthetic polypeptide
DEDEIATTNPVATEQYGCVAANGDTATNNDTE

SEQ ID NO: 143130 - protein, 36 aa, Artificial Sequence
  Description of Artificial Sequence: Synthetic polypeptide
DECEICTTNPVATEQYGVVSTVTNGNLEAGENNEDN

SEQ ID NO: 143131 - protein, 32 aa, Artificial Sequence
  Description of Artificial Sequence: Synthetic polypeptide
DEDEIATTNPVATEQYGCVAAKANDMTMPNTG

SEQ ID NO: 143132 - protein, 35 aa, Artificial Sequence
  Description of Artificial Sequence: Synthetic polypeptide
DEEEIRTTNPVATEQYGCVCSNSGELNQNFISQQS

SEQ ID NO: 143133 - protein, 33 aa, Artificial Sequence
  Description of Artificial Sequence: Synthetic polypeptide
TEGEEIATTNPVAYEQWGSVSVTNAGDPGGDAD

SEQ ID NO: 143134 - protein, 31 aa, Artificial Sequence
  Description of Artificial Sequence: Synthetic polypeptide
DEDEIATTNPVATEQYGCVAAKANDMNMPGT

SEQ ID NO: 143135 - protein, 30 aa, Artificial Sequence
  Description of Artificial Sequence: Synthetic polypeptide
TEGEIAPTNPCSYEQWGITVSCNLSQSGTR

SEQ ID NO: 143136 - protein, 35 aa, Artificial Sequence
  Description of Artificial Sequence: Synthetic polypeptide
DEEEIRTTNPVATEQYGSVMGPEMGNGETGEAGGT

SEQ ID NO: 143137 - protein, 31 aa, Artificial Sequence
  Description of Artificial Sequence: Synthetic polypeptide
DEDEIATTNPVATEQYGCTAGNNLADDSDGD

SEQ ID NO: 143138 - protein, 30 aa, Artificial Sequence
  Description of Artificial Sequence: Synthetic polypeptide
TEGEIAPTNPCSYEQYGCTVSCNHQSGGTR

SEQ ID NO: 143139 - protein, 32 aa, Artificial Sequence
  Description of Artificial Sequence: Synthetic polypeptide
DEDEIATTNPVATEQYGCTAGNGLATDDGDQE

SEQ ID NO: 143140 - protein, 31 aa, Artificial Sequence
  Description of Artificial Sequence: Synthetic polypeptide
DEDEIATTNPVATEQYGCTAGNGLADDLDSV

SEQ ID NO: 143141 - protein, 32 aa, Artificial Sequence
  Description of Artificial Sequence: Synthetic polypeptide
DEDEIATTNPVATEQYGCVAAKANDMGMPSNT

SEQ ID NO: 143142 - protein, 36 aa, Artificial Sequence
  Description of Artificial Sequence: Synthetic polypeptide
DEEEIRTTNPVATEQYGCVCSNSGETNQNFNSETQS

SEQ ID NO: 143143 - protein, 36 aa, Artificial Sequence
  Description of Artificial Sequence: Synthetic polypeptide
DECEICTTNPVATEQYGVVSTVTDQNDEQGEGNNND

SEQ ID NO: 143144 - protein, 30 aa, Artificial Sequence
  Description of Artificial Sequence: Synthetic polypeptide
DESEIRSTNPVSTEQWGNVSNIEMSAAEDR

SEQ ID NO: 143145 - protein, 32 aa, Artificial Sequence
  Description of Artificial Sequence: Synthetic polypeptide
TEEVICTTNPVAYECYGSVSCNNMSNSGGNNA

SEQ ID NO: 143146 - protein, 36 aa, Artificial Sequence
  Description of Artificial Sequence: Synthetic polypeptide
DEEEIRTTNPVATEQYGCVCSNSNHEQENFNSENQS

SEQ ID NO: 143147 - protein, 31 aa, Artificial Sequence
  Description of Artificial Sequence: Synthetic polypeptide
AEEEIATTNPVATEQYGCSCPWPDNQHFEEQ

SEQ ID NO: 143148 - protein, 36 aa, Artificial Sequence
  Description of Artificial Sequence: Synthetic polypeptide
TEEVIRTTNPVATEQYGCWVVSPTNAHSDNTGQNNR

SEQ ID NO: 143149 - protein, 32 aa, Artificial Sequence
  Description of Artificial Sequence: Synthetic polypeptide
AEEEIATTNPVATEQYGCSCPWADNQHFNEQS

SEQ ID NO: 143150 - protein, 34 aa, Artificial Sequence
  Description of Artificial Sequence: Synthetic polypeptide
DESEIRTTNPVATECWGSVSCINKEPQDREWETG

SEQ ID NO: 143151 - protein, 35 aa, Artificial Sequence
  Description of Artificial Sequence: Synthetic polypeptide
DEEEIRTTNPVATEQYGCVCSNSMEHDQNFGSEQP

SEQ ID NO: 143152 - protein, 29 aa, Artificial Sequence
  Description of Artificial Sequence: Synthetic peptide
QEEEIATTNPVATEHYGEAPEYVCQHEEK

SEQ ID NO: 143153 - protein, 35 aa, Artificial Sequence
  Description of Artificial Sequence: Synthetic polypeptide
DEEEIRTTNPVATEQYGAVDSGMGVGDEQGGDEDV

SEQ ID NO: 143154 - protein, 33 aa, Artificial Sequence
  Description of Artificial Sequence: Synthetic polypeptide
TEEVVCTTNPVATEQYGNTVSISNNERRIGNLP

SEQ ID NO: 143155 - protein, 30 aa, Artificial Sequence
  Description of Artificial Sequence: Synthetic polypeptide
DESEIRSTNPVSTEQWGNVSEIIQNAVEQA

SEQ ID NO: 143156 - protein, 33 aa, Artificial Sequence
  Description of Artificial Sequence: Synthetic polypeptide
TEFEICTTNPVAYEQYGVVATNMDDQNGGNYSL

SEQ ID NO: 143157 - protein, 30 aa, Artificial Sequence
  Description of Artificial Sequence: Synthetic polypeptide
DESEIRSTNPVSTEQWGNVSEIIQSAVEQA

SEQ ID NO: 143158 - protein, 34 aa, Artificial Sequence
  Description of Artificial Sequence: Synthetic polypeptide
QEEEIRSTNPVATEQYGSVNTDNMIETGGGQDQG

SEQ ID NO: 143159 - protein, 36 aa, Artificial Sequence
  Description of Artificial Sequence: Synthetic polypeptide
DEEEIRTTNPVATEQYGSVGINMNGEEQMIMNEEEL

SEQ ID NO: 143160 - protein, 35 aa, Artificial Sequence
  Description of Artificial Sequence: Synthetic polypeptide
DECEICTTNPVATEQYGVVSTVTNGNVESGEGNED

SEQ ID NO: 143161 - protein, 31 aa, Artificial Sequence
  Description of Artificial Sequence: Synthetic polypeptide
TEGEIAPTNPCSYEQYGITVPSCNLQSGGTR

SEQ ID NO: 143162 - protein, 31 aa, Artificial Sequence
  Description of Artificial Sequence: Synthetic polypeptide
TEGEIAPTNPCSYEQYGITVSCCNELQSGTR

SEQ ID NO: 143163 - protein, 36 aa, Artificial Sequence
  Description of Artificial Sequence: Synthetic polypeptide
DECEICTTNPVATEQYGVVSTVTNGQNDEEGEGNVD

SEQ ID NO: 143164 - protein, 35 aa, Artificial Sequence
  Description of Artificial Sequence: Synthetic polypeptide
DEDEIATTNPVATEQWGSVSVTAHPLAPDAQGGDE

SEQ ID NO: 143165 - protein, 35 aa, Artificial Sequence
  Description of Artificial Sequence: Synthetic polypeptide
DESEIRTTNCVATDAYGSVNTNDLQNQLEGGNGDT

SEQ ID NO: 143166 - protein, 33 aa, Artificial Sequence
  Description of Artificial Sequence: Synthetic polypeptide
TEGEICTTNPVGTAAWGSVVSCTNMGSQSGNRW

SEQ ID NO: 143167 - protein, 33 aa, Artificial Sequence
  Description of Artificial Sequence: Synthetic polypeptide
TEGEICTTNPVGTAAWGSVVSCTNMLSQSGNHI

SEQ ID NO: 143168 - protein, 37 aa, Artificial Sequence
  Description of Artificial Sequence: Synthetic polypeptide
DEEEIRTTNPVATEQYGSVGIPNTNLLDHQNVVDPFV

SEQ ID NO: 143169 - protein, 38 aa, Artificial Sequence
  Description of Artificial Sequence: Synthetic polypeptide
DEEEIRTTNPVATEAYGVVSTVVNTNLQAGNQQGEEDE

SEQ ID NO: 143170 - protein, 38 aa, Artificial Sequence
  Description of Artificial Sequence: Synthetic polypeptide
DEEEIRTTNPVATEAYGVVSTVVNTNLQAGNQNDEQGE

SEQ ID NO: 143171 - protein, 35 aa, Artificial Sequence
  Description of Artificial Sequence: Synthetic polypeptide
DEEEIRTTNPVATEQYGCVCSNSGEHQEFFPSNQS

SEQ ID NO: 143172 - protein, 34 aa, Artificial Sequence
  Description of Artificial Sequence: Synthetic polypeptide
DEDEIATTNPVATEQWGSVSATGDMADTGGEDNH

SEQ ID NO: 143173 - protein, 35 aa, Artificial Sequence
  Description of Artificial Sequence: Synthetic polypeptide
DEDEIATTNPVATEQWGSVSATGDLEDHQGGEDHK

SEQ ID NO: 143174 - protein, 38 aa, Artificial Sequence
  Description of Artificial Sequence: Synthetic polypeptide
DEEEIRTTNPVATEAYGVVSTVVNTNLQAGNQNDENED

SEQ ID NO: 143175 - protein, 35 aa, Artificial Sequence
  Description of Artificial Sequence: Synthetic polypeptide
DEEEIRTTNPVATEQYGAVMGDLNNGQEGGGDIGD

SEQ ID NO: 143176 - protein, 36 aa, Artificial Sequence
  Description of Artificial Sequence: Synthetic polypeptide
DEEEIRTTNPVATEQYGSVGMWTPVVNQTQMVQEAD

SEQ ID NO: 143177 - protein, 33 aa, Artificial Sequence
  Description of Artificial Sequence: Synthetic polypeptide
DEDEIATTNPVATEQWGSVANMNDGTATDNDRH

SEQ ID NO: 143178 - protein, 35 aa, Artificial Sequence
  Description of Artificial Sequence: Synthetic polypeptide
DEDEIATTNPVATEQWGSVAITNLPEAAGGDQDRH

SEQ ID NO: 143179 - protein, 33 aa, Artificial Sequence
  Description of Artificial Sequence: Synthetic polypeptide
TEGEICTTNPVGTAAWGNVVSCTNMLSQSGNRG

SEQ ID NO: 143180 - protein, 35 aa, Artificial Sequence
  Description of Artificial Sequence: Synthetic polypeptide
DEEEIRTTNPVATEQYGCVCSNSGEHNQNSNSDQP

SEQ ID NO: 143181 - protein, 33 aa, Artificial Sequence
  Description of Artificial Sequence: Synthetic polypeptide
TEGEIATTNPVGTAAWGSVVSCTNMLSQSGNMW

SEQ ID NO: 143182 - protein, 38 aa, Artificial Sequence
  Description of Artificial Sequence: Synthetic polypeptide
DEEEIRTTNPVATEAYGVVSTVVNTNLQAGNTNDEESE

SEQ ID NO: 143183 - protein, 34 aa, Artificial Sequence
  Description of Artificial Sequence: Synthetic polypeptide
DESEIRTTNAVAFELWGSVSCINEPQDREGENIG

SEQ ID NO: 143184 - protein, 34 aa, Artificial Sequence
  Description of Artificial Sequence: Synthetic polypeptide
DEEEIRTTNPVATEQYGAVFGDSGDQDEEGGGQG

SEQ ID NO: 143185 - protein, 35 aa, Artificial Sequence
  Description of Artificial Sequence: Synthetic polypeptide
DEEEIRTTNPVATEQYGCVCSNSGEHQESFGSQQE

SEQ ID NO: 143186 - protein, 31 aa, Artificial Sequence
  Description of Artificial Sequence: Synthetic polypeptide
TEGEIAPTNPCSYEQYGIVSCNLSTSGGTNR

SEQ ID NO: 143187 - protein, 30 aa, Artificial Sequence
  Description of Artificial Sequence: Synthetic polypeptide
TEGEIAPTNPCSYEQYGKTVACNLSQSGTR

SEQ ID NO: 143188 - protein, 32 aa, Artificial Sequence
  Description of Artificial Sequence: Synthetic polypeptide
TEGEIAPTNPCSYEQYGKTVSCNLSQSGTNRQ

SEQ ID NO: 143189 - protein, 32 aa, Artificial Sequence
  Description of Artificial Sequence: Synthetic polypeptide
DEDEIATTNPVATEQYGCTAGNGLADDGDGDI

SEQ ID NO: 143190 - protein, 32 aa, Artificial Sequence
  Description of Artificial Sequence: Synthetic polypeptide
DEDEIATTNPVATEQYGCTAGNGLADDGDESL

SEQ ID NO: 143191 - protein, 35 aa, Artificial Sequence
  Description of Artificial Sequence: Synthetic polypeptide
DEDEIATTNPVATEQYGCSNAATANPLQAPMENHN

SEQ ID NO: 143192 - protein, 31 aa, Artificial Sequence
  Description of Artificial Sequence: Synthetic polypeptide
TEGEIAPTNPCSYEQYGTTVSCNLSQSGTTR

SEQ ID NO: 143193 - protein, 31 aa, Artificial Sequence
  Description of Artificial Sequence: Synthetic polypeptide
TEGEIAPTNPCSYEQYGVTVSCNLQSTGGTR

SEQ ID NO: 143194 - protein, 34 aa, Artificial Sequence
  Description of Artificial Sequence: Synthetic polypeptide
DEEEIRTTNPVATEQYGAVFGDTEQDEMTNGGQG

SEQ ID NO: 143195 - protein, 31 aa, Artificial Sequence
  Description of Artificial Sequence: Synthetic polypeptide
TEGEIAPTNPCSYEQYGVTVSCNLSQSVGTR

SEQ ID NO: 143196 - protein, 38 aa, Artificial Sequence
  Description of Artificial Sequence: Synthetic polypeptide
DEEEIRTTNPVATEAYGVVSTVVNTNLQAGNTNDQQND

SEQ ID NO: 143197 - protein, 36 aa, Artificial Sequence
  Description of Artificial Sequence: Synthetic polypeptide
DEDEIATTNPVATEQWGSVSVTANPLTAPDNQGGRD

SEQ ID NO: 143198 - protein, 36 aa, Artificial Sequence
  Description of Artificial Sequence: Synthetic polypeptide
DEEEIRTTNPVATEQYGCVCSNSGEHQEHFGSENQS

SEQ ID NO: 143199 - protein, 35 aa, Artificial Sequence
  Description of Artificial Sequence: Synthetic polypeptide
DESEIRTTNPVATASWGSVSAANNEPLDRGGENTG

SEQ ID NO: 143200 - protein, 30 aa, Artificial Sequence
  Description of Artificial Sequence: Synthetic polypeptide
TENEIRTTNPVATEQWGDVSEIEMNDAEDA

SEQ ID NO: 143201 - protein, 37 aa, Artificial Sequence
  Description of Artificial Sequence: Synthetic polypeptide
AEEEIRTTNPVATEQYGSVSVTVNNNEQGTTNNNETT

SEQ ID NO: 143202 - protein, 29 aa, Artificial Sequence
  Description of Artificial Sequence: Synthetic peptide
QEEEIATTNPVATEQFGEAPEVCQHEEKI

SEQ ID NO: 143203 - protein, 33 aa, Artificial Sequence
  Description of Artificial Sequence: Synthetic polypeptide
DEDEIATTNPVATAQWGGCVAGTGLPEDQDGNN

SEQ ID NO: 143204 - protein, 35 aa, Artificial Sequence
  Description of Artificial Sequence: Synthetic polypeptide
TETCIRTTNPVATEQYGKTVSTGNMIQEPGGNTFD

SEQ ID NO: 143205 - protein, 35 aa, Artificial Sequence
  Description of Artificial Sequence: Synthetic polypeptide
TETEIATTNPVAYEQWGSVAKTDNDTQKRSGNNSR

SEQ ID NO: 143206 - protein, 35 aa, Artificial Sequence
  Description of Artificial Sequence: Synthetic polypeptide
TETEIATTNPVAYEQWGSVNKTDNLTNERKGNNER

SEQ ID NO: 143207 - protein, 30 aa, Artificial Sequence
  Description of Artificial Sequence: Synthetic polypeptide
QEEEIATTNPVATEQYGEAPEVCQDHEEKL

SEQ ID NO: 143208 - protein, 33 aa, Artificial Sequence
  Description of Artificial Sequence: Synthetic polypeptide
DEDEIATTNPVATAQWGGCVASANDDTRGNMDS

SEQ ID NO: 143209 - protein, 34 aa, Artificial Sequence
  Description of Artificial Sequence: Synthetic polypeptide
QEEEIATTNPVATEQWGCVADTWELAQDNESGNH

SEQ ID NO: 143210 - protein, 33 aa, Artificial Sequence
  Description of Artificial Sequence: Synthetic polypeptide
DEDEIATTNPVATAQWGGCVAGTALQDQGGNQE

SEQ ID NO: 143211 - protein, 30 aa, Artificial Sequence
  Description of Artificial Sequence: Synthetic polypeptide
QEEEIATTNPVATEQYGEAPEVCQDHEEEL

SEQ ID NO: 143212 - protein, 35 aa, Artificial Sequence
  Description of Artificial Sequence: Synthetic polypeptide
DEEEIRTTNPVATEQYGCVCSMWGEDQENFGSDQP

SEQ ID NO: 143213 - protein, 32 aa, Artificial Sequence
  Description of Artificial Sequence: Synthetic polypeptide
DESEIRTTNPIATECWGNVWAANDWQSRKGQI

SEQ ID NO: 143214 - protein, 34 aa, Artificial Sequence
  Description of Artificial Sequence: Synthetic polypeptide
TETEIRTTNPVAYEQWGCYVWDTQDHLQPGHDNR

SEQ ID NO: 143215 - protein, 33 aa, Artificial Sequence
  Description of Artificial Sequence: Synthetic polypeptide
DEDEIATTNPVATAQWGGCVAGNGLDTRDGNND

SEQ ID NO: 143216 - protein, 36 aa, Artificial Sequence
  Description of Artificial Sequence: Synthetic polypeptide
DEEEIATTNPVATEQYGSVAATTPAIPNMRMGMNPV

SEQ ID NO: 143217 - protein, 34 aa, Artificial Sequence
  Description of Artificial Sequence: Synthetic polypeptide
DEEEIRTTNPVATEQYGAVQDDNNVGEMGEGTTV

SEQ ID NO: 143218 - protein, 35 aa, Artificial Sequence
  Description of Artificial Sequence: Synthetic polypeptide
DEEEIRTTNPVATEQYGAVPSTVGDFDPNNEDEQG

SEQ ID NO: 143219 - protein, 35 aa, Artificial Sequence
  Description of Artificial Sequence: Synthetic polypeptide
DEEEIRTTNPVATEQYGAVPESSNMNIVELNVQGE

SEQ ID NO: 143220 - protein, 33 aa, Artificial Sequence
  Description of Artificial Sequence: Synthetic polypeptide
DESEIRTTNPVATECWGSVSCINEPQDHEFELG

SEQ ID NO: 143221 - protein, 35 aa, Artificial Sequence
  Description of Artificial Sequence: Synthetic polypeptide
DEEEIRTTNPVATEQYGCVCSMWGEHQNFTSDNQN

SEQ ID NO: 143222 - protein, 35 aa, Artificial Sequence
  Description of Artificial Sequence: Synthetic polypeptide
DEEEIRTTNPVATEQYGCVCSMWGEHQNFGSDTQS

SEQ ID NO: 143223 - protein, 34 aa, Artificial Sequence
  Description of Artificial Sequence: Synthetic polypeptide
DEDEIATTNPVATAQWGGCVCATGALQQMGNNRN

SEQ ID NO: 143224 - protein, 36 aa, Artificial Sequence
  Description of Artificial Sequence: Synthetic polypeptide
DEEEIRTTNPVATEQYGAVNSTTIDFDSRNNEDEEV

SEQ ID NO: 143225 - protein, 35 aa, Artificial Sequence
  Description of Artificial Sequence: Synthetic polypeptide
DEEEIRTTNPVATEQYGCVCSMWGEHNQNFGSDQS

SEQ ID NO: 143226 - protein, 35 aa, Artificial Sequence
  Description of Artificial Sequence: Synthetic polypeptide
TESEIRTTNPVAYEAYRGTVPSYTQNALQSGGNAP

SEQ ID NO: 143227 - protein, 35 aa, Artificial Sequence
  Description of Artificial Sequence: Synthetic polypeptide
DEEEIRTTNPVATEQYGCVCSMWGEHNQNFGSDQA

SEQ ID NO: 143228 - protein, 34 aa, Artificial Sequence
  Description of Artificial Sequence: Synthetic polypeptide
TESEIRTTNPVAYECWGSVSCINAHSQTREGENG

SEQ ID NO: 143229 - protein, 33 aa, Artificial Sequence
  Description of Artificial Sequence: Synthetic polypeptide
DEDEIATTNPVATAQWGGCVATGALQQMGNDQN

SEQ ID NO: 143230 - protein, 28 aa, Artificial Sequence
  Description of Artificial Sequence: Synthetic peptide
QEEEIATTNPVATEQFGEAPEVCGHEEK

SEQ ID NO: 143231 - protein, 35 aa, Artificial Sequence
  Description of Artificial Sequence: Synthetic polypeptide
DEEEIRTTNPVATEQYGSVHPWNYENQDLMEVTEI

SEQ ID NO: 143232 - protein, 37 aa, Artificial Sequence
  Description of Artificial Sequence: Synthetic polypeptide
DEEEIRTTNPVATEQYGSVLAVNLGSEEARSTVNLAQ

SEQ ID NO: 143233 - protein, 36 aa, Artificial Sequence
  Description of Artificial Sequence: Synthetic polypeptide
DEEEIRTTNPVATEQYGAVNSTVNDFDFNNNEDEDG

SEQ ID NO: 143234 - protein, 32 aa, Artificial Sequence
  Description of Artificial Sequence: Synthetic polypeptide
AEEEIASVNPVCTEQYGVVSWELQESFGSNQA

SEQ ID NO: 143235 - protein, 35 aa, Artificial Sequence
  Description of Artificial Sequence: Synthetic polypeptide
QEEEIQTTNPVAYEQYGTIACTVNSLSQNRTEGNY

SEQ ID NO: 143236 - protein, 28 aa, Artificial Sequence
  Description of Artificial Sequence: Synthetic peptide
QEEEIATTNPVATEQWGEAPEICMHEEA

SEQ ID NO: 143237 - protein, 36 aa, Artificial Sequence
  Description of Artificial Sequence: Synthetic polypeptide
DEEEIRTTNPVATEQYGCVCSMWGEDLNQNFNSEQS

SEQ ID NO: 143238 - protein, 32 aa, Artificial Sequence
  Description of Artificial Sequence: Synthetic polypeptide
TEVEIATTNPVAYDQYGMVPSCCAEHSQRGNP

SEQ ID NO: 143239 - protein, 32 aa, Artificial Sequence
  Description of Artificial Sequence: Synthetic polypeptide
DESEIRTTNPIATECWGSVANCINWADPEGNG

SEQ ID NO: 143240 - protein, 33 aa, Artificial Sequence
  Description of Artificial Sequence: Synthetic polypeptide
TNEEEIATTNPVAYEQWGTVYTNDQGEHGGNDS

SEQ ID NO: 143241 - protein, 34 aa, Artificial Sequence
  Description of Artificial Sequence: Synthetic polypeptide
TNEEIATTNPVATECYGCVCTNDNHQRDGQNGDD

SEQ ID NO: 143242 - protein, 33 aa, Artificial Sequence
  Description of Artificial Sequence: Synthetic polypeptide
DESEIRTTNPIATECWGSVSCIDWPAEREGENG

SEQ ID NO: 143243 - protein, 37 aa, Artificial Sequence
  Description of Artificial Sequence: Synthetic polypeptide
AEEEIRTTNPVATEQYGSVVTTNDGGNNLLQGTNDES

SEQ ID NO: 143244 - protein, 34 aa, Artificial Sequence
  Description of Artificial Sequence: Synthetic polypeptide
TNEEIATTNPVATTQWGNVSKTWNPDEQQGQNDR

SEQ ID NO: 143245 - protein, 37 aa, Artificial Sequence
  Description of Artificial Sequence: Synthetic polypeptide
DEEEIRTTNPVATEQYGSVMGMNVNGGQQDEGENQDL

SEQ ID NO: 143246 - protein, 34 aa, Artificial Sequence
  Description of Artificial Sequence: Synthetic polypeptide
TNEEIATTNPVAYEQWGSVSHTQNGLDQGGDGDS

SEQ ID NO: 143247 - protein, 29 aa, Artificial Sequence
  Description of Artificial Sequence: Synthetic peptide
QEEEIATTNPVATEQWGEASEICMNHEEA

SEQ ID NO: 143248 - protein, 34 aa, Artificial Sequence
  Description of Artificial Sequence: Synthetic polypeptide
DESEIRTTNPVATECWGSVSCINEPNDSDGENFG

SEQ ID NO: 143249 - protein, 35 aa, Artificial Sequence
  Description of Artificial Sequence: Synthetic polypeptide
CEEEIACTNPVATEQYGSACSTNPLQPDASEEGDP

SEQ ID NO: 143250 - protein, 37 aa, Artificial Sequence
  Description of Artificial Sequence: Synthetic polypeptide
DEEEIRTTNPVATEQYGCVCSMTNEDHNQNFGSETQS

SEQ ID NO: 143251 - protein, 35 aa, Artificial Sequence
  Description of Artificial Sequence: Synthetic polypeptide
DEEEIATTNPVATEQYGSACAANPIEQEAEGGNNQ

SEQ ID NO: 143252 - protein, 34 aa, Artificial Sequence
  Description of Artificial Sequence: Synthetic polypeptide
DECEICTTNPVATTQYGVVSTQALQQGTEQGTDA

SEQ ID NO: 143253 - protein, 37 aa, Artificial Sequence
  Description of Artificial Sequence: Synthetic polypeptide
AEDEIRATNPVATEQYGSVSTTNQNLQQQGNGTNQQD

SEQ ID NO: 143254 - protein, 34 aa, Artificial Sequence
  Description of Artificial Sequence: Synthetic polypeptide
TNEAEIATTNPVAYEQWGSVCSGEKNDQRGENNA

SEQ ID NO: 143255 - protein, 38 aa, Artificial Sequence
  Description of Artificial Sequence: Synthetic polypeptide
AEEEIRTTNPVATEQYGSVSVTVTNQLGGTEQGSNSNQ

SEQ ID NO: 143256 - protein, 33 aa, Artificial Sequence
  Description of Artificial Sequence: Synthetic polypeptide
TNAEIRTTNPVATEQYGTVCTSTVDQHGMGGGE

SEQ ID NO: 143257 - protein, 34 aa, Artificial Sequence
  Description of Artificial Sequence: Synthetic polypeptide
DEEEIRTTNPVATEQYGCVCSMWEAHQNFISEQS

SEQ ID NO: 143258 - protein, 29 aa, Artificial Sequence
  Description of Artificial Sequence: Synthetic peptide
QEEEIATTNPVATEQWGEAPEVCPQHEEK

SEQ ID NO: 143259 - protein, 35 aa, Artificial Sequence
  Description of Artificial Sequence: Synthetic polypeptide
DEEEIRTTNPVATEQYGCVCSMWEHQENFPSDNQP

SEQ ID NO: 143260 - protein, 34 aa, Artificial Sequence
  Description of Artificial Sequence: Synthetic polypeptide
DESEIRTTNPIATECWGSCSCINIKPQDRKGENG

SEQ ID NO: 143261 - protein, 30 aa, Artificial Sequence
  Description of Artificial Sequence: Synthetic polypeptide
QEEEIATTNPVATEQYGEAPEVCQDHEEDL

SEQ ID NO: 143262 - protein, 30 aa, Artificial Sequence
  Description of Artificial Sequence: Synthetic polypeptide
QEEEIATTNPVATEQYGEAPEVCQDHEEDK

SEQ ID NO: 143263 - protein, 36 aa, Artificial Sequence
  Description of Artificial Sequence: Synthetic polypeptide
DEEEIATTNPVATEQWGEVSSTNPEGPNMRNGMNPV

SEQ ID NO: 143264 - protein, 33 aa, Artificial Sequence
  Description of Artificial Sequence: Synthetic polypeptide
DESEIRTTNPIATECWGSTACINEPQDREGENG

SEQ ID NO: 143265 - protein, 32 aa, Artificial Sequence
  Description of Artificial Sequence: Synthetic polypeptide
TGEEIATTNPVAYEQWGSVMWTEGDQRGTDEV

SEQ ID NO: 143266 - protein, 32 aa, Artificial Sequence
  Description of Artificial Sequence: Synthetic polypeptide
TGEEIATTNPVAYEQWGSVMWTEGDTRGTTER

SEQ ID NO: 143267 - protein, 36 aa, Artificial Sequence
  Description of Artificial Sequence: Synthetic polypeptide
DEEEIRTTNPVATEQYGCVCSMWEHNQENFGSDNQS

SEQ ID NO: 143268 - protein, 35 aa, Artificial Sequence
  Description of Artificial Sequence: Synthetic polypeptide
DEEEIRTTNPVATEQYGCVCSMWEEHNQNFGSQQS

SEQ ID NO: 143269 - protein, 29 aa, Artificial Sequence
  Description of Artificial Sequence: Synthetic peptide
QEEEIATTNPVATEQWGEAPEVCQHKEEK

SEQ ID NO: 143270 - protein, 32 aa, Artificial Sequence
  Description of Artificial Sequence: Synthetic polypeptide
TGEEIATTNPVAYEQWGSVYWTEQDQRGTTEP

SEQ ID NO: 143271 - protein, 33 aa, Artificial Sequence
  Description of Artificial Sequence: Synthetic polypeptide
TGEEIRTTNPVAYEQWGSVTGGNAGDLREGNMD

SEQ ID NO: 143272 - protein, 34 aa, Artificial Sequence
  Description of Artificial Sequence: Synthetic polypeptide
TNAEIATTNPVATEQYGSVCTIEGQDGQGQNNHR

SEQ ID NO: 143273 - protein, 29 aa, Artificial Sequence
  Description of Artificial Sequence: Synthetic peptide
QEEEIATTNPVATEQWGEAPEWCQHEEKC

SEQ ID NO: 143274 - protein, 30 aa, Artificial Sequence
  Description of Artificial Sequence: Synthetic polypeptide
TENEIRTTNPVATEQWGDVSEIPMNAAEDA

SEQ ID NO: 143275 - protein, 32 aa, Artificial Sequence
  Description of Artificial Sequence: Synthetic polypeptide
YEEEIASTNPVCTEQYGVVSMEDIQQQSNGNH

SEQ ID NO: 143276 - protein, 29 aa, Artificial Sequence
  Description of Artificial Sequence: Synthetic peptide
QEEEIATTNPVATERYGEAPEVCQHEEKA

SEQ ID NO: 143277 - protein, 35 aa, Artificial Sequence
  Description of Artificial Sequence: Synthetic polypeptide
TEQEIATTNPVAYEQWGSVQKTDNDTQKRSGENAR

SEQ ID NO: 143278 - protein, 28 aa, Artificial Sequence
  Description of Artificial Sequence: Synthetic peptide
QEEEIATTNPVATEPYGEAPEVCAHEEK

SEQ ID NO: 143279 - protein, 34 aa, Artificial Sequence
  Description of Artificial Sequence: Synthetic polypeptide
AEEEIATTNPVATEEYGFIASCINLSTRPGGNNV

SEQ ID NO: 143280 - protein, 37 aa, Artificial Sequence
  Description of Artificial Sequence: Synthetic polypeptide
DECEICTTNPVATEQYGVVSVTVSNLQQGNNNNNQED

SEQ ID NO: 143281 - protein, 37 aa, Artificial Sequence
  Description of Artificial Sequence: Synthetic polypeptide
DECEICTTNPVATEQYGVVSVTVTNLQAGNNNDEEDD

SEQ ID NO: 143282 - protein, 35 aa, Artificial Sequence
  Description of Artificial Sequence: Synthetic polypeptide
DEEEIRTTNPVATEQYGCVCSNSEHQEFFNSDTQD

SEQ ID NO: 143283 - protein, 29 aa, Artificial Sequence
  Description of Artificial Sequence: Synthetic peptide
QEEEIATTNPVATEPYGEAPEEVCQQEEK

SEQ ID NO: 143284 - protein, 29 aa, Artificial Sequence
  Description of Artificial Sequence: Synthetic peptide
QEEEIATTNPVATEPYGEAPEVCQHNEEK

SEQ ID NO: 143285 - protein, 37 aa, Artificial Sequence
  Description of Artificial Sequence: Synthetic polypeptide
DECEICTTNPVATEQYGVVSVVVTNLQQGNNNEDEDD

SEQ ID NO: 143286 - protein, 30 aa, Artificial Sequence
  Description of Artificial Sequence: Synthetic polypeptide
TESEIASTNPVGTEGYGVMASTELQHTGDI

SEQ ID NO: 143287 - protein, 36 aa, Artificial Sequence
  Description of Artificial Sequence: Synthetic polypeptide
DEEEIRTTNPVATEQYGSVGSESYGHIVPQVGVLGN

SEQ ID NO: 143288 - protein, 29 aa, Artificial Sequence
  Description of Artificial Sequence: Synthetic peptide
TESEIASTNPVGTEGYGVMAYSTLQHGDI

SEQ ID NO: 143289 - protein, 33 aa, Artificial Sequence
  Description of Artificial Sequence: Synthetic polypeptide
QEEEIRCTNPAATEQYGSVVSEGGMGGGQNGQT

SEQ ID NO: 143290 - protein, 33 aa, Artificial Sequence
  Description of Artificial Sequence: Synthetic polypeptide
DECEICTTNPVATEQYGVVVTVTDGGVEVEGND

SEQ ID NO: 143291 - protein, 28 aa, Artificial Sequence
  Description of Artificial Sequence: Synthetic peptide
TESEIASTNPVGTEGYGVAYQTLQHGDI

SEQ ID NO: 143292 - protein, 29 aa, Artificial Sequence
  Description of Artificial Sequence: Synthetic peptide
QEEEIATTNPVATEPYGEAPEEVCQHEEK

SEQ ID NO: 143293 - protein, 30 aa, Artificial Sequence
  Description of Artificial Sequence: Synthetic polypeptide
QEEEIATTNPVATEPYGEAPEDIQQQHGEH

SEQ ID NO: 143294 - protein, 35 aa, Artificial Sequence
  Description of Artificial Sequence: Synthetic polypeptide
DESEIRTTNPCATECYGVVCYKTNDEGQRQGDGMR

SEQ ID NO: 143295 - protein, 33 aa, Artificial Sequence
  Description of Artificial Sequence: Synthetic polypeptide
TENEIRTTNPVATEQYGSISLTFEETITEMLRG

SEQ ID NO: 143296 - protein, 37 aa, Artificial Sequence
  Description of Artificial Sequence: Synthetic polypeptide
DEEEIRTTNPVATEQYGSVHTNENVEEQQAMNVEVGY

SEQ ID NO: 143297 - protein, 35 aa, Artificial Sequence
  Description of Artificial Sequence: Synthetic polypeptide
DEEEIRTTNPVATEQYGAVMSNGFGNGQINDQEIQ

SEQ ID NO: 143298 - protein, 30 aa, Artificial Sequence
  Description of Artificial Sequence: Synthetic polypeptide
YEEEIASTNPVSTEPYGTISMEDIQQQGNH

SEQ ID NO: 143299 - protein, 34 aa, Artificial Sequence
  Description of Artificial Sequence: Synthetic polypeptide
TEPEIRTTNPVATEEYGCCWYNIGVLQRGMNNQE

SEQ ID NO: 143300 - protein, 36 aa, Artificial Sequence
  Description of Artificial Sequence: Synthetic polypeptide
DEEEIRTTNPVATEQYGSVGQPTVGLQPEMFEAEEN

SEQ ID NO: 143301 - protein, 33 aa, Artificial Sequence
  Description of Artificial Sequence: Synthetic polypeptide
TEPEIVTTNPVATEQYGTVCSATDGPVEFEGND

SEQ ID NO: 143302 - protein, 34 aa, Artificial Sequence
  Description of Artificial Sequence: Synthetic polypeptide
TEQCIRTTNPVATEPYGKTVSTGNIQTPGGNTFI

SEQ ID NO: 143303 - protein, 33 aa, Artificial Sequence
  Description of Artificial Sequence: Synthetic polypeptide
DEDEIATTNPVATASWGCVSANFEPLDRGEENG

SEQ ID NO: 143304 - protein, 34 aa, Artificial Sequence
  Description of Artificial Sequence: Synthetic polypeptide
TEQCIRTTNPVATEQYGKTVSTGGAIQPGGNTFI

SEQ ID NO: 143305 - protein, 36 aa, Artificial Sequence
  Description of Artificial Sequence: Synthetic polypeptide
DEEEIRTTNPVATEQYGSVGQPWNNLQTTETEVLDQ

SEQ ID NO: 143306 - protein, 37 aa, Artificial Sequence
  Description of Artificial Sequence: Synthetic polypeptide
DEEEIRTTNPVATEQYGSVGQSLVLTSEPLGFYPNED

SEQ ID NO: 143307 - protein, 37 aa, Artificial Sequence
  Description of Artificial Sequence: Synthetic polypeptide
AEEEIRTTNPVATEQYGSVSVTVNQNGNTEQGTNQEE

SEQ ID NO: 143308 - protein, 36 aa, Artificial Sequence
  Description of Artificial Sequence: Synthetic polypeptide
DECEICTTNPVATEQYGVVSTVVNDQQGNNEEEEED

SEQ ID NO: 143309 - protein, 35 aa, Artificial Sequence
  Description of Artificial Sequence: Synthetic polypeptide
DESEIRTTNPCATECYGVVCYKTNDEGQRPQDNDR

SEQ ID NO: 143310 - protein, 31 aa, Artificial Sequence
  Description of Artificial Sequence: Synthetic polypeptide
TESEIASTNPVGTEGYGVVIASTELQHGGDI

SEQ ID NO: 143311 - protein, 30 aa, Artificial Sequence
  Description of Artificial Sequence: Synthetic polypeptide
QEEEIATTNPVATEPYGEAPEVCQQHNEEK

SEQ ID NO: 143312 - protein, 30 aa, Artificial Sequence
  Description of Artificial Sequence: Synthetic polypeptide
TESEIASTNPVGTEPYGVMASTLQHGGDNI

SEQ ID NO: 143313 - protein, 29 aa, Artificial Sequence
  Description of Artificial Sequence: Synthetic peptide
QEEEIATTNPVATEPYGEAPEVDSQHEEK

SEQ ID NO: 143314 - protein, 33 aa, Artificial Sequence
  Description of Artificial Sequence: Synthetic polypeptide
DESEIRTTNPEATDQYGQVCCCDQDQKREGNDK

SEQ ID NO: 143315 - protein, 33 aa, Artificial Sequence
  Description of Artificial Sequence: Synthetic polypeptide
TESEIRTTNPVATECWGSVGCINEPQAREGEMG

SEQ ID NO: 143316 - protein, 35 aa, Artificial Sequence
  Description of Artificial Sequence: Synthetic polypeptide
DEEEIRTTNPVATEQYGCVCSNSEHDQENFGSDQS

SEQ ID NO: 143317 - protein, 37 aa, Artificial Sequence
  Description of Artificial Sequence: Synthetic polypeptide
AEEEIRTTNPVATEQYGSVVTVSNNQLGNEQGTNDEE

SEQ ID NO: 143318 - protein, 34 aa, Artificial Sequence
  Description of Artificial Sequence: Synthetic polypeptide
DEEEIATTNPVATEPYGVVCAGNNGDADRGGNEQ

SEQ ID NO: 143319 - protein, 35 aa, Artificial Sequence
  Description of Artificial Sequence: Synthetic polypeptide
DEEEIRTTNPVATEQYGCVCSNSEEHQEGFISDQF

SEQ ID NO: 143320 - protein, 36 aa, Artificial Sequence
  Description of Artificial Sequence: Synthetic polypeptide
DEEEIRTTNPVATEQYGCVCSNSEEHQEFFGSNTQD

SEQ ID NO: 143321 - protein, 37 aa, Artificial Sequence
  Description of Artificial Sequence: Synthetic polypeptide
AEEEIRTTNPVATEQYGSVVTVNTTNLQSGTVDEETD

SEQ ID NO: 143322 - protein, 29 aa, Artificial Sequence
  Description of Artificial Sequence: Synthetic peptide
QEEEIATTNPVATEPYGTIPEDCQQQEEH

SEQ ID NO: 143323 - protein, 37 aa, Artificial Sequence
  Description of Artificial Sequence: Synthetic polypeptide
DEEEIRTTNPVATEQYGSVHSENNSLEQVQPLVPELQ

SEQ ID NO: 143324 - protein, 34 aa, Artificial Sequence
  Description of Artificial Sequence: Synthetic polypeptide
QEEEIRATNPVATEQYGSVSDDIGDGQNEGEQET

SEQ ID NO: 143325 - protein, 32 aa, Artificial Sequence
  Description of Artificial Sequence: Synthetic polypeptide
AEEEIATTNPCAYEQWGSVCYNIEEKRDGNDS

SEQ ID NO: 143326 - protein, 30 aa, Artificial Sequence
  Description of Artificial Sequence: Synthetic polypeptide
QEEEIATTNPVATEPYGTISEEVCQQQEEH

SEQ ID NO: 143327 - protein, 35 aa, Artificial Sequence
  Description of Artificial Sequence: Synthetic polypeptide
DEEEIRTTNPVATEQYGCVCSNSEDDQENFNSNQS

SEQ ID NO: 143328 - protein, 35 aa, Artificial Sequence
  Description of Artificial Sequence: Synthetic polypeptide
DEEEIRTTNPVATEQYGCVCSMWGEPQENFGSEQA

SEQ ID NO: 143329 - protein, 36 aa, Artificial Sequence
  Description of Artificial Sequence: Synthetic polypeptide
DEEEIRTTNPVATEQYGSVMGNMDTTGQGEGGTGTT

SEQ ID NO: 143330 - protein, 30 aa, Artificial Sequence
  Description of Artificial Sequence: Synthetic polypeptide
QEEEIATTNPVATEQYGEAPEVCQEHEEIK

SEQ ID NO: 143331 - protein, 37 aa, Artificial Sequence
  Description of Artificial Sequence: Synthetic polypeptide
QEEEIRATNPVATEQYGSVSVDDTMDNIGQTGGNQGD

SEQ ID NO: 143332 - protein, 35 aa, Artificial Sequence
  Description of Artificial Sequence: Synthetic polypeptide
DEEEIRTTNPVATEQYGCVCSNSEHNQENFNSEQF

SEQ ID NO: 143333 - protein, 29 aa, Artificial Sequence
  Description of Artificial Sequence: Synthetic peptide
QEEEIATTNPVATEPYGEAPEVESQHEEK

SEQ ID NO: 143334 - protein, 33 aa, Artificial Sequence
  Description of Artificial Sequence: Synthetic polypeptide
DESEIRTTNPCSTECWGIVSCINEPQDREGENG

SEQ ID NO: 143335 - protein, 30 aa, Artificial Sequence
  Description of Artificial Sequence: Synthetic polypeptide
QEEEIATTNPVATEPYGEAPMVCQQHNEEK

SEQ ID NO: 143336 - protein, 35 aa, Artificial Sequence
  Description of Artificial Sequence: Synthetic polypeptide
DEEEIRTTNPVATEQYGCVCSNSEHNQNFNSDTQA

SEQ ID NO: 143337 - protein, 32 aa, Artificial Sequence
  Description of Artificial Sequence: Synthetic polypeptide
QEEEIRCTNPAATEQYGCVVSIGGMGGQNGGT

SEQ ID NO: 143338 - protein, 33 aa, Artificial Sequence
  Description of Artificial Sequence: Synthetic polypeptide
DESEIRTTNPDATECWGSVSCINEPQDREVEGG

SEQ ID NO: 143339 - protein, 33 aa, Artificial Sequence
  Description of Artificial Sequence: Synthetic polypeptide
AEEEIATTNPVATEEYGCISCINLSTTPGGMNV

SEQ ID NO: 143340 - protein, 33 aa, Artificial Sequence
  Description of Artificial Sequence: Synthetic polypeptide
AEEEIATTNPVATEEYGCISCINLSTIPVGNNV

SEQ ID NO: 143341 - protein, 29 aa, Artificial Sequence
  Description of Artificial Sequence: Synthetic peptide
QEEEIATTNPVATEPYGEIPEEVCQQEEK

SEQ ID NO: 143342 - protein, 30 aa, Artificial Sequence
  Description of Artificial Sequence: Synthetic polypeptide
QEEEIATTNPVATEPYGEISEEVCQQQEEH

SEQ ID NO: 143343 - protein, 35 aa, Artificial Sequence
  Description of Artificial Sequence: Synthetic polypeptide
TESEIATTNPVAYEQWGSVNKTDNLTQDRSGNQHE

SEQ ID NO: 143344 - protein, 34 aa, Artificial Sequence
  Description of Artificial Sequence: Synthetic polypeptide
AEEEIATTNPVATEEYGCISCCNELETRPGGNNV

SEQ ID NO: 143345 - protein, 35 aa, Artificial Sequence
  Description of Artificial Sequence: Synthetic polypeptide
DEEEIRTTNPVATEQYGCVCSNSEHNQNFGSETQS

SEQ ID NO: 143346 - protein, 30 aa, Artificial Sequence
  Description of Artificial Sequence: Synthetic polypeptide
QEEEIATTNPVATEPYGEISEEVCQQQEEK

SEQ ID NO: 143347 - protein, 33 aa, Artificial Sequence
  Description of Artificial Sequence: Synthetic polypeptide
TESEICTTNPVGTAAWGSVVNCTNMLSQSGNRW

SEQ ID NO: 143348 - protein, 36 aa, Artificial Sequence
  Description of Artificial Sequence: Synthetic polypeptide
QEEEIRATNPVATEQYGSVVVDDTMDNDGQTGGNGD

SEQ ID NO: 143349 - protein, 34 aa, Artificial Sequence
  Description of Artificial Sequence: Synthetic polypeptide
VEDEIATTNPVATEQYGSVCAANNLQDSDGQGMH

SEQ ID NO: 143350 - protein, 38 aa, Artificial Sequence
  Description of Artificial Sequence: Synthetic polypeptide
AEEEIRTTNPVATEQYGSVTVTVTTNQLQNEIGTTNPE

SEQ ID NO: 143351 - protein, 30 aa, Artificial Sequence
  Description of Artificial Sequence: Synthetic polypeptide
VEDEIATTNPVATESYGCIAGTTDQMADNS

SEQ ID NO: 143352 - protein, 30 aa, Artificial Sequence
  Description of Artificial Sequence: Synthetic polypeptide
DECEIRTTNPVATEQWGDVYEIEMNAAEDA

SEQ ID NO: 143353 - protein, 30 aa, Artificial Sequence
  Description of Artificial Sequence: Synthetic polypeptide
QEEEIATTNPVSTEQYGEAPMEVIQQHENK

SEQ ID NO: 143354 - protein, 36 aa, Artificial Sequence
  Description of Artificial Sequence: Synthetic polypeptide
WEEEIATTNPVATEQYGSVANANGLPQEAPGENAHN

SEQ ID NO: 143355 - protein, 30 aa, Artificial Sequence
  Description of Artificial Sequence: Synthetic polypeptide
QEEEIATTNPVATEQYGEAPECVRCQHEEK

SEQ ID NO: 143356 - protein, 37 aa, Artificial Sequence
  Description of Artificial Sequence: Synthetic polypeptide
DEEEIRTTNPVATEAYGVVSTTNQQAGNTEQGSTTTQ

SEQ ID NO: 143357 - protein, 34 aa, Artificial Sequence
  Description of Artificial Sequence: Synthetic polypeptide
DECEIRTTNPVATEQWGKVSEHEESMNAAEGDNA

SEQ ID NO: 143358 - protein, 35 aa, Artificial Sequence
  Description of Artificial Sequence: Synthetic polypeptide
DEEEIATTNPVATEQYGSACAGNNGLDTRMHDNDI

SEQ ID NO: 143359 - protein, 37 aa, Artificial Sequence
  Description of Artificial Sequence: Synthetic polypeptide
DEEEIRTTNPVATEAYGVVSTTNQQAGNTEQGTTTNM

SEQ ID NO: 143360 - protein, 34 aa, Artificial Sequence
  Description of Artificial Sequence: Synthetic polypeptide
DESEIRTTNPVATECWGATVAAINEQDRKGENYG

SEQ ID NO: 143361 - protein, 37 aa, Artificial Sequence
  Description of Artificial Sequence: Synthetic polypeptide
VEEEIRTTNPVATEQYGSVNMDTNGQDQEMEGQNEGQ

SEQ ID NO: 143362 - protein, 37 aa, Artificial Sequence
  Description of Artificial Sequence: Synthetic polypeptide
VEEEIRTTNPVATEQYGSVNMETNGLGEDITNGGGNT

SEQ ID NO: 143363 - protein, 34 aa, Artificial Sequence
  Description of Artificial Sequence: Synthetic polypeptide
DESEIRTTNPVATECWGATVAAINEQEREGENYG

SEQ ID NO: 143364 - protein, 37 aa, Artificial Sequence
  Description of Artificial Sequence: Synthetic polypeptide
DEEEIRTTNPVATEQYGCSCSTGEPLNQEYFNSNNQS

SEQ ID NO: 143365 - protein, 34 aa, Artificial Sequence
  Description of Artificial Sequence: Synthetic polypeptide
DESEIRTTNPVATECWGATVAAINEQERKGENYG

SEQ ID NO: 143366 - protein, 32 aa, Artificial Sequence
  Description of Artificial Sequence: Synthetic polypeptide
DESEIRTTNPVATECWGATSAINEADREGPYG

SEQ ID NO: 143367 - protein, 35 aa, Artificial Sequence
  Description of Artificial Sequence: Synthetic polypeptide
DECTICTTNPVATEQWGSVSTTNQQNQQNGNNTDE

SEQ ID NO: 143368 - protein, 28 aa, Artificial Sequence
  Description of Artificial Sequence: Synthetic peptide
QEEEIATTNPVAYEQYGEAPEVCLHEEK

SEQ ID NO: 143369 - protein, 37 aa, Artificial Sequence
  Description of Artificial Sequence: Synthetic polypeptide
VEEEIRTTNPVATEQYGSVMSGMFNDDGQEEGFINDI

SEQ ID NO: 143370 - protein, 37 aa, Artificial Sequence
  Description of Artificial Sequence: Synthetic polypeptide
DEEEIRTTNPVATEQYGSVLSAVINDIIVQTISVENE

SEQ ID NO: 143371 - protein, 37 aa, Artificial Sequence
  Description of Artificial Sequence: Synthetic polypeptide
VEEEIRTTNPVATEQYGSVISTTPDGPNMGNGENDGI

SEQ ID NO: 143372 - protein, 28 aa, Artificial Sequence
  Description of Artificial Sequence: Synthetic peptide
QEEEIATTNPVAYEQYGEAPEVASHEEK

SEQ ID NO: 143373 - protein, 36 aa, Artificial Sequence
  Description of Artificial Sequence: Synthetic polypeptide
VEEEIRTTNPVATEQYGSVITGDGDDEENGGNGNEQ

SEQ ID NO: 143374 - protein, 37 aa, Artificial Sequence
  Description of Artificial Sequence: Synthetic polypeptide
VEEEIRTTNPVATEQYGSVITGTDNTLNGGEGFNGNG

SEQ ID NO: 143375 - protein, 36 aa, Artificial Sequence
  Description of Artificial Sequence: Synthetic polypeptide
WEEEIRTTNPVATEQFGSVSSTTPAGPNMRNGMNPV

SEQ ID NO: 143376 - protein, 37 aa, Artificial Sequence
  Description of Artificial Sequence: Synthetic polypeptide
DECTICTTNPVATEQYGSVSVVVTTNLQAGIGTNTDT

SEQ ID NO: 143377 - protein, 36 aa, Artificial Sequence
  Description of Artificial Sequence: Synthetic polypeptide
DECTICTTNPVATEQWGSVSTVNQQLNLNQIGNNTD

SEQ ID NO: 143378 - protein, 36 aa, Artificial Sequence
  Description of Artificial Sequence: Synthetic polypeptide
DECTICTTNPVATEQWGSVSTVNQQLLNQIGNNTDT

SEQ ID NO: 143379 - protein, 37 aa, Artificial Sequence
  Description of Artificial Sequence: Synthetic polypeptide
DEEEIRTTNPVATEQYGCSCSTWGEHNQENFGSDNQS

SEQ ID NO: 143380 - protein, 34 aa, Artificial Sequence
  Description of Artificial Sequence: Synthetic polypeptide
VEEEIRTTNPVATEQYGSVMEWPWEQPTNVVVTA

SEQ ID NO: 143381 - protein, 35 aa, Artificial Sequence
  Description of Artificial Sequence: Synthetic polypeptide
VEEEIRTTNPVATEQYGSVMGDGNEQDNGGGEGDD

SEQ ID NO: 143382 - protein, 35 aa, Artificial Sequence
  Description of Artificial Sequence: Synthetic polypeptide
DEEEIRTTNPVATEQYGAVVGSGDDLEDGEGQEDI

SEQ ID NO: 143383 - protein, 31 aa, Artificial Sequence
  Description of Artificial Sequence: Synthetic polypeptide
DECEIRTTNPVATEQWGDVTSEIEMNAAEDA

SEQ ID NO: 143384 - protein, 36 aa, Artificial Sequence
  Description of Artificial Sequence: Synthetic polypeptide
VEEEIRTTNPVATEQYGSVMSGMDNDTDQEEGEGII

SEQ ID NO: 143385 - protein, 36 aa, Artificial Sequence
  Description of Artificial Sequence: Synthetic polypeptide
DEEEIRTTNPVATEQYGCSCSTGEPHQEYFNSDNQS

SEQ ID NO: 143386 - protein, 34 aa, Artificial Sequence
  Description of Artificial Sequence: Synthetic polypeptide
DESEIRTTNPVATECWGATVAAINWQERKGENYG

SEQ ID NO: 143387 - protein, 35 aa, Artificial Sequence
  Description of Artificial Sequence: Synthetic polypeptide
DEEEIRTTNPVATEQYGAVVNGFGNGQITNQTTGL

SEQ ID NO: 143388 - protein, 35 aa, Artificial Sequence
  Description of Artificial Sequence: Synthetic polypeptide
DECTICTTNPVATEQWGSVSTTNQNNTQQGNNTTQ

SEQ ID NO: 143389 - protein, 35 aa, Artificial Sequence
  Description of Artificial Sequence: Synthetic polypeptide
DESEIRTTNPVATECWGQSVGCINEPQAREGENGG

SEQ ID NO: 143390 - protein, 35 aa, Artificial Sequence
  Description of Artificial Sequence: Synthetic polypeptide
DEEEIRTTNPVATEQYGCSCSNWPEDLQYFDSDQS

SEQ ID NO: 143391 - protein, 35 aa, Artificial Sequence
  Description of Artificial Sequence: Synthetic polypeptide
DECEIRTTNPVATEQYGSVITVEDLLTFESPQNEQ

SEQ ID NO: 143392 - protein, 34 aa, Artificial Sequence
  Description of Artificial Sequence: Synthetic polypeptide
DESEIRTTNPVATECWGAVVGCINEPQAREGENG

SEQ ID NO: 143393 - protein, 37 aa, Artificial Sequence
  Description of Artificial Sequence: Synthetic polypeptide
VEEEIRTTNPVATEQYGSVQCMTNLLGIGVIGNVPNN

SEQ ID NO: 143394 - protein, 33 aa, Artificial Sequence
  Description of Artificial Sequence: Synthetic polypeptide
DESEIRTTNPVATECWGPVSCINEPQDREFEGG

SEQ ID NO: 143395 - protein, 36 aa, Artificial Sequence
  Description of Artificial Sequence: Synthetic polypeptide
VEEEIRTTNPVATEQYGSVQSSSNSGGQLTQLVLLG

SEQ ID NO: 143396 - protein, 36 aa, Artificial Sequence
  Description of Artificial Sequence: Synthetic polypeptide
VEEEIRTTNPVATEQYGSVQTGDQGDEENGGGGNEQ

SEQ ID NO: 143397 - protein, 35 aa, Artificial Sequence
  Description of Artificial Sequence: Synthetic polypeptide
DEEEIRTTNPVATEQYGAVVNGFGNGQTTQTTGVD

SEQ ID NO: 143398 - protein, 34 aa, Artificial Sequence
  Description of Artificial Sequence: Synthetic polypeptide
DECTICTTNPVATEQWGSVSTTNQGNQQSNNNTD

SEQ ID NO: 143399 - protein, 34 aa, Artificial Sequence
  Description of Artificial Sequence: Synthetic polypeptide
DESEIRTTNPVATECWGNVSKCINEPADREGENG

SEQ ID NO: 143400 - protein, 35 aa, Artificial Sequence
  Description of Artificial Sequence: Synthetic polypeptide
VEEEIRTTNPVATEQYGSVQWITMGEEQPEGEVEI

SEQ ID NO: 143401 - protein, 34 aa, Artificial Sequence
  Description of Artificial Sequence: Synthetic polypeptide
DESEIRTTNPVATECWGAVWACINEPQDRKGNYG

SEQ ID NO: 143402 - protein, 35 aa, Artificial Sequence
  Description of Artificial Sequence: Synthetic polypeptide
DEEEIATTNPVATEQWGCVAMTNLTNPDDQMGDLH

SEQ ID NO: 143403 - protein, 36 aa, Artificial Sequence
  Description of Artificial Sequence: Synthetic polypeptide
VEEEIRTTNPVATEQYGSVSDGVNTGLGGNGGGQGD

SEQ ID NO: 143404 - protein, 35 aa, Artificial Sequence
  Description of Artificial Sequence: Synthetic polypeptide
VEEEIRTTNPVATEQYGSVPPPLSLEQTMGLLEQV

SEQ ID NO: 143405 - protein, 34 aa, Artificial Sequence
  Description of Artificial Sequence: Synthetic polypeptide
DESEIRTTNPVATECWGSDVMCIQELQDGEGENG

SEQ ID NO: 143406 - protein, 35 aa, Artificial Sequence
  Description of Artificial Sequence: Synthetic polypeptide
DECTICTTNPVATEQWGSVSTTNQNNNQQGNNTDT

SEQ ID NO: 143407 - protein, 34 aa, Artificial Sequence
  Description of Artificial Sequence: Synthetic polypeptide
DEEEIATTNPVATEQWGCVAMTNSENDDGMGDRH

SEQ ID NO: 143408 - protein, 37 aa, Artificial Sequence
  Description of Artificial Sequence: Synthetic polypeptide
DEEEIRTTNPVATEQYGSVLSVTPVQQQIRTIPQEDD

SEQ ID NO: 143409 - protein, 35 aa, Artificial Sequence
  Description of Artificial Sequence: Synthetic polypeptide
VEEEIRTTNPVATEQYGSVNMTGPGGDEGGQTANI

SEQ ID NO: 143410 - protein, 35 aa, Artificial Sequence
  Description of Artificial Sequence: Synthetic polypeptide
DECTICTTNPVATEQWGSVSTTNQNNTQQGNNTDQ

SEQ ID NO: 143411 - protein, 35 aa, Artificial Sequence
  Description of Artificial Sequence: Synthetic polypeptide
DEEEIRTTNPVATEQYGAVVNGFGNGQQTQTTGAG

SEQ ID NO: 143412 - protein, 34 aa, Artificial Sequence
  Description of Artificial Sequence: Synthetic polypeptide
WEEEIATTNPVATEQYGCVATNNLENGMAGEEDA

SEQ ID NO: 143413 - protein, 36 aa, Artificial Sequence
  Description of Artificial Sequence: Synthetic polypeptide
VEEEIRTTNPVATEQYGSVNQTDNNDEQEEGGFGEN

SEQ ID NO: 143414 - protein, 35 aa, Artificial Sequence
  Description of Artificial Sequence: Synthetic polypeptide
DECTICTTNPVATEQWGSVSTTNQNNTQQGNNNDD

SEQ ID NO: 143415 - protein, 35 aa, Artificial Sequence
  Description of Artificial Sequence: Synthetic polypeptide
DEEEIRTTNPVATEQYGCSCSSPEMLQEYFDSDQS

SEQ ID NO: 143416 - protein, 34 aa, Artificial Sequence
  Description of Artificial Sequence: Synthetic polypeptide
DESEIRTTNPVATECWGRSRSCICEPQDREGENG

SEQ ID NO: 143417 - protein, 33 aa, Artificial Sequence
  Description of Artificial Sequence: Synthetic polypeptide
DESEIRTTNPVATECWGAVACINWPQDREGEPG

SEQ ID NO: 143418 - protein, 34 aa, Artificial Sequence
  Description of Artificial Sequence: Synthetic polypeptide
DEEEIRTTNPVATEQYGAVVNGFGNGQTDELTGF

SEQ ID NO: 143419 - protein, 35 aa, Artificial Sequence
  Description of Artificial Sequence: Synthetic polypeptide
WEEEIATTNPVATEQYGCVAANNGLPQTAPGGEER

SEQ ID NO: 143420 - protein, 35 aa, Artificial Sequence
  Description of Artificial Sequence: Synthetic polypeptide
DECEIRTTNPVATEQYGSVISYHYSEQLMTQEMEG

SEQ ID NO: 143421 - protein, 35 aa, Artificial Sequence
  Description of Artificial Sequence: Synthetic polypeptide
VEEEIRTTNPVATEQYGSVNTMDTNEETGGGEETN

SEQ ID NO: 143422 - protein, 35 aa, Artificial Sequence
  Description of Artificial Sequence: Synthetic polypeptide
DEEEIRTTNPVATEQYGAVVNGFGNGQTDQEGGFN

SEQ ID NO: 143423 - protein, 36 aa, Artificial Sequence
  Description of Artificial Sequence: Synthetic polypeptide
VEEEIRTTNPVATEQYGSVNVDGGENNLQGEGQGGE

SEQ ID NO: 143424 - protein, 30 aa, Artificial Sequence
  Description of Artificial Sequence: Synthetic polypeptide
QEEEIATTNPVATEQYGEAPEEVIQHNEEK

SEQ ID NO: 143425 - protein, 35 aa, Artificial Sequence
  Description of Artificial Sequence: Synthetic polypeptide
DEEEIRTTNPVATEQYGCSCSWGEDHNQHFDSNQS

SEQ ID NO: 143426 - protein, 36 aa, Artificial Sequence
  Description of Artificial Sequence: Synthetic polypeptide
DEEEIATTNPVATEQYGSACAVNPAEGTNHQDGMMA

SEQ ID NO: 143427 - protein, 35 aa, Artificial Sequence
  Description of Artificial Sequence: Synthetic polypeptide
DEEEIATTNPVATEQYGSACPGNNDIPQDNDGNNN

SEQ ID NO: 143428 - protein, 37 aa, Artificial Sequence
  Description of Artificial Sequence: Synthetic polypeptide
DEEEIRTTNPVATEAYGVVSTTNNQQQGNNQSDEEDN

SEQ ID NO: 143429 - protein, 37 aa, Artificial Sequence
  Description of Artificial Sequence: Synthetic polypeptide
DEEEIRTTNPVATEAYGVVSTTNNQQQLNQQGTTTTD

SEQ ID NO: 143430 - protein, 35 aa, Artificial Sequence
  Description of Artificial Sequence: Synthetic polypeptide
DECTICTTNPVATEQYGVVSTTNNNPQQTGTNDED

SEQ ID NO: 143431 - protein, 30 aa, Artificial Sequence
  Description of Artificial Sequence: Synthetic polypeptide
QEEEIATTNPVATEQYGEAPCEVEEQHEEK

SEQ ID NO: 143432 - protein, 30 aa, Artificial Sequence
  Description of Artificial Sequence: Synthetic polypeptide
QEEEIATTNPVATEQYGEAPCEVQSQHVEK

SEQ ID NO: 143433 - protein, 35 aa, Artificial Sequence
  Description of Artificial Sequence: Synthetic polypeptide
DECTICTTNPVATEQYGVVSTTNNPNQTNGTNDED

SEQ ID NO: 143434 - protein, 37 aa, Artificial Sequence
  Description of Artificial Sequence: Synthetic polypeptide
VEEEIRTTNPVATEQYGSVDSGFNNGEQQDEGGNITV

SEQ ID NO: 143435 - protein, 36 aa, Artificial Sequence
  Description of Artificial Sequence: Synthetic polypeptide
DEEEIRTTNPVATEQYGSVLTPSTAVEPLMLLVEVA

SEQ ID NO: 143436 - protein, 35 aa, Artificial Sequence
  Description of Artificial Sequence: Synthetic polypeptide
VEEEIRTTNPVATEQYGSVDSPMAVEPNVVLIPGQ

SEQ ID NO: 143437 - protein, 30 aa, Artificial Sequence
  Description of Artificial Sequence: Synthetic polypeptide
QEEEIATTNPVATEQYGEAPCIVCQHEEEK

SEQ ID NO: 143438 - protein, 35 aa, Artificial Sequence
  Description of Artificial Sequence: Synthetic polypeptide
DESEIRTTNPVATECWGSGVSCCIMEPQDREGENG

SEQ ID NO: 143439 - protein, 36 aa, Artificial Sequence
  Description of Artificial Sequence: Synthetic polypeptide
VEEEIRTTNPVATEQYGSVESVSMAQDETEHEANER

SEQ ID NO: 143440 - protein, 35 aa, Artificial Sequence
  Description of Artificial Sequence: Synthetic polypeptide
DEEEIATTNPVATEQYGSACPAGNNDIPQDNGGNN

SEQ ID NO: 143441 - protein, 31 aa, Artificial Sequence
  Description of Artificial Sequence: Synthetic polypeptide
QEEEIATTNPVATEQYGEAPCEVVSQHEENK

SEQ ID NO: 143442 - protein, 35 aa, Artificial Sequence
  Description of Artificial Sequence: Synthetic polypeptide
DEEEIATTNPVATEQYGSACPGNNDIPQDNGENHN

SEQ ID NO: 143443 - protein, 37 aa, Artificial Sequence
  Description of Artificial Sequence: Synthetic polypeptide
DEEEIRTTNPVATEAYGVVSTTNNQQQGNNQEDEGDG

SEQ ID NO: 143444 - protein, 35 aa, Artificial Sequence
  Description of Artificial Sequence: Synthetic polypeptide
VEEEIRTTNPVATEQYGSVDNNGQEDNQEGGGITT

SEQ ID NO: 143445 - protein, 35 aa, Artificial Sequence
  Description of Artificial Sequence: Synthetic polypeptide
VEEEIRTTNPVATEQYGSVAENSPTTEVPTTPNDG

SEQ ID NO: 143446 - protein, 36 aa, Artificial Sequence
  Description of Artificial Sequence: Synthetic polypeptide
VEEEIRTTNPVATEQYGSVANDDNDGEGQTGGNQEI

SEQ ID NO: 143447 - protein, 35 aa, Artificial Sequence
  Description of Artificial Sequence: Synthetic polypeptide
DECTICTTNPVATEQYGVVSTTTNNPQQGNGNVDT

SEQ ID NO: 143448 - protein, 37 aa, Artificial Sequence
  Description of Artificial Sequence: Synthetic polypeptide
WEEEIRTTNPVATEQYGSVSSTTPAGPNMRNGMNPVS

SEQ ID NO: 143449 - protein, 33 aa, Artificial Sequence
  Description of Artificial Sequence: Synthetic polypeptide
AEEEIAATNPVAYERYGISVVATMNMLTGGGNT

SEQ ID NO: 143450 - protein, 30 aa, Artificial Sequence
  Description of Artificial Sequence: Synthetic polypeptide
QEEEIATTNPVATEQYGEAPCEHCSQHEEK

SEQ ID NO: 143451 - protein, 35 aa, Artificial Sequence
  Description of Artificial Sequence: Synthetic polypeptide
DEEEIATTNPVATEQYGSACSAANPLAEAEANANF

SEQ ID NO: 143452 - protein, 29 aa, Artificial Sequence
  Description of Artificial Sequence: Synthetic peptide
QEEEIATVNPVATEQYGEAAPLVCQHEEK

SEQ ID NO: 143453 - protein, 35 aa, Artificial Sequence
  Description of Artificial Sequence: Synthetic polypeptide
VEEEIRTTNPVATEQYGSVDDDDNNMTGTGGNGET

SEQ ID NO: 143454 - protein, 36 aa, Artificial Sequence
  Description of Artificial Sequence: Synthetic polypeptide
VEEEIRTTNPVATEQYGSVDDQDNNIGQETGEGGNI

SEQ ID NO: 143455 - protein, 30 aa, Artificial Sequence
  Description of Artificial Sequence: Synthetic polypeptide
QEEEIATTNPVATEQYGEAPCEVCQHESEK

SEQ ID NO: 143456 - protein, 35 aa, Artificial Sequence
  Description of Artificial Sequence: Synthetic polypeptide
DEEEIATTNPVATEQYGSACPTNDQQEHQDGTADK

SEQ ID NO: 143457 - protein, 37 aa, Artificial Sequence
  Description of Artificial Sequence: Synthetic polypeptide
DEEEIRTTNPVATEAYGVVSTTNNQQQGNNQEDEETD

SEQ ID NO: 143458 - protein, 35 aa, Artificial Sequence
  Description of Artificial Sequence: Synthetic polypeptide
VEEEIRTTNPVATEQYGSVDNFNDGQGEEGEGGTI

SEQ ID NO: 143459 - protein, 36 aa, Artificial Sequence
  Description of Artificial Sequence: Synthetic polypeptide
DESEIRTTNPVATECFWGSTVQSWINEPQDREGENG

SEQ ID NO: 143460 - protein, 37 aa, Artificial Sequence
  Description of Artificial Sequence: Synthetic polypeptide
VEEEIRTTNPVATEQYGSVGDFGNLDGQENDDGNEGA

SEQ ID NO: 143461 - protein, 37 aa, Artificial Sequence
  Description of Artificial Sequence: Synthetic polypeptide
DEEEIRTTNPVATEAYGVVSTTNNQQQQGNNQEDEEE

SEQ ID NO: 143462 - protein, 36 aa, Artificial Sequence
  Description of Artificial Sequence: Synthetic polypeptide
VEEEIRTTNPVATEQYGSVGGPSNNVQPLPNVVDQL

SEQ ID NO: 143463 - protein, 32 aa, Artificial Sequence
  Description of Artificial Sequence: Synthetic polypeptide
DEEEIATTNPVATEQWGAVATGAPNHGDLEAM

SEQ ID NO: 143464 - protein, 37 aa, Artificial Sequence
  Description of Artificial Sequence: Synthetic polypeptide
VEEEIRTTNPVATEQYGSVIMTNGDGQNDQEGENDGD

SEQ ID NO: 143465 - protein, 31 aa, Artificial Sequence
  Description of Artificial Sequence: Synthetic polypeptide
DECEIRTTNPVATEQWGDFVSEIEMNAAEDA

SEQ ID NO: 143466 - protein, 35 aa, Artificial Sequence
  Description of Artificial Sequence: Synthetic polypeptide
VEEEIRTTNPVATEQYGSVINDDNDGEGQGGDDEI

SEQ ID NO: 143467 - protein, 37 aa, Artificial Sequence
  Description of Artificial Sequence: Synthetic polypeptide
DEEEIRTTNPVATEQYGSVLTESTAVEPNPIDVENFG

SEQ ID NO: 143468 - protein, 36 aa, Artificial Sequence
  Description of Artificial Sequence: Synthetic polypeptide
VEEEIRTTNPVATEQYGSVINDDNDQGGQTGGNQEI

SEQ ID NO: 143469 - protein, 30 aa, Artificial Sequence
  Description of Artificial Sequence: Synthetic polypeptide
QEEEIATTNPVSTEQYGTAPMEDIQQHENK

SEQ ID NO: 143470 - protein, 36 aa, Artificial Sequence
  Description of Artificial Sequence: Synthetic polypeptide
VEEEIRTTNPVATEQYGSVINDDNNDGEGQGGNQEI

SEQ ID NO: 143471 - protein, 35 aa, Artificial Sequence
  Description of Artificial Sequence: Synthetic polypeptide
DEEEIATTNPVATEQYGSACAVPAEGQNHQDGTMA

SEQ ID NO: 143472 - protein, 36 aa, Artificial Sequence
  Description of Artificial Sequence: Synthetic polypeptide
VEEEIRTTNPVATEQYGSVINQDNNVGQEEGEGGNI

SEQ ID NO: 143473 - protein, 31 aa, Artificial Sequence
  Description of Artificial Sequence: Synthetic polypeptide
DECEIRTTNPVATEQWGDVSCEIEMNAAEDV

SEQ ID NO: 143474 - protein, 36 aa, Artificial Sequence
  Description of Artificial Sequence: Synthetic polypeptide
VEEEIRTTNPVATEQYGSVINTGFQGNGGDGGNITN

SEQ ID NO: 143475 - protein, 31 aa, Artificial Sequence
  Description of Artificial Sequence: Synthetic polypeptide
DECEIRTTNPVATEQWGDVSEIECMNAAEDA

SEQ ID NO: 143476 - protein, 36 aa, Artificial Sequence
  Description of Artificial Sequence: Synthetic polypeptide
DEEEIRTTNPVATEQYGSVLTEMMAVEPNQILVEVR

SEQ ID NO: 143477 - protein, 36 aa, Artificial Sequence
  Description of Artificial Sequence: Synthetic polypeptide
VEEEIRTTNPVATEQYGSVISTDPDGPNMGNGEGDG

SEQ ID NO: 143478 - protein, 36 aa, Artificial Sequence
  Description of Artificial Sequence: Synthetic polypeptide
VEEEIRTTNPVATEQYGSVISTLDVNGEFEAEGQET

SEQ ID NO: 143479 - protein, 36 aa, Artificial Sequence
  Description of Artificial Sequence: Synthetic polypeptide
VEEEIRTTNPVATEQYGSVIDQENNVGQEEDEGGNE

SEQ ID NO: 143480 - protein, 36 aa, Artificial Sequence
  Description of Artificial Sequence: Synthetic polypeptide
DEEEIRTTNPVATEQYGCSCSWGNDHNQENFNSDQA

SEQ ID NO: 143481 - protein, 37 aa, Artificial Sequence
  Description of Artificial Sequence: Synthetic polypeptide
DEEEIRTTNPVATEQYGSVLTESTAVEPNQIDVEVRY

SEQ ID NO: 143482 - protein, 34 aa, Artificial Sequence
  Description of Artificial Sequence: Synthetic polypeptide
VEEEIRTTNPVATEQYGSVIDGSGGQGDDEANET

SEQ ID NO: 143483 - protein, 31 aa, Artificial Sequence
  Description of Artificial Sequence: Synthetic polypeptide
QEEEIATTNPVAYEQYGEAPEHQSQHEGENK

SEQ ID NO: 143484 - protein, 37 aa, Artificial Sequence
  Description of Artificial Sequence: Synthetic polypeptide
DEEEIRTTNPVATEAYGVVSTTNNQTQQGNNEEDEED

SEQ ID NO: 143485 - protein, 37 aa, Artificial Sequence
  Description of Artificial Sequence: Synthetic polypeptide
DEEEIRTTNPVATEAYGVVSTTNNTQQGNNQEDEEDM

SEQ ID NO: 143486 - protein, 31 aa, Artificial Sequence
  Description of Artificial Sequence: Synthetic polypeptide
QEEEIATTNPVSTEQYGTIPMEDIQQQHGNK

SEQ ID NO: 143487 - protein, 28 aa, Artificial Sequence
  Description of Artificial Sequence: Synthetic peptide
QEEEIATTNPVAYEQYGEAPESCCHEEK

SEQ ID NO: 143488 - protein, 33 aa, Artificial Sequence
  Description of Artificial Sequence: Synthetic polypeptide
DEEEIATTNPVATEQWGCNVATNGLEATASEDF

SEQ ID NO: 143489 - protein, 35 aa, Artificial Sequence
  Description of Artificial Sequence: Synthetic polypeptide
DEEEIRTTNPVATEQYGCSLTNWHELDNTQTETIE

SEQ ID NO: 143490 - protein, 36 aa, Artificial Sequence
  Description of Artificial Sequence: Synthetic polypeptide
DECEIRTTNPVATEDYGSVSSTTPAGPNMRNGMNPV

SEQ ID NO: 143491 - protein, 36 aa, Artificial Sequence
  Description of Artificial Sequence: Synthetic polypeptide
DECEIRTTNPVATEKYGSVSSTTPAGPNMRNGMNPV

SEQ ID NO: 143492 - protein, 30 aa, Artificial Sequence
  Description of Artificial Sequence: Synthetic polypeptide
QEEEIATTNPVSTEQYGTAPMEVIQQHENK

SEQ ID NO: 143493 - protein, 36 aa, Artificial Sequence
  Description of Artificial Sequence: Synthetic polypeptide
VEEEIRTTNPVATEQYGSVGSWTPNVQPTQMVIEHD

SEQ ID NO: 143494 - protein, 37 aa, Artificial Sequence
  Description of Artificial Sequence: Synthetic polypeptide
VEEEIRTTNPVATEQYGSVHSTTPAGPKMRNGMNPVY

SEQ ID NO: 143495 - protein, 37 aa, Artificial Sequence
  Description of Artificial Sequence: Synthetic polypeptide
VEEEIRTTNPVATEQYGSVIDGQSNNVGQETGEGGNI

SEQ ID NO: 143496 - protein, 36 aa, Artificial Sequence
  Description of Artificial Sequence: Synthetic polypeptide
DECTICTTNPVATEQYGSVTVVVTNNLQAGIGNNNL

SEQ ID NO: 143497 - protein, 30 aa, Artificial Sequence
  Description of Artificial Sequence: Synthetic polypeptide
QEEEIATTNPVATEQYGEAPEPVCQHSEEK

SEQ ID NO: 143498 - protein, 36 aa, Artificial Sequence
  Description of Artificial Sequence: Synthetic polypeptide
VEEEIRTTNPVATEQYGSVIDQDPNVGQETGEGQNI

SEQ ID NO: 143499 - protein, 37 aa, Artificial Sequence
  Description of Artificial Sequence: Synthetic polypeptide
DEEEIRTTNPVATEAYGVVSTTNNQQQGNNNEDEEDE

SEQ ID NO: 143500 - protein, 35 aa, Artificial Sequence
  Description of Artificial Sequence: Synthetic polypeptide
DESEIRTTNPVATECWGCMVSCINEPQDREGENGV

SEQ ID NO: 143501 - protein, 36 aa, Artificial Sequence
  Description of Artificial Sequence: Synthetic polypeptide
DECTICTTNPVATEQWGSVSTTNQGNNLQQGTNTDD

SEQ ID NO: 143502 - protein, 36 aa, Artificial Sequence
  Description of Artificial Sequence: Synthetic polypeptide
VEEGIRTTNPVATEQYGSVPSVTIPLEVSPVVNIQR

SEQ ID NO: 143503 - protein, 33 aa, Artificial Sequence
  Description of Artificial Sequence: Synthetic polypeptide
DECEIVTTNPVAAEQYGTVCSATDGPVEFEGND

SEQ ID NO: 143504 - protein, 34 aa, Artificial Sequence
  Description of Artificial Sequence: Synthetic polypeptide
VEEGIRTTNPVATEQYGSVPSVTIPGEHSPVVNQ

SEQ ID NO: 143505 - protein, 35 aa, Artificial Sequence
  Description of Artificial Sequence: Synthetic polypeptide
VEEEIRTTNPVATEQYGSVVDGGENNLGTEGQGGE

SEQ ID NO: 143506 - protein, 37 aa, Artificial Sequence
  Description of Artificial Sequence: Synthetic polypeptide
VEEEIRTTNPVATEQYGSVVDGGESNNLQPVEGQGGE

SEQ ID NO: 143507 - protein, 34 aa, Artificial Sequence
  Description of Artificial Sequence: Synthetic polypeptide
DECEIRTTNPVAYEQWGTVCSTWENDQTNGGGEH

SEQ ID NO: 143508 - protein, 35 aa, Artificial Sequence
  Description of Artificial Sequence: Synthetic polypeptide
VEEEIRTTNPVATEQYGSVTNLNAGEGEFGEEVGA

SEQ ID NO: 143509 - protein, 34 aa, Artificial Sequence
  Description of Artificial Sequence: Synthetic polypeptide
DESEIRTTNPVATECWGGQVGCINEPQAREGENG

SEQ ID NO: 143510 - protein, 36 aa, Artificial Sequence
  Description of Artificial Sequence: Synthetic polypeptide
VEEEIRTTNPVATEQYGSVVDQTDIEQIIGNGEGDI

SEQ ID NO: 143511 - protein, 36 aa, Artificial Sequence
  Description of Artificial Sequence: Synthetic polypeptide
VEEEIRTTNPVATEQYGSVVDQYDNVGQSEEEGGNE

SEQ ID NO: 143512 - protein, 37 aa, Artificial Sequence
  Description of Artificial Sequence: Synthetic polypeptide
VEEEIRTTNPVATEQYGSVVDSQTNNEGQSEEEGGQE

SEQ ID NO: 143513 - protein, 30 aa, Artificial Sequence
  Description of Artificial Sequence: Synthetic polypeptide
QEEEIATTNPVATEQYGEAPEKVCQHLEEK

SEQ ID NO: 143514 - protein, 35 aa, Artificial Sequence
  Description of Artificial Sequence: Synthetic polypeptide
VEEEIRTTNPVATEQYGSVVLGIMTGGQTVTGIGT

SEQ ID NO: 143515 - protein, 34 aa, Artificial Sequence
  Description of Artificial Sequence: Synthetic polypeptide
VEEEIRTTNPVATEQYGSVVMTGFNGGGFDEDTD

SEQ ID NO: 143516 - protein, 34 aa, Artificial Sequence
  Description of Artificial Sequence: Synthetic polypeptide
VEEGIRTTNPVATEQYGSVPSVEIPQEVSPVVNQ

SEQ ID NO: 143517 - protein, 37 aa, Artificial Sequence
  Description of Artificial Sequence: Synthetic polypeptide
DEEEIRTTNPVATEQYGSVGYPWNNLEQTTEFENLFQ

SEQ ID NO: 143518 - protein, 35 aa, Artificial Sequence
  Description of Artificial Sequence: Synthetic polypeptide
VEEGIRTTNPVATEQYGSVPSVTIPLLESPVVHNP

SEQ ID NO: 143519 - protein, 35 aa, Artificial Sequence
  Description of Artificial Sequence: Synthetic polypeptide
VEEGIRTTNPVATEQYGSVPSVTIPWLESPTVHNQ

SEQ ID NO: 143520 - protein, 37 aa, Artificial Sequence
  Description of Artificial Sequence: Synthetic polypeptide
DEEEIRTTNPVATEAYGVVSTTVTNNQQGNNQEEEED

SEQ ID NO: 143521 - protein, 32 aa, Artificial Sequence
  Description of Artificial Sequence: Synthetic polypeptide
DECEIYPTNPVATEQYGITASGSNLMYPGEIT

SEQ ID NO: 143522 - protein, 30 aa, Artificial Sequence
  Description of Artificial Sequence: Synthetic polypeptide
QEEEIATTNPVATEQYGEAPEIVCQDHEEK

SEQ ID NO: 143523 - protein, 30 aa, Artificial Sequence
  Description of Artificial Sequence: Synthetic polypeptide
QEEEIATTNPVATEQYGEAPEIVCQHEEEK

SEQ ID NO: 143524 - protein, 35 aa, Artificial Sequence
  Description of Artificial Sequence: Synthetic polypeptide
DEEEIRTTNPVATEQYGCICSNTMEHQNFNSDNQE

SEQ ID NO: 143525 - protein, 29 aa, Artificial Sequence
  Description of Artificial Sequence: Synthetic peptide
VENEIAGTNPCAFEQYGVCSTVITFDGNT

SEQ ID NO: 143526 - protein, 33 aa, Artificial Sequence
  Description of Artificial Sequence: Synthetic polypeptide
DESEIRTTNPVATECWGDVSCINEPMDREGEDG

SEQ ID NO: 143527 - protein, 33 aa, Artificial Sequence
  Description of Artificial Sequence: Synthetic polypeptide
DESEIRTTNPVATECWGDVSCINEPMNREGEDG

SEQ ID NO: 143528 - protein, 35 aa, Artificial Sequence
  Description of Artificial Sequence: Synthetic polypeptide
DEEEIRTTNPVATEQYGCICSNTGEHNQNFGSEQP

SEQ ID NO: 143529 - protein, 37 aa, Artificial Sequence
  Description of Artificial Sequence: Synthetic polypeptide
DEEEIRTTNPVATEQYGSVGVVPFNGLGEEQAGTEVS

SEQ ID NO: 143530 - protein, 28 aa, Artificial Sequence
  Description of Artificial Sequence: Synthetic peptide
VEGEIACTNPVGTEGWGVSASDLQDGDI

SEQ ID NO: 143531 - protein, 29 aa, Artificial Sequence
  Description of Artificial Sequence: Synthetic peptide
QEEEIATTNPVCTEQYGEAPFVCQHCEEK

SEQ ID NO: 143532 - protein, 36 aa, Artificial Sequence
  Description of Artificial Sequence: Synthetic polypeptide
DEEEIRTTNPVATEAYGVVSTVNQQQQNATTNVATE

SEQ ID NO: 143533 - protein, 38 aa, Artificial Sequence
  Description of Artificial Sequence: Synthetic polypeptide
VEEEIRTTNPVATEQYGSVSTVGDNGLTGGGGEDNDEF

SEQ ID NO: 143534 - protein, 37 aa, Artificial Sequence
  Description of Artificial Sequence: Synthetic polypeptide
DEEEIRTTNPVATEAYGVVSTVDQQNNQQQGTNVATE

SEQ ID NO: 143535 - protein, 30 aa, Artificial Sequence
  Description of Artificial Sequence: Synthetic polypeptide
DESEIRTTNPVATECWGDVSEIEMNAAEDA

SEQ ID NO: 143536 - protein, 35 aa, Artificial Sequence
  Description of Artificial Sequence: Synthetic polypeptide
VEEEIRTTNPVATEQYGSVVTGGDGEQNEGGGEIG

SEQ ID NO: 143537 - protein, 33 aa, Artificial Sequence
  Description of Artificial Sequence: Synthetic polypeptide
AEECIATTNPVAYEQWGSVSKTNPEPDGMGKNQ

SEQ ID NO: 143538 - protein, 31 aa, Artificial Sequence
  Description of Artificial Sequence: Synthetic polypeptide
DESEIRTTNPVATECWGDVSEIEQNAAEEDA

SEQ ID NO: 143539 - protein, 36 aa, Artificial Sequence
  Description of Artificial Sequence: Synthetic polypeptide
DEEEIRTTNPVATEQYGCAVCSSGEHQENFGSDNQS

SEQ ID NO: 143540 - protein, 32 aa, Artificial Sequence
  Description of Artificial Sequence: Synthetic polypeptide
DESEIRTTNPVATECWGEASCINCQDHEGEEK

SEQ ID NO: 143541 - protein, 29 aa, Artificial Sequence
  Description of Artificial Sequence: Synthetic peptide
QEEEIATTNPVATEQYGEAPELVCCHEEK

SEQ ID NO: 143542 - protein, 34 aa, Artificial Sequence
  Description of Artificial Sequence: Synthetic polypeptide
VEEEIRTTNPVATEQYGVVVGFGNQEEDGGGNGS

SEQ ID NO: 143543 - protein, 35 aa, Artificial Sequence
  Description of Artificial Sequence: Synthetic polypeptide
VEEEIRTTNPVATEQYGVVVGFTNQEEDTGGGNGV

SEQ ID NO: 143544 - protein, 37 aa, Artificial Sequence
  Description of Artificial Sequence: Synthetic polypeptide
DEEEIRTTNPVATEAYGVVSTVNQNNQQGNNNNATND

SEQ ID NO: 143545 - protein, 33 aa, Artificial Sequence
  Description of Artificial Sequence: Synthetic polypeptide
AEECIRTTNPVAYEQYGCVCSWGEDQYFGSNQA

SEQ ID NO: 143546 - protein, 37 aa, Artificial Sequence
  Description of Artificial Sequence: Synthetic polypeptide
DEEEIRTTNPVATEAYGVVSTVNNQQGNSEQGTTNTE

SEQ ID NO: 143547 - protein, 33 aa, Artificial Sequence
  Description of Artificial Sequence: Synthetic polypeptide
VEEEIRTTNPVAYEQWGSVCSNWEHQEQQMHQR

SEQ ID NO: 143548 - protein, 34 aa, Artificial Sequence
  Description of Artificial Sequence: Synthetic polypeptide
DEEEIATTNPVATEQWGCVAGTGQLQNQMGGEAH

SEQ ID NO: 143549 - protein, 32 aa, Artificial Sequence
  Description of Artificial Sequence: Synthetic polypeptide
DECEIRTTNPVITEPYGTISMEDIQQQQNGNH

SEQ ID NO: 143550 - protein, 38 aa, Artificial Sequence
  Description of Artificial Sequence: Synthetic polypeptide
DEEEIRTTNPVATEAYGVVSTVNNQNLQQGNNNNNATE

SEQ ID NO: 143551 - protein, 36 aa, Artificial Sequence
  Description of Artificial Sequence: Synthetic polypeptide
DEEEIRTTNPVATEAYGVVSTVNNQNQQQNNNDEED

SEQ ID NO: 143552 - protein, 35 aa, Artificial Sequence
  Description of Artificial Sequence: Synthetic polypeptide
DEEEIRTTNPVATEQYGAVYSDGMGDDEEGGDNGV

SEQ ID NO: 143553 - protein, 32 aa, Artificial Sequence
  Description of Artificial Sequence: Synthetic polypeptide
DECEIRTTNPVSTEPYGTISMEDIQQQQNGNH

SEQ ID NO: 143554 - protein, 30 aa, Artificial Sequence
  Description of Artificial Sequence: Synthetic polypeptide
DECEISTTNPVATEQWGDVSEIEMNAAEDA

SEQ ID NO: 143555 - protein, 33 aa, Artificial Sequence
  Description of Artificial Sequence: Synthetic polypeptide
DESEIRTTNPVATECWGDVSCIIEPMDREGENA

SEQ ID NO: 143556 - protein, 34 aa, Artificial Sequence
  Description of Artificial Sequence: Synthetic polypeptide
DECEISTTNPVATEQYGITVYGSNNLMVYPGEIT

SEQ ID NO: 143557 - protein, 29 aa, Artificial Sequence
  Description of Artificial Sequence: Synthetic peptide
QEEEIATTNPVAYEQYGEIPCEVCQHEEK

SEQ ID NO: 143558 - protein, 32 aa, Artificial Sequence
  Description of Artificial Sequence: Synthetic polypeptide
DESEIRTTNPVATECWGDVSEIIEMNAAEENA

SEQ ID NO: 143559 - protein, 31 aa, Artificial Sequence
  Description of Artificial Sequence: Synthetic polypeptide
DESEIRTTNPVATECWGDVSEIIEMNAAENA

SEQ ID NO: 143560 - protein, 37 aa, Artificial Sequence
  Description of Artificial Sequence: Synthetic polypeptide
DEEEIRTTNPVATEQYGSVHENSWTLIQIETLENEDA

SEQ ID NO: 143561 - protein, 37 aa, Artificial Sequence
  Description of Artificial Sequence: Synthetic polypeptide
DEEEIRTTNPVATEAYGVVSTVNQQNNLQATTNVATE

SEQ ID NO: 143562 - protein, 30 aa, Artificial Sequence
  Description of Artificial Sequence: Synthetic polypeptide
QEEEIATTNPVATEQYGEAPELCQHEETKP

SEQ ID NO: 143563 - protein, 29 aa, Artificial Sequence
  Description of Artificial Sequence: Synthetic peptide
QEEEIATTNPVAYEQYGIEAPEVEQHEEK

SEQ ID NO: 143564 - protein, 35 aa, Artificial Sequence
  Description of Artificial Sequence: Synthetic polypeptide
VEEEIRTTNPVATEQYGSVVYDGFGQEGDQEEDNG

SEQ ID NO: 143565 - protein, 31 aa, Artificial Sequence
  Description of Artificial Sequence: Synthetic polypeptide
QEEEIATTNPVAYEQYGEVAPEVQSTHEGEK

SEQ ID NO: 143566 - protein, 38 aa, Artificial Sequence
  Description of Artificial Sequence: Synthetic polypeptide
DEEEIRTTNPVATEAYGVVSTVNLQQGNNTQQGTEQGS

SEQ ID NO: 143567 - protein, 32 aa, Artificial Sequence
  Description of Artificial Sequence: Synthetic polypeptide
DESEIRTTNPVATECWGEAPCVCPQDREGENK

SEQ ID NO: 143568 - protein, 30 aa, Artificial Sequence
  Description of Artificial Sequence: Synthetic polypeptide
QEEEIATTNPVAYEQYGEVAPEVGSQHVEK

SEQ ID NO: 143569 - protein, 31 aa, Artificial Sequence
  Description of Artificial Sequence: Synthetic polypeptide
DESEIRTTNPVATECWGEAPCVCPQDRGEEK

SEQ ID NO: 143570 - protein, 33 aa, Artificial Sequence
  Description of Artificial Sequence: Synthetic polypeptide
DESEIRTTNPVATECWGEASCINCPQDREGEEK

SEQ ID NO: 143571 - protein, 36 aa, Artificial Sequence
  Description of Artificial Sequence: Synthetic polypeptide
DEEEIRTTNPVATEQYGCAVCSTEEHNQNFNSNTQS

SEQ ID NO: 143572 - protein, 37 aa, Artificial Sequence
  Description of Artificial Sequence: Synthetic polypeptide
VEEEIRTTNPVATEQYGVCGSVTTGDNGLGGEQEDIR

SEQ ID NO: 143573 - protein, 38 aa, Artificial Sequence
  Description of Artificial Sequence: Synthetic polypeptide
DEEEIRTTNPVATEAYGVVSTVNQQLQAGTEEGTTNNQ

SEQ ID NO: 143574 - protein, 35 aa, Artificial Sequence
  Description of Artificial Sequence: Synthetic polypeptide
DEEEIATTNPVATEQYGSACAATNNIETEAEGNDF

SEQ ID NO: 143575 - protein, 34 aa, Artificial Sequence
  Description of Artificial Sequence: Synthetic polypeptide
DEEEIATTNPVATEQWGCVAMNNLTNPDDGMGDR

SEQ ID NO: 143576 - protein, 34 aa, Artificial Sequence
  Description of Artificial Sequence: Synthetic polypeptide
DEEEIRTTNPVATEQYGCICSWPPMLQNFDSDQS

SEQ ID NO: 143577 - protein, 30 aa, Artificial Sequence
  Description of Artificial Sequence: Synthetic polypeptide
QEEEIATTNPVATEQYGEAPEGVICQHEEK

SEQ ID NO: 143578 - protein, 35 aa, Artificial Sequence
  Description of Artificial Sequence: Synthetic polypeptide
VEEEIRTTNPVATEQYGSVSLIPWLIVSQPEEQLI

SEQ ID NO: 143579 - protein, 36 aa, Artificial Sequence
  Description of Artificial Sequence: Synthetic polypeptide
VEEEIRTTNPVATEQYGSVSLNPWLTVSQPPEEQLP

SEQ ID NO: 143580 - protein, 28 aa, Artificial Sequence
  Description of Artificial Sequence: Synthetic peptide
QEEEIATTNPVSTEPYGEAPEVCQHEEH

SEQ ID NO: 143581 - protein, 34 aa, Artificial Sequence
  Description of Artificial Sequence: Synthetic polypeptide
DEEEIATTNPVATEQWGCVADTWELAQDNAENNH

SEQ ID NO: 143582 - protein, 35 aa, Artificial Sequence
  Description of Artificial Sequence: Synthetic polypeptide
VEEEIRTTNPVATEQYGSVSLTPWLIVSMPEEQGY

SEQ ID NO: 143583 - protein, 33 aa, Artificial Sequence
  Description of Artificial Sequence: Synthetic polypeptide
DECSIMTTNPVATECYGSYYNENTLERIGNNME

SEQ ID NO: 143584 - protein, 35 aa, Artificial Sequence
  Description of Artificial Sequence: Synthetic polypeptide
DEEEIRTTNPVATEQYGCQVCSTGEHQENFISEQS

SEQ ID NO: 143585 - protein, 36 aa, Artificial Sequence
  Description of Artificial Sequence: Synthetic polypeptide
VEEEIRTTNPVATEQYGSVSLTPWLTVVQPPEEQLD

SEQ ID NO: 143586 - protein, 36 aa, Artificial Sequence
  Description of Artificial Sequence: Synthetic polypeptide
VEEEIRTTNPVATEQYGSVSLTPWSIGVSLPENQIT

SEQ ID NO: 143587 - protein, 35 aa, Artificial Sequence
  Description of Artificial Sequence: Synthetic polypeptide
DEEEIATTNPVATEQYGSACAATMHGEQTADGERH

SEQ ID NO: 143588 - protein, 30 aa, Artificial Sequence
  Description of Artificial Sequence: Synthetic polypeptide
QEEEIATTNPVATEQYGEAPEHVCHQHEEK

SEQ ID NO: 143589 - protein, 29 aa, Artificial Sequence
  Description of Artificial Sequence: Synthetic peptide
VESEIASTNPVGTEGYGVMASYTLQHGDI

SEQ ID NO: 143590 - protein, 28 aa, Artificial Sequence
  Description of Artificial Sequence: Synthetic peptide
VESEIASTNPVGTEGYGVMASTMQHGDI

SEQ ID NO: 143591 - protein, 36 aa, Artificial Sequence
  Description of Artificial Sequence: Synthetic polypeptide
VEEEIRTTNPVATEQYGSVSLTPWLTVSQPPETQLT

SEQ ID NO: 143592 - protein, 28 aa, Artificial Sequence
  Description of Artificial Sequence: Synthetic peptide
QEEEIATTNPVSTEPYGEAPEVCQHEEK

SEQ ID NO: 143593 - protein, 37 aa, Artificial Sequence
  Description of Artificial Sequence: Synthetic polypeptide
DEEEIRTTNPVATEAYGVVSTTNQQQGNNEQGTEQGE

SEQ ID NO: 143594 - protein, 33 aa, Artificial Sequence
  Description of Artificial Sequence: Synthetic polypeptide
DESEIRTTNPVATECWGMVSCINEPNDGIGENG

SEQ ID NO: 143595 - protein, 36 aa, Artificial Sequence
  Description of Artificial Sequence: Synthetic polypeptide
DEEEIRTTNPVATEQYGCSCSNTGNPHNQNFSSDQS

SEQ ID NO: 143596 - protein, 35 aa, Artificial Sequence
  Description of Artificial Sequence: Synthetic polypeptide
DECTICTTNPVATEQWGSVSTTNQGNLEQGTNTDE

SEQ ID NO: 143597 - protein, 36 aa, Artificial Sequence
  Description of Artificial Sequence: Synthetic polypeptide
VEEEIRTTNPVATEQYGSVSDTPGFGQTGGGEGEII

SEQ ID NO: 143598 - protein, 34 aa, Artificial Sequence
  Description of Artificial Sequence: Synthetic polypeptide
DESEIRTTNPVATECWGNVSACINEPQSRVGEQG

SEQ ID NO: 143599 - protein, 35 aa, Artificial Sequence
  Description of Artificial Sequence: Synthetic polypeptide
VEEEIRTTNPVATEQYGSVSELVVGGLNSGPVPPD

SEQ ID NO: 143600 - protein, 34 aa, Artificial Sequence
  Description of Artificial Sequence: Synthetic polypeptide
DESEIRTTNPVATECWGCVCSWMEENQDRSGSNQ

SEQ ID NO: 143601 - protein, 34 aa, Artificial Sequence
  Description of Artificial Sequence: Synthetic polypeptide
DESEIRTTNPVATECWGCVCSWMNDNQDNEGSNQ

SEQ ID NO: 143602 - protein, 34 aa, Artificial Sequence
  Description of Artificial Sequence: Synthetic polypeptide
DESEIRTTNPVATECWGCVCSWMNENQERFGSDQ

SEQ ID NO: 143603 - protein, 33 aa, Artificial Sequence
  Description of Artificial Sequence: Synthetic polypeptide
DESEIRTTNPVATECWGCVGCINEPQAYEGENG

SEQ ID NO: 143604 - protein, 34 aa, Artificial Sequence
  Description of Artificial Sequence: Synthetic polypeptide
DECSIMTTNPVATEIYGSVYNENTLERIGPNNME

SEQ ID NO: 143605 - protein, 37 aa, Artificial Sequence
  Description of Artificial Sequence: Synthetic polypeptide
DEEEIRTTNPVATEAYGVVSTTNQQGNNNQEGNQNDD

SEQ ID NO: 143606 - protein, 37 aa, Artificial Sequence
  Description of Artificial Sequence: Synthetic polypeptide
DEEEIRTTNPVATEAYGVVSTTNQQGNNQEQGNQNED

SEQ ID NO: 143607 - protein, 29 aa, Artificial Sequence
  Description of Artificial Sequence: Synthetic peptide
QEEEIATTNPVAYEQYGEAPEVCQHSEEK

SEQ ID NO: 143608 - protein, 36 aa, Artificial Sequence
  Description of Artificial Sequence: Synthetic polypeptide
VEEEIRTTNPVATEQYGSVSINMQADEFGEDDDDEE

SEQ ID NO: 143609 - protein, 30 aa, Artificial Sequence
  Description of Artificial Sequence: Synthetic polypeptide
QEEEIATTNPVATEQYGEAPEGVCQHEELK

SEQ ID NO: 143610 - protein, 28 aa, Artificial Sequence
  Description of Artificial Sequence: Synthetic peptide
VESEIASTNPVGTEGYGVMASTLYHGDI

SEQ ID NO: 143611 - protein, 37 aa, Artificial Sequence
  Description of Artificial Sequence: Synthetic polypeptide
VEEEIRTTNPVATEQYGSVSNADNMDNQGGGQTNQDG

SEQ ID NO: 143612 - protein, 28 aa, Artificial Sequence
  Description of Artificial Sequence: Synthetic peptide
VESEIASTNPVGTEGYGVMASTLQHQDI

SEQ ID NO: 143613 - protein, 34 aa, Artificial Sequence
  Description of Artificial Sequence: Synthetic polypeptide
DEEEIATTNPVATEQYGSACAATGEANDNGGTVM

SEQ ID NO: 143614 - protein, 38 aa, Artificial Sequence
  Description of Artificial Sequence: Synthetic polypeptide
DEEEIRTTNPVATEAYGVVSTTNQQQLQIGNTETGTTE

SEQ ID NO: 143615 - protein, 37 aa, Artificial Sequence
  Description of Artificial Sequence: Synthetic polypeptide
VEEEIRTTNPVATEQYGSVSSTTPACGPNMRNGMNPV

SEQ ID NO: 143616 - protein, 33 aa, Artificial Sequence
  Description of Artificial Sequence: Synthetic polypeptide
DECEIYTTNPVATEAYGITVSNSNLYYPGEILP

SEQ ID NO: 143617 - protein, 31 aa, Artificial Sequence
  Description of Artificial Sequence: Synthetic polypeptide
VENEIRTTNPVATEQWGDVSGEIEMNQAEDA

SEQ ID NO: 143618 - protein, 36 aa, Artificial Sequence
  Description of Artificial Sequence: Synthetic polypeptide
VEEEIRTTNPVATEQYGSVSSTTPAGPNMRNGMYPV

SEQ ID NO: 143619 - protein, 37 aa, Artificial Sequence
  Description of Artificial Sequence: Synthetic polypeptide
VEEEIRTTNPVATEQYGSVSSTTPDGPNMGNGENDQE

SEQ ID NO: 143620 - protein, 31 aa, Artificial Sequence
  Description of Artificial Sequence: Synthetic polypeptide
VENEIRTTNPVATEQWGDVSEIEMNAAEDYA

SEQ ID NO: 143621 - protein, 37 aa, Artificial Sequence
  Description of Artificial Sequence: Synthetic polypeptide
DEEEIRTTNPVATEAYGVVSTTTNLQQNNNATTEQGQ

SEQ ID NO: 143622 - protein, 32 aa, Artificial Sequence
  Description of Artificial Sequence: Synthetic polypeptide
DESEIRTTNPVATECWGDVSCIIEMNAAEENA

SEQ ID NO: 143623 - protein, 31 aa, Artificial Sequence
  Description of Artificial Sequence: Synthetic polypeptide
VENEIRTTNPVATEQWGDVSEIEMNAAEDLA

SEQ ID NO: 143624 - protein, 30 aa, Artificial Sequence
  Description of Artificial Sequence: Synthetic polypeptide
VENEIRTTNPVATEQWGDVSEIEMNAAEDA

SEQ ID NO: 143625 - protein, 38 aa, Artificial Sequence
  Description of Artificial Sequence: Synthetic polypeptide
DEEEIRTTNPVATEAYGVVSTTVNNNLQAGNEEQEEDE

SEQ ID NO: 143626 - protein, 30 aa, Artificial Sequence
  Description of Artificial Sequence: Synthetic polypeptide
VENEIRTTNPVATEQWGCVSEIEMNAAEDA

SEQ ID NO: 143627 - protein, 32 aa, Artificial Sequence
  Description of Artificial Sequence: Synthetic polypeptide
DESEIRTTNPVATECWGDVSCIIEMNRAEENA

SEQ ID NO: 143628 - protein, 34 aa, Artificial Sequence
  Description of Artificial Sequence: Synthetic polypeptide
DEEEIATTNPVATEQWGCVAMTGLNPDDGMGDRA

SEQ ID NO: 143629 - protein, 33 aa, Artificial Sequence
  Description of Artificial Sequence: Synthetic polypeptide
DECENATTNPVAYEQWGSVSTGIGLNAGEDNNS

SEQ ID NO: 143630 - protein, 33 aa, Artificial Sequence
  Description of Artificial Sequence: Synthetic polypeptide
DECEIYTTNPVATEAYGITVSHSNLMYPGEETP

SEQ ID NO: 143631 - protein, 33 aa, Artificial Sequence
  Description of Artificial Sequence: Synthetic polypeptide
DECENATTNPVAYEQWGVVCSTNLGGDAGNGEY

SEQ ID NO: 143632 - protein, 30 aa, Artificial Sequence
  Description of Artificial Sequence: Synthetic polypeptide
QEEEIATTNPVAYEQYGEAPEVDSQHEENK

SEQ ID NO: 143633 - protein, 37 aa, Artificial Sequence
  Description of Artificial Sequence: Synthetic polypeptide
VEEEIRTTNPVATEQYGSVSNNDNMDGQGGGQTNQDN

SEQ ID NO: 143634 - protein, 37 aa, Artificial Sequence
  Description of Artificial Sequence: Synthetic polypeptide
DEEEIRTTNPVATEQYGSVGTYLMNGEEQMIINAEEL

SEQ ID NO: 143635 - protein, 35 aa, Artificial Sequence
  Description of Artificial Sequence: Synthetic polypeptide
DEEEIRTTNPVATEQYGCQVCSNTGEHINFGSDQE

SEQ ID NO: 143636 - protein, 37 aa, Artificial Sequence
  Description of Artificial Sequence: Synthetic polypeptide
DEEEIRTTNPVATEQYGCQVCSNTGEDQENFGSENQS

SEQ ID NO: 143637 - protein, 30 aa, Artificial Sequence
  Description of Artificial Sequence: Synthetic polypeptide
QEEEIATTNPVATEQYGEAPEHVCQHEEKE

SEQ ID NO: 143638 - protein, 35 aa, Artificial Sequence
  Description of Artificial Sequence: Synthetic polypeptide
DEEEIATTNPVATEQYGSACAATGEANDMGAGTRM

SEQ ID NO: 143639 - protein, 34 aa, Artificial Sequence
  Description of Artificial Sequence: Synthetic polypeptide
DECSIMTTNPVATECYGSVINESNTLERIGNNME

SEQ ID NO: 143640 - protein, 35 aa, Artificial Sequence
  Description of Artificial Sequence: Synthetic polypeptide
DEEEIATTNPVATEQWGCVADTWELAQDNTSGNEH

SEQ ID NO: 143641 - protein, 35 aa, Artificial Sequence
  Description of Artificial Sequence: Synthetic polypeptide
VEEEIRTTNPVATEQYGSVSPPAGVEHNVVLIPGE

SEQ ID NO: 143642 - protein, 29 aa, Artificial Sequence
  Description of Artificial Sequence: Synthetic peptide
VESEIASTNPVGTEGYGVMASTLQHGDDI

SEQ ID NO: 143643 - protein, 29 aa, Artificial Sequence
  Description of Artificial Sequence: Synthetic peptide
VESEIASTNPVGTEGYGVMASTLHQHGDI

SEQ ID NO: 143644 - protein, 37 aa, Artificial Sequence
  Description of Artificial Sequence: Synthetic polypeptide
DEEEIRTTNPVATEAYGVVSTTNQQQGNQNQGTETGS

SEQ ID NO: 143645 - protein, 37 aa, Artificial Sequence
  Description of Artificial Sequence: Synthetic polypeptide
DEEEIRTTNPVATEAYGVVSTTNQQQGNQQQGTEQGE

SEQ ID NO: 143646 - protein, 37 aa, Artificial Sequence
  Description of Artificial Sequence: Synthetic polypeptide
VEEEIRTTNPVATEQYGSVSPTNNSGLNIIQYQVDTN

SEQ ID NO: 143647 - protein, 37 aa, Artificial Sequence
  Description of Artificial Sequence: Synthetic polypeptide
DEEEIRTTNPVATEAYGVVSTTNQQQGNTEQGTTTDD

SEQ ID NO: 143648 - protein, 36 aa, Artificial Sequence
  Description of Artificial Sequence: Synthetic polypeptide
VEEEIRTTNPVATEQYGSVSSSSNIGGALTQLVLLD

SEQ ID NO: 143649 - protein, 35 aa, Artificial Sequence
  Description of Artificial Sequence: Synthetic polypeptide
DEEEIRTTNPVATEQYGAVDSGMGQDDEQPGDEGQ

SEQ ID NO: 143650 - protein, 36 aa, Artificial Sequence
  Description of Artificial Sequence: Synthetic polypeptide
DEEEIATTNPVATEQYGSACSAANPLAEAEMGNGHH

SEQ ID NO: 143651 - protein, 36 aa, Artificial Sequence
  Description of Artificial Sequence: Synthetic polypeptide
VEEEIRTTNPVATEQYGNVSSTTPAGPNMRNGMNPV

SEQ ID NO: 143652 - protein, 31 aa, Artificial Sequence
  Description of Artificial Sequence: Synthetic polypeptide
DEDEIACTNPVATEQWGCVAGTGLAAMNDFL

SEQ ID NO: 143653 - protein, 36 aa, Artificial Sequence
  Description of Artificial Sequence: Synthetic polypeptide
VEDEIRTTNPVATEQYGSVMSGMFNTDLFEEGFNII

SEQ ID NO: 143654 - protein, 34 aa, Artificial Sequence
  Description of Artificial Sequence: Synthetic polypeptide
DESEIRTTNPVATECWGSVKCIENEPIDREGENG

SEQ ID NO: 143655 - protein, 36 aa, Artificial Sequence
  Description of Artificial Sequence: Synthetic polypeptide
DEEEIRTTNPVATEQYGSVLPATNQWIWNTIELSEL

SEQ ID NO: 143656 - protein, 35 aa, Artificial Sequence
  Description of Artificial Sequence: Synthetic polypeptide
DEEEIRTTNPVATEQYGAVVDGMNVGQGEDDENGD

SEQ ID NO: 143657 - protein, 33 aa, Artificial Sequence
  Description of Artificial Sequence: Synthetic polypeptide
VEDEVATTNPVAYEQWGSTCSTWEGMDQRTGNR

SEQ ID NO: 143658 - protein, 30 aa, Artificial Sequence
  Description of Artificial Sequence: Synthetic polypeptide
QEEEIATTNPVATEQYGEAANEEDWQHEPK

SEQ ID NO: 143659 - protein, 33 aa, Artificial Sequence
  Description of Artificial Sequence: Synthetic polypeptide
VEDEVATTNPVAYEQWGSTCSTWEHLDQRNANR

SEQ ID NO: 143660 - protein, 33 aa, Artificial Sequence
  Description of Artificial Sequence: Synthetic polypeptide
DEDEIACTNPVATEQWGCNVATNGLFQVRQEDF

SEQ ID NO: 143661 - protein, 30 aa, Artificial Sequence
  Description of Artificial Sequence: Synthetic polypeptide
QEEEIATTNPVAYEQWGEAYYVEQEGEENG

SEQ ID NO: 143662 - protein, 30 aa, Artificial Sequence
  Description of Artificial Sequence: Synthetic polypeptide
QEEEIATTNPVATEQYGEAAPEVVCQHEEK

SEQ ID NO: 143663 - protein, 30 aa, Artificial Sequence
  Description of Artificial Sequence: Synthetic polypeptide
QEEEIATTNPVATEQYGEAPEVACSQSEEK

SEQ ID NO: 143664 - protein, 37 aa, Artificial Sequence
  Description of Artificial Sequence: Synthetic polypeptide
DEEEIRTTNPVATEAYGVVSTSNNNNQQGTNNNATND

SEQ ID NO: 143665 - protein, 31 aa, Artificial Sequence
  Description of Artificial Sequence: Synthetic polypeptide
QEEEIATTNPVATEQYGEAPEVACQHGEEEK

SEQ ID NO: 143666 - protein, 34 aa, Artificial Sequence
  Description of Artificial Sequence: Synthetic polypeptide
VEDEVATTNPVAYEQWGSTCSTWEQNDQRVGPNR

SEQ ID NO: 143667 - protein, 31 aa, Artificial Sequence
  Description of Artificial Sequence: Synthetic polypeptide
DEDEIACTNPVATEQWGCVAGTGLAAMNGAH

SEQ ID NO: 143668 - protein, 35 aa, Artificial Sequence
  Description of Artificial Sequence: Synthetic polypeptide
CEDEIRTTNPVATEQYGAVSVYGDLGQRFNQNEQD

SEQ ID NO: 143669 - protein, 37 aa, Artificial Sequence
  Description of Artificial Sequence: Synthetic polypeptide
VEDEIRTTNPVATEQYGSVMSGMFNADLQEEGFNQII

SEQ ID NO: 143670 - protein, 38 aa, Artificial Sequence
  Description of Artificial Sequence: Synthetic polypeptide
DEEEIRTTNPVATEAYGVVSTNLQAGNNENQEGTEDED

SEQ ID NO: 143671 - protein, 37 aa, Artificial Sequence
  Description of Artificial Sequence: Synthetic polypeptide
AEDEIRTTNPVATEQYGVVSTVTNNQNLQEQGTTNVD

SEQ ID NO: 143672 - protein, 34 aa, Artificial Sequence
  Description of Artificial Sequence: Synthetic polypeptide
VEDEIATTNPVAYEQYGSVSAANNLQEATDGMAN

SEQ ID NO: 143673 - protein, 33 aa, Artificial Sequence
  Description of Artificial Sequence: Synthetic polypeptide
DEDEIACTNPVATEQWGCVATNSLFQVTQGEDF

SEQ ID NO: 143674 - protein, 32 aa, Artificial Sequence
  Description of Artificial Sequence: Synthetic polypeptide
VEDEIATVNPVATEQYGCVAGTGLADAGGNMH

SEQ ID NO: 143675 - protein, 37 aa, Artificial Sequence
  Description of Artificial Sequence: Synthetic polypeptide
AEDEIRTTNPVATEQYGVVSTVTNNQQQLNQEGTNVD

SEQ ID NO: 143676 - protein, 37 aa, Artificial Sequence
  Description of Artificial Sequence: Synthetic polypeptide
DEEEIRTTNPVATEAYGVVSTNNNQQQGNNQEDEEDQ

SEQ ID NO: 143677 - protein, 35 aa, Artificial Sequence
  Description of Artificial Sequence: Synthetic polypeptide
DEEEIRTTNPVATEQYGSVMGDFAEFGDGIEDNGQ

SEQ ID NO: 143678 - protein, 36 aa, Artificial Sequence
  Description of Artificial Sequence: Synthetic polypeptide
DECEICTVNPVATEQYGSVSTTNQQGQEQGTNQDEE

SEQ ID NO: 143679 - protein, 37 aa, Artificial Sequence
  Description of Artificial Sequence: Synthetic polypeptide
DEEEIRTTNPVATEAYGVVSTNNQNNQQGTNNNDTND

SEQ ID NO: 143680 - protein, 35 aa, Artificial Sequence
  Description of Artificial Sequence: Synthetic polypeptide
VEDEIRTTNPVATEQYGAPMVMAGINQQTRGLQLR

SEQ ID NO: 143681 - protein, 33 aa, Artificial Sequence
  Description of Artificial Sequence: Synthetic polypeptide
DEDEIACTNPVATEQWGCVATNSLFQVRQEDFD

SEQ ID NO: 143682 - protein, 33 aa, Artificial Sequence
  Description of Artificial Sequence: Synthetic polypeptide
DESEIRTTNPVATDHWGSVCTIEGQNRHDQNDM

SEQ ID NO: 143683 - protein, 35 aa, Artificial Sequence
  Description of Artificial Sequence: Synthetic polypeptide
VEDEIRTTNPVATEQYGASVMAGINQDQTQGLPLR

SEQ ID NO: 143684 - protein, 36 aa, Artificial Sequence
  Description of Artificial Sequence: Synthetic polypeptide
VEDEIRTTNPVATEQYGSVMSGMFNADLAEEGFNIF

SEQ ID NO: 143685 - protein, 29 aa, Artificial Sequence
  Description of Artificial Sequence: Synthetic peptide
QEEEIATTNPVAYEQWGEAYYVEQHEDRG

SEQ ID NO: 143686 - protein, 30 aa, Artificial Sequence
  Description of Artificial Sequence: Synthetic polypeptide
QEEEIATTNPVATEQYGEAPEVACQHEEQK

SEQ ID NO: 143687 - protein, 37 aa, Artificial Sequence
  Description of Artificial Sequence: Synthetic polypeptide
DEEEIRTTNPVATEAYGVVSTSNNQQGNNQQGTNEDE

SEQ ID NO: 143688 - protein, 37 aa, Artificial Sequence
  Description of Artificial Sequence: Synthetic polypeptide
AEDEIRTTNPVATEQYGVVSTVTNNQQQLQGTGTNED

SEQ ID NO: 143689 - protein, 36 aa, Artificial Sequence
  Description of Artificial Sequence: Synthetic polypeptide
AEDEIRTTNPVATEQYGVVSTVTNNQQQNQQGTNED

SEQ ID NO: 143690 - protein, 37 aa, Artificial Sequence
  Description of Artificial Sequence: Synthetic polypeptide
DEEEIRTTNPVATEAYGVVSTTLQAGNTEQGTNEEED

SEQ ID NO: 143691 - protein, 37 aa, Artificial Sequence
  Description of Artificial Sequence: Synthetic polypeptide
DEEEIRTTNPVATEAYGVVSTTNANNLQQGTTEEEED

SEQ ID NO: 143692 - protein, 35 aa, Artificial Sequence
  Description of Artificial Sequence: Synthetic polypeptide
DESEIRTTNPVATDQYGSVVDDDTNDQSEDNEEGD

SEQ ID NO: 143693 - protein, 35 aa, Artificial Sequence
  Description of Artificial Sequence: Synthetic polypeptide
CEDEIATTNPVAYEQYGSVSTNEGPPQENGDNMAM

SEQ ID NO: 143694 - protein, 37 aa, Artificial Sequence
  Description of Artificial Sequence: Synthetic polypeptide
DEEEIRTTNPVATEAYGVVSTTNGQQNNQQGTEQGNT

SEQ ID NO: 143695 - protein, 38 aa, Artificial Sequence
  Description of Artificial Sequence: Synthetic polypeptide
DEEEIRTTNPVATEAYGVVSTTNLQAGNNQQGNTEQGS

SEQ ID NO: 143696 - protein, 38 aa, Artificial Sequence
  Description of Artificial Sequence: Synthetic polypeptide
DEEEIRTTNPVATEAYGVVSTTNLQAGNNTQTGTEQGS

SEQ ID NO: 143697 - protein, 30 aa, Artificial Sequence
  Description of Artificial Sequence: Synthetic polypeptide
QEEEIATTNPVATEQYGEAPEVACMQHEEK

SEQ ID NO: 143698 - protein, 36 aa, Artificial Sequence
  Description of Artificial Sequence: Synthetic polypeptide
DEEEIRTTNPVATEQYGSVLPAYNNQLINTIELSEL

SEQ ID NO: 143699 - protein, 38 aa, Artificial Sequence
  Description of Artificial Sequence: Synthetic polypeptide
DEEEIRTTNPVATEAYGVVSTTNLQAGNTESGGTNTEQ

SEQ ID NO: 143700 - protein, 30 aa, Artificial Sequence
  Description of Artificial Sequence: Synthetic polypeptide
QEEEIATTNPVATEQYGEACPEGCEHEGEK

SEQ ID NO: 143701 - protein, 29 aa, Artificial Sequence
  Description of Artificial Sequence: Synthetic peptide
QEEEIATTNPVAYEQWGESYYVEQHGEED

SEQ ID NO: 143702 - protein, 36 aa, Artificial Sequence
  Description of Artificial Sequence: Synthetic polypeptide
DEEEIRTTNPVATEQYGAVVDNFNMDQNGEGQGNFG

SEQ ID NO: 143703 - protein, 35 aa, Artificial Sequence
  Description of Artificial Sequence: Synthetic polypeptide
WESEIRTTNPVATECWGSVSCINTDPQDREGENGY

SEQ ID NO: 143704 - protein, 36 aa, Artificial Sequence
  Description of Artificial Sequence: Synthetic polypeptide
DECEICTVNPVATEQYGSVSTTNQQNEQQGNNQDEE

SEQ ID NO: 143705 - protein, 35 aa, Artificial Sequence
  Description of Artificial Sequence: Synthetic polypeptide
CEDEIRTTNPVATEQYGDVSVTGEQGEGQGDNEDS

SEQ ID NO: 143706 - protein, 31 aa, Artificial Sequence
  Description of Artificial Sequence: Synthetic polypeptide
DEDEIACTNPVATAQWGCVAGTGLETPDGNN

SEQ ID NO: 143707 - protein, 37 aa, Artificial Sequence
  Description of Artificial Sequence: Synthetic polypeptide
AEEEIRTTNPVATEQYGSVTVVVTNNLLQGNTEENEL

SEQ ID NO: 143708 - protein, 35 aa, Artificial Sequence
  Description of Artificial Sequence: Synthetic polypeptide
DEEEIRTTNPVATEQYGAVVDGMTNQGNFDSNDED

SEQ ID NO: 143709 - protein, 37 aa, Artificial Sequence
  Description of Artificial Sequence: Synthetic polypeptide
AEEEIRTTNPVATEQYGSVTVVVTNLQQNNEEEEEED

SEQ ID NO: 143710 - protein, 33 aa, Artificial Sequence
  Description of Artificial Sequence: Synthetic polypeptide
VEEEIACTNPVATEQYGCVAGTNSHQEADMDIR

SEQ ID NO: 143711 - protein, 32 aa, Artificial Sequence
  Description of Artificial Sequence: Synthetic polypeptide
CEDEIATVNPVATEQYGCVAGTNLFAEMGDQH

SEQ ID NO: 143712 - protein, 34 aa, Artificial Sequence
  Description of Artificial Sequence: Synthetic polypeptide
VEEEIACTNPVATEQYGCVATNNLENGMMENDNN

SEQ ID NO: 143713 - protein, 34 aa, Artificial Sequence
  Description of Artificial Sequence: Synthetic polypeptide
VEEEIACTNPVATEQYGCVATNNLENGMNGENDN

SEQ ID NO: 143714 - protein, 33 aa, Artificial Sequence
  Description of Artificial Sequence: Synthetic polypeptide
VEEEIACTNPVATEQYGSASLANMGQAEDPNGD

SEQ ID NO: 143715 - protein, 34 aa, Artificial Sequence
  Description of Artificial Sequence: Synthetic polypeptide
DESEIRTTNPVATECWGSVGCINEHEAREGENGE

SEQ ID NO: 143716 - protein, 32 aa, Artificial Sequence
  Description of Artificial Sequence: Synthetic polypeptide
CEDEIATVNPVATEQYGCVAGTGLAATGGNHN

SEQ ID NO: 143717 - protein, 34 aa, Artificial Sequence
  Description of Artificial Sequence: Synthetic polypeptide
DEEEIRTTNPVATEQYGCVAITEGGEATVPGEFN

SEQ ID NO: 143718 - protein, 29 aa, Artificial Sequence
  Description of Artificial Sequence: Synthetic peptide
QEEEIATTNPVAYEQWGEAYYVEQHQRGE

SEQ ID NO: 143719 - protein, 36 aa, Artificial Sequence
  Description of Artificial Sequence: Synthetic polypeptide
VEEEIACTNPVATEQYGSVANANNLPQEAPGENARD

SEQ ID NO: 143720 - protein, 31 aa, Artificial Sequence
  Description of Artificial Sequence: Synthetic polypeptide
DEDEIACTNPVATAQWGSVAAGNLFNNNMGN

SEQ ID NO: 143721 - protein, 37 aa, Artificial Sequence
  Description of Artificial Sequence: Synthetic polypeptide
AEEEIRTTNPVATEQYGSVTVVVTNLTQGNNNEENEL

SEQ ID NO: 143722 - protein, 33 aa, Artificial Sequence
  Description of Artificial Sequence: Synthetic polypeptide
DESEIRTTNPVATECWGSVECINEPQDREPEGG

SEQ ID NO: 143723 - protein, 33 aa, Artificial Sequence
  Description of Artificial Sequence: Synthetic polypeptide
DEEEIRTTNPVATEQYGCVADYVLIWPVTDEQN

SEQ ID NO: 143724 - protein, 34 aa, Artificial Sequence
  Description of Artificial Sequence: Synthetic polypeptide
DEDCIRTTNPVATEQWGSVFWNNNALYELGQNEQ

SEQ ID NO: 143725 - protein, 36 aa, Artificial Sequence
  Description of Artificial Sequence: Synthetic polypeptide
DEEEIRTTNPVATEQYGSVGSWMSNVQPTQMVQEPD

SEQ ID NO: 143726 - protein, 38 aa, Artificial Sequence
  Description of Artificial Sequence: Synthetic polypeptide
AEEEIRTTNPVATEQYGSVTVVVNTNLEQGSEGGNTEG

SEQ ID NO: 143727 - protein, 34 aa, Artificial Sequence
  Description of Artificial Sequence: Synthetic polypeptide
DESEIRTTNPVATECWGSVSAIDEPQEREGEPYI

SEQ ID NO: 143728 - protein, 29 aa, Artificial Sequence
  Description of Artificial Sequence: Synthetic peptide
QEEEIATTNPVATEQYGEAPEVCAHEIEK

SEQ ID NO: 143729 - protein, 34 aa, Artificial Sequence
  Description of Artificial Sequence: Synthetic polypeptide
DECEICTTNPVAYEQWGSVTGDNNSQGNQMGNQR

SEQ ID NO: 143730 - protein, 35 aa, Artificial Sequence
  Description of Artificial Sequence: Synthetic polypeptide
DEEEIRTTNPVATEQYGSVLPAHNQFINTIELSEV

SEQ ID NO: 143731 - protein, 32 aa, Artificial Sequence
  Description of Artificial Sequence: Synthetic polypeptide
DESEIRTTNPVATCHYGCVCSWNHQYFTSEQS

SEQ ID NO: 143732 - protein, 30 aa, Artificial Sequence
  Description of Artificial Sequence: Synthetic polypeptide
DEDEIACTNPVATEQWGTNCSAAEMRSNDS

SEQ ID NO: 143733 - protein, 33 aa, Artificial Sequence
  Description of Artificial Sequence: Synthetic polypeptide
DESEIRTTNPVATCHYGCVCSTELQEYFTSDQG

SEQ ID NO: 143734 - protein, 34 aa, Artificial Sequence
  Description of Artificial Sequence: Synthetic polypeptide
DESEIRTTNPVATECWGSVSACNEPEDHEGENDG

SEQ ID NO: 143735 - protein, 35 aa, Artificial Sequence
  Description of Artificial Sequence: Synthetic polypeptide
DEEEIRTTNPVATEQYGAVVDDNNFNIGEMTNGQD

SEQ ID NO: 143736 - protein, 37 aa, Artificial Sequence
  Description of Artificial Sequence: Synthetic polypeptide
AEDEIRTTNPVATEQYGVVSTVTNNNQQLQQGVTNED

SEQ ID NO: 143737 - protein, 33 aa, Artificial Sequence
  Description of Artificial Sequence: Synthetic polypeptide
DEEEIRTTNPVATEQYGAVVDDQNFNGEMTAGQ

SEQ ID NO: 143738 - protein, 35 aa, Artificial Sequence
  Description of Artificial Sequence: Synthetic polypeptide
DESEIRTTNPVATECWGSVSACINEPEDREGENDG

SEQ ID NO: 143739 - protein, 36 aa, Artificial Sequence
  Description of Artificial Sequence: Synthetic polypeptide
DECEICTVNPVATEQYGSVSTTNAQGNEQGNNQDED

SEQ ID NO: 143740 - protein, 33 aa, Artificial Sequence
  Description of Artificial Sequence: Synthetic polypeptide
DESEIRTTNPVATECWGSVSACIDEEDHEGENG

SEQ ID NO: 143741 - protein, 33 aa, Artificial Sequence
  Description of Artificial Sequence: Synthetic polypeptide
DEDEIACTNPVATEQWGSVSMSGNGQPAGVGSM

SEQ ID NO: 143742 - protein, 34 aa, Artificial Sequence
  Description of Artificial Sequence: Synthetic polypeptide
DEDEIACTNPVATEQYGCVATALAAPGAQEEGNP

SEQ ID NO: 143743 - protein, 30 aa, Artificial Sequence
  Description of Artificial Sequence: Synthetic polypeptide
QEEEIATTNPVATEQYGEAPEVCAQPHEEK

SEQ ID NO: 143744 - protein, 29 aa, Artificial Sequence
  Description of Artificial Sequence: Synthetic peptide
QEEEIATTNPVATEQYGEAPEVCCAHEEK

SEQ ID NO: 143745 - protein, 31 aa, Artificial Sequence
  Description of Artificial Sequence: Synthetic polypeptide
DECEICTTNPVAYEQWGSVGWIEDLQAMDGM

SEQ ID NO: 143746 - protein, 34 aa, Artificial Sequence
  Description of Artificial Sequence: Synthetic polypeptide
VEDEIATTNPVAYEQYGQSTATNNDLTQDDGMGR

SEQ ID NO: 143747 - protein, 29 aa, Artificial Sequence
  Description of Artificial Sequence: Synthetic peptide
QEEEIATTNPVATEQYGEAPEVCCHEEKT

SEQ ID NO: 143748 - protein, 36 aa, Artificial Sequence
  Description of Artificial Sequence: Synthetic polypeptide
AEEEIRTTNPVATEQYGSVTVVNTNDESGTVNNNTM

SEQ ID NO: 143749 - protein, 31 aa, Artificial Sequence
  Description of Artificial Sequence: Synthetic polypeptide
QEEEIATTNPVATEQYGDVAGPEEGQGEVEQ

SEQ ID NO: 143750 - protein, 32 aa, Artificial Sequence
  Description of Artificial Sequence: Synthetic polypeptide
DECEICTTNPVAYEQWGSVGWIEDLQQQMDAR

SEQ ID NO: 143751 - protein, 32 aa, Artificial Sequence
  Description of Artificial Sequence: Synthetic polypeptide
QEEEIATTNPVATEQYGDVAGPEGGQGGEEQA

SEQ ID NO: 143752 - protein, 35 aa, Artificial Sequence
  Description of Artificial Sequence: Synthetic polypeptide
VEDEIATTNPVAYEQYGQSVPATNNDLTQDGMGTR

SEQ ID NO: 143753 - protein, 32 aa, Artificial Sequence
  Description of Artificial Sequence: Synthetic polypeptide
VEDEIATTNPVAYEQYGSVAAANDPQDNHNNN

SEQ ID NO: 143754 - protein, 33 aa, Artificial Sequence
  Description of Artificial Sequence: Synthetic polypeptide
DESEIRTTNPVATCHYGCVCSNTEDQYFTSNQS

SEQ ID NO: 143755 - protein, 32 aa, Artificial Sequence
  Description of Artificial Sequence: Synthetic polypeptide
VEDEIATTNPVAYEQYGSVAATANDTATDNQD

SEQ ID NO: 143756 - protein, 37 aa, Artificial Sequence
  Description of Artificial Sequence: Synthetic polypeptide
AEEEIRTTNPVATEQYGSVVTVNNNQLGNTEQGTNDE

SEQ ID NO: 143757 - protein, 32 aa, Artificial Sequence
  Description of Artificial Sequence: Synthetic polypeptide
DESEIRTTNPVATCHYGCVCSSNHQENFTSDQ

SEQ ID NO: 143758 - protein, 32 aa, Artificial Sequence
  Description of Artificial Sequence: Synthetic polypeptide
VEDEIATTNPVAYEQYGSVAATNDTATDGMGN

SEQ ID NO: 143759 - protein, 33 aa, Artificial Sequence
  Description of Artificial Sequence: Synthetic polypeptide
DESEIRTTNPVATCHYGCVCSTEHNQYFISNQG

SEQ ID NO: 143760 - protein, 36 aa, Artificial Sequence
  Description of Artificial Sequence: Synthetic polypeptide
DECEICTVNPVATEQYGSVSTTNAQGQNNGNNQDED

SEQ ID NO: 143761 - protein, 35 aa, Artificial Sequence
  Description of Artificial Sequence: Synthetic polypeptide
CEDEIRTTNPVATEQYGSVSNDDEGQQNIGGNGET

SEQ ID NO: 143762 - protein, 37 aa, Artificial Sequence
  Description of Artificial Sequence: Synthetic polypeptide
DEEEIRTTNPVATEQYGSVGSVWNNLENFTQQEELFQ

SEQ ID NO: 143763 - protein, 32 aa, Artificial Sequence
  Description of Artificial Sequence: Synthetic polypeptide
VEDEIATTNPVAYEQYGSVAATNDTATGGEDN

SEQ ID NO: 143764 - protein, 29 aa, Artificial Sequence
  Description of Artificial Sequence: Synthetic peptide
QEEEIATTNPVATEQYGEAPEVCAFHEEK

SEQ ID NO: 143765 - protein, 38 aa, Artificial Sequence
  Description of Artificial Sequence: Synthetic polypeptide
AEEEIRTTNPVATEQYGSVTVVTTNNLQQGNNGEENEL

SEQ ID NO: 143766 - protein, 33 aa, Artificial Sequence
  Description of Artificial Sequence: Synthetic polypeptide
VEDEIATTNPVAYEQYGSVAATNDTATGTGNQD

SEQ ID NO: 143767 - protein, 38 aa, Artificial Sequence
  Description of Artificial Sequence: Synthetic polypeptide
AEEEIRTTNPVATEQYGSVTVVTTNQLQQGNNNEENEE

SEQ ID NO: 143768 - protein, 30 aa, Artificial Sequence
  Description of Artificial Sequence: Synthetic polypeptide
YDSEIASTNPVSTEGYGVVSANTIQSSGNQ

SEQ ID NO: 143769 - protein, 37 aa, Artificial Sequence
  Description of Artificial Sequence: Synthetic polypeptide
DECEICTVNPVATEQYGSVSTTNNLQQGSEQGTNVTD

SEQ ID NO: 143770 - protein, 33 aa, Artificial Sequence
  Description of Artificial Sequence: Synthetic polypeptide
DESEIRTTNPVATECWGSVPCIWEPQDGEGENG

SEQ ID NO: 143771 - protein, 37 aa, Artificial Sequence
  Description of Artificial Sequence: Synthetic polypeptide
DECEICTVNPVATEQYGSVSTTNNQLQGNEQGTNTTE

SEQ ID NO: 143772 - protein, 36 aa, Artificial Sequence
  Description of Artificial Sequence: Synthetic polypeptide
DECEICTVNPVATEQYGSVSTTNQNQQQQGNNQDED

SEQ ID NO: 143773 - protein, 33 aa, Artificial Sequence
  Description of Artificial Sequence: Synthetic polypeptide
VEDEIATTNPVAYEQYGSVAATNDTATPGGNDN

SEQ ID NO: 143774 - protein, 33 aa, Artificial Sequence
  Description of Artificial Sequence: Synthetic polypeptide
VEDEIATTNPVAYEQYGSVAATNDTATPGGNHH

SEQ ID NO: 143775 - protein, 33 aa, Artificial Sequence
  Description of Artificial Sequence: Synthetic polypeptide
VEDEIATTNPVAYEQYGSVAATNDTATPGGSNY

SEQ ID NO: 143776 - protein, 32 aa, Artificial Sequence
  Description of Artificial Sequence: Synthetic polypeptide
VEDEIATTNPVAYEQYGSVAATNDTATPGSQD

SEQ ID NO: 143777 - protein, 36 aa, Artificial Sequence
  Description of Artificial Sequence: Synthetic polypeptide
DECEICTVNPVATEQYGSVSTTNQQGAEQGTNQTED

SEQ ID NO: 143778 - protein, 33 aa, Artificial Sequence
  Description of Artificial Sequence: Synthetic polypeptide
VEDEIATTNPVAYEQYGSVAATNNDTATGDNDN

SEQ ID NO: 143779 - protein, 34 aa, Artificial Sequence
  Description of Artificial Sequence: Synthetic polypeptide
DESEIRTTNPVATECWGSVRCIDIEDQDRSGENQ

SEQ ID NO: 143780 - protein, 37 aa, Artificial Sequence
  Description of Artificial Sequence: Synthetic polypeptide
AEEEIRTTNPVATEQYGSVTVVVTNLQAGSEGGVVQG

SEQ ID NO: 143781 - protein, 35 aa, Artificial Sequence
  Description of Artificial Sequence: Synthetic polypeptide
DESEIRTTNPVATECWGSVRCIDMEDQDRQGENRQ

SEQ ID NO: 143782 - protein, 35 aa, Artificial Sequence
  Description of Artificial Sequence: Synthetic polypeptide
DESEIRTTNPVATECWGSVRCIDNEDQDRHGENDQ

SEQ ID NO: 143783 - protein, 33 aa, Artificial Sequence
  Description of Artificial Sequence: Synthetic polypeptide
VEDEIATTNPVAYEQYGSVAATNDTATGGGNPM

SEQ ID NO: 143784 - protein, 34 aa, Artificial Sequence
  Description of Artificial Sequence: Synthetic polypeptide
CEDEIRTTNPVATEQYGSVMGQNVGMEDNGNGGE

SEQ ID NO: 143785 - protein, 34 aa, Artificial Sequence
  Description of Artificial Sequence: Synthetic polypeptide
DEDEIACTNPVATEQWGSVSANGPGAPDNQEGNM

SEQ ID NO: 143786 - protein, 37 aa, Artificial Sequence
  Description of Artificial Sequence: Synthetic polypeptide
DEEEIRTTNPVATEQYGAVVDGFTNDLETDQDGEGQG

SEQ ID NO: 143787 - protein, 36 aa, Artificial Sequence
  Description of Artificial Sequence: Synthetic polypeptide
DEEEIRTTNPVATEQYGAVVDGFTNDQTNGDGTGQD

SEQ ID NO: 143788 - protein, 36 aa, Artificial Sequence
  Description of Artificial Sequence: Synthetic polypeptide
DEEEIRTTNPVATEQYGSVGSWLPNVQPTQMVQDAD

SEQ ID NO: 143789 - protein, 34 aa, Artificial Sequence
  Description of Artificial Sequence: Synthetic polypeptide
DESEIRTTNPVATECWGSVRGCINEPQAGEGENG

SEQ ID NO: 143790 - protein, 33 aa, Artificial Sequence
  Description of Artificial Sequence: Synthetic polypeptide
VEDEIATTNPVAYEQYGSVAATNDTATGGNQDH

SEQ ID NO: 143791 - protein, 34 aa, Artificial Sequence
  Description of Artificial Sequence: Synthetic polypeptide
DESEIRTTNPVATECWGSVRCIDWNMQDRNGEKD

SEQ ID NO: 143792 - protein, 32 aa, Artificial Sequence
  Description of Artificial Sequence: Synthetic polypeptide
VEDEIATTNPVAYEQYGSVAATNDTATGMQDN

SEQ ID NO: 143793 - protein, 36 aa, Artificial Sequence
  Description of Artificial Sequence: Synthetic polypeptide
DEEEIRTTNPVATEQYGSVMGDPMNLDGSGTGEGEN

SEQ ID NO: 143794 - protein, 36 aa, Artificial Sequence
  Description of Artificial Sequence: Synthetic polypeptide
DEEEIRTTNPVATEQYGSVMGDNQDLGGGEDEIDGG

SEQ ID NO: 143795 - protein, 29 aa, Artificial Sequence
  Description of Artificial Sequence: Synthetic peptide
QEEEIATTNPVATEQYGEAPEVCAHEEEK

SEQ ID NO: 143796 - protein, 35 aa, Artificial Sequence
  Description of Artificial Sequence: Synthetic polypeptide
DEEEIRTTNPVATEQYGSVMGDNFDEGGGEDEIGG

SEQ ID NO: 143797 - protein, 34 aa, Artificial Sequence
  Description of Artificial Sequence: Synthetic polypeptide
DESEIRTTNPVATECWGSVRCIDWNDKDRHGENQ

SEQ ID NO: 143798 - protein, 28 aa, Artificial Sequence
  Description of Artificial Sequence: Synthetic peptide
YDSEIASVNPVSTEGYGVVSNTIQSGNQ

SEQ ID NO: 143799 - protein, 34 aa, Artificial Sequence
  Description of Artificial Sequence: Synthetic polypeptide
DESEIRTTNPVATECWGSKSCINEPQDRIYENGP

SEQ ID NO: 143800 - protein, 38 aa, Artificial Sequence
  Description of Artificial Sequence: Synthetic polypeptide
DEEEIRTTNPVATEAYGVVSTTNLQAGNTTEQGTNEEQ

SEQ ID NO: 143801 - protein, 36 aa, Artificial Sequence
  Description of Artificial Sequence: Synthetic polypeptide
VEEEIATTNPVATEQWGSVSMSGDTPTNNDDGVGNR

SEQ ID NO: 143802 - protein, 33 aa, Artificial Sequence
  Description of Artificial Sequence: Synthetic polypeptide
AEDEIRTTNPVAYEQWGSVCYTDNDNHGHGDNS

SEQ ID NO: 143803 - protein, 35 aa, Artificial Sequence
  Description of Artificial Sequence: Synthetic polypeptide
DESEIRTTNPVATEAWGSVSTVNNNNQQDEGETGT

SEQ ID NO: 143804 - protein, 35 aa, Artificial Sequence
  Description of Artificial Sequence: Synthetic polypeptide
DECEICTVNPVATEQYGVVSTTNQQNQQGNNQQED

SEQ ID NO: 143805 - protein, 36 aa, Artificial Sequence
  Description of Artificial Sequence: Synthetic polypeptide
DEEEIRTTNPVATEQYGCTCSMTEEPNQSIGSDNQA

SEQ ID NO: 143806 - protein, 33 aa, Artificial Sequence
  Description of Artificial Sequence: Synthetic polypeptide
AEDEIRTTNPVAYEQWGSVCYTDNDNHGHGNAN

SEQ ID NO: 143807 - protein, 35 aa, Artificial Sequence
  Description of Artificial Sequence: Synthetic polypeptide
VEEEIRTTNPVATEQYGAVMGDGNEQDEFGGENND

SEQ ID NO: 143808 - protein, 34 aa, Artificial Sequence
  Description of Artificial Sequence: Synthetic polypeptide
VEEEIRTTNPVATEGYGSVVVDGEFLEMEGNGGE

SEQ ID NO: 143809 - protein, 37 aa, Artificial Sequence
  Description of Artificial Sequence: Synthetic polypeptide
DEEEIRTTNPVATEQYGSVLVPTSGNEEQLMTQHQEQ

SEQ ID NO: 143810 - protein, 34 aa, Artificial Sequence
  Description of Artificial Sequence: Synthetic polypeptide
AEDEIRTTNPVAYEQWGSVCYTDNDNHGHTGNDR

SEQ ID NO: 143811 - protein, 36 aa, Artificial Sequence
  Description of Artificial Sequence: Synthetic polypeptide
DEEEIRTTNPVATEQYGCTCSMTEEHNQESIGSNQS

SEQ ID NO: 143812 - protein, 35 aa, Artificial Sequence
  Description of Artificial Sequence: Synthetic polypeptide
DEEEIRTTNPVATEQYGCTCSMTEEHNISIGSDQS

SEQ ID NO: 143813 - protein, 30 aa, Artificial Sequence
  Description of Artificial Sequence: Synthetic polypeptide
QEEEIATTNPVATEQYGEAPERVCQHEEKY

SEQ ID NO: 143814 - protein, 35 aa, Artificial Sequence
  Description of Artificial Sequence: Synthetic polypeptide
DEEEIRTTNPVATEQYGAVVGDTGDGTEQGEGEEE

SEQ ID NO: 143815 - protein, 37 aa, Artificial Sequence
  Description of Artificial Sequence: Synthetic polypeptide
DEEEIRTTNPVATEQYGSVGSWTPNVSQPTQMVQEDD

SEQ ID NO: 143816 - protein, 29 aa, Artificial Sequence
  Description of Artificial Sequence: Synthetic peptide
QEEEIATTNPVAYEQYGEAPEHCSQHEEE

SEQ ID NO: 143817 - protein, 36 aa, Artificial Sequence
  Description of Artificial Sequence: Synthetic polypeptide
VEEEIRTTNPVATEGYGSVVQGTVNGQEAGNGGGQG

SEQ ID NO: 143818 - protein, 35 aa, Artificial Sequence
  Description of Artificial Sequence: Synthetic polypeptide
VEEEIRTTNPVATEGYGSVVNFDDNNDQTGGGNET

SEQ ID NO: 143819 - protein, 35 aa, Artificial Sequence
  Description of Artificial Sequence: Synthetic polypeptide
VEEEIRTTNPVATEGYGSVVGNIGQTDIAGQNGNA

SEQ ID NO: 143820 - protein, 35 aa, Artificial Sequence
  Description of Artificial Sequence: Synthetic polypeptide
VEEEIRTTNPVATECYGSVYDNFQNLVREGGDDQE

SEQ ID NO: 143821 - protein, 30 aa, Artificial Sequence
  Description of Artificial Sequence: Synthetic polypeptide
QEEEIATTNPVATEQYGEAGEVCCRHEEKF

SEQ ID NO: 143822 - protein, 35 aa, Artificial Sequence
  Description of Artificial Sequence: Synthetic polypeptide
AEDEIRTTNPVAYEQWGSVCSTENDQRNDIQGGDA

SEQ ID NO: 143823 - protein, 35 aa, Artificial Sequence
  Description of Artificial Sequence: Synthetic polypeptide
AEDEIRTTNPVAYEQWGSVCSTENDQRNDTQIGDH

SEQ ID NO: 143824 - protein, 38 aa, Artificial Sequence
  Description of Artificial Sequence: Synthetic polypeptide
AEEEIRTTNPVATEQYGSVTVVVTTNLQQGNVTEEEEE

SEQ ID NO: 143825 - protein, 37 aa, Artificial Sequence
  Description of Artificial Sequence: Synthetic polypeptide
DEEEIRTTNPVATEQYGSVLWVNLGSEEARSTVNELQ

SEQ ID NO: 143826 - protein, 36 aa, Artificial Sequence
  Description of Artificial Sequence: Synthetic polypeptide
DECEICTVNPVATEQYGSVSTVNQQGSEQGNNDDED

SEQ ID NO: 143827 - protein, 35 aa, Artificial Sequence
  Description of Artificial Sequence: Synthetic polypeptide
AEDEIRTTNPVAYEQWGSVCSTENHQRNDTQNGDA

SEQ ID NO: 143828 - protein, 35 aa, Artificial Sequence
  Description of Artificial Sequence: Synthetic polypeptide
AEDEIRTTNPVAYEQWGSVCSTTDDQDHQGRNDAR

SEQ ID NO: 143829 - protein, 38 aa, Artificial Sequence
  Description of Artificial Sequence: Synthetic polypeptide
AEEEIRTTNPVATEQYGSVTVVVTTNLQQGTTTEENEE

SEQ ID NO: 143830 - protein, 35 aa, Artificial Sequence
  Description of Artificial Sequence: Synthetic polypeptide
VEEEIRTTNPVATEGYGSVSTGQGDGQGEEEGGQT

SEQ ID NO: 143831 - protein, 37 aa, Artificial Sequence
  Description of Artificial Sequence: Synthetic polypeptide
DEEEIRTTNPVATEQYGSVLWVNLGSEEARSMVNLTQ

SEQ ID NO: 143832 - protein, 37 aa, Artificial Sequence
  Description of Artificial Sequence: Synthetic polypeptide
DECEICTVNPVATEQYGSVSTVVNNLQEAEQGTNNTD

SEQ ID NO: 143833 - protein, 30 aa, Artificial Sequence
  Description of Artificial Sequence: Synthetic polypeptide
DEDCIACTNPVAYEQWGQVSAIAVQRDDNN

SEQ ID NO: 143834 - protein, 37 aa, Artificial Sequence
  Description of Artificial Sequence: Synthetic polypeptide
DEEEIRTTNPVATEQYGSVGSWTPNMVQPTQTVQEHD

SEQ ID NO: 143835 - protein, 33 aa, Artificial Sequence
  Description of Artificial Sequence: Synthetic polypeptide
DESEIRTTNPVATEAWGVVSVNNNNNNDEGENG

SEQ ID NO: 143836 - protein, 30 aa, Artificial Sequence
  Description of Artificial Sequence: Synthetic polypeptide
QEEEIATTNPVATEQYGEAPAEEVCQHEEK

SEQ ID NO: 143837 - protein, 33 aa, Artificial Sequence
  Description of Artificial Sequence: Synthetic polypeptide
CEDEIATTNPVAYEQYGSVAIANNDTQDNGSNQ

SEQ ID NO: 143838 - protein, 37 aa, Artificial Sequence
  Description of Artificial Sequence: Synthetic polypeptide
DEEEIRTTNPVATEQYGSVGSWTPNVVQPTQMVEEAD

SEQ ID NO: 143839 - protein, 33 aa, Artificial Sequence
  Description of Artificial Sequence: Synthetic polypeptide
AEDEIRTTNPVAYEQWGVVSGGNLQDNHPNMGS

SEQ ID NO: 143840 - protein, 30 aa, Artificial Sequence
  Description of Artificial Sequence: Synthetic polypeptide
QEEEIATTNPVATEQYGEAPERVCQHEEKW

SEQ ID NO: 143841 - protein, 35 aa, Artificial Sequence
  Description of Artificial Sequence: Synthetic polypeptide
VEEEIRTTNPVATEQYGDVVTGIQNDGQEDIGEEF

SEQ ID NO: 143842 - protein, 37 aa, Artificial Sequence
  Description of Artificial Sequence: Synthetic polypeptide
DEEEIRTTNPVATEQYGSVGSWTPNVWQPDQMVQEHD

SEQ ID NO: 143843 - protein, 35 aa, Artificial Sequence
  Description of Artificial Sequence: Synthetic polypeptide
VEEEIRTTNPVATEQYGDVVTGIQNDGQEGEGGEQ

SEQ ID NO: 143844 - protein, 36 aa, Artificial Sequence
  Description of Artificial Sequence: Synthetic polypeptide
DEEEIRTTNPVATEQYGSVGSWTPSVQPTQDVQEHD

SEQ ID NO: 143845 - protein, 36 aa, Artificial Sequence
  Description of Artificial Sequence: Synthetic polypeptide
VEEEIRTTNPVATEQYGDVVTGIQNDGQEGNGQDES

SEQ ID NO: 143846 - protein, 36 aa, Artificial Sequence
  Description of Artificial Sequence: Synthetic polypeptide
VEEEIRTTNPVATEQYGDVVTGIQNDGQEGQGTNEF

SEQ ID NO: 143847 - protein, 37 aa, Artificial Sequence
  Description of Artificial Sequence: Synthetic polypeptide
DEEEIRTTNPVATEQYGSVGSWTSNTVQPTQMVQEHD

SEQ ID NO: 143848 - protein, 30 aa, Artificial Sequence
  Description of Artificial Sequence: Synthetic polypeptide
QEEEIATTNPVATEQYGEAPAEVCQSHEEK

SEQ ID NO: 143849 - protein, 35 aa, Artificial Sequence
  Description of Artificial Sequence: Synthetic polypeptide
DECTICTTNPVATEQYGVVSVTTTNPQQGNGNNDD

SEQ ID NO: 143850 - protein, 35 aa, Artificial Sequence
  Description of Artificial Sequence: Synthetic polypeptide
VEEEIRTTNPVATEQYGEVSDGVTGLGGDGGGETG

SEQ ID NO: 143851 - protein, 37 aa, Artificial Sequence
  Description of Artificial Sequence: Synthetic polypeptide
DEEEIRTTNPVATEAYGVVSTTNNQQLGNNQEDEEDT

SEQ ID NO: 143852 - protein, 38 aa, Artificial Sequence
  Description of Artificial Sequence: Synthetic polypeptide
DEEEIRTTNPVATEAYGVVSTTNNQQLGNQQGTEQGNT

SEQ ID NO: 143853 - protein, 35 aa, Artificial Sequence
  Description of Artificial Sequence: Synthetic polypeptide
DECTICTTNPVATEQYGVVSTVTGNQNQQGNGNVD

SEQ ID NO: 143854 - protein, 33 aa, Artificial Sequence
  Description of Artificial Sequence: Synthetic polypeptide
CEDEIATTNPVAYEQYGSVAATNDTATGDNQDS

SEQ ID NO: 143855 - protein, 30 aa, Artificial Sequence
  Description of Artificial Sequence: Synthetic polypeptide
QEEEIATTNPVATEQYGEAPESVCQVHEEK

SEQ ID NO: 143856 - protein, 37 aa, Artificial Sequence
  Description of Artificial Sequence: Synthetic polypeptide
DEEEIRTTNPVATEAYGVVSTTNNQNNNQQGNTTTTD

SEQ ID NO: 143857 - protein, 35 aa, Artificial Sequence
  Description of Artificial Sequence: Synthetic polypeptide
VEEEIRTTNPVATEQYGDVVGVGNMTNGQGNEEIG

SEQ ID NO: 143858 - protein, 29 aa, Artificial Sequence
  Description of Artificial Sequence: Synthetic peptide
QEEEIATTNPVATEQYGEAPAEVCEHEEK

SEQ ID NO: 143859 - protein, 34 aa, Artificial Sequence
  Description of Artificial Sequence: Synthetic polypeptide
CEDEIATTNPVAYEQYGSVAIANNDTQDNGNQRV

SEQ ID NO: 143860 - protein, 36 aa, Artificial Sequence
  Description of Artificial Sequence: Synthetic polypeptide
VEEEIRTTNPVATEQYGDVDTGIQNDVGQEGIGNEF

SEQ ID NO: 143861 - protein, 38 aa, Artificial Sequence
  Description of Artificial Sequence: Synthetic polypeptide
DEEEIRTTNPVATEAYGVVSTTNNNLQQGNQQGTTDEE

SEQ ID NO: 143862 - protein, 37 aa, Artificial Sequence
  Description of Artificial Sequence: Synthetic polypeptide
DEEEIRTTNPVATEAYGVVSTTNNNQQQLQQATNVTE

SEQ ID NO: 143863 - protein, 37 aa, Artificial Sequence
  Description of Artificial Sequence: Synthetic polypeptide
DEEEIRTTNPVATEAYGVVSTTNNQDQQGNNQEEEED

SEQ ID NO: 143864 - protein, 34 aa, Artificial Sequence
  Description of Artificial Sequence: Synthetic polypeptide
CEDEIATTNPVAYEQYGSVAIANNDTQDNGENRK

SEQ ID NO: 143865 - protein, 34 aa, Artificial Sequence
  Description of Artificial Sequence: Synthetic polypeptide
VEEEIRTTNPVATEQYGDVVDGNFTDQQNIGGDN

SEQ ID NO: 143866 - protein, 35 aa, Artificial Sequence
  Description of Artificial Sequence: Synthetic polypeptide
VEEEIRTTNPVATEQYGDVVDTMGLGGGEEDNEGI

SEQ ID NO: 143867 - protein, 35 aa, Artificial Sequence
  Description of Artificial Sequence: Synthetic polypeptide
VEEEIRTTNPVATEQYGDVVDTVGLGIGEEDNEGT

SEQ ID NO: 143868 - protein, 37 aa, Artificial Sequence
  Description of Artificial Sequence: Synthetic polypeptide
DEEEIRTTNPVATEAYGVVSTTNNQEQQGNNQEDEND

SEQ ID NO: 143869 - protein, 33 aa, Artificial Sequence
  Description of Artificial Sequence: Synthetic polypeptide
DECYIYTTNPVATESYGSVSTNTMMTFESNNTY

SEQ ID NO: 143870 - protein, 33 aa, Artificial Sequence
  Description of Artificial Sequence: Synthetic polypeptide
VEEEIRTTNPVATEQYGDVVGVGNMNDGTGQGG

SEQ ID NO: 143871 - protein, 30 aa, Artificial Sequence
  Description of Artificial Sequence: Synthetic polypeptide
QEEEIATTNPVATEQYGEAPAEVCQHEAEK

SEQ ID NO: 143872 - protein, 33 aa, Artificial Sequence
  Description of Artificial Sequence: Synthetic polypeptide
VEEEIRTTNPVATEQYGDVVGVGNMTDGQGQGI

SEQ ID NO: 143873 - protein, 35 aa, Artificial Sequence
  Description of Artificial Sequence: Synthetic polypeptide
AEDEIRTTNPVAYEQWGSVVCTDNHQGQQDGDQNR

SEQ ID NO: 143874 - protein, 34 aa, Artificial Sequence
  Description of Artificial Sequence: Synthetic polypeptide
DESEIRTTNPVATECWGSVCSCINEPEDFEGENG

SEQ ID NO: 143875 - protein, 36 aa, Artificial Sequence
  Description of Artificial Sequence: Synthetic polypeptide
VEEEIRTTNPVATDQYGSVVDQTLNEGQSEEEGGNE

SEQ ID NO: 143876 - protein, 35 aa, Artificial Sequence
  Description of Artificial Sequence: Synthetic polypeptide
AEDEIRTTNPVAYEQWGSVCSTENDQREDTQNGDD

SEQ ID NO: 143877 - protein, 38 aa, Artificial Sequence
  Description of Artificial Sequence: Synthetic polypeptide
DEEEIRTTNPVATEAYGVVSTTNLQQGSNLQQGTEQGS

SEQ ID NO: 143878 - protein, 38 aa, Artificial Sequence
  Description of Artificial Sequence: Synthetic polypeptide
DEEEIRTTNPVATEAYGVVSTTNLQYGSNTEQGSTQDD

SEQ ID NO: 143879 - protein, 35 aa, Artificial Sequence
  Description of Artificial Sequence: Synthetic polypeptide
QEEEIATTNPVAYEQWGNPVAATNLQDRPQGEDNH

SEQ ID NO: 143880 - protein, 38 aa, Artificial Sequence
  Description of Artificial Sequence: Synthetic polypeptide
AEEEIRTTNPVATEQYGSVTVVVTTNLLQQGNNEEEEL

SEQ ID NO: 143881 - protein, 37 aa, Artificial Sequence
  Description of Artificial Sequence: Synthetic polypeptide
DEEEIRTTNPVATEAYGVVSTTNNGQQGNNQEDEEES

SEQ ID NO: 143882 - protein, 37 aa, Artificial Sequence
  Description of Artificial Sequence: Synthetic polypeptide
DEEEIRTTNPVATEAYGVVSTTNNGQQGNNTEDEEDQ

SEQ ID NO: 143883 - protein, 37 aa, Artificial Sequence
  Description of Artificial Sequence: Synthetic polypeptide
AEEEIRTTNPVATEQYGSVTVVVTNQQQGNNGEENEE

SEQ ID NO: 143884 - protein, 29 aa, Artificial Sequence
  Description of Artificial Sequence: Synthetic peptide
QEEEIATTNPVAYEQWGVAYYVEQHGEEG

SEQ ID NO: 143885 - protein, 28 aa, Artificial Sequence
  Description of Artificial Sequence: Synthetic peptide
QEEEIATTNPVAYEQWGYAYEVCQHEEG

SEQ ID NO: 143886 - protein, 36 aa, Artificial Sequence
  Description of Artificial Sequence: Synthetic polypeptide
DEEEIRTTNPVATEQYGSVGSWNPNVDMTQMVQEAD

SEQ ID NO: 143887 - protein, 29 aa, Artificial Sequence
  Description of Artificial Sequence: Synthetic peptide
QEEEIATTNPVAYEQYGEACEVCCQHEQK

SEQ ID NO: 143888 - protein, 36 aa, Artificial Sequence
  Description of Artificial Sequence: Synthetic polypeptide
DEEEIRTTNPVATEQYGAVVDQDTMNLDTGIEQEDG

SEQ ID NO: 143889 - protein, 36 aa, Artificial Sequence
  Description of Artificial Sequence: Synthetic polypeptide
DECEICTVNPVATEQYGSVSTTTNNLGEEQGTNNTD

SEQ ID NO: 143890 - protein, 35 aa, Artificial Sequence
  Description of Artificial Sequence: Synthetic polypeptide
DEEEIRTTNPVATEQYGCTCSWNEHNQENFNSNQA

SEQ ID NO: 143891 - protein, 35 aa, Artificial Sequence
  Description of Artificial Sequence: Synthetic polypeptide
DESEIRTTNPVATECWGSTWSNCINEPQERKGENI

SEQ ID NO: 143892 - protein, 34 aa, Artificial Sequence
  Description of Artificial Sequence: Synthetic polypeptide
DEDCIRTTNPVATEQWGQVFWTNNALQLVQNEKQ

SEQ ID NO: 143893 - protein, 37 aa, Artificial Sequence
  Description of Artificial Sequence: Synthetic polypeptide
AEEEIRTTNPVATEQYGSVTVVVTNNQQQGNGEETEE

SEQ ID NO: 143894 - protein, 34 aa, Artificial Sequence
  Description of Artificial Sequence: Synthetic polypeptide
DESEIRTTNPVATECWGSVACIDEPQDREGENYG

SEQ ID NO: 143895 - protein, 35 aa, Artificial Sequence
  Description of Artificial Sequence: Synthetic polypeptide
DESEIRTTNPVATECWGSVCSACDNEPQDFEGENG

SEQ ID NO: 143896 - protein, 38 aa, Artificial Sequence
  Description of Artificial Sequence: Synthetic polypeptide
AEEEIRTTNPVATEQYGSVTVVVTNNLQQGNIAEENEE

SEQ ID NO: 143897 - protein, 34 aa, Artificial Sequence
  Description of Artificial Sequence: Synthetic polypeptide
DEEEIRTTNPVATEQYGCVAAAAQPTLEHTNNEQ

SEQ ID NO: 143898 - protein, 34 aa, Artificial Sequence
  Description of Artificial Sequence: Synthetic polypeptide
DEEEIRTTNPVATEQYGCVAAAAKPTEAEGTNGE

SEQ ID NO: 143899 - protein, 38 aa, Artificial Sequence
  Description of Artificial Sequence: Synthetic polypeptide
AEEEIRTTNPVATEQYGSVTVVVTNNLQQGNTGEENEE

SEQ ID NO: 143900 - protein, 38 aa, Artificial Sequence
  Description of Artificial Sequence: Synthetic polypeptide
AEEEIRTTNPVATEQYGSVTVVVTNNLQQGTNGEENED

SEQ ID NO: 143901 - protein, 35 aa, Artificial Sequence
  Description of Artificial Sequence: Synthetic polypeptide
DEDCIRTTNPVATEQWGSVATGNMLSIYNGGNNDF

SEQ ID NO: 143902 - protein, 38 aa, Artificial Sequence
  Description of Artificial Sequence: Synthetic polypeptide
AEEEIRTTNPVATEQYGSVTVVVTNNNLQQGNTEENEE

SEQ ID NO: 143903 - protein, 34 aa, Artificial Sequence
  Description of Artificial Sequence: Synthetic polypeptide
DEEEIRTTNPVATEQYGCVAAAAEPTLEGMTNGE

SEQ ID NO: 143904 - protein, 33 aa, Artificial Sequence
  Description of Artificial Sequence: Synthetic polypeptide
DESEIRTTNPVATECWGSVANCIDEPQEREGPG

SEQ ID NO: 143905 - protein, 30 aa, Artificial Sequence
  Description of Artificial Sequence: Synthetic polypeptide
QEEEIATTNPVATEQYGEACPEVGNQHEEK

SEQ ID NO: 143906 - protein, 35 aa, Artificial Sequence
  Description of Artificial Sequence: Synthetic polypeptide
DEDCIRTTNPVATEQWGSVATGNANSIYNGGNNRN

SEQ ID NO: 143907 - protein, 34 aa, Artificial Sequence
  Description of Artificial Sequence: Synthetic polypeptide
DEDCIRTTNPVATEQWGSVATGGMWSQANGGNNG

SEQ ID NO: 143908 - protein, 31 aa, Artificial Sequence
  Description of Artificial Sequence: Synthetic polypeptide
QEEEIATTNPVATEQYGEACPSEPVEQMIEQ

SEQ ID NO: 143909 - protein, 34 aa, Artificial Sequence
  Description of Artificial Sequence: Synthetic polypeptide
DESEIRTTNPVATECWGSVACIDWPQDREGENYG

SEQ ID NO: 143910 - protein, 35 aa, Artificial Sequence
  Description of Artificial Sequence: Synthetic polypeptide
DESEIRTTNPVATECWGSTVSNCIDEPQDRKGENG

SEQ ID NO: 143911 - protein, 34 aa, Artificial Sequence
  Description of Artificial Sequence: Synthetic polypeptide
VEEEIATTNPVATEQYGSVCAATMGEEAGDNMNN

SEQ ID NO: 143912 - protein, 35 aa, Artificial Sequence
  Description of Artificial Sequence: Synthetic polypeptide
VEEEIATTNPVATEQYGSVCAMNNGLEPTDSLGER

SEQ ID NO: 143913 - protein, 36 aa, Artificial Sequence
  Description of Artificial Sequence: Synthetic polypeptide
DEEEIRTTNPVATEQYGSVGSWTPCVQETQMVQEHD

SEQ ID NO: 143914 - protein, 35 aa, Artificial Sequence
  Description of Artificial Sequence: Synthetic polypeptide
QEEEICTTNPEAYTTEQWGSVATNLQHAGNTNGVM

SEQ ID NO: 143915 - protein, 34 aa, Artificial Sequence
  Description of Artificial Sequence: Synthetic polypeptide
DEDCIRCTNPVAYEQYGSVVSWNEFSDRGGNNLM

SEQ ID NO: 143916 - protein, 32 aa, Artificial Sequence
  Description of Artificial Sequence: Synthetic polypeptide
CEDEIATTNPVAYEQYGSVAITHDQDSGSDEY

SEQ ID NO: 143917 - protein, 38 aa, Artificial Sequence
  Description of Artificial Sequence: Synthetic polypeptide
AEEEIRTTNPVATEQYGSVTVVVTTNLQQGNTAEETEE

SEQ ID NO: 143918 - protein, 34 aa, Artificial Sequence
  Description of Artificial Sequence: Synthetic polypeptide
DESEIRTTNPVATECWGSTVSAENEPQEPEGEPG

SEQ ID NO: 143919 - protein, 34 aa, Artificial Sequence
  Description of Artificial Sequence: Synthetic polypeptide
DESEIRTTNPVATECWGSTVACENWPQDPEGNYI

SEQ ID NO: 143920 - protein, 36 aa, Artificial Sequence
  Description of Artificial Sequence: Synthetic polypeptide
DECEICTVNPVATEQYGSVSTTTNQQNEENGTNNTD

SEQ ID NO: 143921 - protein, 34 aa, Artificial Sequence
  Description of Artificial Sequence: Synthetic polypeptide
DESEIRTTNPVATEAWGCVCSWMNENQDRFNSNQ

SEQ ID NO: 143922 - protein, 36 aa, Artificial Sequence
  Description of Artificial Sequence: Synthetic polypeptide
VEEEIRTTNCVATEQYGSVSDNGQNEDQNNEGGNQG

SEQ ID NO: 143923 - protein, 35 aa, Artificial Sequence
  Description of Artificial Sequence: Synthetic polypeptide
DESEIRTTNPVATECWGSTVAAINEPQEREGENYG

SEQ ID NO: 143924 - protein, 35 aa, Artificial Sequence
  Description of Artificial Sequence: Synthetic polypeptide
DESEIRTTNPVATEAWGCVCSWMNENQERFGSNQM

SEQ ID NO: 143925 - protein, 35 aa, Artificial Sequence
  Description of Artificial Sequence: Synthetic polypeptide
VEEEIRTTNPAATEQYGSVSDQDNGEFTGEEANED

SEQ ID NO: 143926 - protein, 37 aa, Artificial Sequence
  Description of Artificial Sequence: Synthetic polypeptide
AEDEIRTTNPVATEQYGVVSTVVNNQQQLQQAGTNED

SEQ ID NO: 143927 - protein, 37 aa, Artificial Sequence
  Description of Artificial Sequence: Synthetic polypeptide
DEEEIRTTNPVATEQYGSVGSWTPNMVINTQMVQQAD

SEQ ID NO: 143928 - protein, 29 aa, Artificial Sequence
  Description of Artificial Sequence: Synthetic peptide
QEEEIATTNPVAYEQYGEAPCVCQHEEEK

SEQ ID NO: 143929 - protein, 35 aa, Artificial Sequence
  Description of Artificial Sequence: Synthetic polypeptide
DEEEIRTTNPVATEQYGCTCSTGEHNAENFGSDQA

SEQ ID NO: 143930 - protein, 36 aa, Artificial Sequence
  Description of Artificial Sequence: Synthetic polypeptide
VEEEIRTTNPMATEQYGSVSSTTPAGPNMRNGMNPV

SEQ ID NO: 143931 - protein, 38 aa, Artificial Sequence
  Description of Artificial Sequence: Synthetic polypeptide
AEEEIRTTNPVATEQYGSVTVVVTTNLQQGNNGEEQEE

SEQ ID NO: 143932 - protein, 29 aa, Artificial Sequence
  Description of Artificial Sequence: Synthetic peptide
QEEEIATTNPVATEQYGEAFPEVCAHEEK

SEQ ID NO: 143933 - protein, 34 aa, Artificial Sequence
  Description of Artificial Sequence: Synthetic polypeptide
DEEEIRTTNPVATEQYGCTCSWGEHNQNFGSQQS

SEQ ID NO: 143934 - protein, 38 aa, Artificial Sequence
  Description of Artificial Sequence: Synthetic polypeptide
AEEEIRTTNPVATEQYGSVTVVVTTNLQAGNIAEENEE

SEQ ID NO: 143935 - protein, 33 aa, Artificial Sequence
  Description of Artificial Sequence: Synthetic polypeptide
WEQEIATTNPVAIEQYGSVSATDLEDHEGGEDL

SEQ ID NO: 143936 - protein, 35 aa, Artificial Sequence
  Description of Artificial Sequence: Synthetic polypeptide
DESEIRTTNPVATECWGSTVSCINEPQDREGEPYG

SEQ ID NO: 143937 - protein, 35 aa, Artificial Sequence
  Description of Artificial Sequence: Synthetic polypeptide
DESEIRTTNPVATDSYGSVVTQNGLGQLFTEGDQL

SEQ ID NO: 143938 - protein, 35 aa, Artificial Sequence
  Description of Artificial Sequence: Synthetic polypeptide
DEEEIRTTNPVATEQYGCTCSWEEHNANFGSDNQS

SEQ ID NO: 143939 - protein, 38 aa, Artificial Sequence
  Description of Artificial Sequence: Synthetic polypeptide
AEEEIRTTNPVATEQYGSVTVVVTTNLQQGNEGEEDED

SEQ ID NO: 143940 - protein, 36 aa, Artificial Sequence
  Description of Artificial Sequence: Synthetic polypeptide
DEEEIRTTNPVATEQYGSVGSWTPMVQPTQMVQEHI

SEQ ID NO: 143941 - protein, 37 aa, Artificial Sequence
  Description of Artificial Sequence: Synthetic polypeptide
AEDEIRTTNPVATEQYGVVSTVVNNQLNQQQGTTNVD

SEQ ID NO: 143942 - protein, 36 aa, Artificial Sequence
  Description of Artificial Sequence: Synthetic polypeptide
DEEEIRTTNPVATEQYGCTCSTTNEHNQENFGSDQS

SEQ ID NO: 143943 - protein, 37 aa, Artificial Sequence
  Description of Artificial Sequence: Synthetic polypeptide
DEEEIRTTNPVATEQYGSVMENTNVQGINLVAENLGG

SEQ ID NO: 143944 - protein, 36 aa, Artificial Sequence
  Description of Artificial Sequence: Synthetic polypeptide
DESEIRTTNPVATECWGSTVSCINEEPQDRTGGNNG

SEQ ID NO: 143945 - protein, 36 aa, Artificial Sequence
  Description of Artificial Sequence: Synthetic polypeptide
DECEICTVNPVATEQYGSVSTTTNQQEDEIGTNNTD

SEQ ID NO: 143946 - protein, 32 aa, Artificial Sequence
  Description of Artificial Sequence: Synthetic polypeptide
VEEEIATTNPVGYEACYGPTVVLTDAQRGVNQ

SEQ ID NO: 143947 - protein, 33 aa, Artificial Sequence
  Description of Artificial Sequence: Synthetic polypeptide
AEEEIACTNPVATEQYGCVATNLAAMPGGEQPE

SEQ ID NO: 143948 - protein, 34 aa, Artificial Sequence
  Description of Artificial Sequence: Synthetic polypeptide
VEEEIMGTNPVATFFYNGESVSTMMNLRGDGNGP

SEQ ID NO: 143949 - protein, 30 aa, Artificial Sequence
  Description of Artificial Sequence: Synthetic polypeptide
DESEIRSTNPVSTEQWGNVANTEMSAAEDR

SEQ ID NO: 143950 - protein, 33 aa, Artificial Sequence
  Description of Artificial Sequence: Synthetic polypeptide
DEDEIATTNPVATEQYGCVAATGTDTDDNGTRT

SEQ ID NO: 143951 - protein, 33 aa, Artificial Sequence
  Description of Artificial Sequence: Synthetic polypeptide
DEDEIATTNPVATEQYGCVAATNDATMPGGEPN

SEQ ID NO: 143952 - protein, 36 aa, Artificial Sequence
  Description of Artificial Sequence: Synthetic polypeptide
TEEEIRTTNPVATEQYGSVCINTEGMQTEEVGENVE

SEQ ID NO: 143953 - protein, 35 aa, Artificial Sequence
  Description of Artificial Sequence: Synthetic polypeptide
TEEEIRTTNPVATEQYGSVCMNTSGMVTEEVLENV

SEQ ID NO: 143954 - protein, 36 aa, Artificial Sequence
  Description of Artificial Sequence: Synthetic polypeptide
TEEEIRTTNPVATEQYGSVCSNTEGMQTEEVMIENV

SEQ ID NO: 143955 - protein, 35 aa, Artificial Sequence
  Description of Artificial Sequence: Synthetic polypeptide
TEEEIRTTNPVATEQYGSVCSNTEGMQTEEVPELV

SEQ ID NO: 143956 - protein, 36 aa, Artificial Sequence
  Description of Artificial Sequence: Synthetic polypeptide
DEEEIRTTNPVATEQYGSVIGPTNELLSMPLEIEDT

SEQ ID NO: 143957 - protein, 36 aa, Artificial Sequence
  Description of Artificial Sequence: Synthetic polypeptide
TEEEIRTTNPVATEQYGSVCSNTPGMQTEEVLENVA

SEQ ID NO: 143958 - protein, 36 aa, Artificial Sequence
  Description of Artificial Sequence: Synthetic polypeptide
AEEEIRATNPCATEQYGVVSTVNNQLGNQQQGTNED

SEQ ID NO: 143959 - protein, 34 aa, Artificial Sequence
  Description of Artificial Sequence: Synthetic polypeptide
DEDEIATTNPVAYEQWGSVAITNNPTQTGNGDEH

SEQ ID NO: 143960 - protein, 36 aa, Artificial Sequence
  Description of Artificial Sequence: Synthetic polypeptide
TEEEIRTTNPVATEQYGSVDDTVNMGDIGEDGNNGT

SEQ ID NO: 143961 - protein, 37 aa, Artificial Sequence
  Description of Artificial Sequence: Synthetic polypeptide
TEEEIRTTNPVATEQYGSVDNTTVANFGQNEGGNQGD

SEQ ID NO: 143962 - protein, 34 aa, Artificial Sequence
  Description of Artificial Sequence: Synthetic polypeptide
DEDEIATTNPVAYEQWGSVAATANGQAAPGGNNQ

SEQ ID NO: 143963 - protein, 35 aa, Artificial Sequence
  Description of Artificial Sequence: Synthetic polypeptide
TEEEIRTTNPVATEQYGSVGDFGNDGQENDDFNNT

SEQ ID NO: 143964 - protein, 34 aa, Artificial Sequence
  Description of Artificial Sequence: Synthetic polypeptide
DESEICTTNPVATEQYGTTVPSATDGPSEFEGND

SEQ ID NO: 143965 - protein, 36 aa, Artificial Sequence
  Description of Artificial Sequence: Synthetic polypeptide
TEEEIRTTNPVATEQYGSVGDFGNDGQENDDGNIGN

SEQ ID NO: 143966 - protein, 36 aa, Artificial Sequence
  Description of Artificial Sequence: Synthetic polypeptide
TEEEIRTTNPVATEQYGSVDDFTVNTGQEEGEGGEF

SEQ ID NO: 143967 - protein, 32 aa, Artificial Sequence
  Description of Artificial Sequence: Synthetic polypeptide
DEDEIATTNPVAYEQWGSVCGDSGGQQGNQMT

SEQ ID NO: 143968 - protein, 34 aa, Artificial Sequence
  Description of Artificial Sequence: Synthetic polypeptide
DECEICTTNPVATEQYGSVSTVTAQEETTEEEDD

SEQ ID NO: 143969 - protein, 34 aa, Artificial Sequence
  Description of Artificial Sequence: Synthetic polypeptide
TEEEIRTTNPVATEQYGSVAVHLAPLINGQFQMP

SEQ ID NO: 143970 - protein, 35 aa, Artificial Sequence
  Description of Artificial Sequence: Synthetic polypeptide
DEEEIRTTNPVATEQYGCVCSNWGEDLEGFGSEQA

SEQ ID NO: 143971 - protein, 34 aa, Artificial Sequence
  Description of Artificial Sequence: Synthetic polypeptide
DEDEIATTNPVAYEQWGSVCSTDNDQQIEGGDEI

SEQ ID NO: 143972 - protein, 35 aa, Artificial Sequence
  Description of Artificial Sequence: Synthetic polypeptide
DEEEIRTTNPVATEQYGCVCSNWGEDHQNFGSDQA

SEQ ID NO: 143973 - protein, 37 aa, Artificial Sequence
  Description of Artificial Sequence: Synthetic polypeptide
DEEEIRTTNPVATEQYGSVMSGMNMDLGEGESIFGDG

SEQ ID NO: 143974 - protein, 36 aa, Artificial Sequence
  Description of Artificial Sequence: Synthetic polypeptide
DEEEIRTTNPVATECWGSVWSTTPAGPAMRKGMNYV

SEQ ID NO: 143975 - protein, 34 aa, Artificial Sequence
  Description of Artificial Sequence: Synthetic polypeptide
DESEIRTTNPVATEFWGSVSCIIEPRDREGERIG

SEQ ID NO: 143976 - protein, 33 aa, Artificial Sequence
  Description of Artificial Sequence: Synthetic polypeptide
AEEEIRATNPVATEQWGSVSANNHDEAPSGSFT

SEQ ID NO: 143977 - protein, 34 aa, Artificial Sequence
  Description of Artificial Sequence: Synthetic polypeptide
DESEIRTTNPVATEFWGSGMCINEPQDRVGENGH

SEQ ID NO: 143978 - protein, 34 aa, Artificial Sequence
  Description of Artificial Sequence: Synthetic polypeptide
DEDEIATTNPVAYEQWGSVCPTFEDQITRDGGER

SEQ ID NO: 143979 - protein, 36 aa, Artificial Sequence
  Description of Artificial Sequence: Synthetic polypeptide
AEEEIRATNPCATEQYGVVSTVVNQLENQQIGTNVD

SEQ ID NO: 143980 - protein, 36 aa, Artificial Sequence
  Description of Artificial Sequence: Synthetic polypeptide
DECEICTTNPVATEQYGSVSTVTANQNGNTEEAEDD

SEQ ID NO: 143981 - protein, 36 aa, Artificial Sequence
  Description of Artificial Sequence: Synthetic polypeptide
DEEEIRTTNPVATECWGSVWSTTPAGPAERKGMNYV

SEQ ID NO: 143982 - protein, 32 aa, Artificial Sequence
  Description of Artificial Sequence: Synthetic polypeptide
DEDEIATTNPVAYEQWGSVCGDSQGQGGNNQH

SEQ ID NO: 143983 - protein, 33 aa, Artificial Sequence
  Description of Artificial Sequence: Synthetic polypeptide
DEDEIATTNPVAYEQWGSVCGDSNGGQQGNSMD

SEQ ID NO: 143984 - protein, 36 aa, Artificial Sequence
  Description of Artificial Sequence: Synthetic polypeptide
AEEEIRATNPCATEQYGVVSTVNNQLNQQIGTNSVD

SEQ ID NO: 143985 - protein, 35 aa, Artificial Sequence
  Description of Artificial Sequence: Synthetic polypeptide
TEEEIRTTNPVATEQYGSVGINTEGMQTEEVLENV

SEQ ID NO: 143986 - protein, 36 aa, Artificial Sequence
  Description of Artificial Sequence: Synthetic polypeptide
TEEEIRTTNPVATEQYGSVGSLTVNTEEHPLAGPVS

SEQ ID NO: 143987 - protein, 36 aa, Artificial Sequence
  Description of Artificial Sequence: Synthetic polypeptide
TEEEIRTTNPVATEQYGSVGSTGDQLGDGGGEEDGI

SEQ ID NO: 143988 - protein, 35 aa, Artificial Sequence
  Description of Artificial Sequence: Synthetic polypeptide
DEEEIRTTNPVATECWGSVSSCPAGPNMRNGENPV

SEQ ID NO: 143989 - protein, 37 aa, Artificial Sequence
  Description of Artificial Sequence: Synthetic polypeptide
AEEEIRATNPCATEQYGSVSTVTNQLNNQQIGTNQED

SEQ ID NO: 143990 - protein, 35 aa, Artificial Sequence
  Description of Artificial Sequence: Synthetic polypeptide
QEEEIRTTNPVATEQYGMVGSNMNGQEDNGGDDDD

SEQ ID NO: 143991 - protein, 36 aa, Artificial Sequence
  Description of Artificial Sequence: Synthetic polypeptide
QEEEIRTTNPVATEQYGMVGSIMNQLEGQGGDQDDP

SEQ ID NO: 143992 - protein, 35 aa, Artificial Sequence
  Description of Artificial Sequence: Synthetic polypeptide
DEEEIRTTNPVATEQYGSVFGDMFDDEGGNVTNIQ

SEQ ID NO: 143993 - protein, 33 aa, Artificial Sequence
  Description of Artificial Sequence: Synthetic polypeptide
DEEEIATTNPVATEQWGSVAPGNGPAENPGEEQ

SEQ ID NO: 143994 - protein, 35 aa, Artificial Sequence
  Description of Artificial Sequence: Synthetic polypeptide
DEEEIRTTNPVATEQWGSVSMSGDGGQPHGGGQFP

SEQ ID NO: 143995 - protein, 32 aa, Artificial Sequence
  Description of Artificial Sequence: Synthetic polypeptide
DEDEIATTNPVAYEQWGMTSTNWNQGDGGDES

SEQ ID NO: 143996 - protein, 37 aa, Artificial Sequence
  Description of Artificial Sequence: Synthetic polypeptide
AEEEIRATNPCATEQYGSVSTVTNQLGNQQIGTNQVE

SEQ ID NO: 143997 - protein, 37 aa, Artificial Sequence
  Description of Artificial Sequence: Synthetic polypeptide
AEEEIRATNPCATEQYGSVSTVTNQLGNQQIGTNIAD

SEQ ID NO: 143998 - protein, 37 aa, Artificial Sequence
  Description of Artificial Sequence: Synthetic polypeptide
AEEEIRATNPCATEQYGSVSTVTNQLGNQNIGTNSVD

SEQ ID NO: 143999 - protein, 37 aa, Artificial Sequence
  Description of Artificial Sequence: Synthetic polypeptide
AEEEIRATNPCATEQYGSVSTVTNQLGNEQIGTNGVD

SEQ ID NO: 144000 - protein, 37 aa, Artificial Sequence
  Description of Artificial Sequence: Synthetic polypeptide
AEEEIRATNPCATEQYGSVSTVTNNLQNQQQGTNNVD

SEQ ID NO: 144001 - protein, 36 aa, Artificial Sequence
  Description of Artificial Sequence: Synthetic polypeptide
DEEEIRTTNPVATEQYGSVFGDPGQEEQGIEGGNQQ

SEQ ID NO: 144002 - protein, 36 aa, Artificial Sequence
  Description of Artificial Sequence: Synthetic polypeptide
QEEEIRTTNPVATEQYGIVSSTTPAGPNMRNGMNPV

SEQ ID NO: 144003 - protein, 35 aa, Artificial Sequence
  Description of Artificial Sequence: Synthetic polypeptide
DECEICTTNPVATEQYGSVSTVVANLEDTEEQEDD

SEQ ID NO: 144004 - protein, 34 aa, Artificial Sequence
  Description of Artificial Sequence: Synthetic polypeptide
QEEEIRTTNPVATEQYGMVNGSMDGEEFGMGENT

SEQ ID NO: 144005 - protein, 34 aa, Artificial Sequence
  Description of Artificial Sequence: Synthetic polypeptide
DEDEIATTNPVAYEQWGSVCSTENDMTDTQNGGA

SEQ ID NO: 144006 - protein, 37 aa, Artificial Sequence
  Description of Artificial Sequence: Synthetic polypeptide
AEEEIRATNPCATEQYGSVSTVTNQLQNAEQGTNNQD

SEQ ID NO: 144007 - protein, 37 aa, Artificial Sequence
  Description of Artificial Sequence: Synthetic polypeptide
AEEEIRATNPCATEQYGSVSTVTNQLQNQEQGTNNDE

SEQ ID NO: 144008 - protein, 36 aa, Artificial Sequence
  Description of Artificial Sequence: Synthetic polypeptide
AEEEIRATNPCATEQYGVVSTENNQLGNQQIGTNVD

SEQ ID NO: 144009 - protein, 34 aa, Artificial Sequence
  Description of Artificial Sequence: Synthetic polypeptide
DESEICTTNPVATEQYGTVCSATDGPSEFEGTND

SEQ ID NO: 144010 - protein, 34 aa, Artificial Sequence
  Description of Artificial Sequence: Synthetic polypeptide
DEEEIATTNPVATEQWGSVATGPPDNSEHNTDNV

SEQ ID NO: 144011 - protein, 35 aa, Artificial Sequence
  Description of Artificial Sequence: Synthetic polypeptide
AEEEIRATNPCATEQYGVVSTELQLQNQQIGTNVD

SEQ ID NO: 144012 - protein, 37 aa, Artificial Sequence
  Description of Artificial Sequence: Synthetic polypeptide
TEEEIRTTNPVATEQYGSVISSEGPGQTNTQVDPGIY

SEQ ID NO: 144013 - protein, 36 aa, Artificial Sequence
  Description of Artificial Sequence: Synthetic polypeptide
DEEEIRTTNPVATEQYGSVIGPTLNLLNMPVEIEDL

SEQ ID NO: 144014 - protein, 35 aa, Artificial Sequence
  Description of Artificial Sequence: Synthetic polypeptide
TEEEIRTTNPVATEQYGSVLAVTLAPLPINGQFTP

SEQ ID NO: 144015 - protein, 36 aa, Artificial Sequence
  Description of Artificial Sequence: Synthetic polypeptide
DEEEIRTTNPVATEQYGSVIGPTIVEIIERGDEDQG

SEQ ID NO: 144016 - protein, 37 aa, Artificial Sequence
  Description of Artificial Sequence: Synthetic polypeptide
AEEEIRATNPCATEQYGSVSTVVNQLDEQQIGTNNVD

SEQ ID NO: 144017 - protein, 36 aa, Artificial Sequence
  Description of Artificial Sequence: Synthetic polypeptide
DEEEIRTTNPVATEQWGSVSGGEPAGPNMRNGQNPQ

SEQ ID NO: 144018 - protein, 33 aa, Artificial Sequence
  Description of Artificial Sequence: Synthetic polypeptide
DEDEIATTNPVAYEQWGSTSTDNNQGNSGGDAD

SEQ ID NO: 144019 - protein, 36 aa, Artificial Sequence
  Description of Artificial Sequence: Synthetic polypeptide
AEEEIRATNPCATEQYGSVSTVTQQQGNQQIGTNVD

SEQ ID NO: 144020 - protein, 36 aa, Artificial Sequence
  Description of Artificial Sequence: Synthetic polypeptide
QEEEIRTTNPVATEQYGMVNVTDGEGNQGQGDGNDE

SEQ ID NO: 144021 - protein, 37 aa, Artificial Sequence
  Description of Artificial Sequence: Synthetic polypeptide
DEEEIRTTNPVATEQWGSVSGGTPEGPNMRNGMNPED

SEQ ID NO: 144022 - protein, 37 aa, Artificial Sequence
  Description of Artificial Sequence: Synthetic polypeptide
AEEEIRATNPCATEQYGSVSTVTNQLQNSEQGTNTVD

SEQ ID NO: 144023 - protein, 37 aa, Artificial Sequence
  Description of Artificial Sequence: Synthetic polypeptide
TEEEIRTTNPVATEQYGSVNSTTPAEGPNMENGMNDV

SEQ ID NO: 144024 - protein, 34 aa, Artificial Sequence
  Description of Artificial Sequence: Synthetic polypeptide
DECEICTTNPVATEQYGSVSTVVAQEDTEEDEED

SEQ ID NO: 144025 - protein, 34 aa, Artificial Sequence
  Description of Artificial Sequence: Synthetic polypeptide
DEDEIATTNPVAYEQWGSVCSTNDHDHPMGDHRR

SEQ ID NO: 144026 - protein, 36 aa, Artificial Sequence
  Description of Artificial Sequence: Synthetic polypeptide
QEEEIRTTNPVATEQYGMVSITDDEGNQGQGDGDDE

SEQ ID NO: 144027 - protein, 35 aa, Artificial Sequence
  Description of Artificial Sequence: Synthetic polypeptide
TEEEIRTTNPVATEQYGCVCNSGEHNQYFGSNNQA

SEQ ID NO: 144028 - protein, 36 aa, Artificial Sequence
  Description of Artificial Sequence: Synthetic polypeptide
DEEEIRTTNPVATEQYGSVFENVSNLIQFQEVELEV

SEQ ID NO: 144029 - protein, 34 aa, Artificial Sequence
  Description of Artificial Sequence: Synthetic polypeptide
DESEIRTTNPVATEGWGCVSWMNENQEHEGSNQS

SEQ ID NO: 144030 - protein, 36 aa, Artificial Sequence
  Description of Artificial Sequence: Synthetic polypeptide
DEEEIATTNPVATEQWGSVSATWPHGPDAQNGGNPV

SEQ ID NO: 144031 - protein, 36 aa, Artificial Sequence
  Description of Artificial Sequence: Synthetic polypeptide
DECEICTTNPVATEQYGSVSTVNDQSGSTEEEEDTE

SEQ ID NO: 144032 - protein, 36 aa, Artificial Sequence
  Description of Artificial Sequence: Synthetic polypeptide
DEEEIRTTNPVATEQYGCVCSNWGEHNQEGFNSNQS

SEQ ID NO: 144033 - protein, 34 aa, Artificial Sequence
  Description of Artificial Sequence: Synthetic polypeptide
DESEIRTTNPVATEGWGCVTSWMNENIERFGSNQ

SEQ ID NO: 144034 - protein, 35 aa, Artificial Sequence
  Description of Artificial Sequence: Synthetic polypeptide
TEEEIRTTNPVATEQYGCVCNTGAHNQNFGSDNQA

SEQ ID NO: 144035 - protein, 34 aa, Artificial Sequence
  Description of Artificial Sequence: Synthetic polypeptide
TEEEIRTTNPVATEQYGCVCNTGEHNQYFGSETQ

SEQ ID NO: 144036 - protein, 35 aa, Artificial Sequence
  Description of Artificial Sequence: Synthetic polypeptide
TEEEIRTTNPVATEQYGCVCQTGEPNQNFGSNTQS

SEQ ID NO: 144037 - protein, 35 aa, Artificial Sequence
  Description of Artificial Sequence: Synthetic polypeptide
DEEEIRTTNPVATEQYGCVCSNWGEHNIGFGSEQS

SEQ ID NO: 144038 - protein, 35 aa, Artificial Sequence
  Description of Artificial Sequence: Synthetic polypeptide
DEEEIRTTNPVATEQYGCVCSNWGEHNEGFNSEQA

SEQ ID NO: 144039 - protein, 36 aa, Artificial Sequence
  Description of Artificial Sequence: Synthetic polypeptide
TEEEIRTTNPVATEQYGDVVMGETNILTREGMDIGD

SEQ ID NO: 144040 - protein, 37 aa, Artificial Sequence
  Description of Artificial Sequence: Synthetic polypeptide
DEEEIRTTNPVATEQYGSVMSTGGMGQEEEEGDGGEG

SEQ ID NO: 144041 - protein, 33 aa, Artificial Sequence
  Description of Artificial Sequence: Synthetic polypeptide
DESEIRTTNPVATEGWGCVSWMNENADHFGSNQ

SEQ ID NO: 144042 - protein, 35 aa, Artificial Sequence
  Description of Artificial Sequence: Synthetic polypeptide
DESEIRTTNPVATEGWGCVTSWMNENQEREGSNQN

SEQ ID NO: 144043 - protein, 35 aa, Artificial Sequence
  Description of Artificial Sequence: Synthetic polypeptide
TEEEIRTTNPVATEQYGCVCGTGNPNQNFGSDTQS

SEQ ID NO: 144044 - protein, 36 aa, Artificial Sequence
  Description of Artificial Sequence: Synthetic polypeptide
DEEEIATTNPVATEQWGSVSCAGEGLQPDDEMNNRM

SEQ ID NO: 144045 - protein, 34 aa, Artificial Sequence
  Description of Artificial Sequence: Synthetic polypeptide
DESEIRTTNPVATEGWGSVCSWINENAEYEGSNQ

SEQ ID NO: 144046 - protein, 37 aa, Artificial Sequence
  Description of Artificial Sequence: Synthetic polypeptide
AEEEIRTTNPVATEAYGSVSTNTNNNQQGNNSTNDDT

SEQ ID NO: 144047 - protein, 35 aa, Artificial Sequence
  Description of Artificial Sequence: Synthetic polypeptide
DEEEIRTTNPVATEQYGCVCSNWGEHNQNFNSEQS

SEQ ID NO: 144048 - protein, 35 aa, Artificial Sequence
  Description of Artificial Sequence: Synthetic polypeptide
DEEEIRTTNPVATEQYGCVCSNWGEHNQNFNSDQA

SEQ ID NO: 144049 - protein, 36 aa, Artificial Sequence
  Description of Artificial Sequence: Synthetic polypeptide
AEEEIRTTNPVATEAYGSVSTNTDNGNVEQGEEDED

SEQ ID NO: 144050 - protein, 36 aa, Artificial Sequence
  Description of Artificial Sequence: Synthetic polypeptide
DECEICTTNPVATEQYGSVSTVNDQQGSTEEAEDEE

SEQ ID NO: 144051 - protein, 35 aa, Artificial Sequence
  Description of Artificial Sequence: Synthetic polypeptide
DEEEIRTTNPVATEQYGCVCSNWGEHNQHFGSEQA

SEQ ID NO: 144052 - protein, 33 aa, Artificial Sequence
  Description of Artificial Sequence: Synthetic polypeptide
DEDEIATTNPVAYEQWGSVSGEGPGQNAGNSDA

SEQ ID NO: 144053 - protein, 35 aa, Artificial Sequence
  Description of Artificial Sequence: Synthetic polypeptide
DEEEIRTTNPVATEQYGCVCSNWGEHNQGFGSEQE

SEQ ID NO: 144054 - protein, 36 aa, Artificial Sequence
  Description of Artificial Sequence: Synthetic polypeptide
DEEEIRTTNPVATEQYGCVCSNWGEHNQGFGSENQS

SEQ ID NO: 144055 - protein, 36 aa, Artificial Sequence
  Description of Artificial Sequence: Synthetic polypeptide
AEEEIRTTNPVATEAYGSVSTLTQQGNVEQGTEEES

SEQ ID NO: 144056 - protein, 32 aa, Artificial Sequence
  Description of Artificial Sequence: Synthetic polypeptide
DEEEIATTNPVATEPYGEAPEEDIQQQHNGNH

SEQ ID NO: 144057 - protein, 36 aa, Artificial Sequence
  Description of Artificial Sequence: Synthetic polypeptide
DECEICTTNPVATEQYGSVSTVNDQQGSTEEEEEDE

SEQ ID NO: 144058 - protein, 33 aa, Artificial Sequence
  Description of Artificial Sequence: Synthetic polypeptide
DEDEIATTNPVAYEQWGSVSGDNPDQGEHNGEA

SEQ ID NO: 144059 - protein, 35 aa, Artificial Sequence
  Description of Artificial Sequence: Synthetic polypeptide
QEEEIRTTNPVATEQYGSCGSVTGDNGQGDEQEQI

SEQ ID NO: 144060 - protein, 36 aa, Artificial Sequence
  Description of Artificial Sequence: Synthetic polypeptide
TEEEIRTTNPVATEQYGHVSSTTPAGPNMRNGMNPV

SEQ ID NO: 144061 - protein, 37 aa, Artificial Sequence
  Description of Artificial Sequence: Synthetic polypeptide
AEEEIRTTNPCATEQYGVVSTVNLQQGNTEQGTTEDE

SEQ ID NO: 144062 - protein, 33 aa, Artificial Sequence
  Description of Artificial Sequence: Synthetic polypeptide
DESEIRTTNPVATEGWGCVSWMEENQDRFGSQQ

SEQ ID NO: 144063 - protein, 35 aa, Artificial Sequence
  Description of Artificial Sequence: Synthetic polypeptide
DEEEIRTTNPVATEQWGSVSCAGEGPGPRDEMNNN

SEQ ID NO: 144064 - protein, 34 aa, Artificial Sequence
  Description of Artificial Sequence: Synthetic polypeptide
AEEEIRCTNPVATEQYGCVCSWGEHQNFGSENQS

SEQ ID NO: 144065 - protein, 30 aa, Artificial Sequence
  Description of Artificial Sequence: Synthetic polypeptide
QEEEIATTNPVATEQYGEAPEVCQQQHEEK

SEQ ID NO: 144066 - protein, 35 aa, Artificial Sequence
  Description of Artificial Sequence: Synthetic polypeptide
DEEEIATTNPVATEPYGSVCSGDNQDRNDGGQKGL

SEQ ID NO: 144067 - protein, 35 aa, Artificial Sequence
  Description of Artificial Sequence: Synthetic polypeptide
DEEEIRTTNPVATECYGAVSSNAEDGPNMPNGPPI

SEQ ID NO: 144068 - protein, 35 aa, Artificial Sequence
  Description of Artificial Sequence: Synthetic polypeptide
DESEIRTTNPVATEGWGCVCSTWMNENQEHFGSNQ

SEQ ID NO: 144069 - protein, 34 aa, Artificial Sequence
  Description of Artificial Sequence: Synthetic polypeptide
DESEIRTTNPVATEGWGAVSPCINEPQERVGEPG

SEQ ID NO: 144070 - protein, 35 aa, Artificial Sequence
  Description of Artificial Sequence: Synthetic polypeptide
DEEEIRTTNPVATEQYGCVCSNWGEDQESFNSNQS

SEQ ID NO: 144071 - protein, 33 aa, Artificial Sequence
  Description of Artificial Sequence: Synthetic polypeptide
DESEIRTTNPVATEGWGAQSPINEPQERVGEPG

SEQ ID NO: 144072 - protein, 36 aa, Artificial Sequence
  Description of Artificial Sequence: Synthetic polypeptide
DEEEIRTTNPVATEQYGCVCSNWGEDQENFGSDNQS

SEQ ID NO: 144073 - protein, 35 aa, Artificial Sequence
  Description of Artificial Sequence: Synthetic polypeptide
DEEEIRTTNPVATECYGAVSSNAEDGPNEPKGPPI

SEQ ID NO: 144074 - protein, 34 aa, Artificial Sequence
  Description of Artificial Sequence: Synthetic polypeptide
DECEICTTNPVATEQYGSVSTVQAQNEDTEEEDE

SEQ ID NO: 144075 - protein, 35 aa, Artificial Sequence
  Description of Artificial Sequence: Synthetic polypeptide
DEDEIATTNPVAYEQWGSVCSTTENDQGEDQNISR

SEQ ID NO: 144076 - protein, 30 aa, Artificial Sequence
  Description of Artificial Sequence: Synthetic polypeptide
QEEEIATTNPVATEQYGEAPEVCQQQHEEH

SEQ ID NO: 144077 - protein, 35 aa, Artificial Sequence
  Description of Artificial Sequence: Synthetic polypeptide
DECEICTTNPVATEQYGSVSTVQQNQGDTEEEEDD

SEQ ID NO: 144078 - protein, 35 aa, Artificial Sequence
  Description of Artificial Sequence: Synthetic polypeptide
DESEIRTTNPVATEFYGSVVQGGNNEGQGGNEDIS

SEQ ID NO: 144079 - protein, 34 aa, Artificial Sequence
  Description of Artificial Sequence: Synthetic polypeptide
DESEIRTTNPVATEGWGCVCSWINEPQEHEGSNQ

SEQ ID NO: 144080 - protein, 34 aa, Artificial Sequence
  Description of Artificial Sequence: Synthetic polypeptide
DEEEIRTTNPVATECYGAMSTGNGEGGGDTEEQF

SEQ ID NO: 144081 - protein, 34 aa, Artificial Sequence
  Description of Artificial Sequence: Synthetic polypeptide
DESEIRTTNPVATEGWGCVCSWMNENQDRMGSDQ

SEQ ID NO: 144082 - protein, 35 aa, Artificial Sequence
  Description of Artificial Sequence: Synthetic polypeptide
DEEEIRTTNPVATEQYGCVCSNWGEHEGFNSNTQA

SEQ ID NO: 144083 - protein, 35 aa, Artificial Sequence
  Description of Artificial Sequence: Synthetic polypeptide
TEEEIRTTNPVATEQYGLCWSALNDLGNEGTNDSQ

SEQ ID NO: 144084 - protein, 37 aa, Artificial Sequence
  Description of Artificial Sequence: Synthetic polypeptide
TEEEIRTTNPVATEQYGLSVSSTTPAGPNMRNGMNPV

SEQ ID NO: 144085 - protein, 35 aa, Artificial Sequence
  Description of Artificial Sequence: Synthetic polypeptide
QEEEIRTTNPVATEQYGQVSTMQDGFEGGGENEIS

SEQ ID NO: 144086 - protein, 33 aa, Artificial Sequence
  Description of Artificial Sequence: Synthetic polypeptide
DESEIRTTNPVATEGWGCVSWMEENQDHEGSNQ

SEQ ID NO: 144087 - protein, 36 aa, Artificial Sequence
  Description of Artificial Sequence: Synthetic polypeptide
DECEICTTNPVATEQYGSVSTVNQDQQGTTEETEDD

SEQ ID NO: 144088 - protein, 36 aa, Artificial Sequence
  Description of Artificial Sequence: Synthetic polypeptide
DEEEIRTTNPVATEQYGSVMSQLGQGEGQTTIEGDT

SEQ ID NO: 144089 - protein, 35 aa, Artificial Sequence
  Description of Artificial Sequence: Synthetic polypeptide
QEEEIRTTNPVATEQYGNVVDTMNGGQGGQEEDQI

SEQ ID NO: 144090 - protein, 35 aa, Artificial Sequence
  Description of Artificial Sequence: Synthetic polypeptide
QEEEIRTTNPVATEQYGNVNTDNMFETGGGNQEQG

SEQ ID NO: 144091 - protein, 37 aa, Artificial Sequence
  Description of Artificial Sequence: Synthetic polypeptide
DECEICTTNPVATEQYGSVSTVNQLQQGTTEEEEDEE

SEQ ID NO: 144092 - protein, 35 aa, Artificial Sequence
  Description of Artificial Sequence: Synthetic polypeptide
QEEEIRTTNPVATEQYGNVMGDDNDDQEEGNGNII

SEQ ID NO: 144093 - protein, 37 aa, Artificial Sequence
  Description of Artificial Sequence: Synthetic polypeptide
TEEEIRTTNPVATEQYGSCAQPEMMASTVLENGTLNR

SEQ ID NO: 144094 - protein, 34 aa, Artificial Sequence
  Description of Artificial Sequence: Synthetic polypeptide
AEEEIRSTNPCAYEQWGSVYCTDNDQHREGHNGV

SEQ ID NO: 144095 - protein, 34 aa, Artificial Sequence
  Description of Artificial Sequence: Synthetic polypeptide
TEEEIRTTNPVATEQYGSIHHTTLEDHMNESDEQ

SEQ ID NO: 144096 - protein, 34 aa, Artificial Sequence
  Description of Artificial Sequence: Synthetic polypeptide
TEEEIRTTNPVATEQYGSIWNTTLEDHNDESMEQ

SEQ ID NO: 144097 - protein, 36 aa, Artificial Sequence
  Description of Artificial Sequence: Synthetic polypeptide
DECEICTTNPVATEQYGSVSTVNQQQGTTEEEEQDE

SEQ ID NO: 144098 - protein, 35 aa, Artificial Sequence
  Description of Artificial Sequence: Synthetic polypeptide
DEEEIRTTNPVATEQYGCVCSNWGEHAFFGSDNQA

SEQ ID NO: 144099 - protein, 35 aa, Artificial Sequence
  Description of Artificial Sequence: Synthetic polypeptide
DESEIRTTNPVATEGWGSVCSWMNENQEYEGSNQF

SEQ ID NO: 144100 - protein, 35 aa, Artificial Sequence
  Description of Artificial Sequence: Synthetic polypeptide
DECEICTTNPVATEQYGSVSTVVASQGNTEEEEDD

SEQ ID NO: 144101 - protein, 36 aa, Artificial Sequence
  Description of Artificial Sequence: Synthetic polypeptide
DECEICTTNPVATEQYGSVSTVVDQQGGNTEEGEDD

SEQ ID NO: 144102 - protein, 35 aa, Artificial Sequence
  Description of Artificial Sequence: Synthetic polypeptide
DEEEIRTTNPVATEQYGCVCSNWEHNQGFGSETQS

SEQ ID NO: 144103 - protein, 35 aa, Artificial Sequence
  Description of Artificial Sequence: Synthetic polypeptide
DEEEIRTTNPVATEQYGCVCSNWEHNQEYFNSDFS

SEQ ID NO: 144104 - protein, 36 aa, Artificial Sequence
  Description of Artificial Sequence: Synthetic polypeptide
DEEEIRTTNPVATEQYGSVIFPTENLLGEEIEEDDS

SEQ ID NO: 144105 - protein, 35 aa, Artificial Sequence
  Description of Artificial Sequence: Synthetic polypeptide
DEEEIRTTNPVATEQYGCVCSNWEHNQENFNSDQN

SEQ ID NO: 144106 - protein, 35 aa, Artificial Sequence
  Description of Artificial Sequence: Synthetic polypeptide
DEEEIRTTNPVATEQYGCVCSNWEHNQENFNSDQA

SEQ ID NO: 144107 - protein, 35 aa, Artificial Sequence
  Description of Artificial Sequence: Synthetic polypeptide
TEEEIRTTNPVATEQYGSVSLPVNTEEHRLAAPTT

SEQ ID NO: 144108 - protein, 34 aa, Artificial Sequence
  Description of Artificial Sequence: Synthetic polypeptide
DESEIRTTNPVATECWGVQSPITEPQERVGENGE

SEQ ID NO: 144109 - protein, 35 aa, Artificial Sequence
  Description of Artificial Sequence: Synthetic polypeptide
DEEEIRTTNPVATEQYGCVCSNWEHNQENFGSDQS

SEQ ID NO: 144110 - protein, 35 aa, Artificial Sequence
  Description of Artificial Sequence: Synthetic polypeptide
DEEEIRTTNPVATEQYGCVCSNWEHNQENFGSDQA

SEQ ID NO: 144111 - protein, 36 aa, Artificial Sequence
  Description of Artificial Sequence: Synthetic polypeptide
DEEEIRTTNPVATEQYGCVCSNWEHNQENFGSDNQP

SEQ ID NO: 144112 - protein, 35 aa, Artificial Sequence
  Description of Artificial Sequence: Synthetic polypeptide
DEEEIRTTNPVATEQYGCVCSNWEHNQEGFGSEQA

SEQ ID NO: 144113 - protein, 36 aa, Artificial Sequence
  Description of Artificial Sequence: Synthetic polypeptide
DEEEIRTTNPVATEQWGSVSSTTPAGPNMRNAMNPV

SEQ ID NO: 144114 - protein, 33 aa, Artificial Sequence
  Description of Artificial Sequence: Synthetic polypeptide
DECEICTTNPVATEQYGTVNTVTDGGVEGNGND

SEQ ID NO: 144115 - protein, 36 aa, Artificial Sequence
  Description of Artificial Sequence: Synthetic polypeptide
DEEEIRTTNPVATEQYGCVCSNWEHNQEGFGSENQD

SEQ ID NO: 144116 - protein, 35 aa, Artificial Sequence
  Description of Artificial Sequence: Synthetic polypeptide
DESEIKTTNPVATEQYGSVSIGGLRGEAEGQEGEE

SEQ ID NO: 144117 - protein, 34 aa, Artificial Sequence
  Description of Artificial Sequence: Synthetic polypeptide
DESEIRTTNPVATECWGVQSVPINEPADREGENG

SEQ ID NO: 144118 - protein, 35 aa, Artificial Sequence
  Description of Artificial Sequence: Synthetic polypeptide
DEEEIRTTNPVATEQYGCVCSNWEHNQNFNSDNQA

SEQ ID NO: 144119 - protein, 34 aa, Artificial Sequence
  Description of Artificial Sequence: Synthetic polypeptide
DESEIRTTNPVATECWGVVKCIENEHQDREGENG

SEQ ID NO: 144120 - protein, 35 aa, Artificial Sequence
  Description of Artificial Sequence: Synthetic polypeptide
DEEEIRTTNPVATEQYGCVCSNWEHQENFISDNQS

SEQ ID NO: 144121 - protein, 36 aa, Artificial Sequence
  Description of Artificial Sequence: Synthetic polypeptide
DEEEIRTTNPVATEQYGSVFGSFEDDEGGNVQEQIV

SEQ ID NO: 144122 - protein, 36 aa, Artificial Sequence
  Description of Artificial Sequence: Synthetic polypeptide
DEEEIRTTNPVATEQYGSVFGSFEDDEGGNVQTEIE

SEQ ID NO: 144123 - protein, 34 aa, Artificial Sequence
  Description of Artificial Sequence: Synthetic polypeptide
DEEEIRTTNPVATEQYGCVCSNWEHQENFFSDQA

SEQ ID NO: 144124 - protein, 36 aa, Artificial Sequence
  Description of Artificial Sequence: Synthetic polypeptide
DEEEIATTNPVATEQWGSVAITNTPEQDHAGDNSDA

SEQ ID NO: 144125 - protein, 36 aa, Artificial Sequence
  Description of Artificial Sequence: Synthetic polypeptide
DEEEIRTTNPVATEQYGSVFGSFEDDTGGNQTEEIS

SEQ ID NO: 144126 - protein, 36 aa, Artificial Sequence
  Description of Artificial Sequence: Synthetic polypeptide
DEEEIRTTNPVATEQWGSVSSTTPAGPNMRAEMNPA

SEQ ID NO: 144127 - protein, 34 aa, Artificial Sequence
  Description of Artificial Sequence: Synthetic polypeptide
DESEIRTTNPVATECWGVVSVPINEPQDRVAENG

SEQ ID NO: 144128 - protein, 36 aa, Artificial Sequence
  Description of Artificial Sequence: Synthetic polypeptide
DESEIKTTNPVATEQYGAVDDTDNNEQIGGQNRGTG

SEQ ID NO: 144129 - protein, 35 aa, Artificial Sequence
  Description of Artificial Sequence: Synthetic polypeptide
DESEIKTTNPVATEQYGSVISINGPNGEDGQGGEE

SEQ ID NO: 144130 - protein, 34 aa, Artificial Sequence
  Description of Artificial Sequence: Synthetic polypeptide
DEEEIRTTNPVATEQYGCVCSNWEHNQYFISDQA

SEQ ID NO: 144131 - protein, 30 aa, Artificial Sequence
  Description of Artificial Sequence: Synthetic polypeptide
QEEEIRTTNPVATEQYGEAPNEVWAEHEEK

SEQ ID NO: 144132 - protein, 35 aa, Artificial Sequence
  Description of Artificial Sequence: Synthetic polypeptide
DEEEIRTTNPVATEQYGCVCSNWEHNQNFNSNFQP

SEQ ID NO: 144133 - protein, 35 aa, Artificial Sequence
  Description of Artificial Sequence: Synthetic polypeptide
DEEEIRTTNPVATEQYGCVCSNWEHNQNFNSDNQL

SEQ ID NO: 144134 - protein, 35 aa, Artificial Sequence
  Description of Artificial Sequence: Synthetic polypeptide
DESEIRTTNPVATECWGVVQSPINEPQERVGENGE

SEQ ID NO: 144135 - protein, 34 aa, Artificial Sequence
  Description of Artificial Sequence: Synthetic polypeptide
DEEEIRTTNPVATEQYGCVCSNWEHNIFFNSDQS

SEQ ID NO: 144136 - protein, 35 aa, Artificial Sequence
  Description of Artificial Sequence: Synthetic polypeptide
DEEEIATTNPVATEQWGSVAITNAPEATGDGDSNM

SEQ ID NO: 144137 - protein, 36 aa, Artificial Sequence
  Description of Artificial Sequence: Synthetic polypeptide
TEEEIRTTNPVATEQYGSVSPDVNLAQYTHVEHPPI

SEQ ID NO: 144138 - protein, 35 aa, Artificial Sequence
  Description of Artificial Sequence: Synthetic polypeptide
DEEEIRTTNPVATEQYGCVCSNWEHNIENFNSDQA

SEQ ID NO: 144139 - protein, 35 aa, Artificial Sequence
  Description of Artificial Sequence: Synthetic polypeptide
DEEEIRTTNPVATEQWGSVSSTTPIENNAAEMDPA

SEQ ID NO: 144140 - protein, 37 aa, Artificial Sequence
  Description of Artificial Sequence: Synthetic polypeptide
DEEEIRTTNPVATEQYGSVMGVTDNQDQQEQEGEQGE

SEQ ID NO: 144141 - protein, 30 aa, Artificial Sequence
  Description of Artificial Sequence: Synthetic polypeptide
QEEEIATTNPVATEQYGEAPEVCQHPEEWK

SEQ ID NO: 144142 - protein, 35 aa, Artificial Sequence
  Description of Artificial Sequence: Synthetic polypeptide
DEEEIRTTNPVATECWGMHCWTMNEQQRGNDNHST

SEQ ID NO: 144143 - protein, 37 aa, Artificial Sequence
  Description of Artificial Sequence: Synthetic polypeptide
TEEEIRTTNPVATEQYGSVSSTTPAMPNMENGMNPVN

SEQ ID NO: 144144 - protein, 37 aa, Artificial Sequence
  Description of Artificial Sequence: Synthetic polypeptide
TEEEIRTTNPVATEQYGSVSSTTPASGPNMFNGMNPV

SEQ ID NO: 144145 - protein, 34 aa, Artificial Sequence
  Description of Artificial Sequence: Synthetic polypeptide
DEEEIATTNPVATEQWGSVAAGNLDEANPSGVDY

SEQ ID NO: 144146 - protein, 34 aa, Artificial Sequence
  Description of Artificial Sequence: Synthetic polypeptide
DECEICTTNPVATEQYGTVSTVTDGEDEGEGNND

SEQ ID NO: 144147 - protein, 34 aa, Artificial Sequence
  Description of Artificial Sequence: Synthetic polypeptide
DEEEIRTTNPVATECWGMHCWTMNEQNRDRNDFD

SEQ ID NO: 144148 - protein, 34 aa, Artificial Sequence
  Description of Artificial Sequence: Synthetic polypeptide
DEEEIRTTNPVATEQYGCVCSNWEEHTFFNSDQP

SEQ ID NO: 144149 - protein, 35 aa, Artificial Sequence
  Description of Artificial Sequence: Synthetic polypeptide
DEEEIRTTNPVATEQYGCVCSNWEEHQYFNSNTQG

SEQ ID NO: 144150 - protein, 37 aa, Artificial Sequence
  Description of Artificial Sequence: Synthetic polypeptide
DEEEIRTTNPVATEQYGSVITPTTNQETERSSEQNVV

SEQ ID NO: 144151 - protein, 34 aa, Artificial Sequence
  Description of Artificial Sequence: Synthetic polypeptide
DEEEIRTTNPVATEQYGCVCSNWEEHQNFFSDQQ

SEQ ID NO: 144152 - protein, 37 aa, Artificial Sequence
  Description of Artificial Sequence: Synthetic polypeptide
AEEEIRTTNPVATEQYGSVVTVTNNQNGNEQGTNDEV

SEQ ID NO: 144153 - protein, 35 aa, Artificial Sequence
  Description of Artificial Sequence: Synthetic polypeptide
DEEEIRTTNPVATEQYGSVSTKVDPAHEEVESFIT

SEQ ID NO: 144154 - protein, 35 aa, Artificial Sequence
  Description of Artificial Sequence: Synthetic polypeptide
DEEEIRTTNPVATEQYGCVCSNWEENQHFNSENQL

SEQ ID NO: 144155 - protein, 37 aa, Artificial Sequence
  Description of Artificial Sequence: Synthetic polypeptide
DEEEIRTTNPVATEQYGSVIFPTFNQETELSDEVNVT

SEQ ID NO: 144156 - protein, 37 aa, Artificial Sequence
  Description of Artificial Sequence: Synthetic polypeptide
DEEEIRTTNPVATEQYGSVMGVTGSNGQNIQGGEFGD

SEQ ID NO: 144157 - protein, 34 aa, Artificial Sequence
  Description of Artificial Sequence: Synthetic polypeptide
DEEEIRTTNPVATEQYGCVCSNWEHANFNSNTQP

SEQ ID NO: 144158 - protein, 35 aa, Artificial Sequence
  Description of Artificial Sequence: Synthetic polypeptide
DEEEIRTTNPVATEQYGCVCSNWEHNANFNSDNQS

SEQ ID NO: 144159 - protein, 34 aa, Artificial Sequence
  Description of Artificial Sequence: Synthetic polypeptide
DESEIRTTNPVATECWGTVGCINEPQAREGENPG

SEQ ID NO: 144160 - protein, 35 aa, Artificial Sequence
  Description of Artificial Sequence: Synthetic polypeptide
TEEEIRTTNPVATEQYGSVSPDVSLAIMHGVDPPI

SEQ ID NO: 144161 - protein, 36 aa, Artificial Sequence
  Description of Artificial Sequence: Synthetic polypeptide
DEEEIRTTNPVATEQYGSVIFINMGEEQPEGEEPEL

SEQ ID NO: 144162 - protein, 35 aa, Artificial Sequence
  Description of Artificial Sequence: Synthetic polypeptide
QEEEIATTNPVATEQYGSVCAMNGVLPEDDGGNDQ

SEQ ID NO: 144163 - protein, 35 aa, Artificial Sequence
  Description of Artificial Sequence: Synthetic polypeptide
DEEEIATTNPVATEQWGSVAITNAPEATGAGNSDA

SEQ ID NO: 144164 - protein, 35 aa, Artificial Sequence
  Description of Artificial Sequence: Synthetic polypeptide
DESEIRTTNPVATECWGTSVSCINLEPGDAEGENG

SEQ ID NO: 144165 - protein, 36 aa, Artificial Sequence
  Description of Artificial Sequence: Synthetic polypeptide
DEEEIRTTNPVATEQYGSVIFIIMGNEQPEGEVPEI

SEQ ID NO: 144166 - protein, 36 aa, Artificial Sequence
  Description of Artificial Sequence: Synthetic polypeptide
TEEEIRTTNPVATEQYGSVSPDVSLDQFMHGVHPPI

SEQ ID NO: 144167 - protein, 35 aa, Artificial Sequence
  Description of Artificial Sequence: Synthetic polypeptide
QEEEIATTNPVATEQYGSVCSPPAGQQDSDGNPEN

SEQ ID NO: 144168 - protein, 35 aa, Artificial Sequence
  Description of Artificial Sequence: Synthetic polypeptide
TEEEIRTTNPVATEQYGSVSPDVSPAQMVGEHPPI

SEQ ID NO: 144169 - protein, 35 aa, Artificial Sequence
  Description of Artificial Sequence: Synthetic polypeptide
TEEEIRTTNPVATEQYGSVSPDVSVAQMHGVHPSN

SEQ ID NO: 144170 - protein, 37 aa, Artificial Sequence
  Description of Artificial Sequence: Synthetic polypeptide
AEEEIRTTNPVATEQYGSVVTVTNQLGGNEQGTNNND

SEQ ID NO: 144171 - protein, 35 aa, Artificial Sequence
  Description of Artificial Sequence: Synthetic polypeptide
DEEEIRTTNPVATEQYGCVCSNWEHFQNFNSETQS

SEQ ID NO: 144172 - protein, 36 aa, Artificial Sequence
  Description of Artificial Sequence: Synthetic polypeptide
DECEICTTNPVATEQYGTVSTVNDGGVEQGEGNNTD

SEQ ID NO: 144173 - protein, 34 aa, Artificial Sequence
  Description of Artificial Sequence: Synthetic polypeptide
DEEEIRTTNPVATEQYGCVCSNWEHAFFGSETQP

SEQ ID NO: 144174 - protein, 32 aa, Artificial Sequence
  Description of Artificial Sequence: Synthetic polypeptide
QEEEIASTNPVGTEGYGVVSATTPTGQHGMNI

SEQ ID NO: 144175 - protein, 36 aa, Artificial Sequence
  Description of Artificial Sequence: Synthetic polypeptide
DEEEIRTTNPVATEQWGSVSSTTPAGPNMAAEMNPA

SEQ ID NO: 144176 - protein, 35 aa, Artificial Sequence
  Description of Artificial Sequence: Synthetic polypeptide
DEEEIRTTNPVATEQYGCVCSNWEHQENFSSDNQS

SEQ ID NO: 144177 - protein, 36 aa, Artificial Sequence
  Description of Artificial Sequence: Synthetic polypeptide
DEEEIRTTNPVATEQYGSVFGSFDDDEGGNQIENIQ

SEQ ID NO: 144178 - protein, 36 aa, Artificial Sequence
  Description of Artificial Sequence: Synthetic polypeptide
DEEEIRTTNPVATEQYGSVFGSFDDEGGNQTTDGLI

SEQ ID NO: 144179 - protein, 33 aa, Artificial Sequence
  Description of Artificial Sequence: Synthetic polypeptide
DEDEIATTNPVAYEPYGSVSAAANPDSRDGGGN

SEQ ID NO: 144180 - protein, 37 aa, Artificial Sequence
  Description of Artificial Sequence: Synthetic polypeptide
DECEICTTNPVATEQYGSVSVTTNNQQGNQQGNNQDE

SEQ ID NO: 144181 - protein, 33 aa, Artificial Sequence
  Description of Artificial Sequence: Synthetic polypeptide
DEDEIATTNPVAYEPYGSVCAGNNLTTAGGNEQ

SEQ ID NO: 144182 - protein, 36 aa, Artificial Sequence
  Description of Artificial Sequence: Synthetic polypeptide
DEEEIRTTNPVATEQYGSVFGSFEDDEDGNEQENIE

SEQ ID NO: 144183 - protein, 36 aa, Artificial Sequence
  Description of Artificial Sequence: Synthetic polypeptide
DEEEIRTTNPVATEQYGSVFGSFDDDEGGNNQENIV

SEQ ID NO: 144184 - protein, 36 aa, Artificial Sequence
  Description of Artificial Sequence: Synthetic polypeptide
DEEEIRTTNPVATEQYGSVFGSFEDDEGGEIQENIT

SEQ ID NO: 144185 - protein, 37 aa, Artificial Sequence
  Description of Artificial Sequence: Synthetic polypeptide
AEEEIRATNPCATEQYGSVSTVNNQLDNQQIGTNNAD

SEQ ID NO: 144186 - protein, 28 aa, Artificial Sequence
  Description of Artificial Sequence: Synthetic peptide
QEEEIASTNPVGTEQYGVMASVCQHEEI

SEQ ID NO: 144187 - protein, 33 aa, Artificial Sequence
  Description of Artificial Sequence: Synthetic polypeptide
DESEIRTTNPVATECWYSVSCINEPQDIEAENG

SEQ ID NO: 144188 - protein, 32 aa, Artificial Sequence
  Description of Artificial Sequence: Synthetic polypeptide
DEDEIATTNPVAYEPYGSVAATNEANDDSNGN

SEQ ID NO: 144189 - protein, 36 aa, Artificial Sequence
  Description of Artificial Sequence: Synthetic polypeptide
DEEEIRTTNPVATEQYGSVFGSFEDDEGGNEEENIV

SEQ ID NO: 144190 - protein, 32 aa, Artificial Sequence
  Description of Artificial Sequence: Synthetic polypeptide
DEEEIATTNPVATEQYGEVCPATDGCVEFEEK

SEQ ID NO: 144191 - protein, 28 aa, Artificial Sequence
  Description of Artificial Sequence: Synthetic peptide
QEEEIASTNPVGTEQYGVMASVCQHEDI

SEQ ID NO: 144192 - protein, 37 aa, Artificial Sequence
  Description of Artificial Sequence: Synthetic polypeptide
AEEEIRATNPCATEQYGSVSTVNNQLQNQQIGTNSVT

SEQ ID NO: 144193 - protein, 36 aa, Artificial Sequence
  Description of Artificial Sequence: Synthetic polypeptide
TEEEIRTTNPVATEQYGSVPLVYINLVSEFGDEVRD

SEQ ID NO: 144194 - protein, 35 aa, Artificial Sequence
  Description of Artificial Sequence: Synthetic polypeptide
DECEICTTNPVATEQYGSVSTVVTQQGDTEEQEDD

SEQ ID NO: 144195 - protein, 33 aa, Artificial Sequence
  Description of Artificial Sequence: Synthetic polypeptide
DEDEIATTNPVAYEQWGMTSTNLNQQGDGDDSS

SEQ ID NO: 144196 - protein, 35 aa, Artificial Sequence
  Description of Artificial Sequence: Synthetic polypeptide
QEEEIRTTNPVATEQYGEVSPTTPACQMHNEMNPV

SEQ ID NO: 144197 - protein, 36 aa, Artificial Sequence
  Description of Artificial Sequence: Synthetic polypeptide
AEEEIRATNPCATEQYGSVSTVNNQNQNQEQGTNVD

SEQ ID NO: 144198 - protein, 30 aa, Artificial Sequence
  Description of Artificial Sequence: Synthetic polypeptide
QEEEIATTNPVATEQYGEAPEVCQNHAEEK

SEQ ID NO: 144199 - protein, 36 aa, Artificial Sequence
  Description of Artificial Sequence: Synthetic polypeptide
DEEEIRTTNPVATEQYGSVFGINMQDNDEGGGDGGT

SEQ ID NO: 144200 - protein, 37 aa, Artificial Sequence
  Description of Artificial Sequence: Synthetic polypeptide
AEEEIRATNPCATEQYGSVSTVNNQLSNEQIGTNNVD

SEQ ID NO: 144201 - protein, 35 aa, Artificial Sequence
  Description of Artificial Sequence: Synthetic polypeptide
DEEEIRTTNPVATEQYGSVFGQFEDDEGGNETNIE

SEQ ID NO: 144202 - protein, 35 aa, Artificial Sequence
  Description of Artificial Sequence: Synthetic polypeptide
DEEEIRTTNPVATEQYGSVIGPIVAVQIGMVQEQG

SEQ ID NO: 144203 - protein, 36 aa, Artificial Sequence
  Description of Artificial Sequence: Synthetic polypeptide
DESEIDTTNPVATEQYGSVSSTTPAGPNMRNGMNPV

SEQ ID NO: 144204 - protein, 35 aa, Artificial Sequence
  Description of Artificial Sequence: Synthetic polypeptide
DEEEIRTTNPVATEQYGSVFGQFEDDEGGNTENIT

SEQ ID NO: 144205 - protein, 33 aa, Artificial Sequence
  Description of Artificial Sequence: Synthetic polypeptide
QEEEIRTTNPVATEQYGEVSPEPVGNMHNEMEV

SEQ ID NO: 144206 - protein, 30 aa, Artificial Sequence
  Description of Artificial Sequence: Synthetic polypeptide
QEEEIATTNPVATEQYGEAPEVCQNAAEEK

SEQ ID NO: 144207 - protein, 30 aa, Artificial Sequence
  Description of Artificial Sequence: Synthetic polypeptide
QEEEIATTNPVATEQYGEAPEVCQNAAEEA

SEQ ID NO: 144208 - protein, 34 aa, Artificial Sequence
  Description of Artificial Sequence: Synthetic polypeptide
DEDEIATTNPVAYEPYGSVVAATMNLPAPNNNRN

SEQ ID NO: 144209 - protein, 35 aa, Artificial Sequence
  Description of Artificial Sequence: Synthetic polypeptide
DESEIRTTNPVATECYGETTSCTNFAHSQRKGGDS

SEQ ID NO: 144210 - protein, 36 aa, Artificial Sequence
  Description of Artificial Sequence: Synthetic polypeptide
DEEEIRTTNPVATEQYGSVIFSNMGEEQPEGQVPEI

SEQ ID NO: 144211 - protein, 37 aa, Artificial Sequence
  Description of Artificial Sequence: Synthetic polypeptide
DEEEIRTTNPVATEQYGSVFGSFEDDEGGNEQNENII

SEQ ID NO: 144212 - protein, 30 aa, Artificial Sequence
  Description of Artificial Sequence: Synthetic polypeptide
QEEEIATTNPVATEQYGEAPEVCQKHEHEK

SEQ ID NO: 144213 - protein, 31 aa, Artificial Sequence
  Description of Artificial Sequence: Synthetic polypeptide
DEDEIATTNPVAYEPYGSTAATAGEQNIGSE

SEQ ID NO: 144214 - protein, 35 aa, Artificial Sequence
  Description of Artificial Sequence: Synthetic polypeptide
DEEEIRTTNPVATEQYGSVMSDDIEGGQEDTDDDV

SEQ ID NO: 144215 - protein, 36 aa, Artificial Sequence
  Description of Artificial Sequence: Synthetic polypeptide
DEEEIRTTNPVATEQYGSVMSDDGEFNETDGEEFGQ

SEQ ID NO: 144216 - protein, 36 aa, Artificial Sequence
  Description of Artificial Sequence: Synthetic polypeptide
DEEEIRTTNPVATEQYGSVFGSFEDDEGGNQIEDIE

SEQ ID NO: 144217 - protein, 36 aa, Artificial Sequence
  Description of Artificial Sequence: Synthetic polypeptide
DESEIRTTNPVATECWSGNSVSCINTEPLDREGENG

SEQ ID NO: 144218 - protein, 37 aa, Artificial Sequence
  Description of Artificial Sequence: Synthetic polypeptide
DEEEIRTTNPVATEQYGSVIFPTFNQYTERSDEQNVQ

SEQ ID NO: 144219 - protein, 36 aa, Artificial Sequence
  Description of Artificial Sequence: Synthetic polypeptide
DEEEIRTTNPVATEQYGSVMQPTMGLQPEMDEAEEN

SEQ ID NO: 144220 - protein, 31 aa, Artificial Sequence
  Description of Artificial Sequence: Synthetic polypeptide
DEEEIATTNPVATEPYGTASMEVCQQQQEEK

SEQ ID NO: 144221 - protein, 36 aa, Artificial Sequence
  Description of Artificial Sequence: Synthetic polypeptide
DEEEIRTTNPVATEQYGSVFGSFEDDEGGNQTENIT

SEQ ID NO: 144222 - protein, 31 aa, Artificial Sequence
  Description of Artificial Sequence: Synthetic polypeptide
DEEEIATTNPVATEPYGTASMEVIQQQQEEK

SEQ ID NO: 144223 - protein, 36 aa, Artificial Sequence
  Description of Artificial Sequence: Synthetic polypeptide
DEEEIRTTNPVATEQYGSVFGSFEDDEGGNQTTNIE

SEQ ID NO: 144224 - protein, 36 aa, Artificial Sequence
  Description of Artificial Sequence: Synthetic polypeptide
DEEEIRTTNPVATEQYGSVMPNTGLLDAQNVVDPIV

SEQ ID NO: 144225 - protein, 36 aa, Artificial Sequence
  Description of Artificial Sequence: Synthetic polypeptide
DESEIKTTNCVATEQYGSVSTINGLRGEDGGQGGEE

SEQ ID NO: 144226 - protein, 37 aa, Artificial Sequence
  Description of Artificial Sequence: Synthetic polypeptide
DEEEIRTTNPVATEQYGSVIFPTFNQGTMQSDEQNVD

SEQ ID NO: 144227 - protein, 37 aa, Artificial Sequence
  Description of Artificial Sequence: Synthetic polypeptide
DEEEIRTTNPVATEQYGSVMPEVMLQMDGIRQVDEDT

SEQ ID NO: 144228 - protein, 36 aa, Artificial Sequence
  Description of Artificial Sequence: Synthetic polypeptide
DEEEIRTTNPVATEQYGSVFGSFEDDEGGNVQENDT

SEQ ID NO: 144229 - protein, 34 aa, Artificial Sequence
  Description of Artificial Sequence: Synthetic polypeptide
DECEICTTNPVATEQYGTVATVTNGTVEEEGNND

SEQ ID NO: 144230 - protein, 34 aa, Artificial Sequence
  Description of Artificial Sequence: Synthetic polypeptide
DEEEIATTNPVATEPYGTEVCAAMANDQVSNDTR

SEQ ID NO: 144231 - protein, 35 aa, Artificial Sequence
  Description of Artificial Sequence: Synthetic polypeptide
DEEEIRTTNPVATEQWGSVSSTTPAENNAAEMDPA

SEQ ID NO: 144232 - protein, 35 aa, Artificial Sequence
  Description of Artificial Sequence: Synthetic polypeptide
DEEEIRTTNPVATEQYGCVCSNWGAHQENFGSDQA

SEQ ID NO: 144233 - protein, 32 aa, Artificial Sequence
  Description of Artificial Sequence: Synthetic polypeptide
DEDEIATTNPVAYEPYGSTAANNGLQDANDNT

SEQ ID NO: 144234 - protein, 28 aa, Artificial Sequence
  Description of Artificial Sequence: Synthetic peptide
QEEEIASTNPVSTEQYGEAPEVIQHEEK

SEQ ID NO: 144235 - protein, 28 aa, Artificial Sequence
  Description of Artificial Sequence: Synthetic peptide
QEEEIASTNPVSTEQYGEAPEVIQHEQK

SEQ ID NO: 144236 - protein, 37 aa, Artificial Sequence
  Description of Artificial Sequence: Synthetic polypeptide
DECEICTTNPVATEQYGSVSVTTNQQQGNEQGNNQED

SEQ ID NO: 144237 - protein, 35 aa, Artificial Sequence
  Description of Artificial Sequence: Synthetic polypeptide
DESEIRTTNPVATECWWSGSVCCANEPQDREGENG

SEQ ID NO: 144238 - protein, 30 aa, Artificial Sequence
  Description of Artificial Sequence: Synthetic polypeptide
QEEEIASTNPVSTEQYGNAAAETCQSREER

SEQ ID NO: 144239 - protein, 37 aa, Artificial Sequence
  Description of Artificial Sequence: Synthetic polypeptide
DECEICTTNPVATEQYGSVSVTTNQQQGNQQGTTDEE

SEQ ID NO: 144240 - protein, 30 aa, Artificial Sequence
  Description of Artificial Sequence: Synthetic polypeptide
QEEEIASTNPVSTEQYGNAAAEVCQSREER

SEQ ID NO: 144241 - protein, 35 aa, Artificial Sequence
  Description of Artificial Sequence: Synthetic polypeptide
DEEEIRTTNPVATECWGMHCWTMNEQQRGQDNGSS

SEQ ID NO: 144242 - protein, 37 aa, Artificial Sequence
  Description of Artificial Sequence: Synthetic polypeptide
DEEEIRTTNPVATEQYGSVMSDSIEGGQEGNDNDNGD

SEQ ID NO: 144243 - protein, 37 aa, Artificial Sequence
  Description of Artificial Sequence: Synthetic polypeptide
AEEEIRTTNPVATEQYGSVVTTNTNLEQGTNQENNDD

SEQ ID NO: 144244 - protein, 36 aa, Artificial Sequence
  Description of Artificial Sequence: Synthetic polypeptide
DESEIRTTNPVATECWWGSVSCINAEPQDREGENGQ

SEQ ID NO: 144245 - protein, 36 aa, Artificial Sequence
  Description of Artificial Sequence: Synthetic polypeptide
DEEEIRTTNPVATEQYGSVFGSFEDDEGGNQEENDL

SEQ ID NO: 144246 - protein, 35 aa, Artificial Sequence
  Description of Artificial Sequence: Synthetic polypeptide
DEEEIRTTNPVATEQYGCVCSNWGAHQENFNSDQS

SEQ ID NO: 144247 - protein, 33 aa, Artificial Sequence
  Description of Artificial Sequence: Synthetic polypeptide
DESEIHGTNPVATECWGSVSCINEPQDREGEQG

SEQ ID NO: 144248 - protein, 35 aa, Artificial Sequence
  Description of Artificial Sequence: Synthetic polypeptide
DEEEIATTNPVATEQWGSVAITPPEQNHQGDNSDA

SEQ ID NO: 144249 - protein, 34 aa, Artificial Sequence
  Description of Artificial Sequence: Synthetic polypeptide
AEDEICATNPVATEQYGVVATVQENLQLGNGEDD

SEQ ID NO: 144250 - protein, 36 aa, Artificial Sequence
  Description of Artificial Sequence: Synthetic polypeptide
DECEICTTNPVATEQYGSVSTVNAQQNEGTEETEDD

SEQ ID NO: 144251 - protein, 35 aa, Artificial Sequence
  Description of Artificial Sequence: Synthetic polypeptide
DECEICTTNPVATEQYGSVSTVNAQQNEEEEEEED

SEQ ID NO: 144252 - protein, 37 aa, Artificial Sequence
  Description of Artificial Sequence: Synthetic polypeptide
AEEEIRTTNPVATEAYGSVSTVTNNQLGNEQGTDEGS

SEQ ID NO: 144253 - protein, 37 aa, Artificial Sequence
  Description of Artificial Sequence: Synthetic polypeptide
AEEEIRTTNPVATEAYGSVSTVTNNQLGNEQGGTDGG

SEQ ID NO: 144254 - protein, 31 aa, Artificial Sequence
  Description of Artificial Sequence: Synthetic polypeptide
DESEIRTTNPVATEQWGNVAAEIIQSAVEDA

SEQ ID NO: 144255 - protein, 32 aa, Artificial Sequence
  Description of Artificial Sequence: Synthetic polypeptide
DEDEIATTNPVAYEQYGSTANHLQGTPDGSEN

SEQ ID NO: 144256 - protein, 35 aa, Artificial Sequence
  Description of Artificial Sequence: Synthetic polypeptide
DEDEIATTNPVAYEQYGSTACAGANGLQDSDGNRH

SEQ ID NO: 144257 - protein, 37 aa, Artificial Sequence
  Description of Artificial Sequence: Synthetic polypeptide
AEEEIRTTNPVATEAYGSVSTVTNNQLGAEQGTDGGE

SEQ ID NO: 144258 - protein, 36 aa, Artificial Sequence
  Description of Artificial Sequence: Synthetic polypeptide
DEEEIRTTNPVATEQWGICQVCSYTNDLNTYFGSDF

SEQ ID NO: 144259 - protein, 33 aa, Artificial Sequence
  Description of Artificial Sequence: Synthetic polypeptide
DESEIRTTNPVATEQWGKVSCEIESMNAAEGDA

SEQ ID NO: 144260 - protein, 34 aa, Artificial Sequence
  Description of Artificial Sequence: Synthetic polypeptide
DEEEIATTNPVATEQYGSVCAAMMHGDNEMGNQG

SEQ ID NO: 144261 - protein, 33 aa, Artificial Sequence
  Description of Artificial Sequence: Synthetic polypeptide
DESEIRTTNPVATEQWGKVPSEPESMNAAEGDA

SEQ ID NO: 144262 - protein, 36 aa, Artificial Sequence
  Description of Artificial Sequence: Synthetic polypeptide
DEEEIRTTNPVATEQYGSVIGPTNNLLGMTLEIEDH

SEQ ID NO: 144263 - protein, 37 aa, Artificial Sequence
  Description of Artificial Sequence: Synthetic polypeptide
AEEEIRTTNPVATEAYGSVSTVTNNNQNEQQGTNQGD

SEQ ID NO: 144264 - protein, 37 aa, Artificial Sequence
  Description of Artificial Sequence: Synthetic polypeptide
AEEEIRTTNPVATEAYGSVSTVTNNNQLQQNGEEEAD

SEQ ID NO: 144265 - protein, 36 aa, Artificial Sequence
  Description of Artificial Sequence: Synthetic polypeptide
AEEEIRTTNPVATEAYGSVSTVTNNNQLQQNEEEDD

SEQ ID NO: 144266 - protein, 36 aa, Artificial Sequence
  Description of Artificial Sequence: Synthetic polypeptide
AEEEIRTTNPVATEAYGSVSTVTNNNQQQAEEEEND

SEQ ID NO: 144267 - protein, 35 aa, Artificial Sequence
  Description of Artificial Sequence: Synthetic polypeptide
DEEEIATTNPVATEQYGSVCAAMMHGQDEMGNSDE

SEQ ID NO: 144268 - protein, 36 aa, Artificial Sequence
  Description of Artificial Sequence: Synthetic polypeptide
AEEEIRTTNPVATEAYGSVSTVTNNQLQQAEEEEED

SEQ ID NO: 144269 - protein, 36 aa, Artificial Sequence
  Description of Artificial Sequence: Synthetic polypeptide
AEEEIRTTNPVATEAYGSVSTVTNNQLQQNDEEETQ

SEQ ID NO: 144270 - protein, 34 aa, Artificial Sequence
  Description of Artificial Sequence: Synthetic polypeptide
DEEEIATTNPVATEQYGSVCAAMMHGQNEMGGED

SEQ ID NO: 144271 - protein, 35 aa, Artificial Sequence
  Description of Artificial Sequence: Synthetic polypeptide
DEEEIRTTNPVATEQYGCVCSSEEDHQERFMSIQS

SEQ ID NO: 144272 - protein, 35 aa, Artificial Sequence
  Description of Artificial Sequence: Synthetic polypeptide
DEEEIRTTNPVATEQYGCVCSSEEDHEHFGSDNQA

SEQ ID NO: 144273 - protein, 33 aa, Artificial Sequence
  Description of Artificial Sequence: Synthetic polypeptide
DEDEIATTNPVAYEQYGSTVAGANDQATPNENQ

SEQ ID NO: 144274 - protein, 36 aa, Artificial Sequence
  Description of Artificial Sequence: Synthetic polypeptide
AEEEIRTTNPVATEQYGSVVTVVTDGGNNLGGNDDE

SEQ ID NO: 144275 - protein, 37 aa, Artificial Sequence
  Description of Artificial Sequence: Synthetic polypeptide
DEEEIRTTNPVATEQWGICQVCSYTNDLNARFGSQQS

SEQ ID NO: 144276 - protein, 32 aa, Artificial Sequence
  Description of Artificial Sequence: Synthetic polypeptide
DESEIATTNPVSTEGYGTMSMETIQQQHNGNH

SEQ ID NO: 144277 - protein, 34 aa, Artificial Sequence
  Description of Artificial Sequence: Synthetic polypeptide
QEEEIRTTNPVATEQYGSVIGGNNMDNGEGGFDT

SEQ ID NO: 144278 - protein, 35 aa, Artificial Sequence
  Description of Artificial Sequence: Synthetic polypeptide
DEEEIRTTNPVATEQYGCVCSSEDHNQEHFNSIQS

SEQ ID NO: 144279 - protein, 35 aa, Artificial Sequence
  Description of Artificial Sequence: Synthetic polypeptide
DEEEIATTNPVATEQYGSVCAAMMHGQDEMGTNST

SEQ ID NO: 144280 - protein, 35 aa, Artificial Sequence
  Description of Artificial Sequence: Synthetic polypeptide
AEEEIRTTNPVATEAYGSVSTVTNNQNQQEEEEED

SEQ ID NO: 144281 - protein, 37 aa, Artificial Sequence
  Description of Artificial Sequence: Synthetic polypeptide
AEEEIRTTNPVATEAYGSVSTVTNNQNEQQIGTNQGD

SEQ ID NO: 144282 - protein, 36 aa, Artificial Sequence
  Description of Artificial Sequence: Synthetic polypeptide
AEEEIRTTNPVATEAYGSVSTVTNNQLQQNEEETDQ

SEQ ID NO: 144283 - protein, 36 aa, Artificial Sequence
  Description of Artificial Sequence: Synthetic polypeptide
AEEEIRTTNPVATEAYGSVSTVTNNQLQQNEEEEDN

SEQ ID NO: 144284 - protein, 36 aa, Artificial Sequence
  Description of Artificial Sequence: Synthetic polypeptide
DEEEIRTTNPVATEQYGSVMTGVGQIDEDEGGEGIT

SEQ ID NO: 144285 - protein, 34 aa, Artificial Sequence
  Description of Artificial Sequence: Synthetic polypeptide
DEDEIATTNPVAYEQYGSTAATNPLAEAPGNDNF

SEQ ID NO: 144286 - protein, 37 aa, Artificial Sequence
  Description of Artificial Sequence: Synthetic polypeptide
AEEEIRTTNPVATEAYGSVSTVTNNNQLQQGEEEEDD

SEQ ID NO: 144287 - protein, 36 aa, Artificial Sequence
  Description of Artificial Sequence: Synthetic polypeptide
AEEEIRTTNPVATEAYGSVSTVTNNNATESGNNDTQ

SEQ ID NO: 144288 - protein, 29 aa, Artificial Sequence
  Description of Artificial Sequence: Synthetic peptide
QEEEIAPTNPVATEQYGEAPEVCQHEEKS

SEQ ID NO: 144289 - protein, 30 aa, Artificial Sequence
  Description of Artificial Sequence: Synthetic polypeptide
QEEEIATTNPVATEQYGEAPEVCSQHQEEK

SEQ ID NO: 144290 - protein, 36 aa, Artificial Sequence
  Description of Artificial Sequence: Synthetic polypeptide
AEEEIRTTNPVATEAYGSVSTVNNNQQLQTAEEETD

SEQ ID NO: 144291 - protein, 37 aa, Artificial Sequence
  Description of Artificial Sequence: Synthetic polypeptide
DEEEIRTTNPVATEQYGSVIGPTNNLLGMNPLEIEDT

SEQ ID NO: 144292 - protein, 31 aa, Artificial Sequence
  Description of Artificial Sequence: Synthetic polypeptide
DESEIATTNPVSTEPYGTIAAMTIQSRNGNH

SEQ ID NO: 144293 - protein, 36 aa, Artificial Sequence
  Description of Artificial Sequence: Synthetic polypeptide
AEEEIRTTNPVATEAYGSVSTVDQNGNVEQGTEQES

SEQ ID NO: 144294 - protein, 34 aa, Artificial Sequence
  Description of Artificial Sequence: Synthetic polypeptide
AEDEICATNPVATEQYGVVATSGNGNLQLGNGDD

SEQ ID NO: 144295 - protein, 35 aa, Artificial Sequence
  Description of Artificial Sequence: Synthetic polypeptide
AEEEIRTTNPVATEAYGSVSTVDNGNNVEQGEEED

SEQ ID NO: 144296 - protein, 31 aa, Artificial Sequence
  Description of Artificial Sequence: Synthetic polypeptide
DESEIATTNPVSTEPYGTIAAMTIQSRVGNH

SEQ ID NO: 144297 - protein, 36 aa, Artificial Sequence
  Description of Artificial Sequence: Synthetic polypeptide
AEEEIRTTNPVATEAYGSVSTTVNQQQQEATNNATE

SEQ ID NO: 144298 - protein, 38 aa, Artificial Sequence
  Description of Artificial Sequence: Synthetic polypeptide
AEEEIRTTNPVATEQYGSVVTVTVTNLEQGTEGGNTTV

SEQ ID NO: 144299 - protein, 37 aa, Artificial Sequence
  Description of Artificial Sequence: Synthetic polypeptide
AEEEIRTTNPVATEAYGSVSTTVNQNLQQEATNVATE

SEQ ID NO: 144300 - protein, 32 aa, Artificial Sequence
  Description of Artificial Sequence: Synthetic polypeptide
DESEIATTNPVSTEPYGTMSMETIQQQHNGNH

SEQ ID NO: 144301 - protein, 35 aa, Artificial Sequence
  Description of Artificial Sequence: Synthetic polypeptide
DEEEIRTTNPVATEQYGCVCSNWMEPQENFNSDQS

SEQ ID NO: 144302 - protein, 37 aa, Artificial Sequence
  Description of Artificial Sequence: Synthetic polypeptide
AEEEIRTTNPVATEAYGSVSTTVNQNELQEATNNATE

SEQ ID NO: 144303 - protein, 36 aa, Artificial Sequence
  Description of Artificial Sequence: Synthetic polypeptide
AEEEIRTTNPVATEAYGSVSTTVNNQNTNQQGTTAD

SEQ ID NO: 144304 - protein, 31 aa, Artificial Sequence
  Description of Artificial Sequence: Synthetic polypeptide
DESEIATTNPVSTEPYGNIAAMTIQSRVGNH

SEQ ID NO: 144305 - protein, 34 aa, Artificial Sequence
  Description of Artificial Sequence: Synthetic polypeptide
DECEICTTNPVATEQYGSVSTTVQALEDEEEEED

SEQ ID NO: 144306 - protein, 34 aa, Artificial Sequence
  Description of Artificial Sequence: Synthetic polypeptide
DECEICTTNPVATEQYGSVSTVAANNEDTEEEDD

SEQ ID NO: 144307 - protein, 32 aa, Artificial Sequence
  Description of Artificial Sequence: Synthetic polypeptide
DESEIRTTNPVATEQWGDVSEIEPMNRAEEDA

SEQ ID NO: 144308 - protein, 33 aa, Artificial Sequence
  Description of Artificial Sequence: Synthetic polypeptide
DEDEIATTNPVAYEQYGSCSTNQEGTDSGGEDT

SEQ ID NO: 144309 - protein, 36 aa, Artificial Sequence
  Description of Artificial Sequence: Synthetic polypeptide
DEEEIRTTNPVATEQYGSVIGPTNNLLGMPAEIEDT

SEQ ID NO: 144310 - protein, 35 aa, Artificial Sequence
  Description of Artificial Sequence: Synthetic polypeptide
DEEEIRTTNPVATEQYGCVCSNWMYHQENFNSDQT

SEQ ID NO: 144311 - protein, 37 aa, Artificial Sequence
  Description of Artificial Sequence: Synthetic polypeptide
AEEEIRTTNPVATEAYGSVSTVTNNLGNNQQGTDGGE

SEQ ID NO: 144312 - protein, 37 aa, Artificial Sequence
  Description of Artificial Sequence: Synthetic polypeptide
AEEEIRTTNPVATEAYGSVSTVTNLQQLQQNEEEEDE

SEQ ID NO: 144313 - protein, 35 aa, Artificial Sequence
  Description of Artificial Sequence: Synthetic polypeptide
DEEEIATTNPVATEQYGSVCAAMLHDNAMENGNEH

SEQ ID NO: 144314 - protein, 35 aa, Artificial Sequence
  Description of Artificial Sequence: Synthetic polypeptide
AEEEIRTTNPVATEAYGSVSTVTLQNQQQAEEEED

SEQ ID NO: 144315 - protein, 36 aa, Artificial Sequence
  Description of Artificial Sequence: Synthetic polypeptide
AEEEIRTTNPVATEAYGSVSTVTDNGNVEQGNEEEQ

SEQ ID NO: 144316 - protein, 30 aa, Artificial Sequence
  Description of Artificial Sequence: Synthetic polypeptide
QEEEIATTNPVATEQYGEAPEVCSQHYEEK

SEQ ID NO: 144317 - protein, 30 aa, Artificial Sequence
  Description of Artificial Sequence: Synthetic polypeptide
DESEIATTNPVSTEGYGVIAMETLQQQGDI

SEQ ID NO: 144318 - protein, 36 aa, Artificial Sequence
  Description of Artificial Sequence: Synthetic polypeptide
AEEEIRTTNPVATEAYGSVSTVNTNNQNEATNVATE

SEQ ID NO: 144319 - protein, 36 aa, Artificial Sequence
  Description of Artificial Sequence: Synthetic polypeptide
AEEEIRTTNPVATEAYGSVSTVNSNNNVEQGTNDQD

SEQ ID NO: 144320 - protein, 30 aa, Artificial Sequence
  Description of Artificial Sequence: Synthetic polypeptide
QEEEIATTNPVATEQYGEAPEVCSQHVETK

SEQ ID NO: 144321 - protein, 32 aa, Artificial Sequence
  Description of Artificial Sequence: Synthetic polypeptide
DESEIATTNPVSTEGYGVISMEDLQQQQNGNH

SEQ ID NO: 144322 - protein, 37 aa, Artificial Sequence
  Description of Artificial Sequence: Synthetic polypeptide
AEEEIRTTNPVATEAYGSVSTVNNQQGTNDEGNNTDT

SEQ ID NO: 144323 - protein, 32 aa, Artificial Sequence
  Description of Artificial Sequence: Synthetic polypeptide
DESEIRTTNPVATEQWGDVSEIEPMDRAEEDA

SEQ ID NO: 144324 - protein, 35 aa, Artificial Sequence
  Description of Artificial Sequence: Synthetic polypeptide
DEEEIRTTNPVATEQYGCVCSNWMEHQENFGSDQA

SEQ ID NO: 144325 - protein, 36 aa, Artificial Sequence
  Description of Artificial Sequence: Synthetic polypeptide
DEEEIRTTNPVATEQWGICQVCSNTNDLNANFGSGF

SEQ ID NO: 144326 - protein, 34 aa, Artificial Sequence
  Description of Artificial Sequence: Synthetic polypeptide
DESEIRTTNPVATEQWGSVSACDEPEDHEGENDL

SEQ ID NO: 144327 - protein, 34 aa, Artificial Sequence
  Description of Artificial Sequence: Synthetic polypeptide
DEDEIATTNPVAYEQYGSVAATANGQAEPGGQDN

SEQ ID NO: 144328 - protein, 34 aa, Artificial Sequence
  Description of Artificial Sequence: Synthetic polypeptide
AEDEICATNPVATEQYGVVATSENNLQLLGGNDD

SEQ ID NO: 144329 - protein, 37 aa, Artificial Sequence
  Description of Artificial Sequence: Synthetic polypeptide
DECEICTTNPVATEQYGSVSTTTNQQQGNQQGTNVED

SEQ ID NO: 144330 - protein, 36 aa, Artificial Sequence
  Description of Artificial Sequence: Synthetic polypeptide
QEEEIRTTNPVATEQYGSVMGGDQNGGQNQGGANGD

SEQ ID NO: 144331 - protein, 32 aa, Artificial Sequence
  Description of Artificial Sequence: Synthetic polypeptide
DESEIATTNPVSSEQWGSVSCINEPQSEGETG

SEQ ID NO: 144332 - protein, 36 aa, Artificial Sequence
  Description of Artificial Sequence: Synthetic polypeptide
AEEEIRTTNPVATEAYGSVSTVVSNNNSEEGTNTQD

SEQ ID NO: 144333 - protein, 36 aa, Artificial Sequence
  Description of Artificial Sequence: Synthetic polypeptide
AEEEIRTTNPVATEAYGSVSTVVSNNNVEEGTNPTD

SEQ ID NO: 144334 - protein, 37 aa, Artificial Sequence
  Description of Artificial Sequence: Synthetic polypeptide
AEEEIRTTNPVATEQYGSVVTVVTDGGNNQLGGNTDG

SEQ ID NO: 144335 - protein, 34 aa, Artificial Sequence
  Description of Artificial Sequence: Synthetic polypeptide
DEDEIATTNPVAYEQYGSVAATAHGQAMPGGNPQ

SEQ ID NO: 144336 - protein, 34 aa, Artificial Sequence
  Description of Artificial Sequence: Synthetic polypeptide
DEDEIATTNPVAYEQYGSVAATAHGQAAPDGNHH

SEQ ID NO: 144337 - protein, 37 aa, Artificial Sequence
  Description of Artificial Sequence: Synthetic polypeptide
AEEEIRTTNPVATEQYGSVVTVVTDGGNNQLGGNNDD

SEQ ID NO: 144338 - protein, 30 aa, Artificial Sequence
  Description of Artificial Sequence: Synthetic polypeptide
QEEEIATTNPVATEQYGEAPEVCVQHEAEK

SEQ ID NO: 144339 - protein, 30 aa, Artificial Sequence
  Description of Artificial Sequence: Synthetic polypeptide
QEEEIATTNPVATEQYGEAPEVCVQHDEEK

SEQ ID NO: 144340 - protein, 36 aa, Artificial Sequence
  Description of Artificial Sequence: Synthetic polypeptide
AEEEIRTTNPVATEAYGSVSTVTQNGNVEQGTEEEA

SEQ ID NO: 144341 - protein, 36 aa, Artificial Sequence
  Description of Artificial Sequence: Synthetic polypeptide
AEEEIRTTNPVATEAYGSVSTVVNNQQLQEAEEEDE

SEQ ID NO: 144342 - protein, 37 aa, Artificial Sequence
  Description of Artificial Sequence: Synthetic polypeptide
DECEICTTNPVATEQYGSVSTTTNQQQGNQQGNTTNE

SEQ ID NO: 144343 - protein, 35 aa, Artificial Sequence
  Description of Artificial Sequence: Synthetic polypeptide
QEEEIRTTNPVATEQYGSVMGLVNGGQQNDNEEEG

SEQ ID NO: 144344 - protein, 32 aa, Artificial Sequence
  Description of Artificial Sequence: Synthetic polypeptide
DEEEIATTNPVATEMWGSVICANANPDNDHNT

SEQ ID NO: 144345 - protein, 36 aa, Artificial Sequence
  Description of Artificial Sequence: Synthetic polypeptide
DESEIRTTNPVATEQYASVSSTTPAGPNMRNGMNPV

SEQ ID NO: 144346 - protein, 38 aa, Artificial Sequence
  Description of Artificial Sequence: Synthetic polypeptide
AEEEIRTTNPVATEAYGSVSTVVTTNLQQGNQGTNNTQ

SEQ ID NO: 144347 - protein, 36 aa, Artificial Sequence
  Description of Artificial Sequence: Synthetic polypeptide
DEEEIRTTNPVATEQYGSVIGPTNNLNMEEHEIEDL

SEQ ID NO: 144348 - protein, 36 aa, Artificial Sequence
  Description of Artificial Sequence: Synthetic polypeptide
DEEEIRTTNPVATEQYGSVSTEVGPVNQASDETLIF

SEQ ID NO: 144349 - protein, 36 aa, Artificial Sequence
  Description of Artificial Sequence: Synthetic polypeptide
QEEEIRTTNPVATEQYGSVMGTNMTGQFEEGGGEQA

SEQ ID NO: 144350 - protein, 36 aa, Artificial Sequence
  Description of Artificial Sequence: Synthetic polypeptide
DEEEIRTTNPVATEQYGSVIGPTNNLNMAPFEIEDT

SEQ ID NO: 144351 - protein, 37 aa, Artificial Sequence
  Description of Artificial Sequence: Synthetic polypeptide
DECEICTTNPVATEQYGSVSTTTNLQNNNNQGTEEED

SEQ ID NO: 144352 - protein, 37 aa, Artificial Sequence
  Description of Artificial Sequence: Synthetic polypeptide
DECEICTTNPVATEQYGSVSTTTNLQNQNNNNNEEEE

SEQ ID NO: 144353 - protein, 38 aa, Artificial Sequence
  Description of Artificial Sequence: Synthetic polypeptide
AEEEIRTTNPVATEAYGSVSTVVTTNLGQQGTNNNNND

SEQ ID NO: 144354 - protein, 34 aa, Artificial Sequence
  Description of Artificial Sequence: Synthetic polypeptide
DEEEIRTTNPVATEQYGCVCSSEEPNENFNSDQS

SEQ ID NO: 144355 - protein, 35 aa, Artificial Sequence
  Description of Artificial Sequence: Synthetic polypeptide
AEEEIRTTNPVATEAYGSVSTVVSNNQQQAEEEED

SEQ ID NO: 144356 - protein, 36 aa, Artificial Sequence
  Description of Artificial Sequence: Synthetic polypeptide
AEEEIRTTNPVATEAYGSVSTVVSNNNVEEGTNTNQ

SEQ ID NO: 144357 - protein, 35 aa, Artificial Sequence
  Description of Artificial Sequence: Synthetic polypeptide
DEEEIRTTNPVATECYGSVVICTFESSFNGGNNED

SEQ ID NO: 144358 - protein, 35 aa, Artificial Sequence
  Description of Artificial Sequence: Synthetic polypeptide
QEEEIRTTNPVATEQYGSVMGNNNMIDEGNGNDQE

SEQ ID NO: 144359 - protein, 36 aa, Artificial Sequence
  Description of Artificial Sequence: Synthetic polypeptide
DEEEIRTTNPVATEQYGSVIGPTNNLLMMPLEIEDP

SEQ ID NO: 144360 - protein, 33 aa, Artificial Sequence
  Description of Artificial Sequence: Synthetic polypeptide
DEDEIATTNPVAYEQYGSVAANNDATMPGGERH

SEQ ID NO: 144361 - protein, 32 aa, Artificial Sequence
  Description of Artificial Sequence: Synthetic polypeptide
CEDEIACTNPVATEQYGNCASANLQMPMGQAM

SEQ ID NO: 144362 - protein, 35 aa, Artificial Sequence
  Description of Artificial Sequence: Synthetic polypeptide
TEEEIRTTNPVATDQYGSTIPSAGNALSDEFENNR

SEQ ID NO: 144363 - protein, 29 aa, Artificial Sequence
  Description of Artificial Sequence: Synthetic peptide
DESEIATTNPVSTEGYGEAAEVIQHVGEK

SEQ ID NO: 144364 - protein, 35 aa, Artificial Sequence
  Description of Artificial Sequence: Synthetic polypeptide
DEDEIATTNPVAYEQYGSTVCAANNLQDADGNGTD

SEQ ID NO: 144365 - protein, 35 aa, Artificial Sequence
  Description of Artificial Sequence: Synthetic polypeptide
AEEEIRTTNPVATEAYGSVSTVTNNQQQAEEEEAE

SEQ ID NO: 144366 - protein, 34 aa, Artificial Sequence
  Description of Artificial Sequence: Synthetic polypeptide
DEDEIATTNPVAYEQYGSTVCAANNLQDADGMYD

SEQ ID NO: 144367 - protein, 36 aa, Artificial Sequence
  Description of Artificial Sequence: Synthetic polypeptide
AEEEIRTTNPVATEAYGSVSTVTNNQQLQTEEEEDE

SEQ ID NO: 144368 - protein, 35 aa, Artificial Sequence
  Description of Artificial Sequence: Synthetic polypeptide
DEEEIRTTNPVATEQYGCVCSSEEHNQEFFGSDQQ

SEQ ID NO: 144369 - protein, 35 aa, Artificial Sequence
  Description of Artificial Sequence: Synthetic polypeptide
TEEEIRTTNPVATEAWGVSVRTWNDDDQDRREKAR

SEQ ID NO: 144370 - protein, 34 aa, Artificial Sequence
  Description of Artificial Sequence: Synthetic polypeptide
DECEICTTNPVATEQYGSVSTTVATLEDTEEEDD

SEQ ID NO: 144371 - protein, 36 aa, Artificial Sequence
  Description of Artificial Sequence: Synthetic polypeptide
DEEEIRTTNPVATEQWGICNVCSYTEDLNARFGSEF

SEQ ID NO: 144372 - protein, 34 aa, Artificial Sequence
  Description of Artificial Sequence: Synthetic polypeptide
DEEEIRTTNPVATEQYGCVCSSEEHINFNSQPQS

SEQ ID NO: 144373 - protein, 33 aa, Artificial Sequence
  Description of Artificial Sequence: Synthetic polypeptide
AEDEICATNPVATEQYGVVATSENQLQLGGGTD

SEQ ID NO: 144374 - protein, 36 aa, Artificial Sequence
  Description of Artificial Sequence: Synthetic polypeptide
DEEEIRTTNPVATEQYGCVCSSEEHEAENFQSDNQS

SEQ ID NO: 144375 - protein, 35 aa, Artificial Sequence
  Description of Artificial Sequence: Synthetic polypeptide
DEEEIATTNPVATEQYGSVCAAMMHGQNEMGNADN

SEQ ID NO: 144376 - protein, 35 aa, Artificial Sequence
  Description of Artificial Sequence: Synthetic polypeptide
DESEIRTTNPVATEQWGSVSACINEPQDHEGEEDG

SEQ ID NO: 144377 - protein, 29 aa, Artificial Sequence
  Description of Artificial Sequence: Synthetic peptide
QEEEIATTNPVATEQYGEAPEVCVEHEEK

SEQ ID NO: 144378 - protein, 35 aa, Artificial Sequence
  Description of Artificial Sequence: Synthetic polypeptide
DEDEIATTNPVAYEQYGSTVCAANNLQDADDNNRD

SEQ ID NO: 144379 - protein, 35 aa, Artificial Sequence
  Description of Artificial Sequence: Synthetic polypeptide
AEEEIRTTNPVATEAYGSVSTVTNNQQQAEEEEDE

SEQ ID NO: 144380 - protein, 34 aa, Artificial Sequence
  Description of Artificial Sequence: Synthetic polypeptide
DESEIRTTNPVATEQWGSVSACDEPEDHEGENDG

SEQ ID NO: 144381 - protein, 35 aa, Artificial Sequence
  Description of Artificial Sequence: Synthetic polypeptide
QEEEIRTTNPVATEQYGSVIYGVGQQGGDGEENET

SEQ ID NO: 144382 - protein, 35 aa, Artificial Sequence
  Description of Artificial Sequence: Synthetic polypeptide
DEDEIATTNPVAYEQYGSTVCAANNLQDADGNNNK

SEQ ID NO: 144383 - protein, 36 aa, Artificial Sequence
  Description of Artificial Sequence: Synthetic polypeptide
TEEEIRTTNPVATDQYGSTVPSVQGNNLSDEFENNR

SEQ ID NO: 144384 - protein, 36 aa, Artificial Sequence
  Description of Artificial Sequence: Synthetic polypeptide
AEEEIRTTNPVATEAYGSVSTVTQNGNNVEQGTEES

SEQ ID NO: 144385 - protein, 29 aa, Artificial Sequence
  Description of Artificial Sequence: Synthetic peptide
QEEEIATTNPVATEQYGEAPEVCVHEEKF

SEQ ID NO: 144386 - protein, 35 aa, Artificial Sequence
  Description of Artificial Sequence: Synthetic polypeptide
DEEEIRTTNPVATEQYGCVCSSEEHNQNFISDNQA

SEQ ID NO: 144387 - protein, 36 aa, Artificial Sequence
  Description of Artificial Sequence: Synthetic polypeptide
AEEEIRTTNPVATEAYGSVSTVTNTNNQEATNNATE

SEQ ID NO: 144388 - protein, 36 aa, Artificial Sequence
  Description of Artificial Sequence: Synthetic polypeptide
DEEEIATTNPVATEQYGSVCAAMNHDEQAMPGNDNH

SEQ ID NO: 144389 - protein, 36 aa, Artificial Sequence
  Description of Artificial Sequence: Synthetic polypeptide
QEEEIRTTNPVATEQYGSVLITNDEGDDQGGQEEED

SEQ ID NO: 144390 - protein, 33 aa, Artificial Sequence
  Description of Artificial Sequence: Synthetic polypeptide
DESEIRTTNPVATEQWGSVSCIIEPMDREEEDG

SEQ ID NO: 144391 - protein, 33 aa, Artificial Sequence
  Description of Artificial Sequence: Synthetic polypeptide
DESEIRTTNPVATEQWGSVSCIIEPMDRAEEDG

SEQ ID NO: 144392 - protein, 33 aa, Artificial Sequence
  Description of Artificial Sequence: Synthetic polypeptide
DEDEIATTNPVAYEQYGSVAAAANQGLQNPPPT

SEQ ID NO: 144393 - protein, 34 aa, Artificial Sequence
  Description of Artificial Sequence: Synthetic polypeptide
AEDEICATNPVATEQYGVVATSENNLQLLGNGTD

SEQ ID NO: 144394 - protein, 35 aa, Artificial Sequence
  Description of Artificial Sequence: Synthetic polypeptide
DEEEIRTTNPVATEQYGCVCSSEEHNQEHFNSQQS

SEQ ID NO: 144395 - protein, 37 aa, Artificial Sequence
  Description of Artificial Sequence: Synthetic polypeptide
AEEEIRTTNPVATEAYGSVSTVTNQQAGEQQGNNQGD

SEQ ID NO: 144396 - protein, 35 aa, Artificial Sequence
  Description of Artificial Sequence: Synthetic polypeptide
DEDEIATTNPVAYEQYGSTVCAANNLQDTPDGNGN

SEQ ID NO: 144397 - protein, 35 aa, Artificial Sequence
  Description of Artificial Sequence: Synthetic polypeptide
AEEEIRTTNPVATEAYGSVSTVTNNQQQSEEEEVD

SEQ ID NO: 144398 - protein, 35 aa, Artificial Sequence
  Description of Artificial Sequence: Synthetic polypeptide
AEEEIRTTNPVATEAYGSVSTVTNNQQQQAEEEGD

SEQ ID NO: 144399 - protein, 33 aa, Artificial Sequence
  Description of Artificial Sequence: Synthetic polypeptide
DEDEIATTNPVAYEQWGSVSGGMNHQGQGGGEN

SEQ ID NO: 144400 - protein, 36 aa, Artificial Sequence
  Description of Artificial Sequence: Synthetic polypeptide
AEEEIRTTNPVATEAYGSVSTTTQQQNGTEQGTNDE

SEQ ID NO: 144401 - protein, 36 aa, Artificial Sequence
  Description of Artificial Sequence: Synthetic polypeptide
DEEEIRTTNPVATEQYGSVIGPTNNLLGHPLEIEDI

SEQ ID NO: 144402 - protein, 36 aa, Artificial Sequence
  Description of Artificial Sequence: Synthetic polypeptide
DEEEIRTTNPVATEQWGSTWSTTPAGPNMRNGMNYV

SEQ ID NO: 144403 - protein, 34 aa, Artificial Sequence
  Description of Artificial Sequence: Synthetic polypeptide
CEEEIACTNPVATEQWGCNVAGTNLQAENAGMNM

SEQ ID NO: 144404 - protein, 34 aa, Artificial Sequence
  Description of Artificial Sequence: Synthetic polypeptide
DESEIRTTNPVATEMWGSVSCIAEPQDHKGENGE

SEQ ID NO: 144405 - protein, 35 aa, Artificial Sequence
  Description of Artificial Sequence: Synthetic polypeptide
DEEEIRTTNPVATECYGSVGDNDNDQGGGGEDEEY

SEQ ID NO: 144406 - protein, 34 aa, Artificial Sequence
  Description of Artificial Sequence: Synthetic polypeptide
DEEEIRTTNPVATEQYGSVETTSGVEVAPVEEHL

SEQ ID NO: 144407 - protein, 37 aa, Artificial Sequence
  Description of Artificial Sequence: Synthetic polypeptide
DECEICTTNPVATEQYGSVSTVNAEQLGNTEEGEDED

SEQ ID NO: 144408 - protein, 35 aa, Artificial Sequence
  Description of Artificial Sequence: Synthetic polypeptide
DESEIRTTNPVATENWGSSNVTCINMPQDREGENG

SEQ ID NO: 144409 - protein, 36 aa, Artificial Sequence
  Description of Artificial Sequence: Synthetic polypeptide
DECEICTTNPVATEQYGSVSTVNANQQGTTDEEEDD

SEQ ID NO: 144410 - protein, 34 aa, Artificial Sequence
  Description of Artificial Sequence: Synthetic polypeptide
CEDEIACTNPVATEQYGSVCAANNLQEAQDGTNH

SEQ ID NO: 144411 - protein, 36 aa, Artificial Sequence
  Description of Artificial Sequence: Synthetic polypeptide
DEEEIRTTNPVATEQYGSVIGPTNNFDGMPLEIEDT

SEQ ID NO: 144412 - protein, 31 aa, Artificial Sequence
  Description of Artificial Sequence: Synthetic polypeptide
DEEEIATTNPVATEPYGEAPEEDIQQQHGEH

SEQ ID NO: 144413 - protein, 36 aa, Artificial Sequence
  Description of Artificial Sequence: Synthetic polypeptide
AEEEIRTTNPVATEAYGSVSTTNNQLGSEEGTTEDE

SEQ ID NO: 144414 - protein, 36 aa, Artificial Sequence
  Description of Artificial Sequence: Synthetic polypeptide
AEEEIRTTNPVATEAYGSVSTTNNNNNTNDEGNTDT

SEQ ID NO: 144415 - protein, 35 aa, Artificial Sequence
  Description of Artificial Sequence: Synthetic polypeptide
DESEICSTNPVATEHYGSVCIWVNDQDQRKGDNTR

SEQ ID NO: 144416 - protein, 35 aa, Artificial Sequence
  Description of Artificial Sequence: Synthetic polypeptide
DEEEIRTTNPVATEQYGCVCSNWGEHQNFNSDTQM

SEQ ID NO: 144417 - protein, 33 aa, Artificial Sequence
  Description of Artificial Sequence: Synthetic polypeptide
CEDEIACTNPVATEQYGSVCAANNLQEAGHTDN

SEQ ID NO: 144418 - protein, 35 aa, Artificial Sequence
  Description of Artificial Sequence: Synthetic polypeptide
DEEEIRTTNPVATEQYGCVCSNWGEHQNFNSETQA

SEQ ID NO: 144419 - protein, 36 aa, Artificial Sequence
  Description of Artificial Sequence: Synthetic polypeptide
QEEEIRTTNPVATEQYGSVCIPTNDLEGTNDDTQES

SEQ ID NO: 144420 - protein, 36 aa, Artificial Sequence
  Description of Artificial Sequence: Synthetic polypeptide
QEEEIRTTNPVATEQYGSVDFTQNGQGDGQDEEGEM

SEQ ID NO: 144421 - protein, 37 aa, Artificial Sequence
  Description of Artificial Sequence: Synthetic polypeptide
AEEEIRTTNPVATEAYGSVSTTNQNQNQGEQGTNQVG

SEQ ID NO: 144422 - protein, 35 aa, Artificial Sequence
  Description of Artificial Sequence: Synthetic polypeptide
QEEEIRTTNPVATEQYGSVCVPTTNGERNDDTQES

SEQ ID NO: 144423 - protein, 37 aa, Artificial Sequence
  Description of Artificial Sequence: Synthetic polypeptide
AEEEIRTTNPVATEAYGSVSTTNQNQNQDEQGTNNVE

SEQ ID NO: 144424 - protein, 36 aa, Artificial Sequence
  Description of Artificial Sequence: Synthetic polypeptide
AEEEIRTTNPVATEAYGSVSTTNQNNEQEATNVATE

SEQ ID NO: 144425 - protein, 35 aa, Artificial Sequence
  Description of Artificial Sequence: Synthetic polypeptide
DEEEIRTTNPVATEQYGCVCSNWGEHQYFNSDFQS

SEQ ID NO: 144426 - protein, 35 aa, Artificial Sequence
  Description of Artificial Sequence: Synthetic polypeptide
QEEEIRTTNPVATEQYGSVCTPTNDLETNDDTQMS

SEQ ID NO: 144427 - protein, 35 aa, Artificial Sequence
  Description of Artificial Sequence: Synthetic polypeptide
DEEEIRTTNPVATEQYGCVCSNWGEHQYFGSDTQS

SEQ ID NO: 144428 - protein, 36 aa, Artificial Sequence
  Description of Artificial Sequence: Synthetic polypeptide
DEEEIRTTNPVATECYGSVSANTEAWPAERNGMPYV

SEQ ID NO: 144429 - protein, 34 aa, Artificial Sequence
  Description of Artificial Sequence: Synthetic polypeptide
DECEICTTNPVATEQYGSVSTVAQQNEDTEEEDD

SEQ ID NO: 144430 - protein, 34 aa, Artificial Sequence
  Description of Artificial Sequence: Synthetic polypeptide
DEEEIATTNPVATEPWGISVSSYAPVSQMMGPNG

SEQ ID NO: 144431 - protein, 36 aa, Artificial Sequence
  Description of Artificial Sequence: Synthetic polypeptide
AEEEIRTTNPVATEAYGSVSTTNNQQQQEATNNATE

SEQ ID NO: 144432 - protein, 37 aa, Artificial Sequence
  Description of Artificial Sequence: Synthetic polypeptide
DEEEIRTTNPVATEQWGSTVSSNAPAWPNMRNGMNPV

SEQ ID NO: 144433 - protein, 35 aa, Artificial Sequence
  Description of Artificial Sequence: Synthetic polypeptide
QEEEIRTTNPVATEQYGSVCSPTCDLETFDDTQES

SEQ ID NO: 144434 - protein, 37 aa, Artificial Sequence
  Description of Artificial Sequence: Synthetic polypeptide
AEEEIRTTNPVATEAYGSVSTTNNQQGTAEEGTNTDE

SEQ ID NO: 144435 - protein, 37 aa, Artificial Sequence
  Description of Artificial Sequence: Synthetic polypeptide
DECEICTTNPVATEQYGSVSTVNAQQGNNNEENEDED

SEQ ID NO: 144436 - protein, 35 aa, Artificial Sequence
  Description of Artificial Sequence: Synthetic polypeptide
DEEEIRTTNPVATEQYGCVCSNWGEHQNFGSQTQG

SEQ ID NO: 144437 - protein, 35 aa, Artificial Sequence
  Description of Artificial Sequence: Synthetic polypeptide
DEEEIRTTNPVATECYGSVFCTEEESSFNGGNNED

SEQ ID NO: 144438 - protein, 33 aa, Artificial Sequence
  Description of Artificial Sequence: Synthetic polypeptide
DESEICTTNPVATECWGSVSCINEPQDKEEENG

SEQ ID NO: 144439 - protein, 30 aa, Artificial Sequence
  Description of Artificial Sequence: Synthetic polypeptide
QEEEIATTNPVATEQYGEAPEVCQSHVEEK

SEQ ID NO: 144440 - protein, 35 aa, Artificial Sequence
  Description of Artificial Sequence: Synthetic polypeptide
AEEEIRTTNPVATEAYGSVSTTDNGNNNEQGEDED

SEQ ID NO: 144441 - protein, 36 aa, Artificial Sequence
  Description of Artificial Sequence: Synthetic polypeptide
AEEEIRTTNPVATEAYGSVSTTAQQNQQEATNVATE

SEQ ID NO: 144442 - protein, 36 aa, Artificial Sequence
  Description of Artificial Sequence: Synthetic polypeptide
AEEEIRTTNPVATEAYGSVSTSTQNGNVEQGTEEGS

SEQ ID NO: 144443 - protein, 37 aa, Artificial Sequence
  Description of Artificial Sequence: Synthetic polypeptide
AEEEIRTTNPVATEAYGSVSTSNNQQGTQQIGTNAND

SEQ ID NO: 144444 - protein, 35 aa, Artificial Sequence
  Description of Artificial Sequence: Synthetic polypeptide
DEDEIATTNPVAYEQWGSVSHTTNGNDDTGGGNTR

SEQ ID NO: 144445 - protein, 37 aa, Artificial Sequence
  Description of Artificial Sequence: Synthetic polypeptide
AEEEIRTTNPVATEAYGSVSTSNNQQGTEQGGTNQND

SEQ ID NO: 144446 - protein, 30 aa, Artificial Sequence
  Description of Artificial Sequence: Synthetic polypeptide
QEEEIASTNPVATEQYGNAPETCQSHVGEK

SEQ ID NO: 144447 - protein, 37 aa, Artificial Sequence
  Description of Artificial Sequence: Synthetic polypeptide
AEEEIRTTNPVATEAYGSVSTNTQQQNATEQGTANVE

SEQ ID NO: 144448 - protein, 37 aa, Artificial Sequence
  Description of Artificial Sequence: Synthetic polypeptide
AEEEIRTTNPVATEAYGSVSTNTQNGNNVEQGTEEED

SEQ ID NO: 144449 - protein, 37 aa, Artificial Sequence
  Description of Artificial Sequence: Synthetic polypeptide
AEEEIRTTNPVATEAYGSVSTNTNQQGNNQQGNNTND

SEQ ID NO: 144450 - protein, 32 aa, Artificial Sequence
  Description of Artificial Sequence: Synthetic polypeptide
DEDEIATTNPVAYEQWGSVSGGNGNSGEGDTQ

SEQ ID NO: 144451 - protein, 33 aa, Artificial Sequence
  Description of Artificial Sequence: Synthetic polypeptide
DEDEIATTNPVAYEQWGSVSGGNGNPSGEGNTD

SEQ ID NO: 144452 - protein, 34 aa, Artificial Sequence
  Description of Artificial Sequence: Synthetic polypeptide
QEEEIRTTNPVATEQYGSISCCGSESSQGPGSYE

SEQ ID NO: 144453 - protein, 35 aa, Artificial Sequence
  Description of Artificial Sequence: Synthetic polypeptide
DECEICTTNPVATEQYGSVSTVNAQQNEDEEEEDE

SEQ ID NO: 144454 - protein, 36 aa, Artificial Sequence
  Description of Artificial Sequence: Synthetic polypeptide
AEEEIRTTNPVATEAYGSVSTTDNGNNVEQGTEGED

SEQ ID NO: 144455 - protein, 37 aa, Artificial Sequence
  Description of Artificial Sequence: Synthetic polypeptide
AEEEIRTTNPVATEAYGSVSTTNQQAGNNQQGEINQE

SEQ ID NO: 144456 - protein, 36 aa, Artificial Sequence
  Description of Artificial Sequence: Synthetic polypeptide
DECEICTTNPVATEQYGSVSTVNAQQGTTEEEEDEE

SEQ ID NO: 144457 - protein, 35 aa, Artificial Sequence
  Description of Artificial Sequence: Synthetic polypeptide
QEEEIRTTNPVATEQYGSSCSPTNDLETNDDTQVS

SEQ ID NO: 144458 - protein, 35 aa, Artificial Sequence
  Description of Artificial Sequence: Synthetic polypeptide
DEEEIRTTNPVATEQYGCVCSNWGEHQHFNSDTQT

SEQ ID NO: 144459 - protein, 36 aa, Artificial Sequence
  Description of Artificial Sequence: Synthetic polypeptide
AEEEIRTTNPVATEAYGSVSTTNNLLQGTAEETTED

SEQ ID NO: 144460 - protein, 37 aa, Artificial Sequence
  Description of Artificial Sequence: Synthetic polypeptide
DEEEIRTTNPVATECYGSTVSSTTPDGPNMRKGMNYV

SEQ ID NO: 144461 - protein, 35 aa, Artificial Sequence
  Description of Artificial Sequence: Synthetic polypeptide
DEEEIRTTNPVATEQYGCVCSNWGEHQEYFNSDQA

SEQ ID NO: 144462 - protein, 35 aa, Artificial Sequence
  Description of Artificial Sequence: Synthetic polypeptide
AEEEIRTTNPVATEAYGSVSTTNNGNNVEQGDEED

SEQ ID NO: 144463 - protein, 34 aa, Artificial Sequence
  Description of Artificial Sequence: Synthetic polypeptide
CEDEIACTNPVATEQYGSVCATNLQPDNQAEGAV

SEQ ID NO: 144464 - protein, 35 aa, Artificial Sequence
  Description of Artificial Sequence: Synthetic polypeptide
AEEEIRTTNPVATEQYGSVVTVTTNNNNSEAGTIF

SEQ ID NO: 144465 - protein, 38 aa, Artificial Sequence
  Description of Artificial Sequence: Synthetic polypeptide
AEEEIRTTNPVATEQYGSVVTVTTNNNLQSNEAGTNND

SEQ ID NO: 144466 - protein, 34 aa, Artificial Sequence
  Description of Artificial Sequence: Synthetic polypeptide
CEDEIACTNPVATEQYGSVCATNLQPDNQTEGDD

SEQ ID NO: 144467 - protein, 30 aa, Artificial Sequence
  Description of Artificial Sequence: Synthetic polypeptide
QEEEIASTNPVATEQYGNAAAEVCQSHEER

SEQ ID NO: 144468 - protein, 36 aa, Artificial Sequence
  Description of Artificial Sequence: Synthetic polypeptide
QEEEIRTTNPVATEQYGSVASGGDGGNDGQEDDNIQ

SEQ ID NO: 144469 - protein, 36 aa, Artificial Sequence
  Description of Artificial Sequence: Synthetic polypeptide
AEEEIRTTNPVATEAYGSVSTTNGNQQNEATNNATE

SEQ ID NO: 144470 - protein, 36 aa, Artificial Sequence
  Description of Artificial Sequence: Synthetic polypeptide
QEEEIRTTNPVATEQYGSVAGNDTDDLGQGGPEFED

SEQ ID NO: 144471 - protein, 34 aa, Artificial Sequence
  Description of Artificial Sequence: Synthetic polypeptide
DEDEIATTNPVAYEQWGSVTSANPNDQRPVNAML

SEQ ID NO: 144472 - protein, 34 aa, Artificial Sequence
  Description of Artificial Sequence: Synthetic polypeptide
AEDEICATNPVATEQYGVVATTENLQLLGNGTDE

SEQ ID NO: 144473 - protein, 34 aa, Artificial Sequence
  Description of Artificial Sequence: Synthetic polypeptide
DEEEIRTTNPVATECYGNVHCTEESSFNGGNNED

SEQ ID NO: 144474 - protein, 36 aa, Artificial Sequence
  Description of Artificial Sequence: Synthetic polypeptide
DEEEIRTTNPVATEQYGCVCSNWMEHNQEGFNSEQG

SEQ ID NO: 144475 - protein, 35 aa, Artificial Sequence
  Description of Artificial Sequence: Synthetic polypeptide
DEEEIRTTNPVATEQYGCVCSNWGEHQYFNSDNQS

SEQ ID NO: 144476 - protein, 35 aa, Artificial Sequence
  Description of Artificial Sequence: Synthetic polypeptide
QEEEIRTTNPVATEQYGSVDIMNNNINEGGGQNGT

SEQ ID NO: 144477 - protein, 36 aa, Artificial Sequence
  Description of Artificial Sequence: Synthetic polypeptide
AEEEIRTTNPVATEAYGSVSTTTDNGNNVEQGENED

SEQ ID NO: 144478 - protein, 35 aa, Artificial Sequence
  Description of Artificial Sequence: Synthetic polypeptide
TEEEIRTTNPVATEFYGSVGDFGNNDGQENDDGNG

SEQ ID NO: 144479 - protein, 34 aa, Artificial Sequence
  Description of Artificial Sequence: Synthetic polypeptide
DEEEIATTNPVATEQYGSVCAAMHGPADSGEHNH

SEQ ID NO: 144480 - protein, 37 aa, Artificial Sequence
  Description of Artificial Sequence: Synthetic polypeptide
AEEEIRTTNPVATEQYGSVVTVTTNQNGNQQGNNQGD

SEQ ID NO: 144481 - protein, 29 aa, Artificial Sequence
  Description of Artificial Sequence: Synthetic peptide
QEEEIATTNPVATEQYGEAPEVCSHEAEK

SEQ ID NO: 144482 - protein, 28 aa, Artificial Sequence
  Description of Artificial Sequence: Synthetic peptide
QEEEIASTNPVATEGYGEAAEVCQHEEK

SEQ ID NO: 144483 - protein, 34 aa, Artificial Sequence
  Description of Artificial Sequence: Synthetic polypeptide
DEEEIATTNPVATEQYGSVCAAMHGPADSGENNY

SEQ ID NO: 144484 - protein, 28 aa, Artificial Sequence
  Description of Artificial Sequence: Synthetic peptide
QEEEIASTNPVATEGYGEAPEVCQHEEK

SEQ ID NO: 144485 - protein, 36 aa, Artificial Sequence
  Description of Artificial Sequence: Synthetic polypeptide
DEEEIRTTNPVATEQYGCVCSNWGEWHQNFGSDNQS

SEQ ID NO: 144486 - protein, 31 aa, Artificial Sequence
  Description of Artificial Sequence: Synthetic polypeptide
QEEEIASTNPVATEGYGNAAANTCQSRVGQK

SEQ ID NO: 144487 - protein, 31 aa, Artificial Sequence
  Description of Artificial Sequence: Synthetic polypeptide
QEEEIASTNPVATEGYGNAAANTIQSRVGQK

SEQ ID NO: 144488 - protein, 36 aa, Artificial Sequence
  Description of Artificial Sequence: Synthetic polypeptide
AEEEIRTTNPVATEAYGSVSTTQQQLQNNNNGTEDE

SEQ ID NO: 144489 - protein, 34 aa, Artificial Sequence
  Description of Artificial Sequence: Synthetic polypeptide
DEEEIATTNPVATEQYGSVCAAMHDNMGGEDGTE

SEQ ID NO: 144490 - protein, 31 aa, Artificial Sequence
  Description of Artificial Sequence: Synthetic polypeptide
DESEIRTTNPVATEQWGDIVSEIEMNAAEDA

SEQ ID NO: 144491 - protein, 30 aa, Artificial Sequence
  Description of Artificial Sequence: Synthetic polypeptide
DESEIRTTNPVATEQWGDVAEIEMNAAEDA

SEQ ID NO: 144492 - protein, 32 aa, Artificial Sequence
  Description of Artificial Sequence: Synthetic polypeptide
DESEIRTTNPVATEQWGDVSCIEPMDRAEEDA

SEQ ID NO: 144493 - protein, 36 aa, Artificial Sequence
  Description of Artificial Sequence: Synthetic polypeptide
AEEEIRTTNPVATEAYGSVSTTTDNGNNVEQGNEEQ

SEQ ID NO: 144494 - protein, 36 aa, Artificial Sequence
  Description of Artificial Sequence: Synthetic polypeptide
AEEEIRTTNPVATEAYGSVSTTTDNGNVEQGTEDNN

SEQ ID NO: 144495 - protein, 36 aa, Artificial Sequence
  Description of Artificial Sequence: Synthetic polypeptide
AEEEIRTTNPVATEAYGSVSTTTQNGNVEQGTTEEF

SEQ ID NO: 144496 - protein, 36 aa, Artificial Sequence
  Description of Artificial Sequence: Synthetic polypeptide
AEEEIRTTNPVATEAYGSVSTTTQNGNVEQGTEDES

SEQ ID NO: 144497 - protein, 32 aa, Artificial Sequence
  Description of Artificial Sequence: Synthetic polypeptide
YEEEIASVNPVCTEQYGVVWSNDENLAEPGNQ

SEQ ID NO: 144498 - protein, 33 aa, Artificial Sequence
  Description of Artificial Sequence: Synthetic polypeptide
DESEIRTTNPVATEQWGDVSCINEPMDAEGEDG

SEQ ID NO: 144499 - protein, 36 aa, Artificial Sequence
  Description of Artificial Sequence: Synthetic polypeptide
AEEEIRTTNPVATEAYGSVSTTTNNNQQEATNVATE

SEQ ID NO: 144500 - protein, 34 aa, Artificial Sequence
  Description of Artificial Sequence: Synthetic polypeptide
DEEEIRTTNPVATEQYGSVETPIFIATVVEQFQV

SEQ ID NO: 144501 - protein, 36 aa, Artificial Sequence
  Description of Artificial Sequence: Synthetic polypeptide
DEEEIRTTNPVATECYGSVSSTTPAGPNMRNGMWPV

SEQ ID NO: 144502 - protein, 34 aa, Artificial Sequence
  Description of Artificial Sequence: Synthetic polypeptide
DEEEIATTNPVATEQYGSVCAAMHGQAMQPNDNP

SEQ ID NO: 144503 - protein, 34 aa, Artificial Sequence
  Description of Artificial Sequence: Synthetic polypeptide
DEEEIATTNPVATEQYGSVCAAMHGQAMPMEDRP

SEQ ID NO: 144504 - protein, 33 aa, Artificial Sequence
  Description of Artificial Sequence: Synthetic polypeptide
QEEEIATTNPVATEQYGSTAATTEVQNHQDNDA

SEQ ID NO: 144505 - protein, 36 aa, Artificial Sequence
  Description of Artificial Sequence: Synthetic polypeptide
AEEEIRTTNPVATEAYGSVSTTTNNNQQDENGTDEM

SEQ ID NO: 144506 - protein, 36 aa, Artificial Sequence
  Description of Artificial Sequence: Synthetic polypeptide
AEEEIRTTNPVATEAYGSVSTTTNNNQAEATNNATE

SEQ ID NO: 144507 - protein, 36 aa, Artificial Sequence
  Description of Artificial Sequence: Synthetic polypeptide
DEEEIRTTNPVATEQYGSVMTGGNDITDDENEMNGE

SEQ ID NO: 144508 - protein, 32 aa, Artificial Sequence
  Description of Artificial Sequence: Synthetic polypeptide
DESEIRTTNPVATEQWGDVSCIEPMDREEEDA

SEQ ID NO: 144509 - protein, 35 aa, Artificial Sequence
  Description of Artificial Sequence: Synthetic polypeptide
DECEICTTNPVATEQYGSVSTVANQQGDTEEAEDD

SEQ ID NO: 144510 - protein, 34 aa, Artificial Sequence
  Description of Artificial Sequence: Synthetic polypeptide
DEEEIATTNPVATEQYGSVCAAMGEEQADEQNNN

SEQ ID NO: 144511 - protein, 36 aa, Artificial Sequence
  Description of Artificial Sequence: Synthetic polypeptide
AEEEIRTTNPVATEAYGSVSTTQQQLGNNNNQQIDE

SEQ ID NO: 144512 - protein, 36 aa, Artificial Sequence
  Description of Artificial Sequence: Synthetic polypeptide
AEEEIRTTNPVATEAYGSVSTTQQQLGNNNGNQINE

SEQ ID NO: 144513 - protein, 36 aa, Artificial Sequence
  Description of Artificial Sequence: Synthetic polypeptide
DEEEIRTTNPVATECYGSVSSTTEAWPNERNGMPYV

SEQ ID NO: 144514 - protein, 37 aa, Artificial Sequence
  Description of Artificial Sequence: Synthetic polypeptide
DEEEIRTTNPVATEQYGSVIGPTNNLDQMTVLEIEDT

SEQ ID NO: 144515 - protein, 33 aa, Artificial Sequence
  Description of Artificial Sequence: Synthetic polypeptide
DESEIATVNPVATECWGSVSCINEPQDSEGENG

SEQ ID NO: 144516 - protein, 32 aa, Artificial Sequence
  Description of Artificial Sequence: Synthetic polypeptide
DESEIRTTNPVATEPWGTISMEDIQQQQNGNG

SEQ ID NO: 144517 - protein, 33 aa, Artificial Sequence
  Description of Artificial Sequence: Synthetic polypeptide
DESEIRTTNPVATEPWGTISCENIPQQQEGENH

SEQ ID NO: 144518 - protein, 37 aa, Artificial Sequence
  Description of Artificial Sequence: Synthetic polypeptide
AEEEIRTTNPVATEAYGSVSTTNQQLNNNNNGNIGQE

SEQ ID NO: 144519 - protein, 34 aa, Artificial Sequence
  Description of Artificial Sequence: Synthetic polypeptide
AEDEICATNPVATEQYGVVATSQENLQLNGNGDD

SEQ ID NO: 144520 - protein, 33 aa, Artificial Sequence
  Description of Artificial Sequence: Synthetic polypeptide
DESEIRTTNPVATEPWGTISCENEPQQQEGENH

SEQ ID NO: 144521 - protein, 33 aa, Artificial Sequence
  Description of Artificial Sequence: Synthetic polypeptide
DEDEIATTNPVAYEQWGVVSSTNMQLNDEHGRM

SEQ ID NO: 144522 - protein, 37 aa, Artificial Sequence
  Description of Artificial Sequence: Synthetic polypeptide
DEEEIRTTNPVATEQWGSTVSANAEAWPNMRNGMNPV

SEQ ID NO: 144523 - protein, 30 aa, Artificial Sequence
  Description of Artificial Sequence: Synthetic polypeptide
QEEEIATTNPVATEQYGEAPEVCQWHEEKY

SEQ ID NO: 144524 - protein, 30 aa, Artificial Sequence
  Description of Artificial Sequence: Synthetic polypeptide
QEEEIASTNPVATEQYGEAAAEVCQSHEER

SEQ ID NO: 144525 - protein, 33 aa, Artificial Sequence
  Description of Artificial Sequence: Synthetic polypeptide
DESEIATVNPVATECWGSVSDINEPQDSEGENG

SEQ ID NO: 144526 - protein, 37 aa, Artificial Sequence
  Description of Artificial Sequence: Synthetic polypeptide
DEEEIRTTNPVATEQWGSTVSANAPAWPNMRNGMNPV

SEQ ID NO: 144527 - protein, 35 aa, Artificial Sequence
  Description of Artificial Sequence: Synthetic polypeptide
DEEEIRTTNPVATEQYGSVIGPTNNINMPHEIEDI

SEQ ID NO: 144528 - protein, 33 aa, Artificial Sequence
  Description of Artificial Sequence: Synthetic polypeptide
DESEIATVNPVATECWGVVSCINEPQDREGENG

SEQ ID NO: 144529 - protein, 36 aa, Artificial Sequence
  Description of Artificial Sequence: Synthetic polypeptide
DEEEIRTTNPVATEQWGSTSSTTPAGPNMPNGMNYI

SEQ ID NO: 144530 - protein, 35 aa, Artificial Sequence
  Description of Artificial Sequence: Synthetic polypeptide
DEEEIRTTNPVATEQYGCVCSNWGELNESFNSEQS

SEQ ID NO: 144531 - protein, 32 aa, Artificial Sequence
  Description of Artificial Sequence: Synthetic polypeptide
DESEIRTTNPVATEPWGTISMEDIQQQQNGNH

SEQ ID NO: 144532 - protein, 37 aa, Artificial Sequence
  Description of Artificial Sequence: Synthetic polypeptide
AEEEIRTTNPVATEAYGSVSTTNQQQNATEQGTNLNE

SEQ ID NO: 144533 - protein, 36 aa, Artificial Sequence
  Description of Artificial Sequence: Synthetic polypeptide
DEEEIRTTNPVATECYGSVSSNTEAWPNERNGMPYV

SEQ ID NO: 144534 - protein, 34 aa, Artificial Sequence
  Description of Artificial Sequence: Synthetic polypeptide
DEEEIATTNPVATEQYGSVCAAMGEEAGDLMNNP

SEQ ID NO: 144535 - protein, 34 aa, Artificial Sequence
  Description of Artificial Sequence: Synthetic polypeptide
DECEICTTNPVATEQYGSVSTVAQGEDTEETEDD

SEQ ID NO: 144536 - protein, 36 aa, Artificial Sequence
  Description of Artificial Sequence: Synthetic polypeptide
DEEEIRTTNPVATEQYGCVCSNWGETNQSFNSENQS

SEQ ID NO: 144537 - protein, 36 aa, Artificial Sequence
  Description of Artificial Sequence: Synthetic polypeptide
TEEEIRTTNPVATEHYGSVPNATSPELSQRVTNYEW

SEQ ID NO: 144538 - protein, 36 aa, Artificial Sequence
  Description of Artificial Sequence: Synthetic polypeptide
AEEEIRTTNPVATEAYGSVSTTNSTNQQEATNVATE

SEQ ID NO: 144539 - protein, 37 aa, Artificial Sequence
  Description of Artificial Sequence: Synthetic polypeptide
DEEEIRTTNPVATEQYGSVIGPTNNLDVMQVLEIEDQ

SEQ ID NO: 144540 - protein, 35 aa, Artificial Sequence
  Description of Artificial Sequence: Synthetic polypeptide
DEDEIATTNPVAYEQYGQSTTATNNDLTQDGMGDR

SEQ ID NO: 144541 - protein, 34 aa, Artificial Sequence
  Description of Artificial Sequence: Synthetic polypeptide
DEEEIATTNPVATEQYGSVCAAMEGEEAGDEMNN

SEQ ID NO: 144542 - protein, 36 aa, Artificial Sequence
  Description of Artificial Sequence: Synthetic polypeptide
DEEEIRTTNPVATEQWGSTSSTTPAGPNMPKGMNYI

SEQ ID NO: 144543 - protein, 37 aa, Artificial Sequence
  Description of Artificial Sequence: Synthetic polypeptide
DEEEIRTTNPVATEQYGCVCSNWGETNQENFGSENQS

SEQ ID NO: 144544 - protein, 33 aa, Artificial Sequence
  Description of Artificial Sequence: Synthetic polypeptide
DEDEIATTNPVAYEQYGCVAANTNLATPAGPPN

SEQ ID NO: 144545 - protein, 34 aa, Artificial Sequence
  Description of Artificial Sequence: Synthetic polypeptide
AEDEICATNPVATEQYGVVATSNENLQQGEGNDE

SEQ ID NO: 144546 - protein, 35 aa, Artificial Sequence
  Description of Artificial Sequence: Synthetic polypeptide
DEEEIRTTNPVATEQYGCVCSNWGEPQHFNSDNQA

SEQ ID NO: 144547 - protein, 37 aa, Artificial Sequence
  Description of Artificial Sequence: Synthetic polypeptide
AEEEIRTTNPVATEAYGSVSTTNQQQNGNEQGTNNVE

SEQ ID NO: 144548 - protein, 37 aa, Artificial Sequence
  Description of Artificial Sequence: Synthetic polypeptide
AEEEIRTTNPVATEAYGSVSTTNQQQNADEQGNNNVE

SEQ ID NO: 144549 - protein, 37 aa, Artificial Sequence
  Description of Artificial Sequence: Synthetic polypeptide
DECEICTTNPVATEQYGSVSTTTNLLNQGNNEEEEEE

SEQ ID NO: 144550 - protein, 30 aa, Artificial Sequence
  Description of Artificial Sequence: Synthetic polypeptide
QEEEIATTNPVATEQYGEAPEVCQHNEEPK

SEQ ID NO: 144551 - protein, 35 aa, Artificial Sequence
  Description of Artificial Sequence: Synthetic polypeptide
DEEEIRTTNPVATEQYGCVCSNWEEHNQNFNSDQA

SEQ ID NO: 144552 - protein, 31 aa, Artificial Sequence
  Description of Artificial Sequence: Synthetic polypeptide
TEEETSTTNPVATDGYGSAASTTNIIQLNYE

SEQ ID NO: 144553 - protein, 33 aa, Artificial Sequence
  Description of Artificial Sequence: Synthetic polypeptide
TEEETSTTNPVATDQYGGSNASTHNTLIQLNSV

SEQ ID NO: 144554 - protein, 39 aa, Artificial Sequence
  Description of Artificial Sequence: Synthetic polypeptide
DEEEIRTTNPVATEAYGVVSTVVSTNLQAGNNQETNDDT

SEQ ID NO: 144555 - protein, 32 aa, Artificial Sequence
  Description of Artificial Sequence: Synthetic polypeptide
TEEETSTTNPVATDQYGSNADSTHNIIWLNSV

SEQ ID NO: 144556 - protein, 33 aa, Artificial Sequence
  Description of Artificial Sequence: Synthetic polypeptide
TEEEVCTTNPVATEQYGNTCSISNAERREGNLP

SEQ ID NO: 144557 - protein, 35 aa, Artificial Sequence
  Description of Artificial Sequence: Synthetic polypeptide
DESEIRSTNPVATEPYGSVCIWVNDQDQRKGDDTR

SEQ ID NO: 144558 - protein, 31 aa, Artificial Sequence
  Description of Artificial Sequence: Synthetic polypeptide
QEEEIATTNPVATECYGEVSEIVEPQHEEEK

SEQ ID NO: 144559 - protein, 39 aa, Artificial Sequence
  Description of Artificial Sequence: Synthetic polypeptide
DEEEIRTTNPVATEAYGVVSTVVSTNLQAGNNQAGNEDD

SEQ ID NO: 144560 - protein, 39 aa, Artificial Sequence
  Description of Artificial Sequence: Synthetic polypeptide
DEEEIRTTNPVATEAYGVVSTVVSTNLQAGNNNQTNDDE

SEQ ID NO: 144561 - protein, 39 aa, Artificial Sequence
  Description of Artificial Sequence: Synthetic polypeptide
DEEEIRTTNPVATEAYGVVSTVVSTNLQAGNNNQGNEDT

SEQ ID NO: 144562 - protein, 34 aa, Artificial Sequence
  Description of Artificial Sequence: Synthetic polypeptide
DEEEIRTTNPVATEQYGSVHYTIDPYVEDEEDWD

SEQ ID NO: 144563 - protein, 35 aa, Artificial Sequence
  Description of Artificial Sequence: Synthetic polypeptide
DEEEIRTTNPVATEQYGCVCSNTEHNQEYFMSDFA

SEQ ID NO: 144564 - protein, 36 aa, Artificial Sequence
  Description of Artificial Sequence: Synthetic polypeptide
DEEEIRTTNPVATEQYGSVGFATTVLIDDQQEDQHQ

SEQ ID NO: 144565 - protein, 35 aa, Artificial Sequence
  Description of Artificial Sequence: Synthetic polypeptide
DESEIRSTNPVATEPYGSVCIWVNDQEDQRQSNTR

SEQ ID NO: 144566 - protein, 36 aa, Artificial Sequence
  Description of Artificial Sequence: Synthetic polypeptide
QEEEIRTTNPVATEFYGAVTSMTGNGEGQGEGENAE

SEQ ID NO: 144567 - protein, 35 aa, Artificial Sequence
  Description of Artificial Sequence: Synthetic polypeptide
DEDEIATTNPVATEQYGSVCAMTNHGEQTLDGAQT

SEQ ID NO: 144568 - protein, 34 aa, Artificial Sequence
  Description of Artificial Sequence: Synthetic polypeptide
DEDEIATTNPVATEQYGSVCAMTNNGADDPGGDM

SEQ ID NO: 144569 - protein, 35 aa, Artificial Sequence
  Description of Artificial Sequence: Synthetic polypeptide
DESEIRSTNPVATEGYGSVSSTSPAGPQMRNGDPI

SEQ ID NO: 144570 - protein, 36 aa, Artificial Sequence
  Description of Artificial Sequence: Synthetic polypeptide
DEDEIATTNPVATEQYGSVCATNHPMQQGNQTEGDN

SEQ ID NO: 144571 - protein, 29 aa, Artificial Sequence
  Description of Artificial Sequence: Synthetic peptide
QEEEIATTNPVATECYGETPAVCQPEEYK

SEQ ID NO: 144572 - protein, 36 aa, Artificial Sequence
  Description of Artificial Sequence: Synthetic polypeptide
DECEICTTNPVATEQYGVVSTVNADQQGNTEENEDD

SEQ ID NO: 144573 - protein, 35 aa, Artificial Sequence
  Description of Artificial Sequence: Synthetic polypeptide
DEEEIRTTNPVATEQYGCVCSNTEHQENFPSDTQN

SEQ ID NO: 144574 - protein, 35 aa, Artificial Sequence
  Description of Artificial Sequence: Synthetic polypeptide
DEEEIRTTNPVATEQYGCVCSNTEHQENFISDDQS

SEQ ID NO: 144575 - protein, 39 aa, Artificial Sequence
  Description of Artificial Sequence: Synthetic polypeptide
DEEEIRTTNPVATEAYGVVSTVVSTNLQAGNNQQANDTT

SEQ ID NO: 144576 - protein, 36 aa, Artificial Sequence
  Description of Artificial Sequence: Synthetic polypeptide
DEEEIRTTNPVATEQYGSVIYPGNENEQEHGQVIIN

SEQ ID NO: 144577 - protein, 36 aa, Artificial Sequence
  Description of Artificial Sequence: Synthetic polypeptide
QEEEIRTTNPVATEGYGSVGNNMTSNGQSGGETNGD

SEQ ID NO: 144578 - protein, 35 aa, Artificial Sequence
  Description of Artificial Sequence: Synthetic polypeptide
DEDEIATTNPVATEQYGSVCATNAQDQDSDDNAAG

SEQ ID NO: 144579 - protein, 36 aa, Artificial Sequence
  Description of Artificial Sequence: Synthetic polypeptide
QEEEIRTTNPVATEGYGMVSVTGIGNQNQGEDGENI

SEQ ID NO: 144580 - protein, 34 aa, Artificial Sequence
  Description of Artificial Sequence: Synthetic polypeptide
QEEEIRTTNPVATEGYGMVDDQGNGQGEITGNNG

SEQ ID NO: 144581 - protein, 35 aa, Artificial Sequence
  Description of Artificial Sequence: Synthetic polypeptide
QEEEIRTTNPVATEFYGSVVDTADQAGGNGQTDDQ

SEQ ID NO: 144582 - protein, 36 aa, Artificial Sequence
  Description of Artificial Sequence: Synthetic polypeptide
QEEEIRTTNPVATEFYGSVTMTDNGDGQEDEGENGG

SEQ ID NO: 144583 - protein, 36 aa, Artificial Sequence
  Description of Artificial Sequence: Synthetic polypeptide
QEEEIRTTNPVATEFYGSVSTDNGFGQEDDQENAGG

SEQ ID NO: 144584 - protein, 35 aa, Artificial Sequence
  Description of Artificial Sequence: Synthetic polypeptide
DEDEIATTNPVATEQYGSVCANANHGQDSDGQDNH

SEQ ID NO: 144585 - protein, 39 aa, Artificial Sequence
  Description of Artificial Sequence: Synthetic polypeptide
DEEEIRTTNPVATEAYGVVSTVVSTNLQAGNNEQGNDTE

SEQ ID NO: 144586 - protein, 36 aa, Artificial Sequence
  Description of Artificial Sequence: Synthetic polypeptide
DEEEIRTTNPVATEQYGCVCSNTEHNQENFNSNTQF

SEQ ID NO: 144587 - protein, 36 aa, Artificial Sequence
  Description of Artificial Sequence: Synthetic polypeptide
DEEEIRTTNPVATEQYGCVCSNTEHNQENFNSETQS

SEQ ID NO: 144588 - protein, 36 aa, Artificial Sequence
  Description of Artificial Sequence: Synthetic polypeptide
DEEEIRTTNPVATEQYGCVCSNTEHNQENFNSDNQS

SEQ ID NO: 144589 - protein, 35 aa, Artificial Sequence
  Description of Artificial Sequence: Synthetic polypeptide
DEDEIATTNPVATEQYGSVCAATMHGENTADGITR

SEQ ID NO: 144590 - protein, 37 aa, Artificial Sequence
  Description of Artificial Sequence: Synthetic polypeptide
DEEEIRTTNPVATEQYGAIMWESTINFIQVGEGNIET

SEQ ID NO: 144591 - protein, 36 aa, Artificial Sequence
  Description of Artificial Sequence: Synthetic polypeptide
DECEICTTNPVATEQYGVVSTVNAQQNGNQEENEDD

SEQ ID NO: 144592 - protein, 35 aa, Artificial Sequence
  Description of Artificial Sequence: Synthetic polypeptide
DEEEIRTTNPVATEQYGCVCSNTEHDAENFGSEQD

SEQ ID NO: 144593 - protein, 37 aa, Artificial Sequence
  Description of Artificial Sequence: Synthetic polypeptide
DEEEIRTTNPVATEQYGSVGGPSLNNQPSPENVVDLE

SEQ ID NO: 144594 - protein, 36 aa, Artificial Sequence
  Description of Artificial Sequence: Synthetic polypeptide
DEEEIRTTNPVATEQYGSVMGQNMNSEIGNGDEGEE

SEQ ID NO: 144595 - protein, 32 aa, Artificial Sequence
  Description of Artificial Sequence: Synthetic polypeptide
QEEEIATTNPVATEQYGSVVAGPEVGQHEEGI

SEQ ID NO: 144596 - protein, 36 aa, Artificial Sequence
  Description of Artificial Sequence: Synthetic polypeptide
DECEICTTNPVATEQYGVVSTVNGQQAGNTEENEDD

SEQ ID NO: 144597 - protein, 37 aa, Artificial Sequence
  Description of Artificial Sequence: Synthetic polypeptide
DECEICTTNPVATEQYGVVSTVNLQQGNNQQGNNQTD

SEQ ID NO: 144598 - protein, 34 aa, Artificial Sequence
  Description of Artificial Sequence: Synthetic polypeptide
DEDEIATTNPVATEQYGSVCAATGPEAAAENDRN

SEQ ID NO: 144599 - protein, 33 aa, Artificial Sequence
  Description of Artificial Sequence: Synthetic polypeptide
DEDEIATTNPVATEQYGSVCAATGEEADSSERH

SEQ ID NO: 144600 - protein, 35 aa, Artificial Sequence
  Description of Artificial Sequence: Synthetic polypeptide
DEDEIATTNPVATEQYGSVCAATAQLAAPAENDRN

SEQ ID NO: 144601 - protein, 35 aa, Artificial Sequence
  Description of Artificial Sequence: Synthetic polypeptide
DEEEIRTTNPVATEQYGCVCSNTEEHQYFQSDTQS

SEQ ID NO: 144602 - protein, 35 aa, Artificial Sequence
  Description of Artificial Sequence: Synthetic polypeptide
DEEEIRTTNPVATEQYGCVCSNTEEHQGFMSDTQA

SEQ ID NO: 144603 - protein, 36 aa, Artificial Sequence
  Description of Artificial Sequence: Synthetic polypeptide
DEEEIRTTNPVATEQYGAIWSLTINHGQGGEGEQEQ

SEQ ID NO: 144604 - protein, 37 aa, Artificial Sequence
  Description of Artificial Sequence: Synthetic polypeptide
DEEEIRTTNPVATEQYGSVGGPSINDVQSLENNVDQY

SEQ ID NO: 144605 - protein, 38 aa, Artificial Sequence
  Description of Artificial Sequence: Synthetic polypeptide
DEEEIRTTNPVATEQYGSVGDSDYSNLTQPELGQVEDP

SEQ ID NO: 144606 - protein, 37 aa, Artificial Sequence
  Description of Artificial Sequence: Synthetic polypeptide
DEEEIRTTNPVATEQYGAIMWESTINFIQQGGEGNIT

SEQ ID NO: 144607 - protein, 36 aa, Artificial Sequence
  Description of Artificial Sequence: Synthetic polypeptide
DECEICTTNPVATEQYGVVSTVNAQQIGTTEENEDD

SEQ ID NO: 144608 - protein, 32 aa, Artificial Sequence
  Description of Artificial Sequence: Synthetic polypeptide
YEEEIASVNPVCTEQYGCVTVSDNPLQSGDEQ

SEQ ID NO: 144609 - protein, 35 aa, Artificial Sequence
  Description of Artificial Sequence: Synthetic polypeptide
DEDEIATTNPVATEQYGSVCAMMNHGGTGSDGNPR

SEQ ID NO: 144610 - protein, 36 aa, Artificial Sequence
  Description of Artificial Sequence: Synthetic polypeptide
DEEEIRTTNPVATEQYGCVCSNTEHNQENFNSDFQP

SEQ ID NO: 144611 - protein, 35 aa, Artificial Sequence
  Description of Artificial Sequence: Synthetic polypeptide
DEEEIRTTNPVATEQYGCVCSNTEHNQENFLSEQA

SEQ ID NO: 144612 - protein, 36 aa, Artificial Sequence
  Description of Artificial Sequence: Synthetic polypeptide
DEEEIRTTNPVATEQYGCVCSNTEHNQENFISENQF

SEQ ID NO: 144613 - protein, 36 aa, Artificial Sequence
  Description of Artificial Sequence: Synthetic polypeptide
QEEEIRTTNPVATECYGSVSSTTPCGPNMRNGMNPL

SEQ ID NO: 144614 - protein, 36 aa, Artificial Sequence
  Description of Artificial Sequence: Synthetic polypeptide
DEEEIRTTNPVATEQYGCVCSNTEHNQENFGSETQP

SEQ ID NO: 144615 - protein, 30 aa, Artificial Sequence
  Description of Artificial Sequence: Synthetic polypeptide
QEEEIATTNPVATECYGSAPCIVCQDHEEG

SEQ ID NO: 144616 - protein, 36 aa, Artificial Sequence
  Description of Artificial Sequence: Synthetic polypeptide
DEEEIRTTNPVATEQYGAFICQCTPNEIGEEQEANR

SEQ ID NO: 144617 - protein, 34 aa, Artificial Sequence
  Description of Artificial Sequence: Synthetic polypeptide
DEDEIATTNPVATEQYGSVCAGTNPANPDGGDQH

SEQ ID NO: 144618 - protein, 36 aa, Artificial Sequence
  Description of Artificial Sequence: Synthetic polypeptide
DEDEIATTNPVATEQYGSVCAGTNGQDQDSDDNARG

SEQ ID NO: 144619 - protein, 31 aa, Artificial Sequence
  Description of Artificial Sequence: Synthetic polypeptide
DESEIRSTNPVATEQWGNVAAETIQSAVEDR

SEQ ID NO: 144620 - protein, 34 aa, Artificial Sequence
  Description of Artificial Sequence: Synthetic polypeptide
DEDEIATTNPVATEQYGSVCAGTGLDNGPMDQDD

SEQ ID NO: 144621 - protein, 31 aa, Artificial Sequence
  Description of Artificial Sequence: Synthetic polypeptide
DESEIRSTNPVATEQWGNVAAETIQSAVEQR

SEQ ID NO: 144622 - protein, 33 aa, Artificial Sequence
  Description of Artificial Sequence: Synthetic polypeptide
DEDEIATTNPVATEQYGSVCAGNGLLTMMDSDG

SEQ ID NO: 144623 - protein, 37 aa, Artificial Sequence
  Description of Artificial Sequence: Synthetic polypeptide
DEEEIRTTNPVATEQYGSVGGPASVGNHERVFPEERQ

SEQ ID NO: 144624 - protein, 36 aa, Artificial Sequence
  Description of Artificial Sequence: Synthetic polypeptide
DEEEIRTTNPVATEQYGAIWSLTINHGQQGDGEVEQ

SEQ ID NO: 144625 - protein, 39 aa, Artificial Sequence
  Description of Artificial Sequence: Synthetic polypeptide
DEEEIRTTNPVATEAYGVVSTVVSTNLQAGNNQQGDDEE

SEQ ID NO: 144626 - protein, 35 aa, Artificial Sequence
  Description of Artificial Sequence: Synthetic polypeptide
TEEEISTTNPVATEQYGCVCNTGNHNQYFGSNNQA

SEQ ID NO: 144627 - protein, 39 aa, Artificial Sequence
  Description of Artificial Sequence: Synthetic polypeptide
DEEEIRTTNPVATEAYGVVSTVVSTNLQAGSNDQGSDDS

SEQ ID NO: 144628 - protein, 32 aa, Artificial Sequence
  Description of Artificial Sequence: Synthetic polypeptide
TEEEIRTTNPVAYERYGSVVAASLMEPVGSHP

SEQ ID NO: 144629 - protein, 32 aa, Artificial Sequence
  Description of Artificial Sequence: Synthetic polypeptide
TEEEIRTTNPVAYERYGSVVAISLMENGGSPP

SEQ ID NO: 144630 - protein, 36 aa, Artificial Sequence
  Description of Artificial Sequence: Synthetic polypeptide
DEEEIRTTNPVATEQYGSVMGQVNMNDEGGEDNQTS

SEQ ID NO: 144631 - protein, 36 aa, Artificial Sequence
  Description of Artificial Sequence: Synthetic polypeptide
DEEEIRTTNPVATEQYGSVMGQVNMEDEGGNDTQNV

SEQ ID NO: 144632 - protein, 35 aa, Artificial Sequence
  Description of Artificial Sequence: Synthetic polypeptide
DEDEIATTNPVATEQYGSVCATNPMQPDNQTQGTD

SEQ ID NO: 144633 - protein, 36 aa, Artificial Sequence
  Description of Artificial Sequence: Synthetic polypeptide
DEEEIRTTNPVATEQYGCVCSNTGEDHNQFFGSDQE

SEQ ID NO: 144634 - protein, 36 aa, Artificial Sequence
  Description of Artificial Sequence: Synthetic polypeptide
DEEEIRTTNPVATEQYGCVCSNTGEDDQFFNSDFQS

SEQ ID NO: 144635 - protein, 36 aa, Artificial Sequence
  Description of Artificial Sequence: Synthetic polypeptide
DEEEIRTTNPVATEQYGSVMGQVNMEDEGGEQNQTA

SEQ ID NO: 144636 - protein, 32 aa, Artificial Sequence
  Description of Artificial Sequence: Synthetic polypeptide
DESEIRSTNPVATECYGVMSCITEQDHEGENG

SEQ ID NO: 144637 - protein, 35 aa, Artificial Sequence
  Description of Artificial Sequence: Synthetic polypeptide
DEEEIRTTNPVATEQYGCVCSNTETNQENFISEQG

SEQ ID NO: 144638 - protein, 34 aa, Artificial Sequence
  Description of Artificial Sequence: Synthetic polypeptide
TEEEIRTTNPVAYESYGSTVQINSGDEMVGNPRR

SEQ ID NO: 144639 - protein, 29 aa, Artificial Sequence
  Description of Artificial Sequence: Synthetic peptide
DESEIRSTNPVATEGWGDVAETEQAAEDA

SEQ ID NO: 144640 - protein, 36 aa, Artificial Sequence
  Description of Artificial Sequence: Synthetic polypeptide
DEEEIRTTNPVATEQYGSVMGQVNMEDEGGEDQVNV

SEQ ID NO: 144641 - protein, 38 aa, Artificial Sequence
  Description of Artificial Sequence: Synthetic polypeptide
AEEEIRTTNPVATEQYGSVVTVTNLQSGNVEQGTNDEY

SEQ ID NO: 144642 - protein, 36 aa, Artificial Sequence
  Description of Artificial Sequence: Synthetic polypeptide
DEEEIRTTNPVATEQYGCVCSNTGEDHNQNFGSQQV

SEQ ID NO: 144643 - protein, 36 aa, Artificial Sequence
  Description of Artificial Sequence: Synthetic polypeptide
DEDEIATTNPVATEQYGSVCATNPPMQNGNQTEGTD

SEQ ID NO: 144644 - protein, 36 aa, Artificial Sequence
  Description of Artificial Sequence: Synthetic polypeptide
DEEEIRTTNPVATEQYGCVCSNTGEDHNQNFNSNQG

SEQ ID NO: 144645 - protein, 33 aa, Artificial Sequence
  Description of Artificial Sequence: Synthetic polypeptide
DESEIRSTNPVATECWGVMSCITEPQDREGENG

SEQ ID NO: 144646 - protein, 37 aa, Artificial Sequence
  Description of Artificial Sequence: Synthetic polypeptide
AEEEIRTTNPVATEQYGSVVTVTNNLEQGTEGGTTTV

SEQ ID NO: 144647 - protein, 30 aa, Artificial Sequence
  Description of Artificial Sequence: Synthetic polypeptide
QEEEIRTTNPVATEQWGEAPNEVWAEHGEK

SEQ ID NO: 144648 - protein, 36 aa, Artificial Sequence
  Description of Artificial Sequence: Synthetic polypeptide
DEEEIRTTNPVATEQYGCVCSNTGEDPQESFGSDQP

SEQ ID NO: 144649 - protein, 36 aa, Artificial Sequence
  Description of Artificial Sequence: Synthetic polypeptide
DEEEIRTTNPVATEQYGCVCSNTGEDNTENFNSDQT

SEQ ID NO: 144650 - protein, 37 aa, Artificial Sequence
  Description of Artificial Sequence: Synthetic polypeptide
DECEICTTNPVATEQYGVVSTTVTNLQQGNNEEEEDD

SEQ ID NO: 144651 - protein, 37 aa, Artificial Sequence
  Description of Artificial Sequence: Synthetic polypeptide
DECEICTTNPVATEQYGVVSTTVTNLQQGNNNEQEDT

SEQ ID NO: 144652 - protein, 35 aa, Artificial Sequence
  Description of Artificial Sequence: Synthetic polypeptide
DEDEIATTNPVATEQYGSVCATTPMQQGNQTEGDD

SEQ ID NO: 144653 - protein, 37 aa, Artificial Sequence
  Description of Artificial Sequence: Synthetic polypeptide
DECEICTTNPVATEQYGVVSTTVTNLQQGNNNQNQDE

SEQ ID NO: 144654 - protein, 37 aa, Artificial Sequence
  Description of Artificial Sequence: Synthetic polypeptide
DECEICTTNPVATEQYGVVSTTVVNLQQGNNEEDEED

SEQ ID NO: 144655 - protein, 30 aa, Artificial Sequence
  Description of Artificial Sequence: Synthetic polypeptide
QEEEIRTTNPVATEQWGAAWAAVCQEHEPK

SEQ ID NO: 144656 - protein, 39 aa, Artificial Sequence
  Description of Artificial Sequence: Synthetic polypeptide
DEEEIRTTNPVATEAYGVVSTVVSTNLQAGSNGNGNDDT

SEQ ID NO: 144657 - protein, 35 aa, Artificial Sequence
  Description of Artificial Sequence: Synthetic polypeptide
AEDEICATNPVATEQYGVVSTSGENLQQLGNGTDD

SEQ ID NO: 144658 - protein, 36 aa, Artificial Sequence
  Description of Artificial Sequence: Synthetic polypeptide
DEEEIRTTNPVATEQYGSVMGSFEDDEGGNQQENIE

SEQ ID NO: 144659 - protein, 36 aa, Artificial Sequence
  Description of Artificial Sequence: Synthetic polypeptide
DEEEIRTTNPVATEQYGCVCSNTGEDHNQNGGSEQS

SEQ ID NO: 144660 - protein, 36 aa, Artificial Sequence
  Description of Artificial Sequence: Synthetic polypeptide
DEEEIRTTNPVATEQYGSVMGQVNMEDEGGEDNQNQ

SEQ ID NO: 144661 - protein, 31 aa, Artificial Sequence
  Description of Artificial Sequence: Synthetic polypeptide
AEEEIATTNPVATEQYGVVAVEVTEQGTEET

SEQ ID NO: 144662 - protein, 37 aa, Artificial Sequence
  Description of Artificial Sequence: Synthetic polypeptide
DEEEIRTTNPVATEQYGSVIAPWTNTELYVPVANEEN

SEQ ID NO: 144663 - protein, 37 aa, Artificial Sequence
  Description of Artificial Sequence: Synthetic polypeptide
DECEICTTNPVATEQYGVVSTTVVNLQQGNNQEEEDE

SEQ ID NO: 144664 - protein, 36 aa, Artificial Sequence
  Description of Artificial Sequence: Synthetic polypeptide
DEDEIATTNPVATEQYGSVCATNPELGQHPDENGMN

SEQ ID NO: 144665 - protein, 31 aa, Artificial Sequence
  Description of Artificial Sequence: Synthetic polypeptide
AEEEIATTNPVATEQYGVVAVEVENQDEEET

SEQ ID NO: 144666 - protein, 39 aa, Artificial Sequence
  Description of Artificial Sequence: Synthetic polypeptide
DEEEIRTTNPVATEAYGVVSTVVSTNLQAGNTEQGNDDS

SEQ ID NO: 144667 - protein, 34 aa, Artificial Sequence
  Description of Artificial Sequence: Synthetic polypeptide
QEEEIRTTNPVATEGYGSVVTDGDENQGEGQGQT

SEQ ID NO: 144668 - protein, 31 aa, Artificial Sequence
  Description of Artificial Sequence: Synthetic polypeptide
AEEEIATTNPVATEQYGVVAVEVDEQGEEET

SEQ ID NO: 144669 - protein, 35 aa, Artificial Sequence
  Description of Artificial Sequence: Synthetic polypeptide
QEEEIRTTNPVATEGYGSVVGTDNNGQEEMEGGGN

SEQ ID NO: 144670 - protein, 36 aa, Artificial Sequence
  Description of Artificial Sequence: Synthetic polypeptide
DEDEIATTNPVATEQYGSVCATNNPMQQGNQTEGIM

SEQ ID NO: 144671 - protein, 39 aa, Artificial Sequence
  Description of Artificial Sequence: Synthetic polypeptide
DEEEIRTTNPVATEAYGVVSTVVSTNLQAGNNQQGVDTD

SEQ ID NO: 144672 - protein, 30 aa, Artificial Sequence
  Description of Artificial Sequence: Synthetic polypeptide
QEEEIATTNPVATECYGEAPEVCQHKGEYK

SEQ ID NO: 144673 - protein, 39 aa, Artificial Sequence
  Description of Artificial Sequence: Synthetic polypeptide
DEEEIRTTNPVATEAYGVVSTVVSTNLQAGNNQQGTDDF

SEQ ID NO: 144674 - protein, 36 aa, Artificial Sequence
  Description of Artificial Sequence: Synthetic polypeptide
DEEEIRTTNPVATEQYGSVMGQVNEEDEGGEDNQGF

SEQ ID NO: 144675 - protein, 39 aa, Artificial Sequence
  Description of Artificial Sequence: Synthetic polypeptide
DEEEIRTTNPVATEAYGVVSTVVSTNLQAGNNQQGNQDQ

SEQ ID NO: 144676 - protein, 36 aa, Artificial Sequence
  Description of Artificial Sequence: Synthetic polypeptide
DEDEIATTNPVATEQYGSVCATNNPMQQGNLTEGTD

SEQ ID NO: 144677 - protein, 35 aa, Artificial Sequence
  Description of Artificial Sequence: Synthetic polypeptide
TEEEISCTNPVAYTEQYGYTVSCSNGSQGSTGSNR

SEQ ID NO: 144678 - protein, 35 aa, Artificial Sequence
  Description of Artificial Sequence: Synthetic polypeptide
DEEEIRTTNPVATEQYGCVCSNTEHTEGFGSDTQS

SEQ ID NO: 144679 - protein, 36 aa, Artificial Sequence
  Description of Artificial Sequence: Synthetic polypeptide
DEEEIATTNPVATEQWGHSNVAATANGLQAAPGVGF

SEQ ID NO: 144680 - protein, 35 aa, Artificial Sequence
  Description of Artificial Sequence: Synthetic polypeptide
TEEEISTTNPVATEQYGCVCNTMNHNQNFGSDNQA

SEQ ID NO: 144681 - protein, 35 aa, Artificial Sequence
  Description of Artificial Sequence: Synthetic polypeptide
DEEEIRTTNPVATEQYGSVGDFGQGNDDEVTGQAG

SEQ ID NO: 144682 - protein, 35 aa, Artificial Sequence
  Description of Artificial Sequence: Synthetic polypeptide
QEEEIRTTNPVATEPYGKISQTNHEFSGNRVGNFG

SEQ ID NO: 144683 - protein, 31 aa, Artificial Sequence
  Description of Artificial Sequence: Synthetic polypeptide
AEEEIATTNPVATEQYGVVAVEVTEQDEETT

SEQ ID NO: 144684 - protein, 35 aa, Artificial Sequence
  Description of Artificial Sequence: Synthetic polypeptide
AEDEICATNPVATEQYGVVSTSNEGNLQLGNGTDQ

SEQ ID NO: 144685 - protein, 39 aa, Artificial Sequence
  Description of Artificial Sequence: Synthetic polypeptide
DEEEIRTTNPVATEAYGVVSTVVSTNLQAGNTQQGNTDE

SEQ ID NO: 144686 - protein, 38 aa, Artificial Sequence
  Description of Artificial Sequence: Synthetic polypeptide
DEEEIRTTNPVATEQYGSVIYLTPNTQGQVRENVEDGA

SEQ ID NO: 144687 - protein, 35 aa, Artificial Sequence
  Description of Artificial Sequence: Synthetic polypeptide
QEEEIRTTNPVATEPYGKTISQTHEFSQNRSGNFG

SEQ ID NO: 144688 - protein, 34 aa, Artificial Sequence
  Description of Artificial Sequence: Synthetic polypeptide
DEDEIATTNPVATEQYGSVCATNPMAQANQTEGT

SEQ ID NO: 144689 - protein, 36 aa, Artificial Sequence
  Description of Artificial Sequence: Synthetic polypeptide
DEEEIRTTNPVATEQYGSVMGQVNMEDEGGEDNGTV

SEQ ID NO: 144690 - protein, 31 aa, Artificial Sequence
  Description of Artificial Sequence: Synthetic polypeptide
AEEEIATTNPVATEQYGVVAVEVGEQQEETE

SEQ ID NO: 144691 - protein, 37 aa, Artificial Sequence
  Description of Artificial Sequence: Synthetic polypeptide
DEEEIRTTNPVATEAYGTVSTVNQQQNQQQGTNVATE

SEQ ID NO: 144692 - protein, 35 aa, Artificial Sequence
  Description of Artificial Sequence: Synthetic polypeptide
DEDEIATTNPVATEQYGSVCATNPEPQEHDDNLAG

SEQ ID NO: 144693 - protein, 35 aa, Artificial Sequence
  Description of Artificial Sequence: Synthetic polypeptide
QEEEIRTTNPVATEPYGKISYTIHEFSQSRVGNFG

SEQ ID NO: 144694 - protein, 31 aa, Artificial Sequence
  Description of Artificial Sequence: Synthetic polypeptide
DESEIRSTNPVATEGYGDVAAEIIQSAAGDA

SEQ ID NO: 144695 - protein, 37 aa, Artificial Sequence
  Description of Artificial Sequence: Synthetic polypeptide
DEEEIRTTNPVATEQYGSVIAPWTNQTEGVRPVVNEN

SEQ ID NO: 144696 - protein, 35 aa, Artificial Sequence
  Description of Artificial Sequence: Synthetic polypeptide
DESEIRSTNPVATEGYGNVSAATPAIPQMRNGNPV

SEQ ID NO: 144697 - protein, 33 aa, Artificial Sequence
  Description of Artificial Sequence: Synthetic polypeptide
QEEEIRTTNPVATEPYGKISTHEESQNEVGTFA

SEQ ID NO: 144698 - protein, 34 aa, Artificial Sequence
  Description of Artificial Sequence: Synthetic polypeptide
QEEEIRTTNPVATEPYGKISCTGHEESQNRVGTF

SEQ ID NO: 144699 - protein, 35 aa, Artificial Sequence
  Description of Artificial Sequence: Synthetic polypeptide
DEDEIATTNPVATEQYGSVCSPTNGHEVDDPGQDN

SEQ ID NO: 144700 - protein, 33 aa, Artificial Sequence
  Description of Artificial Sequence: Synthetic polypeptide
DEDEIATTNPVATEQYGSVCAATANEEMMMPED

SEQ ID NO: 144701 - protein, 36 aa, Artificial Sequence
  Description of Artificial Sequence: Synthetic polypeptide
DEEEIRTTNPVATEQYGAIWSLTINHGQQGEGEQES

SEQ ID NO: 144702 - protein, 38 aa, Artificial Sequence
  Description of Artificial Sequence: Synthetic polypeptide
DEEEIRTTNPVATEAYGVVSTVVNTNLQLNNGNDEQGE

SEQ ID NO: 144703 - protein, 36 aa, Artificial Sequence
  Description of Artificial Sequence: Synthetic polypeptide
DECEICTTNPVATEQYGVVSTVTDGNLEQGSTNNDG

SEQ ID NO: 144704 - protein, 33 aa, Artificial Sequence
  Description of Artificial Sequence: Synthetic polypeptide
DESEIRSTNPVNTECWGSVSCIIEPQTREGENG

SEQ ID NO: 144705 - protein, 38 aa, Artificial Sequence
  Description of Artificial Sequence: Synthetic polypeptide
DEEEIRTTNPVATEAYGVVSTVVNTNLQLGNSNDEEGS

SEQ ID NO: 144706 - protein, 34 aa, Artificial Sequence
  Description of Artificial Sequence: Synthetic polypeptide
DEDEIATTNPVATEQYGCVCTIEGNQDQGGQGQS

SEQ ID NO: 144707 - protein, 36 aa, Artificial Sequence
  Description of Artificial Sequence: Synthetic polypeptide
DEEEIRTTNPVATEQYGAVDIDTNMNELEGGGQDDV

SEQ ID NO: 144708 - protein, 35 aa, Artificial Sequence
  Description of Artificial Sequence: Synthetic polypeptide
DEDEIATTNPVATEQYGCVCTIEGNQDQRGQGESH

SEQ ID NO: 144709 - protein, 35 aa, Artificial Sequence
  Description of Artificial Sequence: Synthetic polypeptide
DEEEIRTTNPVATEQYGCVCSNTEDHTNFNSQTQS

SEQ ID NO: 144710 - protein, 36 aa, Artificial Sequence
  Description of Artificial Sequence: Synthetic polypeptide
DEEEIRTTNPVATEQYGAVDIDTNMNLEIGGGQDAD

SEQ ID NO: 144711 - protein, 37 aa, Artificial Sequence
  Description of Artificial Sequence: Synthetic polypeptide
DEEEIRTTNPVATEQYGAVDIDTNMNLEQEGGGQGTV

SEQ ID NO: 144712 - protein, 36 aa, Artificial Sequence
  Description of Artificial Sequence: Synthetic polypeptide
DEEEIRTTNPVATEQYGCVCSNTEDHQEYFPSENQP

SEQ ID NO: 144713 - protein, 35 aa, Artificial Sequence
  Description of Artificial Sequence: Synthetic polypeptide
QEEEIRTTNPCATEQYGSVSSTTPAGPNRNGMTPV

SEQ ID NO: 144714 - protein, 36 aa, Artificial Sequence
  Description of Artificial Sequence: Synthetic polypeptide
DEEEIRTTNPVATEQYGCVCSNTEDHQESFGSQTQE

SEQ ID NO: 144715 - protein, 30 aa, Artificial Sequence
  Description of Artificial Sequence: Synthetic polypeptide
QEEEIATTNPVATEGYGNAPAETCQSHGQK

SEQ ID NO: 144716 - protein, 35 aa, Artificial Sequence
  Description of Artificial Sequence: Synthetic polypeptide
DEEEIRTTNPVATEQYGCVCSNTEDHQFFISDTQA

SEQ ID NO: 144717 - protein, 35 aa, Artificial Sequence
  Description of Artificial Sequence: Synthetic polypeptide
QEEEIRTTNPCSTEQYGSVSSTPAGPQMRNGMTPV

SEQ ID NO: 144718 - protein, 34 aa, Artificial Sequence
  Description of Artificial Sequence: Synthetic polypeptide
DEDEIATTNPVATEQYGCVVAANNGLEGMEGGNV

SEQ ID NO: 144719 - protein, 36 aa, Artificial Sequence
  Description of Artificial Sequence: Synthetic polypeptide
DECEICTTNPVATEQYGVVSTVTDGNLEQGETNNTQ

SEQ ID NO: 144720 - protein, 36 aa, Artificial Sequence
  Description of Artificial Sequence: Synthetic polypeptide
DEEEIRTTNPVATEQYGCVCSNTEDNQENFNSEFQA

SEQ ID NO: 144721 - protein, 33 aa, Artificial Sequence
  Description of Artificial Sequence: Synthetic polypeptide
DESEIRSTNPVGTEGYGVVSASPTLQMHNGNPV

SEQ ID NO: 144722 - protein, 34 aa, Artificial Sequence
  Description of Artificial Sequence: Synthetic polypeptide
DESEIRSTNPVGTEGYGVVSATSPTLQMHNGNPV

SEQ ID NO: 144723 - protein, 34 aa, Artificial Sequence
  Description of Artificial Sequence: Synthetic polypeptide
TEEGISTTNPVATEQYGSVSDTLILTGPELQCSN

SEQ ID NO: 144724 - protein, 30 aa, Artificial Sequence
  Description of Artificial Sequence: Synthetic polypeptide
DESEIRSTNPVGTEGYGVVSETEQNHAEDA

SEQ ID NO: 144725 - protein, 37 aa, Artificial Sequence
  Description of Artificial Sequence: Synthetic polypeptide
DEEEIRTTNPVATEQYGSVGGPTFVQEQLSREGEFLE

SEQ ID NO: 144726 - protein, 30 aa, Artificial Sequence
  Description of Artificial Sequence: Synthetic polypeptide
QEEEIATTNPVATEQYGTASEDVPEHEEED

SEQ ID NO: 144727 - protein, 32 aa, Artificial Sequence
  Description of Artificial Sequence: Synthetic polypeptide
DESEIRSTNPVGTEGYGVVSSSPTGQRNGDPV

SEQ ID NO: 144728 - protein, 36 aa, Artificial Sequence
  Description of Artificial Sequence: Synthetic polypeptide
DEEEIRTTNPVATEQYGSVMGQGVNGQQDQEGESEP

SEQ ID NO: 144729 - protein, 35 aa, Artificial Sequence
  Description of Artificial Sequence: Synthetic polypeptide
DEDEIATTNPVATEQYGSVAANAGELQDSKGGTPE

SEQ ID NO: 144730 - protein, 35 aa, Artificial Sequence
  Description of Artificial Sequence: Synthetic polypeptide
DEDEIATTNPVATEQYGSCATAEPTNPGAQTEGNN

SEQ ID NO: 144731 - protein, 34 aa, Artificial Sequence
  Description of Artificial Sequence: Synthetic polypeptide
TEENIACTNPVATEQYGSVSWNEGQDRQRMTGSK

SEQ ID NO: 144732 - protein, 38 aa, Artificial Sequence
  Description of Artificial Sequence: Synthetic polypeptide
DEEEIRTTNPVATEAYGVVSTVVNTNLQNGNGNDEQGD

SEQ ID NO: 144733 - protein, 35 aa, Artificial Sequence
  Description of Artificial Sequence: Synthetic polypeptide
DEDEIATTNPVATEQYGSACAATNPQADDPMGDRA

SEQ ID NO: 144734 - protein, 37 aa, Artificial Sequence
  Description of Artificial Sequence: Synthetic polypeptide
DECEICTTNPVATEQYGVVSTVTDGNLEQGETGNNDD

SEQ ID NO: 144735 - protein, 37 aa, Artificial Sequence
  Description of Artificial Sequence: Synthetic polypeptide
DECEICTTNPVATEQYGVVSTVTDGNNLEQGEGNNDD

SEQ ID NO: 144736 - protein, 35 aa, Artificial Sequence
  Description of Artificial Sequence: Synthetic polypeptide
QEEEIRTTNPCATEQYGSVSSTPAGPNMRNGMTPV

SEQ ID NO: 144737 - protein, 35 aa, Artificial Sequence
  Description of Artificial Sequence: Synthetic polypeptide
DECEICTTNPVATEQYGVVSTVTDGNNVESGEGND

SEQ ID NO: 144738 - protein, 36 aa, Artificial Sequence
  Description of Artificial Sequence: Synthetic polypeptide
DEEEIRTTNPVATEQYGCVCSNTEDHNQHFNSDNQS

SEQ ID NO: 144739 - protein, 32 aa, Artificial Sequence
  Description of Artificial Sequence: Synthetic polypeptide
DESEIRSTNPVSTEPYGNISANEDIQQQVGQR

SEQ ID NO: 144740 - protein, 35 aa, Artificial Sequence
  Description of Artificial Sequence: Synthetic polypeptide
DEEEIRTTNPVATEQYGAVDSGMEGDDEQQGDEDQ

SEQ ID NO: 144741 - protein, 36 aa, Artificial Sequence
  Description of Artificial Sequence: Synthetic polypeptide
DEEEIRTTNPVATEQYGCVCSNTEAHNQENFNSDQE

SEQ ID NO: 144742 - protein, 36 aa, Artificial Sequence
  Description of Artificial Sequence: Synthetic polypeptide
QEEEIRSTNPVATEQYGSVSDDNDNNFQGEDGNDDF

SEQ ID NO: 144743 - protein, 33 aa, Artificial Sequence
  Description of Artificial Sequence: Synthetic polypeptide
DESEIRSTNPVSTEPYGTISANEDIQQQQVGNR

SEQ ID NO: 144744 - protein, 35 aa, Artificial Sequence
  Description of Artificial Sequence: Synthetic polypeptide
DEEEIRTTNPVATEQYGCVCSNSPEHNQNFNSQQS

SEQ ID NO: 144745 - protein, 36 aa, Artificial Sequence
  Description of Artificial Sequence: Synthetic polypeptide
DEEEIRTTNPVATEQYGSVMGPEMQNLGETGEDGGT

SEQ ID NO: 144746 - protein, 35 aa, Artificial Sequence
  Description of Artificial Sequence: Synthetic polypeptide
DEEEIRTTNPVATEQYGSVMGPEMNVGETGEEGGT

SEQ ID NO: 144747 - protein, 33 aa, Artificial Sequence
  Description of Artificial Sequence: Synthetic polypeptide
DEDEIATTNPVATEQYGCVAATPDATMPPGERH

SEQ ID NO: 144748 - protein, 34 aa, Artificial Sequence
  Description of Artificial Sequence: Synthetic polypeptide
AEEEIATTNPVATEQYGCVAANNPLNADPGETRH

SEQ ID NO: 144749 - protein, 29 aa, Artificial Sequence
  Description of Artificial Sequence: Synthetic peptide
QEEEIATTNPVATEHYGEAPEVCMQHEEK

SEQ ID NO: 144750 - protein, 34 aa, Artificial Sequence
  Description of Artificial Sequence: Synthetic polypeptide
DEEEIRTTNPVATEQYGSVHWLYVPEQEMVDSIM

SEQ ID NO: 144751 - protein, 32 aa, Artificial Sequence
  Description of Artificial Sequence: Synthetic polypeptide
TEEVIACTNPVATEQWGCVAGTNLATMNPEER

SEQ ID NO: 144752 - protein, 31 aa, Artificial Sequence
  Description of Artificial Sequence: Synthetic polypeptide
DESEIRSTNPVSTEQWGNVAANTEMSAAGDR

SEQ ID NO: 144753 - protein, 35 aa, Artificial Sequence
  Description of Artificial Sequence: Synthetic polypeptide
TEEVIATTNPVAYEQYGISVSTINEHQPSPGGNNT

SEQ ID NO: 144754 - protein, 38 aa, Artificial Sequence
  Description of Artificial Sequence: Synthetic polypeptide
DEEEIRTTNPVATEAYGVVSTVVNTNLQAGSTNDEQGD

SEQ ID NO: 144755 - protein, 37 aa, Artificial Sequence
  Description of Artificial Sequence: Synthetic polypeptide
DEEEIRTTNPVATEQYGSVGGPSYQNVSSRENVVDQL

SEQ ID NO: 144756 - protein, 32 aa, Artificial Sequence
  Description of Artificial Sequence: Synthetic polypeptide
DEDEIATTNPVATEQYGCVAGTGLAANPAQDN

SEQ ID NO: 144757 - protein, 36 aa, Artificial Sequence
  Description of Artificial Sequence: Synthetic polypeptide
QEEEIRSTNPVATEQYGSVVQNSDDTEEQGNEGEND

SEQ ID NO: 144758 - protein, 34 aa, Artificial Sequence
  Description of Artificial Sequence: Synthetic polypeptide
AEDEICATNPVATEQYGVVSVSNENLQQGEGEDE

SEQ ID NO: 144759 - protein, 34 aa, Artificial Sequence
  Description of Artificial Sequence: Synthetic polypeptide
QEEEIRTTNPAATEQYGSVAGQDNQTGQGGEGET

SEQ ID NO: 144760 - protein, 34 aa, Artificial Sequence
  Description of Artificial Sequence: Synthetic polypeptide
AEDEICATNPVATEQYGVVTVSNENLQQGEGNDD

SEQ ID NO: 144761 - protein, 33 aa, Artificial Sequence
  Description of Artificial Sequence: Synthetic polypeptide
TEEQIRTTNPVAYEAYGKTVATSLLTMVGNNRT

SEQ ID NO: 144762 - protein, 33 aa, Artificial Sequence
  Description of Artificial Sequence: Synthetic polypeptide
QEEEIRSTNPVGTEGYGVVSATTPTGQHNGMNI

SEQ ID NO: 144763 - protein, 36 aa, Artificial Sequence
  Description of Artificial Sequence: Synthetic polypeptide
DEEEIRTTNPVATEQYGSVGGWTPNVQPTQMVSEAD

SEQ ID NO: 144764 - protein, 33 aa, Artificial Sequence
  Description of Artificial Sequence: Synthetic polypeptide
DESEIRSTNPVSTEGYGNVSACNIPQSRVGEQG

SEQ ID NO: 144765 - protein, 33 aa, Artificial Sequence
  Description of Artificial Sequence: Synthetic polypeptide
DESEIRSTNPVSTEGYGNVSANNIPQSRVGEQG

SEQ ID NO: 144766 - protein, 36 aa, Artificial Sequence
  Description of Artificial Sequence: Synthetic polypeptide
DEEEIRTTNPVATEQYGCVCSNTEDHNQENFGSDQN

SEQ ID NO: 144767 - protein, 38 aa, Artificial Sequence
  Description of Artificial Sequence: Synthetic polypeptide
DEEEIRTTNPVATEAYGVVSTVVNTNLQLGNLNDEQDE

SEQ ID NO: 144768 - protein, 36 aa, Artificial Sequence
  Description of Artificial Sequence: Synthetic polypeptide
DEEEIRTTNPVATEQYGCVCSNTEDHEEYFGSDNQP

SEQ ID NO: 144769 - protein, 36 aa, Artificial Sequence
  Description of Artificial Sequence: Synthetic polypeptide
QEEEIRSTNPVATEQYGTVVSGTMNDAGQNGEGGNE

SEQ ID NO: 144770 - protein, 35 aa, Artificial Sequence
  Description of Artificial Sequence: Synthetic polypeptide
DEEEIRTTNPVATEQYGSVMGPIMNNGETGEFGGT

SEQ ID NO: 144771 - protein, 38 aa, Artificial Sequence
  Description of Artificial Sequence: Synthetic polypeptide
DEEEIRTTNPVATEAYGVVSTVVNTNLQLGNINDEAGE

SEQ ID NO: 144772 - protein, 34 aa, Artificial Sequence
  Description of Artificial Sequence: Synthetic polypeptide
QEEEIRSTNPVATEQYGSVYTDNNMNVEEGGQTG

SEQ ID NO: 144773 - protein, 36 aa, Artificial Sequence
  Description of Artificial Sequence: Synthetic polypeptide
QEEEIRSTNPVATEQYGSVVQNLIDDEEQGDEGEND

SEQ ID NO: 144774 - protein, 36 aa, Artificial Sequence
  Description of Artificial Sequence: Synthetic polypeptide
DEEEIRTTNPVATEQYGCVCSNTEEHQEYFGSQTQS

SEQ ID NO: 144775 - protein, 36 aa, Artificial Sequence
  Description of Artificial Sequence: Synthetic polypeptide
DEEEIRTTNPVATEQYGSVHYTIDMPYNVEQEEDGD

SEQ ID NO: 144776 - protein, 37 aa, Artificial Sequence
  Description of Artificial Sequence: Synthetic polypeptide
DEEEIRTTNPVATEQYGSVGGPSVQNVQSLENVVDQL

SEQ ID NO: 144777 - protein, 36 aa, Artificial Sequence
  Description of Artificial Sequence: Synthetic polypeptide
DEEEIRTTNPVATEQYGCVCSNTEEHNQNFGSDTQF

SEQ ID NO: 144778 - protein, 37 aa, Artificial Sequence
  Description of Artificial Sequence: Synthetic polypeptide
DEEEIRTTNPVATEQYGSVGGPSNANTQSLPNVVDQL

SEQ ID NO: 144779 - protein, 36 aa, Artificial Sequence
  Description of Artificial Sequence: Synthetic polypeptide
DEEEIRTTNPVATEQYGCVCSNTEEHNQGFNSNTQF

SEQ ID NO: 144780 - protein, 30 aa, Artificial Sequence
  Description of Artificial Sequence: Synthetic polypeptide
QEEEIATTNPVATEQYGTAPEGVGQHQEEK

SEQ ID NO: 144781 - protein, 35 aa, Artificial Sequence
  Description of Artificial Sequence: Synthetic polypeptide
DEDEIATTNPVATEQYGSVCAANNLDEALGNNDNH

SEQ ID NO: 144782 - protein, 36 aa, Artificial Sequence
  Description of Artificial Sequence: Synthetic polypeptide
DEEEIRTTNPVATEQYGCVCSNTEEHNQGFGSDTQS

SEQ ID NO: 144783 - protein, 31 aa, Artificial Sequence
  Description of Artificial Sequence: Synthetic polypeptide
QEEEIRTTNPVATECWGEVPEIVEPQDREEG

SEQ ID NO: 144784 - protein, 36 aa, Artificial Sequence
  Description of Artificial Sequence: Synthetic polypeptide
DEDEIATTNPVATEQYGSVCAAMNHLQAMAPDNERP

SEQ ID NO: 144785 - protein, 31 aa, Artificial Sequence
  Description of Artificial Sequence: Synthetic polypeptide
AEEEIATTNPVATEQYGEYTPWVDQHFNSEQ

SEQ ID NO: 144786 - protein, 29 aa, Artificial Sequence
  Description of Artificial Sequence: Synthetic peptide
QEEEIATTNPVATEEYGCAPEVCQHEEHK

SEQ ID NO: 144787 - protein, 36 aa, Artificial Sequence
  Description of Artificial Sequence: Synthetic polypeptide
DEEEIRTTNPVATEQYGCVCSNTEEHNQESFGSDQN

SEQ ID NO: 144788 - protein, 30 aa, Artificial Sequence
  Description of Artificial Sequence: Synthetic polypeptide
AEEEIATTNPVATEQYGEYCPWVDQHMSEQ

SEQ ID NO: 144789 - protein, 36 aa, Artificial Sequence
  Description of Artificial Sequence: Synthetic polypeptide
DEEEIRTTNPVATEQYGCVCSNTEEHNQENFGSQQA

SEQ ID NO: 144790 - protein, 36 aa, Artificial Sequence
  Description of Artificial Sequence: Synthetic polypeptide
DEEEIRTTNPVATEQYGCVCSNTEEHNQENFGSDQS

SEQ ID NO: 144791 - protein, 37 aa, Artificial Sequence
  Description of Artificial Sequence: Synthetic polypeptide
DEEEIRTTNPVATEQYGCVCSNTEEHNQEYFGSENQA

SEQ ID NO: 144792 - protein, 30 aa, Artificial Sequence
  Description of Artificial Sequence: Synthetic polypeptide
QEEEIRTTNPVATECWGEVPEVCPQDHEEK

SEQ ID NO: 144793 - protein, 30 aa, Artificial Sequence
  Description of Artificial Sequence: Synthetic polypeptide
YEEEIASVNPVCTEGYGVVSNTIQSSVGNQ

SEQ ID NO: 144794 - protein, 32 aa, Artificial Sequence
  Description of Artificial Sequence: Synthetic polypeptide
TEEGICTTNPVAYERYGSISCMNMSQDGGLNS

SEQ ID NO: 144795 - protein, 36 aa, Artificial Sequence
  Description of Artificial Sequence: Synthetic polypeptide
DEEEIRTTNPVATEQYGCVCSNTEEHQEYFGSDTQA

SEQ ID NO: 144796 - protein, 36 aa, Artificial Sequence
  Description of Artificial Sequence: Synthetic polypeptide
DEEEIRTTNPVATEQYGSVMGQNMNSEGGNGNSTEE

SEQ ID NO: 144797 - protein, 34 aa, Artificial Sequence
  Description of Artificial Sequence: Synthetic polypeptide
DEDEIATTNPVATEQYGSVCAATAGLAAAENDNN

SEQ ID NO: 144798 - protein, 32 aa, Artificial Sequence
  Description of Artificial Sequence: Synthetic polypeptide
TEEGICTTNPVAYEHYGSVSCMNMSNDGGNNK

SEQ ID NO: 144799 - protein, 35 aa, Artificial Sequence
  Description of Artificial Sequence: Synthetic polypeptide
QEEEIATTNPVATECYGSVSSTTPALPQHNEMNPV

SEQ ID NO: 144800 - protein, 34 aa, Artificial Sequence
  Description of Artificial Sequence: Synthetic polypeptide
TEEGICTTNPVAYEQYGSTVSCMNMSQLGGLNSK

SEQ ID NO: 144801 - protein, 38 aa, Artificial Sequence
  Description of Artificial Sequence: Synthetic polypeptide
DEEEIRTTNPVATEQYGASMVSSTTPAGPNMRNGMNPV

SEQ ID NO: 144802 - protein, 36 aa, Artificial Sequence
  Description of Artificial Sequence: Synthetic polypeptide
DEEEIRTTNPVATEQYGASNSTTVNSFDPNNEDEDG

SEQ ID NO: 144803 - protein, 33 aa, Artificial Sequence
  Description of Artificial Sequence: Synthetic polypeptide
TEEGICTTNPVAYEQYGSVACMNMSNRGGNNAE

SEQ ID NO: 144804 - protein, 36 aa, Artificial Sequence
  Description of Artificial Sequence: Synthetic polypeptide
DEEEIRTTNPVATEQYGCVCSNTEEHQENFLSDTQS

SEQ ID NO: 144805 - protein, 36 aa, Artificial Sequence
  Description of Artificial Sequence: Synthetic polypeptide
DEEEIRTTNPVATEQYGSVMGQNMNIEGGNGDETEG

SEQ ID NO: 144806 - protein, 38 aa, Artificial Sequence
  Description of Artificial Sequence: Synthetic polypeptide
DEEEIRTTNPVATEAYGVVSTVVSNNLQAGNTNDEEDE

SEQ ID NO: 144807 - protein, 35 aa, Artificial Sequence
  Description of Artificial Sequence: Synthetic polypeptide
TEEGICTTNPVAYEQYGSVSCLTNMSNRPGGNNAP

SEQ ID NO: 144808 - protein, 35 aa, Artificial Sequence
  Description of Artificial Sequence: Synthetic polypeptide
DEEEIRTTNPVATEQYGCVCSNTEEHNTHFNSDQG

SEQ ID NO: 144809 - protein, 36 aa, Artificial Sequence
  Description of Artificial Sequence: Synthetic polypeptide
DECEICTTNPVATEQYGVVSTVNNLQQQNNATEEEE

SEQ ID NO: 144810 - protein, 36 aa, Artificial Sequence
  Description of Artificial Sequence: Synthetic polypeptide
DECEICTTNPVATEQYGVVSTVNNLQQQNQNTEDEE

SEQ ID NO: 144811 - protein, 33 aa, Artificial Sequence
  Description of Artificial Sequence: Synthetic polypeptide
DESEIRSTNPVGTECWGSMSCITEPQDREGENG

SEQ ID NO: 144812 - protein, 36 aa, Artificial Sequence
  Description of Artificial Sequence: Synthetic polypeptide
DEEEIRTTNPVATEQYGCVCSNTEEHNEENFGSDQS

SEQ ID NO: 144813 - protein, 37 aa, Artificial Sequence
  Description of Artificial Sequence: Synthetic polypeptide
DEEEIRTTNPVATEQYGSVGGPSNINVQSTENVVDQL

SEQ ID NO: 144814 - protein, 38 aa, Artificial Sequence
  Description of Artificial Sequence: Synthetic polypeptide
DEEEIRTTNPVATEAYGVVSTVVNTNLQYGNDNDEQGT

SEQ ID NO: 144815 - protein, 36 aa, Artificial Sequence
  Description of Artificial Sequence: Synthetic polypeptide
DEEEIRTTNPVATEQYGCVCSNTEEDHNQNFGSDQS

SEQ ID NO: 144816 - protein, 38 aa, Artificial Sequence
  Description of Artificial Sequence: Synthetic polypeptide
DEEEIRTTNPVATEAYGVVSTVVNTNLQSGTNNDEQGS

SEQ ID NO: 144817 - protein, 38 aa, Artificial Sequence
  Description of Artificial Sequence: Synthetic polypeptide
DEEEIRTTNPVATEAYGVVSTVVNTNLQSGNTNDEQAE

SEQ ID NO: 144818 - protein, 38 aa, Artificial Sequence
  Description of Artificial Sequence: Synthetic polypeptide
DEEEIRTTNPVATEQYGSVGGPSNTENVQSLENNVDQY

SEQ ID NO: 144819 - protein, 36 aa, Artificial Sequence
  Description of Artificial Sequence: Synthetic polypeptide
DECEICTTNPVATEQYGVVSTVTDGNLEQGEESNND

SEQ ID NO: 144820 - protein, 36 aa, Artificial Sequence
  Description of Artificial Sequence: Synthetic polypeptide
DEEEIRTTNPVATEQYGCVCSNTEEDHNQHFGSEQT

SEQ ID NO: 144821 - protein, 36 aa, Artificial Sequence
  Description of Artificial Sequence: Synthetic polypeptide
DEEEIRTTNPVATEQYGCVCSNTEEDHNQGFNSDQF

SEQ ID NO: 144822 - protein, 30 aa, Artificial Sequence
  Description of Artificial Sequence: Synthetic polypeptide
AEEEIATTNPVATEQYGCYTPWVDQHFEEQ

SEQ ID NO: 144823 - protein, 30 aa, Artificial Sequence
  Description of Artificial Sequence: Synthetic polypeptide
DESEIRSTNPVGTEGYGVTWASTWAEHGDI

SEQ ID NO: 144824 - protein, 36 aa, Artificial Sequence
  Description of Artificial Sequence: Synthetic polypeptide
DEEEIRTTNPVATEQYGSVGGPSQVVQSRETVVDQL

SEQ ID NO: 144825 - protein, 35 aa, Artificial Sequence
  Description of Artificial Sequence: Synthetic polypeptide
DEDEIATTNPVATEQYGSVAITNHPEAPDNQEGFP

SEQ ID NO: 144826 - protein, 30 aa, Artificial Sequence
  Description of Artificial Sequence: Synthetic polypeptide
AEEEIATTNPVATEQYGCYCPWVDNQHDEQ

SEQ ID NO: 144827 - protein, 35 aa, Artificial Sequence
  Description of Artificial Sequence: Synthetic polypeptide
DEDEIATTNPVATEQYGSVAIANNLTEAEGGNEHT

SEQ ID NO: 144828 - protein, 38 aa, Artificial Sequence
  Description of Artificial Sequence: Synthetic polypeptide
DEEEIRTTNPVATEQYGSVGGPSVNHNDQSRENVVDQE

SEQ ID NO: 144829 - protein, 37 aa, Artificial Sequence
  Description of Artificial Sequence: Synthetic polypeptide
DEEEIRTTNPVATEQYGCVCSNTEEDHNQYFGSENQD

SEQ ID NO: 144830 - protein, 35 aa, Artificial Sequence
  Description of Artificial Sequence: Synthetic polypeptide
DEEEIRTTNPVATEQYGSVMGQNMEDEGGEDEQGH

SEQ ID NO: 144831 - protein, 36 aa, Artificial Sequence
  Description of Artificial Sequence: Synthetic polypeptide
DECEICTTNPVATEQYGVVSTVTDGGNLEQGETNND

SEQ ID NO: 144832 - protein, 38 aa, Artificial Sequence
  Description of Artificial Sequence: Synthetic polypeptide
DEEEIRTTNPVATEAYGVVSTVVNTNLQYGNNNDEQEE

SEQ ID NO: 144833 - protein, 36 aa, Artificial Sequence
  Description of Artificial Sequence: Synthetic polypeptide
DEEEIRTTNPVATEQYGCVCSNTEEHNAENFGSEQF

SEQ ID NO: 144834 - protein, 36 aa, Artificial Sequence
  Description of Artificial Sequence: Synthetic polypeptide
DEEEIRTTNPVATEQYGCVCSNTEEHEQYFGSDTQS

SEQ ID NO: 144835 - protein, 35 aa, Artificial Sequence
  Description of Artificial Sequence: Synthetic polypeptide
DEEEIRTTNPVATEQYGCVCSNTEEHDANFGSEQP

SEQ ID NO: 144836 - protein, 32 aa, Artificial Sequence
  Description of Artificial Sequence: Synthetic polypeptide
DESEIRSTNPVGTECWGVMSCITEPQDRGENG

SEQ ID NO: 144837 - protein, 35 aa, Artificial Sequence
  Description of Artificial Sequence: Synthetic polypeptide
DEEEIRTTNPVATEQYGCVCSNTEEHAFFNSDNQP

SEQ ID NO: 144838 - protein, 29 aa, Artificial Sequence
  Description of Artificial Sequence: Synthetic peptide
DESEIRSTNPVGTEGWGDVASTEQAAEDA

SEQ ID NO: 144839 - protein, 35 aa, Artificial Sequence
  Description of Artificial Sequence: Synthetic polypeptide
DEEEIRTTNPVATEQYGCVCSNTEEHAEFFGSDQP

SEQ ID NO: 144840 - protein, 32 aa, Artificial Sequence
  Description of Artificial Sequence: Synthetic polypeptide
DESEIRSTNPVGTEGWGVMSCITEPQDRGENG

SEQ ID NO: 144841 - protein, 31 aa, Artificial Sequence
  Description of Artificial Sequence: Synthetic polypeptide
QEEEIATTNPVATEGYGEAPAETCQSRVGEK

SEQ ID NO: 144842 - protein, 32 aa, Artificial Sequence
  Description of Artificial Sequence: Synthetic polypeptide
DESEIRSTNPVGTEGWGVMSCITLPQDRGENG

SEQ ID NO: 144843 - protein, 37 aa, Artificial Sequence
  Description of Artificial Sequence: Synthetic polypeptide
DEEEIRTTNPVATEQYGASVSSTTPAGPNMRNNMNPV

SEQ ID NO: 144844 - protein, 36 aa, Artificial Sequence
  Description of Artificial Sequence: Synthetic polypeptide
DEEEIRTTNPVATEQYGSVHYTIDPFYDVEGEEDRD

SEQ ID NO: 144845 - protein, 37 aa, Artificial Sequence
  Description of Artificial Sequence: Synthetic polypeptide
DEEEIRTTNPVATEAYGVVSTVVNTNQQAGNNDEQEE

SEQ ID NO: 144846 - protein, 36 aa, Artificial Sequence
  Description of Artificial Sequence: Synthetic polypeptide
DEEEIRTTNPVATEQYGCVCSNTEEDQENFNSDNQS

SEQ ID NO: 144847 - protein, 36 aa, Artificial Sequence
  Description of Artificial Sequence: Synthetic polypeptide
DEEEIRTTNPVATEQYGCVCSNTEEDNQNFNSDNQG

SEQ ID NO: 144848 - protein, 36 aa, Artificial Sequence
  Description of Artificial Sequence: Synthetic polypeptide
DEEEIRTTNPVATEQYGCVCSNTEEDNQEGFGSDQS

SEQ ID NO: 144849 - protein, 35 aa, Artificial Sequence
  Description of Artificial Sequence: Synthetic polypeptide
DEEEIRTTNPVATEQYGCVCSNWEEHNQNFNSDQS

SEQ ID NO: 144850 - protein, 37 aa, Artificial Sequence
  Description of Artificial Sequence: Synthetic polypeptide
DEEEIRTTNPVATEQYGSVMGSFEDGEQGNGQENSIE

SEQ ID NO: 144851 - protein, 36 aa, Artificial Sequence
  Description of Artificial Sequence: Synthetic polypeptide
DEDEIATTNPVATEQYGSVCSTDTGPQDHGNGMPPM

SEQ ID NO: 144852 - protein, 34 aa, Artificial Sequence
  Description of Artificial Sequence: Synthetic polypeptide
DEEEIATTNPVATEQWGNTTTSANELAGMPGNNH

SEQ ID NO: 144853 - protein, 35 aa, Artificial Sequence
  Description of Artificial Sequence: Synthetic polypeptide
DECEICTTNPVATEQYGTVSTVTNGTVEAGEGNND

SEQ ID NO: 144854 - protein, 33 aa, Artificial Sequence
  Description of Artificial Sequence: Synthetic polypeptide
DEEEIATTNPVATEQWGNTTTATGEGAGMMNRE

SEQ ID NO: 144855 - protein, 36 aa, Artificial Sequence
  Description of Artificial Sequence: Synthetic polypeptide
DEEEIRTTNPVATEQYGCVCSNTMEDHNQNFGSDQE

SEQ ID NO: 144856 - protein, 33 aa, Artificial Sequence
  Description of Artificial Sequence: Synthetic polypeptide
QEEEIATTNPCSTEQYGIVSSCALQMSNGMTPR

SEQ ID NO: 144857 - protein, 34 aa, Artificial Sequence
  Description of Artificial Sequence: Synthetic polypeptide
QEEEIATTNPCSTEQYGIVSSTPALQMSNGMTPR

SEQ ID NO: 144858 - protein, 36 aa, Artificial Sequence
  Description of Artificial Sequence: Synthetic polypeptide
DEEEIRTTNPVATEQYGSVMGTMNQNMDEGGEGATI

SEQ ID NO: 144859 - protein, 34 aa, Artificial Sequence
  Description of Artificial Sequence: Synthetic polypeptide
QEEEIATTNPCSTEQYGSVSSTPALNMSNGMTPR

SEQ ID NO: 144860 - protein, 32 aa, Artificial Sequence
  Description of Artificial Sequence: Synthetic polypeptide
DEEEIRTTNPVATEQWGTNCAGAMNWLHMNES

SEQ ID NO: 144861 - protein, 34 aa, Artificial Sequence
  Description of Artificial Sequence: Synthetic polypeptide
DESEIRFTNPVATECWGSVSCINMPQDGEGENDG

SEQ ID NO: 144862 - protein, 35 aa, Artificial Sequence
  Description of Artificial Sequence: Synthetic polypeptide
DEEEIRTTNPVATEQYGCVCSNTGPHQENFPSDQP

SEQ ID NO: 144863 - protein, 32 aa, Artificial Sequence
  Description of Artificial Sequence: Synthetic polypeptide
DEDEIATTNPVAYEAWGVVTSTNTQGEDTNNS

SEQ ID NO: 144864 - protein, 34 aa, Artificial Sequence
  Description of Artificial Sequence: Synthetic polypeptide
DEEEIRTTNPVATEQWGTNCAGTMNLSHQMNEAE

SEQ ID NO: 144865 - protein, 32 aa, Artificial Sequence
  Description of Artificial Sequence: Synthetic polypeptide
DEEEIATTNPVATEQWGNTTTATGEGAGMGNN

SEQ ID NO: 144866 - protein, 35 aa, Artificial Sequence
  Description of Artificial Sequence: Synthetic polypeptide
DEEEIRTTNPVATEQWGTCVCSTMYDNAHFGSDQS

SEQ ID NO: 144867 - protein, 35 aa, Artificial Sequence
  Description of Artificial Sequence: Synthetic polypeptide
DECEICTTNPVATEQYGTVSTVTNGTNVEGEGNND

SEQ ID NO: 144868 - protein, 36 aa, Artificial Sequence
  Description of Artificial Sequence: Synthetic polypeptide
DEEEIRTTNPVATEQYGSVIEPHPLQHQDVEVNECE

SEQ ID NO: 144869 - protein, 34 aa, Artificial Sequence
  Description of Artificial Sequence: Synthetic polypeptide
AEDEICATNPVATEQYGVVAVSNENLQQGNGNDT

SEQ ID NO: 144870 - protein, 35 aa, Artificial Sequence
  Description of Artificial Sequence: Synthetic polypeptide
TEEEIRTTNPVATESYGSVPACNNSGDEMVGNPRR

SEQ ID NO: 144871 - protein, 33 aa, Artificial Sequence
  Description of Artificial Sequence: Synthetic polypeptide
TEEEIRTTNPVATESYGSVVDQPEGEGNQGGGI

SEQ ID NO: 144872 - protein, 35 aa, Artificial Sequence
  Description of Artificial Sequence: Synthetic polypeptide
DECEICTTNPVATEQYGTVSTVTNGNPVESGEGND

SEQ ID NO: 144873 - protein, 35 aa, Artificial Sequence
  Description of Artificial Sequence: Synthetic polypeptide
DEEEIATTNPVATEQYGSVCAAAANDQDMPPENAN

SEQ ID NO: 144874 - protein, 36 aa, Artificial Sequence
  Description of Artificial Sequence: Synthetic polypeptide
DEEEIRTTNPVATEAYGVVTVVVTTNEEQNGNQNQD

SEQ ID NO: 144875 - protein, 35 aa, Artificial Sequence
  Description of Artificial Sequence: Synthetic polypeptide
DECEICTTNPVATEQYGTVSTVTNGNVEGEGNEDT

SEQ ID NO: 144876 - protein, 35 aa, Artificial Sequence
  Description of Artificial Sequence: Synthetic polypeptide
DESEIRCTNPVATEPYGSVCFTNEDHTDQGGDNHG

SEQ ID NO: 144877 - protein, 35 aa, Artificial Sequence
  Description of Artificial Sequence: Synthetic polypeptide
DECEICTTNPVATEQYGTVSTVTNGNVEGEGTNND

SEQ ID NO: 144878 - protein, 35 aa, Artificial Sequence
  Description of Artificial Sequence: Synthetic polypeptide
DEEEIRTTNPVATEQYGCVCSNTMEHAEGFGSDQS

SEQ ID NO: 144879 - protein, 37 aa, Artificial Sequence
  Description of Artificial Sequence: Synthetic polypeptide
DEEEIRTTNPVATEQYGSVMGTMTQEDQSGENGGGQG

SEQ ID NO: 144880 - protein, 35 aa, Artificial Sequence
  Description of Artificial Sequence: Synthetic polypeptide
DECEICTTNPVATEQYGTVSTVTNGNVESGETNVD

SEQ ID NO: 144881 - protein, 37 aa, Artificial Sequence
  Description of Artificial Sequence: Synthetic polypeptide
DEEEIRTTNPVATEQYGSVMGTMNVDQGGGEITQEGG

SEQ ID NO: 144882 - protein, 36 aa, Artificial Sequence
  Description of Artificial Sequence: Synthetic polypeptide
DECEICTTNPVATEQYGTVSTVTNGQNDEEGEGGND

SEQ ID NO: 144883 - protein, 37 aa, Artificial Sequence
  Description of Artificial Sequence: Synthetic polypeptide
DEEEIRTTNPVATEQWGSVVSTGNENATPPTGGQNHG

SEQ ID NO: 144884 - protein, 33 aa, Artificial Sequence
  Description of Artificial Sequence: Synthetic polypeptide
AEDEICATNPVATEQYGVVAVSNENLQQGEGTD

SEQ ID NO: 144885 - protein, 32 aa, Artificial Sequence
  Description of Artificial Sequence: Synthetic polypeptide
DESEIRGTNPVATDAYGVISINNGQGTGNGDG

SEQ ID NO: 144886 - protein, 38 aa, Artificial Sequence
  Description of Artificial Sequence: Synthetic polypeptide
AEEEIRTTNPVATEQYGSVVTVTNNNLEQGTEAGNTTV

SEQ ID NO: 144887 - protein, 34 aa, Artificial Sequence
  Description of Artificial Sequence: Synthetic polypeptide
DESEIRGTNPVATDAYGVVISITNGQGQTGNGDG

SEQ ID NO: 144888 - protein, 36 aa, Artificial Sequence
  Description of Artificial Sequence: Synthetic polypeptide
DEEEIRTTNPVATEQYGCVCSNTGPHNQFFNSDFQS

SEQ ID NO: 144889 - protein, 34 aa, Artificial Sequence
  Description of Artificial Sequence: Synthetic polypeptide
DEEEIATTNPVATEQYGSVATPAITQLDMEPAIE

SEQ ID NO: 144890 - protein, 34 aa, Artificial Sequence
  Description of Artificial Sequence: Synthetic polypeptide
AEEEICTTNPVATEQYGVVATVNEQQGEEQEEEE

SEQ ID NO: 144891 - protein, 34 aa, Artificial Sequence
  Description of Artificial Sequence: Synthetic polypeptide
DEDEIATTNPVATEVWGSVCYTNDNQDQGGNNSE

SEQ ID NO: 144892 - protein, 37 aa, Artificial Sequence
  Description of Artificial Sequence: Synthetic polypeptide
DEEEIRTTNPVATEQYGCVCSNTGNDEQENFNSEFQA

SEQ ID NO: 144893 - protein, 34 aa, Artificial Sequence
  Description of Artificial Sequence: Synthetic polypeptide
DEDEIATTNPVATEVWGSVCYTNDNQDQGGNNDL

SEQ ID NO: 144894 - protein, 37 aa, Artificial Sequence
  Description of Artificial Sequence: Synthetic polypeptide
DEEEIRTTNPVATEAYGVVSTVVTTNLEQGNTEAGQD

SEQ ID NO: 144895 - protein, 34 aa, Artificial Sequence
  Description of Artificial Sequence: Synthetic polypeptide
DESEIRGTNPVATECWGSVYSCINEPPDREGENG

SEQ ID NO: 144896 - protein, 36 aa, Artificial Sequence
  Description of Artificial Sequence: Synthetic polypeptide
DEEEIRTTNPVATEQYGSVIELNCNFLQPQSSVEIL

SEQ ID NO: 144897 - protein, 34 aa, Artificial Sequence
  Description of Artificial Sequence: Synthetic polypeptide
AEEEICTTNPVATEQYGVVATVLEQVAEQGTEEG

SEQ ID NO: 144898 - protein, 33 aa, Artificial Sequence
  Description of Artificial Sequence: Synthetic polypeptide
AEEEICTTNPVATEQYGVVATVEVQEQGTEEQE

SEQ ID NO: 144899 - protein, 33 aa, Artificial Sequence
  Description of Artificial Sequence: Synthetic polypeptide
AEEEICTTNPVATEQYGVVATVEVQEQGEEEED

SEQ ID NO: 144900 - protein, 33 aa, Artificial Sequence
  Description of Artificial Sequence: Synthetic polypeptide
AEEEICTTNPVATEQYGVVATVEVNEQNEEEED

SEQ ID NO: 144901 - protein, 34 aa, Artificial Sequence
  Description of Artificial Sequence: Synthetic polypeptide
DEDEIATTNPVATEVWGSVCYTNDLGDQGHQEDR

SEQ ID NO: 144902 - protein, 35 aa, Artificial Sequence
  Description of Artificial Sequence: Synthetic polypeptide
DESEIRGTNPVATEQYGDVTSVGDSGQRGLGEENS

SEQ ID NO: 144903 - protein, 34 aa, Artificial Sequence
  Description of Artificial Sequence: Synthetic polypeptide
DEDEIATTNPVATEVWGSVCYTNDLGDQGGQQDP

SEQ ID NO: 144904 - protein, 37 aa, Artificial Sequence
  Description of Artificial Sequence: Synthetic polypeptide
DEEEIRTTNPVATEAYGTVSTTQQANTEQGTNGNQDD

SEQ ID NO: 144905 - protein, 35 aa, Artificial Sequence
  Description of Artificial Sequence: Synthetic polypeptide
TEEEIRTTNPVATESYGSTVQCANSGSEMSGNPRR

SEQ ID NO: 144906 - protein, 36 aa, Artificial Sequence
  Description of Artificial Sequence: Synthetic polypeptide
DEEEIRTTNPVATEAYGTVSTTQQANTEQGTNANND

SEQ ID NO: 144907 - protein, 37 aa, Artificial Sequence
  Description of Artificial Sequence: Synthetic polypeptide
DEEEIRTTNPVATEAYGTVSTTNNGQQGNNQEDEEDG

SEQ ID NO: 144908 - protein, 38 aa, Artificial Sequence
  Description of Artificial Sequence: Synthetic polypeptide
AEEEIRTTNPVATEQYGSVVTVTNNNGNLNQQGTNAIG

SEQ ID NO: 144909 - protein, 36 aa, Artificial Sequence
  Description of Artificial Sequence: Synthetic polypeptide
DECEICTTNPVATEQYGTVSTVTNTNLEAGETDNED

SEQ ID NO: 144910 - protein, 28 aa, Artificial Sequence
  Description of Artificial Sequence: Synthetic peptide
QEEEIATTNPIATEQWGEAPEVCQHEEK

SEQ ID NO: 144911 - protein, 36 aa, Artificial Sequence
  Description of Artificial Sequence: Synthetic polypeptide
DEEEIATTNPVATEQYGSVATPHQLPQEAANSNMDS

SEQ ID NO: 144912 - protein, 38 aa, Artificial Sequence
  Description of Artificial Sequence: Synthetic polypeptide
DEEEIRTTNPVATEAYGVVSVTNLQAGNTEQGGTTNDD

SEQ ID NO: 144913 - protein, 28 aa, Artificial Sequence
  Description of Artificial Sequence: Synthetic peptide
QEEEIATTNPIATEQYGEAPEVCMHEEK

SEQ ID NO: 144914 - protein, 38 aa, Artificial Sequence
  Description of Artificial Sequence: Synthetic polypeptide
DEEEIRTTNPVATEAYGVVSTVVVTNLQSGNVNDEQGE

SEQ ID NO: 144915 - protein, 38 aa, Artificial Sequence
  Description of Artificial Sequence: Synthetic polypeptide
DEEEIRTTNPVATEAYGVVSTVVVTNLQLGNTNDEQGS

SEQ ID NO: 144916 - protein, 38 aa, Artificial Sequence
  Description of Artificial Sequence: Synthetic polypeptide
DEEEIRTTNPVATEAYGVVSTVVVTNLQAGNQTDEEDE

SEQ ID NO: 144917 - protein, 29 aa, Artificial Sequence
  Description of Artificial Sequence: Synthetic peptide
QEEEIATTNPIATEQYGEAPEVCQHEEKF

SEQ ID NO: 144918 - protein, 33 aa, Artificial Sequence
  Description of Artificial Sequence: Synthetic polypeptide
QEEEIRTTNPVATEQYGDVSVEMGMGGGEGEED

SEQ ID NO: 144919 - protein, 38 aa, Artificial Sequence
  Description of Artificial Sequence: Synthetic polypeptide
DEEEIRTTNPVATEAYGVVSTVVVTNLQAGNNQGNDDQ

SEQ ID NO: 144920 - protein, 34 aa, Artificial Sequence
  Description of Artificial Sequence: Synthetic polypeptide
DECEICTTNPVATEQYGTVVTVTDGGVNVEGGND

SEQ ID NO: 144921 - protein, 38 aa, Artificial Sequence
  Description of Artificial Sequence: Synthetic polypeptide
DEEEIRTTNPVATEAYGVVSTVVTTNLQSGNGNDEQDE

SEQ ID NO: 144922 - protein, 31 aa, Artificial Sequence
  Description of Artificial Sequence: Synthetic polypeptide
TEEEIRTTNPVAYEAWGCFCIDDDQRGGPNA

SEQ ID NO: 144923 - protein, 29 aa, Artificial Sequence
  Description of Artificial Sequence: Synthetic peptide
QEEEIATTNPIATEQYGEAPNEVCQHEEK

SEQ ID NO: 144924 - protein, 34 aa, Artificial Sequence
  Description of Artificial Sequence: Synthetic polypeptide
DEDEIATTNPVATEVWGSVCYTNDHQDQHRQNDH

SEQ ID NO: 144925 - protein, 35 aa, Artificial Sequence
  Description of Artificial Sequence: Synthetic polypeptide
DECEICTTNPVATEQYGTVSTVTNGNNVEGEGNVD

SEQ ID NO: 144926 - protein, 37 aa, Artificial Sequence
  Description of Artificial Sequence: Synthetic polypeptide
AEEEIRTTNPVATEQYGSVVTVTNNQAGNQQGNNQGD

SEQ ID NO: 144927 - protein, 37 aa, Artificial Sequence
  Description of Artificial Sequence: Synthetic polypeptide
AEEEIRTTNPVATEQYGSVVTVTNNQLGNNEQGNVDE

SEQ ID NO: 144928 - protein, 34 aa, Artificial Sequence
  Description of Artificial Sequence: Synthetic polypeptide
DECEICTTNPVATEQYGTVSTVTDGGVEDEGNTD

SEQ ID NO: 144929 - protein, 37 aa, Artificial Sequence
  Description of Artificial Sequence: Synthetic polypeptide
AEEEIRTTNPVATEQYGSVVTVTNNQLGNGEQGTTDE

SEQ ID NO: 144930 - protein, 35 aa, Artificial Sequence
  Description of Artificial Sequence: Synthetic polypeptide
DEEEIRTTNPVATEQYGCVCSNWEDHQEYFNSDQA

SEQ ID NO: 144931 - protein, 35 aa, Artificial Sequence
  Description of Artificial Sequence: Synthetic polypeptide
DEEEIRTTNPVATEQYGSVMGVFESDQDNGGGDQE

SEQ ID NO: 144932 - protein, 35 aa, Artificial Sequence
  Description of Artificial Sequence: Synthetic polypeptide
DEEEIRTTNPVATEQYGCVCSNWEDDNQYFGSDQA

SEQ ID NO: 144933 - protein, 37 aa, Artificial Sequence
  Description of Artificial Sequence: Synthetic polypeptide
AEEEICTTNPVATEQYGVVSVTTTTNLQAGNVTNQQD

SEQ ID NO: 144934 - protein, 33 aa, Artificial Sequence
  Description of Artificial Sequence: Synthetic polypeptide
DEEEIRTTNPVATECWGMHCWTMNEERRMNGQS

SEQ ID NO: 144935 - protein, 37 aa, Artificial Sequence
  Description of Artificial Sequence: Synthetic polypeptide
AEEEICTTNPVATEQYGVVSVTNTNNLQAGNNAEQQD

SEQ ID NO: 144936 - protein, 36 aa, Artificial Sequence
  Description of Artificial Sequence: Synthetic polypeptide
DEEEIRTTNPVATEQYGSVIEPTLSHPSRNANVVND

SEQ ID NO: 144937 - protein, 37 aa, Artificial Sequence
  Description of Artificial Sequence: Synthetic polypeptide
AEEEIRTTNPVATEQYGSVVTVTNNQLGNEQGNTDED

SEQ ID NO: 144938 - protein, 37 aa, Artificial Sequence
  Description of Artificial Sequence: Synthetic polypeptide
AEEEICTTNPVATEQYGVVSVTNTNLQQIGTNNTEDD

SEQ ID NO: 144939 - protein, 30 aa, Artificial Sequence
  Description of Artificial Sequence: Synthetic polypeptide
QEEEIATTNPVATEQYGEAPEVCQHLEEFK

SEQ ID NO: 144940 - protein, 36 aa, Artificial Sequence
  Description of Artificial Sequence: Synthetic polypeptide
DEEEIRTTNPVATEQYGSVFGVNMQDEDEGGGDGTP

SEQ ID NO: 144941 - protein, 36 aa, Artificial Sequence
  Description of Artificial Sequence: Synthetic polypeptide
AEEEICTTNPVATEQYGVVSVTNTNQQAGNNNNQQD

SEQ ID NO: 144942 - protein, 37 aa, Artificial Sequence
  Description of Artificial Sequence: Synthetic polypeptide
AEEEICTTNPVATEQYGVVSVTVTNLNQAGNNQEQED

SEQ ID NO: 144943 - protein, 34 aa, Artificial Sequence
  Description of Artificial Sequence: Synthetic polypeptide
DECEICTTNPVATEQYGTVSTVTDGGEVEGEGND

SEQ ID NO: 144944 - protein, 34 aa, Artificial Sequence
  Description of Artificial Sequence: Synthetic polypeptide
QEEEIATTNPVATEQYGSVPTEVGPNMRNEMNPV

SEQ ID NO: 144945 - protein, 35 aa, Artificial Sequence
  Description of Artificial Sequence: Synthetic polypeptide
DEEEIRTTNPVATEQYGCVCSNWEEHNQNFGSEQV

SEQ ID NO: 144946 - protein, 35 aa, Artificial Sequence
  Description of Artificial Sequence: Synthetic polypeptide
DEEEIRTTNPVATEQYGCVCSNWEEHNQGFGSDQS

SEQ ID NO: 144947 - protein, 35 aa, Artificial Sequence
  Description of Artificial Sequence: Synthetic polypeptide
AEEEIRATNPCATEQYGSVSTEGNNTSEQGTNTVD

SEQ ID NO: 144948 - protein, 36 aa, Artificial Sequence
  Description of Artificial Sequence: Synthetic polypeptide
DEEEIRTTNPVATEQYGCVCSNWEEHNQEGFNSDQA

SEQ ID NO: 144949 - protein, 35 aa, Artificial Sequence
  Description of Artificial Sequence: Synthetic polypeptide
DEEEIRTTNPVATEQYGCVCSNWEEHNENFGSDQS

SEQ ID NO: 144950 - protein, 35 aa, Artificial Sequence
  Description of Artificial Sequence: Synthetic polypeptide
DEEEIRTTNPVATEQYGCVCSNWEEHNANFGSQQG

SEQ ID NO: 144951 - protein, 34 aa, Artificial Sequence
  Description of Artificial Sequence: Synthetic polypeptide
DEEEIRTTNPVATEQYGCVCSNWEEDQNFISDQS

SEQ ID NO: 144952 - protein, 33 aa, Artificial Sequence
  Description of Artificial Sequence: Synthetic polypeptide
AEEEIGTTNPVGYDAWGSVVSTGNMLSQSGNEW

SEQ ID NO: 144953 - protein, 34 aa, Artificial Sequence
  Description of Artificial Sequence: Synthetic polypeptide
AEEEICTTNPVGYDAWGSVVSTGNMLSQSGNMRW

SEQ ID NO: 144954 - protein, 33 aa, Artificial Sequence
  Description of Artificial Sequence: Synthetic polypeptide
DEDEIATTNPVAYEEWGSVSGGNGNANGNDNQR

SEQ ID NO: 144955 - protein, 34 aa, Artificial Sequence
  Description of Artificial Sequence: Synthetic polypeptide
DESEIRTTNPVATECWGSVYHINNEPRDREGENG

SEQ ID NO: 144956 - protein, 34 aa, Artificial Sequence
  Description of Artificial Sequence: Synthetic polypeptide
AEEEICTTNPVGYDAWGSVVSTGNELSQSGDNRW

SEQ ID NO: 144957 - protein, 33 aa, Artificial Sequence
  Description of Artificial Sequence: Synthetic polypeptide
AEEEICTTNPVAYEQWGEVATNDGNQGQQGNAT

SEQ ID NO: 144958 - protein, 37 aa, Artificial Sequence
  Description of Artificial Sequence: Synthetic polypeptide
AEEEICTTNPVATEQYGVVSVTVTNLQQQGNGNNNAE

SEQ ID NO: 144959 - protein, 37 aa, Artificial Sequence
  Description of Artificial Sequence: Synthetic polypeptide
AEEEIRTTNPVATEQYGSVVTVTNNQNGNEEQGNNDE

SEQ ID NO: 144960 - protein, 37 aa, Artificial Sequence
  Description of Artificial Sequence: Synthetic polypeptide
DEEEIRTTNPVATEQYGSVMGVDFNVNIQEGEGNGQE

SEQ ID NO: 144961 - protein, 34 aa, Artificial Sequence
  Description of Artificial Sequence: Synthetic polypeptide
DECEICTTNPVATEQYGTVSTVTDGGVENEGNDT

SEQ ID NO: 144962 - protein, 36 aa, Artificial Sequence
  Description of Artificial Sequence: Synthetic polypeptide
DEEEIRTTNPVATEQYGSVMGTVNENMDEGGEGTDT

SEQ ID NO: 144963 - protein, 37 aa, Artificial Sequence
  Description of Artificial Sequence: Synthetic polypeptide
AEEEICTTNPVATEQYGVVSTVTNTNLQAGTNDEQQD

SEQ ID NO: 144964 - protein, 35 aa, Artificial Sequence
  Description of Artificial Sequence: Synthetic polypeptide
DESEIRTTNPVATECWGSVWSCINWEPNDRIGENG

SEQ ID NO: 144965 - protein, 34 aa, Artificial Sequence
  Description of Artificial Sequence: Synthetic polypeptide
DEDEIATTNPVAYECWGSVSGENLGEERQGDNSH

SEQ ID NO: 144966 - protein, 36 aa, Artificial Sequence
  Description of Artificial Sequence: Synthetic polypeptide
TEEEIRTTNPVATEQYGVVSGTMNDGQAEGGGEQSD

SEQ ID NO: 144967 - protein, 36 aa, Artificial Sequence
  Description of Artificial Sequence: Synthetic polypeptide
TEEEIRTTNPVATEQYGVVVSDDTDENNQGEGQEIE

SEQ ID NO: 144968 - protein, 36 aa, Artificial Sequence
  Description of Artificial Sequence: Synthetic polypeptide
DECEICTTNPVATEQYGTVSTVTNGNLEAGENQNED

SEQ ID NO: 144969 - protein, 36 aa, Artificial Sequence
  Description of Artificial Sequence: Synthetic polypeptide
DECEICTTNPVATEQYGTVSTVTNGNLEAGETGNDD

SEQ ID NO: 144970 - protein, 36 aa, Artificial Sequence
  Description of Artificial Sequence: Synthetic polypeptide
DECEICTTNPVATEQYGTVSTVTNGNLEAGTNNEDG

SEQ ID NO: 144971 - protein, 36 aa, Artificial Sequence
  Description of Artificial Sequence: Synthetic polypeptide
DEEEIRTTNPVATEQYGSVIEPTLSHDMRNANVVTD

SEQ ID NO: 144972 - protein, 36 aa, Artificial Sequence
  Description of Artificial Sequence: Synthetic polypeptide
DEEEIRTTNPVATEAYGTVSTSNTNNTEQGSNNNFT

SEQ ID NO: 144973 - protein, 37 aa, Artificial Sequence
  Description of Artificial Sequence: Synthetic polypeptide
DEEEIRTTNPVATEQYGSVFSAVMELRQEQDELNLVQ

SEQ ID NO: 144974 - protein, 36 aa, Artificial Sequence
  Description of Artificial Sequence: Synthetic polypeptide
DEEEIRTTNPVATEAYGTVSTSQSNNTEQGTNNNFE

SEQ ID NO: 144975 - protein, 36 aa, Artificial Sequence
  Description of Artificial Sequence: Synthetic polypeptide
DEEEIRTTNPVATEAYGTVSTSQTNNTEQGTNTNNF

SEQ ID NO: 144976 - protein, 33 aa, Artificial Sequence
  Description of Artificial Sequence: Synthetic polypeptide
AEEEICTTNPVATEQYGVVATVNVAEQGEEEDD

SEQ ID NO: 144977 - protein, 37 aa, Artificial Sequence
  Description of Artificial Sequence: Synthetic polypeptide
DECEICTTNPVATEQYGTVSTVTNGNLEQGENGNEDN

SEQ ID NO: 144978 - protein, 36 aa, Artificial Sequence
  Description of Artificial Sequence: Synthetic polypeptide
DECEICTTNPVATEQYGTVSTVTNGNNLEAGETNED

SEQ ID NO: 144979 - protein, 35 aa, Artificial Sequence
  Description of Artificial Sequence: Synthetic polypeptide
DECEICTTNPVATEQYGTVSTVTNGNDEAGEGNVD

SEQ ID NO: 144980 - protein, 36 aa, Artificial Sequence
  Description of Artificial Sequence: Synthetic polypeptide
DEEEIRTTNPVATEQYGSVIEPHPSSHAMREVNEVE

SEQ ID NO: 144981 - protein, 32 aa, Artificial Sequence
  Description of Artificial Sequence: Synthetic polypeptide
AEEEICTTNPVATEQYGVVATVVEVENQDEEE

SEQ ID NO: 144982 - protein, 36 aa, Artificial Sequence
  Description of Artificial Sequence: Synthetic polypeptide
DEEEIRTTNPVATEQYGCVCSNTPEHNAENFNSDQS

SEQ ID NO: 144983 - protein, 34 aa, Artificial Sequence
  Description of Artificial Sequence: Synthetic polypeptide
TEEEIRTTNPVATEQYGSVTHTTEDHNDENLEEG

SEQ ID NO: 144984 - protein, 37 aa, Artificial Sequence
  Description of Artificial Sequence: Synthetic polypeptide
AEEEIRTTNPVATEQYGSVVTVTNNQLGNEQGNNEEE

SEQ ID NO: 144985 - protein, 34 aa, Artificial Sequence
  Description of Artificial Sequence: Synthetic polypeptide
DESEIRATNPVATECWGSVVSCINEPQDFEGENG

SEQ ID NO: 144986 - protein, 31 aa, Artificial Sequence
  Description of Artificial Sequence: Synthetic polypeptide
DESEIRATNPVAYEQWGMVTGWNDHQGQNND

SEQ ID NO: 144987 - protein, 32 aa, Artificial Sequence
  Description of Artificial Sequence: Synthetic polypeptide
DEEEIRTTNPVATECWGEVPCIVEPQDREEEG

SEQ ID NO: 144988 - protein, 35 aa, Artificial Sequence
  Description of Artificial Sequence: Synthetic polypeptide
TEEEIRTTNPVATEQYGSVVIDEMGQDGEENGTTE

SEQ ID NO: 144989 - protein, 37 aa, Artificial Sequence
  Description of Artificial Sequence: Synthetic polypeptide
AEEEIRTTNPVATEQYGSVVTVTNNQGGNEQGNNDEQ

SEQ ID NO: 144990 - protein, 32 aa, Artificial Sequence
  Description of Artificial Sequence: Synthetic polypeptide
AEEEICTTNPVATEQYGVVAVTEVTEQNEEED

SEQ ID NO: 144991 - protein, 36 aa, Artificial Sequence
  Description of Artificial Sequence: Synthetic polypeptide
DEEEIRTTNPVATEQYGSVFPEINTGVIDNQVANLF

SEQ ID NO: 144992 - protein, 30 aa, Artificial Sequence
  Description of Artificial Sequence: Synthetic polypeptide
QEEEIATTNPVATEQYGEAPEVCQHHEEKN

SEQ ID NO: 144993 - protein, 31 aa, Artificial Sequence
  Description of Artificial Sequence: Synthetic polypeptide
AEEEICTTNPVATEQYGVVAVEVENQEEETE

SEQ ID NO: 144994 - protein, 31 aa, Artificial Sequence
  Description of Artificial Sequence: Synthetic polypeptide
AEEEICTTNPVATEQYGVVAVEVEEQEEEEE

SEQ ID NO: 144995 - protein, 36 aa, Artificial Sequence
  Description of Artificial Sequence: Synthetic polypeptide
TEEEIRTTNPVATEQYGSVYLTENNKTQQEIMEIDR

SEQ ID NO: 144996 - protein, 35 aa, Artificial Sequence
  Description of Artificial Sequence: Synthetic polypeptide
TEEEIRTTNPVATEQYGSVYWMNGEEQMIMNAEEL

SEQ ID NO: 144997 - protein, 35 aa, Artificial Sequence
  Description of Artificial Sequence: Synthetic polypeptide
DEEEIRTTNPVATEQYGSVFPMPLNEQSPVFLVDN

SEQ ID NO: 144998 - protein, 33 aa, Artificial Sequence
  Description of Artificial Sequence: Synthetic polypeptide
AEDEICATNPVATEQYGVVAVSENLQQGTGTDE

SEQ ID NO: 144999 - protein, 39 aa, Artificial Sequence
  Description of Artificial Sequence: Synthetic polypeptide
DEEEIRTTNPVATEAYGVVSTVVSTNLQAGSNGQGEDDM

SEQ ID NO: 145000 - protein, 34 aa, Artificial Sequence
  Description of Artificial Sequence: Synthetic polypeptide
DEDEIATTNPVATEVWGSVCYTNDHQDQGGQSDR

SEQ ID NO: 145001 - protein, 34 aa, Artificial Sequence
  Description of Artificial Sequence: Synthetic polypeptide
DEDEIATTNPVATEVWGSVCYTNDHQDQGGDNNS

SEQ ID NO: 145002 - protein, 32 aa, Artificial Sequence
  Description of Artificial Sequence: Synthetic polypeptide
AEEEICTTNPVATEQYGVVATEGVEEQTEEED

SEQ ID NO: 145003 - protein, 35 aa, Artificial Sequence
  Description of Artificial Sequence: Synthetic polypeptide
DEEEIRTTNPVATEQYGCVCSNTGEHNQNFISDQS

SEQ ID NO: 145004 - protein, 37 aa, Artificial Sequence
  Description of Artificial Sequence: Synthetic polypeptide
DECEICTTNPVATEQYGVVSTTNNNLNENQQGTNQTD

SEQ ID NO: 145005 - protein, 36 aa, Artificial Sequence
  Description of Artificial Sequence: Synthetic polypeptide
DEEEIRTTNPVATEQYGSVGCPTPLESESQIMVLSV

SEQ ID NO: 145006 - protein, 36 aa, Artificial Sequence
  Description of Artificial Sequence: Synthetic polypeptide
DEDEIATTNPVATEQYGSVSSTTPAGPNQRAGMEPV

SEQ ID NO: 145007 - protein, 37 aa, Artificial Sequence
  Description of Artificial Sequence: Synthetic polypeptide
DECEICTTNPVATEQYGVVSTTNNQLQGNQQGTNVTD

SEQ ID NO: 145008 - protein, 39 aa, Artificial Sequence
  Description of Artificial Sequence: Synthetic polypeptide
DEEEIRTTNPVATEAYGVVSTVVSTNLQAGSNTQGNDGG

SEQ ID NO: 145009 - protein, 37 aa, Artificial Sequence
  Description of Artificial Sequence: Synthetic polypeptide
DEEEIRTTNPVATEQYGSVMGTGDEMNQTNIGGNGQD

SEQ ID NO: 145010 - protein, 35 aa, Artificial Sequence
  Description of Artificial Sequence: Synthetic polypeptide
DECEICTTNPVATEQYGVVSTTNNQQQQQGTTTTE

SEQ ID NO: 145011 - protein, 35 aa, Artificial Sequence
  Description of Artificial Sequence: Synthetic polypeptide
DEEEIRTTNPVATEQYGCVCSNTGEHNQGFISDQE

SEQ ID NO: 145012 - protein, 36 aa, Artificial Sequence
  Description of Artificial Sequence: Synthetic polypeptide
DEEEIRTTNPVATEQYGCVCSNTGEHNQFFNSNTQI

SEQ ID NO: 145013 - protein, 36 aa, Artificial Sequence
  Description of Artificial Sequence: Synthetic polypeptide
DEEEIRTTNPVATEQYGCVCSNTGEHNQEYFNSDQA

SEQ ID NO: 145014 - protein, 37 aa, Artificial Sequence
  Description of Artificial Sequence: Synthetic polypeptide
DEEEIRTTNPVATEQYGCVCSNTGEHNQEYFGSENQS

SEQ ID NO: 145015 - protein, 36 aa, Artificial Sequence
  Description of Artificial Sequence: Synthetic polypeptide
DEEEIRTTNPVATEQYGCVCSNTGEHNQEYFGSDQE

SEQ ID NO: 145016 - protein, 36 aa, Artificial Sequence
  Description of Artificial Sequence: Synthetic polypeptide
DEEEIRTTNPVATEQYGCVCSNTGEHNQHFNSDTQA

SEQ ID NO: 145017 - protein, 37 aa, Artificial Sequence
  Description of Artificial Sequence: Synthetic polypeptide
DECEICTTNPVATEQYGVVSTTNLQQGNNQQGTTEDD

SEQ ID NO: 145018 - protein, 37 aa, Artificial Sequence
  Description of Artificial Sequence: Synthetic polypeptide
DECEICTTNPVATEQYGVVSTTNLQQANNQQGTNVND

SEQ ID NO: 145019 - protein, 36 aa, Artificial Sequence
  Description of Artificial Sequence: Synthetic polypeptide
DEEEIRTTNPVATEQYGCVCSNTGEHNQNFNSENQF

SEQ ID NO: 145020 - protein, 37 aa, Artificial Sequence
  Description of Artificial Sequence: Synthetic polypeptide
DEEEIRTTNPVATEQYGSVIYCTENDNNALNNEVNGS

SEQ ID NO: 145021 - protein, 29 aa, Artificial Sequence
  Description of Artificial Sequence: Synthetic peptide
QEEEIATTNPVAFEQYGEAPLEVCQHEKK

SEQ ID NO: 145022 - protein, 34 aa, Artificial Sequence
  Description of Artificial Sequence: Synthetic polypeptide
DECEICTTNPVATEQYGVVSTTNALEDTEEEDEG

SEQ ID NO: 145023 - protein, 36 aa, Artificial Sequence
  Description of Artificial Sequence: Synthetic polypeptide
DEEEIRTTNPVATEQYGSVGCPNPLLGESQIMVVEV

SEQ ID NO: 145024 - protein, 32 aa, Artificial Sequence
  Description of Artificial Sequence: Synthetic polypeptide
AEEEICTTNPVATEQYGVVATEVAEQETEEED

SEQ ID NO: 145025 - protein, 32 aa, Artificial Sequence
  Description of Artificial Sequence: Synthetic polypeptide
AEEEICTTNPVATEQYGVVATEVAEQEEETED

SEQ ID NO: 145026 - protein, 33 aa, Artificial Sequence
  Description of Artificial Sequence: Synthetic polypeptide
AEEEICTTNPVATEQYGVVATEQVTEQNEENED

SEQ ID NO: 145027 - protein, 36 aa, Artificial Sequence
  Description of Artificial Sequence: Synthetic polypeptide
DEEEIRTTNPVATEQYGSVIDINMGEEQPWGEVPEI

SEQ ID NO: 145028 - protein, 35 aa, Artificial Sequence
  Description of Artificial Sequence: Synthetic polypeptide
QEEEIRTTNPVATEQYGAVDSDTNMNGDEFTNVTE

SEQ ID NO: 145029 - protein, 34 aa, Artificial Sequence
  Description of Artificial Sequence: Synthetic polypeptide
TEEEIRTTNPVAYEQWGSYWSTINPNGEEGNPND

SEQ ID NO: 145030 - protein, 39 aa, Artificial Sequence
  Description of Artificial Sequence: Synthetic polypeptide
DEEEIRTTNPVATEAYGVVSTVVSTNLQAGSNTQGNTDE

SEQ ID NO: 145031 - protein, 37 aa, Artificial Sequence
  Description of Artificial Sequence: Synthetic polypeptide
DEEEIRTTNPVATEQYGCVCSNTGEHNTENFGSDNQQ

SEQ ID NO: 145032 - protein, 36 aa, Artificial Sequence
  Description of Artificial Sequence: Synthetic polypeptide
DEEEIATTNPVATEQWGHSNVSATANGLFAEAPGGF

SEQ ID NO: 145033 - protein, 35 aa, Artificial Sequence
  Description of Artificial Sequence: Synthetic polypeptide
DEEEIRTTNPVATEQYGCVCSNTGEHNQNFSSDQA

SEQ ID NO: 145034 - protein, 34 aa, Artificial Sequence
  Description of Artificial Sequence: Synthetic polypeptide
DEEEIATTNPVATEQYGNTIATNPLENGMPMGEA

SEQ ID NO: 145035 - protein, 36 aa, Artificial Sequence
  Description of Artificial Sequence: Synthetic polypeptide
DEEEIRTTNPVATEQYGCVCSNTGEHNQESFGSDQG

SEQ ID NO: 145036 - protein, 37 aa, Artificial Sequence
  Description of Artificial Sequence: Synthetic polypeptide
DEEEIRTTNPVATEQWGYSNVAASNELQHQRPGQGQV

SEQ ID NO: 145037 - protein, 37 aa, Artificial Sequence
  Description of Artificial Sequence: Synthetic polypeptide
DEEEIRTTNPVATEQWGYSNVAATAELQHQRPGQGFN

SEQ ID NO: 145038 - protein, 36 aa, Artificial Sequence
  Description of Artificial Sequence: Synthetic polypeptide
DEEEIRTTNPVATEQYGCVCSNTGEHNQENSNSDQT

SEQ ID NO: 145039 - protein, 39 aa, Artificial Sequence
  Description of Artificial Sequence: Synthetic polypeptide
DEEEIRTTNPVATEAYGVVSTVVSTNLQAGSNNQGNNDM

SEQ ID NO: 145040 - protein, 39 aa, Artificial Sequence
  Description of Artificial Sequence: Synthetic polypeptide
DEEEIRTTNPVATEAYGVVSTVVSTNLQAGSNLQGTDDQ

SEQ ID NO: 145041 - protein, 36 aa, Artificial Sequence
  Description of Artificial Sequence: Synthetic polypeptide
DECEICTTNPVATEQYGVVSTTQQLQQGNQNGNQED

SEQ ID NO: 145042 - protein, 39 aa, Artificial Sequence
  Description of Artificial Sequence: Synthetic polypeptide
DEEEIRTTNPVATEAYGVVSTVVSTNLQAGSNLQGNDTS

SEQ ID NO: 145043 - protein, 34 aa, Artificial Sequence
  Description of Artificial Sequence: Synthetic polypeptide
DESEIRTTNPVATECWGSVSNCIDEPQDREGEPI

SEQ ID NO: 145044 - protein, 30 aa, Artificial Sequence
  Description of Artificial Sequence: Synthetic polypeptide
QEEEIRTTNPVATEQWGEVPEVEMNAAEEA

SEQ ID NO: 145045 - protein, 31 aa, Artificial Sequence
  Description of Artificial Sequence: Synthetic polypeptide
AEEEIATTNPVAYEPWVVTTIATNLQDGNDP

SEQ ID NO: 145046 - protein, 37 aa, Artificial Sequence
  Description of Artificial Sequence: Synthetic polypeptide
DEEEIRTTNPVATEQYGCVCSNTGEDTQENFGSDNQS

SEQ ID NO: 145047 - protein, 36 aa, Artificial Sequence
  Description of Artificial Sequence: Synthetic polypeptide
DEEEIRTTNPVATEQYGCVCSNTGEDTNQSFGSEQS

SEQ ID NO: 145048 - protein, 30 aa, Artificial Sequence
  Description of Artificial Sequence: Synthetic polypeptide
QEEEIRTTNPVATEQWGEVPEIEMNHAEEA

SEQ ID NO: 145049 - protein, 29 aa, Artificial Sequence
  Description of Artificial Sequence: Synthetic peptide
QEEEIATTNPVATEAYGEAPEVHQHTEEK

SEQ ID NO: 145050 - protein, 35 aa, Artificial Sequence
  Description of Artificial Sequence: Synthetic polypeptide
DEEEIRTTNPVATEQYGCVCSNTGEDQESFISDQS

SEQ ID NO: 145051 - protein, 34 aa, Artificial Sequence
  Description of Artificial Sequence: Synthetic polypeptide
AEEEIATTNPVAYEGWGSVCSGTDNQDRDGGQNL

SEQ ID NO: 145052 - protein, 30 aa, Artificial Sequence
  Description of Artificial Sequence: Synthetic polypeptide
QEEEIRTTNPVATEQWGEVPEIEMNAAEEA

SEQ ID NO: 145053 - protein, 36 aa, Artificial Sequence
  Description of Artificial Sequence: Synthetic polypeptide
DEEEIRTTNPVATEQYGCVCSNTGEDQEHFISENQA

SEQ ID NO: 145054 - protein, 39 aa, Artificial Sequence
  Description of Artificial Sequence: Synthetic polypeptide
DEEEIRTTNPVATEAYGVVSTVVSTNLQAGSNQQGNDDD

SEQ ID NO: 145055 - protein, 38 aa, Artificial Sequence
  Description of Artificial Sequence: Synthetic polypeptide
DEEEIRTTNPVATEAYGVVSTVVSTNLQAGSTQQTEDD

SEQ ID NO: 145056 - protein, 34 aa, Artificial Sequence
  Description of Artificial Sequence: Synthetic polypeptide
AEEEIATTNPVAYEQWGSVCSTTNLPWDGGEGDT

SEQ ID NO: 145057 - protein, 33 aa, Artificial Sequence
  Description of Artificial Sequence: Synthetic polypeptide
QEEEIATTNPVATAQWGSVSITGDNPDNNNANN

SEQ ID NO: 145058 - protein, 36 aa, Artificial Sequence
  Description of Artificial Sequence: Synthetic polypeptide
DEEEIRTTNPVATEQYGSVGCPTPLLPESQINVLEV

SEQ ID NO: 145059 - protein, 36 aa, Artificial Sequence
  Description of Artificial Sequence: Synthetic polypeptide
DEEEIRTTNPVATEQYGCVCSNTGEHNQENFNSDQA

SEQ ID NO: 145060 - protein, 36 aa, Artificial Sequence
  Description of Artificial Sequence: Synthetic polypeptide
DEEEIRTTNPVATEQYGCVCSNTGEHNQENFGSQQA

SEQ ID NO: 145061 - protein, 34 aa, Artificial Sequence
  Description of Artificial Sequence: Synthetic polypeptide
AEEEIATTNPVGYDAWGSVVSTGNMLSQYSGNRW

SEQ ID NO: 145062 - protein, 36 aa, Artificial Sequence
  Description of Artificial Sequence: Synthetic polypeptide
DEEEIRTTNPVATEQYGSVGCPTPLLSEGQIMVLEV

SEQ ID NO: 145063 - protein, 37 aa, Artificial Sequence
  Description of Artificial Sequence: Synthetic polypeptide
DEEEIRTTNPVATEQYGCVCSNTGEHNQEGFGSDNQS

SEQ ID NO: 145064 - protein, 36 aa, Artificial Sequence
  Description of Artificial Sequence: Synthetic polypeptide
DEEEIRTTNPVATEQYGSVGCPTPLMLESQIMVLEE

SEQ ID NO: 145065 - protein, 33 aa, Artificial Sequence
  Description of Artificial Sequence: Synthetic polypeptide
AEEEIATTNPVAYEQYGSTVAPAGNNETAGNEQ

SEQ ID NO: 145066 - protein, 36 aa, Artificial Sequence
  Description of Artificial Sequence: Synthetic polypeptide
DEEEIRTTNPVATEQYGCVCSNTGEHNANFISDNQS

SEQ ID NO: 145067 - protein, 36 aa, Artificial Sequence
  Description of Artificial Sequence: Synthetic polypeptide
DEEEIRTTNPVATEQYGCVCSNTGEHNAENFGSEQA

SEQ ID NO: 145068 - protein, 37 aa, Artificial Sequence
  Description of Artificial Sequence: Synthetic polypeptide
DEEEIRTTNPVATEQYGCVCSNTGEHNAEGFGSENQA

SEQ ID NO: 145069 - protein, 38 aa, Artificial Sequence
  Description of Artificial Sequence: Synthetic polypeptide
DEEEIRTTNPVATEQWGYSNVAAWNELQHQRPGQGNFV

SEQ ID NO: 145070 - protein, 38 aa, Artificial Sequence
  Description of Artificial Sequence: Synthetic polypeptide
DEEEIRTTNPVATEQYGSVICPTVLTNQHALNGELTRI

SEQ ID NO: 145071 - protein, 38 aa, Artificial Sequence
  Description of Artificial Sequence: Synthetic polypeptide
DEEEIRTTNPVATEQWGYSNVSATTNELQHQAPGQLFS

SEQ ID NO: 145072 - protein, 38 aa, Artificial Sequence
  Description of Artificial Sequence: Synthetic polypeptide
DEEEIRTTNPVATEQYGSVGCSEMSNLTQPEPGQVEPT

SEQ ID NO: 145073 - protein, 37 aa, Artificial Sequence
  Description of Artificial Sequence: Synthetic polypeptide
DEEEIRTTNPVATEQYGCVCSNTGEHDQENFGSNTQA

SEQ ID NO: 145074 - protein, 28 aa, Artificial Sequence
  Description of Artificial Sequence: Synthetic peptide
QEEEIATTNPLATEQYGEAPEVCMHEEK

SEQ ID NO: 145075 - protein, 30 aa, Artificial Sequence
  Description of Artificial Sequence: Synthetic polypeptide
QEEEIATTNPVATEQYGEAPEVCQHEIEKT

SEQ ID NO: 145076 - protein, 39 aa, Artificial Sequence
  Description of Artificial Sequence: Synthetic polypeptide
DEEEIRTTNPVATEAYGVVSTVVSTNLQAGTNAQGNDDE

SEQ ID NO: 145077 - protein, 34 aa, Artificial Sequence
  Description of Artificial Sequence: Synthetic polypeptide
AEDEICATNPVATEQYGVVAVSNNNLQQGNGTDQ

SEQ ID NO: 145078 - protein, 33 aa, Artificial Sequence
  Description of Artificial Sequence: Synthetic polypeptide
AEEEICTTNPVATEQYGVVATVEVGEQQGEDEE

SEQ ID NO: 145079 - protein, 32 aa, Artificial Sequence
  Description of Artificial Sequence: Synthetic polypeptide
DEDEIATTNPVATESYGCIAGTNDQAMADGAF

SEQ ID NO: 145080 - protein, 29 aa, Artificial Sequence
  Description of Artificial Sequence: Synthetic peptide
QEEEIATTNPMATEQYGEAPEVCQHCEEK

SEQ ID NO: 145081 - protein, 30 aa, Artificial Sequence
  Description of Artificial Sequence: Synthetic polypeptide
QEEEIATTNPVATEQYGEAPEVCQHEPEWK

SEQ ID NO: 145082 - protein, 32 aa, Artificial Sequence
  Description of Artificial Sequence: Synthetic polypeptide
AEEEICTTNPVATEQYGVVATVEVEQEEEEDD

SEQ ID NO: 145083 - protein, 34 aa, Artificial Sequence
  Description of Artificial Sequence: Synthetic polypeptide
DESEIRHTNPVATECWGSMVSCINEPDDREGENG

SEQ ID NO: 145084 - protein, 29 aa, Artificial Sequence
  Description of Artificial Sequence: Synthetic peptide
QEEEIATTNPMATEQYGEAPEVCQHEIEC

SEQ ID NO: 145085 - protein, 33 aa, Artificial Sequence
  Description of Artificial Sequence: Synthetic polypeptide
DECEICTTNPVATEQYGVVATVTDGTVEEEGND

SEQ ID NO: 145086 - protein, 37 aa, Artificial Sequence
  Description of Artificial Sequence: Synthetic polypeptide
DEEEIRTTNPVATEAYGVVSTVVTNNNQQGNNNDEDE

SEQ ID NO: 145087 - protein, 32 aa, Artificial Sequence
  Description of Artificial Sequence: Synthetic polypeptide
AEEEICTTNPVATEQYGVVATVEVEEQEEEEE

SEQ ID NO: 145088 - protein, 32 aa, Artificial Sequence
  Description of Artificial Sequence: Synthetic polypeptide
AEEEICTTNPVATEQYGVVATVEVAEQEEEDN

SEQ ID NO: 145089 - protein, 36 aa, Artificial Sequence
  Description of Artificial Sequence: Synthetic polypeptide
DEEEIRTTNPVATEQWGTVSSTPPAGPNMRNGMNPV

SEQ ID NO: 145090 - protein, 32 aa, Artificial Sequence
  Description of Artificial Sequence: Synthetic polypeptide
TEEEIRTTNPVAYEHWGCFSWINDLERQGQKQ

SEQ ID NO: 145091 - protein, 32 aa, Artificial Sequence
  Description of Artificial Sequence: Synthetic polypeptide
AEEEICTTNPVATEQYGVVATVEVEQDEEEEE

SEQ ID NO: 145092 - protein, 37 aa, Artificial Sequence
  Description of Artificial Sequence: Synthetic polypeptide
DEEEIRTTNPVATEAYGVVSTVVTNNQQGQGNEEETD

SEQ ID NO: 145093 - protein, 32 aa, Artificial Sequence
  Description of Artificial Sequence: Synthetic polypeptide
DEDEIATTNPVATESYGCIAGTNDQAMADNQF

SEQ ID NO: 145094 - protein, 33 aa, Artificial Sequence
  Description of Artificial Sequence: Synthetic polypeptide
QEEEIRTTNPVATEQYGDVMSGIGGNGDGEEGM

SEQ ID NO: 145095 - protein, 34 aa, Artificial Sequence
  Description of Artificial Sequence: Synthetic polypeptide
DEDEIATTNPVATEVWGSVCYTNDHNDQGGDGDR

SEQ ID NO: 145096 - protein, 34 aa, Artificial Sequence
  Description of Artificial Sequence: Synthetic polypeptide
DEDEIATTNPVATEVWGSVCYNNDHQDQRGQNDK

SEQ ID NO: 145097 - protein, 34 aa, Artificial Sequence
  Description of Artificial Sequence: Synthetic polypeptide
QEEEIRTTNPVATEQYGDVSIDGMGEDGNIDDGE

SEQ ID NO: 145098 - protein, 35 aa, Artificial Sequence
  Description of Artificial Sequence: Synthetic polypeptide
DESEIRGTNPVATEQYGDVVTSVGDLGQRGLDEEG

SEQ ID NO: 145099 - protein, 36 aa, Artificial Sequence
  Description of Artificial Sequence: Synthetic polypeptide
DESEIRTTNPVATECWGSVSSTCPNGPNDRNGMNPG

SEQ ID NO: 145100 - protein, 35 aa, Artificial Sequence
  Description of Artificial Sequence: Synthetic polypeptide
DESEIRGTNPVATEQYGSVDTSVGDTGQRGLGDEG

SEQ ID NO: 145101 - protein, 37 aa, Artificial Sequence
  Description of Artificial Sequence: Synthetic polypeptide
DEEEIRTTNPVATEAYGVVSTVVTNQQQGNNDTEDEE

SEQ ID NO: 145102 - protein, 29 aa, Artificial Sequence
  Description of Artificial Sequence: Synthetic peptide
QEEEIATTNPLATEQYGEAPEVCQHEEKH

SEQ ID NO: 145103 - protein, 35 aa, Artificial Sequence
  Description of Artificial Sequence: Synthetic polypeptide
QEEEIRTTNPVATEQYGDVSDGVTGLGGNGGGQGG

SEQ ID NO: 145104 - protein, 36 aa, Artificial Sequence
  Description of Artificial Sequence: Synthetic polypeptide
DEEEIATTNPVATEQWGIKVVPSTNLSDPRVGSPLW

SEQ ID NO: 145105 - protein, 36 aa, Artificial Sequence
  Description of Artificial Sequence: Synthetic polypeptide
DESEIRGTNPVATEQYGSVQTSVGDLGQRGLGEQGE

SEQ ID NO: 145106 - protein, 36 aa, Artificial Sequence
  Description of Artificial Sequence: Synthetic polypeptide
DESEIRGTNPVATEQYGSVTMSITGDLGQDGLGEEG

SEQ ID NO: 145107 - protein, 35 aa, Artificial Sequence
  Description of Artificial Sequence: Synthetic polypeptide
DESEIRTTNPVATECWGSVSSCINHEPQDREFENG

SEQ ID NO: 145108 - protein, 30 aa, Artificial Sequence
  Description of Artificial Sequence: Synthetic polypeptide
DEDEIATTNPVATESYGCIAGTTDQMADTF

SEQ ID NO: 145109 - protein, 36 aa, Artificial Sequence
  Description of Artificial Sequence: Synthetic polypeptide
DESEIRGTNPVATEQYGSVVTSVGDLGQRGLGEEGV

SEQ ID NO: 145110 - protein, 35 aa, Artificial Sequence
  Description of Artificial Sequence: Synthetic polypeptide
QEEEIRTTNPVATEQYGDVDTGIQNDGETGNGNNE

SEQ ID NO: 145111 - protein, 35 aa, Artificial Sequence
  Description of Artificial Sequence: Synthetic polypeptide
QEEEIRTTNPVATEQYGDVCGNMNMTGQGGGNDGD

SEQ ID NO: 145112 - protein, 29 aa, Artificial Sequence
  Description of Artificial Sequence: Synthetic peptide
QEEEIATTNPNATEQYGEAPEVCCQHEEK

SEQ ID NO: 145113 - protein, 35 aa, Artificial Sequence
  Description of Artificial Sequence: Synthetic polypeptide
QEEEIATTNPVATEQYGSVSSTEPAGPNMREMNPV

SEQ ID NO: 145114 - protein, 32 aa, Artificial Sequence
  Description of Artificial Sequence: Synthetic polypeptide
AEEEICTTNPVATEQYGVVATVEGVEQDEEEQ

SEQ ID NO: 145115 - protein, 35 aa, Artificial Sequence
  Description of Artificial Sequence: Synthetic polypeptide
DEEEIRTTNPVATEQYGCVCSNTGEHQNFTSDTQA

SEQ ID NO: 145116 - protein, 34 aa, Artificial Sequence
  Description of Artificial Sequence: Synthetic polypeptide
QEEEIRTTNPVATEQYGAVVDGMTNQGNFDTNIN

SEQ ID NO: 145117 - protein, 28 aa, Artificial Sequence
  Description of Artificial Sequence: Synthetic peptide
QEEEIATTNPVAFEIYGEAPEVCQHEEK

SEQ ID NO: 145118 - protein, 31 aa, Artificial Sequence
  Description of Artificial Sequence: Synthetic polypeptide
DESEIRPTNPCSSEQWGIVSCNLPQSEGETG

SEQ ID NO: 145119 - protein, 39 aa, Artificial Sequence
  Description of Artificial Sequence: Synthetic polypeptide
DEEEIRTTNPVATEAYGVVSTVVSTNLQAGTTEQGNTDT

SEQ ID NO: 145120 - protein, 29 aa, Artificial Sequence
  Description of Artificial Sequence: Synthetic peptide
QEEEIATTNPVAFEQYGEAPEVCIQHEEK

SEQ ID NO: 145121 - protein, 28 aa, Artificial Sequence
  Description of Artificial Sequence: Synthetic peptide
QEEEIATTNPVAFEQYGEAPEVCKHEEK

SEQ ID NO: 145122 - protein, 29 aa, Artificial Sequence
  Description of Artificial Sequence: Synthetic peptide
QEEEIATTNPVAFEQYGEAPEVCQHEPEK

SEQ ID NO: 145123 - protein, 30 aa, Artificial Sequence
  Description of Artificial Sequence: Synthetic polypeptide
QEEEIATTNPVAFEQYGEAPEVCQQHEREK

SEQ ID NO: 145124 - protein, 33 aa, Artificial Sequence
  Description of Artificial Sequence: Synthetic polypeptide
DEDEIATTNPVATEQYGTVCSATDGPSEFEVND

SEQ ID NO: 145125 - protein, 32 aa, Artificial Sequence
  Description of Artificial Sequence: Synthetic polypeptide
AEEEICTTNPVATEQYGVVATEVGEQNEEEED

SEQ ID NO: 145126 - protein, 29 aa, Artificial Sequence
  Description of Artificial Sequence: Synthetic peptide
QEEEIATTNPVAFEQYGEAPEVCQYHEEK

SEQ ID NO: 145127 - protein, 39 aa, Artificial Sequence
  Description of Artificial Sequence: Synthetic polypeptide
DEEEIRTTNPVATEAYGVVSTVVSTNLQAGTNQQGEDDT

SEQ ID NO: 145128 - protein, 37 aa, Artificial Sequence
  Description of Artificial Sequence: Synthetic polypeptide
DEEEIRTTNPVATEQYGSVSTLMEMFMEPVSLEPDND

SEQ ID NO: 145129 - protein, 35 aa, Artificial Sequence
  Description of Artificial Sequence: Synthetic polypeptide
QEEEIRTTNPVATEQYGAVVDVNMNIIQTGEDNGE

SEQ ID NO: 145130 - protein, 36 aa, Artificial Sequence
  Description of Artificial Sequence: Synthetic polypeptide
TEEEIRTTNPVAYEQWGQVSSCTNMQSADPSGNYRA

SEQ ID NO: 145131 - protein, 33 aa, Artificial Sequence
  Description of Artificial Sequence: Synthetic polypeptide
DEDEIATTNPVATEQYGVVCAATDGPVEFEGND

SEQ ID NO: 145132 - protein, 39 aa, Artificial Sequence
  Description of Artificial Sequence: Synthetic polypeptide
DEEEIRTTNPVATEAYGVVSTVVSTNLQQGNNQQGNDDT

SEQ ID NO: 145133 - protein, 37 aa, Artificial Sequence
  Description of Artificial Sequence: Synthetic polypeptide
DEEEIRTTNPVATEAYGVVSTVVTNLQAGTTTDETEE

SEQ ID NO: 145134 - protein, 37 aa, Artificial Sequence
  Description of Artificial Sequence: Synthetic polypeptide
DEEEIRTTNPVATEQYGSVIEARTNEDLEIQGSEDQQ

SEQ ID NO: 145135 - protein, 30 aa, Artificial Sequence
  Description of Artificial Sequence: Synthetic polypeptide
QEEEIATTNPVATEQYGEAPEVCQHELEKG

SEQ ID NO: 145136 - protein, 32 aa, Artificial Sequence
  Description of Artificial Sequence: Synthetic polypeptide
AEEEICTTNPVATEQYGVVATVEQVEEQDEEE

SEQ ID NO: 145137 - protein, 38 aa, Artificial Sequence
  Description of Artificial Sequence: Synthetic polypeptide
DEEEIRTTNPVATEAYGVVSTVVSTNQQAGNNQQGDDN

SEQ ID NO: 145138 - protein, 34 aa, Artificial Sequence
  Description of Artificial Sequence: Synthetic polypeptide
DESEIRTTNPVATECWGSVSSCIAEPNMRNGENG

SEQ ID NO: 145139 - protein, 34 aa, Artificial Sequence
  Description of Artificial Sequence: Synthetic polypeptide
DESEIRTTNPVATECWGSVSSCIAEPNDRNGMNV

SEQ ID NO: 145140 - protein, 34 aa, Artificial Sequence
  Description of Artificial Sequence: Synthetic polypeptide
DESEIRTTNPVATECWGSVSSCIAEPNDRNGMNG

SEQ ID NO: 145141 - protein, 33 aa, Artificial Sequence
  Description of Artificial Sequence: Synthetic polypeptide
AEEEICTTNPVATEQYGVVATVEQVDEQGEEEA

SEQ ID NO: 145142 - protein, 33 aa, Artificial Sequence
  Description of Artificial Sequence: Synthetic polypeptide
AEEEICTTNPVATEQYGVVATVEQVAEQNEEED

SEQ ID NO: 145143 - protein, 37 aa, Artificial Sequence
  Description of Artificial Sequence: Synthetic polypeptide
DEEEIRTTNPVATEQYGCVCSNTGELNQEFFNSDNQE

SEQ ID NO: 145144 - protein, 39 aa, Artificial Sequence
  Description of Artificial Sequence: Synthetic polypeptide
DEEEIRTTNPVATEAYGVVSTVVSTNLQSGTNEQGNDDN

SEQ ID NO: 145145 - protein, 35 aa, Artificial Sequence
  Description of Artificial Sequence: Synthetic polypeptide
DEEEIRTTNPVATEQYGSVIDWPWNTAQFEESIQD

SEQ ID NO: 145146 - protein, 29 aa, Artificial Sequence
  Description of Artificial Sequence: Synthetic peptide
QEEEIATTNPSATEQYGEAPEVCRQHEEK

SEQ ID NO: 145147 - protein, 34 aa, Artificial Sequence
  Description of Artificial Sequence: Synthetic polypeptide
AEEEICTTNPVATEQYGVVATVEQVAEQGENEEE

SEQ ID NO: 145148 - protein, 33 aa, Artificial Sequence
  Description of Artificial Sequence: Synthetic polypeptide
AEEEICTTNPVATEQYGVVATVELVGEQEEEED

SEQ ID NO: 145149 - protein, 32 aa, Artificial Sequence
  Description of Artificial Sequence: Synthetic polypeptide
DESSIATTNPTAYEQWGSYYSHDNDQQSGNDR

SEQ ID NO: 145150 - protein, 35 aa, Artificial Sequence
  Description of Artificial Sequence: Synthetic polypeptide
FEEEIRTTNPVATEQYGAVVDVNMNIIQTENGNGE

SEQ ID NO: 145151 - protein, 32 aa, Artificial Sequence
  Description of Artificial Sequence: Synthetic polypeptide
DESSIATTNPVAYEQYSEEVTTGDNHQGGGKR

SEQ ID NO: 145152 - protein, 33 aa, Artificial Sequence
  Description of Artificial Sequence: Synthetic polypeptide
DEECLRTTNPIAYEQYGCVCSTEDLQNFGSDQA

SEQ ID NO: 145153 - protein, 34 aa, Artificial Sequence
  Description of Artificial Sequence: Synthetic polypeptide
DEEEIRATNPVATEQYGSVCAANGEEADNQENAN

SEQ ID NO: 145154 - protein, 38 aa, Artificial Sequence
  Description of Artificial Sequence: Synthetic polypeptide
DEEEIRTTNPVATEQYGSVSMENTNVQGIELVNENLGG

SEQ ID NO: 145155 - protein, 33 aa, Artificial Sequence
  Description of Artificial Sequence: Synthetic polypeptide
DEECLRTTNPIAYEQYGCVCSTGEHQNFGSNQA

SEQ ID NO: 145156 - protein, 32 aa, Artificial Sequence
  Description of Artificial Sequence: Synthetic polypeptide
DEECIATTNPVAYEQYAEEVTTTGDNHQGMAR

SEQ ID NO: 145157 - protein, 34 aa, Artificial Sequence
  Description of Artificial Sequence: Synthetic polypeptide
DEEEIRATNPVATEQYGSVCAANGEEADNQETTM

SEQ ID NO: 145158 - protein, 33 aa, Artificial Sequence
  Description of Artificial Sequence: Synthetic polypeptide
DEECLRTTNPIAYEQYGCVCSTGELQNFGSEQS

SEQ ID NO: 145159 - protein, 34 aa, Artificial Sequence
  Description of Artificial Sequence: Synthetic polypeptide
DEECIATTNPVAYEQWGVVCTIEDDGQRQGNGNR

SEQ ID NO: 145160 - protein, 37 aa, Artificial Sequence
  Description of Artificial Sequence: Synthetic polypeptide
AEEEIRTTNPVATEQYGVVSVTTNNGQQGNDEQNEED

SEQ ID NO: 145161 - protein, 35 aa, Artificial Sequence
  Description of Artificial Sequence: Synthetic polypeptide
DEEEIRTTNPVATEQYGSVSMESVHSEDPNVLEVE

SEQ ID NO: 145162 - protein, 34 aa, Artificial Sequence
  Description of Artificial Sequence: Synthetic polypeptide
DEEEICTTNPVAYEQWGEVATNDGNQGQAGNNDT

SEQ ID NO: 145163 - protein, 34 aa, Artificial Sequence
  Description of Artificial Sequence: Synthetic polypeptide
DSYEIRTTNPVATEQYGSVSSALDMEQISFDEDL

SEQ ID NO: 145164 - protein, 31 aa, Artificial Sequence
  Description of Artificial Sequence: Synthetic polypeptide
DSTDIACTNPVATAQWGCVSTNHQQRDSNGN

SEQ ID NO: 145165 - protein, 34 aa, Artificial Sequence
  Description of Artificial Sequence: Synthetic polypeptide
DEECIATTNPVAYEQWGTVCSTNDNHDQNGENHS

SEQ ID NO: 145166 - protein, 34 aa, Artificial Sequence
  Description of Artificial Sequence: Synthetic polypeptide
DEEEICTTNPVAYEQWGEVATNDGNQGQAGGNAH

SEQ ID NO: 145167 - protein, 33 aa, Artificial Sequence
  Description of Artificial Sequence: Synthetic polypeptide
DEEEICTTNPVAYEQWGEVATNDGNQGQAGEST

SEQ ID NO: 145168 - protein, 36 aa, Artificial Sequence
  Description of Artificial Sequence: Synthetic polypeptide
DEEEIRTTNPVATEQYGSVSATMEGLDDMMLESEGE

SEQ ID NO: 145169 - protein, 36 aa, Artificial Sequence
  Description of Artificial Sequence: Synthetic polypeptide
DEEEIRTTNPVATEQYGSVSATMEGLDDLALESEVE

SEQ ID NO: 145170 - protein, 35 aa, Artificial Sequence
  Description of Artificial Sequence: Synthetic polypeptide
DEECIATTNPVAYEQWGVVCSTQNDLHDQNGQNHS

SEQ ID NO: 145171 - protein, 32 aa, Artificial Sequence
  Description of Artificial Sequence: Synthetic polypeptide
QESEIATTNPVATECYGEVSEIVEPQHEGENK

SEQ ID NO: 145172 - protein, 35 aa, Artificial Sequence
  Description of Artificial Sequence: Synthetic polypeptide
DEEEIRTTNPVATEQYGSVSMENDVHADEASDLEH

SEQ ID NO: 145173 - protein, 31 aa, Artificial Sequence
  Description of Artificial Sequence: Synthetic polypeptide
QESEIATTNPVATECYGEVSEIVEPQHEGEK

SEQ ID NO: 145174 - protein, 34 aa, Artificial Sequence
  Description of Artificial Sequence: Synthetic polypeptide
DTEAEIACTNPVAYEQYGSVATNLQGTPDGSDMN

SEQ ID NO: 145175 - protein, 38 aa, Artificial Sequence
  Description of Artificial Sequence: Synthetic polypeptide
AEEEIRTTNPVATEQYGVVSVVSTTNLQQGTTEAGSVI

SEQ ID NO: 145176 - protein, 30 aa, Artificial Sequence
  Description of Artificial Sequence: Synthetic polypeptide
DEECIATTNPVAYEQYSEEVTTGDNHNGGA

SEQ ID NO: 145177 - protein, 33 aa, Artificial Sequence
  Description of Artificial Sequence: Synthetic polypeptide
DEEEICTTNPVAYEQWGSVCPNDNHNNGHNGME

SEQ ID NO: 145178 - protein, 35 aa, Artificial Sequence
  Description of Artificial Sequence: Synthetic polypeptide
DEEEIRTTNPVATEQYGSFGDMNADQNGIGGMETE

SEQ ID NO: 145179 - protein, 37 aa, Artificial Sequence
  Description of Artificial Sequence: Synthetic polypeptide
AEEEIRTTNPVATEQYGSVSTVVNEGNNNDEGTNESD

SEQ ID NO: 145180 - protein, 34 aa, Artificial Sequence
  Description of Artificial Sequence: Synthetic polypeptide
DEEEICTTNPVAYEQWGSVCPNDNERNGHGNNNQ

SEQ ID NO: 145181 - protein, 37 aa, Artificial Sequence
  Description of Artificial Sequence: Synthetic polypeptide
AEEEIRTTNPVATEQYGVVSVTVTNGNQQGIGNNEDD

SEQ ID NO: 145182 - protein, 37 aa, Artificial Sequence
  Description of Artificial Sequence: Synthetic polypeptide
AEEEIRTTNPVATEQYGVVSVTVNLLNQQGTEETTED

SEQ ID NO: 145183 - protein, 29 aa, Artificial Sequence
  Description of Artificial Sequence: Synthetic peptide
MEEEIATTNPVAYEQYGEAPEVCQHESEK

SEQ ID NO: 145184 - protein, 34 aa, Artificial Sequence
  Description of Artificial Sequence: Synthetic polypeptide
DEEEICTTNPVAYEQWGSCVYSDEWNDGQRSDHD

SEQ ID NO: 145185 - protein, 36 aa, Artificial Sequence
  Description of Artificial Sequence: Synthetic polypeptide
AEEEIRTTNPVATEQYGVVSVTTTNDQQGSTDEQTQ

SEQ ID NO: 145186 - protein, 35 aa, Artificial Sequence
  Description of Artificial Sequence: Synthetic polypeptide
DEEEIRTTNPVATEQYGSFGDMNADQNGEFGMETD

SEQ ID NO: 145187 - protein, 35 aa, Artificial Sequence
  Description of Artificial Sequence: Synthetic polypeptide
DEEEIRTTNPVATEQYGSFGDMNADEFGIGGNNGG

SEQ ID NO: 145188 - protein, 37 aa, Artificial Sequence
  Description of Artificial Sequence: Synthetic polypeptide
AEEEIRTTNPVATEQYGVVSVTTNNLQQGTEGGTEGT

SEQ ID NO: 145189 - protein, 33 aa, Artificial Sequence
  Description of Artificial Sequence: Synthetic polypeptide
DEEEICTTNPVAYEQWGEVMWTEHDNRGGGGGR

SEQ ID NO: 145190 - protein, 36 aa, Artificial Sequence
  Description of Artificial Sequence: Synthetic polypeptide
DEEEIRTTNPVATEQYGSVSMENDDEQADEASDLEH

SEQ ID NO: 145191 - protein, 31 aa, Artificial Sequence
  Description of Artificial Sequence: Synthetic polypeptide
QESEIATTNPVATECYGEAPEINCQDREENK

SEQ ID NO: 145192 - protein, 32 aa, Artificial Sequence
  Description of Artificial Sequence: Synthetic polypeptide
QESEIATTNPVATECYGEVSCIVEPQHEGENG

SEQ ID NO: 145193 - protein, 36 aa, Artificial Sequence
  Description of Artificial Sequence: Synthetic polypeptide
DEEEIRTTNPVATEQYGSVSATMEGLDDEASELEDE

SEQ ID NO: 145194 - protein, 32 aa, Artificial Sequence
  Description of Artificial Sequence: Synthetic polypeptide
DEECIATTNPVAYEQYSEEVTTGDNHQGGGPN

SEQ ID NO: 145195 - protein, 34 aa, Artificial Sequence
  Description of Artificial Sequence: Synthetic polypeptide
DEEEICTTNPVAYEQWGEVATGGNQQDHQNGNQM

SEQ ID NO: 145196 - protein, 34 aa, Artificial Sequence
  Description of Artificial Sequence: Synthetic polypeptide
DEEEICTTNPVAYEQWGEVATGGNQQDAQGGNDM

SEQ ID NO: 145197 - protein, 32 aa, Artificial Sequence
  Description of Artificial Sequence: Synthetic polypeptide
DEECNATTNPIAYEQWGEVCHTNDQDHDGNNR

SEQ ID NO: 145198 - protein, 37 aa, Artificial Sequence
  Description of Artificial Sequence: Synthetic polypeptide
DEEEIRTTNPVATEQYGSCVVSITTVLDENGSESQEM

SEQ ID NO: 145199 - protein, 35 aa, Artificial Sequence
  Description of Artificial Sequence: Synthetic polypeptide
DEEEIRTTNPVATEQYGSCVVPPWPLENGSEQYEI

SEQ ID NO: 145200 - protein, 35 aa, Artificial Sequence
  Description of Artificial Sequence: Synthetic polypeptide
DSNEIRTTNPVATEQYGSVSPMDMTQMETMQITNG

SEQ ID NO: 145201 - protein, 36 aa, Artificial Sequence
  Description of Artificial Sequence: Synthetic polypeptide
DSNEIRTTNPVATEQYGSVCSTIMLEELHNGNEEVF

SEQ ID NO: 145202 - protein, 34 aa, Artificial Sequence
  Description of Artificial Sequence: Synthetic polypeptide
DSNEIRTTNPVATEQYGSLCSANENQMTDNSEQY

SEQ ID NO: 145203 - protein, 32 aa, Artificial Sequence
  Description of Artificial Sequence: Synthetic polypeptide
MEEEIRCTNPAATEQYGVVVSEGGMGGQGGEV

SEQ ID NO: 145204 - protein, 32 aa, Artificial Sequence
  Description of Artificial Sequence: Synthetic polypeptide
MEEEIRCTNPAATEQYGVVVSEGGMGGQNDQG

SEQ ID NO: 145205 - protein, 28 aa, Artificial Sequence
  Description of Artificial Sequence: Synthetic peptide
QESEIATTNPVATEGYGNAPEVCQHEQK

SEQ ID NO: 145206 - protein, 37 aa, Artificial Sequence
  Description of Artificial Sequence: Synthetic polypeptide
AEEEIRTTNPVATEQYGVVSTVVNNQQQNDEGTNNNE

SEQ ID NO: 145207 - protein, 35 aa, Artificial Sequence
  Description of Artificial Sequence: Synthetic polypeptide
DEEEICTTNPVAYEAYGTTVSCTNELPQNFPLERR

SEQ ID NO: 145208 - protein, 31 aa, Artificial Sequence
  Description of Artificial Sequence: Synthetic polypeptide
DSNEIRTTNPVATEQWGDVSEIEMNAAEDRA

SEQ ID NO: 145209 - protein, 30 aa, Artificial Sequence
  Description of Artificial Sequence: Synthetic polypeptide
DSNEIRTTNPVATEQWGDVSEIEMNAAEDA

SEQ ID NO: 145210 - protein, 36 aa, Artificial Sequence
  Description of Artificial Sequence: Synthetic polypeptide
MEEEIRGTNPVATEQWGSSVPTNGGQLIRGGGNDGQ

SEQ ID NO: 145211 - protein, 33 aa, Artificial Sequence
  Description of Artificial Sequence: Synthetic polypeptide
DSMEIVTTNPVATEQYGTVCSATDGPVEFEGND

SEQ ID NO: 145212 - protein, 33 aa, Artificial Sequence
  Description of Artificial Sequence: Synthetic polypeptide
DEECNATTNPIAYEQWGEVCSTDNDDQHHDGNR

SEQ ID NO: 145213 - protein, 34 aa, Artificial Sequence
  Description of Artificial Sequence: Synthetic polypeptide
DSHNIRTTNPVATEQWGSCSCTNEISQIGGNNPF

SEQ ID NO: 145214 - protein, 33 aa, Artificial Sequence
  Description of Artificial Sequence: Synthetic polypeptide
DSHEIRTTNPVAYEAYGSVVSQPISFPVGNNRY

SEQ ID NO: 145215 - protein, 28 aa, Artificial Sequence
  Description of Artificial Sequence: Synthetic peptide
QESEIATTNPVATEGYGVMAETCQHEEK

SEQ ID NO: 145216 - protein, 28 aa, Artificial Sequence
  Description of Artificial Sequence: Synthetic peptide
QESEIATTNPVATEGYGEMAETCQHEEK

SEQ ID NO: 145217 - protein, 34 aa, Artificial Sequence
  Description of Artificial Sequence: Synthetic polypeptide
MEEEIRCTNPAATEQYGSVVSENAGMEGGGENGE

SEQ ID NO: 145218 - protein, 35 aa, Artificial Sequence
  Description of Artificial Sequence: Synthetic polypeptide
DSNEIRTTNPVATEQYGSVSPYNALNFPQLEDDSM

SEQ ID NO: 145219 - protein, 36 aa, Artificial Sequence
  Description of Artificial Sequence: Synthetic polypeptide
DEEEIRTTNPVATEQYGSVSAPTQGAEATVDQEVEP

SEQ ID NO: 145220 - protein, 36 aa, Artificial Sequence
  Description of Artificial Sequence: Synthetic polypeptide
DEEEIRATNPVATEQYGSVCAATEPGLATDPGGERH

SEQ ID NO: 145221 - protein, 38 aa, Artificial Sequence
  Description of Artificial Sequence: Synthetic polypeptide
AEEEIRTTNPVATEQYGVVSVSVTTNQLAGTEGGNNQE

SEQ ID NO: 145222 - protein, 32 aa, Artificial Sequence
  Description of Artificial Sequence: Synthetic polypeptide
DSSEIGTTNPVSYEQYGISVPQTNFSTRVTNS

SEQ ID NO: 145223 - protein, 38 aa, Artificial Sequence
  Description of Artificial Sequence: Synthetic polypeptide
AEEEIRTTNPVATEQYGVVSVSVSTNQLAGSEGGNNQN

SEQ ID NO: 145224 - protein, 37 aa, Artificial Sequence
  Description of Artificial Sequence: Synthetic polypeptide
AEEEIRTTNPVATEQYGVVSTVVVTNQTQEQGTNQDE

SEQ ID NO: 145225 - protein, 37 aa, Artificial Sequence
  Description of Artificial Sequence: Synthetic polypeptide
AEEEIRTTNPVATEQYGVVSTVVTNQQQNDEGGNQNE

SEQ ID NO: 145226 - protein, 37 aa, Artificial Sequence
  Description of Artificial Sequence: Synthetic polypeptide
AEEEIRTTNPVATEQYGVVSTVVTDGGNLNNLGGNDD

SEQ ID NO: 145227 - protein, 37 aa, Artificial Sequence
  Description of Artificial Sequence: Synthetic polypeptide
AEEEIRTTNPVATEQYGVVSTVVSNSNQQGNGNNEQD

SEQ ID NO: 145228 - protein, 37 aa, Artificial Sequence
  Description of Artificial Sequence: Synthetic polypeptide
AEEEIRTTNPVATEQYGVVSTVVSNNNQQGIGNNQTD

SEQ ID NO: 145229 - protein, 34 aa, Artificial Sequence
  Description of Artificial Sequence: Synthetic polypeptide
DEEEICTTNPVAYENWGQSVSCEENELQVPSGQE

SEQ ID NO: 145230 - protein, 35 aa, Artificial Sequence
  Description of Artificial Sequence: Synthetic polypeptide
DEEEICTTNPVAYECWGSVATTNNLQGNAGENDGM

SEQ ID NO: 145231 - protein, 37 aa, Artificial Sequence
  Description of Artificial Sequence: Synthetic polypeptide
AEEEIRTTNPVATEQYGVVSTVVNQNQQQGVTNQEDE

SEQ ID NO: 145232 - protein, 37 aa, Artificial Sequence
  Description of Artificial Sequence: Synthetic polypeptide
AEEEIRTTNPVATEQYGVVSTVVNQGNNQDEGTNNDD

SEQ ID NO: 145233 - protein, 35 aa, Artificial Sequence
  Description of Artificial Sequence: Synthetic polypeptide
MEEEIRATNPVATEQYGSVSDLNNMDNGGEGGENG

SEQ ID NO: 145234 - protein, 29 aa, Artificial Sequence
  Description of Artificial Sequence: Synthetic peptide
QESEIATTNPVATEGYGEAAEVIQHVGEK

SEQ ID NO: 145235 - protein, 32 aa, Artificial Sequence
  Description of Artificial Sequence: Synthetic polypeptide
DSNEIRTTNPVSTEPYGTISMTDIQQQQNGNH

SEQ ID NO: 145236 - protein, 28 aa, Artificial Sequence
  Description of Artificial Sequence: Synthetic peptide
QESEIATTNPVATEGYGEAPEVCQHEEK

SEQ ID NO: 145237 - protein, 37 aa, Artificial Sequence
  Description of Artificial Sequence: Synthetic polypeptide
AEEEIRTTNPVATEQYGVVSTVVNNSNQQGNGNNQQD

SEQ ID NO: 145238 - protein, 32 aa, Artificial Sequence
  Description of Artificial Sequence: Synthetic polypeptide
DEECIATTNPVAYEQWGSYISLDNDDQRKVDT

SEQ ID NO: 145239 - protein, 34 aa, Artificial Sequence
  Description of Artificial Sequence: Synthetic polypeptide
DEECIATTNPVAYEQWGESYSVDNEMQPGDNRRN

SEQ ID NO: 145240 - protein, 36 aa, Artificial Sequence
  Description of Artificial Sequence: Synthetic polypeptide
DEEEIRTTNPVATEQYGSVSATPDSIIQGTISVEEW

SEQ ID NO: 145241 - protein, 34 aa, Artificial Sequence
  Description of Artificial Sequence: Synthetic polypeptide
DEEEICTTNPVAYEQWGSVCSNDNHQNNDHNNEP

SEQ ID NO: 145242 - protein, 31 aa, Artificial Sequence
  Description of Artificial Sequence: Synthetic polypeptide
DEECIATVNPVATEGYGCVCSWNHENFGSEQ

SEQ ID NO: 145243 - protein, 28 aa, Artificial Sequence
  Description of Artificial Sequence: Synthetic peptide
QESEIASTNPVGWEGYGVMASTLQYGDI

SEQ ID NO: 145244 - protein, 34 aa, Artificial Sequence
  Description of Artificial Sequence: Synthetic polypeptide
DEECIATVNPVATECYGSVVCIDQNDERQGTNER

SEQ ID NO: 145245 - protein, 34 aa, Artificial Sequence
  Description of Artificial Sequence: Synthetic polypeptide
DEECIATVNPVATECYGSVVCIDNQDENRDGNER

SEQ ID NO: 145246 - protein, 35 aa, Artificial Sequence
  Description of Artificial Sequence: Synthetic polypeptide
DEECIATVNPVATECYGSVVCIDNNDQERQGMNDR

SEQ ID NO: 145247 - protein, 28 aa, Artificial Sequence
  Description of Artificial Sequence: Synthetic peptide
QESEIASTNPVGYEGYGKMASTLQHGDI

SEQ ID NO: 145248 - protein, 28 aa, Artificial Sequence
  Description of Artificial Sequence: Synthetic peptide
QESEIASTNPVGYEGYGVAYSTLQHGDA

SEQ ID NO: 145249 - protein, 28 aa, Artificial Sequence
  Description of Artificial Sequence: Synthetic peptide
QESEIASTNPVGYEGYGVMASTLQHGDI

SEQ ID NO: 145250 - protein, 28 aa, Artificial Sequence
  Description of Artificial Sequence: Synthetic peptide
QESEIASTNPVGWEGYGVMASTLQPGDI

SEQ ID NO: 145251 - protein, 29 aa, Artificial Sequence
  Description of Artificial Sequence: Synthetic peptide
QESEIASTNPVGYTEGYGVMASTLQHGDI

SEQ ID NO: 145252 - protein, 30 aa, Artificial Sequence
  Description of Artificial Sequence: Synthetic polypeptide
QESEIASTNPVSSEGYGIVAANTLQSVGQR

SEQ ID NO: 145253 - protein, 35 aa, Artificial Sequence
  Description of Artificial Sequence: Synthetic polypeptide
MEDEIRTTNPVATEQYGSVMGQNLGMGEANDNGGQ

SEQ ID NO: 145254 - protein, 37 aa, Artificial Sequence
  Description of Artificial Sequence: Synthetic polypeptide
AEEEIRTTNPVATEQYGVVTVVVTNLQQGNEGEENEL

SEQ ID NO: 145255 - protein, 30 aa, Artificial Sequence
  Description of Artificial Sequence: Synthetic polypeptide
QENEIATTNPVATECYGTVLEVEGLQSEEL

SEQ ID NO: 145256 - protein, 37 aa, Artificial Sequence
  Description of Artificial Sequence: Synthetic polypeptide
AEEEIRTTNPVATEQYGVVTVVTTNLQQGNTGEENEL

SEQ ID NO: 145257 - protein, 37 aa, Artificial Sequence
  Description of Artificial Sequence: Synthetic polypeptide
DEEEIRTTNPVATEQYGSFSSTTPAHGPNMRNGMNPV

SEQ ID NO: 145258 - protein, 30 aa, Artificial Sequence
  Description of Artificial Sequence: Synthetic polypeptide
QESEIASTNPVSTEGYGIVACTIQSRVGQR

SEQ ID NO: 145259 - protein, 31 aa, Artificial Sequence
  Description of Artificial Sequence: Synthetic polypeptide
QENEIATTNPVATECYGTVCSAEDGLEFEND

SEQ ID NO: 145260 - protein, 29 aa, Artificial Sequence
  Description of Artificial Sequence: Synthetic peptide
QESEIASTNPVGYTEGYGVMSSTLQHGDI

SEQ ID NO: 145261 - protein, 28 aa, Artificial Sequence
  Description of Artificial Sequence: Synthetic peptide
QESEIASTNPVGWEGYGVMASTLQHGDI

SEQ ID NO: 145262 - protein, 29 aa, Artificial Sequence
  Description of Artificial Sequence: Synthetic peptide
QESEIASTNPVGWEGYGCVMASTLQHGDI

SEQ ID NO: 145263 - protein, 29 aa, Artificial Sequence
  Description of Artificial Sequence: Synthetic peptide
QESEIASTNPVGTYGYGVMASTLQHGDRI

SEQ ID NO: 145264 - protein, 28 aa, Artificial Sequence
  Description of Artificial Sequence: Synthetic peptide
QESEIASTNPVGTEYYGVMASMLQHGDI

SEQ ID NO: 145265 - protein, 29 aa, Artificial Sequence
  Description of Artificial Sequence: Synthetic peptide
QESEIASTNPVGTEYYGVMASTLIQHGDI

SEQ ID NO: 145266 - protein, 37 aa, Artificial Sequence
  Description of Artificial Sequence: Synthetic polypeptide
DTEEIRATNPVATEQYGSVSTNNTNNNNQQQGTNNNE

SEQ ID NO: 145267 - protein, 38 aa, Artificial Sequence
  Description of Artificial Sequence: Synthetic polypeptide
DTEEIRATNPVATEQYGSVSTNLNQLQNQNQQGTNNNE

SEQ ID NO: 145268 - protein, 38 aa, Artificial Sequence
  Description of Artificial Sequence: Synthetic polypeptide
DTEEIRATNPVATEQYGSVSTNLNNNNNQEQIGTNNNE

SEQ ID NO: 145269 - protein, 33 aa, Artificial Sequence
  Description of Artificial Sequence: Synthetic polypeptide
DEECIQTTNPVAYEQYGCKVNITMGSDRPGGNA

SEQ ID NO: 145270 - protein, 33 aa, Artificial Sequence
  Description of Artificial Sequence: Synthetic polypeptide
DEECIQTTNPVAYEQYGCHVNINMGSDRPEGNA

SEQ ID NO: 145271 - protein, 29 aa, Artificial Sequence
  Description of Artificial Sequence: Synthetic peptide
QESEIASTNPVGTEYYGVMASTLQHGYDI

SEQ ID NO: 145272 - protein, 28 aa, Artificial Sequence
  Description of Artificial Sequence: Synthetic peptide
QESEIASTNPVGTEYYGVMASTLQHIDI

SEQ ID NO: 145273 - protein, 28 aa, Artificial Sequence
  Description of Artificial Sequence: Synthetic peptide
QESEIASTNPVGTFGYGVMASTLQHGDI

SEQ ID NO: 145274 - protein, 28 aa, Artificial Sequence
  Description of Artificial Sequence: Synthetic peptide
QESEIASTNPVGTHGYGVMASTLQHGDI

SEQ ID NO: 145275 - protein, 36 aa, Artificial Sequence
  Description of Artificial Sequence: Synthetic polypeptide
DEECINTTNPVAYEHYGQSTVAVTNELAQRSGPTRG

SEQ ID NO: 145276 - protein, 28 aa, Artificial Sequence
  Description of Artificial Sequence: Synthetic peptide
QESEIASTNPVGTIGYGVMASTLQHGDI

SEQ ID NO: 145277 - protein, 28 aa, Artificial Sequence
  Description of Artificial Sequence: Synthetic peptide
QESEIASTNPVGTQGYGVMASTLQHGDG

SEQ ID NO: 145278 - protein, 28 aa, Artificial Sequence
  Description of Artificial Sequence: Synthetic peptide
QESEIASTNPVGTQGYGVMASTLQHGDI

SEQ ID NO: 145279 - protein, 28 aa, Artificial Sequence
  Description of Artificial Sequence: Synthetic peptide
QESEIASTNPVGTSGYGVMASTLQHGDI

SEQ ID NO: 145280 - protein, 28 aa, Artificial Sequence
  Description of Artificial Sequence: Synthetic peptide
QESEIASTNPVGTTGYGVMASTLQHGDI

SEQ ID NO: 145281 - protein, 28 aa, Artificial Sequence
  Description of Artificial Sequence: Synthetic peptide
QESEIASTNPVGTVGYGVMASTLQHGDI

SEQ ID NO: 145282 - protein, 28 aa, Artificial Sequence
  Description of Artificial Sequence: Synthetic peptide
QESEIASTNPVGTYGYGVMASTLQHGDI

SEQ ID NO: 145283 - protein, 34 aa, Artificial Sequence
  Description of Artificial Sequence: Synthetic polypeptide
DEECLRTTNPCAYEQYGCVCSTGNDQYFGSDNQS

SEQ ID NO: 145284 - protein, 30 aa, Artificial Sequence
  Description of Artificial Sequence: Synthetic polypeptide
MEEEIATTNPVATEQYGEAPPEVEQHSEQQ

SEQ ID NO: 145285 - protein, 34 aa, Artificial Sequence
  Description of Artificial Sequence: Synthetic polypeptide
DEECIATVNPVATECYGSVVCIDNDNERSGGNER

SEQ ID NO: 145286 - protein, 33 aa, Artificial Sequence
  Description of Artificial Sequence: Synthetic polypeptide
DEECIATVNPVATECYGSVVCIDNDHERGHNGS

SEQ ID NO: 145287 - protein, 35 aa, Artificial Sequence
  Description of Artificial Sequence: Synthetic polypeptide
DEECIATVNPVATEAYGSTVPSCDNPSERGGNNRW

SEQ ID NO: 145288 - protein, 36 aa, Artificial Sequence
  Description of Artificial Sequence: Synthetic polypeptide
AEEEIRTTNPVATEQYGVVSVVVNNNDEQSEGTNAE

SEQ ID NO: 145289 - protein, 31 aa, Artificial Sequence
  Description of Artificial Sequence: Synthetic polypeptide
MEEEIATTNPVATEQYGCAPAMHGQDSEGED

SEQ ID NO: 145290 - protein, 28 aa, Artificial Sequence
  Description of Artificial Sequence: Synthetic peptide
QESEIASVNPVGTEGYGVMASTLQHGDI

SEQ ID NO: 145291 - protein, 28 aa, Artificial Sequence
  Description of Artificial Sequence: Synthetic peptide
QESEIASVNPVGTEGYGVMASTLQHGDK

SEQ ID NO: 145292 - protein, 33 aa, Artificial Sequence
  Description of Artificial Sequence: Synthetic polypeptide
DEECIATTNPVAYERYGEVSTGNQGNTGGDDER

SEQ ID NO: 145293 - protein, 28 aa, Artificial Sequence
  Description of Artificial Sequence: Synthetic peptide
QESEIASVNPVGTEGYGVMASTLQHGDQ

SEQ ID NO: 145294 - protein, 33 aa, Artificial Sequence
  Description of Artificial Sequence: Synthetic polypeptide
DEECIATTNPVAYEQYSEEVTTTGDNHQGNNAR

SEQ ID NO: 145295 - protein, 34 aa, Artificial Sequence
  Description of Artificial Sequence: Synthetic polypeptide
DEECIATVNPVATEAYGSVPNCDNVSERGGNNRR

SEQ ID NO: 145296 - protein, 36 aa, Artificial Sequence
  Description of Artificial Sequence: Synthetic polypeptide
AEEEIRTTNPVATEQYGSVSTVVNQQGQTEATEDED

SEQ ID NO: 145297 - protein, 31 aa, Artificial Sequence
  Description of Artificial Sequence: Synthetic polypeptide
QESEIATTNPCASECWGSVSCNEPQDSGETR

SEQ ID NO: 145298 - protein, 32 aa, Artificial Sequence
  Description of Artificial Sequence: Synthetic polypeptide
DEECIATTNPVAYEQYSEEVTTTGDNHNGNSR

SEQ ID NO: 145299 - protein, 34 aa, Artificial Sequence
  Description of Artificial Sequence: Synthetic polypeptide
DEEEICTTNPVAYEQWGVVATGINQNDHQGGNTA

SEQ ID NO: 145300 - protein, 34 aa, Artificial Sequence
  Description of Artificial Sequence: Synthetic polypeptide
MEEEIATTNPVATEQYGCVCSVTGEHQGFNSDQA

SEQ ID NO: 145301 - protein, 31 aa, Artificial Sequence
  Description of Artificial Sequence: Synthetic polypeptide
QESEIATTNPCSSEQWGSVSCNEPQSEGETR

SEQ ID NO: 145302 - protein, 28 aa, Artificial Sequence
  Description of Artificial Sequence: Synthetic peptide
QESEIATTNPIATECWGVMASDLQHGDI

SEQ ID NO: 145303 - protein, 38 aa, Artificial Sequence
  Description of Artificial Sequence: Synthetic polypeptide
AEEEIRTTNPVATEQYGVVSVVSVTNQQQGTNGNNNQD

SEQ ID NO: 145304 - protein, 38 aa, Artificial Sequence
  Description of Artificial Sequence: Synthetic polypeptide
AEEEIRTTNPVATEQYGVVSVVSVTNQQQGTNATNAQD

SEQ ID NO: 145305 - protein, 33 aa, Artificial Sequence
  Description of Artificial Sequence: Synthetic polypeptide
DEECIATTNPVAYEQYSEEVTTTGDNHQGGGAR

SEQ ID NO: 145306 - protein, 35 aa, Artificial Sequence
  Description of Artificial Sequence: Synthetic polypeptide
DEECIATVNPVATEAYGSVPSCDNEPSERVGNERR

SEQ ID NO: 145307 - protein, 32 aa, Artificial Sequence
  Description of Artificial Sequence: Synthetic polypeptide
QENEIATTNPVATECYGSVSEPAGNMHNEMNL

SEQ ID NO: 145308 - protein, 28 aa, Artificial Sequence
  Description of Artificial Sequence: Synthetic peptide
QESEIASTNPVSYEGYGVMASTLQHGDI

SEQ ID NO: 145309 - protein, 33 aa, Artificial Sequence
  Description of Artificial Sequence: Synthetic polypeptide
QENEIATTNPVATECYGTTVVSEPLSQHEGENL

SEQ ID NO: 145310 - protein, 29 aa, Artificial Sequence
  Description of Artificial Sequence: Synthetic peptide
QESEIASTNPVSTEGYGTMASTLQHNGDI

SEQ ID NO: 145311 - protein, 29 aa, Artificial Sequence
  Description of Artificial Sequence: Synthetic peptide
QESEIASTNPVSTEGYGTMASTLQQHGDI

SEQ ID NO: 145312 - protein, 29 aa, Artificial Sequence
  Description of Artificial Sequence: Synthetic peptide
QESEIASTNPVSTEGYGVIASTLQQHGDI

SEQ ID NO: 145313 - protein, 29 aa, Artificial Sequence
  Description of Artificial Sequence: Synthetic peptide
QESEIASTNPVSTEGYGVMAASTLQHGDI

SEQ ID NO: 145314 - protein, 28 aa, Artificial Sequence
  Description of Artificial Sequence: Synthetic peptide
QESEIASTNPVSTEGYGVMACTLQHGDI

SEQ ID NO: 145315 - protein, 29 aa, Artificial Sequence
  Description of Artificial Sequence: Synthetic peptide
QESEIASTNPVSTEGYGVMASETLQHGDI

SEQ ID NO: 145316 - protein, 29 aa, Artificial Sequence
  Description of Artificial Sequence: Synthetic peptide
QESEIASTNPVSTEGYGVMASTLQHNGDH

SEQ ID NO: 145317 - protein, 29 aa, Artificial Sequence
  Description of Artificial Sequence: Synthetic peptide
QESEIASTNPVSTEGYGVMASTLQHPGDI

SEQ ID NO: 145318 - protein, 29 aa, Artificial Sequence
  Description of Artificial Sequence: Synthetic peptide
QESEIASTNPVSTEGYGVMASTLQQHGDI

SEQ ID NO: 145319 - protein, 36 aa, Artificial Sequence
  Description of Artificial Sequence: Synthetic polypeptide
DEEEIRTTNPVATEQYGSFSDTPTNTHGLTIEPEEE

SEQ ID NO: 145320 - protein, 35 aa, Artificial Sequence
  Description of Artificial Sequence: Synthetic polypeptide
DEEEIRTTNPVATEQYGSTVCWPLEDATTGGEMHI

SEQ ID NO: 145321 - protein, 36 aa, Artificial Sequence
  Description of Artificial Sequence: Synthetic polypeptide
DEEEIRTTNPVATEQYGSFSDTLTNHHGLTPEVEEQ

SEQ ID NO: 145322 - protein, 34 aa, Artificial Sequence
  Description of Artificial Sequence: Synthetic polypeptide
DTEEIAATNPVAYEQYGISVVPATDNMLTGGGNT

SEQ ID NO: 145323 - protein, 29 aa, Artificial Sequence
  Description of Artificial Sequence: Synthetic peptide
QESEIASTNPVSTEGYWGVMASTLQHGDI

SEQ ID NO: 145324 - protein, 37 aa, Artificial Sequence
  Description of Artificial Sequence: Synthetic polypeptide
DEEEIRTTNPVATEQYGSFSDTATNTHGLTIEQEEEV

SEQ ID NO: 145325 - protein, 37 aa, Artificial Sequence
  Description of Artificial Sequence: Synthetic polypeptide
DEEEIRTTNPVATEQYGSFSCTCTNTHGLTPEQEEEG

SEQ ID NO: 145326 - protein, 35 aa, Artificial Sequence
  Description of Artificial Sequence: Synthetic polypeptide
DEECIATVNPVATEAYGSVPSCDNEPSPRAGNNRR

SEQ ID NO: 145327 - protein, 29 aa, Artificial Sequence
  Description of Artificial Sequence: Synthetic peptide
QESEIASTNPVSTEQYGNVPNVIQSREQK

SEQ ID NO: 145328 - protein, 35 aa, Artificial Sequence
  Description of Artificial Sequence: Synthetic polypeptide
DEEEIRTTNPVATEQYGSFSNACGGEETEIAFVNE

SEQ ID NO: 145329 - protein, 33 aa, Artificial Sequence
  Description of Artificial Sequence: Synthetic polypeptide
DSHEIRSTNPVAYEQWGSIACTNHQERTGGNND

SEQ ID NO: 145330 - protein, 36 aa, Artificial Sequence
  Description of Artificial Sequence: Synthetic polypeptide
MEEEIRGTNPVATEQYGSVNSVTGSGQAEGEGNEGE

SEQ ID NO: 145331 - protein, 36 aa, Artificial Sequence
  Description of Artificial Sequence: Synthetic polypeptide
DSGEIRTTNPVAYEQYGSTVCSYTEMLSQTEGGTRL

SEQ ID NO: 145332 - protein, 30 aa, Artificial Sequence
  Description of Artificial Sequence: Synthetic polypeptide
QENEIATTNPVATECYGEAVEVVLQHQEEL

SEQ ID NO: 145333 - protein, 37 aa, Artificial Sequence
  Description of Artificial Sequence: Synthetic polypeptide
MEEEIRTTNPVATEQYGSIVNGTESLDDQLGSNDGQI

SEQ ID NO: 145334 - protein, 38 aa, Artificial Sequence
  Description of Artificial Sequence: Synthetic polypeptide
AEEEIRTTNPVATEQYGVVSTVTNQQLGNQQNGNNEGD

SEQ ID NO: 145335 - protein, 36 aa, Artificial Sequence
  Description of Artificial Sequence: Synthetic polypeptide
MEEEIRTTNPVATEQYGSVADNDDDQEQGGNGNIQG

SEQ ID NO: 145336 - protein, 37 aa, Artificial Sequence
  Description of Artificial Sequence: Synthetic polypeptide
AEEEIRTTNPVATEQYGVVSTVTNQQGNNQQGTNANM

SEQ ID NO: 145337 - protein, 34 aa, Artificial Sequence
  Description of Artificial Sequence: Synthetic polypeptide
DEEEIRTTNPVATEQYGSCTPHGTNHPSIEEEGQ

SEQ ID NO: 145338 - protein, 30 aa, Artificial Sequence
  Description of Artificial Sequence: Synthetic polypeptide
QESEIATTNPVGTEGYGVMASTLQQHNGDI

SEQ ID NO: 145339 - protein, 30 aa, Artificial Sequence
  Description of Artificial Sequence: Synthetic polypeptide
QESEIATTNPVGTEGYGVMATSPTLQHGDV

SEQ ID NO: 145340 - protein, 37 aa, Artificial Sequence
  Description of Artificial Sequence: Synthetic polypeptide
AEEEIRTTNPVATEQYGVVSTVTNQQQNQQGNGNNQD

SEQ ID NO: 145341 - protein, 37 aa, Artificial Sequence
  Description of Artificial Sequence: Synthetic polypeptide
DEEEIRTTNPVATEQYGSVSMVMEMLQEQDQETNIVT

SEQ ID NO: 145342 - protein, 31 aa, Artificial Sequence
  Description of Artificial Sequence: Synthetic polypeptide
QESEIATTNPVGTEGYGVMATSPTLQHNGNV

SEQ ID NO: 145343 - protein, 30 aa, Artificial Sequence
  Description of Artificial Sequence: Synthetic polypeptide
QESEIATTNPVGTEGYGVMCASDTLQHGDD

SEQ ID NO: 145344 - protein, 37 aa, Artificial Sequence
  Description of Artificial Sequence: Synthetic polypeptide
AEEEIRTTNPVATEQYGVVSTVTNQANQAGNNNNQQD

SEQ ID NO: 145345 - protein, 37 aa, Artificial Sequence
  Description of Artificial Sequence: Synthetic polypeptide
AEEEIRTTNPVATEQYGVVSTVTNNTNQQQIGTNTET

SEQ ID NO: 145346 - protein, 30 aa, Artificial Sequence
  Description of Artificial Sequence: Synthetic polypeptide
QESEIATTNPVGTEGYGVMSSTLQQHNGDI

SEQ ID NO: 145347 - protein, 29 aa, Artificial Sequence
  Description of Artificial Sequence: Synthetic peptide
QESEIATTNPVGTEGYGVTWAATLQHGDI

SEQ ID NO: 145348 - protein, 37 aa, Artificial Sequence
  Description of Artificial Sequence: Synthetic polypeptide
AEEEIRTTNPVATEQYGVVSTVTNNSNQQGNGNNNEE

SEQ ID NO: 145349 - protein, 37 aa, Artificial Sequence
  Description of Artificial Sequence: Synthetic polypeptide
AEEEIRTTNPVATEQYGVVSTVTNNSNQAGNNNNEQD

SEQ ID NO: 145350 - protein, 32 aa, Artificial Sequence
  Description of Artificial Sequence: Synthetic polypeptide
DEEAISTTNPVAYEEWGQCTTGGDHQRGSNER

SEQ ID NO: 145351 - protein, 32 aa, Artificial Sequence
  Description of Artificial Sequence: Synthetic polypeptide
AENEIACTNPVATEQYGCACSWNLQNFGSQQG

SEQ ID NO: 145352 - protein, 31 aa, Artificial Sequence
  Description of Artificial Sequence: Synthetic polypeptide
AENEIACTNPVATEQYGCACSWALQNFGSDQ

SEQ ID NO: 145353 - protein, 36 aa, Artificial Sequence
  Description of Artificial Sequence: Synthetic polypeptide
DEEAITTTNPVATEQYGSVSSTTPAGPNMRNGMNPV

SEQ ID NO: 145354 - protein, 30 aa, Artificial Sequence
  Description of Artificial Sequence: Synthetic polypeptide
QESEIATTNPVGTEGYGTMSSTLVQFEGDD

SEQ ID NO: 145355 - protein, 30 aa, Artificial Sequence
  Description of Artificial Sequence: Synthetic polypeptide
QESEIATTNPVGTEGYGTMSSTLVQHEGDD

SEQ ID NO: 145356 - protein, 35 aa, Artificial Sequence
  Description of Artificial Sequence: Synthetic polypeptide
DEECIACTNPVATEQYGSVSWNEGEQERQRHGGTA

SEQ ID NO: 145357 - protein, 30 aa, Artificial Sequence
  Description of Artificial Sequence: Synthetic polypeptide
QESEIATTNPVGTEGYGTVSSTLVEFEGDD

SEQ ID NO: 145358 - protein, 36 aa, Artificial Sequence
  Description of Artificial Sequence: Synthetic polypeptide
MEEEIRTTNPVATEQYGMVGSVTGIGNQNNEGGGNN

SEQ ID NO: 145359 - protein, 34 aa, Artificial Sequence
  Description of Artificial Sequence: Synthetic polypeptide
DEECIAATNPVAYEQYGVSVVATMNMLSTGGGNT

SEQ ID NO: 145360 - protein, 34 aa, Artificial Sequence
  Description of Artificial Sequence: Synthetic polypeptide
DSEEIRTTNPVGTEQWGQCVCSTGNHQNFGSVQA

SEQ ID NO: 145361 - protein, 34 aa, Artificial Sequence
  Description of Artificial Sequence: Synthetic polypeptide
DSEEIRTTNPVGTEQWGQCVCSTEHNQRFGSVQA

SEQ ID NO: 145362 - protein, 34 aa, Artificial Sequence
  Description of Artificial Sequence: Synthetic polypeptide
MEEEIRTTNPVATEQYGMVTTTGGQGEGDGEDGI

SEQ ID NO: 145363 - protein, 33 aa, Artificial Sequence
  Description of Artificial Sequence: Synthetic polypeptide
DEECIAATNPVAYEQYGISVVATMNMLTGGGET

SEQ ID NO: 145364 - protein, 35 aa, Artificial Sequence
  Description of Artificial Sequence: Synthetic polypeptide
MEEEIRTTNPVATEQYGNVVDTMNGGQGGQEEGQT

SEQ ID NO: 145365 - protein, 35 aa, Artificial Sequence
  Description of Artificial Sequence: Synthetic polypeptide
MEEEIRTTNPVATEQYGQCVCSTMEHQENFGSDQS

SEQ ID NO: 145366 - protein, 34 aa, Artificial Sequence
  Description of Artificial Sequence: Synthetic polypeptide
DEEASRTTNPVATEQYGEVVSWGNLGNRIDIEPA

SEQ ID NO: 145367 - protein, 29 aa, Artificial Sequence
  Description of Artificial Sequence: Synthetic peptide
QESEIATTNPVGTEGYGVIAMTLQQQGDI

SEQ ID NO: 145368 - protein, 36 aa, Artificial Sequence
  Description of Artificial Sequence: Synthetic polypeptide
MEEEIRTTNPVATEQYGSASSTTPAGPNMRNGMNPV

SEQ ID NO: 145369 - protein, 34 aa, Artificial Sequence
  Description of Artificial Sequence: Synthetic polypeptide
MEEEIRTTNPVATEQYGSAYLMNQLEEANLPEES

SEQ ID NO: 145370 - protein, 29 aa, Artificial Sequence
  Description of Artificial Sequence: Synthetic peptide
QESEIATTNPVGTEGYGVMAMTLQQNGDH

SEQ ID NO: 145371 - protein, 29 aa, Artificial Sequence
  Description of Artificial Sequence: Synthetic peptide
QESEIATTNPVGTEGYGVMASDLQDHGDI

SEQ ID NO: 145372 - protein, 29 aa, Artificial Sequence
  Description of Artificial Sequence: Synthetic peptide
QESEIATTNPVGTEGYGVMASDLQEPGDI

SEQ ID NO: 145373 - protein, 30 aa, Artificial Sequence
  Description of Artificial Sequence: Synthetic polypeptide
QESEIATTNPVGTEPYGVMAMETLQQNGNH

SEQ ID NO: 145374 - protein, 34 aa, Artificial Sequence
  Description of Artificial Sequence: Synthetic polypeptide
DEECIACTNPVAYEQYGSVVSMNEFSTQRGGLLM

SEQ ID NO: 145375 - protein, 37 aa, Artificial Sequence
  Description of Artificial Sequence: Synthetic polypeptide
AEEEIRTTNPVATEQYGVVSTVTNNQQQNDEGSTNNE

SEQ ID NO: 145376 - protein, 28 aa, Artificial Sequence
  Description of Artificial Sequence: Synthetic peptide
QESEIATTNPVGTEQYGEAASVCQHEDI

SEQ ID NO: 145377 - protein, 28 aa, Artificial Sequence
  Description of Artificial Sequence: Synthetic peptide
QESEIATTNPVSTEQYGEAAETIQHEQK

SEQ ID NO: 145378 - protein, 29 aa, Artificial Sequence
  Description of Artificial Sequence: Synthetic peptide
QESEIATTNPVSTEQYGEAPEVCQHVEER

SEQ ID NO: 145379 - protein, 36 aa, Artificial Sequence
  Description of Artificial Sequence: Synthetic polypeptide
DEEEIRTTNPVATEQYGSVSALNVDNGQIHQEEELM

SEQ ID NO: 145380 - protein, 28 aa, Artificial Sequence
  Description of Artificial Sequence: Synthetic peptide
QENEIATTNPVATECYGEAPECCQHEEK

SEQ ID NO: 145381 - protein, 28 aa, Artificial Sequence
  Description of Artificial Sequence: Synthetic peptide
QESEIATTNPVSTEQYGNAAETIQHEQK

SEQ ID NO: 145382 - protein, 36 aa, Artificial Sequence
  Description of Artificial Sequence: Synthetic polypeptide
DEEEIRTTNPVATEQYGSVSALNVDNGMIFQEEMLD

SEQ ID NO: 145383 - protein, 37 aa, Artificial Sequence
  Description of Artificial Sequence: Synthetic polypeptide
AEEEIRTTNPVATEQYGVVSTVTNNQQGNDEGNNNNE

SEQ ID NO: 145384 - protein, 36 aa, Artificial Sequence
  Description of Artificial Sequence: Synthetic polypeptide
MEEEIRTTNPVATEQYGSVIDDTDTNMTGTGGNGGT

SEQ ID NO: 145385 - protein, 34 aa, Artificial Sequence
  Description of Artificial Sequence: Synthetic polypeptide
DSEEIRTTNPVAYQQYGSTVNTTGNGSQYSSNNE

SEQ ID NO: 145386 - protein, 28 aa, Artificial Sequence
  Description of Artificial Sequence: Synthetic peptide
QESEICSTNPVSTEIYGVTASTEQIGTI

SEQ ID NO: 145387 - protein, 29 aa, Artificial Sequence
  Description of Artificial Sequence: Synthetic peptide
QESEIGSTNPVGTEGYGVMASGTLQHGDI

SEQ ID NO: 145388 - protein, 29 aa, Artificial Sequence
  Description of Artificial Sequence: Synthetic peptide
QESEIGSTNPVGTEGYGVMASTLQHGDHI

SEQ ID NO: 145389 - protein, 34 aa, Artificial Sequence
  Description of Artificial Sequence: Synthetic polypeptide
MEEEIRTTNPVATEQYGSVMGFDIQDQNNGDGGI

SEQ ID NO: 145390 - protein, 36 aa, Artificial Sequence
  Description of Artificial Sequence: Synthetic polypeptide
MEEEIRTTNPVATEQYGSVMGGNNMQENGGGGNGGI

SEQ ID NO: 145391 - protein, 35 aa, Artificial Sequence
  Description of Artificial Sequence: Synthetic polypeptide
MEEEIRTTNPVATEQYGSVMGQNMNMEGGNGDGEE

SEQ ID NO: 145392 - protein, 36 aa, Artificial Sequence
  Description of Artificial Sequence: Synthetic polypeptide
DEEEIRTTNPVATEQYGSVSNDLGSGQGEIEDTEDF

SEQ ID NO: 145393 - protein, 33 aa, Artificial Sequence
  Description of Artificial Sequence: Synthetic polypeptide
AENEIACTNPVATEQYGCSCSNSNLQNFGSGQA

SEQ ID NO: 145394 - protein, 34 aa, Artificial Sequence
  Description of Artificial Sequence: Synthetic polypeptide
MEEEIRTTNPVATEQYGSVMGQVGSNGEGNEEGN

SEQ ID NO: 145395 - protein, 36 aa, Artificial Sequence
  Description of Artificial Sequence: Synthetic polypeptide
DEEEIRTTNPVATEQYGSVSALNVDNGMIFQEEELG

SEQ ID NO: 145396 - protein, 36 aa, Artificial Sequence
  Description of Artificial Sequence: Synthetic polypeptide
DEEEIRTTNPVATEQYGSVSALNVDNNMIFQEEMCI

SEQ ID NO: 145397 - protein, 30 aa, Artificial Sequence
  Description of Artificial Sequence: Synthetic polypeptide
QESEIATTNPVSTEPYGTMSSTIQQHNGDH

SEQ ID NO: 145398 - protein, 30 aa, Artificial Sequence
  Description of Artificial Sequence: Synthetic polypeptide
QESEIATTNPVSTEGYGVMSSTLQQHNGDH

SEQ ID NO: 145399 - protein, 28 aa, Artificial Sequence
  Description of Artificial Sequence: Synthetic peptide
QESEIATTNPVGTEQYGEAPETCQHEEK

SEQ ID NO: 145400 - protein, 28 aa, Artificial Sequence
  Description of Artificial Sequence: Synthetic peptide
QESEIATTNPVGTEQYGEMASVCQHEDI

SEQ ID NO: 145401 - protein, 35 aa, Artificial Sequence
  Description of Artificial Sequence: Synthetic polypeptide
MEEEIRTTNPVATEQYGSVDGTNMGDDNGGEGQGT

SEQ ID NO: 145402 - protein, 28 aa, Artificial Sequence
  Description of Artificial Sequence: Synthetic peptide
QESEIATTNPVGTEQYGVAPEVCQHEEI

SEQ ID NO: 145403 - protein, 33 aa, Artificial Sequence
  Description of Artificial Sequence: Synthetic polypeptide
DSEEIRTTNPVGTEQWGCVCSTEHQENFGSVQA

SEQ ID NO: 145404 - protein, 35 aa, Artificial Sequence
  Description of Artificial Sequence: Synthetic polypeptide
MEEEIRTTNPVATEQYGSVDIMNNMTDNGGEGQGT

SEQ ID NO: 145405 - protein, 33 aa, Artificial Sequence
  Description of Artificial Sequence: Synthetic polypeptide
DSEEIRTTNPVGTEQWGCVCSNWNHQHFGSVQS

SEQ ID NO: 145406 - protein, 35 aa, Artificial Sequence
  Description of Artificial Sequence: Synthetic polypeptide
MEEEIRTTNPVATEQYGSVDNQDINQNEGQGNENV

SEQ ID NO: 145407 - protein, 35 aa, Artificial Sequence
  Description of Artificial Sequence: Synthetic polypeptide
MEEEIRTTNPVATEQYGSVDQGTNMTDGGGEGQGT

SEQ ID NO: 145408 - protein, 37 aa, Artificial Sequence
  Description of Artificial Sequence: Synthetic polypeptide
AEEEIRTTNPVATEQYGVVSTVTNNQQQNDEGGNNDE

SEQ ID NO: 145409 - protein, 32 aa, Artificial Sequence
  Description of Artificial Sequence: Synthetic polypeptide
QESEIATTNPVSSEQWGSVSCINEPQSEGETR

SEQ ID NO: 145410 - protein, 36 aa, Artificial Sequence
  Description of Artificial Sequence: Synthetic polypeptide
AEEEIRTTNPVATEQYGVVSTVTNNQQQNDEENNNE

SEQ ID NO: 145411 - protein, 38 aa, Artificial Sequence
  Description of Artificial Sequence: Synthetic polypeptide
DEEEIRATNPVATEQYGSVISITLNGLGLQEGQGGGDT

SEQ ID NO: 145412 - protein, 32 aa, Artificial Sequence
  Description of Artificial Sequence: Synthetic polypeptide
AENEIACTNPVATEQYGCFCSWNLQNFGSDTQ

SEQ ID NO: 145413 - protein, 37 aa, Artificial Sequence
  Description of Artificial Sequence: Synthetic polypeptide
AEEEIRTTNPVATEQYGVVSTVTNNQQNGDEAGNEDG

SEQ ID NO: 145414 - protein, 36 aa, Artificial Sequence
  Description of Artificial Sequence: Synthetic polypeptide
DEEEICTTNPVATEQYGSSSSTTPAGPNMRNGMNPV

SEQ ID NO: 145415 - protein, 30 aa, Artificial Sequence
  Description of Artificial Sequence: Synthetic polypeptide
QESEIATTNPVSTEGYGTMSSTIQQHNGDH

SEQ ID NO: 145416 - protein, 29 aa, Artificial Sequence
  Description of Artificial Sequence: Synthetic peptide
QESEIATTNPVSTEGYGVIAMTLQQQGDI

SEQ ID NO: 145417 - protein, 30 aa, Artificial Sequence
  Description of Artificial Sequence: Synthetic polypeptide
QESEIATTNPVSTEGYGVMSSTIQQHNGDH

SEQ ID NO: 145418 - protein, 35 aa, Artificial Sequence
  Description of Artificial Sequence: Synthetic polypeptide
MEEEIRTTNPVATEQYGSVDGNTNMDDNGGEGQET

SEQ ID NO: 145419 - protein, 30 aa, Artificial Sequence
  Description of Artificial Sequence: Synthetic polypeptide
QESEIATTNPVGTEGYGTMASDLQQHNGNI

SEQ ID NO: 145420 - protein, 33 aa, Artificial Sequence
  Description of Artificial Sequence: Synthetic polypeptide
DEECIASTNPVAYEQYGSVVSMNEFSTRGGPLM

SEQ ID NO: 145421 - protein, 34 aa, Artificial Sequence
  Description of Artificial Sequence: Synthetic polypeptide
MEEEIRTTNPVATEQYGMVGSIDFQGEGDGEGEV

SEQ ID NO: 145422 - protein, 35 aa, Artificial Sequence
  Description of Artificial Sequence: Synthetic polypeptide
MEEEIRTTNPVATDQYGVVMSDNNMLIREGQGGGN

SEQ ID NO: 145423 - protein, 31 aa, Artificial Sequence
  Description of Artificial Sequence: Synthetic polypeptide
QESEIATTNPVATEQYGEAPEINCQDHEENK

SEQ ID NO: 145424 - protein, 36 aa, Artificial Sequence
  Description of Artificial Sequence: Synthetic polypeptide
MEEEIRTTNPVATECYGSVMDNGTNALDREGGDQGE

SEQ ID NO: 145425 - protein, 33 aa, Artificial Sequence
  Description of Artificial Sequence: Synthetic polypeptide
MEEEIRTTNPVATECYGSVNNVDNGEFTEGGGG

SEQ ID NO: 145426 - protein, 33 aa, Artificial Sequence
  Description of Artificial Sequence: Synthetic polypeptide
DSEEISTTNPVAYTAWGSTVSTNPSMRGGNLGI

SEQ ID NO: 145427 - protein, 34 aa, Artificial Sequence
  Description of Artificial Sequence: Synthetic polypeptide
MEEEIRTTNPVATEFYGCVSTTDGGEEQEGGEED

SEQ ID NO: 145428 - protein, 35 aa, Artificial Sequence
  Description of Artificial Sequence: Synthetic polypeptide
MEEEIRTTNPVATEFYGSVMGNNDQGGGEDTNEGG

SEQ ID NO: 145429 - protein, 29 aa, Artificial Sequence
  Description of Artificial Sequence: Synthetic peptide
QESEIATTNPVATEQYGEAPEVCQHEEEK

SEQ ID NO: 145430 - protein, 37 aa, Artificial Sequence
  Description of Artificial Sequence: Synthetic polypeptide
AEEEIRTTNPVATEQYGVVSTVTVNNNQAGNQNNEQD

SEQ ID NO: 145431 - protein, 32 aa, Artificial Sequence
  Description of Artificial Sequence: Synthetic polypeptide
DSEEIRTTNPVSYEQYGKTVPCFNQSQDGGQT

SEQ ID NO: 145432 - protein, 32 aa, Artificial Sequence
  Description of Artificial Sequence: Synthetic polypeptide
DSEEIRTTNPVSYEAYGKTVPCFNLSQGGGAT

SEQ ID NO: 145433 - protein, 32 aa, Artificial Sequence
  Description of Artificial Sequence: Synthetic polypeptide
DEECIATTNPVAYEGWGQCTTGGDHQRGGNVR

SEQ ID NO: 145434 - protein, 34 aa, Artificial Sequence
  Description of Artificial Sequence: Synthetic polypeptide
MEEEIRTTNPVATEFYGSVTGGQGGGQTTNINST

SEQ ID NO: 145435 - protein, 36 aa, Artificial Sequence
  Description of Artificial Sequence: Synthetic polypeptide
MEEEIRTTNPVATEFYGSVYSDNNMQSGEGGETGNL

SEQ ID NO: 145436 - protein, 37 aa, Artificial Sequence
  Description of Artificial Sequence: Synthetic polypeptide
DEEEIRTTNPVATEQYGSTVSSTTPAGPNMRNGMPPV

SEQ ID NO: 145437 - protein, 29 aa, Artificial Sequence
  Description of Artificial Sequence: Synthetic peptide
QESEIATTNPVATEQYGEAPEVCQHVEEK

SEQ ID NO: 145438 - protein, 33 aa, Artificial Sequence
  Description of Artificial Sequence: Synthetic polypeptide
DSEEIRTTNPVGYEQWGCVRHNDQQQDRRGESR

SEQ ID NO: 145439 - protein, 37 aa, Artificial Sequence
  Description of Artificial Sequence: Synthetic polypeptide
AEEEIRTTNPVATEQYGVVSTVTTNANQQGNNNNQQD

SEQ ID NO: 145440 - protein, 32 aa, Artificial Sequence
  Description of Artificial Sequence: Synthetic polypeptide
DSEEIRTTNPVSYEGYGSTVPCFNLSGGGGQT

SEQ ID NO: 145441 - protein, 37 aa, Artificial Sequence
  Description of Artificial Sequence: Synthetic polypeptide
AEEEIRTTNPVATEQYGVVSTVTVNNNQQQIGTNEEE

SEQ ID NO: 145442 - protein, 34 aa, Artificial Sequence
  Description of Artificial Sequence: Synthetic polypeptide
DSEEISTTNPVAYTQWGSTVVSTNPSMRGGNNIT

SEQ ID NO: 145443 - protein, 34 aa, Artificial Sequence
  Description of Artificial Sequence: Synthetic polypeptide
DSEEISTTNPVAYTQYGSTVPCTNPSMTTTGTNR

SEQ ID NO: 145444 - protein, 35 aa, Artificial Sequence
  Description of Artificial Sequence: Synthetic polypeptide
MEEEIRGTNPVATEQYGSVVMGDINQNNINQEGNG

SEQ ID NO: 145445 - protein, 34 aa, Artificial Sequence
  Description of Artificial Sequence: Synthetic polypeptide
DSGEIRTTNPVATQQYGCVVSCTNVSEDGGNNPC

SEQ ID NO: 145446 - protein, 34 aa, Artificial Sequence
  Description of Artificial Sequence: Synthetic polypeptide
DSGEIRTTNPVATEQYGSWSWTWPLQIDTTESQS

SEQ ID NO: 145447 - protein, 34 aa, Artificial Sequence
  Description of Artificial Sequence: Synthetic polypeptide
DSGEIRTTNPVATEQYGSVSWTWPMQIDTTESQM

SEQ ID NO: 145448 - protein, 30 aa, Artificial Sequence
  Description of Artificial Sequence: Synthetic polypeptide
QESEIATTNPVATEGYGVMCAASGLQHGDI

SEQ ID NO: 145449 - protein, 35 aa, Artificial Sequence
  Description of Artificial Sequence: Synthetic polypeptide
DEECIATTNPVAYEHYGQTTVAVTNELAQRGGERG

SEQ ID NO: 145450 - protein, 30 aa, Artificial Sequence
  Description of Artificial Sequence: Synthetic polypeptide
QENEIATTNPVATECYGMTPEVNELQHEEL

SEQ ID NO: 145451 - protein, 31 aa, Artificial Sequence
  Description of Artificial Sequence: Synthetic polypeptide
QESEIATTNPVATEGYGVMCASDTLVQHGDD

SEQ ID NO: 145452 - protein, 32 aa, Artificial Sequence
  Description of Artificial Sequence: Synthetic polypeptide
QESEIATTNPVATEGYGVVCAASDTLVEFGND

SEQ ID NO: 145453 - protein, 35 aa, Artificial Sequence
  Description of Artificial Sequence: Synthetic polypeptide
DSGEICTTNPVAYEQYGSVVPSTVMLSQNTGMTRI

SEQ ID NO: 145454 - protein, 33 aa, Artificial Sequence
  Description of Artificial Sequence: Synthetic polypeptide
DEEEICTTNPVAYEAYGHVSCARSLSQVSGGEF

SEQ ID NO: 145455 - protein, 31 aa, Artificial Sequence
  Description of Artificial Sequence: Synthetic polypeptide
QESEIATTNPVATEGYGVVCASDTLVEHGDD

SEQ ID NO: 145456 - protein, 36 aa, Artificial Sequence
  Description of Artificial Sequence: Synthetic polypeptide
DEEEIRTTNPVATEQYGSTVSPTVNVIEEWHDAEQM

SEQ ID NO: 145457 - protein, 36 aa, Artificial Sequence
  Description of Artificial Sequence: Synthetic polypeptide
AEEEIRTTNPVATEQYGVVSTVVNGNQAQNNNNTDT

SEQ ID NO: 145458 - protein, 32 aa, Artificial Sequence
  Description of Artificial Sequence: Synthetic polypeptide
QENEIATTNPVATECYGKVSCEDELSQHEGEL

SEQ ID NO: 145459 - protein, 34 aa, Artificial Sequence
  Description of Artificial Sequence: Synthetic polypeptide
DEEEIRATNPVATEQYGSVCAATMGEEGGMMEEG

SEQ ID NO: 145460 - protein, 32 aa, Artificial Sequence
  Description of Artificial Sequence: Synthetic polypeptide
DSEEISTTNPVGTEQWGCVCSWELQNFGSVQA

SEQ ID NO: 145461 - protein, 33 aa, Artificial Sequence
  Description of Artificial Sequence: Synthetic polypeptide
DSEEISTTNPVAYTRWGSTVSTNAPSMRMGNGI

SEQ ID NO: 145462 - protein, 30 aa, Artificial Sequence
  Description of Artificial Sequence: Synthetic polypeptide
QESEIATTNPVATEQYGDMAETLQNHAEDA

SEQ ID NO: 145463 - protein, 35 aa, Artificial Sequence
  Description of Artificial Sequence: Synthetic polypeptide
MEEEIRTTNPVATEGYGSVNSNNDEMQVGEGGFDG

SEQ ID NO: 145464 - protein, 35 aa, Artificial Sequence
  Description of Artificial Sequence: Synthetic polypeptide
MEEEIRTTNPVATEGYGSVNTLGLNLINGGGGEGN

SEQ ID NO: 145465 - protein, 33 aa, Artificial Sequence
  Description of Artificial Sequence: Synthetic polypeptide
DEECNATTNPIAYEQWGEVCSTDNQDQHQDGNR

SEQ ID NO: 145466 - protein, 38 aa, Artificial Sequence
  Description of Artificial Sequence: Synthetic polypeptide
DEEEIRTTNPVATEQYGSTVSSTTPAPGPNMRNGMNPV

SEQ ID NO: 145467 - protein, 34 aa, Artificial Sequence
  Description of Artificial Sequence: Synthetic polypeptide
DEEEICTTNPVATESWGSVSTGGNTGGADGGMEH

SEQ ID NO: 145468 - protein, 33 aa, Artificial Sequence
  Description of Artificial Sequence: Synthetic polypeptide
DEEEIRTTNPVATEQYGSCVEPLGIPTDVEETV

SEQ ID NO: 145469 - protein, 37 aa, Artificial Sequence
  Description of Artificial Sequence: Synthetic polypeptide
DEEEICTTNPVATEQYGSVSSTTPARGPNMNNGMNPV

SEQ ID NO: 145470 - protein, 36 aa, Artificial Sequence
  Description of Artificial Sequence: Synthetic polypeptide
AEEEIRTTNPVATEQYGVVSTVTQNGNQEQGEDETD

SEQ ID NO: 145471 - protein, 36 aa, Artificial Sequence
  Description of Artificial Sequence: Synthetic polypeptide
DEEEIRTTNPVATEQYGSVSMPPNGTAEALVVEASI

SEQ ID NO: 145472 - protein, 34 aa, Artificial Sequence
  Description of Artificial Sequence: Synthetic polypeptide
DEECTCTTNPVAVEQYGVVSTVNNNNQDQGNDND

SEQ ID NO: 145473 - protein, 34 aa, Artificial Sequence
  Description of Artificial Sequence: Synthetic polypeptide
MEEEIRTTNPVATEQYGDVMSGVGFEGNGGNEGG

SEQ ID NO: 145474 - protein, 36 aa, Artificial Sequence
  Description of Artificial Sequence: Synthetic polypeptide
DEEEIRTTNPVATEQYGSCTYPTNNLALVDGLDIID

SEQ ID NO: 145475 - protein, 35 aa, Artificial Sequence
  Description of Artificial Sequence: Synthetic polypeptide
MEEEIRTTNPVATEQYGDVVDGMNNQRNDDIIGEG

SEQ ID NO: 145476 - protein, 35 aa, Artificial Sequence
  Description of Artificial Sequence: Synthetic polypeptide
MEEEIRTTNPVATEQYGDVVQTDPNMNGTGGENDD

SEQ ID NO: 145477 - protein, 35 aa, Artificial Sequence
  Description of Artificial Sequence: Synthetic polypeptide
DEECIATTNPVATEQYGSVFVWINGEQDRTKFGDT

SEQ ID NO: 145478 - protein, 31 aa, Artificial Sequence
  Description of Artificial Sequence: Synthetic polypeptide
QENEIATTNPVATECYGGVSEFLQAHTETMG

SEQ ID NO: 145479 - protein, 33 aa, Artificial Sequence
  Description of Artificial Sequence: Synthetic polypeptide
DEECIATTNPVATEQYGCVYVWENGIQKTGDGN

SEQ ID NO: 145480 - protein, 30 aa, Artificial Sequence
  Description of Artificial Sequence: Synthetic polypeptide
QENEIATTNPVATECYGGVSEFILTAHTEM

SEQ ID NO: 145481 - protein, 35 aa, Artificial Sequence
  Description of Artificial Sequence: Synthetic polypeptide
MEEEIRTTNPVATEQYGDVVTGQTGLQDEGGIGGT

SEQ ID NO: 145482 - protein, 35 aa, Artificial Sequence
  Description of Artificial Sequence: Synthetic polypeptide
MEEEIRTTNPVATEQYGDVVVNGFNQGQGGGGNID

SEQ ID NO: 145483 - protein, 30 aa, Artificial Sequence
  Description of Artificial Sequence: Synthetic polypeptide
QESEIATTNPVGTEGYGTMAMDLQQHNGNI

SEQ ID NO: 145484 - protein, 31 aa, Artificial Sequence
  Description of Artificial Sequence: Synthetic polypeptide
DEECIATTNPIATECWGSCSKNEDDQGGGKA

SEQ ID NO: 145485 - protein, 29 aa, Artificial Sequence
  Description of Artificial Sequence: Synthetic peptide
QESEIATTNPVGTEGYGTMASDLQHNGDI

SEQ ID NO: 145486 - protein, 31 aa, Artificial Sequence
  Description of Artificial Sequence: Synthetic polypeptide
QENEIATTNPVATECYGGVSSECLYQHEHEM

SEQ ID NO: 145487 - protein, 37 aa, Artificial Sequence
  Description of Artificial Sequence: Synthetic polypeptide
AEEEIRTTNPVATEQYGVVTVVVTNNLQQNEGEENED

SEQ ID NO: 145488 - protein, 33 aa, Artificial Sequence
  Description of Artificial Sequence: Synthetic polypeptide
QESEIATTNPVAYDHYGSVSYTPNEPSQRVLNM

SEQ ID NO: 145489 - protein, 36 aa, Artificial Sequence
  Description of Artificial Sequence: Synthetic polypeptide
DEEEICTTNPVATESYGSVTTGNEGNQGGHGQGNND

SEQ ID NO: 145490 - protein, 29 aa, Artificial Sequence
  Description of Artificial Sequence: Synthetic peptide
QESEIATTNPVATEQYGNAPEVCQHVEEK

SEQ ID NO: 145491 - protein, 29 aa, Artificial Sequence
  Description of Artificial Sequence: Synthetic peptide
QESEIATTNPVATEQYGNAPNVCQHVEEK

SEQ ID NO: 145492 - protein, 33 aa, Artificial Sequence
  Description of Artificial Sequence: Synthetic polypeptide
DEECNATTNPIAYEQWGEVCSTENGDQDHDGNR

SEQ ID NO: 145493 - protein, 37 aa, Artificial Sequence
  Description of Artificial Sequence: Synthetic polypeptide
DEEEIRTTNPVATEQYGSCVSPAPYLLPEGVDMTERD

SEQ ID NO: 145494 - protein, 36 aa, Artificial Sequence
  Description of Artificial Sequence: Synthetic polypeptide
MEEEIRTTNPVATEQYGAVDIDTNMNLDEGGGQNIT

SEQ ID NO: 145495 - protein, 32 aa, Artificial Sequence
  Description of Artificial Sequence: Synthetic polypeptide
DSEEIRTTNPVGYECWGMVRHNDGQDRGVANH

SEQ ID NO: 145496 - protein, 33 aa, Artificial Sequence
  Description of Artificial Sequence: Synthetic polypeptide
DSEEIRTTNPVGYECWGMVPHWNDLQDREGTVR

SEQ ID NO: 145497 - protein, 32 aa, Artificial Sequence
  Description of Artificial Sequence: Synthetic polypeptide
DSEEIRTTNPVGYECWGMVPHWNDIQDRGAVR

SEQ ID NO: 145498 - protein, 36 aa, Artificial Sequence
  Description of Artificial Sequence: Synthetic polypeptide
MEEEIRTTNPVATEQYGAVDIDTNMNLEEGDGQDNT

SEQ ID NO: 145499 - protein, 36 aa, Artificial Sequence
  Description of Artificial Sequence: Synthetic polypeptide
MEEEIRTTNPVATEQYGAVDIDTNMTLEEGGNQDIT

SEQ ID NO: 145500 - protein, 33 aa, Artificial Sequence
  Description of Artificial Sequence: Synthetic polypeptide
MEEEIRTTNPVATEQYGAVFGDLEGDEMGGGQG

SEQ ID NO: 145501 - protein, 33 aa, Artificial Sequence
  Description of Artificial Sequence: Synthetic polypeptide
DEECNATTNPIAYEQWGEVCSTNDFQDTDGNNR

SEQ ID NO: 145502 - protein, 34 aa, Artificial Sequence
  Description of Artificial Sequence: Synthetic polypeptide
MEEEIRTTNPVATEQYGAVMGLGDNGQGGGEIGT

SEQ ID NO: 145503 - protein, 31 aa, Artificial Sequence
  Description of Artificial Sequence: Synthetic polypeptide
DSEEIRTTNPVGTEWWGMVPTVPLEREVQQE

SEQ ID NO: 145504 - protein, 31 aa, Artificial Sequence
  Description of Artificial Sequence: Synthetic polypeptide
DSEEIRTTNPVGTEWWGMVPTNVEVREVQQE

SEQ ID NO: 145505 - protein, 31 aa, Artificial Sequence
  Description of Artificial Sequence: Synthetic polypeptide
DSEEIRTTNPVGTEWWGMVPANLETREVQQE

SEQ ID NO: 145506 - protein, 34 aa, Artificial Sequence
  Description of Artificial Sequence: Synthetic polypeptide
MEEEIRTTNPVATEQYGAVVGDNNDGTEQGEGEE

SEQ ID NO: 145507 - protein, 31 aa, Artificial Sequence
  Description of Artificial Sequence: Synthetic polypeptide
QENEIATTNPVATECYGHVSEQCLEQHEEDL

SEQ ID NO: 145508 - protein, 32 aa, Artificial Sequence
  Description of Artificial Sequence: Synthetic polypeptide
QESEIATTNPVAYDHYGSVSYTNEASQGVLNM

SEQ ID NO: 145509 - protein, 30 aa, Artificial Sequence
  Description of Artificial Sequence: Synthetic polypeptide
QENEIATTNPVATECYGGVVECLQHEHEQM

SEQ ID NO: 145510 - protein, 28 aa, Artificial Sequence
  Description of Artificial Sequence: Synthetic peptide
QESEIASTNPVGTEWYGVMASTLQHNDI

SEQ ID NO: 145511 - protein, 33 aa, Artificial Sequence
  Description of Artificial Sequence: Synthetic polypeptide
MEDEIRTTNPVATEQYGEMTSGNGDQDEQGGDG

SEQ ID NO: 145512 - protein, 29 aa, Artificial Sequence
  Description of Artificial Sequence: Synthetic peptide
QESEIASTNPVGTEWYGVMASTLQHGDEI

SEQ ID NO: 145513 - protein, 33 aa, Artificial Sequence
  Description of Artificial Sequence: Synthetic polypeptide
IEQEIATTNPVATEQYGSVNATDLEDHEGIEDL

SEQ ID NO: 145514 - protein, 29 aa, Artificial Sequence
  Description of Artificial Sequence: Synthetic peptide
QESEIASTNPVGTEGYGVMSSTLQQHGDI

SEQ ID NO: 145515 - protein, 30 aa, Artificial Sequence
  Description of Artificial Sequence: Synthetic polypeptide
QENEIATTNPVATEPYGTISECIQQQHENL

SEQ ID NO: 145516 - protein, 29 aa, Artificial Sequence
  Description of Artificial Sequence: Synthetic peptide
QESEIASTNPVGTEGYGVMSTTLEHEGDI

SEQ ID NO: 145517 - protein, 37 aa, Artificial Sequence
  Description of Artificial Sequence: Synthetic polypeptide
DTEEIRTTNPCATEAYGSVSTVTNNLQQGNTEENEDT

SEQ ID NO: 145518 - protein, 36 aa, Artificial Sequence
  Description of Artificial Sequence: Synthetic polypeptide
DEEEIRTTNPVATEQYGSGIPPTNIGLNIFGQVQEN

SEQ ID NO: 145519 - protein, 35 aa, Artificial Sequence
  Description of Artificial Sequence: Synthetic polypeptide
DEECIRTTNPCAYEQWGSVSTTNLGNDNANNGNAQ

SEQ ID NO: 145520 - protein, 29 aa, Artificial Sequence
  Description of Artificial Sequence: Synthetic peptide
QESEIASTNPVGTEGYGVMTAITLQHGDI

SEQ ID NO: 145521 - protein, 36 aa, Artificial Sequence
  Description of Artificial Sequence: Synthetic polypeptide
DEEEIRTTNPVATEQYGSGSDTLTNHHGLTPEQEEE

SEQ ID NO: 145522 - protein, 29 aa, Artificial Sequence
  Description of Artificial Sequence: Synthetic peptide
QESEIASTNPVGTEGYGVMTASTLQHGDI

SEQ ID NO: 145523 - protein, 35 aa, Artificial Sequence
  Description of Artificial Sequence: Synthetic polypeptide
IEQEIRTTNPVATEQYGSYTTTNDNNQENGNEDQQ

SEQ ID NO: 145524 - protein, 36 aa, Artificial Sequence
  Description of Artificial Sequence: Synthetic polypeptide
DTEEIRTTNPCATEAYGSVSTVNNNLQQGTEEGEDD

SEQ ID NO: 145525 - protein, 34 aa, Artificial Sequence
  Description of Artificial Sequence: Synthetic polypeptide
IESEIRTTNPVATEQYGSVWTLNDNNEELNEMIL

SEQ ID NO: 145526 - protein, 37 aa, Artificial Sequence
  Description of Artificial Sequence: Synthetic polypeptide
AEEEIRTTNPVATEQYGVVVVTTTQNGNLQQGTNQEE

SEQ ID NO: 145527 - protein, 29 aa, Artificial Sequence
  Description of Artificial Sequence: Synthetic peptide
QESEIASTNPVGTEGYGVMWSTLQHGDIN

SEQ ID NO: 145528 - protein, 34 aa, Artificial Sequence
  Description of Artificial Sequence: Synthetic polypeptide
ITEEIRTTNPVATDQYGSVSTYGMGQTEGQGGQQ

SEQ ID NO: 145529 - protein, 36 aa, Artificial Sequence
  Description of Artificial Sequence: Synthetic polypeptide
DEECIRTTNPCATEEYGVVCYKTNDETQRQGGGNTR

SEQ ID NO: 145530 - protein, 31 aa, Artificial Sequence
  Description of Artificial Sequence: Synthetic polypeptide
QENEIATTNPVATEPYGNVSGHLQHWDESAE

SEQ ID NO: 145531 - protein, 34 aa, Artificial Sequence
  Description of Artificial Sequence: Synthetic polypeptide
DEECIRTTNPCAYEQWGSVSTTNGDNANNGNNMQ

SEQ ID NO: 145532 - protein, 36 aa, Artificial Sequence
  Description of Artificial Sequence: Synthetic polypeptide
IENEIRTTNPVATEQYGSVSAVENLQEQHISSLNDS

SEQ ID NO: 145533 - protein, 35 aa, Artificial Sequence
  Description of Artificial Sequence: Synthetic polypeptide
IENEIRTTNPVATEQYGSCISVTQHDLQTGEEQQE

SEQ ID NO: 145534 - protein, 31 aa, Artificial Sequence
  Description of Artificial Sequence: Synthetic polypeptide
IENEIRTTNPVATEQWGDVSEIEMNAAEWDA

SEQ ID NO: 145535 - protein, 29 aa, Artificial Sequence
  Description of Artificial Sequence: Synthetic peptide
QESEIASTNPVGTEGYGVMRASTLQHGDE

SEQ ID NO: 145536 - protein, 29 aa, Artificial Sequence
  Description of Artificial Sequence: Synthetic peptide
QESEIASTNPVGTEGYGVMSASTLNHGDI

SEQ ID NO: 145537 - protein, 37 aa, Artificial Sequence
  Description of Artificial Sequence: Synthetic polypeptide
AEEEIRTTNPVATEQYGVVVVTVNNLQSNEQGTNTND

SEQ ID NO: 145538 - protein, 37 aa, Artificial Sequence
  Description of Artificial Sequence: Synthetic polypeptide
AEEEIRTTNPVATEQYGVVVVTVNNLQSNEQGTNAND

SEQ ID NO: 145539 - protein, 30 aa, Artificial Sequence
  Description of Artificial Sequence: Synthetic polypeptide
QESEIASTNPVGTEGYGVMSASTLQHGDPI

SEQ ID NO: 145540 - protein, 36 aa, Artificial Sequence
  Description of Artificial Sequence: Synthetic polypeptide
DTEEIRTTNPCATEAYGSVSTVVNNLQQGTEEEEEE

SEQ ID NO: 145541 - protein, 30 aa, Artificial Sequence
  Description of Artificial Sequence: Synthetic polypeptide
QESEIASTNPVGTEGYGVMSASTLQHGDPV

SEQ ID NO: 145542 - protein, 30 aa, Artificial Sequence
  Description of Artificial Sequence: Synthetic polypeptide
QESEIASTNPVGTEGYGVMSATDLQHEGEI

SEQ ID NO: 145543 - protein, 36 aa, Artificial Sequence
  Description of Artificial Sequence: Synthetic polypeptide
DTEEIRTTNPCATEAYGSVSTVTNNNQIGTEENNDE

SEQ ID NO: 145544 - protein, 30 aa, Artificial Sequence
  Description of Artificial Sequence: Synthetic polypeptide
QESEIASTNPVGTEGYGVMSATDLQHEGEL

SEQ ID NO: 145545 - protein, 30 aa, Artificial Sequence
  Description of Artificial Sequence: Synthetic polypeptide
QESEIASTNPVGTEGYGVMSATTLQHEGEI

SEQ ID NO: 145546 - protein, 37 aa, Artificial Sequence
  Description of Artificial Sequence: Synthetic polypeptide
DTEEIRTTNPCATEAYGSVSTVTNNNLQQGTEENTDE

SEQ ID NO: 145547 - protein, 31 aa, Artificial Sequence
  Description of Artificial Sequence: Synthetic polypeptide
IENEIATTNPVATECYGHVSVECLEQHWEDH

SEQ ID NO: 145548 - protein, 31 aa, Artificial Sequence
  Description of Artificial Sequence: Synthetic polypeptide
IENEIATTNPVATECYGHVSVEELEQPHPEL

SEQ ID NO: 145549 - protein, 32 aa, Artificial Sequence
  Description of Artificial Sequence: Synthetic polypeptide
QENEIATTNPVATEPYGTTVSEGELSQHEGEL

SEQ ID NO: 145550 - protein, 37 aa, Artificial Sequence
  Description of Artificial Sequence: Synthetic polypeptide
DEEEIRTTNPVATEQYGSVSCTLAMMMQEENNEEEVN

SEQ ID NO: 145551 - protein, 28 aa, Artificial Sequence
  Description of Artificial Sequence: Synthetic peptide
QESEIASTNPVGTEGYGVMSSTLEHGDI

SEQ ID NO: 145552 - protein, 28 aa, Artificial Sequence
  Description of Artificial Sequence: Synthetic peptide
QESEIASTNPVGTEGYGVMSSTLMHGDI

SEQ ID NO: 145553 - protein, 28 aa, Artificial Sequence
  Description of Artificial Sequence: Synthetic peptide
QESEIASTNPVGTEGYGVMSSTLQHEDI

SEQ ID NO: 145554 - protein, 29 aa, Artificial Sequence
  Description of Artificial Sequence: Synthetic peptide
QESEIASTNPVGTEGYGVMYTSTLQHGDI

SEQ ID NO: 145555 - protein, 29 aa, Artificial Sequence
  Description of Artificial Sequence: Synthetic peptide
QESEIASTNPVGTEGYGVMQASTLQHGDI

SEQ ID NO: 145556 - protein, 34 aa, Artificial Sequence
  Description of Artificial Sequence: Synthetic polypeptide
DEECISTTNPVAYEQYGQSTVSVDNEWAGHGGER

SEQ ID NO: 145557 - protein, 29 aa, Artificial Sequence
  Description of Artificial Sequence: Synthetic peptide
QESEIASTNPVGTEGYGVNASTLQHGDIY

SEQ ID NO: 145558 - protein, 30 aa, Artificial Sequence
  Description of Artificial Sequence: Synthetic polypeptide
QESEIASTNPVGTEGYGVSMASTLQHGDIM

SEQ ID NO: 145559 - protein, 32 aa, Artificial Sequence
  Description of Artificial Sequence: Synthetic polypeptide
DTEEIRATNPVAYEQWGSSYYTEHMQGGNNDN

SEQ ID NO: 145560 - protein, 33 aa, Artificial Sequence
  Description of Artificial Sequence: Synthetic polypeptide
DTEEIRATNPVAYEQWGSSYYTEHMDQRGDNNH

SEQ ID NO: 145561 - protein, 31 aa, Artificial Sequence
  Description of Artificial Sequence: Synthetic polypeptide
QENEIATTNPVATEPYGNVAGEPLQHMNEKL

SEQ ID NO: 145562 - protein, 32 aa, Artificial Sequence
  Description of Artificial Sequence: Synthetic polypeptide
QENEIATTNPVATEPYGNTVSGEHLQHGMMEM

SEQ ID NO: 145563 - protein, 37 aa, Artificial Sequence
  Description of Artificial Sequence: Synthetic polypeptide
AEEEIRTTNPVATEQYGVVVVSVTTNQNQEQGTTNDD

SEQ ID NO: 145564 - protein, 35 aa, Artificial Sequence
  Description of Artificial Sequence: Synthetic polypeptide
DEEEIRTTNPVATEQYGSVSLEFDEQPEMIVVEPI

SEQ ID NO: 145565 - protein, 37 aa, Artificial Sequence
  Description of Artificial Sequence: Synthetic polypeptide
AEEEIRTTNPVATEQYGVVVVSVTTNQNQEQGENNTD

SEQ ID NO: 145566 - protein, 36 aa, Artificial Sequence
  Description of Artificial Sequence: Synthetic polypeptide
DEEEIGTTNPVATEQYGCVCSTGEDHNQENFGSNLS

SEQ ID NO: 145567 - protein, 37 aa, Artificial Sequence
  Description of Artificial Sequence: Synthetic polypeptide
AEEEIRTTNPVATEQYGVVVVSVTTNQNQEQGENNDE

SEQ ID NO: 145568 - protein, 37 aa, Artificial Sequence
  Description of Artificial Sequence: Synthetic polypeptide
AEEEIRTTNPVATEQYGVVVVSVTTNNNQEQGEGNDE

SEQ ID NO: 145569 - protein, 31 aa, Artificial Sequence
  Description of Artificial Sequence: Synthetic polypeptide
DTEEIRATNPVAYEQWGCSYQVDNQQNGDSS

SEQ ID NO: 145570 - protein, 28 aa, Artificial Sequence
  Description of Artificial Sequence: Synthetic peptide
QESEIASTNPVGTEGYGVTASALQHGDI

SEQ ID NO: 145571 - protein, 29 aa, Artificial Sequence
  Description of Artificial Sequence: Synthetic peptide
QESEIASTNPVGTEGYGVTASNTLQHGDQ

SEQ ID NO: 145572 - protein, 30 aa, Artificial Sequence
  Description of Artificial Sequence: Synthetic polypeptide
QESEIASTNPVGTEGYGVTASTELQHGGDE

SEQ ID NO: 145573 - protein, 28 aa, Artificial Sequence
  Description of Artificial Sequence: Synthetic peptide
QESEIASTNPVGTEGYGVTASTLNHGDI

SEQ ID NO: 145574 - protein, 29 aa, Artificial Sequence
  Description of Artificial Sequence: Synthetic peptide
QESEIASTNPVGTEGYGVTASTLQEHGDI

SEQ ID NO: 145575 - protein, 32 aa, Artificial Sequence
  Description of Artificial Sequence: Synthetic polypeptide
KENEIRTTNPVSTEQYGTISMEDIQQQQNGNH

SEQ ID NO: 145576 - protein, 35 aa, Artificial Sequence
  Description of Artificial Sequence: Synthetic polypeptide
AEEEIRTTNPVATEQYGVVVVSVTTNNQEQQETED

SEQ ID NO: 145577 - protein, 30 aa, Artificial Sequence
  Description of Artificial Sequence: Synthetic polypeptide
QESEIASTNPVGTEGYGVSMANSTLQHGDN

SEQ ID NO: 145578 - protein, 30 aa, Artificial Sequence
  Description of Artificial Sequence: Synthetic polypeptide
QESEIASTNPVGTEGYGVSCQSTLQHFGDQ

SEQ ID NO: 145579 - protein, 35 aa, Artificial Sequence
  Description of Artificial Sequence: Synthetic polypeptide
DEEEIRTTNPVATEQYGSVSLDPVGLIETMVEQTT

SEQ ID NO: 145580 - protein, 32 aa, Artificial Sequence
  Description of Artificial Sequence: Synthetic polypeptide
QENEIATTNPVATEPYGNVSGENHLQHMMQLN

SEQ ID NO: 145581 - protein, 35 aa, Artificial Sequence
  Description of Artificial Sequence: Synthetic polypeptide
DEECIRTTNPCATECYGVVCYKTNDEHQRNGGNTH

SEQ ID NO: 145582 - protein, 28 aa, Artificial Sequence
  Description of Artificial Sequence: Synthetic peptide
QESEIASTNPVGTEGYGVQASTLWHGDI

SEQ ID NO: 145583 - protein, 31 aa, Artificial Sequence
  Description of Artificial Sequence: Synthetic polypeptide
QENEIATTNPVATEPYGNVSGEHLQQHQEEL

SEQ ID NO: 145584 - protein, 31 aa, Artificial Sequence
  Description of Artificial Sequence: Synthetic polypeptide
QENEIATTNPVATEPYGNVSGEHLQHWDESL

SEQ ID NO: 145585 - protein, 29 aa, Artificial Sequence
  Description of Artificial Sequence: Synthetic peptide
QESEIASTNPVGTEGYGVRASTLMQHGDI

SEQ ID NO: 145586 - protein, 28 aa, Artificial Sequence
  Description of Artificial Sequence: Synthetic peptide
QESEIASTNPVGTEGYGVRASTLPHGDI

SEQ ID NO: 145587 - protein, 36 aa, Artificial Sequence
  Description of Artificial Sequence: Synthetic polypeptide
AEEEIRTTNPVATEQYGVVVVTTNNNTEQLGNNNAS

SEQ ID NO: 145588 - protein, 29 aa, Artificial Sequence
  Description of Artificial Sequence: Synthetic peptide
QESEIASTNPVGTEGYGVRASTLQHGDIK

SEQ ID NO: 145589 - protein, 33 aa, Artificial Sequence
  Description of Artificial Sequence: Synthetic polypeptide
DEECIRCTNPVAYEQYGKVVSVNEFSMRGGPLM

SEQ ID NO: 145590 - protein, 28 aa, Artificial Sequence
  Description of Artificial Sequence: Synthetic peptide
QESEIASTNPVGTEGYGVRASTVQHGDI

SEQ ID NO: 145591 - protein, 33 aa, Artificial Sequence
  Description of Artificial Sequence: Synthetic polypeptide
DEECIRCTNPVAYEGYGSVVSSNEFSTRGGPLM

SEQ ID NO: 145592 - protein, 29 aa, Artificial Sequence
  Description of Artificial Sequence: Synthetic peptide
QESEIASTNPVGTEGYGVRMASTLQHGDI

SEQ ID NO: 145593 - protein, 30 aa, Artificial Sequence
  Description of Artificial Sequence: Synthetic polypeptide
QESEIASTNPVGTEGYGVSAASTLQHGDIY

SEQ ID NO: 145594 - protein, 32 aa, Artificial Sequence
  Description of Artificial Sequence: Synthetic polypeptide
QENEIATTNPVATEPYGNVSGEHLQHMNEKAE

SEQ ID NO: 145595 - protein, 37 aa, Artificial Sequence
  Description of Artificial Sequence: Synthetic polypeptide
AEEEIRTTNPVATEQYGVVVVTTNNLEQGTEGGNTTQ

SEQ ID NO: 145596 - protein, 32 aa, Artificial Sequence
  Description of Artificial Sequence: Synthetic polypeptide
QENEIATTNPVATEPYGNVSGEHLQHMIMQNN

SEQ ID NO: 145597 - protein, 35 aa, Artificial Sequence
  Description of Artificial Sequence: Synthetic polypeptide
DEECIRCTNPVATEQYGVVSWNEGEQERQRMNGEE

SEQ ID NO: 145598 - protein, 32 aa, Artificial Sequence
  Description of Artificial Sequence: Synthetic polypeptide
QENEIATTNPVATEPYGNVSGEHLQHGMMQMN

SEQ ID NO: 145599 - protein, 31 aa, Artificial Sequence
  Description of Artificial Sequence: Synthetic polypeptide
QENEIATTNPVATEPYGNVSGHLQHHWDEST

SEQ ID NO: 145600 - protein, 28 aa, Artificial Sequence
  Description of Artificial Sequence: Synthetic peptide
QESEIASTNPVGTEGYGVMPSVLQHGDI

SEQ ID NO: 145601 - protein, 28 aa, Artificial Sequence
  Description of Artificial Sequence: Synthetic peptide
QESEIASTNPVGTEGYGVMPSTPQHGDI

SEQ ID NO: 145602 - protein, 29 aa, Artificial Sequence
  Description of Artificial Sequence: Synthetic peptide
QESEIASTNPVGTEGYGVMPSTLQHGWDI

SEQ ID NO: 145603 - protein, 34 aa, Artificial Sequence
  Description of Artificial Sequence: Synthetic polypeptide
DEECIRTTNPVATEIYGCVCGNTEDNQNFGSNQS

SEQ ID NO: 145604 - protein, 31 aa, Artificial Sequence
  Description of Artificial Sequence: Synthetic polypeptide
AEMEIVCTNPVATEQYGEASAEDGPEFEGNR

SEQ ID NO: 145605 - protein, 30 aa, Artificial Sequence
  Description of Artificial Sequence: Synthetic polypeptide
QESEIASTNPVGTEGYGVMAVSLTLQSGDI

SEQ ID NO: 145606 - protein, 30 aa, Artificial Sequence
  Description of Artificial Sequence: Synthetic polypeptide
QESEIASTNPVGTEGYGVMAVSTLQFHGDI

SEQ ID NO: 145607 - protein, 31 aa, Artificial Sequence
  Description of Artificial Sequence: Synthetic polypeptide
AEMEIVCTNPVATEQYGEASATDGPEFEGND

SEQ ID NO: 145608 - protein, 38 aa, Artificial Sequence
  Description of Artificial Sequence: Synthetic polypeptide
AEEEIRTTNPVATEQYGVVVVVSTTNLGQQGTEQGNVD

SEQ ID NO: 145609 - protein, 30 aa, Artificial Sequence
  Description of Artificial Sequence: Synthetic polypeptide
QESEIASTNPVGTEGYGVMAVSTLQHGLDI

SEQ ID NO: 145610 - protein, 29 aa, Artificial Sequence
  Description of Artificial Sequence: Synthetic peptide
QESEIASTNPVGTEGYGVMAVSTLQHSDI

SEQ ID NO: 145611 - protein, 28 aa, Artificial Sequence
  Description of Artificial Sequence: Synthetic peptide
QESEIASTNPVGTEGYGVMAVSLQHGDI

SEQ ID NO: 145612 - protein, 37 aa, Artificial Sequence
  Description of Artificial Sequence: Synthetic polypeptide
AEEEIRTTNPVATEQYGVVVVVSTTNLGQQGTEEGEV

SEQ ID NO: 145613 - protein, 29 aa, Artificial Sequence
  Description of Artificial Sequence: Synthetic peptide
QESEIASTNPVGTEGYGVMAWSTLQHGDI

SEQ ID NO: 145614 - protein, 36 aa, Artificial Sequence
  Description of Artificial Sequence: Synthetic polypeptide
AEEEIRTTNPVATEQYGVVVVVSTTLQQGTEQGEVD

SEQ ID NO: 145615 - protein, 33 aa, Artificial Sequence
  Description of Artificial Sequence: Synthetic polypeptide
AEMEIVTTNPVATEQYGEVCSATDGLVEFEGGD

SEQ ID NO: 145616 - protein, 29 aa, Artificial Sequence
  Description of Artificial Sequence: Synthetic peptide
QESEIASTNPVGTEGYGVMAWTLLQHGDI

SEQ ID NO: 145617 - protein, 28 aa, Artificial Sequence
  Description of Artificial Sequence: Synthetic peptide
QESEIASTNPVGTEGYGVMAWTLQHGDI

SEQ ID NO: 145618 - protein, 29 aa, Artificial Sequence
  Description of Artificial Sequence: Synthetic peptide
QESEIASTNPVGTEGYGVMAYSTLQHGDI

SEQ ID NO: 145619 - protein, 28 aa, Artificial Sequence
  Description of Artificial Sequence: Synthetic peptide
QESEIASTNPVGTEGYGVMAYTLQHGDI

SEQ ID NO: 145620 - protein, 33 aa, Artificial Sequence
  Description of Artificial Sequence: Synthetic polypeptide
AEMEIVTTNPVATEQYGEVCSATDGPVEFEGND

SEQ ID NO: 145621 - protein, 28 aa, Artificial Sequence
  Description of Artificial Sequence: Synthetic peptide
QESEIASTNPVGTEGYGVMAVTLQHGDI

SEQ ID NO: 145622 - protein, 38 aa, Artificial Sequence
  Description of Artificial Sequence: Synthetic polypeptide
AEEEIRTTNPVATEQYGVVVVVSTTNLNQDEQGTNVET

SEQ ID NO: 145623 - protein, 34 aa, Artificial Sequence
  Description of Artificial Sequence: Synthetic polypeptide
DEECIRTTNPVATEIYGCVCGSGELNQNFGSQQS

SEQ ID NO: 145624 - protein, 29 aa, Artificial Sequence
  Description of Artificial Sequence: Synthetic peptide
QESEIASTNPVGTEGYGVMATTLVQHGDD

SEQ ID NO: 145625 - protein, 34 aa, Artificial Sequence
  Description of Artificial Sequence: Synthetic polypeptide
DTEEIRTTNPVATEQYGSCWTVNGETGHISMQQE

SEQ ID NO: 145626 - protein, 28 aa, Artificial Sequence
  Description of Artificial Sequence: Synthetic peptide
QESEIASTNPVGTEGYGVMASVLQHGEI

SEQ ID NO: 145627 - protein, 28 aa, Artificial Sequence
  Description of Artificial Sequence: Synthetic peptide
QESEIASTNPVGTEGYGVMASVLQHTNI

SEQ ID NO: 145628 - protein, 34 aa, Artificial Sequence
  Description of Artificial Sequence: Synthetic polypeptide
DTEEIRTTNPVATEQYGSCWTNNMETGHISMQIM

SEQ ID NO: 145629 - protein, 29 aa, Artificial Sequence
  Description of Artificial Sequence: Synthetic peptide
QESEIASTNPVGTEGYGVMASVTLQHGDI

SEQ ID NO: 145630 - protein, 35 aa, Artificial Sequence
  Description of Artificial Sequence: Synthetic polypeptide
DTEEIRTTNPVATEQYGCVSTTSNAMTLEGEEDFD

SEQ ID NO: 145631 - protein, 37 aa, Artificial Sequence
  Description of Artificial Sequence: Synthetic polypeptide
AEEEIRTTNPVATEQYGVVVVVSTTNLQAGTEEGVVD

SEQ ID NO: 145632 - protein, 28 aa, Artificial Sequence
  Description of Artificial Sequence: Synthetic peptide
QESEIASTNPVGTEGYGVMASWLQHGDI

SEQ ID NO: 145633 - protein, 29 aa, Artificial Sequence
  Description of Artificial Sequence: Synthetic peptide
QESEIASTNPVGTEGYGVMASWTLQHGDI

SEQ ID NO: 145634 - protein, 29 aa, Artificial Sequence
  Description of Artificial Sequence: Synthetic peptide
QESEIASTNPVGTEGYGVMASWVLQHGDI

SEQ ID NO: 145635 - protein, 33 aa, Artificial Sequence
  Description of Artificial Sequence: Synthetic polypeptide
DEECIRTTNPVATEIYGCVCGTEPNQNFGSQQS

SEQ ID NO: 145636 - protein, 28 aa, Artificial Sequence
  Description of Artificial Sequence: Synthetic peptide
QESEIASTNPVGTEGYGVMASYLQHGDI

SEQ ID NO: 145637 - protein, 28 aa, Artificial Sequence
  Description of Artificial Sequence: Synthetic peptide
QESEIASTNPVGTEGYGVMASYLQTGDI

SEQ ID NO: 145638 - protein, 29 aa, Artificial Sequence
  Description of Artificial Sequence: Synthetic peptide
QESEIASTNPVGTEGYGVMASYTLQHGDI

SEQ ID NO: 145639 - protein, 37 aa, Artificial Sequence
  Description of Artificial Sequence: Synthetic polypeptide
AEEEIRTTNPVATEQYGSVSTVVNQNNNEDEGTNNSD

SEQ ID NO: 145640 - protein, 29 aa, Artificial Sequence
  Description of Artificial Sequence: Synthetic peptide
QESEIASTNPVGTEGYGVMATSTLQHGDI

SEQ ID NO: 145641 - protein, 29 aa, Artificial Sequence
  Description of Artificial Sequence: Synthetic peptide
QESEIASTNPVGTEGYGVMATTLQHEGDI

SEQ ID NO: 145642 - protein, 29 aa, Artificial Sequence
  Description of Artificial Sequence: Synthetic peptide
QENEIATTNPVATEQYGDAPEVCQNHEEK

SEQ ID NO: 145643 - protein, 29 aa, Artificial Sequence
  Description of Artificial Sequence: Synthetic peptide
QENEIATTNPVATEQYGDAPEVCQNHEDK

SEQ ID NO: 145644 - protein, 28 aa, Artificial Sequence
  Description of Artificial Sequence: Synthetic peptide
QESEIASTNPVGTEGYGVMAYTLQYGDI

SEQ ID NO: 145645 - protein, 29 aa, Artificial Sequence
  Description of Artificial Sequence: Synthetic peptide
QESEIASTNPVGTEGYGVMCASTLQHGDI

SEQ ID NO: 145646 - protein, 29 aa, Artificial Sequence
  Description of Artificial Sequence: Synthetic peptide
QESEIASTNPVGTEGYGVMCSHTLQHGDI

SEQ ID NO: 145647 - protein, 33 aa, Artificial Sequence
  Description of Artificial Sequence: Synthetic polypeptide
AEMEIVTTNPVATEQYGTVCSAEDGPVQFEGND

SEQ ID NO: 145648 - protein, 36 aa, Artificial Sequence
  Description of Artificial Sequence: Synthetic polypeptide
AEEEIRTTNPVATEQYGVVVVTVVNEQAGSNQQIDE

SEQ ID NO: 145649 - protein, 29 aa, Artificial Sequence
  Description of Artificial Sequence: Synthetic peptide
QESEIASTNPVGTEGYGVMHTSTLQHGDI

SEQ ID NO: 145650 - protein, 28 aa, Artificial Sequence
  Description of Artificial Sequence: Synthetic peptide
QESEIASTNPVGTEGYGVMISTYQHGDI

SEQ ID NO: 145651 - protein, 36 aa, Artificial Sequence
  Description of Artificial Sequence: Synthetic polypeptide
DTEEIRTTNPCATEAYGVVSTVTNNNLQQGTDENDE

SEQ ID NO: 145652 - protein, 29 aa, Artificial Sequence
  Description of Artificial Sequence: Synthetic peptide
QESEIASTNPVGTEGYGVMKSTLQHGDTI

SEQ ID NO: 145653 - protein, 29 aa, Artificial Sequence
  Description of Artificial Sequence: Synthetic peptide
QESEIASTNPVGTEGYGVMLASTLQHGDI

SEQ ID NO: 145654 - protein, 36 aa, Artificial Sequence
  Description of Artificial Sequence: Synthetic polypeptide
DTEEIRTTNPCATEAYGVVSTVNNLQLQQGTEEGND

SEQ ID NO: 145655 - protein, 29 aa, Artificial Sequence
  Description of Artificial Sequence: Synthetic peptide
QESEIASTNPVGTEGYGVMMSTLQHGKDI

SEQ ID NO: 145656 - protein, 29 aa, Artificial Sequence
  Description of Artificial Sequence: Synthetic peptide
QESEIASTNPVGTEGYGVMNASTLQHGAI

SEQ ID NO: 145657 - protein, 29 aa, Artificial Sequence
  Description of Artificial Sequence: Synthetic peptide
QESEIASTNPVGTEGYGVMNASTLQHGDI

SEQ ID NO: 145658 - protein, 29 aa, Artificial Sequence
  Description of Artificial Sequence: Synthetic peptide
QESEIASTNPVGTEGYGVMNSTLGQHGDI

SEQ ID NO: 145659 - protein, 29 aa, Artificial Sequence
  Description of Artificial Sequence: Synthetic peptide
QESEIASTNPVGTEGYGVMNSTLQHGDAI

SEQ ID NO: 145660 - protein, 35 aa, Artificial Sequence
  Description of Artificial Sequence: Synthetic polypeptide
IEGEIRTTNPVATEQYGSCTTTWDNNQENGNEDQQ

SEQ ID NO: 145661 - protein, 29 aa, Artificial Sequence
  Description of Artificial Sequence: Synthetic peptide
QESEIASTNPVGTEGYGVMPASTLQHGDI

SEQ ID NO: 145662 - protein, 28 aa, Artificial Sequence
  Description of Artificial Sequence: Synthetic peptide
QENEIATTNPVATEQWGDASEVEMHEEA

SEQ ID NO: 145663 - protein, 29 aa, Artificial Sequence
  Description of Artificial Sequence: Synthetic peptide
QESEIASTNPVGTEGYGVMPASTLQHGDN

SEQ ID NO: 145664 - protein, 28 aa, Artificial Sequence
  Description of Artificial Sequence: Synthetic peptide
QESEIASTNPVGTEGYGVMPEVLQHGDI

SEQ ID NO: 145665 - protein, 28 aa, Artificial Sequence
  Description of Artificial Sequence: Synthetic peptide
QESEIASTNPVGTEGYGVMPSTLQHEDK

SEQ ID NO: 145666 - protein, 34 aa, Artificial Sequence
  Description of Artificial Sequence: Synthetic polypeptide
IEMEIRTTNPVATEQYGSVTPANLMELFEDNQIM

SEQ ID NO: 145667 - protein, 28 aa, Artificial Sequence
  Description of Artificial Sequence: Synthetic peptide
QESEIASTNPVGTEGYGVMHSTLQHEDI

SEQ ID NO: 145668 - protein, 29 aa, Artificial Sequence
  Description of Artificial Sequence: Synthetic peptide
QESEIASTNPVGTEGYGVTASTLQHGDIM

SEQ ID NO: 145669 - protein, 36 aa, Artificial Sequence
  Description of Artificial Sequence: Synthetic polypeptide
DTEEIRTTNPCATEAYGVVSTVTTNLQAGTEENETE

SEQ ID NO: 145670 - protein, 29 aa, Artificial Sequence
  Description of Artificial Sequence: Synthetic peptide
QESEIASTNPVGTEGYGVMHASTLQHGDI

SEQ ID NO: 145671 - protein, 29 aa, Artificial Sequence
  Description of Artificial Sequence: Synthetic peptide
QESEIASTNPVGTEGYGVMCSQTLQHGDI

SEQ ID NO: 145672 - protein, 37 aa, Artificial Sequence
  Description of Artificial Sequence: Synthetic polypeptide
IEEEIRTTNPVATEQYGSVQCPGSAELQPDRLLFENT

SEQ ID NO: 145673 - protein, 33 aa, Artificial Sequence
  Description of Artificial Sequence: Synthetic polypeptide
AEMEIVTTNPVATEQYGTVCSATDGPGEFEGND

SEQ ID NO: 145674 - protein, 29 aa, Artificial Sequence
  Description of Artificial Sequence: Synthetic peptide
QESEIASTNPVGTEGYGVMCSTLQHGDLI

SEQ ID NO: 145675 - protein, 30 aa, Artificial Sequence
  Description of Artificial Sequence: Synthetic polypeptide
QENEIATTNPVATEQWGDVSEIEQNAAEEA

SEQ ID NO: 145676 - protein, 36 aa, Artificial Sequence
  Description of Artificial Sequence: Synthetic polypeptide
AEEEIRTTNPVATEQYGVVVVVSTTLNQQGTEEGVE

SEQ ID NO: 145677 - protein, 29 aa, Artificial Sequence
  Description of Artificial Sequence: Synthetic peptide
QESEIASTNPVGTEGYGVMDASTLQHGDI

SEQ ID NO: 145678 - protein, 29 aa, Artificial Sequence
  Description of Artificial Sequence: Synthetic peptide
QENEIATTNPVATEQWGDVSEIEMNHEEA

SEQ ID NO: 145679 - protein, 33 aa, Artificial Sequence
  Description of Artificial Sequence: Synthetic polypeptide
AEMEIVTTNPVATEQYGTVCSATDGPVEFEGND

SEQ ID NO: 145680 - protein, 29 aa, Artificial Sequence
  Description of Artificial Sequence: Synthetic peptide
QESEIASTNPVGTEGYGVMEASTLQHGDY

SEQ ID NO: 145681 - protein, 29 aa, Artificial Sequence
  Description of Artificial Sequence: Synthetic peptide
QESEIASTNPVGTEGYGVMESTLQHGDIN

SEQ ID NO: 145682 - protein, 28 aa, Artificial Sequence
  Description of Artificial Sequence: Synthetic peptide
QESEIASTNPVGTEGYGVMESYLQHGDI

SEQ ID NO: 145683 - protein, 36 aa, Artificial Sequence
  Description of Artificial Sequence: Synthetic polypeptide
IEEEIRTTNPVATEQYGSVSSTTPAGPNMRNPMNPV

SEQ ID NO: 145684 - protein, 30 aa, Artificial Sequence
  Description of Artificial Sequence: Synthetic polypeptide
QESEIASTNPVGTEGYGVMGASTDLQHGDI

SEQ ID NO: 145685 - protein, 29 aa, Artificial Sequence
  Description of Artificial Sequence: Synthetic peptide
QESEIASTNPVGTEGYGVMGASTLQHGDI

SEQ ID NO: 145686 - protein, 35 aa, Artificial Sequence
  Description of Artificial Sequence: Synthetic polypeptide
DEECIRTTNPVATEAWGESVRTWNDDDQDRQEKAR

SEQ ID NO: 145687 - protein, 37 aa, Artificial Sequence
  Description of Artificial Sequence: Synthetic polypeptide
AEEEIRTTNPVATEQYGVVVVVSNTTNLQAGTEEGTV

SEQ ID NO: 145688 - protein, 29 aa, Artificial Sequence
  Description of Artificial Sequence: Synthetic peptide
QESEIASTNPVGTEGYGVMGSTLQHGDIN

SEQ ID NO: 145689 - protein, 33 aa, Artificial Sequence
  Description of Artificial Sequence: Synthetic polypeptide
AEMEIVTTNPVATEQYGTVCSATDNPVEFEGGD

SEQ ID NO: 145690 - protein, 36 aa, Artificial Sequence
  Description of Artificial Sequence: Synthetic polypeptide
DTEEIRTTNPCATEAYGVVSTVVTNLQAGTDENEDE

SEQ ID NO: 145691 - protein, 28 aa, Artificial Sequence
  Description of Artificial Sequence: Synthetic peptide
QESEINSTNPVGTEGYGVMASTRQHGDI

SEQ ID NO: 145692 - protein, 28 aa, Artificial Sequence
  Description of Artificial Sequence: Synthetic peptide
QESEIASTNPVGTEGYGVTASTLQHNDI

SEQ ID NO: 145693 - protein, 37 aa, Artificial Sequence
  Description of Artificial Sequence: Synthetic polypeptide
AEEEIRTTNPVATEQYGVVVVSVTNQNQEQGTNNEDE

SEQ ID NO: 145694 - protein, 35 aa, Artificial Sequence
  Description of Artificial Sequence: Synthetic polypeptide
LEPEIRTTNPVATEQYGSVISTVEDLEDNGSSQIL

SEQ ID NO: 145695 - protein, 28 aa, Artificial Sequence
  Description of Artificial Sequence: Synthetic peptide
QESEIASTNPVGTEQYGEMPSVCQHGDI

SEQ ID NO: 145696 - protein, 28 aa, Artificial Sequence
  Description of Artificial Sequence: Synthetic peptide
QESEIASTNPVGTEQYGEMPSVCQHGEI

SEQ ID NO: 145697 - protein, 36 aa, Artificial Sequence
  Description of Artificial Sequence: Synthetic polypeptide
DEEEIGTTNPVATEQYGCVCSMTGEHQENFGSNTQS

SEQ ID NO: 145698 - protein, 31 aa, Artificial Sequence
  Description of Artificial Sequence: Synthetic polypeptide
QENEIATTNPVATEEYGCVSWELQHFESELA

SEQ ID NO: 145699 - protein, 31 aa, Artificial Sequence
  Description of Artificial Sequence: Synthetic polypeptide
QENEIATTNPVATECYGWVVKSKECLQSEEL

SEQ ID NO: 145700 - protein, 32 aa, Artificial Sequence
  Description of Artificial Sequence: Synthetic polypeptide
QESEIASTNPVGTEQYGSVSASPTLQHNGDPV

SEQ ID NO: 145701 - protein, 37 aa, Artificial Sequence
  Description of Artificial Sequence: Synthetic polypeptide
DTEEIRATNPVATEQYGSVSTVTNNQNQAGNNNQQND

SEQ ID NO: 145702 - protein, 31 aa, Artificial Sequence
  Description of Artificial Sequence: Synthetic polypeptide
QENEIATTNPVATEFYGDVVEGNGQGEGEEL

SEQ ID NO: 145703 - protein, 33 aa, Artificial Sequence
  Description of Artificial Sequence: Synthetic polypeptide
QESEIASTNPVGTEQYGSVSSTTTLPQHNGMDV

SEQ ID NO: 145704 - protein, 30 aa, Artificial Sequence
  Description of Artificial Sequence: Synthetic polypeptide
QESEIASTNPVGTEQYGVMAASTLVEHGNI

SEQ ID NO: 145705 - protein, 38 aa, Artificial Sequence
  Description of Artificial Sequence: Synthetic polypeptide
DTEEIRATNPVATEQYGSVSTVTDNQLQLGNQQGTDDT

SEQ ID NO: 145706 - protein, 37 aa, Artificial Sequence
  Description of Artificial Sequence: Synthetic polypeptide
DTEEIRATNPVATEQYGSVSTVQNQNQNEQQGTNNNE

SEQ ID NO: 145707 - protein, 30 aa, Artificial Sequence
  Description of Artificial Sequence: Synthetic polypeptide
AENEIACTNPIATEQWGAAWAENLQPKGPR

SEQ ID NO: 145708 - protein, 38 aa, Artificial Sequence
  Description of Artificial Sequence: Synthetic polypeptide
DEEEIRTTNPVATEQYGSFVISPTYNQETERSEEQNVT

SEQ ID NO: 145709 - protein, 38 aa, Artificial Sequence
  Description of Artificial Sequence: Synthetic polypeptide
DTEEIRATNPVATEQYGSVSTTVTNQLQQGNQQGTDDT

SEQ ID NO: 145710 - protein, 37 aa, Artificial Sequence
  Description of Artificial Sequence: Synthetic polypeptide
DTEEIRATNPVATEQYGSVSTTTNNNNQAGTNNQQQD

SEQ ID NO: 145711 - protein, 28 aa, Artificial Sequence
  Description of Artificial Sequence: Synthetic peptide
QESEIASTNPVGTEQYGVMASGLEHGDI

SEQ ID NO: 145712 - protein, 28 aa, Artificial Sequence
  Description of Artificial Sequence: Synthetic peptide
QESEIASTNPVGTEQYGVAAEVLQHEDI

SEQ ID NO: 145713 - protein, 35 aa, Artificial Sequence
  Description of Artificial Sequence: Synthetic polypeptide
DEEEIGTTNPVATEQYGCVCSNTEDHQENMGSQLA

SEQ ID NO: 145714 - protein, 34 aa, Artificial Sequence
  Description of Artificial Sequence: Synthetic polypeptide
LENEIRTTNPVATEQYGSVCSVTWPVEDDNGIEM

SEQ ID NO: 145715 - protein, 28 aa, Artificial Sequence
  Description of Artificial Sequence: Synthetic peptide
QESEIASTNPVGTEQWGVMASTLMAGDI

SEQ ID NO: 145716 - protein, 29 aa, Artificial Sequence
  Description of Artificial Sequence: Synthetic peptide
QESEIASTNPVGTEPYGVAAYSTLQHGDI

SEQ ID NO: 145717 - protein, 30 aa, Artificial Sequence
  Description of Artificial Sequence: Synthetic polypeptide
QESEIASTNPVGTEPYGVIACSTELQHGDI

SEQ ID NO: 145718 - protein, 30 aa, Artificial Sequence
  Description of Artificial Sequence: Synthetic polypeptide
QENEIATTNPVATEGYGCVSWEDQHISELS

SEQ ID NO: 145719 - protein, 29 aa, Artificial Sequence
  Description of Artificial Sequence: Synthetic peptide
QESEIASTNPVGTEPYGVMASFTLQHGDI

SEQ ID NO: 145720 - protein, 28 aa, Artificial Sequence
  Description of Artificial Sequence: Synthetic peptide
QESEIASTNPVGTEPYGVMASTHQHGDI

SEQ ID NO: 145721 - protein, 30 aa, Artificial Sequence
  Description of Artificial Sequence: Synthetic polypeptide
QENEIATTNPVATEGYGCVCSWYHQHISEL

SEQ ID NO: 145722 - protein, 29 aa, Artificial Sequence
  Description of Artificial Sequence: Synthetic peptide
QESEIASTNPVGTEPYGVMASTLQHGGDD

SEQ ID NO: 145723 - protein, 33 aa, Artificial Sequence
  Description of Artificial Sequence: Synthetic polypeptide
DEECIRCTNPVATEQYGCVCSWNHAEHFGSDQS

SEQ ID NO: 145724 - protein, 37 aa, Artificial Sequence
  Description of Artificial Sequence: Synthetic polypeptide
AEEEIRTTNPVATEQYGVVVTVTNLQLGNVEQGTNDE

SEQ ID NO: 145725 - protein, 34 aa, Artificial Sequence
  Description of Artificial Sequence: Synthetic polypeptide
DEECIRCTNPVATEQYGCVCSWNDHQHFGSDTQS

SEQ ID NO: 145726 - protein, 30 aa, Artificial Sequence
  Description of Artificial Sequence: Synthetic polypeptide
QENEIATTNPVATEGYGCVCSWEHQHMELA

SEQ ID NO: 145727 - protein, 37 aa, Artificial Sequence
  Description of Artificial Sequence: Synthetic polypeptide
DEEEIRTTNPVATEQYGSVSLNNLPGIENTEALQVQT

SEQ ID NO: 145728 - protein, 31 aa, Artificial Sequence
  Description of Artificial Sequence: Synthetic polypeptide
QENEIATTNPVATEGYGCVCSNWELQHNELA

SEQ ID NO: 145729 - protein, 35 aa, Artificial Sequence
  Description of Artificial Sequence: Synthetic polypeptide
DEECIRCTNPVATEQYGCVCSWGNDQEYFGSDNQS

SEQ ID NO: 145730 - protein, 30 aa, Artificial Sequence
  Description of Artificial Sequence: Synthetic polypeptide
LENEIRTTNPVATEQWGDVSEIEMNAAEDA

SEQ ID NO: 145731 - protein, 30 aa, Artificial Sequence
  Description of Artificial Sequence: Synthetic polypeptide
LENEIRTTNPVATEQWGDVSLIEMNAAEDA

SEQ ID NO: 145732 - protein, 38 aa, Artificial Sequence
  Description of Artificial Sequence: Synthetic polypeptide
DEEEIRTTNPVATEQYGSFVSSTTPAGPNMRNGMNPVW

SEQ ID NO: 145733 - protein, 30 aa, Artificial Sequence
  Description of Artificial Sequence: Synthetic polypeptide
LENEIRTTNPVATEQWGDVSVIEMNAAEDA

SEQ ID NO: 145734 - protein, 35 aa, Artificial Sequence
  Description of Artificial Sequence: Synthetic polypeptide
DEECIRCTNPVATEQYGCVCSWENHNQERFGSDQS

SEQ ID NO: 145735 - protein, 36 aa, Artificial Sequence
  Description of Artificial Sequence: Synthetic polypeptide
DEEEIRTTNPVATEQYGSVSLPVTVNPEPDILSLQA

SEQ ID NO: 145736 - protein, 29 aa, Artificial Sequence
  Description of Artificial Sequence: Synthetic peptide
QESEIASTNPVGTEPYGTMSSTLQQQGDI

SEQ ID NO: 145737 - protein, 36 aa, Artificial Sequence
  Description of Artificial Sequence: Synthetic polypeptide
DEEEIRTTNPVATEQYGSTSSTTPAGPNMRNGMPPV

SEQ ID NO: 145738 - protein, 28 aa, Artificial Sequence
  Description of Artificial Sequence: Synthetic peptide
QESEIASTNPVGTEQYGVMASTCQHEDI

SEQ ID NO: 145739 - protein, 29 aa, Artificial Sequence
  Description of Artificial Sequence: Synthetic peptide
QESEIASTNPVGTEQYGVVASTGNHGMDI

SEQ ID NO: 145740 - protein, 37 aa, Artificial Sequence
  Description of Artificial Sequence: Synthetic polypeptide
DTEEIRATNPVATEQYGSVSTNTTNNNNQQQGTNNNE

SEQ ID NO: 145741 - protein, 30 aa, Artificial Sequence
  Description of Artificial Sequence: Synthetic polypeptide
QESEIASTNPVGTEQYGVVASTGNHNGMDI

SEQ ID NO: 145742 - protein, 34 aa, Artificial Sequence
  Description of Artificial Sequence: Synthetic polypeptide
DEEEICTTNPVAYERYGHVVSCSNSLSQVSGGEQ

SEQ ID NO: 145743 - protein, 32 aa, Artificial Sequence
  Description of Artificial Sequence: Synthetic polypeptide
QESEIASTNPVGTEQYGVVSSTTTLPQHGMDV

SEQ ID NO: 145744 - protein, 33 aa, Artificial Sequence
  Description of Artificial Sequence: Synthetic polypeptide
MDAEIRTTNPVATEQYGSVTTYEDSDELGNEQE

SEQ ID NO: 145745 - protein, 30 aa, Artificial Sequence
  Description of Artificial Sequence: Synthetic polypeptide
QESEIASTNPVGTERYGVIASTELQHGGDI

SEQ ID NO: 145746 - protein, 37 aa, Artificial Sequence
  Description of Artificial Sequence: Synthetic polypeptide
DEEEIRTTNPVATEQYGSTTSSTAPAGPNMRNGMNPV

SEQ ID NO: 145747 - protein, 34 aa, Artificial Sequence
  Description of Artificial Sequence: Synthetic polypeptide
DEEEICTTNPVGTYAWGEVVSCTNMISQSGNNRW

SEQ ID NO: 145748 - protein, 29 aa, Artificial Sequence
  Description of Artificial Sequence: Synthetic peptide
QESEIASTNPVGTERYGVMTASTLQHGDI

SEQ ID NO: 145749 - protein, 28 aa, Artificial Sequence
  Description of Artificial Sequence: Synthetic peptide
QESEIASTNPVGTETYGVMASTLQHMDI

SEQ ID NO: 145750 - protein, 31 aa, Artificial Sequence
  Description of Artificial Sequence: Synthetic polypeptide
AENEIACTNPIATEQYGETWSNEDLQRGGYI

SEQ ID NO: 145751 - protein, 29 aa, Artificial Sequence
  Description of Artificial Sequence: Synthetic peptide
QESEIASTNPVGTETYGVMASTLSQHGDI

SEQ ID NO: 145752 - protein, 33 aa, Artificial Sequence
  Description of Artificial Sequence: Synthetic polypeptide
MDTEIRTTNPVATEQYGSVTTTYVEAELGNEQV

SEQ ID NO: 145753 - protein, 29 aa, Artificial Sequence
  Description of Artificial Sequence: Synthetic peptide
QESEIASTNPVGTEVYGVMAASTLQHGDI

SEQ ID NO: 145754 - protein, 28 aa, Artificial Sequence
  Description of Artificial Sequence: Synthetic peptide
QESEIASTNPVGTEVYGVMAETLQHGDI

SEQ ID NO: 145755 - protein, 35 aa, Artificial Sequence
  Description of Artificial Sequence: Synthetic polypeptide
MEDEICTTNPVATEQYGSVTDTGGQLQEEMGNGEN

SEQ ID NO: 145756 - protein, 29 aa, Artificial Sequence
  Description of Artificial Sequence: Synthetic peptide
QESEIASTNPVGTEWGYGVMASTLQHGDI

SEQ ID NO: 145757 - protein, 32 aa, Artificial Sequence
  Description of Artificial Sequence: Synthetic polypeptide
MDQEIRTTNPVATEQYGSVTYENGEDGSEQQS

SEQ ID NO: 145758 - protein, 34 aa, Artificial Sequence
  Description of Artificial Sequence: Synthetic polypeptide
DEEEICTTNPVGTYAWGSVVACTNMLSQSGNNLW

SEQ ID NO: 145759 - protein, 31 aa, Artificial Sequence
  Description of Artificial Sequence: Synthetic polypeptide
QESEIASTNPVGTEQYGVMCSASTLVEHGNI

SEQ ID NO: 145760 - protein, 35 aa, Artificial Sequence
  Description of Artificial Sequence: Synthetic polypeptide
DEECIRCTNPVATEPYGSVSWNEGEQERQRMNGTE

SEQ ID NO: 145761 - protein, 33 aa, Artificial Sequence
  Description of Artificial Sequence: Synthetic polypeptide
LESEIRTTNPVATACWGDVSCINEPLDREGENG

SEQ ID NO: 145762 - protein, 37 aa, Artificial Sequence
  Description of Artificial Sequence: Synthetic polypeptide
DEEEIRTTNPVATEQYGSVSLPVTVNQQEVFILSPQA

SEQ ID NO: 145763 - protein, 29 aa, Artificial Sequence
  Description of Artificial Sequence: Synthetic peptide
QESEIASTNPVGTEQYGVMASTEQHAGDI

SEQ ID NO: 145764 - protein, 29 aa, Artificial Sequence
  Description of Artificial Sequence: Synthetic peptide
QESEIASTNPVGTEQYGVMASTLEHGDDI

SEQ ID NO: 145765 - protein, 34 aa, Artificial Sequence
  Description of Artificial Sequence: Synthetic polypeptide
DEECIRCTNPVATEQYGCVCSWEDDQEYFGSNQS

SEQ ID NO: 145766 - protein, 29 aa, Artificial Sequence
  Description of Artificial Sequence: Synthetic peptide
QESEIASTNPVGTEQYGVMASTLEHGEDI

SEQ ID NO: 145767 - protein, 30 aa, Artificial Sequence
  Description of Artificial Sequence: Synthetic polypeptide
QESEIASTNPVGTEQYGVMASTLPQMHGDI

SEQ ID NO: 145768 - protein, 34 aa, Artificial Sequence
  Description of Artificial Sequence: Synthetic polypeptide
DEECIRCTNPVATEQYGCVCSNWNHNQHFGSDQS

SEQ ID NO: 145769 - protein, 36 aa, Artificial Sequence
  Description of Artificial Sequence: Synthetic polypeptide
DEEEIRTTNPVATEQYGSVSLTAQLDLPSEMVLEVW

SEQ ID NO: 145770 - protein, 30 aa, Artificial Sequence
  Description of Artificial Sequence: Synthetic polypeptide
QESEIASTNPVGTEQYGVMASTLQDHEGDI

SEQ ID NO: 145771 - protein, 36 aa, Artificial Sequence
  Description of Artificial Sequence: Synthetic polypeptide
DEEEIECTNPVATEQYGSVSSTTPAGPNMRNGMNPV

SEQ ID NO: 145772 - protein, 34 aa, Artificial Sequence
  Description of Artificial Sequence: Synthetic polypeptide
DEEEICTTNPVGYYAWGSVVSTNMLSQSEGGPRW

SEQ ID NO: 145773 - protein, 31 aa, Artificial Sequence
  Description of Artificial Sequence: Synthetic polypeptide
QENEIATTNPVATECYGTVSEECIQQHNENH

SEQ ID NO: 145774 - protein, 33 aa, Artificial Sequence
  Description of Artificial Sequence: Synthetic polypeptide
DEEEICTTNPVGYYAWGSVVSCTPMLTSGGNRW

SEQ ID NO: 145775 - protein, 33 aa, Artificial Sequence
  Description of Artificial Sequence: Synthetic polypeptide
DEEEICTTNPVGYDAWGCVVSTGNMLSQSGNAW

SEQ ID NO: 145776 - protein, 30 aa, Artificial Sequence
  Description of Artificial Sequence: Synthetic polypeptide
AENEIACTNPIATEQWGEAWAENLQPKGPR

SEQ ID NO: 145777 - protein, 35 aa, Artificial Sequence
  Description of Artificial Sequence: Synthetic polypeptide
DEEEICTTNPVGTYAWGSVVSTNMLSQSEGGNNVW

SEQ ID NO: 145778 - protein, 29 aa, Artificial Sequence
  Description of Artificial Sequence: Synthetic peptide
QESEIASTNPVGTEQYGVMASTLVEHGDI

SEQ ID NO: 145779 - protein, 35 aa, Artificial Sequence
  Description of Artificial Sequence: Synthetic polypeptide
DEEEICTTNPVGTYAWGSVVSCTNMLSQSTGNNTW

SEQ ID NO: 145780 - protein, 36 aa, Artificial Sequence
  Description of Artificial Sequence: Synthetic polypeptide
DEEEIRTTNPVATEQYGSTSSTTPAGPNMRNGMPYV

SEQ ID NO: 145781 - protein, 37 aa, Artificial Sequence
  Description of Artificial Sequence: Synthetic polypeptide
AEEEIRTTNPVATEQYGVVVTVTTNNGNLQQGTNNQD

SEQ ID NO: 145782 - protein, 29 aa, Artificial Sequence
  Description of Artificial Sequence: Synthetic peptide
QESEIASTNPVGTEPYGKMACSTLQHGDI

SEQ ID NO: 145783 - protein, 37 aa, Artificial Sequence
  Description of Artificial Sequence: Synthetic polypeptide
AEEEIRTTNPVATEQYGVVVTVVTTNLQQGNNEENEL

SEQ ID NO: 145784 - protein, 29 aa, Artificial Sequence
  Description of Artificial Sequence: Synthetic peptide
QESEIASTNPVGTEGYGVVCAETLQHGDI

SEQ ID NO: 145785 - protein, 36 aa, Artificial Sequence
  Description of Artificial Sequence: Synthetic polypeptide
AEEEIRTTNPVATEQYGVVVVSTTQLQQGTEAGTVD

SEQ ID NO: 145786 - protein, 29 aa, Artificial Sequence
  Description of Artificial Sequence: Synthetic peptide
QESEIASTNPVGTEGYGVVMASDLQHGDI

SEQ ID NO: 145787 - protein, 34 aa, Artificial Sequence
  Description of Artificial Sequence: Synthetic polypeptide
DTEEIRATNPVAYEPYGSVVPCTNELQNGGTQEI

SEQ ID NO: 145788 - protein, 35 aa, Artificial Sequence
  Description of Artificial Sequence: Synthetic polypeptide
DTEEIRATNPVAYEPYGQSVVPVYTNELQNGGTRA

SEQ ID NO: 145789 - protein, 30 aa, Artificial Sequence
  Description of Artificial Sequence: Synthetic polypeptide
QESEIASTNPVGTEGYGVVMASTLQCHGDI

SEQ ID NO: 145790 - protein, 33 aa, Artificial Sequence
  Description of Artificial Sequence: Synthetic polypeptide
DEECISTVNPVATEGYGCVCSWELERFGSNTQS

SEQ ID NO: 145791 - protein, 30 aa, Artificial Sequence
  Description of Artificial Sequence: Synthetic polypeptide
QESEIASTNPVGTEGYGVVMASTLQHGDIQ

SEQ ID NO: 145792 - protein, 30 aa, Artificial Sequence
  Description of Artificial Sequence: Synthetic polypeptide
QESEIASTNPVGTEGYGVVATTTLPQHGDI

SEQ ID NO: 145793 - protein, 30 aa, Artificial Sequence
  Description of Artificial Sequence: Synthetic polypeptide
QESEIASTNPVGTEGYGVVMEASTLQHGDI

SEQ ID NO: 145794 - protein, 36 aa, Artificial Sequence
  Description of Artificial Sequence: Synthetic polypeptide
DEEEIRTTNPVATEQYGSTNVLANMQQQHTNPTIED

SEQ ID NO: 145795 - protein, 36 aa, Artificial Sequence
  Description of Artificial Sequence: Synthetic polypeptide
DTEEIRATNPVATEQYGVVSTVVTNLQQGSTDQQED

SEQ ID NO: 145796 - protein, 31 aa, Artificial Sequence
  Description of Artificial Sequence: Synthetic polypeptide
QESEIASTNPVGTEGYGVVSCNEPQDHEGNI

SEQ ID NO: 145797 - protein, 37 aa, Artificial Sequence
  Description of Artificial Sequence: Synthetic polypeptide
DTEEIRATNPVATEQYGVVSTVVTNLNQQGNNQQGTD

SEQ ID NO: 145798 - protein, 31 aa, Artificial Sequence
  Description of Artificial Sequence: Synthetic polypeptide
QESEIASTNPVGTEGYGVVSCTEPQDHEGNI

SEQ ID NO: 145799 - protein, 31 aa, Artificial Sequence
  Description of Artificial Sequence: Synthetic polypeptide
QESEIASTNPVGTEGYGVVSSTEPQDHEGNI

SEQ ID NO: 145800 - protein, 29 aa, Artificial Sequence
  Description of Artificial Sequence: Synthetic peptide
QESEIASTNPVGTEGYGVVSSTLEHEGDI

SEQ ID NO: 145801 - protein, 37 aa, Artificial Sequence
  Description of Artificial Sequence: Synthetic polypeptide
DTEEIRATNPVATEQYGVVSTVVTNLGQAGNNQQNTD

SEQ ID NO: 145802 - protein, 37 aa, Artificial Sequence
  Description of Artificial Sequence: Synthetic polypeptide
DTEEIRATNPVATEQYGVVSTVVTNLTQQGNNNQQQD

SEQ ID NO: 145803 - protein, 34 aa, Artificial Sequence
  Description of Artificial Sequence: Synthetic polypeptide
LEDEIRTTNPVATEQYGSVSTWVDHTVEGQEDDL

SEQ ID NO: 145804 - protein, 34 aa, Artificial Sequence
  Description of Artificial Sequence: Synthetic polypeptide
LDNTIRTTNPVATEQYGAVSTNHQQVRIVANNTT

SEQ ID NO: 145805 - protein, 31 aa, Artificial Sequence
  Description of Artificial Sequence: Synthetic polypeptide
DTEEIRATNPVAYEQWGCSYQLDNHQQNGTN

SEQ ID NO: 145806 - protein, 29 aa, Artificial Sequence
  Description of Artificial Sequence: Synthetic peptide
QESEIASTNPVGTEGYGVTMASTLQHGDI

SEQ ID NO: 145807 - protein, 29 aa, Artificial Sequence
  Description of Artificial Sequence: Synthetic peptide
QESEIASTNPVGTEGYGVTMASTLQHGDQ

SEQ ID NO: 145808 - protein, 29 aa, Artificial Sequence
  Description of Artificial Sequence: Synthetic peptide
QESEIASTNPVGTEGYGVTMASTLQPGDI

SEQ ID NO: 145809 - protein, 28 aa, Artificial Sequence
  Description of Artificial Sequence: Synthetic peptide
KESAIASTNPVGTEGYGVMASTLQHGDI

SEQ ID NO: 145810 - protein, 28 aa, Artificial Sequence
  Description of Artificial Sequence: Synthetic peptide
QENEIATTNPVATEPYGEIPEVIQQEEK

SEQ ID NO: 145811 - protein, 28 aa, Artificial Sequence
  Description of Artificial Sequence: Synthetic peptide
QENEIATTNPVATEPYGEIPEVCQQEEK

SEQ ID NO: 145812 - protein, 30 aa, Artificial Sequence
  Description of Artificial Sequence: Synthetic polypeptide
QENEIATTNPVATEPYGEASMVCQQHNEEH

SEQ ID NO: 145813 - protein, 28 aa, Artificial Sequence
  Description of Artificial Sequence: Synthetic peptide
QENEIATTNPVATEPYGEAPEVCQHEEK

SEQ ID NO: 145814 - protein, 30 aa, Artificial Sequence
  Description of Artificial Sequence: Synthetic polypeptide
QENEIATTNPVATEPYGDVSMECIQQHEEL

SEQ ID NO: 145815 - protein, 33 aa, Artificial Sequence
  Description of Artificial Sequence: Synthetic polypeptide
DEEEIRATNPVATEQYGCVVGDNGEDEGGQQDT

SEQ ID NO: 145816 - protein, 36 aa, Artificial Sequence
  Description of Artificial Sequence: Synthetic polypeptide
DEEEIRATNPVATEQYGDVSINNGLGQQEGQGGGDE

SEQ ID NO: 145817 - protein, 34 aa, Artificial Sequence
  Description of Artificial Sequence: Synthetic polypeptide
DEEEIRTTNPVATEQYGSFYNVTLDVERQLLTDG

SEQ ID NO: 145818 - protein, 31 aa, Artificial Sequence
  Description of Artificial Sequence: Synthetic polypeptide
QESEIASTNPVGTEGYGVVASTEPQDHEGNI

SEQ ID NO: 145819 - protein, 37 aa, Artificial Sequence
  Description of Artificial Sequence: Synthetic polypeptide
AEEEIRTTNPVATEQYGVVVVSVTNNNNQEQGEENGD

SEQ ID NO: 145820 - protein, 32 aa, Artificial Sequence
  Description of Artificial Sequence: Synthetic polypeptide
DTEEIRATNPVAYEQWGCSYQMDNHQQRNGSE

SEQ ID NO: 145821 - protein, 30 aa, Artificial Sequence
  Description of Artificial Sequence: Synthetic polypeptide
QESEIASTNPVGTEGYGVVASTIQSHVGDR

SEQ ID NO: 145822 - protein, 35 aa, Artificial Sequence
  Description of Artificial Sequence: Synthetic polypeptide
DEEEIRTTNPVATEQYGSTNPYLMMQPGQGEELQW

SEQ ID NO: 145823 - protein, 32 aa, Artificial Sequence
  Description of Artificial Sequence: Synthetic polypeptide
DTEEIRATNPVAYEQWGCSYQMDNHQQNGMDR

SEQ ID NO: 145824 - protein, 30 aa, Artificial Sequence
  Description of Artificial Sequence: Synthetic polypeptide
QESEIASTNPVGTEGYGVVASTLQDHGEDI

SEQ ID NO: 145825 - protein, 37 aa, Artificial Sequence
  Description of Artificial Sequence: Synthetic polypeptide
DTEEIRATNPVATEQYGVVSTVVNNLQQLQQGNTDDE

SEQ ID NO: 145826 - protein, 37 aa, Artificial Sequence
  Description of Artificial Sequence: Synthetic polypeptide
DTEEIRATNPVATEQYGVVSTVVNNLNQQGNNNQNQD

SEQ ID NO: 145827 - protein, 34 aa, Artificial Sequence
  Description of Artificial Sequence: Synthetic polypeptide
DEEEIRATNPVATEQYGMVSIMDGEMQEGGGEQV

SEQ ID NO: 145828 - protein, 32 aa, Artificial Sequence
  Description of Artificial Sequence: Synthetic polypeptide
DEECISTVNPVATEGYGCVCSWNHENGSNFQS

SEQ ID NO: 145829 - protein, 34 aa, Artificial Sequence
  Description of Artificial Sequence: Synthetic polypeptide
DEEEIRTTNPVATEQYGSTPMNPGEQVEEVTEHQ

SEQ ID NO: 145830 - protein, 36 aa, Artificial Sequence
  Description of Artificial Sequence: Synthetic polypeptide
DTEEIRATNPVATEQYGSVVVTVTNLEQGNEGQTED

SEQ ID NO: 145831 - protein, 29 aa, Artificial Sequence
  Description of Artificial Sequence: Synthetic peptide
QESEIASTNPVGTEHYGVMASTLQVHGDI

SEQ ID NO: 145832 - protein, 37 aa, Artificial Sequence
  Description of Artificial Sequence: Synthetic polypeptide
DEEEIRTTNPVATEQYGSTPSYDNYLVDQSEMVEENV

SEQ ID NO: 145833 - protein, 29 aa, Artificial Sequence
  Description of Artificial Sequence: Synthetic peptide
QESEIASTNPVGTEIGYGVMASTLQHGDI

SEQ ID NO: 145834 - protein, 29 aa, Artificial Sequence
  Description of Artificial Sequence: Synthetic peptide
QESEIASTNPVGTEIYGVMASTLQHGDDI

SEQ ID NO: 145835 - protein, 36 aa, Artificial Sequence
  Description of Artificial Sequence: Synthetic polypeptide
DEEEIRTTNPVATEQYGSTQVAIGSQIENTEEANDM

SEQ ID NO: 145836 - protein, 28 aa, Artificial Sequence
  Description of Artificial Sequence: Synthetic peptide
QESEIASTNPVGTEKYGVMASGLQHGDI

SEQ ID NO: 145837 - protein, 29 aa, Artificial Sequence
  Description of Artificial Sequence: Synthetic peptide
QESEIASTNPVGTEKYGVMASSTLQHGCI

SEQ ID NO: 145838 - protein, 29 aa, Artificial Sequence
  Description of Artificial Sequence: Synthetic peptide
QESEIASTNPVGTEKYGVMASTLQHGDGI

SEQ ID NO: 145839 - protein, 34 aa, Artificial Sequence
  Description of Artificial Sequence: Synthetic polypeptide
LEEEIRTTNPVATEQYGSVAPAEWGDTESQEDQG

SEQ ID NO: 145840 - protein, 32 aa, Artificial Sequence
  Description of Artificial Sequence: Synthetic polypeptide
DEECISTVNPVATEGYGCVCSWNLENFNSNQS

SEQ ID NO: 145841 - protein, 36 aa, Artificial Sequence
  Description of Artificial Sequence: Synthetic polypeptide
DEEEIGTTNPVATEQYGCVCSTEDHNQEYFGSDNQA

SEQ ID NO: 145842 - protein, 34 aa, Artificial Sequence
  Description of Artificial Sequence: Synthetic polypeptide
DEEEIGTTNPVATEQYGCVCSSEEHNQNFNSDQD

SEQ ID NO: 145843 - protein, 29 aa, Artificial Sequence
  Description of Artificial Sequence: Synthetic peptide
QESEIASTNPVGTENYGVMASTLQHMGDI

SEQ ID NO: 145844 - protein, 29 aa, Artificial Sequence
  Description of Artificial Sequence: Synthetic peptide
QESEIASTNPVGTEPGYGVMASTLQHGDI

SEQ ID NO: 145845 - protein, 29 aa, Artificial Sequence
  Description of Artificial Sequence: Synthetic peptide
QESEIASTNPVGTEPWGVYYSTDLQHGDI

SEQ ID NO: 145846 - protein, 35 aa, Artificial Sequence
  Description of Artificial Sequence: Synthetic polypeptide
AEEEIRTTNPVATEQYGVVVVNTNDESGTVNNATG

SEQ ID NO: 145847 - protein, 33 aa, Artificial Sequence
  Description of Artificial Sequence: Synthetic polypeptide
DEECIRCTNPVATEQYGQSQSWRNSFEPGGKEI

SEQ ID NO: 145848 - protein, 37 aa, Artificial Sequence
  Description of Artificial Sequence: Synthetic polypeptide
DTEEIRATNPVATEQYGSVVVTVTNLQQGNNEGTTDT

SEQ ID NO: 145849 - protein, 37 aa, Artificial Sequence
  Description of Artificial Sequence: Synthetic polypeptide
DEEEIRTTNPVATEQYGSVSCPENGVPQMQYTVEEND

SEQ ID NO: 145850 - protein, 28 aa, Artificial Sequence
  Description of Artificial Sequence: Synthetic peptide
QESEIASTNPVGTEHWGVAYSTLQHGDI

SEQ ID NO: 145851 - protein, 34 aa, Artificial Sequence
  Description of Artificial Sequence: Synthetic polypeptide
DEEEIRTTNPVATEQYGSTPMNNIEQVEEVTEMQ

SEQ ID NO: 145852 - protein, 36 aa, Artificial Sequence
  Description of Artificial Sequence: Synthetic polypeptide
DTEEIRATNPVATEQYGVVSTTTNNQQQGNNNQQDE

SEQ ID NO: 145853 - protein, 36 aa, Artificial Sequence
  Description of Artificial Sequence: Synthetic polypeptide
DTEEIRATNPVATEQYGVVSTTTNNNQAGNNNQQED

SEQ ID NO: 145854 - protein, 37 aa, Artificial Sequence
  Description of Artificial Sequence: Synthetic polypeptide
DTEEIRATNPVATEQYGVVSTTNNNLGQQGNGNQQQD

SEQ ID NO: 145855 - protein, 29 aa, Artificial Sequence
  Description of Artificial Sequence: Synthetic peptide
QESEIASTNPVGTEGYGVWQASTLQHGDI

SEQ ID NO: 145856 - protein, 29 aa, Artificial Sequence
  Description of Artificial Sequence: Synthetic peptide
QESEIASTNPVGTEGYGVYASTLEQHGDI

SEQ ID NO: 145857 - protein, 31 aa, Artificial Sequence
  Description of Artificial Sequence: Synthetic polypeptide
QENEIATTNPVATEPWGNVSGEHLQHMNPKS

SEQ ID NO: 145858 - protein, 29 aa, Artificial Sequence
  Description of Artificial Sequence: Synthetic peptide
QESEIASTNPVGTEGYGVYCASTLQHGDI

SEQ ID NO: 145859 - protein, 29 aa, Artificial Sequence
  Description of Artificial Sequence: Synthetic peptide
QESEIASTNPVGTEGYGVYMASTLQHGDI

SEQ ID NO: 145860 - protein, 37 aa, Artificial Sequence
  Description of Artificial Sequence: Synthetic polypeptide
DTEEIRATNPVATEQYGSVVVVTTNLQQGNNGTTEDT

SEQ ID NO: 145861 - protein, 37 aa, Artificial Sequence
  Description of Artificial Sequence: Synthetic polypeptide
DTEEIRATNPVATEQYGSVVVTVTTNLQQGNNGTTDT

SEQ ID NO: 145862 - protein, 37 aa, Artificial Sequence
  Description of Artificial Sequence: Synthetic polypeptide
DTEEIRATNPVATEQYGSVVVTVTNQLQQGNNGTEET

SEQ ID NO: 145863 - protein, 37 aa, Artificial Sequence
  Description of Artificial Sequence: Synthetic polypeptide
DTEEIRATNPVATEQYGSVVVTVTNNLQQGNNGTTTD

SEQ ID NO: 145864 - protein, 37 aa, Artificial Sequence
  Description of Artificial Sequence: Synthetic polypeptide
DTEEIRATNPVATEQYGSVVVTVTNNLQQGNNGTTDT

SEQ ID NO: 145865 - protein, 35 aa, Artificial Sequence
  Description of Artificial Sequence: Synthetic polypeptide
DEEEIRTTNPVATEQYGSTPMNIEEEQVEEVTERQ

SEQ ID NO: 145866 - protein, 32 aa, Artificial Sequence
  Description of Artificial Sequence: Synthetic polypeptide
DEECISTVNPVATEGYGCVCSWNLEGFGSDQA

SEQ ID NO: 145867 - protein, 37 aa, Artificial Sequence
  Description of Artificial Sequence: Synthetic polypeptide
DTEEIRATNPVATEQYGSVVVTVTNLQQGNQGGTTDQ

SEQ ID NO: 145868 - protein, 30 aa, Artificial Sequence
  Description of Artificial Sequence: Synthetic polypeptide
QESEIASTNPVGTEGYGWVMASTLQHGDIS

SEQ ID NO: 145869 - protein, 37 aa, Artificial Sequence
  Description of Artificial Sequence: Synthetic polypeptide
DTEEIRATNPVATEQYGSVVVTVTNLQQGNNNDTQDT

SEQ ID NO: 145870 - protein, 30 aa, Artificial Sequence
  Description of Artificial Sequence: Synthetic polypeptide
QESEIASTNPVGTEGYGWVMASTLQSHGDI

SEQ ID NO: 145871 - protein, 36 aa, Artificial Sequence
  Description of Artificial Sequence: Synthetic polypeptide
LEEEIRTTNPVATEQYGNVSSTTPAGPNMRNGMNPV

SEQ ID NO: 145872 - protein, 35 aa, Artificial Sequence
  Description of Artificial Sequence: Synthetic polypeptide
MEEEIRTTNPVATEQYGSVMGTGDEGQGEEGGGIQ

SEQ ID NO: 145873 - protein, 35 aa, Artificial Sequence
  Description of Artificial Sequence: Synthetic polypeptide
MEEEIRTTNPVATEQYGSVMSGMIVDEGEGNGNGD

SEQ ID NO: 145874 - protein, 34 aa, Artificial Sequence
  Description of Artificial Sequence: Synthetic polypeptide
DSEEIRTTNPVAYEQWGSSYSLPNMLDQHQDNQS

SEQ ID NO: 145875 - protein, 33 aa, Artificial Sequence
  Description of Artificial Sequence: Synthetic polypeptide
DEDEIRTTNPVAYESWGSVCPEDGQGNGGNNDR

SEQ ID NO: 145876 - protein, 36 aa, Artificial Sequence
  Description of Artificial Sequence: Synthetic polypeptide
DEEEIRTTNPVATEQYGSCNNNLETNLWEQENDQIE

SEQ ID NO: 145877 - protein, 34 aa, Artificial Sequence
  Description of Artificial Sequence: Synthetic polypeptide
MEGEIRTTNPVATEQYGSCSPDLMQHENGDETQG

SEQ ID NO: 145878 - protein, 34 aa, Artificial Sequence
  Description of Artificial Sequence: Synthetic polypeptide
MEGEIRTTNPVATEQYGSCSPDNEGFEQGNEDQA

SEQ ID NO: 145879 - protein, 36 aa, Artificial Sequence
  Description of Artificial Sequence: Synthetic polypeptide
DEEEIRTTNPVATEQYGSCNNNEVELETLGNPETQD

SEQ ID NO: 145880 - protein, 28 aa, Artificial Sequence
  Description of Artificial Sequence: Synthetic peptide
QQSEIASTNPVGTEGYGVMASTLQEGDI

SEQ ID NO: 145881 - protein, 28 aa, Artificial Sequence
  Description of Artificial Sequence: Synthetic peptide
QSEEIATTNPVACEQYGEAPEVCQHEEK

SEQ ID NO: 145882 - protein, 35 aa, Artificial Sequence
  Description of Artificial Sequence: Synthetic polypeptide
MEGEIRTTNPVATEQYGSCSPDNMQSHESGNEDQG

SEQ ID NO: 145883 - protein, 35 aa, Artificial Sequence
  Description of Artificial Sequence: Synthetic polypeptide
DQAEIRTTNPVATEQYGCSCSNTGELNQHFGSDQS

SEQ ID NO: 145884 - protein, 35 aa, Artificial Sequence
  Description of Artificial Sequence: Synthetic polypeptide
MEGEIRTTNPVATEQYGSCSPPNDMQHENGNEDQG

SEQ ID NO: 145885 - protein, 36 aa, Artificial Sequence
  Description of Artificial Sequence: Synthetic polypeptide
DEEEIRTTNPVATEQYGSVASPTFSSEAQIVEVQVL

SEQ ID NO: 145886 - protein, 39 aa, Artificial Sequence
  Description of Artificial Sequence: Synthetic polypeptide
AEEEIRTTNPVATEQYGSVSTVTTNNNLEQGTEGGNVTD

SEQ ID NO: 145887 - protein, 36 aa, Artificial Sequence
  Description of Artificial Sequence: Synthetic polypeptide
DEEEIRTTNPVATEQYGSVSPAIHGQPQPVGVEQHV

SEQ ID NO: 145888 - protein, 37 aa, Artificial Sequence
  Description of Artificial Sequence: Synthetic polypeptide
DEEEIRTTNPVATEQYGSVASPTFSSLELQIVEVDVE

SEQ ID NO: 145889 - protein, 33 aa, Artificial Sequence
  Description of Artificial Sequence: Synthetic polypeptide
QSEEIRTTNPVAYHQYGSSVTETWHQGGNNAFY

SEQ ID NO: 145890 - protein, 34 aa, Artificial Sequence
  Description of Artificial Sequence: Synthetic polypeptide
MEGEIRTTNPVATEQYGSCSYTDHIWSRENEEHN

SEQ ID NO: 145891 - protein, 37 aa, Artificial Sequence
  Description of Artificial Sequence: Synthetic polypeptide
DEEEIRTTNPVATEQYGSVSPAISTQITNVTTQVSDG

SEQ ID NO: 145892 - protein, 31 aa, Artificial Sequence
  Description of Artificial Sequence: Synthetic polypeptide
QSGEIAPTNPCSYEQYGKVSCNLSQSGGTNR

SEQ ID NO: 145893 - protein, 36 aa, Artificial Sequence
  Description of Artificial Sequence: Synthetic polypeptide
DEEEIRTTNPVATEQYGSVSNWPWDMQEEHVPVNNE

SEQ ID NO: 145894 - protein, 33 aa, Artificial Sequence
  Description of Artificial Sequence: Synthetic polypeptide
DQAEIRTTNPVATEQYGCSCSSEHNQHFGSDQA

SEQ ID NO: 145895 - protein, 34 aa, Artificial Sequence
  Description of Artificial Sequence: Synthetic polypeptide
MEGEIRTTNPVATEQYGSCSCVDHIEQRENEEHN

SEQ ID NO: 145896 - protein, 29 aa, Artificial Sequence
  Description of Artificial Sequence: Synthetic peptide
QQEEIATTNPVATEQYGEAPEVCHQHEIK

SEQ ID NO: 145897 - protein, 36 aa, Artificial Sequence
  Description of Artificial Sequence: Synthetic polypeptide
DEEEIRTTNPVATEQYGSCNSPWNPPQETQIEDNGY

SEQ ID NO: 145898 - protein, 34 aa, Artificial Sequence
  Description of Artificial Sequence: Synthetic polypeptide
MEGEIRTTNPVATEQYGCVSTVNEAEIRTQDSEQ

SEQ ID NO: 145899 - protein, 36 aa, Artificial Sequence
  Description of Artificial Sequence: Synthetic polypeptide
DQAEIRTTNPVATEQYGSVSWATWNEEARFGDLPQV

SEQ ID NO: 145900 - protein, 34 aa, Artificial Sequence
  Description of Artificial Sequence: Synthetic polypeptide
MEGEIRTTNPVATEQYGCVSTYNGAEIREQDAEN

SEQ ID NO: 145901 - protein, 36 aa, Artificial Sequence
  Description of Artificial Sequence: Synthetic polypeptide
DQAEIRTTNPVATEQYGSVSTWANWNEEARNGDLDQ

SEQ ID NO: 145902 - protein, 33 aa, Artificial Sequence
  Description of Artificial Sequence: Synthetic polypeptide
MEGEIRTTNPVATEQYGCVYTNDVQQMIETQVQ

SEQ ID NO: 145903 - protein, 34 aa, Artificial Sequence
  Description of Artificial Sequence: Synthetic polypeptide
DQAEIRTTNPVATEQYGSVNTLWEQMESDEIDNV

SEQ ID NO: 145904 - protein, 34 aa, Artificial Sequence
  Description of Artificial Sequence: Synthetic polypeptide
DQAEIRTTNPVATEQYGSVCWPNEDQLESQNESQ

SEQ ID NO: 145905 - protein, 33 aa, Artificial Sequence
  Description of Artificial Sequence: Synthetic polypeptide
DQAEIRTTNPVATEQYGSCWTNEHQLESTEESQ

SEQ ID NO: 145906 - protein, 35 aa, Artificial Sequence
  Description of Artificial Sequence: Synthetic polypeptide
DQAEIRTTNPVATEQYGSCSVTNEHEQLESTNESQ

SEQ ID NO: 145907 - protein, 35 aa, Artificial Sequence
  Description of Artificial Sequence: Synthetic polypeptide
DEEEIRTTNPVATEQYGSCNNTQPLDEGMMEPEIV

SEQ ID NO: 145908 - protein, 28 aa, Artificial Sequence
  Description of Artificial Sequence: Synthetic peptide
QNSEIASTNPVGTEGYGVMASTLQTGDI

SEQ ID NO: 145909 - protein, 34 aa, Artificial Sequence
  Description of Artificial Sequence: Synthetic polypeptide
MEGEIRTTNPVATEQYGSCFSPDDTQENGQEDQG

SEQ ID NO: 145910 - protein, 37 aa, Artificial Sequence
  Description of Artificial Sequence: Synthetic polypeptide
DEEEIRTTNPVATEQYGSVASPTFSLLELEIVEVNDE

SEQ ID NO: 145911 - protein, 28 aa, Artificial Sequence
  Description of Artificial Sequence: Synthetic peptide
QQEEIATTNPLATEQYGEAPEVCQHEEK

SEQ ID NO: 145912 - protein, 33 aa, Artificial Sequence
  Description of Artificial Sequence: Synthetic polypeptide
DQAEIRTTNPVATEQYGCVSVLVDEQQGGIEVG

SEQ ID NO: 145913 - protein, 33 aa, Artificial Sequence
  Description of Artificial Sequence: Synthetic polypeptide
DQAEIRTTNPVATEQYGCVSTVVNDIEDTSIST

SEQ ID NO: 145914 - protein, 35 aa, Artificial Sequence
  Description of Artificial Sequence: Synthetic polypeptide
DEDEIRTTNPVAYESWGVVCSTIDGLHQNGQNGDR

SEQ ID NO: 145915 - protein, 35 aa, Artificial Sequence
  Description of Artificial Sequence: Synthetic polypeptide
MEGEIRTTNPVATEQYGSCSCGDHIWQREGNEEDN

SEQ ID NO: 145916 - protein, 36 aa, Artificial Sequence
  Description of Artificial Sequence: Synthetic polypeptide
DEEEIRTTNPVATEQYGSVSPALGLSQAVPDFVQVA

SEQ ID NO: 145917 - protein, 34 aa, Artificial Sequence
  Description of Artificial Sequence: Synthetic polypeptide
DQAEIRTTNPVATEQYGSVYQCWTLNEEDGSVQE

SEQ ID NO: 145918 - protein, 34 aa, Artificial Sequence
  Description of Artificial Sequence: Synthetic polypeptide
MEGEIRTTNPVATEQYGSCTSPNWALEPQVDDQG

SEQ ID NO: 145919 - protein, 29 aa, Artificial Sequence
  Description of Artificial Sequence: Synthetic peptide
QSNEIATTNPVATECYGDVTECLQGHEEL

SEQ ID NO: 145920 - protein, 34 aa, Artificial Sequence
  Description of Artificial Sequence: Synthetic polypeptide
MEGEIRTTNPVATEQYGSLSPDNESTENGNEDQG

SEQ ID NO: 145921 - protein, 34 aa, Artificial Sequence
  Description of Artificial Sequence: Synthetic polypeptide
DEEEICTTNPMATETYGSVPTTPDPQHASSENFR

SEQ ID NO: 145922 - protein, 31 aa, Artificial Sequence
  Description of Artificial Sequence: Synthetic polypeptide
DQAEIATTNPVAYEQWGCCGTWDDNQGHGNR

SEQ ID NO: 145923 - protein, 34 aa, Artificial Sequence
  Description of Artificial Sequence: Synthetic polypeptide
DEEEICTTNPMATETYGSVPTPDPQHASGENFLI

SEQ ID NO: 145924 - protein, 36 aa, Artificial Sequence
  Description of Artificial Sequence: Synthetic polypeptide
DEEEIRTTNPVATEQYGSVQVAGEEQTENTEEANAM

SEQ ID NO: 145925 - protein, 38 aa, Artificial Sequence
  Description of Artificial Sequence: Synthetic polypeptide
AEEEIRTTNPVATEQYGSVSTVTTNGNNQEEEGTNNVE

SEQ ID NO: 145926 - protein, 34 aa, Artificial Sequence
  Description of Artificial Sequence: Synthetic polypeptide
DEEEICTTNPMATETYGSVPTPDPQHASEENFRG

SEQ ID NO: 145927 - protein, 36 aa, Artificial Sequence
  Description of Artificial Sequence: Synthetic polypeptide
REEEIRTTNPVATENYGSVSSTTPAGPNMRNGMNPV

SEQ ID NO: 145928 - protein, 34 aa, Artificial Sequence
  Description of Artificial Sequence: Synthetic polypeptide
DEDEIRTTNPVAYEQYGTVYCTDNQNDRGQGGGA

SEQ ID NO: 145929 - protein, 37 aa, Artificial Sequence
  Description of Artificial Sequence: Synthetic polypeptide
AEEEIRTTNPVATEQYGSVSTVTQSQQGNTEAGNNLE

SEQ ID NO: 145930 - protein, 34 aa, Artificial Sequence
  Description of Artificial Sequence: Synthetic polypeptide
DPSEIRTTNPVATECWGYSVGCINEPQAREGENG

SEQ ID NO: 145931 - protein, 36 aa, Artificial Sequence
  Description of Artificial Sequence: Synthetic polypeptide
MEGEIRTTNPVATEQYGSVCSTTLLSEEEGGDFARD

SEQ ID NO: 145932 - protein, 38 aa, Artificial Sequence
  Description of Artificial Sequence: Synthetic polypeptide
AEEEIRTTNPVATEQYGSVSTVTQNQQEQGTTNVATED

SEQ ID NO: 145933 - protein, 35 aa, Artificial Sequence
  Description of Artificial Sequence: Synthetic polypeptide
DPESEIRTTNPVAYEAWGSVSCINWSQDREGGNTG

SEQ ID NO: 145934 - protein, 36 aa, Artificial Sequence
  Description of Artificial Sequence: Synthetic polypeptide
AEEEIRTTNPVATEQYGSVSTVTQNQNTEQGETETD

SEQ ID NO: 145935 - protein, 37 aa, Artificial Sequence
  Description of Artificial Sequence: Synthetic polypeptide
AEEEIRTTNPVATEQYGSVSTVTQNQNNTENGNNVED

SEQ ID NO: 145936 - protein, 37 aa, Artificial Sequence
  Description of Artificial Sequence: Synthetic polypeptide
DEEEIRTTNPVATEQYGSVSPCGNAVEFAADQLENDD

SEQ ID NO: 145937 - protein, 37 aa, Artificial Sequence
  Description of Artificial Sequence: Synthetic polypeptide
AEEEIRTTNPVATEQYGVVSTTTNNAQNGNDEGNNAE

SEQ ID NO: 145938 - protein, 36 aa, Artificial Sequence
  Description of Artificial Sequence: Synthetic polypeptide
DEEEIRTTNPVATEQYGSCNAVLNANEQLQPNEAQF

SEQ ID NO: 145939 - protein, 34 aa, Artificial Sequence
  Description of Artificial Sequence: Synthetic polypeptide
DEDEIRTTNPVAYEQYGTVYCTDVNQNDREGGGA

SEQ ID NO: 145940 - protein, 37 aa, Artificial Sequence
  Description of Artificial Sequence: Synthetic polypeptide
AEEEIRTTNPVATEQYGSVSTVTTNMEQGTNNTTDET

SEQ ID NO: 145941 - protein, 37 aa, Artificial Sequence
  Description of Artificial Sequence: Synthetic polypeptide
AEEEIRTTNPVATEQYGSVSTVTTNMEQGTNNVTEEE

SEQ ID NO: 145942 - protein, 28 aa, Artificial Sequence
  Description of Artificial Sequence: Synthetic peptide
QSSEIASTNPVGTEGYGVMASTLQHGDI

SEQ ID NO: 145943 - protein, 28 aa, Artificial Sequence
  Description of Artificial Sequence: Synthetic peptide
QSSEIASTNPVGTEGYGVMASTLQHGGI

SEQ ID NO: 145944 - protein, 29 aa, Artificial Sequence
  Description of Artificial Sequence: Synthetic peptide
QTEEIATTNPVATEQYGEAPEDVCQHEEK

SEQ ID NO: 145945 - protein, 37 aa, Artificial Sequence
  Description of Artificial Sequence: Synthetic polypeptide
DEEEIRTTNPVATEQYGSVSPAMSMQITNVTTQVSPG

SEQ ID NO: 145946 - protein, 28 aa, Artificial Sequence
  Description of Artificial Sequence: Synthetic peptide
QTEEIATTNPVATEQYGEAPEVCRHEEK

SEQ ID NO: 145947 - protein, 32 aa, Artificial Sequence
  Description of Artificial Sequence: Synthetic polypeptide
DEDEIRTTNPVAYERWGSVCVNDVAGDRGDLA

SEQ ID NO: 145948 - protein, 33 aa, Artificial Sequence
  Description of Artificial Sequence: Synthetic polypeptide
DEDEIRTTNPVAYERWGSVCVNDHAGDRGGDER

SEQ ID NO: 145949 - protein, 37 aa, Artificial Sequence
  Description of Artificial Sequence: Synthetic polypeptide
DEEEIRTTNPVATEQYGSVASPTVPAENFRQFQQADN

SEQ ID NO: 145950 - protein, 35 aa, Artificial Sequence
  Description of Artificial Sequence: Synthetic polypeptide
MEGEIRTTNPVATEQYGSCVSPPNEQHENANEDQG

SEQ ID NO: 145951 - protein, 36 aa, Artificial Sequence
  Description of Artificial Sequence: Synthetic polypeptide
MEGEIRTTNPVATEQYGSCVWVNELEQESGDDNYEG

SEQ ID NO: 145952 - protein, 34 aa, Artificial Sequence
  Description of Artificial Sequence: Synthetic polypeptide
DQAEIRTTNPVATEQYGCCCSTEALQHFGSDTQS

SEQ ID NO: 145953 - protein, 28 aa, Artificial Sequence
  Description of Artificial Sequence: Synthetic peptide
QTSEIASTNPVGTEGYGVMASTLQHGDI

SEQ ID NO: 145954 - protein, 28 aa, Artificial Sequence
  Description of Artificial Sequence: Synthetic peptide
QTYEIATTNPVATEQYGEAPEVCQHEEK

SEQ ID NO: 145955 - protein, 33 aa, Artificial Sequence
  Description of Artificial Sequence: Synthetic polypeptide
MEGEIRTTNPVATEQYGSCWPTVLLETMDGDHD

SEQ ID NO: 145956 - protein, 32 aa, Artificial Sequence
  Description of Artificial Sequence: Synthetic polypeptide
REECIRTTNPVAWEQYGQCCTITDVQGGGNNV

SEQ ID NO: 145957 - protein, 33 aa, Artificial Sequence
  Description of Artificial Sequence: Synthetic polypeptide
DEDEIRTTNPVAYERWGSVCVNDGAGDRTGDTR

SEQ ID NO: 145958 - protein, 33 aa, Artificial Sequence
  Description of Artificial Sequence: Synthetic polypeptide
DEDEIRTTNPVAYERWGSVCVNDGAGDQGGDAR

SEQ ID NO: 145959 - protein, 33 aa, Artificial Sequence
  Description of Artificial Sequence: Synthetic polypeptide
DEDEIRTTNPVAYERWGSVCVNDDQGDRQGDTD

SEQ ID NO: 145960 - protein, 33 aa, Artificial Sequence
  Description of Artificial Sequence: Synthetic polypeptide
DEDEIRTTNPVAYERWGSVCVNDDAGDTRGDHR

SEQ ID NO: 145961 - protein, 36 aa, Artificial Sequence
  Description of Artificial Sequence: Synthetic polypeptide
DEEEIRTTNPVATEQYGSVSPAMNAPDGDQIMMQED

SEQ ID NO: 145962 - protein, 35 aa, Artificial Sequence
  Description of Artificial Sequence: Synthetic polypeptide
DEEEIRTTNPVATEQYGSCNSQPQQGEAQPEPQRN

SEQ ID NO: 145963 - protein, 30 aa, Artificial Sequence
  Description of Artificial Sequence: Synthetic polypeptide
QENEIATTNPVATECYGDVSECRFAQHEEL

SEQ ID NO: 145964 - protein, 32 aa, Artificial Sequence
  Description of Artificial Sequence: Synthetic polypeptide
DEDEIRTTNPVSTEPYGTISEEDIIQIQNGNG

SEQ ID NO: 145965 - protein, 35 aa, Artificial Sequence
  Description of Artificial Sequence: Synthetic polypeptide
DQEEIRTTNPVATEQYGCVSTVESAMTLEGNEDFD

SEQ ID NO: 145966 - protein, 30 aa, Artificial Sequence
  Description of Artificial Sequence: Synthetic polypeptide
QEYEIAPTNPCSYEQWGQVSCNLQSMGDTR

SEQ ID NO: 145967 - protein, 38 aa, Artificial Sequence
  Description of Artificial Sequence: Synthetic polypeptide
AEEEIRTTNPVATEQYGVVSTTTNQQLLQQIGTNSEET

SEQ ID NO: 145968 - protein, 35 aa, Artificial Sequence
  Description of Artificial Sequence: Synthetic polypeptide
DQEEIRTTNPVATEQYGCVSTDWSAMTLEGNEDND

SEQ ID NO: 145969 - protein, 35 aa, Artificial Sequence
  Description of Artificial Sequence: Synthetic polypeptide
DQEEIRTTNPVATEQYGCVSSTDSAMTLEGNEDND

SEQ ID NO: 145970 - protein, 34 aa, Artificial Sequence
  Description of Artificial Sequence: Synthetic polypeptide
DEEEIRTTNPVATEQYGSCNVPEWPLDAEKDSQQ

SEQ ID NO: 145971 - protein, 28 aa, Artificial Sequence
  Description of Artificial Sequence: Synthetic peptide
QEYEIATTNPVATEGYGEAPEVCQHEEK

SEQ ID NO: 145972 - protein, 33 aa, Artificial Sequence
  Description of Artificial Sequence: Synthetic polypeptide
DEDVINTTNPVATEIYGVCVEELTNNEQGGCNN

SEQ ID NO: 145973 - protein, 35 aa, Artificial Sequence
  Description of Artificial Sequence: Synthetic polypeptide
DEEEICTTNPVATECYGEVTTGNQGNQGGHGNGNQ

SEQ ID NO: 145974 - protein, 32 aa, Artificial Sequence
  Description of Artificial Sequence: Synthetic polypeptide
DEDVINTTNPVATEIYGCVELTNNEKGSGCNN

SEQ ID NO: 145975 - protein, 37 aa, Artificial Sequence
  Description of Artificial Sequence: Synthetic polypeptide
AEEEIRTTNPVATEQYGVVSTTTNNQNNNQLQGTNVD

SEQ ID NO: 145976 - protein, 35 aa, Artificial Sequence
  Description of Artificial Sequence: Synthetic polypeptide
DQEEIRTTNPVATEAYGVVPSTATELSTRTVNLPS

SEQ ID NO: 145977 - protein, 35 aa, Artificial Sequence
  Description of Artificial Sequence: Synthetic polypeptide
DQEEIRTTNPVATEAYGSVPSTAFESSTRTVNLPT

SEQ ID NO: 145978 - protein, 35 aa, Artificial Sequence
  Description of Artificial Sequence: Synthetic polypeptide
DQEEIRTTNPVATEAYGSVPSSTTTELSTMTVNPP

SEQ ID NO: 145979 - protein, 35 aa, Artificial Sequence
  Description of Artificial Sequence: Synthetic polypeptide
DQEEIRTTNPVATEAYGSVPSSTATELSTPTVNYP

SEQ ID NO: 145980 - protein, 38 aa, Artificial Sequence
  Description of Artificial Sequence: Synthetic polypeptide
AEEEIRTTNPVATEQYGVVSTTTNNQLQQQNNGTNNVE

SEQ ID NO: 145981 - protein, 29 aa, Artificial Sequence
  Description of Artificial Sequence: Synthetic peptide
QEYEIATTNPVATEQYGEAPEVCQHEEMK

SEQ ID NO: 145982 - protein, 36 aa, Artificial Sequence
  Description of Artificial Sequence: Synthetic polypeptide
DEEEICTTNPVATECWGSVSTGGNTGNEGGRGNGND

SEQ ID NO: 145983 - protein, 32 aa, Artificial Sequence
  Description of Artificial Sequence: Synthetic polypeptide
DEDVINTTNPVATEIYGACVELWNNEQGGCNN

SEQ ID NO: 145984 - protein, 28 aa, Artificial Sequence
  Description of Artificial Sequence: Synthetic peptide
QEWEIATTNPIATEQYGEAPEVCQHEEK

SEQ ID NO: 145985 - protein, 36 aa, Artificial Sequence
  Description of Artificial Sequence: Synthetic polypeptide
DQEEIRTTNPVATEQYGSVSTEDYLTTTEETQNDDY

SEQ ID NO: 145986 - protein, 28 aa, Artificial Sequence
  Description of Artificial Sequence: Synthetic peptide
QEVELATTNPVATEQYGEAPEVCQHEEK

SEQ ID NO: 145987 - protein, 35 aa, Artificial Sequence
  Description of Artificial Sequence: Synthetic polypeptide
DEEAEIRTTNPVAYECWGSVSGGNADDERGGNGNS

SEQ ID NO: 145988 - protein, 34 aa, Artificial Sequence
  Description of Artificial Sequence: Synthetic polypeptide
DEEAEIRTTNPVAYEAWGTVATNQNRGEDQNMGS

SEQ ID NO: 145989 - protein, 34 aa, Artificial Sequence
  Description of Artificial Sequence: Synthetic polypeptide
DEEAEICTTNPVAYEQWGTVATNDGNQGQAGNAT

SEQ ID NO: 145990 - protein, 34 aa, Artificial Sequence
  Description of Artificial Sequence: Synthetic polypeptide
DQEEIRTTNPVATHQYGCVCSWEDDQNFGSNNQA

SEQ ID NO: 145991 - protein, 35 aa, Artificial Sequence
  Description of Artificial Sequence: Synthetic polypeptide
DQEEIRTTNPVATHQYGCVCSTTEGHQNFGSDNQA

SEQ ID NO: 145992 - protein, 35 aa, Artificial Sequence
  Description of Artificial Sequence: Synthetic polypeptide
QEVEIRTTNPVATEQYGSVSIDGLGDEQGGGETET

SEQ ID NO: 145993 - protein, 35 aa, Artificial Sequence
  Description of Artificial Sequence: Synthetic polypeptide
QEVEIRTTNPVATEQYGSVSIDGLGDQGGGEAEDT

SEQ ID NO: 145994 - protein, 35 aa, Artificial Sequence
  Description of Artificial Sequence: Synthetic polypeptide
DQEEIRTTNPVATHQYGCVCSTMEGHQNFGSDNQS

SEQ ID NO: 145995 - protein, 35 aa, Artificial Sequence
  Description of Artificial Sequence: Synthetic polypeptide
DEEEIRTTNPVATEQYGSCNYNTQPLDEGMEQEIP

SEQ ID NO: 145996 - protein, 38 aa, Artificial Sequence
  Description of Artificial Sequence: Synthetic polypeptide
AEEEIRTTNPVATEQYGSVSTVTTNNQAGNQQGNNDGD

SEQ ID NO: 145997 - protein, 37 aa, Artificial Sequence
  Description of Artificial Sequence: Synthetic polypeptide
AEEEIRTTNPVATEQYGVVSTTTQNNNQQGNNNNNEY

SEQ ID NO: 145998 - protein, 33 aa, Artificial Sequence
  Description of Artificial Sequence: Synthetic polypeptide
DEEAEIATTNPVAYEQWGSVYGGNGNSGEGNTQ

SEQ ID NO: 145999 - protein, 35 aa, Artificial Sequence
  Description of Artificial Sequence: Synthetic polypeptide
DEEAEIATTNPVAYEQWGSVSWGIGDLQQNGNGNE

SEQ ID NO: 146000 - protein, 36 aa, Artificial Sequence
  Description of Artificial Sequence: Synthetic polypeptide
DEEAEIATTNPVAYEQWGSVSHTMNDRGNLDGGNDP

SEQ ID NO: 146001 - protein, 34 aa, Artificial Sequence
  Description of Artificial Sequence: Synthetic polypeptide
DEEAEIATTNPVAYEQWGSVSGGNGNSGEGNGGQ

SEQ ID NO: 146002 - protein, 33 aa, Artificial Sequence
  Description of Artificial Sequence: Synthetic polypeptide
DEEAEIATTNPVAYEQWGSVSGGNGNSGEGDTS

SEQ ID NO: 146003 - protein, 34 aa, Artificial Sequence
  Description of Artificial Sequence: Synthetic polypeptide
DEEAEIATTNPVAYEQWGSVCYNTDQQMHGENDQ

SEQ ID NO: 146004 - protein, 36 aa, Artificial Sequence
  Description of Artificial Sequence: Synthetic polypeptide
DEEAEIATTNPVAYEQWGSVCSNDNFGQTERGNNHQ

SEQ ID NO: 146005 - protein, 34 aa, Artificial Sequence
  Description of Artificial Sequence: Synthetic polypeptide
QEVEIRTTNPVATEQYGVVVDGNGNLDEGENDGT

SEQ ID NO: 146006 - protein, 33 aa, Artificial Sequence
  Description of Artificial Sequence: Synthetic polypeptide
DEDTIGTTNPVATEQYGSVDTTIGGQGGGQGET

SEQ ID NO: 146007 - protein, 29 aa, Artificial Sequence
  Description of Artificial Sequence: Synthetic peptide
QEYEIATTNPVATEQYGEYAPEVCQHEEK

SEQ ID NO: 146008 - protein, 30 aa, Artificial Sequence
  Description of Artificial Sequence: Synthetic polypeptide
QEYEIATTNPVATEQYGVVAGPEGGQGEED

SEQ ID NO: 146009 - protein, 33 aa, Artificial Sequence
  Description of Artificial Sequence: Synthetic polypeptide
MEEHIRTTNPVATEGWGFGVYATNNLVELGVER

SEQ ID NO: 146010 - protein, 33 aa, Artificial Sequence
  Description of Artificial Sequence: Synthetic polypeptide
DQEEIATTNPVATTQWGEVSGGNGDAGNGNHRR

SEQ ID NO: 146011 - protein, 29 aa, Artificial Sequence
  Description of Artificial Sequence: Synthetic peptide
QMEEIATTNPVATEQYGEAPEVCQYHEEK

SEQ ID NO: 146012 - protein, 36 aa, Artificial Sequence
  Description of Artificial Sequence: Synthetic polypeptide
MEGEIRTTNPVATEQYGCVSLDVLTQNNIGNNFHRD

SEQ ID NO: 146013 - protein, 35 aa, Artificial Sequence
  Description of Artificial Sequence: Synthetic polypeptide
DQDEIRTTNPVATEQYGCVSTLLATQFNGLQDQEV

SEQ ID NO: 146014 - protein, 35 aa, Artificial Sequence
  Description of Artificial Sequence: Synthetic polypeptide
QMEEIRTTNPVATEQYGSVCSPTNDDETNDDTQES

SEQ ID NO: 146015 - protein, 32 aa, Artificial Sequence
  Description of Artificial Sequence: Synthetic polypeptide
DQAEISTTNPVATEQYGCCCSWEDQHFGSNQS

SEQ ID NO: 146016 - protein, 33 aa, Artificial Sequence
  Description of Artificial Sequence: Synthetic polypeptide
DQAEISTTNPVATEQYGCCCSTAHNQHFGSNQA

SEQ ID NO: 146017 - protein, 35 aa, Artificial Sequence
  Description of Artificial Sequence: Synthetic polypeptide
MEGEIRTTNPVATEQYGCVSLEVLEQNNIGNNFVD

SEQ ID NO: 146018 - protein, 32 aa, Artificial Sequence
  Description of Artificial Sequence: Synthetic polypeptide
DEDEIRTTNPVSTEPYGTMSMENIQQQQNGSH

SEQ ID NO: 146019 - protein, 36 aa, Artificial Sequence
  Description of Artificial Sequence: Synthetic polypeptide
DEEEIRTTNPVATEQYGSCNSTCNPDDENSGQEEIP

SEQ ID NO: 146020 - protein, 32 aa, Artificial Sequence
  Description of Artificial Sequence: Synthetic polypeptide
DEDEIRTTNPVSTEPYGTISPEDIQQQQNGNH

SEQ ID NO: 146021 - protein, 34 aa, Artificial Sequence
  Description of Artificial Sequence: Synthetic polypeptide
DQAEIRTTNPVAYEQYGCTCSCTVELFQDGTNNQ

SEQ ID NO: 146022 - protein, 28 aa, Artificial Sequence
  Description of Artificial Sequence: Synthetic peptide
QMSEIASTNPVGTEGYGVMASTLQHGDI

SEQ ID NO: 146023 - protein, 33 aa, Artificial Sequence
  Description of Artificial Sequence: Synthetic polypeptide
DQAEIRTTNPVAYEQYGCTCSCIVELDHGTQNR

SEQ ID NO: 146024 - protein, 32 aa, Artificial Sequence
  Description of Artificial Sequence: Synthetic polypeptide
DEDEIRTTNPVSTEPYGTISMEDIQQQQNGNH

SEQ ID NO: 146025 - protein, 32 aa, Artificial Sequence
  Description of Artificial Sequence: Synthetic polypeptide
DEDEIRTTNPVSTEPYGTISMEDIQQDQNGNH

SEQ ID NO: 146026 - protein, 32 aa, Artificial Sequence
  Description of Artificial Sequence: Synthetic polypeptide
DQAEIRTTNPVAYEQWGCCSTVMHSQHGGPRT

SEQ ID NO: 146027 - protein, 32 aa, Artificial Sequence
  Description of Artificial Sequence: Synthetic polypeptide
DEDEIRTTNPVSTEPYGTISMEDIQAQQNGNH

SEQ ID NO: 146028 - protein, 32 aa, Artificial Sequence
  Description of Artificial Sequence: Synthetic polypeptide
DEDEIRTTNPVSTEPYGTISMEDGQQQQNGNH

SEQ ID NO: 146029 - protein, 29 aa, Artificial Sequence
  Description of Artificial Sequence: Synthetic peptide
QMEEIATTNPVATEQYGEAPEVCQPTEDK

SEQ ID NO: 146030 - protein, 36 aa, Artificial Sequence
  Description of Artificial Sequence: Synthetic polypeptide
MEGEIRTTNPVATEQYGSVMTWNELETESGDDNYEG

SEQ ID NO: 146031 - protein, 29 aa, Artificial Sequence
  Description of Artificial Sequence: Synthetic peptide
QMEEIATTNPVATEQYGEAPEVCQKHEEK

SEQ ID NO: 146032 - protein, 34 aa, Artificial Sequence
  Description of Artificial Sequence: Synthetic polypeptide
DEDEIVTTNPVATEQYGAVVSATDGPEEGEGGND

SEQ ID NO: 146033 - protein, 33 aa, Artificial Sequence
  Description of Artificial Sequence: Synthetic polypeptide
QEYEIGTTNPVATEQYGSVDVANAGMEEGGNEG

SEQ ID NO: 146034 - protein, 34 aa, Artificial Sequence
  Description of Artificial Sequence: Synthetic polypeptide
QEYEIGTTNPVATEQYGSVSVVANAGMEGGNDEG

SEQ ID NO: 146035 - protein, 34 aa, Artificial Sequence
  Description of Artificial Sequence: Synthetic polypeptide
QEYEIGTTNPVATEQYGSVSVVANAGMEGGNEEG

SEQ ID NO: 146036 - protein, 36 aa, Artificial Sequence
  Description of Artificial Sequence: Synthetic polypeptide
DEDELRTTNPVATEQYGSVSSTTPAGPNMRNGMNPV

SEQ ID NO: 146037 - protein, 35 aa, Artificial Sequence
  Description of Artificial Sequence: Synthetic polypeptide
DQEEIRCTNPVATERYGKTVVSCTNALTETGDNQS

SEQ ID NO: 146038 - protein, 33 aa, Artificial Sequence
  Description of Artificial Sequence: Synthetic polypeptide
DEDEIVTTNPVGTEQYGTVCSATDGPVEFEGND

SEQ ID NO: 146039 - protein, 34 aa, Artificial Sequence
  Description of Artificial Sequence: Synthetic polypeptide
DEDEIVTTNPVATEQYGVVVSNTDGPEEFEGQND

SEQ ID NO: 146040 - protein, 38 aa, Artificial Sequence
  Description of Artificial Sequence: Synthetic polypeptide
AEEEIRTTNPVATEQYGSVSTVTTNNNQQGTNNNTEEA

SEQ ID NO: 146041 - protein, 35 aa, Artificial Sequence
  Description of Artificial Sequence: Synthetic polypeptide
QEYETVTTNPVATEQYGSVSTGDNGDQRIGGDGGD

SEQ ID NO: 146042 - protein, 35 aa, Artificial Sequence
  Description of Artificial Sequence: Synthetic polypeptide
DEDEIVTTNPVATEQYGTVVSATDGNEEFEGNADQ

SEQ ID NO: 146043 - protein, 34 aa, Artificial Sequence
  Description of Artificial Sequence: Synthetic polypeptide
DEDEIVTTNPVATEQYGTVVSATDGIEEFEGNDD

SEQ ID NO: 146044 - protein, 35 aa, Artificial Sequence
  Description of Artificial Sequence: Synthetic polypeptide
DEDEIVTTNPVATEQYGTVVSATDGGNEEFEGNID

SEQ ID NO: 146045 - protein, 33 aa, Artificial Sequence
  Description of Artificial Sequence: Synthetic polypeptide
DEDEIVTTNPVATEQYGTVVSASDGPVEFEGND

SEQ ID NO: 146046 - protein, 36 aa, Artificial Sequence
  Description of Artificial Sequence: Synthetic polypeptide
AEEEIRTTNPVATEQYGVVSTTTNNNNSEQGTNFEG

SEQ ID NO: 146047 - protein, 37 aa, Artificial Sequence
  Description of Artificial Sequence: Synthetic polypeptide
AEEEIRTTNPVATEQYGVVSTTTNNNNQQQIGTNIGE

SEQ ID NO: 146048 - protein, 29 aa, Artificial Sequence
  Description of Artificial Sequence: Synthetic peptide
QENEIATTNPVATECYGDVSECWAEHEEL

SEQ ID NO: 146049 - protein, 36 aa, Artificial Sequence
  Description of Artificial Sequence: Synthetic polypeptide
DEEEIRTTNPVATEQYGSVASPTFLEELEIVEVQVL

SEQ ID NO: 146050 - protein, 29 aa, Artificial Sequence
  Description of Artificial Sequence: Synthetic peptide
MEGEIATTNPVATEQYGEAPEVCQFPHEK

SEQ ID NO: 146051 - protein, 34 aa, Artificial Sequence
  Description of Artificial Sequence: Synthetic polypeptide
DEDEIVTTNPVATEQYGTVCSATDGPVEFEGNDV

SEQ ID NO: 146052 - protein, 29 aa, Artificial Sequence
  Description of Artificial Sequence: Synthetic peptide
QMEEIATTNPVATEQYGEAPEVCQHEHEK

SEQ ID NO: 146053 - protein, 36 aa, Artificial Sequence
  Description of Artificial Sequence: Synthetic polypeptide
DEEEICTTNPVATECYGSVATTGNEGNQGGHGQGND

SEQ ID NO: 146054 - protein, 38 aa, Artificial Sequence
  Description of Artificial Sequence: Synthetic polypeptide
AEEEIRTTNPVATEQYGSVSTVTQNNQQNGTEAGNTDT

SEQ ID NO: 146055 - protein, 36 aa, Artificial Sequence
  Description of Artificial Sequence: Synthetic polypeptide
MEGEIRTTNPVATEQYGSVNSTTPAMPNMENGMNDD

SEQ ID NO: 146056 - protein, 34 aa, Artificial Sequence
  Description of Artificial Sequence: Synthetic polypeptide
DEEEIATVNPVATEQYGCVAGNGLQSNNNAHAES

SEQ ID NO: 146057 - protein, 36 aa, Artificial Sequence
  Description of Artificial Sequence: Synthetic polypeptide
DNEEIRTTNPVAFEQYGSVSSTTVAGENMRNGVNPV

SEQ ID NO: 146058 - protein, 34 aa, Artificial Sequence
  Description of Artificial Sequence: Synthetic polypeptide
DEEEIATVNPVATEQYGCVAGNGLQSNNASQAEN

SEQ ID NO: 146059 - protein, 30 aa, Artificial Sequence
  Description of Artificial Sequence: Synthetic polypeptide
MENEIACTNPVATEYYGEAPEVLQRGDGQQ

SEQ ID NO: 146060 - protein, 33 aa, Artificial Sequence
  Description of Artificial Sequence: Synthetic polypeptide
DEEEIATVNPVATEQYGCVAGNGLASNNNSQAE

SEQ ID NO: 146061 - protein, 37 aa, Artificial Sequence
  Description of Artificial Sequence: Synthetic polypeptide
DEEEIRTTNPVATEQYGSCAQPEMMMSTVLENGPLND

SEQ ID NO: 146062 - protein, 35 aa, Artificial Sequence
  Description of Artificial Sequence: Synthetic polypeptide
DEEEIRTTNPVATEQYGSVSPGIAALEMDEMEIPA

SEQ ID NO: 146063 - protein, 35 aa, Artificial Sequence
  Description of Artificial Sequence: Synthetic polypeptide
SAEEIATTNPVATEQYGSVANANNLPQEAPGENAH

SEQ ID NO: 146064 - protein, 31 aa, Artificial Sequence
  Description of Artificial Sequence: Synthetic polypeptide
MENEIACTNPVATEQYGEASAAVLTRNDGQQ

SEQ ID NO: 146065 - protein, 37 aa, Artificial Sequence
  Description of Artificial Sequence: Synthetic polypeptide
DEEEIRTTNPVATEQYGSVQTPNMVHEGQINQHNVNQ

SEQ ID NO: 146066 - protein, 34 aa, Artificial Sequence
  Description of Artificial Sequence: Synthetic polypeptide
DEDEIRTTNPVAYEQWGVVSGGNGLQQDHPNGGS

SEQ ID NO: 146067 - protein, 35 aa, Artificial Sequence
  Description of Artificial Sequence: Synthetic polypeptide
SAEEIATTNPVATEQYGSVCSDGTGNEAADGNDNH

SEQ ID NO: 146068 - protein, 34 aa, Artificial Sequence
  Description of Artificial Sequence: Synthetic polypeptide
DEDEIRTTNPVAYEQWGVVCYTMEDQQDQGDGNR

SEQ ID NO: 146069 - protein, 31 aa, Artificial Sequence
  Description of Artificial Sequence: Synthetic polypeptide
MENEIRTTNPVATEQWGDVSEIEENAAEDAS

SEQ ID NO: 146070 - protein, 30 aa, Artificial Sequence
  Description of Artificial Sequence: Synthetic polypeptide
MENEIRTTNPVATEQWGDVSEIEMNAAEDA

SEQ ID NO: 146071 - protein, 34 aa, Artificial Sequence
  Description of Artificial Sequence: Synthetic polypeptide
DEDEIRTTNPVAYEQWGVVCSTENDDGDDQNGGA

SEQ ID NO: 146072 - protein, 31 aa, Artificial Sequence
  Description of Artificial Sequence: Synthetic polypeptide
MENEIRTTNPVATEQWGDVSTEIEMNAAEDA

SEQ ID NO: 146073 - protein, 34 aa, Artificial Sequence
  Description of Artificial Sequence: Synthetic polypeptide
DEDEIRTTNPVAYEQWGVVCSTDNNDGKQGNNAS

SEQ ID NO: 146074 - protein, 33 aa, Artificial Sequence
  Description of Artificial Sequence: Synthetic polypeptide
MENEIRTTNPVATEFYGSVDENNMEGGGNENEG

SEQ ID NO: 146075 - protein, 35 aa, Artificial Sequence
  Description of Artificial Sequence: Synthetic polypeptide
DNEEIRTTNPVATEQYGCVSTWVNDIEDDTSINSL

SEQ ID NO: 146076 - protein, 35 aa, Artificial Sequence
  Description of Artificial Sequence: Synthetic polypeptide
DNEEIRTTNPVATEQYGCVSTYLNDIEDDTSIQSR

SEQ ID NO: 146077 - protein, 36 aa, Artificial Sequence
  Description of Artificial Sequence: Synthetic polypeptide
DNEEIRTTNPVATEQYGGVSSTTPAGPNMPNGMNPV

SEQ ID NO: 146078 - protein, 36 aa, Artificial Sequence
  Description of Artificial Sequence: Synthetic polypeptide
DNEEIRTTNPVATEQYGSVCSPDNNLEDRITDLMDG

SEQ ID NO: 146079 - protein, 35 aa, Artificial Sequence
  Description of Artificial Sequence: Synthetic polypeptide
DNEEIRTTNPVATEQYGSVCSPDENEDRITDFMDG

SEQ ID NO: 146080 - protein, 35 aa, Artificial Sequence
  Description of Artificial Sequence: Synthetic polypeptide
MEHEIATVNPVATEQYGSVSINNGLGGGQEGGNIT

SEQ ID NO: 146081 - protein, 35 aa, Artificial Sequence
  Description of Artificial Sequence: Synthetic polypeptide
DEEEIRTTNPVATEQYGSCCSPTKHDEFMDGGEDP

SEQ ID NO: 146082 - protein, 36 aa, Artificial Sequence
  Description of Artificial Sequence: Synthetic polypeptide
DNEEIRTTNPVATEQYGSVCSPDDNLEDRIEDFMDG

SEQ ID NO: 146083 - protein, 37 aa, Artificial Sequence
  Description of Artificial Sequence: Synthetic polypeptide
DEEEIRTTNPVATEQYGSCCSDTGTNTHGLTQEQEEE

SEQ ID NO: 146084 - protein, 35 aa, Artificial Sequence
  Description of Artificial Sequence: Synthetic polypeptide
DEDEIRTTNPVAYEQWGVVVPTDNAGDQSGGNMNR

SEQ ID NO: 146085 - protein, 36 aa, Artificial Sequence
  Description of Artificial Sequence: Synthetic polypeptide
AEEEIRTTNPVATEQYGVVSTTQQQQNSEQGTNASE

SEQ ID NO: 146086 - protein, 35 aa, Artificial Sequence
  Description of Artificial Sequence: Synthetic polypeptide
DNEEIRTTNPVATEQYGSIVNSAELESSAEGDDEV

SEQ ID NO: 146087 - protein, 36 aa, Artificial Sequence
  Description of Artificial Sequence: Synthetic polypeptide
AEEEIRTTNPVATEQYGVVSTTQQQLTNSEEGTNTE

SEQ ID NO: 146088 - protein, 34 aa, Artificial Sequence
  Description of Artificial Sequence: Synthetic polypeptide
DNEEIRTTNPVATEQYGSAWSPDENQMTDNSEQE

SEQ ID NO: 146089 - protein, 33 aa, Artificial Sequence
  Description of Artificial Sequence: Synthetic polypeptide
SAEEIATTNPVATEQWGGCCAGTNLQNEMGNQQ

SEQ ID NO: 146090 - protein, 34 aa, Artificial Sequence
  Description of Artificial Sequence: Synthetic polypeptide
SAEEIATTNPVATEQWGGCVAGNNNLQTEDGNRN

SEQ ID NO: 146091 - protein, 31 aa, Artificial Sequence
  Description of Artificial Sequence: Synthetic polypeptide
MENEIACTNPVACEQYGEASEVLQRGDGQQY

SEQ ID NO: 146092 - protein, 33 aa, Artificial Sequence
  Description of Artificial Sequence: Synthetic polypeptide
SAEEIATTNPVATEQWGSTNTGNLPAEAQGGAD

SEQ ID NO: 146093 - protein, 32 aa, Artificial Sequence
  Description of Artificial Sequence: Synthetic polypeptide
SAEEIATTNPVATEQWGSVSEGNPPGNHSNDS

SEQ ID NO: 146094 - protein, 33 aa, Artificial Sequence
  Description of Artificial Sequence: Synthetic polypeptide
SAEEIATTNPVATEQWGSVSGTGDPPQADSGDS

SEQ ID NO: 146095 - protein, 37 aa, Artificial Sequence
  Description of Artificial Sequence: Synthetic polypeptide
AEEEIRTTNPVATEQYGVVSTTQQQLQNSEEGTNTNS

SEQ ID NO: 146096 - protein, 34 aa, Artificial Sequence
  Description of Artificial Sequence: Synthetic polypeptide
SAEEIATTNPVATEQWGSVSGTGNPPDANGSNDS

SEQ ID NO: 146097 - protein, 34 aa, Artificial Sequence
  Description of Artificial Sequence: Synthetic polypeptide
MENEIRTTNPVATEQYGEVVMSAELEQVTPQNDG

SEQ ID NO: 146098 - protein, 32 aa, Artificial Sequence
  Description of Artificial Sequence: Synthetic polypeptide
SAEEIATTNPVATEQWGCVAGTMLQHQDDNPN

SEQ ID NO: 146099 - protein, 34 aa, Artificial Sequence
  Description of Artificial Sequence: Synthetic polypeptide
DEDEIRTTNPVAYEQWGVVCSTDNMGEQDGGDMP

SEQ ID NO: 146100 - protein, 34 aa, Artificial Sequence
  Description of Artificial Sequence: Synthetic polypeptide
MENEIRTTNPVATEQYGEVVMSSAELEQRSQDDG

SEQ ID NO: 146101 - protein, 36 aa, Artificial Sequence
  Description of Artificial Sequence: Synthetic polypeptide
MENEIRTTNPVATEQYGSVSTWWDLLEEQGNGPEKM

SEQ ID NO: 146102 - protein, 34 aa, Artificial Sequence
  Description of Artificial Sequence: Synthetic polypeptide
MENEIRTTNPVATEQYGSVSVMSIDQESNQGSMP

SEQ ID NO: 146103 - protein, 35 aa, Artificial Sequence
  Description of Artificial Sequence: Synthetic polypeptide
MENEIRTTNPVATEQYGSVSVSFNVQPRELQDDIV

SEQ ID NO: 146104 - protein, 36 aa, Artificial Sequence
  Description of Artificial Sequence: Synthetic polypeptide
DMEEIRTTNPVATEQYGSVSSTTPAGPNMENGMDPV

SEQ ID NO: 146105 - protein, 35 aa, Artificial Sequence
  Description of Artificial Sequence: Synthetic polypeptide
MENEIRTTNPVATEQYGSVSWTDVLEIPMPQEIET

SEQ ID NO: 146106 - protein, 35 aa, Artificial Sequence
  Description of Artificial Sequence: Synthetic polypeptide
MENEIRTTNPVATEQYGSVSWTGVAEINFHQEIFD

SEQ ID NO: 146107 - protein, 36 aa, Artificial Sequence
  Description of Artificial Sequence: Synthetic polypeptide
MENEIRTTNPVATEQYGSVSWVDNNNTQEGNQPDHN

SEQ ID NO: 146108 - protein, 31 aa, Artificial Sequence
  Description of Artificial Sequence: Synthetic polypeptide
DEEEIATTNPVCTECWGVVSNDEDLAESGPI

SEQ ID NO: 146109 - protein, 36 aa, Artificial Sequence
  Description of Artificial Sequence: Synthetic polypeptide
DMEEIRTTNPVATETYGSVSSTTPAGPNMRNGMNPV

SEQ ID NO: 146110 - protein, 37 aa, Artificial Sequence
  Description of Artificial Sequence: Synthetic polypeptide
DEEEIRTTNPVATEQYGSAYSYTVNEDDSMRDQDGDD

SEQ ID NO: 146111 - protein, 35 aa, Artificial Sequence
  Description of Artificial Sequence: Synthetic polypeptide
DMEEIRTTNPVATEQYGCVNTDVLDQDQYGGEEPM

SEQ ID NO: 146112 - protein, 34 aa, Artificial Sequence
  Description of Artificial Sequence: Synthetic polypeptide
DMEEIRTTNPVATEQYGCCTTVLDQDQYGGEEPM

SEQ ID NO: 146113 - protein, 33 aa, Artificial Sequence
  Description of Artificial Sequence: Synthetic polypeptide
SDEEIRTTNPVATEQWGTVCSWEHNQHFGSNQA

SEQ ID NO: 146114 - protein, 37 aa, Artificial Sequence
  Description of Artificial Sequence: Synthetic polypeptide
DEEEIRTTNPVATEQYGSAYSTCWNEDVQVENDEQQE

SEQ ID NO: 146115 - protein, 34 aa, Artificial Sequence
  Description of Artificial Sequence: Synthetic polypeptide
SDEEIRTTNPVATEQYGCVCSWNHNQNFGSDTQS

SEQ ID NO: 146116 - protein, 31 aa, Artificial Sequence
  Description of Artificial Sequence: Synthetic polypeptide
DEEEIATTNPVCTECWGAVSNDEDLAESGPI

SEQ ID NO: 146117 - protein, 34 aa, Artificial Sequence
  Description of Artificial Sequence: Synthetic polypeptide
MENEIRTTNPVATEQYGSVTVAYDLQEGEEDQMA

SEQ ID NO: 146118 - protein, 36 aa, Artificial Sequence
  Description of Artificial Sequence: Synthetic polypeptide
DEEEIRTTNPVATEQYGSAYSPTVNENTSVPEENQF

SEQ ID NO: 146119 - protein, 35 aa, Artificial Sequence
  Description of Artificial Sequence: Synthetic polypeptide
DEEEIRTTNPVATEQYGSVSPIIAAEDVDQMMTVT

SEQ ID NO: 146120 - protein, 33 aa, Artificial Sequence
  Description of Artificial Sequence: Synthetic polypeptide
DEDEIRTTNPVAYEQWGVCSTGNPDIDGGGGQR

SEQ ID NO: 146121 - protein, 37 aa, Artificial Sequence
  Description of Artificial Sequence: Synthetic polypeptide
AEEEIRTTNPVATEQYGVVSTTNTNLEQGSNQENNDD

SEQ ID NO: 146122 - protein, 37 aa, Artificial Sequence
  Description of Artificial Sequence: Synthetic polypeptide
AEEEIRTTNPVATEQYGVVSTTNTNLEQGSNQQQGDD

SEQ ID NO: 146123 - protein, 34 aa, Artificial Sequence
  Description of Artificial Sequence: Synthetic polypeptide
DNAEIRTTNPVATEQYGSVCEWVDTLERNENPQE

SEQ ID NO: 146124 - protein, 35 aa, Artificial Sequence
  Description of Artificial Sequence: Synthetic polypeptide
DEEEIRTTNPVATEQYGSCAESPTTEVVTTVPNDG

SEQ ID NO: 146125 - protein, 34 aa, Artificial Sequence
  Description of Artificial Sequence: Synthetic polypeptide
SAWEIATTNPVATEQWGCVAGTNNLQAEMGNMRN

SEQ ID NO: 146126 - protein, 33 aa, Artificial Sequence
  Description of Artificial Sequence: Synthetic polypeptide
DEEEIATTNPVGTEGYGVVSSTPAGPNMHGMNV

SEQ ID NO: 146127 - protein, 35 aa, Artificial Sequence
  Description of Artificial Sequence: Synthetic polypeptide
DEEEIRTTNPVATEQYGSVSPIAIMETSAMPEHSS

SEQ ID NO: 146128 - protein, 35 aa, Artificial Sequence
  Description of Artificial Sequence: Synthetic polypeptide
MENEIRTTNPVATEQYGEVVVPCSAELEQRPQNDG

SEQ ID NO: 146129 - protein, 38 aa, Artificial Sequence
  Description of Artificial Sequence: Synthetic polypeptide
AEEEIRTTNPVATEQYGSVSTVTNQQQGNQQIGTNEGD

SEQ ID NO: 146130 - protein, 31 aa, Artificial Sequence
  Description of Artificial Sequence: Synthetic polypeptide
SDECIATTNPVATECWGKVSHTNDHQGQVNL

SEQ ID NO: 146131 - protein, 32 aa, Artificial Sequence
  Description of Artificial Sequence: Synthetic polypeptide
SDECIATTNPVATEQWGKVSHTMNDHQQDQNL

SEQ ID NO: 146132 - protein, 32 aa, Artificial Sequence
  Description of Artificial Sequence: Synthetic polypeptide
SDECIATTNPVATEQWGKVSHTNDHQGQDNNL

SEQ ID NO: 146133 - protein, 32 aa, Artificial Sequence
  Description of Artificial Sequence: Synthetic polypeptide
MENEIRTTNPVATEQYGSCSMLGVTDEGTEPV

SEQ ID NO: 146134 - protein, 33 aa, Artificial Sequence
  Description of Artificial Sequence: Synthetic polypeptide
DEDEIRTTNPVAYEQWGVCSTTQGPNDTNGNSG

SEQ ID NO: 146135 - protein, 32 aa, Artificial Sequence
  Description of Artificial Sequence: Synthetic polypeptide
SDECIATTNPVATEQWGKVSHTNDHQGQQNNL

SEQ ID NO: 146136 - protein, 33 aa, Artificial Sequence
  Description of Artificial Sequence: Synthetic polypeptide
DMQEIATTNPVATEQYGSVSATDLEDHEAYEDL

SEQ ID NO: 146137 - protein, 36 aa, Artificial Sequence
  Description of Artificial Sequence: Synthetic polypeptide
DEEEIRTTNPVATEQYGSVQTPEGLLLGEFEQMVQE

SEQ ID NO: 146138 - protein, 32 aa, Artificial Sequence
  Description of Artificial Sequence: Synthetic polypeptide
SDECIATTNPVATEQWGKVSHTNDHQGQVNSD

SEQ ID NO: 146139 - protein, 35 aa, Artificial Sequence
  Description of Artificial Sequence: Synthetic polypeptide
DEEEIRCTNPVATEQYGCVCSMWEDDNQGFGSNQA

SEQ ID NO: 146140 - protein, 38 aa, Artificial Sequence
  Description of Artificial Sequence: Synthetic polypeptide
AEEEIRTTNPVATEQYGVVSTTNTNNLEQGSNQLGNDD

SEQ ID NO: 146141 - protein, 32 aa, Artificial Sequence
  Description of Artificial Sequence: Synthetic polypeptide
DMNEIRTTNPVSTEPYGTISMEDITQQQNGNH

SEQ ID NO: 146142 - protein, 36 aa, Artificial Sequence
  Description of Artificial Sequence: Synthetic polypeptide
DEEEIRCTNPVATEQYGCVCSMTGNDFQGFNSNTQS

SEQ ID NO: 146143 - protein, 35 aa, Artificial Sequence
  Description of Artificial Sequence: Synthetic polypeptide
DEEEIATVNPVCTEQYGSVSSTTPAGNMRNGMNPV

SEQ ID NO: 146144 - protein, 34 aa, Artificial Sequence
  Description of Artificial Sequence: Synthetic polypeptide
MEHEIATVNPVATEQYGSVITNGLGGGQEGGQTN

SEQ ID NO: 146145 - protein, 38 aa, Artificial Sequence
  Description of Artificial Sequence: Synthetic polypeptide
AEEEIRTTNPVATEQYGSVSTVTNTQAGNQQSGNNEGD

SEQ ID NO: 146146 - protein, 34 aa, Artificial Sequence
  Description of Artificial Sequence: Synthetic polypeptide
MEGEIRTTNPVATEQYGSVSFWDVLDENRIEVGT

SEQ ID NO: 146147 - protein, 36 aa, Artificial Sequence
  Description of Artificial Sequence: Synthetic polypeptide
DEEEIRTTNPVATEQYGSCNAPVLNANQLQPNEETF

SEQ ID NO: 146148 - protein, 34 aa, Artificial Sequence
  Description of Artificial Sequence: Synthetic polypeptide
MEGEIRTTNPVATEQYGSVSNENVNESMINEMEE

SEQ ID NO: 146149 - protein, 37 aa, Artificial Sequence
  Description of Artificial Sequence: Synthetic polypeptide
DEEEIRTTNPVATEQYGSVSPDMSNYYQPTENESDQQ

SEQ ID NO: 146150 - protein, 28 aa, Artificial Sequence
  Description of Artificial Sequence: Synthetic peptide
RESEIASTNPVGTEGYGVMACTLQHGDI

SEQ ID NO: 146151 - protein, 35 aa, Artificial Sequence
  Description of Artificial Sequence: Synthetic polypeptide
DEDEIRTTNPVAYEQYGSVCCAANNLQRTTPPDQE

SEQ ID NO: 146152 - protein, 36 aa, Artificial Sequence
  Description of Artificial Sequence: Synthetic polypeptide
MEGEIRTTNPVATEQYGSVSPTDNELDEKTNNSDQD

SEQ ID NO: 146153 - protein, 35 aa, Artificial Sequence
  Description of Artificial Sequence: Synthetic polypeptide
DEEEIRTTNPVATEQYGSVQTTSIVQMSEEVSEDE

SEQ ID NO: 146154 - protein, 36 aa, Artificial Sequence
  Description of Artificial Sequence: Synthetic polypeptide
DNGEIRTTNPVATEQYGCSWHSFTINLLEERETQNE

SEQ ID NO: 146155 - protein, 36 aa, Artificial Sequence
  Description of Artificial Sequence: Synthetic polypeptide
DEEEIRCTNPVATEQWGSVSGGTPAGPNMRNGMNPV

SEQ ID NO: 146156 - protein, 36 aa, Artificial Sequence
  Description of Artificial Sequence: Synthetic polypeptide
DEEEIRTTNPVATEQYGSVSPDSNAPMPTMNEVDQQ

SEQ ID NO: 146157 - protein, 34 aa, Artificial Sequence
  Description of Artificial Sequence: Synthetic polypeptide
DEEEIRTTNPVATEQYGSCISQPQQGEAQPELQN

SEQ ID NO: 146158 - protein, 36 aa, Artificial Sequence
  Description of Artificial Sequence: Synthetic polypeptide
MEGEIRTTNPVATEQYGSVSSTTPAGPNMENGMNVD

SEQ ID NO: 146159 - protein, 36 aa, Artificial Sequence
  Description of Artificial Sequence: Synthetic polypeptide
DEEEIRCTNPVATEQYGAVSNGSNGQSGQEGGQNNT

SEQ ID NO: 146160 - protein, 31 aa, Artificial Sequence
  Description of Artificial Sequence: Synthetic polypeptide
SAEEIATTNPVATAQWGCNVAAGLQTAGENF

SEQ ID NO: 146161 - protein, 36 aa, Artificial Sequence
  Description of Artificial Sequence: Synthetic polypeptide
DEEEIRTTNPVATEQYGSVSPDSNYYVPTENEVDGQ

SEQ ID NO: 146162 - protein, 34 aa, Artificial Sequence
  Description of Artificial Sequence: Synthetic polypeptide
DEEEICTTNPMATEAYGSVPTPDPQHASGENFMG

SEQ ID NO: 146163 - protein, 35 aa, Artificial Sequence
  Description of Artificial Sequence: Synthetic polypeptide
DEDEIRTTNPVAYEQWGVVYSGDNQNNEDRGGNTR

SEQ ID NO: 146164 - protein, 35 aa, Artificial Sequence
  Description of Artificial Sequence: Synthetic polypeptide
MEGEIRTTNPVATEQYGSVSPVDGLETEMNSDHRG

SEQ ID NO: 146165 - protein, 37 aa, Artificial Sequence
  Description of Artificial Sequence: Synthetic polypeptide
AEEEIRTTNPVATEQYGSVSTVTQNDEQGTTNVATEL

SEQ ID NO: 146166 - protein, 36 aa, Artificial Sequence
  Description of Artificial Sequence: Synthetic polypeptide
DNHEIRTTNPVATEQYGSVSTNDVDEEIFMLQDEPI

SEQ ID NO: 146167 - protein, 33 aa, Artificial Sequence
  Description of Artificial Sequence: Synthetic polypeptide
DNMEIVTTNPVATEQYGTVCSATDGPVEFEGND

SEQ ID NO: 146168 - protein, 37 aa, Artificial Sequence
  Description of Artificial Sequence: Synthetic polypeptide
AEEEIRTTNPVATEQYGSVSTVTQNNQNGDEAGTEDE

SEQ ID NO: 146169 - protein, 34 aa, Artificial Sequence
  Description of Artificial Sequence: Synthetic polypeptide
MEGEIRTTNPVATEQYGSVNVCWTVESGGESNQD

SEQ ID NO: 146170 - protein, 37 aa, Artificial Sequence
  Description of Artificial Sequence: Synthetic polypeptide
AEEEIRTTNPVATEQYGSVSTVTQNNMEQGTNNVTTE

SEQ ID NO: 146171 - protein, 37 aa, Artificial Sequence
  Description of Artificial Sequence: Synthetic polypeptide
DEEEIRTTNPVATEQYGSVSPDAYVLEPNGVEGNMSD

SEQ ID NO: 146172 - protein, 33 aa, Artificial Sequence
  Description of Artificial Sequence: Synthetic polypeptide
DNVEIVTTNPVATEQYGTVCSQTDGPVEFEGND

SEQ ID NO: 146173 - protein, 31 aa, Artificial Sequence
  Description of Artificial Sequence: Synthetic polypeptide
DNSEVATTNPVSTEGYGNVAANTIQSRVGQR

SEQ ID NO: 146174 - protein, 34 aa, Artificial Sequence
  Description of Artificial Sequence: Synthetic polypeptide
DNSEIRTTNPVATECWGSVWCINYEPQDREGENH

SEQ ID NO: 146175 - protein, 37 aa, Artificial Sequence
  Description of Artificial Sequence: Synthetic polypeptide
AEEEIRTTNPVATEQYGSVSTVTQNNMEQGTNNQTED

SEQ ID NO: 146176 - protein, 37 aa, Artificial Sequence
  Description of Artificial Sequence: Synthetic polypeptide
AEEEIRTTNPVATEQYGSVSTVTQNNEQTTTNVATED

SEQ ID NO: 146177 - protein, 37 aa, Artificial Sequence
  Description of Artificial Sequence: Synthetic polypeptide
AEEEIRTTNPVATEQYGSVSTVTQNMEQGTTNVTTED

SEQ ID NO: 146178 - protein, 38 aa, Artificial Sequence
  Description of Artificial Sequence: Synthetic polypeptide
AEEEIRTTNPVATEQYGSVSTVTQNGNQIRTTNVATED

SEQ ID NO: 146179 - protein, 35 aa, Artificial Sequence
  Description of Artificial Sequence: Synthetic polypeptide
DEEEIACTNPVATAQWGSVSVSGNPLENTRGNEDF

SEQ ID NO: 146180 - protein, 37 aa, Artificial Sequence
  Description of Artificial Sequence: Synthetic polypeptide
AEEEIRTTNPVATEQYGSVSTVTQNGNNNNQGENETD

SEQ ID NO: 146181 - protein, 34 aa, Artificial Sequence
  Description of Artificial Sequence: Synthetic polypeptide
MEGEIRTTNPVATEQYGSVSDWLDGSDEHGFDEG

SEQ ID NO: 146182 - protein, 33 aa, Artificial Sequence
  Description of Artificial Sequence: Synthetic polypeptide
REMEIVTTNPVATEQYGTVCSATDGKVEFEGND

SEQ ID NO: 146183 - protein, 33 aa, Artificial Sequence
  Description of Artificial Sequence: Synthetic polypeptide
DNQEIASTNPVATEQYGSVSATDLNEDHEGEDL

SEQ ID NO: 146184 - protein, 33 aa, Artificial Sequence
  Description of Artificial Sequence: Synthetic polypeptide
REMEIVTTNPVATEQYGTVCSATDGPVEFEGND

SEQ ID NO: 146185 - protein, 33 aa, Artificial Sequence
  Description of Artificial Sequence: Synthetic polypeptide
REMEIVTTNPVATEQYGTVCSATDTPVEFEGND

SEQ ID NO: 146186 - protein, 30 aa, Artificial Sequence
  Description of Artificial Sequence: Synthetic polypeptide
DNNEIRTTNPVATEQWGDVSEAEMNAAEDA

SEQ ID NO: 146187 - protein, 35 aa, Artificial Sequence
  Description of Artificial Sequence: Synthetic polypeptide
DEDEIRTTNPVAYEQWGVVVPTDNTGDDQSGNDNR

SEQ ID NO: 146188 - protein, 34 aa, Artificial Sequence
  Description of Artificial Sequence: Synthetic polypeptide
DNEEISTTNPVATTQYGSVSLVTLPVVTGNPGEE

SEQ ID NO: 146189 - protein, 34 aa, Artificial Sequence
  Description of Artificial Sequence: Synthetic polypeptide
DNEEISTTNPVATTQYGSVSLVTLPVEMGNPTEG

SEQ ID NO: 146190 - protein, 35 aa, Artificial Sequence
  Description of Artificial Sequence: Synthetic polypeptide
DEDEIRTTNPVAYEQWGVVVPTDNPGDQAGGNGNR

SEQ ID NO: 146191 - protein, 37 aa, Artificial Sequence
  Description of Artificial Sequence: Synthetic polypeptide
AEEEIRTTNPVATEQYGVVSTTTNGEQNGNQEGNNAE

SEQ ID NO: 146192 - protein, 37 aa, Artificial Sequence
  Description of Artificial Sequence: Synthetic polypeptide
AEEEIRTTNPVATEQYGVVSTTTDNLQAGTEAGEEEG

SEQ ID NO: 146193 - protein, 35 aa, Artificial Sequence
  Description of Artificial Sequence: Synthetic polypeptide
DEEEIRTTNPVATEQYGSCFSPDEMIEYINVEERN

SEQ ID NO: 146194 - protein, 34 aa, Artificial Sequence
  Description of Artificial Sequence: Synthetic polypeptide
DEDEIRTTNPVAYEQWGVVVPTDNGDQAGGNMNG

SEQ ID NO: 146195 - protein, 32 aa, Artificial Sequence
  Description of Artificial Sequence: Synthetic polypeptide
DEEEICATNPVAYEQWGVVTGWNDHQGMRGTD

SEQ ID NO: 146196 - protein, 37 aa, Artificial Sequence
  Description of Artificial Sequence: Synthetic polypeptide
AEEEIRTTNPVATEQYGSVSTVTNTQLGSEEGTTEDN

SEQ ID NO: 146197 - protein, 29 aa, Artificial Sequence
  Description of Artificial Sequence: Synthetic peptide
SAEEIATTNPVATASWGCVAGTGLMNGGA

SEQ ID NO: 146198 - protein, 34 aa, Artificial Sequence
  Description of Artificial Sequence: Synthetic polypeptide
MEHEIATVNPVATEQYGAVIITNGLGGGQEGGNT

SEQ ID NO: 146199 - protein, 34 aa, Artificial Sequence
  Description of Artificial Sequence: Synthetic polypeptide
DEDEIRTTNPVAYEQWGVVVPTDNGDMAGGMNNR

SEQ ID NO: 146200 - protein, 34 aa, Artificial Sequence
  Description of Artificial Sequence: Synthetic polypeptide
DEDEIRTTNPVAYEQWGVVVPTDNGDHAGGNINR

SEQ ID NO: 146201 - protein, 34 aa, Artificial Sequence
  Description of Artificial Sequence: Synthetic polypeptide
DEDEIRTTNPVAYEQWGVVVPTDNGDDQSGNEIS

SEQ ID NO: 146202 - protein, 35 aa, Artificial Sequence
  Description of Artificial Sequence: Synthetic polypeptide
DEDEIRTTNPVAYEQWGVVVPTDNGDDQAGNSGRN

SEQ ID NO: 146203 - protein, 35 aa, Artificial Sequence
  Description of Artificial Sequence: Synthetic polypeptide
DEEEIATVNPVCTEQYGSVSSTTPNGNMSNGMNPV

SEQ ID NO: 146204 - protein, 34 aa, Artificial Sequence
  Description of Artificial Sequence: Synthetic polypeptide
MEHEIATVNPVATEQYGSVITNGLGGGQEDGDTA

SEQ ID NO: 146205 - protein, 35 aa, Artificial Sequence
  Description of Artificial Sequence: Synthetic polypeptide
MEHEIATVNPVATEQYGSVITNGLGGGQEGGNVTA

SEQ ID NO: 146206 - protein, 36 aa, Artificial Sequence
  Description of Artificial Sequence: Synthetic polypeptide
DNEEIRTTNPVATEQYGSVSSTTPAGPNMRNGMHPV

SEQ ID NO: 146207 - protein, 36 aa, Artificial Sequence
  Description of Artificial Sequence: Synthetic polypeptide
DNEEIRTTNPVATEQYGSVSSTTPAGPNMRNGMDPV

SEQ ID NO: 146208 - protein, 36 aa, Artificial Sequence
  Description of Artificial Sequence: Synthetic polypeptide
DNEEIRTTNPVATEQYGSVSDTYDVVDTRFESNQIA

SEQ ID NO: 146209 - protein, 34 aa, Artificial Sequence
  Description of Artificial Sequence: Synthetic polypeptide
DEDEIRTTNPVAYEQWGVVVPTDNGDDHAGGENR

SEQ ID NO: 146210 - protein, 35 aa, Artificial Sequence
  Description of Artificial Sequence: Synthetic polypeptide
DNEEIRTTNPVATEQYGSVWVTEPWNQSRIEVSES

SEQ ID NO: 146211 - protein, 36 aa, Artificial Sequence
  Description of Artificial Sequence: Synthetic polypeptide
DEEEIRTTNPVATEQYGSVQVAAEETIENEEEANDM

SEQ ID NO: 146212 - protein, 36 aa, Artificial Sequence
  Description of Artificial Sequence: Synthetic polypeptide
MEGEIRTTNPVATEQYGSVWSPTPAGPNMRFGENNA

SEQ ID NO: 146213 - protein, 36 aa, Artificial Sequence
  Description of Artificial Sequence: Synthetic polypeptide
MEGEIRTTNPVATEQYGSVWNVTPNLDIESNEDERG

SEQ ID NO: 146214 - protein, 34 aa, Artificial Sequence
  Description of Artificial Sequence: Synthetic polypeptide
MEGEIRTTNPVATEQYGSVSVAAPTQEYFGEVGE

SEQ ID NO: 146215 - protein, 32 aa, Artificial Sequence
  Description of Artificial Sequence: Synthetic polypeptide
DEEEICTTNPCAYAEYGSVAYTNEHSGRGGMG

SEQ ID NO: 146216 - protein, 35 aa, Artificial Sequence
  Description of Artificial Sequence: Synthetic polypeptide
MEGEIRTTNPVATEQYGSVSVPNNIDSSEMGSLNE

SEQ ID NO: 146217 - protein, 35 aa, Artificial Sequence
  Description of Artificial Sequence: Synthetic polypeptide
MEGEIRTTNPVATEQYGSVSVSDNLTPRQVQADIV

SEQ ID NO: 146218 - protein, 36 aa, Artificial Sequence
  Description of Artificial Sequence: Synthetic polypeptide
MEGEIRTTNPVATEQYGSVSVSHNLWQPREVQDDIV

SEQ ID NO: 146219 - protein, 35 aa, Artificial Sequence
  Description of Artificial Sequence: Synthetic polypeptide
MEGEIRTTNPVATEQYGSVSVSMNLNPREVQADIV

SEQ ID NO: 146220 - protein, 35 aa, Artificial Sequence
  Description of Artificial Sequence: Synthetic polypeptide
DEDEIRTTNPVAYEQWGVVVPTDNGLDQAGGNMTI

SEQ ID NO: 146221 - protein, 35 aa, Artificial Sequence
  Description of Artificial Sequence: Synthetic polypeptide
MEGEIRTTNPVATEQYGSVSVSYNLTPREVQADII

SEQ ID NO: 146222 - protein, 34 aa, Artificial Sequence
  Description of Artificial Sequence: Synthetic polypeptide
DEDEIRTTNPVAYEQWGVVVPTDNGDVQHGGMNL

SEQ ID NO: 146223 - protein, 35 aa, Artificial Sequence
  Description of Artificial Sequence: Synthetic polypeptide
MEGEIRTTNPVATEQYGSVSWDESEQESGDDNYEG

SEQ ID NO: 146224 - protein, 35 aa, Artificial Sequence
  Description of Artificial Sequence: Synthetic polypeptide
MEGEIRTTNPVATEQYGSVTFETGMQQEMGNEEEN

SEQ ID NO: 146225 - protein, 37 aa, Artificial Sequence
  Description of Artificial Sequence: Synthetic polypeptide
DEEEIRTTNPVATEQYGSCHSSTTPAGPRMRNGMNPV

SEQ ID NO: 146226 - protein, 33 aa, Artificial Sequence
  Description of Artificial Sequence: Synthetic polypeptide
SAEEIATTNPVATAQWGSVSGTGNPDNADGGRM

SEQ ID NO: 146227 - protein, 33 aa, Artificial Sequence
  Description of Artificial Sequence: Synthetic polypeptide
MEGEIRTTNPVATEQYGSVTPDIDDQPMGEEKN

SEQ ID NO: 146228 - protein, 35 aa, Artificial Sequence
  Description of Artificial Sequence: Synthetic polypeptide
DEDEIRTTNPVAYEQWGVVVPTDNGDQAGGNMTRD

SEQ ID NO: 146229 - protein, 33 aa, Artificial Sequence
  Description of Artificial Sequence: Synthetic polypeptide
SAEEIATTNPVATAQWGSVSGTGNPDNADGNGN

SEQ ID NO: 146230 - protein, 35 aa, Artificial Sequence
  Description of Artificial Sequence: Synthetic polypeptide
MEGEIRTTNPVATEQYGSVTTPTGDNDQPMGEEKN

SEQ ID NO: 146231 - protein, 34 aa, Artificial Sequence
  Description of Artificial Sequence: Synthetic polypeptide
MEGEIRTTNPVATEQYGSVTYEGMQGEMGNEEKN

SEQ ID NO: 146232 - protein, 35 aa, Artificial Sequence
  Description of Artificial Sequence: Synthetic polypeptide
MEGEIRTTNPVATEQYGSVWNVTPLQIEPNEDEMT

SEQ ID NO: 146233 - protein, 35 aa, Artificial Sequence
  Description of Artificial Sequence: Synthetic polypeptide
DEEEIRTTNPVATEQYGSCGPNAPNLQPMMFEPTQ

SEQ ID NO: 146234 - protein, 29 aa, Artificial Sequence
  Description of Artificial Sequence: Synthetic peptide
QESEIASTNPVGTEGYGVMASVLQHGDRI

SEQ ID NO: 146235 - protein, 35 aa, Artificial Sequence
  Description of Artificial Sequence: Synthetic polypeptide
DEEEIRTTNPVATEQYGSVARCIEESSFNGGNNED

SEQ ID NO: 146236 - protein, 34 aa, Artificial Sequence
  Description of Artificial Sequence: Synthetic polypeptide
MEEEIVTTNPVATEQYGNVSVTGGGQGDGGIGEG

SEQ ID NO: 146237 - protein, 36 aa, Artificial Sequence
  Description of Artificial Sequence: Synthetic polypeptide
DEEEICTTNPVATECYGSVTTGNQGNQGGHGNNGQD

SEQ ID NO: 146238 - protein, 37 aa, Artificial Sequence
  Description of Artificial Sequence: Synthetic polypeptide
AEEEIRTTNPVATEQYGVVSTVNQNANQQGNGNNNQD

SEQ ID NO: 146239 - protein, 36 aa, Artificial Sequence
  Description of Artificial Sequence: Synthetic polypeptide
DEEAIRTTNPVAYEQYGQVVHFQMNDLLQPRGQIPR

SEQ ID NO: 146240 - protein, 33 aa, Artificial Sequence
  Description of Artificial Sequence: Synthetic polypeptide
DEEAIRTTNPVAYEQYGCVCSTGEHQNFISDQG

SEQ ID NO: 146241 - protein, 35 aa, Artificial Sequence
  Description of Artificial Sequence: Synthetic polypeptide
DEEEIRTTNPVATEQYGSVAEAPCTTEVPMTDNDV

SEQ ID NO: 146242 - protein, 35 aa, Artificial Sequence
  Description of Artificial Sequence: Synthetic polypeptide
DEEEIRTTNPVATEQYGSVAEDPTTEVRTTLPPDV

SEQ ID NO: 146243 - protein, 37 aa, Artificial Sequence
  Description of Artificial Sequence: Synthetic polypeptide
DEEEIRATNPVATEQYGVVSTVTQQQLQQGTNNQQED

SEQ ID NO: 146244 - protein, 37 aa, Artificial Sequence
  Description of Artificial Sequence: Synthetic polypeptide
DEEEIRATNPVATEQYGVVSTVVNQQGDTEQGTNQDE

SEQ ID NO: 146245 - protein, 37 aa, Artificial Sequence
  Description of Artificial Sequence: Synthetic polypeptide
DEEEIRATNPVATEQYGVVSTVNLQQSATEEGSTEDD

SEQ ID NO: 146246 - protein, 37 aa, Artificial Sequence
  Description of Artificial Sequence: Synthetic polypeptide
DEEEIRATNPVATEQYGVVSTVVNQQGTDEQGNTDDE

SEQ ID NO: 146247 - protein, 37 aa, Artificial Sequence
  Description of Artificial Sequence: Synthetic polypeptide
DEEEIRATNPVATEQYGVVSTVVNQQGTTEQGSNDEQ

SEQ ID NO: 146248 - protein, 34 aa, Artificial Sequence
  Description of Artificial Sequence: Synthetic polypeptide
DEEAIRTTNPVATEQYRYCVSVEVPMQSRGDGQQ

SEQ ID NO: 146249 - protein, 34 aa, Artificial Sequence
  Description of Artificial Sequence: Synthetic polypeptide
DEEAIRTTNPVATEQYRYCVSVEVEQSRYGDGQH

SEQ ID NO: 146250 - protein, 32 aa, Artificial Sequence
  Description of Artificial Sequence: Synthetic polypeptide
QESEIRTTNPVATECYGDVSCNEPQDHEEEEL

SEQ ID NO: 146251 - protein, 36 aa, Artificial Sequence
  Description of Artificial Sequence: Synthetic polypeptide
DSEEIRSTNPVATEHYGSTVCSCTNELSQARNVQQS

SEQ ID NO: 146252 - protein, 33 aa, Artificial Sequence
  Description of Artificial Sequence: Synthetic polypeptide
DEEEIAATNPFATEQYGQVDIELNPQDSKGTNS

SEQ ID NO: 146253 - protein, 33 aa, Artificial Sequence
  Description of Artificial Sequence: Synthetic polypeptide
QESEIRTTNPVATECYGEAPEINCPQDREGENK

SEQ ID NO: 146254 - protein, 33 aa, Artificial Sequence
  Description of Artificial Sequence: Synthetic polypeptide
DEEEIAATNPVATEQYGCVAANHDSQDSGGEPP

SEQ ID NO: 146255 - protein, 36 aa, Artificial Sequence
  Description of Artificial Sequence: Synthetic polypeptide
DSEEIRSTNPVATEQYGCTVCNCTNELSQASNVQQR

SEQ ID NO: 146256 - protein, 37 aa, Artificial Sequence
  Description of Artificial Sequence: Synthetic polypeptide
AEEEIRTTNPVATEQYGVVSTVNQNGSNQQGNNNQQD

SEQ ID NO: 146257 - protein, 36 aa, Artificial Sequence
  Description of Artificial Sequence: Synthetic polypeptide
AEEEIRTTNPVATEQYGVVSTVNQNGSTEQGTNQEE

SEQ ID NO: 146258 - protein, 37 aa, Artificial Sequence
  Description of Artificial Sequence: Synthetic polypeptide
DSEEIRSTNPVATEQYGSTVVSCTEELSQASNVDQQR

SEQ ID NO: 146259 - protein, 36 aa, Artificial Sequence
  Description of Artificial Sequence: Synthetic polypeptide
DEEEIRTTNPVATEQYGSVSNLSVISNDPSDEGVIF

SEQ ID NO: 146260 - protein, 36 aa, Artificial Sequence
  Description of Artificial Sequence: Synthetic polypeptide
DSEEIRTTNPVATECYGITVSCTNEQSQEFTGTNEY

SEQ ID NO: 146261 - protein, 37 aa, Artificial Sequence
  Description of Artificial Sequence: Synthetic polypeptide
DSEEIRTTNPVATEAYGSTASCLPNMLSQDRPDGNLT

SEQ ID NO: 146262 - protein, 37 aa, Artificial Sequence
  Description of Artificial Sequence: Synthetic polypeptide
DSEEIRTTNPVATEAYGSTASCLPNMLSQDRNDGNDL

SEQ ID NO: 146263 - protein, 36 aa, Artificial Sequence
  Description of Artificial Sequence: Synthetic polypeptide
DEEEIRTTNPVATEQYGSVADTIPAGPNMRNGMFPV

SEQ ID NO: 146264 - protein, 36 aa, Artificial Sequence
  Description of Artificial Sequence: Synthetic polypeptide
DEEEIRTTNPVATEQYGSVSNMMLLATPEVPELLRL

SEQ ID NO: 146265 - protein, 36 aa, Artificial Sequence
  Description of Artificial Sequence: Synthetic polypeptide
AEEEIRTTNPVATEQYGVVSTVNQQQNNNDEQNEAE

SEQ ID NO: 146266 - protein, 36 aa, Artificial Sequence
  Description of Artificial Sequence: Synthetic polypeptide
DSEEIRTTNPVAIEQYGSVSSTTPAGPNMRNGMNPV

SEQ ID NO: 146267 - protein, 32 aa, Artificial Sequence
  Description of Artificial Sequence: Synthetic polypeptide
AENEIACTNPVATEQYGCYCSNWNLQHFGSDQ

SEQ ID NO: 146268 - protein, 32 aa, Artificial Sequence
  Description of Artificial Sequence: Synthetic polypeptide
AENEIACTNPVATEQYGCYCSWALQRFGSGQA

SEQ ID NO: 146269 - protein, 32 aa, Artificial Sequence
  Description of Artificial Sequence: Synthetic polypeptide
AENEIACTNPVATEQYGCYCSWGNLQSFGSGQ

SEQ ID NO: 146270 - protein, 36 aa, Artificial Sequence
  Description of Artificial Sequence: Synthetic polypeptide
DEEEICTTNPVATECYGVVSTGNQGNQGGHGGGDND

SEQ ID NO: 146271 - protein, 36 aa, Artificial Sequence
  Description of Artificial Sequence: Synthetic polypeptide
DEEEICTTNPVATECYGVVSTGNMGNQGGQGGGRND

SEQ ID NO: 146272 - protein, 33 aa, Artificial Sequence
  Description of Artificial Sequence: Synthetic polypeptide
AENEIACTNPVATEQYGCYCSWNLNQRFGSDQF

SEQ ID NO: 146273 - protein, 36 aa, Artificial Sequence
  Description of Artificial Sequence: Synthetic polypeptide
DEEEIRTTNPVATEQYGSVSAEFPGTPERENPQEDT

SEQ ID NO: 146274 - protein, 33 aa, Artificial Sequence
  Description of Artificial Sequence: Synthetic polypeptide
QESEIRTTNPVATECWGSVSCICEPQDREEENG

SEQ ID NO: 146275 - protein, 32 aa, Artificial Sequence
  Description of Artificial Sequence: Synthetic polypeptide
AENEIACTNPVATEQYGCYCSWNLQRFISDQS

SEQ ID NO: 146276 - protein, 30 aa, Artificial Sequence
  Description of Artificial Sequence: Synthetic polypeptide
AENEIACTNPVATEQYGDASEIEQNAAGGA

SEQ ID NO: 146277 - protein, 33 aa, Artificial Sequence
  Description of Artificial Sequence: Synthetic polypeptide
DEEAIRTTNPVSTEFQYGQSNQVPNMHQRSETE

SEQ ID NO: 146278 - protein, 36 aa, Artificial Sequence
  Description of Artificial Sequence: Synthetic polypeptide
DEEEIRATNPVATERYGSVSSTTPAGPNMRNGMNPV

SEQ ID NO: 146279 - protein, 38 aa, Artificial Sequence
  Description of Artificial Sequence: Synthetic polypeptide
AEEEIRTTNPVATEQYGVVSTVNTANQLGNQQGNNNGD

SEQ ID NO: 146280 - protein, 35 aa, Artificial Sequence
  Description of Artificial Sequence: Synthetic polypeptide
DEEEIRATNPVAYEQWGEVSGGNMDRQDGQGGNGR

SEQ ID NO: 146281 - protein, 35 aa, Artificial Sequence
  Description of Artificial Sequence: Synthetic polypeptide
DEEEIAATNPVATEQYGSVCAMANNDQDQGGNDYQ

SEQ ID NO: 146282 - protein, 36 aa, Artificial Sequence
  Description of Artificial Sequence: Synthetic polypeptide
DEEEIRTTNPVATEQYGSCSSTTPAGPNMRNMMNPV

SEQ ID NO: 146283 - protein, 36 aa, Artificial Sequence
  Description of Artificial Sequence: Synthetic polypeptide
MEEEIRTTNPVATEQYGSVVTDGQIGQDEQGGENQA

SEQ ID NO: 146284 - protein, 37 aa, Artificial Sequence
  Description of Artificial Sequence: Synthetic polypeptide
DEEEIRTTNPVATEQYGSCSSTTPAGPNMRNGMNPVP

SEQ ID NO: 146285 - protein, 32 aa, Artificial Sequence
  Description of Artificial Sequence: Synthetic polypeptide
DSEEIATTNPVGYEQWGCVRHNDLQQDRRGAA

SEQ ID NO: 146286 - protein, 34 aa, Artificial Sequence
  Description of Artificial Sequence: Synthetic polypeptide
DEEAIRTTNPVATEQYGSVNPTEQDDDRQEEEEG

SEQ ID NO: 146287 - protein, 36 aa, Artificial Sequence
  Description of Artificial Sequence: Synthetic polypeptide
DEEEIRTTNPVATEQYGSVAEESPTTEVPTTAPNDV

SEQ ID NO: 146288 - protein, 37 aa, Artificial Sequence
  Description of Artificial Sequence: Synthetic polypeptide
AEEEIRTTNPVATEQYGVVSTVNNNQQQGTEGTNNNQ

SEQ ID NO: 146289 - protein, 35 aa, Artificial Sequence
  Description of Artificial Sequence: Synthetic polypeptide
DEEAIRTTNPVATEQYGSAVVTLVNSHFENSEEFQ

SEQ ID NO: 146290 - protein, 36 aa, Artificial Sequence
  Description of Artificial Sequence: Synthetic polypeptide
MEEEIRTTNPVATEQYGSVTVGNNMSQNDGGGNEEI

SEQ ID NO: 146291 - protein, 34 aa, Artificial Sequence
  Description of Artificial Sequence: Synthetic polypeptide
DEEAIRTTNPVATEQYGSAVPNLVSHFENSEEFQ

SEQ ID NO: 146292 - protein, 37 aa, Artificial Sequence
  Description of Artificial Sequence: Synthetic polypeptide
MEEEIRTTNPVATEQYGSVYDQSNLNSIQTGGGNQGD

SEQ ID NO: 146293 - protein, 35 aa, Artificial Sequence
  Description of Artificial Sequence: Synthetic polypeptide
DEEAIRTTNPVATEQYGQCVCSTEHFQESFGSEQS

SEQ ID NO: 146294 - protein, 36 aa, Artificial Sequence
  Description of Artificial Sequence: Synthetic polypeptide
MEEEIRTTNPVATEQYGSVYGDDNTLQDTGGEETED

SEQ ID NO: 146295 - protein, 36 aa, Artificial Sequence
  Description of Artificial Sequence: Synthetic polypeptide
DEEEIRTTNPVATEQYGSVSNNLTYSEAVPFFVQVA

SEQ ID NO: 146296 - protein, 34 aa, Artificial Sequence
  Description of Artificial Sequence: Synthetic polypeptide
DSEEIAATNPVAYEQYGISVVATMNMLTGGGNTF

SEQ ID NO: 146297 - protein, 33 aa, Artificial Sequence
  Description of Artificial Sequence: Synthetic polypeptide
DSEEIAATNPVAYEQYGIKVVATLNMLTGGGNT

SEQ ID NO: 146298 - protein, 37 aa, Artificial Sequence
  Description of Artificial Sequence: Synthetic polypeptide
AEEEIRTTNPVATEQYGSVSTVTTNQNNSEQGTNTTQ

SEQ ID NO: 146299 - protein, 34 aa, Artificial Sequence
  Description of Artificial Sequence: Synthetic polypeptide
QESEIRTTNPVCYEPYGVVSCDPNLSQNRGGNND

SEQ ID NO: 146300 - protein, 36 aa, Artificial Sequence
  Description of Artificial Sequence: Synthetic polypeptide
DEEEIRTTNPVATEQYGSCSSTTPAGPDMENGMNPV

SEQ ID NO: 146301 - protein, 37 aa, Artificial Sequence
  Description of Artificial Sequence: Synthetic polypeptide
DEEEIRTTNPVATEQYGSCSSTTPAYPNMRNGMNPVG

SEQ ID NO: 146302 - protein, 36 aa, Artificial Sequence
  Description of Artificial Sequence: Synthetic polypeptide
MEEEIRTTNPVATEQYGSVTTDNQGDQNMEGEDGET

SEQ ID NO: 146303 - protein, 37 aa, Artificial Sequence
  Description of Artificial Sequence: Synthetic polypeptide
AEEEIRTTNPVATEQYGVVSTVNNNQQQNDETGNNNE

SEQ ID NO: 146304 - protein, 37 aa, Artificial Sequence
  Description of Artificial Sequence: Synthetic polypeptide
DEEAIRTTNPVATEQYGSVSSTTMAGPNMRNGMNPVT

SEQ ID NO: 146305 - protein, 37 aa, Artificial Sequence
  Description of Artificial Sequence: Synthetic polypeptide
AEEEIRTTNPVATEQYGVVSTVNNQLGGSEEGTNTNT

SEQ ID NO: 146306 - protein, 35 aa, Artificial Sequence
  Description of Artificial Sequence: Synthetic polypeptide
DEEEIAATNPVATEQYGSVCAMANNDQDQGGNENN

SEQ ID NO: 146307 - protein, 32 aa, Artificial Sequence
  Description of Artificial Sequence: Synthetic polypeptide
AENEIACTNPVATEQYGEACSAENLVEREGGD

SEQ ID NO: 146308 - protein, 33 aa, Artificial Sequence
  Description of Artificial Sequence: Synthetic polypeptide
DEEEIRATNPVAYEQWGMVTGGNDHQMGQGNGL

SEQ ID NO: 146309 - protein, 38 aa, Artificial Sequence
  Description of Artificial Sequence: Synthetic polypeptide
AEEEIRTTNPVATEQYGSVSTVTTNTNNQNDEGTNNEE

SEQ ID NO: 146310 - protein, 34 aa, Artificial Sequence
  Description of Artificial Sequence: Synthetic polypeptide
DEEEIRATNPVAYEQYGSACAANNLQGAGLPSDM

SEQ ID NO: 146311 - protein, 37 aa, Artificial Sequence
  Description of Artificial Sequence: Synthetic polypeptide
DEEAIRTTNPVATEQYGSVNSTETQFDDDTRGQQEEG

SEQ ID NO: 146312 - protein, 35 aa, Artificial Sequence
  Description of Artificial Sequence: Synthetic polypeptide
DEEAIRTTNPVATEQYGSVNSTEQWDDDRSEEEEG

SEQ ID NO: 146313 - protein, 35 aa, Artificial Sequence
  Description of Artificial Sequence: Synthetic polypeptide
DEEAIRTTNPVATEQYGSVNSTEQNDDDSVEEEEG

SEQ ID NO: 146314 - protein, 37 aa, Artificial Sequence
  Description of Artificial Sequence: Synthetic polypeptide
AEEEIRTTNPVATEQYGVVSTVNNQGNNQDNGNNNSD

SEQ ID NO: 146315 - protein, 36 aa, Artificial Sequence
  Description of Artificial Sequence: Synthetic polypeptide
DEEAIRTTNPVATEQYGSVNSTEQMDDDNRVEEEEG

SEQ ID NO: 146316 - protein, 35 aa, Artificial Sequence
  Description of Artificial Sequence: Synthetic polypeptide
DEEAIRTTNPVATEQYGSVNSTEQEDDDRMEEQEG

SEQ ID NO: 146317 - protein, 35 aa, Artificial Sequence
  Description of Artificial Sequence: Synthetic polypeptide
DEEAIRTTNPVATEQYGSVNSTEQEDDDEVEEENG

SEQ ID NO: 146318 - protein, 30 aa, Artificial Sequence
  Description of Artificial Sequence: Synthetic polypeptide
QESEIRTTNPVATEGWGVVSEILMNAAEDI

SEQ ID NO: 146319 - protein, 36 aa, Artificial Sequence
  Description of Artificial Sequence: Synthetic polypeptide
DEEAIRTTNPVATEQYGSVNSTEQDDDTRGQGQEEG

SEQ ID NO: 146320 - protein, 30 aa, Artificial Sequence
  Description of Artificial Sequence: Synthetic polypeptide
QESEIRTTNPVATEGWGVVSETLMNAAEDI

SEQ ID NO: 146321 - protein, 33 aa, Artificial Sequence
  Description of Artificial Sequence: Synthetic polypeptide
DEEEIAATNPVAYEAYGIKVVWTDNMLTGGGNT

SEQ ID NO: 146322 - protein, 35 aa, Artificial Sequence
  Description of Artificial Sequence: Synthetic polypeptide
DEEAIRTTNPVATEQYGSVNSTEQDDDSRSVEEEN

SEQ ID NO: 146323 - protein, 36 aa, Artificial Sequence
  Description of Artificial Sequence: Synthetic polypeptide
DEEEIRTTNPVATEQYGSVSADWPYNCAQFEESIQD

SEQ ID NO: 146324 - protein, 33 aa, Artificial Sequence
  Description of Artificial Sequence: Synthetic polypeptide
AENEIACTNPVATEQYGCSCSWNLQHFGSQTQS

SEQ ID NO: 146325 - protein, 37 aa, Artificial Sequence
  Description of Artificial Sequence: Synthetic polypeptide
AEEEIRTTNPVATEQYGVVSTVNTDGGNTNQLGGNDD

SEQ ID NO: 146326 - protein, 34 aa, Artificial Sequence
  Description of Artificial Sequence: Synthetic polypeptide
AENEIACTNPVATEQYGCSCSWNLNQERFGSQQA

SEQ ID NO: 146327 - protein, 33 aa, Artificial Sequence
  Description of Artificial Sequence: Synthetic polypeptide
AENEIACTNPVATEQYGCSCSSNDLQNFGSGQS

SEQ ID NO: 146328 - protein, 37 aa, Artificial Sequence
  Description of Artificial Sequence: Synthetic polypeptide
DEEEIRATNPVATEQYGSVSTVNNQQGSTEQGSTDDE

SEQ ID NO: 146329 - protein, 37 aa, Artificial Sequence
  Description of Artificial Sequence: Synthetic polypeptide
DEEEIRATNPVATEQYGSVSTVTNQQGTTEQGSTTDD

SEQ ID NO: 146330 - protein, 38 aa, Artificial Sequence
  Description of Artificial Sequence: Synthetic polypeptide
AEEEIRTTNPVATEQYGVVSTVTNNNLQGTEQGSNQNQ

SEQ ID NO: 146331 - protein, 37 aa, Artificial Sequence
  Description of Artificial Sequence: Synthetic polypeptide
MEEEIRTTNPVATEQYGSVSGGFNGGGQGENDGNGGV

SEQ ID NO: 146332 - protein, 33 aa, Artificial Sequence
  Description of Artificial Sequence: Synthetic polypeptide
QESEIRSTNPVATECWGSVACINEPQDREGENG

SEQ ID NO: 146333 - protein, 38 aa, Artificial Sequence
  Description of Artificial Sequence: Synthetic polypeptide
AEEEIRTTNPVATEQYGVVSTVTNNNLQAGTTEENTDM

SEQ ID NO: 146334 - protein, 37 aa, Artificial Sequence
  Description of Artificial Sequence: Synthetic polypeptide
DEEEIRATNPVATEQYGSVSTVVNQQSATEQGSTEDE

SEQ ID NO: 146335 - protein, 33 aa, Artificial Sequence
  Description of Artificial Sequence: Synthetic polypeptide
AENEIACTNPVATEQYGCSCSSMNLQNFGSDQA

SEQ ID NO: 146336 - protein, 35 aa, Artificial Sequence
  Description of Artificial Sequence: Synthetic polypeptide
MEEEIRTTNPVATEQYGSVSNGFDEENDEGGGDGD

SEQ ID NO: 146337 - protein, 32 aa, Artificial Sequence
  Description of Artificial Sequence: Synthetic polypeptide
AENEIACTNPVATEQYGCSCSSNPQYFGSDQS

SEQ ID NO: 146338 - protein, 32 aa, Artificial Sequence
  Description of Artificial Sequence: Synthetic polypeptide
AENEIACTNPVATEQYGCSCSSPLNQHFGSDQ

SEQ ID NO: 146339 - protein, 36 aa, Artificial Sequence
  Description of Artificial Sequence: Synthetic polypeptide
MEEEIRTTNPVATEQYGSVSPPPTLAINVGSNVQNP

SEQ ID NO: 146340 - protein, 34 aa, Artificial Sequence
  Description of Artificial Sequence: Synthetic polypeptide
DEECVRTTNPIAYEQYGEVVSCTGNSSQLGGNYY

SEQ ID NO: 146341 - protein, 36 aa, Artificial Sequence
  Description of Artificial Sequence: Synthetic polypeptide
DSEEIRTTNPVATEQYGSVSPFYAEMLENFEGSNDH

SEQ ID NO: 146342 - protein, 33 aa, Artificial Sequence
  Description of Artificial Sequence: Synthetic polypeptide
AENEIACTNPVATEQYGCSCSTWNDQYFGSDQA

SEQ ID NO: 146343 - protein, 35 aa, Artificial Sequence
  Description of Artificial Sequence: Synthetic polypeptide
DEEEIRATNPVATEQYGSVVSDDGQAEGQTGGEGE

SEQ ID NO: 146344 - protein, 31 aa, Artificial Sequence
  Description of Artificial Sequence: Synthetic polypeptide
QESEIRSTNPVATEGYGVTTANATLAEPGDI

SEQ ID NO: 146345 - protein, 36 aa, Artificial Sequence
  Description of Artificial Sequence: Synthetic polypeptide
MEEEIRTTNPVATEQYGSVSNNDNMDQGGGQTQTTP

SEQ ID NO: 146346 - protein, 36 aa, Artificial Sequence
  Description of Artificial Sequence: Synthetic polypeptide
DSEEIRTTNPVATEQYGVVSCTNALSTEFTGTPTSY

SEQ ID NO: 146347 - protein, 37 aa, Artificial Sequence
  Description of Artificial Sequence: Synthetic polypeptide
AEEEIRTTNPVATEQYGVVSTVTNNNNQNDNGTNNVE

SEQ ID NO: 146348 - protein, 37 aa, Artificial Sequence
  Description of Artificial Sequence: Synthetic polypeptide
AEEEIRTTNPVATEQYGSVSTVVADGGNNNLGGNDDT

SEQ ID NO: 146349 - protein, 34 aa, Artificial Sequence
  Description of Artificial Sequence: Synthetic polypeptide
MEEEIRTTNPVATEQYGSVNDMDENLETIEVPQQ

SEQ ID NO: 146350 - protein, 36 aa, Artificial Sequence
  Description of Artificial Sequence: Synthetic polypeptide
DEEEIRTTNPVATEQYGSVSALNEDNTGIFQEEMLI

SEQ ID NO: 146351 - protein, 37 aa, Artificial Sequence
  Description of Artificial Sequence: Synthetic polypeptide
AEEEIRTTNPVATEQYGVVSTVTNNQLQDEQGTTEDE

SEQ ID NO: 146352 - protein, 36 aa, Artificial Sequence
  Description of Artificial Sequence: Synthetic polypeptide
DSEEIRTTNPVATNQWGQSVPSCTTELNGTGGTNRD

SEQ ID NO: 146353 - protein, 37 aa, Artificial Sequence
  Description of Artificial Sequence: Synthetic polypeptide
AEEEIRTTNPVATEQYGSVSTVVDQNGNSEEGNNQED

SEQ ID NO: 146354 - protein, 31 aa, Artificial Sequence
  Description of Artificial Sequence: Synthetic polypeptide
AENEIACTNPVATEQYGCSCSSEHQNFGSGQ

SEQ ID NO: 146355 - protein, 36 aa, Artificial Sequence
  Description of Artificial Sequence: Synthetic polypeptide
MEEEIRTTNPVATEQYGSVNGTSNMDDQGEGQGEIE

SEQ ID NO: 146356 - protein, 33 aa, Artificial Sequence
  Description of Artificial Sequence: Synthetic polypeptide
AENEIACTNPVATEQYGCSCSSELNQNFGSGNQ

SEQ ID NO: 146357 - protein, 32 aa, Artificial Sequence
  Description of Artificial Sequence: Synthetic polypeptide
AENEIACTNPVATEQYGCSCSSELQNFGSDQS

SEQ ID NO: 146358 - protein, 36 aa, Artificial Sequence
  Description of Artificial Sequence: Synthetic polypeptide
DSEEIRTTNPVATESWGQSVPSCTAEFQATTGTNRH

SEQ ID NO: 146359 - protein, 34 aa, Artificial Sequence
  Description of Artificial Sequence: Synthetic polypeptide
DEEAISTTNPVATEQYGCVCSWGELQNFNSENQS

SEQ ID NO: 146360 - protein, 36 aa, Artificial Sequence
  Description of Artificial Sequence: Synthetic polypeptide
DEEEIRATNPVATEQYGSVSGDDIGDGQNEGENETT

SEQ ID NO: 146361 - protein, 35 aa, Artificial Sequence
  Description of Artificial Sequence: Synthetic polypeptide
MEEEIRTTNPVATEQYGSVNQDENNMTGTGGNGGT

SEQ ID NO: 146362 - protein, 35 aa, Artificial Sequence
  Description of Artificial Sequence: Synthetic polypeptide
DEECVRTTNPIAYEQYGCEVVACTNLSQTDGNYRD

SEQ ID NO: 146363 - protein, 35 aa, Artificial Sequence
  Description of Artificial Sequence: Synthetic polypeptide
MEEEIRTTNPVATEQYGSVPPEGLAIQQLNGVLTN

SEQ ID NO: 146364 - protein, 33 aa, Artificial Sequence
  Description of Artificial Sequence: Synthetic polypeptide
AENEIACTNPVATEQYGCSCSSGNLQHFGSDQS

SEQ ID NO: 146365 - protein, 36 aa, Artificial Sequence
  Description of Artificial Sequence: Synthetic polypeptide
DEEEIRTTNPVATEQYGSVAAPNIVEMVREGMVSVM

SEQ ID NO: 146366 - protein, 36 aa, Artificial Sequence
  Description of Artificial Sequence: Synthetic polypeptide
DEEEICTTNPVATEQYGCVSSTTPAGPNMRNGMNPV

SEQ ID NO: 146367 - protein, 37 aa, Artificial Sequence
  Description of Artificial Sequence: Synthetic polypeptide
AEEEIRTTNPVATEQYGVVSTVTNNNNQQGNNNNQED

SEQ ID NO: 146368 - protein, 37 aa, Artificial Sequence
  Description of Artificial Sequence: Synthetic polypeptide
MEEEIRTTNPVATEQYGSVSSGFNGGGQGENDGNGGV

SEQ ID NO: 146369 - protein, 33 aa, Artificial Sequence
  Description of Artificial Sequence: Synthetic polypeptide
QESEIRSTNPVGTECYGSVACITEPQDREGENG

SEQ ID NO: 146370 - protein, 31 aa, Artificial Sequence
  Description of Artificial Sequence: Synthetic polypeptide
QESEIRSTNPVGTECYGVVACINEQREGEDG

SEQ ID NO: 146371 - protein, 36 aa, Artificial Sequence
  Description of Artificial Sequence: Synthetic polypeptide
DSEEIRTTNPVATEQYGSVNSTTPAEWNMENGMIDD

SEQ ID NO: 146372 - protein, 36 aa, Artificial Sequence
  Description of Artificial Sequence: Synthetic polypeptide
MEEEIRTTNPVATEQYGSVSTMGVMEGQNVEGQSGD

SEQ ID NO: 146373 - protein, 33 aa, Artificial Sequence
  Description of Artificial Sequence: Synthetic polypeptide
QESEIRTTNPCSTECWGIVSCINEPQDREGENR

SEQ ID NO: 146374 - protein, 32 aa, Artificial Sequence
  Description of Artificial Sequence: Synthetic polypeptide
QENEIATTNPVATECYGDVSSEPCGPQRGEPL

SEQ ID NO: 146375 - protein, 31 aa, Artificial Sequence
  Description of Artificial Sequence: Synthetic polypeptide
QENEIATTNPVATECYGDVSSEPALQHNEEL

SEQ ID NO: 146376 - protein, 36 aa, Artificial Sequence
  Description of Artificial Sequence: Synthetic polypeptide
AEEEIRTTNPVATEQYGVVSTVTNDEEEEIGTNSTS

SEQ ID NO: 146377 - protein, 36 aa, Artificial Sequence
  Description of Artificial Sequence: Synthetic polypeptide
AEEEIRTTNPVATEQYGVVSTVTGNQLGGNNDENSE

SEQ ID NO: 146378 - protein, 37 aa, Artificial Sequence
  Description of Artificial Sequence: Synthetic polypeptide
AEEEIRTTNPVATEQYGVVSTVTDNGGNQQGNNNQQD

SEQ ID NO: 146379 - protein, 35 aa, Artificial Sequence
  Description of Artificial Sequence: Synthetic polypeptide
DSEEIRTTNPVATEQYGAVCSTWVEDEDDGNDNQD

SEQ ID NO: 146380 - protein, 33 aa, Artificial Sequence
  Description of Artificial Sequence: Synthetic polypeptide
QESEIRTTNPVATECWGDVSCINEPQDHEGENL

SEQ ID NO: 146381 - protein, 36 aa, Artificial Sequence
  Description of Artificial Sequence: Synthetic polypeptide
AEEEIRTTNPVATEQYGVVSTVQNQNGNDEGNNVED

SEQ ID NO: 146382 - protein, 35 aa, Artificial Sequence
  Description of Artificial Sequence: Synthetic polypeptide
DEEEIRTTNPVATEQYGSVADPLMEEVPMGPLEQG

SEQ ID NO: 146383 - protein, 33 aa, Artificial Sequence
  Description of Artificial Sequence: Synthetic polypeptide
DSEEIRTTNPVATEQWGSCTTTELLWREQTQYL

SEQ ID NO: 146384 - protein, 33 aa, Artificial Sequence
  Description of Artificial Sequence: Synthetic polypeptide
QESEIRTTNPVATECWGDVSCINEPQDREEENG

SEQ ID NO: 146385 - protein, 37 aa, Artificial Sequence
  Description of Artificial Sequence: Synthetic polypeptide
AEEEIRTTNPVATEQYGVVSTVNTNQLQGNNDENSEA

SEQ ID NO: 146386 - protein, 32 aa, Artificial Sequence
  Description of Artificial Sequence: Synthetic polypeptide
QESEIRTTNPVATECWGDVSCNEPQDHEEENL

SEQ ID NO: 146387 - protein, 33 aa, Artificial Sequence
  Description of Artificial Sequence: Synthetic polypeptide
QESEIRTTNPVATECWGDVSEINEPQDREEENG

SEQ ID NO: 146388 - protein, 33 aa, Artificial Sequence
  Description of Artificial Sequence: Synthetic polypeptide
QESEIRTTNPVATECWGEVSCINEPFDREGENG

SEQ ID NO: 146389 - protein, 36 aa, Artificial Sequence
  Description of Artificial Sequence: Synthetic polypeptide
DEEEIRTTNPVATEQYGSVSAEFVYMQIMENPEDIQ

SEQ ID NO: 146390 - protein, 31 aa, Artificial Sequence
  Description of Artificial Sequence: Synthetic polypeptide
QESEIRTTNPVATECWGSAPEINEQDHEGEG

SEQ ID NO: 146391 - protein, 35 aa, Artificial Sequence
  Description of Artificial Sequence: Synthetic polypeptide
DEEEICTTNPVATECYGVVTTGNQGNQGGHGNTND

SEQ ID NO: 146392 - protein, 35 aa, Artificial Sequence
  Description of Artificial Sequence: Synthetic polypeptide
DEEEICTTNPVATECYGSVTTGNQGNQGGHGGGSD

SEQ ID NO: 146393 - protein, 36 aa, Artificial Sequence
  Description of Artificial Sequence: Synthetic polypeptide
DEEEIRTTNPVATEQYGSVACVTLMLQEVESEFQAA

SEQ ID NO: 146394 - protein, 36 aa, Artificial Sequence
  Description of Artificial Sequence: Synthetic polypeptide
DEEEIRTTNPVATEQYGSVACVMLMLQEVESEEQRN

SEQ ID NO: 146395 - protein, 35 aa, Artificial Sequence
  Description of Artificial Sequence: Synthetic polypeptide
DEEEIRTTNPVATEQYGSVSNFGMLVEVALAVEEE

SEQ ID NO: 146396 - protein, 28 aa, Artificial Sequence
  Description of Artificial Sequence: Synthetic peptide
QESEIRSTNPVGTEGWGVMASTLAHGDI

SEQ ID NO: 146397 - protein, 37 aa, Artificial Sequence
  Description of Artificial Sequence: Synthetic polypeptide
DEEEIRTTNPVATEQYGSVACCTEMLVQEVESESQRN

SEQ ID NO: 146398 - protein, 36 aa, Artificial Sequence
  Description of Artificial Sequence: Synthetic polypeptide
MEEEIRTTNPVATEQYGSVSSTTPAGPNMRNGMGPV

SEQ ID NO: 146399 - protein, 30 aa, Artificial Sequence
  Description of Artificial Sequence: Synthetic polypeptide
QESEIRSTNPVGTEGYGVISMTIQQQHGDI

SEQ ID NO: 146400 - protein, 37 aa, Artificial Sequence
  Description of Artificial Sequence: Synthetic polypeptide
MEEEIRTTNPVATEQYGSVSSTTPAGPNMRNGMNPVL

SEQ ID NO: 146401 - protein, 34 aa, Artificial Sequence
  Description of Artificial Sequence: Synthetic polypeptide
DEEEICTTNPVATEMWGEVSTNNGNDDRQNNGDH

SEQ ID NO: 146402 - protein, 35 aa, Artificial Sequence
  Description of Artificial Sequence: Synthetic polypeptide
DEEEIRTTNPVATEQYGSVACTLMLVEVESEFQSN

SEQ ID NO: 146403 - protein, 32 aa, Artificial Sequence
  Description of Artificial Sequence: Synthetic polypeptide
AENEIACTNPVATEQYGCSCSWEHQRFGSDQS

SEQ ID NO: 146404 - protein, 36 aa, Artificial Sequence
  Description of Artificial Sequence: Synthetic polypeptide
DSEEIRTTNPVATEQYGKVSCTNELSQEATVTPTSY

SEQ ID NO: 146405 - protein, 30 aa, Artificial Sequence
  Description of Artificial Sequence: Synthetic polypeptide
QESEIRSTNPVGTEGYGVVSETEQNHAGDA

SEQ ID NO: 146406 - protein, 37 aa, Artificial Sequence
  Description of Artificial Sequence: Synthetic polypeptide
AEEEIRTTNPVATEQYGVVSTVTNNGNQQGNTNNQQD

SEQ ID NO: 146407 - protein, 36 aa, Artificial Sequence
  Description of Artificial Sequence: Synthetic polypeptide
DSEEIRTTNPVATEQYGIVSCTNELSQSFTVTHTSY

SEQ ID NO: 146408 - protein, 36 aa, Artificial Sequence
  Description of Artificial Sequence: Synthetic polypeptide
DSEEIRTTNPVATEQYGIVSCTNELSQQFTVTPTSN

SEQ ID NO: 146409 - protein, 36 aa, Artificial Sequence
  Description of Artificial Sequence: Synthetic polypeptide
DSEEIRTTNPVATEQYGIVSCTNELSHESTGTETSY

SEQ ID NO: 146410 - protein, 32 aa, Artificial Sequence
  Description of Artificial Sequence: Synthetic polypeptide
AENEIACTNPVATEQYGCSCSWELQHFGSQQA

SEQ ID NO: 146411 - protein, 36 aa, Artificial Sequence
  Description of Artificial Sequence: Synthetic polypeptide
DEEEIRATNPVATEQYGVVSDNMGQIMGGGGGNDQQ

SEQ ID NO: 146412 - protein, 32 aa, Artificial Sequence
  Description of Artificial Sequence: Synthetic polypeptide
QESEIRSTNPVGTEQYGSVATSAGNHNGMNPV

SEQ ID NO: 146413 - protein, 37 aa, Artificial Sequence
  Description of Artificial Sequence: Synthetic polypeptide
MEEEIRTTNPVATEQYGSVSTDQEGQNEDQGGQGGGI

SEQ ID NO: 146414 - protein, 35 aa, Artificial Sequence
  Description of Artificial Sequence: Synthetic polypeptide
DEECVRTTNPIAYEWYGEVVSCTNALSQTGGNYRD

SEQ ID NO: 146415 - protein, 37 aa, Artificial Sequence
  Description of Artificial Sequence: Synthetic polypeptide
AEEEIRTTNPVATEQYGVVSTTTQQLQQQISTEQGNE

SEQ ID NO: 146416 - protein, 33 aa, Artificial Sequence
  Description of Artificial Sequence: Synthetic polypeptide
QESEIRTTNPVGTECWGVVSCINEPQDREGENG

SEQ ID NO: 146417 - protein, 31 aa, Artificial Sequence
  Description of Artificial Sequence: Synthetic polypeptide
DSEDIATTNPVATEQWGCVAGEGHQRAVENL

SEQ ID NO: 146418 - protein, 29 aa, Artificial Sequence
  Description of Artificial Sequence: Synthetic peptide
QETEIATTNPISSECWGAVSCNWQEPGTR

SEQ ID NO: 146419 - protein, 29 aa, Artificial Sequence
  Description of Artificial Sequence: Synthetic peptide
QETEIATTNPISSECWGAVSCNWQESGTR

SEQ ID NO: 146420 - protein, 36 aa, Artificial Sequence
  Description of Artificial Sequence: Synthetic polypeptide
DEEAICTVNPVATEAYGSVSTVNNQLQENNNGNNQD

SEQ ID NO: 146421 - protein, 36 aa, Artificial Sequence
  Description of Artificial Sequence: Synthetic polypeptide
DEEAICTVNPVATEAYGSVSTVNNQLQENNGTNNTE

SEQ ID NO: 146422 - protein, 37 aa, Artificial Sequence
  Description of Artificial Sequence: Synthetic polypeptide
DEEEICTTNPVATECYGSVSTGGNPGNQGGHGGGGND

SEQ ID NO: 146423 - protein, 37 aa, Artificial Sequence
  Description of Artificial Sequence: Synthetic polypeptide
DEEEIRTTNPVATEQYGSVAQPAMMEEEVLENGTLNR

SEQ ID NO: 146424 - protein, 36 aa, Artificial Sequence
  Description of Artificial Sequence: Synthetic polypeptide
DEEAICTVNPVATEAYGSVSTVNNQLQEGNNGNNQE

SEQ ID NO: 146425 - protein, 37 aa, Artificial Sequence
  Description of Artificial Sequence: Synthetic polypeptide
DEEEIRTTNPVATEQYGSVAQPEMMESTVLENVTLND

SEQ ID NO: 146426 - protein, 30 aa, Artificial Sequence
  Description of Artificial Sequence: Synthetic polypeptide
QETEIATTNPIATECYGATSNADLQEHGPL

SEQ ID NO: 146427 - protein, 36 aa, Artificial Sequence
  Description of Artificial Sequence: Synthetic polypeptide
DEEAICTVNPVATEAYGSVSTVNNLQENNNGTNTQD

SEQ ID NO: 146428 - protein, 38 aa, Artificial Sequence
  Description of Artificial Sequence: Synthetic polypeptide
DEEEIRTTNPVATEQYGSVAQPEMMEVTVLEVGITQNR

SEQ ID NO: 146429 - protein, 38 aa, Artificial Sequence
  Description of Artificial Sequence: Synthetic polypeptide
AEEEIRTTNPVATEQYGVVSTVATNLQQGNQQGNNEGD

SEQ ID NO: 146430 - protein, 29 aa, Artificial Sequence
  Description of Artificial Sequence: Synthetic peptide
QETEIATTNPVATEQYGAAPEDWQHKEPK

SEQ ID NO: 146431 - protein, 29 aa, Artificial Sequence
  Description of Artificial Sequence: Synthetic peptide
QETEIATTNPVATEQYGEAPEDWQHKEPK

SEQ ID NO: 146432 - protein, 35 aa, Artificial Sequence
  Description of Artificial Sequence: Synthetic polypeptide
MEEEISTTNPVATEQYGCVTSVTEEHQGFGSDNQS

SEQ ID NO: 146433 - protein, 29 aa, Artificial Sequence
  Description of Artificial Sequence: Synthetic peptide
QETEIATTNPVATEQYGEAPEVCQHKEEK

SEQ ID NO: 146434 - protein, 34 aa, Artificial Sequence
  Description of Artificial Sequence: Synthetic polypeptide
DQEEIRTTNPVAYEAYGSVPSTATELSTMPVNLP

SEQ ID NO: 146435 - protein, 34 aa, Artificial Sequence
  Description of Artificial Sequence: Synthetic polypeptide
MEEEISTTNPVATEQYGCVTSVTGEHQGFNSNQS

SEQ ID NO: 146436 - protein, 36 aa, Artificial Sequence
  Description of Artificial Sequence: Synthetic polypeptide
DEEAICTVNPVATEAYGSVSTVNNLQENNNGNNGED

SEQ ID NO: 146437 - protein, 34 aa, Artificial Sequence
  Description of Artificial Sequence: Synthetic polypeptide
DEEEIRTTNPVATEQYGSCSDPVGLIETMVEQTA

SEQ ID NO: 146438 - protein, 29 aa, Artificial Sequence
  Description of Artificial Sequence: Synthetic peptide
QETEIATTNPCSSEQYGIVACNWASKGTR

SEQ ID NO: 146439 - protein, 33 aa, Artificial Sequence
  Description of Artificial Sequence: Synthetic polypeptide
MEEEISTTNPVATEQYGCVCSWPEHQNFGSEQY

SEQ ID NO: 146440 - protein, 28 aa, Artificial Sequence
  Description of Artificial Sequence: Synthetic peptide
QESVIASTNPVGTEGYGVMASTLQHGDI

SEQ ID NO: 146441 - protein, 34 aa, Artificial Sequence
  Description of Artificial Sequence: Synthetic polypeptide
QETAEIACTNPVATEQYGSVATNHQEADGPGENG

SEQ ID NO: 146442 - protein, 30 aa, Artificial Sequence
  Description of Artificial Sequence: Synthetic polypeptide
QENEIATTNPVATECYGDVSEPAGQHEMEL

SEQ ID NO: 146443 - protein, 36 aa, Artificial Sequence
  Description of Artificial Sequence: Synthetic polypeptide
DEEEIRTTNPVATEQYGSCSHEMNLDELLNFQVEQN

SEQ ID NO: 146444 - protein, 33 aa, Artificial Sequence
  Description of Artificial Sequence: Synthetic polypeptide
DQGEIRTTNPVATEQYGSVTFVNKVEDMFGQQE

SEQ ID NO: 146445 - protein, 33 aa, Artificial Sequence
  Description of Artificial Sequence: Synthetic polypeptide
DQGEIRTTNPVATEQYGSVTDPVVKGELMIGQQ

SEQ ID NO: 146446 - protein, 35 aa, Artificial Sequence
  Description of Artificial Sequence: Synthetic polypeptide
DQGEIRTTNPVATEQYGSVCTPVNKLEPMFNGQQF

SEQ ID NO: 146447 - protein, 36 aa, Artificial Sequence
  Description of Artificial Sequence: Synthetic polypeptide
DEEEIRTTNPVATEQYGSCSGAGPDNDGTAGGNNYN

SEQ ID NO: 146448 - protein, 30 aa, Artificial Sequence
  Description of Artificial Sequence: Synthetic polypeptide
QETEIAPTNPIATECWGITVSCNLASKGTR

SEQ ID NO: 146449 - protein, 35 aa, Artificial Sequence
  Description of Artificial Sequence: Synthetic polypeptide
MEEEISTTNPVATEQYGCVCSVTGEDNQGFGSNQL

SEQ ID NO: 146450 - protein, 28 aa, Artificial Sequence
  Description of Artificial Sequence: Synthetic peptide
QETEIASTNPVGTEGYGVMADTLQHGDI

SEQ ID NO: 146451 - protein, 30 aa, Artificial Sequence
  Description of Artificial Sequence: Synthetic polypeptide
QENEIATTNPVATECYGDVSEPAGNHEMNL

SEQ ID NO: 146452 - protein, 29 aa, Artificial Sequence
  Description of Artificial Sequence: Synthetic peptide
QETEIASTNPVGTEGYGVMAWSTLQHGDI

SEQ ID NO: 146453 - protein, 34 aa, Artificial Sequence
  Description of Artificial Sequence: Synthetic polypeptide
DEEAIRCTNPVATEQYGCVCSTGEHQEFFGSEQS

SEQ ID NO: 146454 - protein, 35 aa, Artificial Sequence
  Description of Artificial Sequence: Synthetic polypeptide
DEEEIRTTNPVATEQYGSCSGAGPDLDGTADGSVH

SEQ ID NO: 146455 - protein, 32 aa, Artificial Sequence
  Description of Artificial Sequence: Synthetic polypeptide
QETEIATTNPCATEQYGATVWANCENLQPGPI

SEQ ID NO: 146456 - protein, 29 aa, Artificial Sequence
  Description of Artificial Sequence: Synthetic peptide
QETEIATTNPCSSECWGAVSCNWQESGTR

SEQ ID NO: 146457 - protein, 36 aa, Artificial Sequence
  Description of Artificial Sequence: Synthetic polypeptide
DEEEIRTTNPVATEQYGSCSGAGPDLDGRAIGSVHN

SEQ ID NO: 146458 - protein, 29 aa, Artificial Sequence
  Description of Artificial Sequence: Synthetic peptide
QETEIATTNPCSSECWGIVSCNWQESGTR

SEQ ID NO: 146459 - protein, 34 aa, Artificial Sequence
  Description of Artificial Sequence: Synthetic polypeptide
DQEEIRTTNPVAYEAYGSVPSTATELSEMTVNAD

SEQ ID NO: 146460 - protein, 28 aa, Artificial Sequence
  Description of Artificial Sequence: Synthetic peptide
QESVIACTNPVGTEGYGVTASTLQHGDI

SEQ ID NO: 146461 - protein, 29 aa, Artificial Sequence
  Description of Artificial Sequence: Synthetic peptide
QETEIATTNPVATEQYGEAPEVHQHEEKK

SEQ ID NO: 146462 - protein, 38 aa, Artificial Sequence
  Description of Artificial Sequence: Synthetic polypeptide
DEEEIRTTNPVATEQYGSVAQPLMMMETVLENGITLNR

SEQ ID NO: 146463 - protein, 35 aa, Artificial Sequence
  Description of Artificial Sequence: Synthetic polypeptide
DEEAEIRTTNPVAYEQWGVVTGGNGNQQGVGNADR

SEQ ID NO: 146464 - protein, 34 aa, Artificial Sequence
  Description of Artificial Sequence: Synthetic polypeptide
DEEAEIRTTNPVAYEQWGVVTGGNGNQGEGNADK

SEQ ID NO: 146465 - protein, 34 aa, Artificial Sequence
  Description of Artificial Sequence: Synthetic polypeptide
MEEEITTTNPVATEQYGNVSVTGGGQGDGGQGEE

SEQ ID NO: 146466 - protein, 36 aa, Artificial Sequence
  Description of Artificial Sequence: Synthetic polypeptide
DEEEIRTTNPVATEQYGSVQVAVEEQIENTEGANNM

SEQ ID NO: 146467 - protein, 29 aa, Artificial Sequence
  Description of Artificial Sequence: Synthetic peptide
QEVEIATTNPVATEQYGEAPEVCQHEEKS

SEQ ID NO: 146468 - protein, 34 aa, Artificial Sequence
  Description of Artificial Sequence: Synthetic polypeptide
MEEEITTTNPVATEQYGNVSVTGQGGQGDGQGEN

SEQ ID NO: 146469 - protein, 36 aa, Artificial Sequence
  Description of Artificial Sequence: Synthetic polypeptide
DEEEIRTTNPVATEQYGSCNYTYQPLDEGNMENEID

SEQ ID NO: 146470 - protein, 35 aa, Artificial Sequence
  Description of Artificial Sequence: Synthetic polypeptide
DEEEIRTTNPVATEQYGSCNYTQPLDEVNMENEIV

SEQ ID NO: 146471 - protein, 30 aa, Artificial Sequence
  Description of Artificial Sequence: Synthetic polypeptide
QEVEIATTNPVATEQYGDVAGPEGGQGEEQ

SEQ ID NO: 146472 - protein, 37 aa, Artificial Sequence
  Description of Artificial Sequence: Synthetic polypeptide
DEEAEIRTTNPVAYEQWGSVCSTTPNGNQGEDGNNDG

SEQ ID NO: 146473 - protein, 35 aa, Artificial Sequence
  Description of Artificial Sequence: Synthetic polypeptide
DEEEIRTTNPVATEQYGSCNYTQPFDEEGMENEIQ

SEQ ID NO: 146474 - protein, 36 aa, Artificial Sequence
  Description of Artificial Sequence: Synthetic polypeptide
DEEAEIRTTNPVAYEQWGSVCSTDNDGNHTGGNNTT

SEQ ID NO: 146475 - protein, 34 aa, Artificial Sequence
  Description of Artificial Sequence: Synthetic polypeptide
DEEEIRTTNPVATEQYGSCNYTQPEDEGMEQEYV

SEQ ID NO: 146476 - protein, 36 aa, Artificial Sequence
  Description of Artificial Sequence: Synthetic polypeptide
DEEEICTTNPVATECYGSVATTGNMGNQGGHGNTND

SEQ ID NO: 146477 - protein, 36 aa, Artificial Sequence
  Description of Artificial Sequence: Synthetic polypeptide
DEEAEIRTTNPVAYEQWGSVAGNPNGNHQNEGGNNR

SEQ ID NO: 146478 - protein, 37 aa, Artificial Sequence
  Description of Artificial Sequence: Synthetic polypeptide
AEEEIRTTNPVATEQYGSVSTVTTNNTEQGTNNVTDE

SEQ ID NO: 146479 - protein, 35 aa, Artificial Sequence
  Description of Artificial Sequence: Synthetic polypeptide
QEVEIRTTNPVATEQYGSVDDGTNDENEGQGENTT

SEQ ID NO: 146480 - protein, 35 aa, Artificial Sequence
  Description of Artificial Sequence: Synthetic polypeptide
DEEAEIRTTNPVAYEHYGEVSTGPNQGNAGGDDER

SEQ ID NO: 146481 - protein, 34 aa, Artificial Sequence
  Description of Artificial Sequence: Synthetic polypeptide
QEVEIATTNPVATEQYGSVSATGDDLEDGEGEEQ

SEQ ID NO: 146482 - protein, 34 aa, Artificial Sequence
  Description of Artificial Sequence: Synthetic polypeptide
DEEAIATTNPVATEQYGVVPCWDNQGQRQGGKGA

SEQ ID NO: 146483 - protein, 36 aa, Artificial Sequence
  Description of Artificial Sequence: Synthetic polypeptide
DEEEICTTNPVATECYGSVATTGNQGNQGGHGNGNA

SEQ ID NO: 146484 - protein, 28 aa, Artificial Sequence
  Description of Artificial Sequence: Synthetic peptide
QEVEIASTNPVGWEGYGVMASTLQHGDI

SEQ ID NO: 146485 - protein, 29 aa, Artificial Sequence
  Description of Artificial Sequence: Synthetic peptide
QETEIATTNPVATEQYGEAPEVWQHKEPK

SEQ ID NO: 146486 - protein, 35 aa, Artificial Sequence
  Description of Artificial Sequence: Synthetic polypeptide
MEEEISTTNPVATEQYGQCVTSVTEHQEGFGSNQS

SEQ ID NO: 146487 - protein, 37 aa, Artificial Sequence
  Description of Artificial Sequence: Synthetic polypeptide
AEEEIRTTNPVATEQYGVVSTTVNNLQNNNDEQNEAE

SEQ ID NO: 146488 - protein, 36 aa, Artificial Sequence
  Description of Artificial Sequence: Synthetic polypeptide
DEEEIRTTNPVATEQYGSVQVAVLEQIENEEEANDQ

SEQ ID NO: 146489 - protein, 37 aa, Artificial Sequence
  Description of Artificial Sequence: Synthetic polypeptide
DEEEIRTTNPVATEQYGSVAQPSPAGPNMQNGMQDVV

SEQ ID NO: 146490 - protein, 34 aa, Artificial Sequence
  Description of Artificial Sequence: Synthetic polypeptide
MEEEITTTNPVATEGYGNVSVTGGGQGDGNGGED

SEQ ID NO: 146491 - protein, 33 aa, Artificial Sequence
  Description of Artificial Sequence: Synthetic polypeptide
QETEIKTTNPAATEQYGSVPTGLIMGGGNEGDT

SEQ ID NO: 146492 - protein, 36 aa, Artificial Sequence
  Description of Artificial Sequence: Synthetic polypeptide
DEEEIRTTNPVATEQYGSCQSPAHNLLPEVDMTERD

SEQ ID NO: 146493 - protein, 31 aa, Artificial Sequence
  Description of Artificial Sequence: Synthetic polypeptide
QETEIRTTNPIATECWGAVWANAEDWQPGPR

SEQ ID NO: 146494 - protein, 31 aa, Artificial Sequence
  Description of Artificial Sequence: Synthetic polypeptide
QETEIRTTNPIATECWGIVWANAEDWQPGPR

SEQ ID NO: 146495 - protein, 37 aa, Artificial Sequence
  Description of Artificial Sequence: Synthetic polypeptide
AEEEIRTTNPVATEQYGSVSTVTTNQLGTEEGTTEDQ

SEQ ID NO: 146496 - protein, 34 aa, Artificial Sequence
  Description of Artificial Sequence: Synthetic polypeptide
MEEEITTTNPVATEGYGVVSVTGEGQGGQGNDEI

SEQ ID NO: 146497 - protein, 35 aa, Artificial Sequence
  Description of Artificial Sequence: Synthetic polypeptide
MEEEITTTNPVATEQYGAVSVTGEGEQGGEGNDDE

SEQ ID NO: 146498 - protein, 35 aa, Artificial Sequence
  Description of Artificial Sequence: Synthetic polypeptide
MEEEITTTNPVATEQYGDVSVTGEGQNGGQGNQEQ

SEQ ID NO: 146499 - protein, 34 aa, Artificial Sequence
  Description of Artificial Sequence: Synthetic polypeptide
QETTIRTTNPVATEQYGSVSVTTGEGDNGQEEGE

SEQ ID NO: 146500 - protein, 37 aa, Artificial Sequence
  Description of Artificial Sequence: Synthetic polypeptide
DEEEIRTTNPVATEQYGSCPSSTTPAGPNMRNGMNPV

SEQ ID NO: 146501 - protein, 35 aa, Artificial Sequence
  Description of Artificial Sequence: Synthetic polypeptide
DEEAICTTNPVATEAYGSVATVNNDQYGTEENEEE

SEQ ID NO: 146502 - protein, 35 aa, Artificial Sequence
  Description of Artificial Sequence: Synthetic polypeptide
DEEAICTTNPVATEAYGSVATVNNDQQGNEEQEED

SEQ ID NO: 146503 - protein, 35 aa, Artificial Sequence
  Description of Artificial Sequence: Synthetic polypeptide
DEEEIRTTNPVATEQYGSVAQPTMEETVENFIIND

SEQ ID NO: 146504 - protein, 29 aa, Artificial Sequence
  Description of Artificial Sequence: Synthetic peptide
QETEIATTNPVATEQYGEAPEVWQHKEEK

SEQ ID NO: 146505 - protein, 28 aa, Artificial Sequence
  Description of Artificial Sequence: Synthetic peptide
QESTIASTNPVGTEGYGVMASTLQHGDN

SEQ ID NO: 146506 - protein, 28 aa, Artificial Sequence
  Description of Artificial Sequence: Synthetic peptide
QESTIASTNPVGTEGYGVMASTLQHGDI

SEQ ID NO: 146507 - protein, 28 aa, Artificial Sequence
  Description of Artificial Sequence: Synthetic peptide
QESSIASTNPVGTEGYGVMASTLQHGDI

SEQ ID NO: 146508 - protein, 35 aa, Artificial Sequence
  Description of Artificial Sequence: Synthetic polypeptide
DEEEIRATNPVTTEQYGSVATNVATEEGQTTTNTD

SEQ ID NO: 146509 - protein, 35 aa, Artificial Sequence
  Description of Artificial Sequence: Synthetic polypeptide
DEEEIRATNPVTTEQYGSVATNVATEEGTATTNTN

SEQ ID NO: 146510 - protein, 33 aa, Artificial Sequence
  Description of Artificial Sequence: Synthetic polypeptide
DEEAIRTTNPVATEQYDYCVSVEVMQSRYIDGQ

SEQ ID NO: 146511 - protein, 34 aa, Artificial Sequence
  Description of Artificial Sequence: Synthetic polypeptide
MEEEIRTTNPVATESYGSVSDGLGGEGQGEEQGL

SEQ ID NO: 146512 - protein, 35 aa, Artificial Sequence
  Description of Artificial Sequence: Synthetic polypeptide
DEEEIRATNPVTTEQYGSVATNVATEGGVTTTNTN

SEQ ID NO: 146513 - protein, 36 aa, Artificial Sequence
  Description of Artificial Sequence: Synthetic polypeptide
MEEEIRTTNPVATESYGSVSTMDAEGGQENGQDGGE

SEQ ID NO: 146514 - protein, 33 aa, Artificial Sequence
  Description of Artificial Sequence: Synthetic polypeptide
DSAEIRTTNPVATEQYGCVCILDQTEIGQNEDH

SEQ ID NO: 146515 - protein, 30 aa, Artificial Sequence
  Description of Artificial Sequence: Synthetic polypeptide
QESEIRTTNPVGTEGYGVVSETLMNAAEDI

SEQ ID NO: 146516 - protein, 36 aa, Artificial Sequence
  Description of Artificial Sequence: Synthetic polypeptide
DEEEIRTTNPVATEQYGSVAEPPLPHQLRLIVEEHI

SEQ ID NO: 146517 - protein, 33 aa, Artificial Sequence
  Description of Artificial Sequence: Synthetic polypeptide
AENEIACTNPVATEQYGEAPSCENLSQTTVGGR

SEQ ID NO: 146518 - protein, 35 aa, Artificial Sequence
  Description of Artificial Sequence: Synthetic polypeptide
DEEEIRTTNPVATEQYGSCSPSELELPQVMTTDIL

SEQ ID NO: 146519 - protein, 34 aa, Artificial Sequence
  Description of Artificial Sequence: Synthetic polypeptide
DEEAIRTTNPVATEQWGCVCGWNNHQEHFGSNQS

SEQ ID NO: 146520 - protein, 36 aa, Artificial Sequence
  Description of Artificial Sequence: Synthetic polypeptide
DEEEIRTTNPVATEQYGSVAESCTWEVSPMTEDNDV

SEQ ID NO: 146521 - protein, 36 aa, Artificial Sequence
  Description of Artificial Sequence: Synthetic polypeptide
DEEEIRTTNPVATEQYGSVAESNTTEVSPMTLDNDV

SEQ ID NO: 146522 - protein, 36 aa, Artificial Sequence
  Description of Artificial Sequence: Synthetic polypeptide
DEEEIRTTNPVATEQYGSVAESPTCTEVPTTVPNDG

SEQ ID NO: 146523 - protein, 36 aa, Artificial Sequence
  Description of Artificial Sequence: Synthetic polypeptide
MEEEIRTTNPVAYEQYGQSITSNTNDLLQPRSIEKH

SEQ ID NO: 146524 - protein, 34 aa, Artificial Sequence
  Description of Artificial Sequence: Synthetic polypeptide
DSAEIRSTNPVAYEQWGSISCTLNHQDRTGGNND

SEQ ID NO: 146525 - protein, 34 aa, Artificial Sequence
  Description of Artificial Sequence: Synthetic polypeptide
DSAEIRSTNPVAYEQWGSIASCTNHQERTGGPND

SEQ ID NO: 146526 - protein, 36 aa, Artificial Sequence
  Description of Artificial Sequence: Synthetic polypeptide
DEEEIRTTNPVATEQYGSCSPTAHLEIQVQSELQYI

SEQ ID NO: 146527 - protein, 35 aa, Artificial Sequence
  Description of Artificial Sequence: Synthetic polypeptide
DEEAIRTTNPVATEQYGCVCSDTEHNQENFNSDQS

SEQ ID NO: 146528 - protein, 34 aa, Artificial Sequence
  Description of Artificial Sequence: Synthetic polypeptide
DSDCIRTTNPVATEQWGSVNWTNNALQLGQEPKQ

SEQ ID NO: 146529 - protein, 35 aa, Artificial Sequence
  Description of Artificial Sequence: Synthetic polypeptide
MEEEIRTTNPVATEQYGVVTMTVNGEGEFGDNEDN

SEQ ID NO: 146530 - protein, 31 aa, Artificial Sequence
  Description of Artificial Sequence: Synthetic polypeptide
DSEDIATTNPVATEQWGCVAGEGHQNRMVNL

SEQ ID NO: 146531 - protein, 31 aa, Artificial Sequence
  Description of Artificial Sequence: Synthetic polypeptide
DSEDIATTNPVATEQWGCVAGEGDQRAVNLH

SEQ ID NO: 146532 - protein, 34 aa, Artificial Sequence
  Description of Artificial Sequence: Synthetic polypeptide
DEEAIRTTNPVATEQYGCVCSWEEHQNFNSDFQS

SEQ ID NO: 146533 - protein, 34 aa, Artificial Sequence
  Description of Artificial Sequence: Synthetic polypeptide
DEEEIAATNPVAYEQYGIKVVACTDNWLTGGGNT

SEQ ID NO: 146534 - protein, 36 aa, Artificial Sequence
  Description of Artificial Sequence: Synthetic polypeptide
DEEAIRTTNPVATEQYGCVCSTTGEHNQNFGSENQA

SEQ ID NO: 146535 - protein, 32 aa, Artificial Sequence
  Description of Artificial Sequence: Synthetic polypeptide
QESEIRTTNPVGTECWGVVSCINEQDREGEDG

SEQ ID NO: 146536 - protein, 34 aa, Artificial Sequence
  Description of Artificial Sequence: Synthetic polypeptide
DEEEIAATNPVAYEQYGIKVVATDNMLTGGGNNH

SEQ ID NO: 146537 - protein, 34 aa, Artificial Sequence
  Description of Artificial Sequence: Synthetic polypeptide
MEEEIRTTNPVATEQYGTVMGLDGDQEEGEGNNG

SEQ ID NO: 146538 - protein, 34 aa, Artificial Sequence
  Description of Artificial Sequence: Synthetic polypeptide
MEEEIRTTNPVATEQYGTVMTNNNDINEEGEGQG

SEQ ID NO: 146539 - protein, 36 aa, Artificial Sequence
  Description of Artificial Sequence: Synthetic polypeptide
DEEEIRTTNPVATEQYGSVSNPMYENDDAAMNELEQ

SEQ ID NO: 146540 - protein, 36 aa, Artificial Sequence
  Description of Artificial Sequence: Synthetic polypeptide
DEEEICTTNPVATECYGSVTTGNQGNQGGHGGGMNS

SEQ ID NO: 146541 - protein, 31 aa, Artificial Sequence
  Description of Artificial Sequence: Synthetic polypeptide
QESEIRTTNPVGTEGWGVMSSNEPQDRGEDI

SEQ ID NO: 146542 - protein, 37 aa, Artificial Sequence
  Description of Artificial Sequence: Synthetic polypeptide
DEEEIRTTNPVATEQYGSVSNSDNTQTLVQQLVQQEW

SEQ ID NO: 146543 - protein, 36 aa, Artificial Sequence
  Description of Artificial Sequence: Synthetic polypeptide
DEEEICTTNPVATECYGSVTTGNQGNQGGHGGGGMR

SEQ ID NO: 146544 - protein, 36 aa, Artificial Sequence
  Description of Artificial Sequence: Synthetic polypeptide
DEEAIRTTNPVATEQYGCVCSNTNEDHQNFGSETQS

SEQ ID NO: 146545 - protein, 35 aa, Artificial Sequence
  Description of Artificial Sequence: Synthetic polypeptide
DSDEICTTNPVAYEQYGSVVCSTGVMLSQTGMTRL

SEQ ID NO: 146546 - protein, 36 aa, Artificial Sequence
  Description of Artificial Sequence: Synthetic polypeptide
DEEEICTTNPVATECYGSVTTGNEGNQGGHGQGNAN

SEQ ID NO: 146547 - protein, 36 aa, Artificial Sequence
  Description of Artificial Sequence: Synthetic polypeptide
DEEEIRTTNPVATEQYGSVRSPPASMLGVINPEIDL

SEQ ID NO: 146548 - protein, 36 aa, Artificial Sequence
  Description of Artificial Sequence: Synthetic polypeptide
AEEEIRTTNPVATEQYGVVSTVNNNEQGTNNNEELQ

SEQ ID NO: 146549 - protein, 34 aa, Artificial Sequence
  Description of Artificial Sequence: Synthetic polypeptide
DEEEIRATNPVTTEQYGTVATNVATEEGTTTNTN

SEQ ID NO: 146550 - protein, 33 aa, Artificial Sequence
  Description of Artificial Sequence: Synthetic polypeptide
DSAEIRSTNPCAYEQWGSISCTNHQRTGGNTND

SEQ ID NO: 146551 - protein, 36 aa, Artificial Sequence
  Description of Artificial Sequence: Synthetic polypeptide
DEEEIRTTNPVATEQYGSVAESPTVTEVPMTVDNDV

SEQ ID NO: 146552 - protein, 29 aa, Artificial Sequence
  Description of Artificial Sequence: Synthetic peptide
QESEISSTNPVGTEGYGVMASTLQHQGDI

SEQ ID NO: 146553 - protein, 30 aa, Artificial Sequence
  Description of Artificial Sequence: Synthetic polypeptide
QESEVASTNPVSTEGYGNVAANTLQSRGQI

SEQ ID NO: 146554 - protein, 38 aa, Artificial Sequence
  Description of Artificial Sequence: Synthetic polypeptide
AEEEIRTTNPVATEQYGVVSTVNANLQNENEQGNNNVE

SEQ ID NO: 146555 - protein, 29 aa, Artificial Sequence
  Description of Artificial Sequence: Synthetic peptide
QESEVASTNPVSTEGYGNVAASTIQRGQI

SEQ ID NO: 146556 - protein, 35 aa, Artificial Sequence
  Description of Artificial Sequence: Synthetic polypeptide
DEEEICTTNPVATECYGSVSTGNGNTGGHGGDGTD

SEQ ID NO: 146557 - protein, 35 aa, Artificial Sequence
  Description of Artificial Sequence: Synthetic polypeptide
DEEEIRTTNPVATEQYGSCSLMPMLPIILDENLIE

SEQ ID NO: 146558 - protein, 28 aa, Artificial Sequence
  Description of Artificial Sequence: Synthetic peptide
QESEVASTNPVSTEGYGVMASTLQHGDI

SEQ ID NO: 146559 - protein, 30 aa, Artificial Sequence
  Description of Artificial Sequence: Synthetic polypeptide
QENEIATTNPVATECYGDVSEPCGQHEEPL

SEQ ID NO: 146560 - protein, 29 aa, Artificial Sequence
  Description of Artificial Sequence: Synthetic peptide
QESEVASTNPVSTEQYGNVPNVIQSREQR

SEQ ID NO: 146561 - protein, 30 aa, Artificial Sequence
  Description of Artificial Sequence: Synthetic polypeptide
QESEVATTNPVATECYGNVSAECIQRVEQL

SEQ ID NO: 146562 - protein, 34 aa, Artificial Sequence
  Description of Artificial Sequence: Synthetic polypeptide
MEEEISTTNPVATEQYGCVCSTGEHNQNFGSDQS

SEQ ID NO: 146563 - protein, 35 aa, Artificial Sequence
  Description of Artificial Sequence: Synthetic polypeptide
MEEEISTTNPVATEQYGCVCSVTEDLNQGFGSQQL

SEQ ID NO: 146564 - protein, 35 aa, Artificial Sequence
  Description of Artificial Sequence: Synthetic polypeptide
DEEEIRTTNPVATEQYGSCSLMPLPLAEEMLMPNG

SEQ ID NO: 146565 - protein, 30 aa, Artificial Sequence
  Description of Artificial Sequence: Synthetic polypeptide
QESEVATTNPVATEQYGNAAAEVCQSREER

SEQ ID NO: 146566 - protein, 30 aa, Artificial Sequence
  Description of Artificial Sequence: Synthetic polypeptide
QESEVATTNPVATEQYGNAAAEVIQSREER

SEQ ID NO: 146567 - protein, 34 aa, Artificial Sequence
  Description of Artificial Sequence: Synthetic polypeptide
DQQEICTTNPVATEQYGSVSATPDLEDHIGEDLN

SEQ ID NO: 146568 - protein, 28 aa, Artificial Sequence
  Description of Artificial Sequence: Synthetic peptide
QESHIASTNPVGTEGYGVMASTLQHGDI

SEQ ID NO: 146569 - protein, 28 aa, Artificial Sequence
  Description of Artificial Sequence: Synthetic peptide
QESPIASTNPVGTEGYGVMASTLQHGDI

SEQ ID NO: 146570 - protein, 34 aa, Artificial Sequence
  Description of Artificial Sequence: Synthetic polypeptide
DQQEIATTNPVATEQYGSVSATPDLLEDHIGEDL

SEQ ID NO: 146571 - protein, 28 aa, Artificial Sequence
  Description of Artificial Sequence: Synthetic peptide
QESQIASTNPVGTEGYGVMASTLQHGDI

SEQ ID NO: 146572 - protein, 37 aa, Artificial Sequence
  Description of Artificial Sequence: Synthetic polypeptide
DEEEIRTTNPVATEQYGSVALTESTAVEDNSLLVEVA

SEQ ID NO: 146573 - protein, 31 aa, Artificial Sequence
  Description of Artificial Sequence: Synthetic polypeptide
DSEDIATTNPVATEQWGCVAGEGHQRAVGML

SEQ ID NO: 146574 - protein, 36 aa, Artificial Sequence
  Description of Artificial Sequence: Synthetic polypeptide
DEEEIRTTNPVATEQYGSVAIADTMTEQPPMQENSI

SEQ ID NO: 146575 - protein, 36 aa, Artificial Sequence
  Description of Artificial Sequence: Synthetic polypeptide
AEEEIRTTNPVATEQYGVVSTVNGNQNQNNNENQDT

SEQ ID NO: 146576 - protein, 36 aa, Artificial Sequence
  Description of Artificial Sequence: Synthetic polypeptide
MEEEIRTTNPVGTEQYGSVVSATMGLMGEQGGFGET

SEQ ID NO: 146577 - protein, 28 aa, Artificial Sequence
  Description of Artificial Sequence: Synthetic peptide
QESEITSTNPVGTEGYGVMASTLQHQDI

SEQ ID NO: 146578 - protein, 28 aa, Artificial Sequence
  Description of Artificial Sequence: Synthetic peptide
QESEITSTNPVGTEGYGVMASTVQHGDI

SEQ ID NO: 146579 - protein, 35 aa, Artificial Sequence
  Description of Artificial Sequence: Synthetic polypeptide
DEEAIRTTNPVATEQWGCVCGTNNHNQEGFGSNQA

SEQ ID NO: 146580 - protein, 34 aa, Artificial Sequence
  Description of Artificial Sequence: Synthetic polypeptide
DEEAIRTTNPVATEQWGCVCGTNEPQEHFGSDQA

SEQ ID NO: 146581 - protein, 33 aa, Artificial Sequence
  Description of Artificial Sequence: Synthetic polypeptide
DQYEISTTNPVATEQYGTVCSATDAQVEFQNND

SEQ ID NO: 146582 - protein, 35 aa, Artificial Sequence
  Description of Artificial Sequence: Synthetic polypeptide
DEEAIRTTNPVATEQWGCVCGTNEHNQHFGSNTQS

SEQ ID NO: 146583 - protein, 32 aa, Artificial Sequence
  Description of Artificial Sequence: Synthetic polypeptide
DEEEIRCTNPIATECWGSVAAENWMEPKGPYR

SEQ ID NO: 146584 - protein, 28 aa, Artificial Sequence
  Description of Artificial Sequence: Synthetic peptide
QESELASTNPVGTEGYGVMASTLQHGDI

SEQ ID NO: 146585 - protein, 34 aa, Artificial Sequence
  Description of Artificial Sequence: Synthetic polypeptide
DEEAIRTTNPVATEQWGCVCGNTNEHQHFGSDQA

SEQ ID NO: 146586 - protein, 36 aa, Artificial Sequence
  Description of Artificial Sequence: Synthetic polypeptide
DEEAIRTTNPVATEQEGSVSSTTPAGPNMRNGMNPV

SEQ ID NO: 146587 - protein, 28 aa, Artificial Sequence
  Description of Artificial Sequence: Synthetic peptide
QESELASTNPVGTEGYGVMASTLQHGDM

SEQ ID NO: 146588 - protein, 29 aa, Artificial Sequence
  Description of Artificial Sequence: Synthetic peptide
QESEVASTNPVGTEGYGNVAANTIQHGQR

SEQ ID NO: 146589 - protein, 30 aa, Artificial Sequence
  Description of Artificial Sequence: Synthetic polypeptide
QESEVASTNPVGTEGYGNVAANTIQRVGQR

SEQ ID NO: 146590 - protein, 34 aa, Artificial Sequence
  Description of Artificial Sequence: Synthetic polypeptide
DEEAIRTTNPVATEGYGCVCSTEEHQENFGSDQS

SEQ ID NO: 146591 - protein, 33 aa, Artificial Sequence
  Description of Artificial Sequence: Synthetic polypeptide
DEEAIRTTNPVATEFYRYCVSMEVMQSRGDGQQ

SEQ ID NO: 146592 - protein, 35 aa, Artificial Sequence
  Description of Artificial Sequence: Synthetic polypeptide
DQSEIRTTNPVATECWGSVVSCINAECQDREGENG

SEQ ID NO: 146593 - protein, 33 aa, Artificial Sequence
  Description of Artificial Sequence: Synthetic polypeptide
DEEAIRTTNPVATEEYRYCVKYEVLQRGDGQQS

SEQ ID NO: 146594 - protein, 28 aa, Artificial Sequence
  Description of Artificial Sequence: Synthetic peptide
QESEVASTNPVGTEGYGVMASTLQHGDI

SEQ ID NO: 146595 - protein, 35 aa, Artificial Sequence
  Description of Artificial Sequence: Synthetic polypeptide
DEEEIRTTNPVATEQYGSVAHDTMVITAMTQANQP

SEQ ID NO: 146596 - protein, 35 aa, Artificial Sequence
  Description of Artificial Sequence: Synthetic polypeptide
DEEEIGTTNPVATEQYGCVCSTGEDHNQFFGSDQS

SEQ ID NO: 146597 - protein, 28 aa, Artificial Sequence
  Description of Artificial Sequence: Synthetic peptide
QESEIASTNPVGTEGYGVMASVLQHGDI

SEQ ID NO: 146598 - protein, 28 aa, Artificial Sequence
  Description of Artificial Sequence: Synthetic peptide
QESEIASTNPVGTEGYGVMASTYQHGDI

SEQ ID NO: 146599 - protein, 34 aa, Artificial Sequence
  Description of Artificial Sequence: Synthetic polypeptide
DEECIRTTNPVAYEQWGSVACTNNGLQDHVDQME

SEQ ID NO: 146600 - protein, 29 aa, Artificial Sequence
  Description of Artificial Sequence: Synthetic peptide
QENEIRPTNPVSSEPYGTISCDIQQSGTR

SEQ ID NO: 146601 - protein, 36 aa, Artificial Sequence
  Description of Artificial Sequence: Synthetic polypeptide
DEEEIRTTNPVATEQYGSNIVTTNDEETNNPEIQGG

SEQ ID NO: 146602 - protein, 35 aa, Artificial Sequence
  Description of Artificial Sequence: Synthetic polypeptide
DEEEIRATNPVATEQWGGCVAITNHDEQASGENNN

SEQ ID NO: 146603 - protein, 35 aa, Artificial Sequence
  Description of Artificial Sequence: Synthetic polypeptide
DEECIRTTNPVAYEQWGSVACTNNGLQDHPINDGG

SEQ ID NO: 146604 - protein, 31 aa, Artificial Sequence
  Description of Artificial Sequence: Synthetic polypeptide
QENEIGTTNPVATECYGHVSVECLEQHPFEL

SEQ ID NO: 146605 - protein, 35 aa, Artificial Sequence
  Description of Artificial Sequence: Synthetic polypeptide
DEEEIRATNPVATEQWGGCVAITNHGEEQTGMENN

SEQ ID NO: 146606 - protein, 37 aa, Artificial Sequence
  Description of Artificial Sequence: Synthetic polypeptide
AEEEIRTTNPVATEQYGSVSTVVNGGNNNDEGNNQND

SEQ ID NO: 146607 - protein, 30 aa, Artificial Sequence
  Description of Artificial Sequence: Synthetic polypeptide
QESEIASTNPVATEQYGDVAEILQNHAEDA

SEQ ID NO: 146608 - protein, 35 aa, Artificial Sequence
  Description of Artificial Sequence: Synthetic polypeptide
DEEEIRATNPVATEQWGGCVAITNHTEQAPMENRQ

SEQ ID NO: 146609 - protein, 35 aa, Artificial Sequence
  Description of Artificial Sequence: Synthetic polypeptide
AEEEISTTNPVATEQYGCVCSNTGELQNFGSQTQS

SEQ ID NO: 146610 - protein, 35 aa, Artificial Sequence
  Description of Artificial Sequence: Synthetic polypeptide
DEEEIRATNPVATEQWGGCVAITNNLENTGMEEDR

SEQ ID NO: 146611 - protein, 36 aa, Artificial Sequence
  Description of Artificial Sequence: Synthetic polypeptide
DEEEIRATNPVATEQWGGCVAITNNLEQTGMENGDF

SEQ ID NO: 146612 - protein, 36 aa, Artificial Sequence
  Description of Artificial Sequence: Synthetic polypeptide
DEECIRTTNPVAYEQWGSVACTNNGLQDGHQDNEQH

SEQ ID NO: 146613 - protein, 29 aa, Artificial Sequence
  Description of Artificial Sequence: Synthetic peptide
QENEIATTNPVSTEQYGTAPEDCQQNENK

SEQ ID NO: 146614 - protein, 31 aa, Artificial Sequence
  Description of Artificial Sequence: Synthetic polypeptide
QENEIATTNPVSTEQYGEISMDIQQQQNGNH

SEQ ID NO: 146615 - protein, 36 aa, Artificial Sequence
  Description of Artificial Sequence: Synthetic polypeptide
FEEEIRTTNPVATEQYGSVSTMGVGEGQNIEGQSGD

SEQ ID NO: 146616 - protein, 36 aa, Artificial Sequence
  Description of Artificial Sequence: Synthetic polypeptide
DEECIRTTNPVAYEQWGSVACTNNGLQDDRQDIERN

SEQ ID NO: 146617 - protein, 34 aa, Artificial Sequence
  Description of Artificial Sequence: Synthetic polypeptide
DEECIRTTNPVAYEQWGSVACTNNGLQDHEDSKG

SEQ ID NO: 146618 - protein, 30 aa, Artificial Sequence
  Description of Artificial Sequence: Synthetic polypeptide
QESEIASTNPVATEQYGDVAEILQNAAEDA

SEQ ID NO: 146619 - protein, 30 aa, Artificial Sequence
  Description of Artificial Sequence: Synthetic polypeptide
QENEIRSTNPVGTEGYGVISMTIQQQHGDI

SEQ ID NO: 146620 - protein, 36 aa, Artificial Sequence
  Description of Artificial Sequence: Synthetic polypeptide
FEEEIRTTNPVATEQYGSVSSTTPAGPNMRNGMKPV

SEQ ID NO: 146621 - protein, 35 aa, Artificial Sequence
  Description of Artificial Sequence: Synthetic polypeptide
FEEEIRTTNPVATEQYGSVSPTGPMAEIESQDPRQ

SEQ ID NO: 146622 - protein, 35 aa, Artificial Sequence
  Description of Artificial Sequence: Synthetic polypeptide
FEEEIRTTNPVATEQYGSVSPTGPMAEIESQNPPG

SEQ ID NO: 146623 - protein, 37 aa, Artificial Sequence
  Description of Artificial Sequence: Synthetic polypeptide
AEENIRTTNPVATEQYGSVSTTNNNQQQGTNATEDTE

SEQ ID NO: 146624 - protein, 36 aa, Artificial Sequence
  Description of Artificial Sequence: Synthetic polypeptide
DEEEIRATNPVATEQWGGCVAIANNLEQTGMENDRT

SEQ ID NO: 146625 - protein, 38 aa, Artificial Sequence
  Description of Artificial Sequence: Synthetic polypeptide
DEEEIRTTNPVATEQYGSNAVSWVMTDEEAQRQMINVE

SEQ ID NO: 146626 - protein, 37 aa, Artificial Sequence
  Description of Artificial Sequence: Synthetic polypeptide
AEENIRTTNPVATEQYGSVSTVNNNQQQGTNNTTDTE

SEQ ID NO: 146627 - protein, 37 aa, Artificial Sequence
  Description of Artificial Sequence: Synthetic polypeptide
DEEEIRTTNPVATEQYGSICSATEGLTQQTIVNVSTL

SEQ ID NO: 146628 - protein, 28 aa, Artificial Sequence
  Description of Artificial Sequence: Synthetic peptide
QESEIASTNPVATEGYGVMASVLQHEDK

SEQ ID NO: 146629 - protein, 36 aa, Artificial Sequence
  Description of Artificial Sequence: Synthetic polypeptide
FEEEIRTTNPVATEQYGSVSPTVNMMFPESGEEEVM

SEQ ID NO: 146630 - protein, 36 aa, Artificial Sequence
  Description of Artificial Sequence: Synthetic polypeptide
AEENIRTTNPVATEQYGSVSTVTNQLLQLEQQATTE

SEQ ID NO: 146631 - protein, 31 aa, Artificial Sequence
  Description of Artificial Sequence: Synthetic polypeptide
QENEIRTTNPCSTEPYGIISMDLQQQSNGTR

SEQ ID NO: 146632 - protein, 37 aa, Artificial Sequence
  Description of Artificial Sequence: Synthetic polypeptide
AEENIRTTNPVATEQYGSVSTVTNQQQLQLNQQNTTE

SEQ ID NO: 146633 - protein, 31 aa, Artificial Sequence
  Description of Artificial Sequence: Synthetic polypeptide
QESEIASTNPVATEGYGVTTANATLQEHGDI

SEQ ID NO: 146634 - protein, 31 aa, Artificial Sequence
  Description of Artificial Sequence: Synthetic polypeptide
QESEIASTNPVATEGYGVTTANSTLQEHGDI

SEQ ID NO: 146635 - protein, 30 aa, Artificial Sequence
  Description of Artificial Sequence: Synthetic polypeptide
QENEIRTTNPCATEQWGDVSEIEMNAAGDA

SEQ ID NO: 146636 - protein, 33 aa, Artificial Sequence
  Description of Artificial Sequence: Synthetic polypeptide
DEECIRTTNPVAYEQWGSVFQHEDLGRGGITTQ

SEQ ID NO: 146637 - protein, 29 aa, Artificial Sequence
  Description of Artificial Sequence: Synthetic peptide
QENEIRSTNPVGTEQWGDVSSTLMNAEDI

SEQ ID NO: 146638 - protein, 33 aa, Artificial Sequence
  Description of Artificial Sequence: Synthetic polypeptide
DEECIRTTNPVAYEQWGSVFQHEDEGRGGNTTG

SEQ ID NO: 146639 - protein, 37 aa, Artificial Sequence
  Description of Artificial Sequence: Synthetic polypeptide
AEENIRTTNPVATEQYGVVSTVQNLQQQIGTTEQGNE

SEQ ID NO: 146640 - protein, 37 aa, Artificial Sequence
  Description of Artificial Sequence: Synthetic polypeptide
DEEEIRATNPVATEQWGGCVAITNNLEQTGMENNVRT

SEQ ID NO: 146641 - protein, 35 aa, Artificial Sequence
  Description of Artificial Sequence: Synthetic polypeptide
DEEEIRTTNPVATEQYGSMWSMDFQQFVSLNDKDV

SEQ ID NO: 146642 - protein, 34 aa, Artificial Sequence
  Description of Artificial Sequence: Synthetic polypeptide
AEEEISTTNPVATEQYGCVCSNTEHQENFGSDQS

SEQ ID NO: 146643 - protein, 37 aa, Artificial Sequence
  Description of Artificial Sequence: Synthetic polypeptide
AEEQIRTTNPVATEQYGSVSTTNNQNGNQLLQQNTTE

SEQ ID NO: 146644 - protein, 28 aa, Artificial Sequence
  Description of Artificial Sequence: Synthetic peptide
QESEIASTNPVGTDGYGVMASTLQHGDI

SEQ ID NO: 146645 - protein, 30 aa, Artificial Sequence
  Description of Artificial Sequence: Synthetic polypeptide
QESEIASTNPVGTEAGYGHVMASTLQHGDI

SEQ ID NO: 146646 - protein, 29 aa, Artificial Sequence
  Description of Artificial Sequence: Synthetic peptide
QESEIASTNPVGTEAGYGVMASTLQHGDI

SEQ ID NO: 146647 - protein, 28 aa, Artificial Sequence
  Description of Artificial Sequence: Synthetic peptide
QESEIASTNPVGTEAWGVAASTLQHGDY

SEQ ID NO: 146648 - protein, 29 aa, Artificial Sequence
  Description of Artificial Sequence: Synthetic peptide
QENEIATTNPVSTEPYGDISECIQQNGEL

SEQ ID NO: 146649 - protein, 29 aa, Artificial Sequence
  Description of Artificial Sequence: Synthetic peptide
QESEIASTNPVGTEAYGVAAMTDLQHGDI

SEQ ID NO: 146650 - protein, 29 aa, Artificial Sequence
  Description of Artificial Sequence: Synthetic peptide
QESEIASTNPVGTEAYGVCASTLQHGGDI

SEQ ID NO: 146651 - protein, 35 aa, Artificial Sequence
  Description of Artificial Sequence: Synthetic polypeptide
DEEEIRTTNPVATEQYGSVSDPVGLIETTPVEQIV

SEQ ID NO: 146652 - protein, 29 aa, Artificial Sequence
  Description of Artificial Sequence: Synthetic peptide
QESEIASTNPVGTDEGYGVMPSTLQHGDI

SEQ ID NO: 146653 - protein, 28 aa, Artificial Sequence
  Description of Artificial Sequence: Synthetic peptide
QESEIASTNPVGTEAYGVMASTLQHEDI

SEQ ID NO: 146654 - protein, 29 aa, Artificial Sequence
  Description of Artificial Sequence: Synthetic peptide
QESEIASTNPVGTEAYGVTAYSTLQHGDA

SEQ ID NO: 146655 - protein, 29 aa, Artificial Sequence
  Description of Artificial Sequence: Synthetic peptide
QESEIASTNPVGTECWGVTCSTELQHGDI

SEQ ID NO: 146656 - protein, 33 aa, Artificial Sequence
  Description of Artificial Sequence: Synthetic polypeptide
DEECIRTTNPVAYEQWGCVYQNDWQDGGNQNHP

SEQ ID NO: 146657 - protein, 36 aa, Artificial Sequence
  Description of Artificial Sequence: Synthetic polypeptide
AEEEIRTVNPVATEQYGSVSPALLNLDSRYNAQNDQ

SEQ ID NO: 146658 - protein, 36 aa, Artificial Sequence
  Description of Artificial Sequence: Synthetic polypeptide
AEEQIRTTNPVATEQYGSVSTVTNQGNQNNEQGTTE

SEQ ID NO: 146659 - protein, 36 aa, Artificial Sequence
  Description of Artificial Sequence: Synthetic polypeptide
EEEEIRTTNPVATEQYGSVSPTMPNPNEEALVDQGE

SEQ ID NO: 146660 - protein, 28 aa, Artificial Sequence
  Description of Artificial Sequence: Synthetic peptide
QESEIASTNPVGTECYGVAYYTLQHGDI

SEQ ID NO: 146661 - protein, 36 aa, Artificial Sequence
  Description of Artificial Sequence: Synthetic polypeptide
EEEEIRTTNPVATEQYGSVSPTENIHYARQDEDQMQ

SEQ ID NO: 146662 - protein, 29 aa, Artificial Sequence
  Description of Artificial Sequence: Synthetic peptide
QESEIASTNPVGTEAYGVMASTLQHGDEI

SEQ ID NO: 146663 - protein, 29 aa, Artificial Sequence
  Description of Artificial Sequence: Synthetic peptide
QESEIASTNPVGTDEGYGVMASTLQNGDI

SEQ ID NO: 146664 - protein, 32 aa, Artificial Sequence
  Description of Artificial Sequence: Synthetic polypeptide
DEECIRTTNPVAYEQWGCVYQVDAQDHGDNME

SEQ ID NO: 146665 - protein, 33 aa, Artificial Sequence
  Description of Artificial Sequence: Synthetic polypeptide
DEECIRTTNPVAYEQWGCVYQVDAQDHRGDNHM

SEQ ID NO: 146666 - protein, 30 aa, Artificial Sequence
  Description of Artificial Sequence: Synthetic polypeptide
QENEIATTNPVSTEQYGEAPEEDCQQHGNH

SEQ ID NO: 146667 - protein, 32 aa, Artificial Sequence
  Description of Artificial Sequence: Synthetic polypeptide
DEECIRTTNPVAYEQWGSSFQMEDLGRGDVTS

SEQ ID NO: 146668 - protein, 28 aa, Artificial Sequence
  Description of Artificial Sequence: Synthetic peptide
QESEIASTNPVCSEGYGVMASTLQHGDI

SEQ ID NO: 146669 - protein, 31 aa, Artificial Sequence
  Description of Artificial Sequence: Synthetic polypeptide
DEECIRTTNPVAYEQWGSSFQIEDLGRNDQT

SEQ ID NO: 146670 - protein, 30 aa, Artificial Sequence
  Description of Artificial Sequence: Synthetic polypeptide
QENEIATTNPVSTEPYGVIAMETLQQNGNH

SEQ ID NO: 146671 - protein, 31 aa, Artificial Sequence
  Description of Artificial Sequence: Synthetic polypeptide
QENEIATTNPVSTEPYGTVSEECLQQQNENL

SEQ ID NO: 146672 - protein, 30 aa, Artificial Sequence
  Description of Artificial Sequence: Synthetic polypeptide
QENEIATTNPVSTEPYGTISMEDLQQNGEH

SEQ ID NO: 146673 - protein, 30 aa, Artificial Sequence
  Description of Artificial Sequence: Synthetic polypeptide
QENEIATTNPVSTEPYGTASMDIQQHNGNH

SEQ ID NO: 146674 - protein, 28 aa, Artificial Sequence
  Description of Artificial Sequence: Synthetic peptide
QESEIASTNPVGCEGYGVMASTLQGGDI

SEQ ID NO: 146675 - protein, 28 aa, Artificial Sequence
  Description of Artificial Sequence: Synthetic peptide
QESEIASTNPVGFEGYGVMASTLQHGDI

SEQ ID NO: 146676 - protein, 30 aa, Artificial Sequence
  Description of Artificial Sequence: Synthetic polypeptide
QENEIATTNPVSTEPYGDISMCIQQQNGNL

SEQ ID NO: 146677 - protein, 28 aa, Artificial Sequence
  Description of Artificial Sequence: Synthetic peptide
QESEIASTNPVGHEGYGVCASTLQHGDI

SEQ ID NO: 146678 - protein, 28 aa, Artificial Sequence
  Description of Artificial Sequence: Synthetic peptide
QESEIASTNPVGHEGYGVMASTLQHGDI

SEQ ID NO: 146679 - protein, 35 aa, Artificial Sequence
  Description of Artificial Sequence: Synthetic polypeptide
EEEEIRTTNPVATEQYGSVSQPNQLTETEAEMTEG

SEQ ID NO: 146680 - protein, 28 aa, Artificial Sequence
  Description of Artificial Sequence: Synthetic peptide
QESEIASTNPVGHEKYGVMASTLQHGDI

SEQ ID NO: 146681 - protein, 35 aa, Artificial Sequence
  Description of Artificial Sequence: Synthetic polypeptide
DEEEIRTTNPVATEQYGSVSDPVGLLETHMVEQTF

SEQ ID NO: 146682 - protein, 36 aa, Artificial Sequence
  Description of Artificial Sequence: Synthetic polypeptide
FEEEIRTTNPVATEQYGSVSTVAMDEQGENGVPEPL

SEQ ID NO: 146683 - protein, 28 aa, Artificial Sequence
  Description of Artificial Sequence: Synthetic peptide
QESEIASTNPVGTAGYGVMASTLQHGDI

SEQ ID NO: 146684 - protein, 28 aa, Artificial Sequence
  Description of Artificial Sequence: Synthetic peptide
QESEIASTNPVGTCGYGVMASTLQHGDI

SEQ ID NO: 146685 - protein, 31 aa, Artificial Sequence
  Description of Artificial Sequence: Synthetic polypeptide
QESEIASTNPVATEQYGVVATPTGQMHGDPI

SEQ ID NO: 146686 - protein, 31 aa, Artificial Sequence
  Description of Artificial Sequence: Synthetic polypeptide
QESEIASTNPVATEGYGVMASITEPQHEGNI

SEQ ID NO: 146687 - protein, 35 aa, Artificial Sequence
  Description of Artificial Sequence: Synthetic polypeptide
DEEEIKTTNPVATEQYGCVCSTGEHQENFFSENQS

SEQ ID NO: 146688 - protein, 37 aa, Artificial Sequence
  Description of Artificial Sequence: Synthetic polypeptide
FEEEIRTTNPVATEQYGSVSNTGVNEGQNVEGQGGDV

SEQ ID NO: 146689 - protein, 35 aa, Artificial Sequence
  Description of Artificial Sequence: Synthetic polypeptide
EEEEIRTTNPVATEQYGSVTELMTDPSVPAQVGQN

SEQ ID NO: 146690 - protein, 36 aa, Artificial Sequence
  Description of Artificial Sequence: Synthetic polypeptide
EEEEIRTTNPVATEQYGSVSYDVNEEDELETTVNSP

SEQ ID NO: 146691 - protein, 35 aa, Artificial Sequence
  Description of Artificial Sequence: Synthetic polypeptide
EEEEIRTTNPVATEQYGSVSVTVSTDDERLESQVA

SEQ ID NO: 146692 - protein, 36 aa, Artificial Sequence
  Description of Artificial Sequence: Synthetic polypeptide
EEEEIRTTNPVATEQYGSVSVTPLHHVPVLPFNVHE

SEQ ID NO: 146693 - protein, 34 aa, Artificial Sequence
  Description of Artificial Sequence: Synthetic polypeptide
DEEEIRTTNPVATEQYGSIHHTTYEDHNDEGQEQ

SEQ ID NO: 146694 - protein, 35 aa, Artificial Sequence
  Description of Artificial Sequence: Synthetic polypeptide
DEECIRTTNPVAYEQYAEEVTTTGNGPNDQGGNTR

SEQ ID NO: 146695 - protein, 30 aa, Artificial Sequence
  Description of Artificial Sequence: Synthetic polypeptide
QENEIRTTNPVATEQWGDVSEICMNAAEDA

SEQ ID NO: 146696 - protein, 35 aa, Artificial Sequence
  Description of Artificial Sequence: Synthetic polypeptide
DEEEIRTTNPVATEQYGSIHHTTLEDHNDEGMEQA

SEQ ID NO: 146697 - protein, 33 aa, Artificial Sequence
  Description of Artificial Sequence: Synthetic polypeptide
AEEEISTTNPVATEQYGCVCSWEHQNFNSDNQS

SEQ ID NO: 146698 - protein, 36 aa, Artificial Sequence
  Description of Artificial Sequence: Synthetic polypeptide
DEEEIRTTNPVATEQYGSIHHTTLEDHNDEGDENQP

SEQ ID NO: 146699 - protein, 35 aa, Artificial Sequence
  Description of Artificial Sequence: Synthetic polypeptide
DEECIRTTNPVAYEQWGVVPTIEDDGQRQGMNGNR

SEQ ID NO: 146700 - protein, 30 aa, Artificial Sequence
  Description of Artificial Sequence: Synthetic polypeptide
QENEIRTTNPVATEQWGDVSDIEMNAAEDA

SEQ ID NO: 146701 - protein, 32 aa, Artificial Sequence
  Description of Artificial Sequence: Synthetic polypeptide
DEECIRTTNPVAYEQWGVVFQHEDLGRGGKET

SEQ ID NO: 146702 - protein, 37 aa, Artificial Sequence
  Description of Artificial Sequence: Synthetic polypeptide
EEEEIRTTNPVATEQYGSVSTVNQQAGSEAGGVTTDD

SEQ ID NO: 146703 - protein, 34 aa, Artificial Sequence
  Description of Artificial Sequence: Synthetic polypeptide
DEECIRTTNPVAYEQWGVVCTIEWDGQRQGNGNK

SEQ ID NO: 146704 - protein, 37 aa, Artificial Sequence
  Description of Artificial Sequence: Synthetic polypeptide
DEEEIKTTNPVATEQYGRSVSDTTPAGPNVRNGMNPV

SEQ ID NO: 146705 - protein, 33 aa, Artificial Sequence
  Description of Artificial Sequence: Synthetic polypeptide
DEECIRTTNPVAYEQWGVVCTIEHDGQRQSNNL

SEQ ID NO: 146706 - protein, 34 aa, Artificial Sequence
  Description of Artificial Sequence: Synthetic polypeptide
DEECIRTTNPVAYEQWGVVCTIEDGQRQGMNSHE

SEQ ID NO: 146707 - protein, 35 aa, Artificial Sequence
  Description of Artificial Sequence: Synthetic polypeptide
DEEEIRTTNPVATEQYGSIHHTTLEDHNDEGDEIT

SEQ ID NO: 146708 - protein, 36 aa, Artificial Sequence
  Description of Artificial Sequence: Synthetic polypeptide
DEEEIRTTNPVATEQYGSIINTTNMQAIGTQMQTEE

SEQ ID NO: 146709 - protein, 30 aa, Artificial Sequence
  Description of Artificial Sequence: Synthetic polypeptide
QENEIRTTNPVATEQWGDVSEIEMNAAEDA

SEQ ID NO: 146710 - protein, 30 aa, Artificial Sequence
  Description of Artificial Sequence: Synthetic polypeptide
QENEIRTTNPVATEQWGDVSEIEMNAAEEA

SEQ ID NO: 146711 - protein, 35 aa, Artificial Sequence
  Description of Artificial Sequence: Synthetic polypeptide
DEEEIRTTNPVATEQYGSILSFEELPIEENELNDN

SEQ ID NO: 146712 - protein, 34 aa, Artificial Sequence
  Description of Artificial Sequence: Synthetic polypeptide
DEEEIRTTNPVATEQYGSILAFEELIEEMELNDN

SEQ ID NO: 146713 - protein, 31 aa, Artificial Sequence
  Description of Artificial Sequence: Synthetic polypeptide
QESEIAPTNPCSYEQYGCTVSCNLSQSVGTR

SEQ ID NO: 146714 - protein, 36 aa, Artificial Sequence
  Description of Artificial Sequence: Synthetic polypeptide
FEEEIRTTNPVATEQYGSVSAEFPGTQERENPQDDT

SEQ ID NO: 146715 - protein, 37 aa, Artificial Sequence
  Description of Artificial Sequence: Synthetic polypeptide
DEEEIRTTNPVATEQYGSIISEVPELQQVRPNSVFDQ

SEQ ID NO: 146716 - protein, 30 aa, Artificial Sequence
  Description of Artificial Sequence: Synthetic polypeptide
QENEIRTTNPVATEQWGDVSEVEMNAAEDA

SEQ ID NO: 146717 - protein, 38 aa, Artificial Sequence
  Description of Artificial Sequence: Synthetic polypeptide
EEEEIRTTNPVATEQYGSVTVVVTNLNQLQAGNQNGNE

SEQ ID NO: 146718 - protein, 31 aa, Artificial Sequence
  Description of Artificial Sequence: Synthetic polypeptide
QESEIAPTNPVATECYGIVSCNEQDSEGETG

SEQ ID NO: 146719 - protein, 34 aa, Artificial Sequence
  Description of Artificial Sequence: Synthetic polypeptide
DEECIRTTNPVAYEQYGCVCSTGEDNIYFGSEQA

SEQ ID NO: 146720 - protein, 28 aa, Artificial Sequence
  Description of Artificial Sequence: Synthetic peptide
QESEIAPTNPVGSEGYGVVACTLQHGDI

SEQ ID NO: 146721 - protein, 38 aa, Artificial Sequence
  Description of Artificial Sequence: Synthetic polypeptide
EEEEIRTTNPVATEQYGSVTVVVTNLGLQQGNQNGNET

SEQ ID NO: 146722 - protein, 36 aa, Artificial Sequence
  Description of Artificial Sequence: Synthetic polypeptide
DEEEIRTTNPVATEQYGSMSIENHQDSVVNSNPNVS

SEQ ID NO: 146723 - protein, 35 aa, Artificial Sequence
  Description of Artificial Sequence: Synthetic polypeptide
DEEEIRTTNPVATEQYGSVSFPEYGVQMQETMEED

SEQ ID NO: 146724 - protein, 36 aa, Artificial Sequence
  Description of Artificial Sequence: Synthetic polypeptide
DEEEIRTTNPVATEQYGSVSFQLGLSQAQPFEVQVA

SEQ ID NO: 146725 - protein, 34 aa, Artificial Sequence
  Description of Artificial Sequence: Synthetic polypeptide
DEECIRTTNPVAYEQYGCVCFTINVPTRIGDGQQ

SEQ ID NO: 146726 - protein, 35 aa, Artificial Sequence
  Description of Artificial Sequence: Synthetic polypeptide
FEEEIRTTNPVATEQYGSVSCPLISQEMSDEEQAQ

SEQ ID NO: 146727 - protein, 36 aa, Artificial Sequence
  Description of Artificial Sequence: Synthetic polypeptide
DEEEIRTTNPVATEQYGSMSLMNQLEIFNDEPEEEI

SEQ ID NO: 146728 - protein, 33 aa, Artificial Sequence
  Description of Artificial Sequence: Synthetic polypeptide
DEECISTTNPVATEQYGCVCSTEDAEFFGSDQS

SEQ ID NO: 146729 - protein, 31 aa, Artificial Sequence
  Description of Artificial Sequence: Synthetic polypeptide
QESEIAPTNPVSSECYGIVSCINLQDSEGTR

SEQ ID NO: 146730 - protein, 33 aa, Artificial Sequence
  Description of Artificial Sequence: Synthetic polypeptide
DEECISTTNPVATEQYGCVCSWEENAYFGSDQS

SEQ ID NO: 146731 - protein, 35 aa, Artificial Sequence
  Description of Artificial Sequence: Synthetic polypeptide
DEEEIRTTNPVATEQYGSIGQETMNMNDVQMVVEI

SEQ ID NO: 146732 - protein, 36 aa, Artificial Sequence
  Description of Artificial Sequence: Synthetic polypeptide
DEEEIKTTNPVATEQYGIAVVPSTNLSDPPVGSPET

SEQ ID NO: 146733 - protein, 34 aa, Artificial Sequence
  Description of Artificial Sequence: Synthetic polypeptide
DEECIRTTNPVAYEQWGVVCTIEDDGQLQGNTNR

SEQ ID NO: 146734 - protein, 28 aa, Artificial Sequence
  Description of Artificial Sequence: Synthetic peptide
QESEIASTNPVATEGYGEAASVCQHGEI

SEQ ID NO: 146735 - protein, 35 aa, Artificial Sequence
  Description of Artificial Sequence: Synthetic polypeptide
FEEEIRTTNPVATEQYGSVSITGPMAEIESQMPPQ

SEQ ID NO: 146736 - protein, 30 aa, Artificial Sequence
  Description of Artificial Sequence: Synthetic polypeptide
QESEIASTNPVATEGYGSMAASTLEHGEDI

SEQ ID NO: 146737 - protein, 30 aa, Artificial Sequence
  Description of Artificial Sequence: Synthetic polypeptide
QESEIASTNPVATEGYGSMAATDLEHGEDI

SEQ ID NO: 146738 - protein, 36 aa, Artificial Sequence
  Description of Artificial Sequence: Synthetic polypeptide
FEEEIRTTNPVATEQYGSVSLTPWLGVSQPPEEQLF

SEQ ID NO: 146739 - protein, 37 aa, Artificial Sequence
  Description of Artificial Sequence: Synthetic polypeptide
AEEEIRTTNPVATEQYGSVSTVVNNGNNEDEGNEESD

SEQ ID NO: 146740 - protein, 36 aa, Artificial Sequence
  Description of Artificial Sequence: Synthetic polypeptide
FEEEIRTTNPVATEQYGSVSNDQNEMQNENGGEGQE

SEQ ID NO: 146741 - protein, 37 aa, Artificial Sequence
  Description of Artificial Sequence: Synthetic polypeptide
FEEEIRTTNPVATEQYGSVSNQGVNEGQNVEGQNGDE

SEQ ID NO: 146742 - protein, 32 aa, Artificial Sequence
  Description of Artificial Sequence: Synthetic polypeptide
DEECIRTTNPVAYEQWGSYWSLDDDNQRPDDF

SEQ ID NO: 146743 - protein, 34 aa, Artificial Sequence
  Description of Artificial Sequence: Synthetic polypeptide
AEEEVRTTNPVATEQYGCVCSTEEHDQYIGSEQS

SEQ ID NO: 146744 - protein, 33 aa, Artificial Sequence
  Description of Artificial Sequence: Synthetic polypeptide
QESEIASTNPVATEGYGSMSATSPAGQRGMNPI

SEQ ID NO: 146745 - protein, 37 aa, Artificial Sequence
  Description of Artificial Sequence: Synthetic polypeptide
AEEEIRTTNPVATEQYGSVSTVVNNGNNEDEGNNQED

SEQ ID NO: 146746 - protein, 28 aa, Artificial Sequence
  Description of Artificial Sequence: Synthetic peptide
QESEIASTNPVATEGYGVAPETCQHGEI

SEQ ID NO: 146747 - protein, 32 aa, Artificial Sequence
  Description of Artificial Sequence: Synthetic polypeptide
DEECIRTTNPVAYEQWGSYWSLDDDLASPDDR

SEQ ID NO: 146748 - protein, 28 aa, Artificial Sequence
  Description of Artificial Sequence: Synthetic peptide
QESEIASTNPVATEGYGVMAETCQHGEI

SEQ ID NO: 146749 - protein, 37 aa, Artificial Sequence
  Description of Artificial Sequence: Synthetic polypeptide
DEEEIRTTNPVATEQYGSVSGDPSTMGEPQQEQNDEL

SEQ ID NO: 146750 - protein, 36 aa, Artificial Sequence
  Description of Artificial Sequence: Synthetic polypeptide
DEECIRTTNPVAYEQWGSVSSTTGQGPNMRNGMNDV

SEQ ID NO: 146751 - protein, 35 aa, Artificial Sequence
  Description of Artificial Sequence: Synthetic polypeptide
FEEEIRTTNPVATEQYGSVSNTDDEQGQTFTEADD

SEQ ID NO: 146752 - protein, 36 aa, Artificial Sequence
  Description of Artificial Sequence: Synthetic polypeptide
DEEEIRTTNPVATEQYGSIEPTPIMPQEPGLNVALQ

SEQ ID NO: 146753 - protein, 30 aa, Artificial Sequence
  Description of Artificial Sequence: Synthetic polypeptide
QESEIASTNPVATEGYGDVAEILQNHAGDI

SEQ ID NO: 146754 - protein, 29 aa, Artificial Sequence
  Description of Artificial Sequence: Synthetic peptide
QENEIATTNPVSTEPYGDISECIQHNGEL

SEQ ID NO: 146755 - protein, 38 aa, Artificial Sequence
  Description of Artificial Sequence: Synthetic polypeptide
DEEEIRTTNPVATEQYGSMVSSTTPAGPNMRNGMNPVI

SEQ ID NO: 146756 - protein, 37 aa, Artificial Sequence
  Description of Artificial Sequence: Synthetic polypeptide
EEEEIRTTNPVATEQYGSVSTTNNNNQQLQQNATEEG

SEQ ID NO: 146757 - protein, 29 aa, Artificial Sequence
  Description of Artificial Sequence: Synthetic peptide
QESEIASTNPIATECYGVTMASTLQHGDI

SEQ ID NO: 146758 - protein, 28 aa, Artificial Sequence
  Description of Artificial Sequence: Synthetic peptide
QESEIASTNPIGTECYGVMASTLQHGDI

SEQ ID NO: 146759 - protein, 28 aa, Artificial Sequence
  Description of Artificial Sequence: Synthetic peptide
QESEIASTNPIGTEGYGTMASTLQHGDI

SEQ ID NO: 146760 - protein, 34 aa, Artificial Sequence
  Description of Artificial Sequence: Synthetic polypeptide
DEECIRTTNPVAYEQWGVVCFTIEDGQRQQNGER

SEQ ID NO: 146761 - protein, 28 aa, Artificial Sequence
  Description of Artificial Sequence: Synthetic peptide
QESEIASTNPIGTEGYGVMASTLQHGDI

SEQ ID NO: 146762 - protein, 34 aa, Artificial Sequence
  Description of Artificial Sequence: Synthetic polypeptide
DEECIRTTNPVAYEQWGTYVYTQDSGLDRNGEND

SEQ ID NO: 146763 - protein, 38 aa, Artificial Sequence
  Description of Artificial Sequence: Synthetic polypeptide
DEEEIRTTNPVATEQYGSMVSQTRPAGPTMRNGMNPVD

SEQ ID NO: 146764 - protein, 35 aa, Artificial Sequence
  Description of Artificial Sequence: Synthetic polypeptide
FEEEIRTTNPVATEQYGSVSILGMGQENGGEGEEI

SEQ ID NO: 146765 - protein, 37 aa, Artificial Sequence
  Description of Artificial Sequence: Synthetic polypeptide
DEEEIRTTNPVATEQYGSVSFTPNIDSSHVALVNIEA

SEQ ID NO: 146766 - protein, 33 aa, Artificial Sequence
  Description of Artificial Sequence: Synthetic polypeptide
DEECIRTTNPVAYEQWGTYVYTQDQDLDRGDQP

SEQ ID NO: 146767 - protein, 29 aa, Artificial Sequence
  Description of Artificial Sequence: Synthetic peptide
QESEIASTNPLGTEGYGCVMASTLQHGDI

SEQ ID NO: 146768 - protein, 28 aa, Artificial Sequence
  Description of Artificial Sequence: Synthetic peptide
QESEIASTNPMGTEGYGVIASTLQHGDI

SEQ ID NO: 146769 - protein, 29 aa, Artificial Sequence
  Description of Artificial Sequence: Synthetic peptide
QESEIASTNPVATECWGVMACTLQRGEDG

SEQ ID NO: 146770 - protein, 35 aa, Artificial Sequence
  Description of Artificial Sequence: Synthetic polypeptide
DEECIRTTNPVAYEQWGTYVYTQDNDLDRGENNSE

SEQ ID NO: 146771 - protein, 30 aa, Artificial Sequence
  Description of Artificial Sequence: Synthetic polypeptide
QESEIASTNPVATEGWGSMACNEQREGEDI

SEQ ID NO: 146772 - protein, 36 aa, Artificial Sequence
  Description of Artificial Sequence: Synthetic polypeptide
FEEEIRTTNPVATEQYGSVSINNFDINGEGGENGED

SEQ ID NO: 146773 - protein, 33 aa, Artificial Sequence
  Description of Artificial Sequence: Synthetic polypeptide
DEECIRTTNPVAYEQWGTYVYTQDIDDDRGNND

SEQ ID NO: 146774 - protein, 29 aa, Artificial Sequence
  Description of Artificial Sequence: Synthetic peptide
QESEIASTNPVATEGWGVMASTLQNAGDI

SEQ ID NO: 146775 - protein, 29 aa, Artificial Sequence
  Description of Artificial Sequence: Synthetic peptide
QESEIASTNPVATEGWGVTASTLQEHGDI

SEQ ID NO: 146776 - protein, 29 aa, Artificial Sequence
  Description of Artificial Sequence: Synthetic peptide
QESEIASTNPVATEGYGDMASILQHAGDI

SEQ ID NO: 146777 - protein, 30 aa, Artificial Sequence
  Description of Artificial Sequence: Synthetic polypeptide
QENEIRTTNPVATEQWGEVSEIEMNAAEEA

SEQ ID NO: 146778 - protein, 28 aa, Artificial Sequence
  Description of Artificial Sequence: Synthetic peptide
QESEIASTNPVGTECYGVMASTLQHEEI

SEQ ID NO: 146779 - protein, 29 aa, Artificial Sequence
  Description of Artificial Sequence: Synthetic peptide
QESEIASTNPVGTECYGVMASTLQHEGDG

SEQ ID NO: 146780 - protein, 36 aa, Artificial Sequence
  Description of Artificial Sequence: Synthetic polypeptide
EEEEIRTTNPVATEAYGVVSTTNQQQGNQNGNQQDE

SEQ ID NO: 146781 - protein, 29 aa, Artificial Sequence
  Description of Artificial Sequence: Synthetic peptide
QESEIASTNPVGTEGYGHMASTLQHGDKI

SEQ ID NO: 146782 - protein, 36 aa, Artificial Sequence
  Description of Artificial Sequence: Synthetic polypeptide
EEEEIRTTNPVATEAYGVVSTTNQQGGNQNGNAQNE

SEQ ID NO: 146783 - protein, 36 aa, Artificial Sequence
  Description of Artificial Sequence: Synthetic polypeptide
EEEEIRTTNPVATEAYGVVSTTNQQAGNQAGNQNSE

SEQ ID NO: 146784 - protein, 35 aa, Artificial Sequence
  Description of Artificial Sequence: Synthetic polypeptide
FEEEIRTTNPVATEQYGSVVGFNESNLQAEEFTEG

SEQ ID NO: 146785 - protein, 35 aa, Artificial Sequence
  Description of Artificial Sequence: Synthetic polypeptide
DEEEIRTTNPVATEQYGSVSDPMGLIETMVPVTHP

SEQ ID NO: 146786 - protein, 35 aa, Artificial Sequence
  Description of Artificial Sequence: Synthetic polypeptide
FEEEIRTTNPVATEQYGSVVGVNVNIGNQGEFGEG

SEQ ID NO: 146787 - protein, 36 aa, Artificial Sequence
  Description of Artificial Sequence: Synthetic polypeptide
FEEEIRTTNPVATEQYGSVVITNNFDDNNQEGGGDT

SEQ ID NO: 146788 - protein, 29 aa, Artificial Sequence
  Description of Artificial Sequence: Synthetic peptide
QESEIASTNPVGTEGYGFVMASTRQHGDI

SEQ ID NO: 146789 - protein, 35 aa, Artificial Sequence
  Description of Artificial Sequence: Synthetic polypeptide
FEEEIRTTNPVATEQYGSVVMNGFNGGGFDDNTLV

SEQ ID NO: 146790 - protein, 34 aa, Artificial Sequence
  Description of Artificial Sequence: Synthetic polypeptide
FEEEIRTTNPVATEQYGSVVMNGFNGGGFDELTV

SEQ ID NO: 146791 - protein, 35 aa, Artificial Sequence
  Description of Artificial Sequence: Synthetic polypeptide
FEEEIRTTNPVATEQYGSVVMNGFNGGGFDQLENV

SEQ ID NO: 146792 - protein, 36 aa, Artificial Sequence
  Description of Artificial Sequence: Synthetic polypeptide
FEEEIRTTNPVATEQYGSVVNFDDNIDEQGGGNETF

SEQ ID NO: 146793 - protein, 30 aa, Artificial Sequence
  Description of Artificial Sequence: Synthetic polypeptide
QENEIATTNPVAYEPYGNVSGEHLQHQVEL

SEQ ID NO: 146794 - protein, 34 aa, Artificial Sequence
  Description of Artificial Sequence: Synthetic polypeptide
EEEEIRTTNPVATEAYGKIPSTGGEESVSMGGNR

SEQ ID NO: 146795 - protein, 30 aa, Artificial Sequence
  Description of Artificial Sequence: Synthetic polypeptide
QENEIATTNPVAYEPYGNVSGEHLQHMMLH

SEQ ID NO: 146796 - protein, 37 aa, Artificial Sequence
  Description of Artificial Sequence: Synthetic polypeptide
DEECIRTTNPVATEQYGSFVSSTTPAGPNMRNGMNPV

SEQ ID NO: 146797 - protein, 33 aa, Artificial Sequence
  Description of Artificial Sequence: Synthetic polypeptide
EEEEICTTNPVAYEQYGVVATHMDSQNGGNYSF

SEQ ID NO: 146798 - protein, 36 aa, Artificial Sequence
  Description of Artificial Sequence: Synthetic polypeptide
DEEEIRTTNPVATEQYGSHGQPTNLIQPEMMPSSEN

SEQ ID NO: 146799 - protein, 36 aa, Artificial Sequence
  Description of Artificial Sequence: Synthetic polypeptide
EEEEIRTTNPVATEAYGVVSTTNQQYGNQNGNDENE

SEQ ID NO: 146800 - protein, 29 aa, Artificial Sequence
  Description of Artificial Sequence: Synthetic peptide
QESEIASTNPVGTEGYGFMASTLQHGHDI

SEQ ID NO: 146801 - protein, 30 aa, Artificial Sequence
  Description of Artificial Sequence: Synthetic polypeptide
QESEIASTNPVGTEGYGEVWMASTLQHGDI

SEQ ID NO: 146802 - protein, 37 aa, Artificial Sequence
  Description of Artificial Sequence: Synthetic polypeptide
FEEEIRTTNPVATEQYGSVVDGTVNGLEAETTGGGNG

SEQ ID NO: 146803 - protein, 36 aa, Artificial Sequence
  Description of Artificial Sequence: Synthetic polypeptide
FEEEIRTTNPVATEQYGSVVDGTVNGLEEENTGGQG

SEQ ID NO: 146804 - protein, 37 aa, Artificial Sequence
  Description of Artificial Sequence: Synthetic polypeptide
EEEEIRTTNPVATEAYGVVSTVTNLQQGNQNGNQQDE

SEQ ID NO: 146805 - protein, 36 aa, Artificial Sequence
  Description of Artificial Sequence: Synthetic polypeptide
FEEEIRTTNPVATEQYGSVVDTNMDLENTNGQTDDD

SEQ ID NO: 146806 - protein, 28 aa, Artificial Sequence
  Description of Artificial Sequence: Synthetic peptide
QESEIASTNPVGTEGYGEMASVLQHGDI

SEQ ID NO: 146807 - protein, 36 aa, Artificial Sequence
  Description of Artificial Sequence: Synthetic polypeptide
DEEEIRATNPVATEQWGSVSGTNGPTNPAAEAGERD

SEQ ID NO: 146808 - protein, 36 aa, Artificial Sequence
  Description of Artificial Sequence: Synthetic polypeptide
EEEEIRTTNPVATEAYGVVSTVNQQAGNQAGNQQEE

SEQ ID NO: 146809 - protein, 35 aa, Artificial Sequence
  Description of Artificial Sequence: Synthetic polypeptide
DEEEIRATNPVATEQWGSVSGTNGPTNPAAEANEN

SEQ ID NO: 146810 - protein, 36 aa, Artificial Sequence
  Description of Artificial Sequence: Synthetic polypeptide
FEEEIRTTNPVATEQYGSVVFETVNGLEGENGGGEG

SEQ ID NO: 146811 - protein, 36 aa, Artificial Sequence
  Description of Artificial Sequence: Synthetic polypeptide
EEEEIRTTNPVATEAYGVVSTVNNQNGNQNGNDQDE

SEQ ID NO: 146812 - protein, 36 aa, Artificial Sequence
  Description of Artificial Sequence: Synthetic polypeptide
EEEEIRTTNPVATEAYGVVSTTVNNNTNQNGNQQDE

SEQ ID NO: 146813 - protein, 29 aa, Artificial Sequence
  Description of Artificial Sequence: Synthetic peptide
QESEIASTNPVGTEGYGEVMASRLQHGDI

SEQ ID NO: 146814 - protein, 34 aa, Artificial Sequence
  Description of Artificial Sequence: Synthetic polypeptide
FEEEIRTTNPVATEQYGSVVFGMEGEGGEENENQ

SEQ ID NO: 146815 - protein, 36 aa, Artificial Sequence
  Description of Artificial Sequence: Synthetic polypeptide
EEEEIRTTNPVATEAYGVVSTTTNQQGNQQGNDTDE

SEQ ID NO: 146816 - protein, 30 aa, Artificial Sequence
  Description of Artificial Sequence: Synthetic polypeptide
QESEIASTNPVGTEGYGEVMASTLQHGDID

SEQ ID NO: 146817 - protein, 30 aa, Artificial Sequence
  Description of Artificial Sequence: Synthetic polypeptide
QESEIASTNPVGTEGYGEVMASTLQHGDIM

SEQ ID NO: 146818 - protein, 29 aa, Artificial Sequence
  Description of Artificial Sequence: Synthetic peptide
QESEIASTNPVGTEGYGEVMASTLQHNDI

SEQ ID NO: 146819 - protein, 30 aa, Artificial Sequence
  Description of Artificial Sequence: Synthetic polypeptide
QESEIASTNPVGTEGYGEVQMASTLQHGDI

SEQ ID NO: 146820 - protein, 37 aa, Artificial Sequence
  Description of Artificial Sequence: Synthetic polypeptide
FEEEIRTTNPVATEQYGSVVFGTVNGLQEQENEGGQT

SEQ ID NO: 146821 - protein, 29 aa, Artificial Sequence
  Description of Artificial Sequence: Synthetic peptide
QESEIASTNPVGTEGYGKIASTLQHGGDI

SEQ ID NO: 146822 - protein, 28 aa, Artificial Sequence
  Description of Artificial Sequence: Synthetic peptide
QESEIASTNPVGTEGYGEMAETLQHGDI

SEQ ID NO: 146823 - protein, 36 aa, Artificial Sequence
  Description of Artificial Sequence: Synthetic polypeptide
FEEEIRTTNPVATEQYGSVVNNFDDEIDEQGGGNET

SEQ ID NO: 146824 - protein, 36 aa, Artificial Sequence
  Description of Artificial Sequence: Synthetic polypeptide
FEEEIRTTNPVATEQYGSVVNNTMDGTNGEFGGNIG

SEQ ID NO: 146825 - protein, 36 aa, Artificial Sequence
  Description of Artificial Sequence: Synthetic polypeptide
FEEEIRTTNPVATEQYGSVYSDDITEGQGQINIEQT

SEQ ID NO: 146826 - protein, 32 aa, Artificial Sequence
  Description of Artificial Sequence: Synthetic polypeptide
EEAEIRTTNPVAYEQWGSVTGGNMGDRGGDGD

SEQ ID NO: 146827 - protein, 31 aa, Artificial Sequence
  Description of Artificial Sequence: Synthetic polypeptide
QESEIASTNPVGTEGYGNVMLSTLQHGNDIG

SEQ ID NO: 146828 - protein, 34 aa, Artificial Sequence
  Description of Artificial Sequence: Synthetic polypeptide
EEAEIRTTNPVAYEQWGSVSWGIGDLQQNGNGNH

SEQ ID NO: 146829 - protein, 28 aa, Artificial Sequence
  Description of Artificial Sequence: Synthetic peptide
QESEIASTNPVGTEGYGQMASTGQHGDI

SEQ ID NO: 146830 - protein, 31 aa, Artificial Sequence
  Description of Artificial Sequence: Synthetic polypeptide
QENEIATTNPVAYECYGKVSERSLSQHVGEQ

SEQ ID NO: 146831 - protein, 29 aa, Artificial Sequence
  Description of Artificial Sequence: Synthetic peptide
QESEIASTNPVGTEGYGQMASTLQHGDIE

SEQ ID NO: 146832 - protein, 35 aa, Artificial Sequence
  Description of Artificial Sequence: Synthetic polypeptide
DEEEIITTNPVAYEQYGASVMNTIPDELDSRGIEQ

SEQ ID NO: 146833 - protein, 34 aa, Artificial Sequence
  Description of Artificial Sequence: Synthetic polypeptide
EEAEIRTTNPVAYEQWGSYTISPNEGDQQTQGNR

SEQ ID NO: 146834 - protein, 34 aa, Artificial Sequence
  Description of Artificial Sequence: Synthetic polypeptide
FEEEIRTTNPVATEQYGTVMGELNDGEDGGQNGE

SEQ ID NO: 146835 - protein, 30 aa, Artificial Sequence
  Description of Artificial Sequence: Synthetic polypeptide
QESEIASTNPVGTEGYGQVMASTLQHGSDI

SEQ ID NO: 146836 - protein, 28 aa, Artificial Sequence
  Description of Artificial Sequence: Synthetic peptide
QESEIASTNPVGTEGYGRMASTLAHGDI

SEQ ID NO: 146837 - protein, 35 aa, Artificial Sequence
  Description of Artificial Sequence: Synthetic polypeptide
AEEEIRTTNPVAYEQYGCVCSNTNEHQEGFGSEQG

SEQ ID NO: 146838 - protein, 29 aa, Artificial Sequence
  Description of Artificial Sequence: Synthetic peptide
QESEIASTNPVGTEGYGRMASTLQHGDID

SEQ ID NO: 146839 - protein, 34 aa, Artificial Sequence
  Description of Artificial Sequence: Synthetic polypeptide
FEEEIRTTNPVATEQYGTVVGVNDNGNQGEFGEG

SEQ ID NO: 146840 - protein, 36 aa, Artificial Sequence
  Description of Artificial Sequence: Synthetic polypeptide
DEEEIITTNPVAYEQYGASVMETNDELDWRNGIEMQ

SEQ ID NO: 146841 - protein, 34 aa, Artificial Sequence
  Description of Artificial Sequence: Synthetic polypeptide
EEAEIRTTNPVAYEQWGSVCSTMDRDNQMGEGRD

SEQ ID NO: 146842 - protein, 34 aa, Artificial Sequence
  Description of Artificial Sequence: Synthetic polypeptide
EEAEIRTTNPVAYEQWGSVCSTMDRDNGGEGGRE

SEQ ID NO: 146843 - protein, 34 aa, Artificial Sequence
  Description of Artificial Sequence: Synthetic polypeptide
FEEEIRTTNPVATEQYGTVMGETNDGEGGGQSGE

SEQ ID NO: 146844 - protein, 34 aa, Artificial Sequence
  Description of Artificial Sequence: Synthetic polypeptide
EEAEIRTTNPVAYEQWGSYTISPNEGGQQRAGNE

SEQ ID NO: 146845 - protein, 35 aa, Artificial Sequence
  Description of Artificial Sequence: Synthetic polypeptide
EEAEIRTTNPVAYEQWGYVTISPNEGDQQRQGNTR

SEQ ID NO: 146846 - protein, 29 aa, Artificial Sequence
  Description of Artificial Sequence: Synthetic peptide
QESEIASTNPVGTEGYGNVAMSDLQHGDI

SEQ ID NO: 146847 - protein, 30 aa, Artificial Sequence
  Description of Artificial Sequence: Synthetic polypeptide
QENEIATTNPVAYEPYGKVSIHLSQHETEA

SEQ ID NO: 146848 - protein, 30 aa, Artificial Sequence
  Description of Artificial Sequence: Synthetic polypeptide
QENEIATTNPVAYEPYGKVSEHLSQHTEEL

SEQ ID NO: 146849 - protein, 36 aa, Artificial Sequence
  Description of Artificial Sequence: Synthetic polypeptide
FEEEIRTTNPVATEQYGSVVPTLDLASIEISQTGMQ

SEQ ID NO: 146850 - protein, 36 aa, Artificial Sequence
  Description of Artificial Sequence: Synthetic polypeptide
DEECIRTTNPVATEQYGQCVCSTGEDQEFFGSDNQS

SEQ ID NO: 146851 - protein, 35 aa, Artificial Sequence
  Description of Artificial Sequence: Synthetic polypeptide
DEECIRTTNPVATEQYGQCVCSTEPNQEFFGSDQS

SEQ ID NO: 146852 - protein, 36 aa, Artificial Sequence
  Description of Artificial Sequence: Synthetic polypeptide
FEEEIRTTNPVATEQYGSVVPTSDLPSIEVSQTGMQ

SEQ ID NO: 146853 - protein, 36 aa, Artificial Sequence
  Description of Artificial Sequence: Synthetic polypeptide
FEEEIRTTNPVATEQYGSVVQNGFNLTGTGEGEGNE

SEQ ID NO: 146854 - protein, 29 aa, Artificial Sequence
  Description of Artificial Sequence: Synthetic peptide
QESEIASTNPVGTEGYGMMASTLQHGDIW

SEQ ID NO: 146855 - protein, 35 aa, Artificial Sequence
  Description of Artificial Sequence: Synthetic polypeptide
DEEEIITTNPVAYEQYGASVRETIPDELVFRGIEQ

SEQ ID NO: 146856 - protein, 29 aa, Artificial Sequence
  Description of Artificial Sequence: Synthetic peptide
QESEIASTNPVGTEGYGNMAASTLQHGQI

SEQ ID NO: 146857 - protein, 36 aa, Artificial Sequence
  Description of Artificial Sequence: Synthetic polypeptide
FEEEIRTTNPVATEQYGSVVSPTPNVQPTQMVQEPD

SEQ ID NO: 146858 - protein, 37 aa, Artificial Sequence
  Description of Artificial Sequence: Synthetic polypeptide
FEEEIRTTNPVATEQYGSVVSTPGVNEGQNVEGQSGQ

SEQ ID NO: 146859 - protein, 35 aa, Artificial Sequence
  Description of Artificial Sequence: Synthetic polypeptide
EEDEIRTTNPVAYEQWGQVSSCTNMQSADPGNYRA

SEQ ID NO: 146860 - protein, 34 aa, Artificial Sequence
  Description of Artificial Sequence: Synthetic polypeptide
EEDCIRTTNPVATEQWGSVFWTNNALQPLVQNKQ

SEQ ID NO: 146861 - protein, 31 aa, Artificial Sequence
  Description of Artificial Sequence: Synthetic polypeptide
QENEIATTNPVAYECYGKVVSESLSQHEENL

SEQ ID NO: 146862 - protein, 31 aa, Artificial Sequence
  Description of Artificial Sequence: Synthetic polypeptide
EECEIATTNPVAYEQWGSLSCFEHNQRQGEH

SEQ ID NO: 146863 - protein, 36 aa, Artificial Sequence
  Description of Artificial Sequence: Synthetic polypeptide
FEEEIRTTNPVATEQYGSVVTTGMNTETGEDGGNET

SEQ ID NO: 146864 - protein, 35 aa, Artificial Sequence
  Description of Artificial Sequence: Synthetic polypeptide
FEEEIRTTNPVATEQYGSVVVGVNQNGQGEFTGEG

SEQ ID NO: 146865 - protein, 30 aa, Artificial Sequence
  Description of Artificial Sequence: Synthetic polypeptide
QESEIASTNPVGTEGYGNVAASTLDQHGDI

SEQ ID NO: 146866 - protein, 28 aa, Artificial Sequence
  Description of Artificial Sequence: Synthetic peptide
QESEIASTNPVGTEGYGKMAFTLQHGDI

SEQ ID NO: 146867 - protein, 36 aa, Artificial Sequence
  Description of Artificial Sequence: Synthetic polypeptide
FEEEIRTTNPVATEQYGSVVDFTDQNEQTEEDNNGD

SEQ ID NO: 146868 - protein, 36 aa, Artificial Sequence
  Description of Artificial Sequence: Synthetic polypeptide
FEEEIRTTNPVATEQYGSVVAGVNDNNGQQGEFNED

SEQ ID NO: 146869 - protein, 37 aa, Artificial Sequence
  Description of Artificial Sequence: Synthetic polypeptide
EEEEIRTTNPVATEPYGSVCGFTNYLIATQRIGQEEV

SEQ ID NO: 146870 - protein, 28 aa, Artificial Sequence
  Description of Artificial Sequence: Synthetic peptide
QESEIASTNPVGTEEYGVMASTKQHGDI

SEQ ID NO: 146871 - protein, 35 aa, Artificial Sequence
  Description of Artificial Sequence: Synthetic polypeptide
DEEEIRTTNPVATEQYGSVSDPVGLIEPTPEQIVM

SEQ ID NO: 146872 - protein, 32 aa, Artificial Sequence
  Description of Artificial Sequence: Synthetic polypeptide
DEECIRTTNPVAYEPWGQCTTGGDHQRGSNKQ

SEQ ID NO: 146873 - protein, 29 aa, Artificial Sequence
  Description of Artificial Sequence: Synthetic peptide
QESEIASTNPVGTEEYGVMASTLQHGDAI

SEQ ID NO: 146874 - protein, 29 aa, Artificial Sequence
  Description of Artificial Sequence: Synthetic peptide
QESEIASTNPVGTEEYGVMASTLQHGDDI

SEQ ID NO: 146875 - protein, 36 aa, Artificial Sequence
  Description of Artificial Sequence: Synthetic polypeptide
EEEEIRTTNPVATEQYGSVQVSMSVTAQNVLPFVGE

SEQ ID NO: 146876 - protein, 37 aa, Artificial Sequence
  Description of Artificial Sequence: Synthetic polypeptide
EEEEIRTTNPVATEQYGSVQVSGDSVTAQNVLQFVGE

SEQ ID NO: 146877 - protein, 29 aa, Artificial Sequence
  Description of Artificial Sequence: Synthetic peptide
QESEIASTNPVGTEEYGVMASTLQHGDII

SEQ ID NO: 146878 - protein, 35 aa, Artificial Sequence
  Description of Artificial Sequence: Synthetic polypeptide
EEEEIRTTNPVATEQYGSVSEPTVGMMMRTPVSEI

SEQ ID NO: 146879 - protein, 30 aa, Artificial Sequence
  Description of Artificial Sequence: Synthetic polypeptide
QESEIASTNPVGTEFGYGNVMASTLQHGDI

SEQ ID NO: 146880 - protein, 36 aa, Artificial Sequence
  Description of Artificial Sequence: Synthetic polypeptide
EEEEIRTTNPVATEQYGSVQCTTSSLELVREEGFQS

SEQ ID NO: 146881 - protein, 36 aa, Artificial Sequence
  Description of Artificial Sequence: Synthetic polypeptide
DEECIRTTNPVAYEEWGSVACTNNGLQDGQQDNERG

SEQ ID NO: 146882 - protein, 28 aa, Artificial Sequence
  Description of Artificial Sequence: Synthetic peptide
QESEIASTNPVGTEFYGVMASDLQHGDI

SEQ ID NO: 146883 - protein, 36 aa, Artificial Sequence
  Description of Artificial Sequence: Synthetic polypeptide
EEEEIRTTNPVATEQYGSVNAGTNMGQGNQGEFTEG

SEQ ID NO: 146884 - protein, 29 aa, Artificial Sequence
  Description of Artificial Sequence: Synthetic peptide
QENEIATTNPVSSEPYGIISCENIQQGTH

SEQ ID NO: 146885 - protein, 28 aa, Artificial Sequence
  Description of Artificial Sequence: Synthetic peptide
QESEIASTNPVGTEGAGVMASTLQHGDI

SEQ ID NO: 146886 - protein, 37 aa, Artificial Sequence
  Description of Artificial Sequence: Synthetic polypeptide
EEEEIRTTNPVATEQYGSVISVAPNLEIQVNSQGQPD

SEQ ID NO: 146887 - protein, 28 aa, Artificial Sequence
  Description of Artificial Sequence: Synthetic peptide
QESEIASTNPVGTEGCGVMASTNQHGDI

SEQ ID NO: 146888 - protein, 35 aa, Artificial Sequence
  Description of Artificial Sequence: Synthetic polypeptide
EEEEIRTTNPVATEQYGSVQLTVSTDENVGESQVS

SEQ ID NO: 146889 - protein, 28 aa, Artificial Sequence
  Description of Artificial Sequence: Synthetic peptide
QESEIASTNPVGTEEYGVMASTDQHGDI

SEQ ID NO: 146890 - protein, 34 aa, Artificial Sequence
  Description of Artificial Sequence: Synthetic polypeptide
DEEEIKTTNPVATDQYGSVQCTRASSNNGGNNET

SEQ ID NO: 146891 - protein, 33 aa, Artificial Sequence
  Description of Artificial Sequence: Synthetic polypeptide
DEECIRTTNPVAYEQWGAYWSLDNDLRDGKVDR

SEQ ID NO: 146892 - protein, 34 aa, Artificial Sequence
  Description of Artificial Sequence: Synthetic polypeptide
DEEEIKTTNPVATEQYGCVCSNWGEHQSFGSEQP

SEQ ID NO: 146893 - protein, 31 aa, Artificial Sequence
  Description of Artificial Sequence: Synthetic polypeptide
DEECIRTTNPVAYEQWGCVYQFDAVDGGNNH

SEQ ID NO: 146894 - protein, 35 aa, Artificial Sequence
  Description of Artificial Sequence: Synthetic polypeptide
DEEEIRTTNPVATEQYGSVSDPVGLIETMVIQTVG

SEQ ID NO: 146895 - protein, 33 aa, Artificial Sequence
  Description of Artificial Sequence: Synthetic polypeptide
DEECIRTTNPVAYEQWGCVYQENTDWQDHGNNH

SEQ ID NO: 146896 - protein, 29 aa, Artificial Sequence
  Description of Artificial Sequence: Synthetic peptide
QESEIASTNPVGTECYGVMSSTLQHEGDG

SEQ ID NO: 146897 - protein, 29 aa, Artificial Sequence
  Description of Artificial Sequence: Synthetic peptide
QESEIASTNPVGTECYGVTASCELQHGDI

SEQ ID NO: 146898 - protein, 36 aa, Artificial Sequence
  Description of Artificial Sequence: Synthetic polypeptide
EEEEIRTTNPVATEQYGSVSPIMSDDMLNQLPELRE

SEQ ID NO: 146899 - protein, 37 aa, Artificial Sequence
  Description of Artificial Sequence: Synthetic polypeptide
AEEQIRTTNPVATEQYGSVSTVTNQNNNNLNQQGTTE

SEQ ID NO: 146900 - protein, 31 aa, Artificial Sequence
  Description of Artificial Sequence: Synthetic polypeptide
QESEIASTNPVGTECYGVVACINLQREGEDG

SEQ ID NO: 146901 - protein, 30 aa, Artificial Sequence
  Description of Artificial Sequence: Synthetic polypeptide
QESEIASTNPVGTECYGVVACNLQHEGEDG

SEQ ID NO: 146902 - protein, 37 aa, Artificial Sequence
  Description of Artificial Sequence: Synthetic polypeptide
AEEQIRTTNPVATEQYGSVSTVTNQQLNQNNQQGTTE

SEQ ID NO: 146903 - protein, 34 aa, Artificial Sequence
  Description of Artificial Sequence: Synthetic polypeptide
EEEEIRTTNPVATEQYGSVSNPEAVEQNVVLIPG

SEQ ID NO: 146904 - protein, 37 aa, Artificial Sequence
  Description of Artificial Sequence: Synthetic polypeptide
AEEQIRTTNPVATEQYGSVSTVTQQGTNQLNQQGTTE

SEQ ID NO: 146905 - protein, 36 aa, Artificial Sequence
  Description of Artificial Sequence: Synthetic polypeptide
AEEQIRTTNPVATEQYGVVSTTVNNNNQLQLQNTTD

SEQ ID NO: 146906 - protein, 34 aa, Artificial Sequence
  Description of Artificial Sequence: Synthetic polypeptide
DEEEIRATNPVATEQWGSVSGQGGIDNPAGENDG

SEQ ID NO: 146907 - protein, 31 aa, Artificial Sequence
  Description of Artificial Sequence: Synthetic polypeptide
QESEIASTNPVGTECYGVVSCNEPQDHEGNG

SEQ ID NO: 146908 - protein, 31 aa, Artificial Sequence
  Description of Artificial Sequence: Synthetic polypeptide
QESEIASTNPVGTECYGVVSCNEPQDHEGNI

SEQ ID NO: 146909 - protein, 36 aa, Artificial Sequence
  Description of Artificial Sequence: Synthetic polypeptide
FEEEIRTTNPVATEQYGSVSVYNGNEEQVQLENTDG

SEQ ID NO: 146910 - protein, 31 aa, Artificial Sequence
  Description of Artificial Sequence: Synthetic polypeptide
DEECIRTTNPVAYEQWGCSFQHEDLGRNDHT

SEQ ID NO: 146911 - protein, 28 aa, Artificial Sequence
  Description of Artificial Sequence: Synthetic peptide
QESEIASTNPVGTEGFGVMASTLQHGDI

SEQ ID NO: 146912 - protein, 28 aa, Artificial Sequence
  Description of Artificial Sequence: Synthetic peptide
QESEIASTNPVGTEGRGVMASTLQHGDI

SEQ ID NO: 146913 - protein, 36 aa, Artificial Sequence
  Description of Artificial Sequence: Synthetic polypeptide
EEEEIRTTNPVATEQYGSVIQAPNLVIQPEQQLSNL

SEQ ID NO: 146914 - protein, 34 aa, Artificial Sequence
  Description of Artificial Sequence: Synthetic polypeptide
DEECIRTTNPVAYECWGSVACTNNGLQDHTDDMR

SEQ ID NO: 146915 - protein, 29 aa, Artificial Sequence
  Description of Artificial Sequence: Synthetic peptide
QENEIATTNPVGTEGYGTMASETIQHGDI

SEQ ID NO: 146916 - protein, 35 aa, Artificial Sequence
  Description of Artificial Sequence: Synthetic polypeptide
DEEEIRTTNPVATEQYGSVSDPVGLIENTMVPVTP

SEQ ID NO: 146917 - protein, 34 aa, Artificial Sequence
  Description of Artificial Sequence: Synthetic polypeptide
DEECIRTTNPVATEQYSACVCSWNDNQNFGSEQS

SEQ ID NO: 146918 - protein, 33 aa, Artificial Sequence
  Description of Artificial Sequence: Synthetic polypeptide
DEECIRTTNPVATEQYSACVCSWEHQGFGSDQA

SEQ ID NO: 146919 - protein, 35 aa, Artificial Sequence
  Description of Artificial Sequence: Synthetic polypeptide
DEEEIRTTNPVATEQYGSVSDPVGLIENTMVMQTV

SEQ ID NO: 146920 - protein, 30 aa, Artificial Sequence
  Description of Artificial Sequence: Synthetic polypeptide
QESEIASTNPVGTEGYGAVMASTLSQHGDI

SEQ ID NO: 146921 - protein, 28 aa, Artificial Sequence
  Description of Artificial Sequence: Synthetic peptide
QESEIASTNPVGTEGYGCAAPTLQHGDI

SEQ ID NO: 146922 - protein, 28 aa, Artificial Sequence
  Description of Artificial Sequence: Synthetic peptide
QESEIASTNPVGTEGYGCMARTLQHGDI

SEQ ID NO: 146923 - protein, 29 aa, Artificial Sequence
  Description of Artificial Sequence: Synthetic peptide
QESEIASTNPVGTEGYGCMASSTLQHGDI

SEQ ID NO: 146924 - protein, 34 aa, Artificial Sequence
  Description of Artificial Sequence: Synthetic polypeptide
DEECIRTTNPVATEQYSACVCSTEPNQYFGSDQS

SEQ ID NO: 146925 - protein, 29 aa, Artificial Sequence
  Description of Artificial Sequence: Synthetic peptide
QESEIASTNPVGTEGYGCMASTLQQHGDI

SEQ ID NO: 146926 - protein, 31 aa, Artificial Sequence
  Description of Artificial Sequence: Synthetic polypeptide
AEGEIATTNPIATECWGSCSKNEDDQGGGNK

SEQ ID NO: 146927 - protein, 35 aa, Artificial Sequence
  Description of Artificial Sequence: Synthetic polypeptide
FEEEIRTTNPVATEQYGSVTGQQNVDQGEGGDTEE

SEQ ID NO: 146928 - protein, 35 aa, Artificial Sequence
  Description of Artificial Sequence: Synthetic polypeptide
DEECIRTTNPVATEQYSACVCSTEHNQNFGSDNQS

SEQ ID NO: 146929 - protein, 35 aa, Artificial Sequence
  Description of Artificial Sequence: Synthetic polypeptide
EEEEIRTTNPVATEQYGSVAISNMVITEMTQAVIP

SEQ ID NO: 146930 - protein, 34 aa, Artificial Sequence
  Description of Artificial Sequence: Synthetic polypeptide
DEECIRTTNPVATEQYSACVCSNWELQNFGSDQA

SEQ ID NO: 146931 - protein, 29 aa, Artificial Sequence
  Description of Artificial Sequence: Synthetic peptide
QESEIASTNPVGTEGYGCVMASTLWHGDI

SEQ ID NO: 146932 - protein, 36 aa, Artificial Sequence
  Description of Artificial Sequence: Synthetic polypeptide
DEEEIRTTNPVATEQYGSNVPITPNMPNDQNELTVT

SEQ ID NO: 146933 - protein, 34 aa, Artificial Sequence
  Description of Artificial Sequence: Synthetic polypeptide
DEEEIRTTNPVATEQYGSVSDPVGEIETMFAQTV

SEQ ID NO: 146934 - protein, 37 aa, Artificial Sequence
  Description of Artificial Sequence: Synthetic polypeptide
EEEEIRTTNPVATEQYGSVATTNLQLQQANNNTEQGS

SEQ ID NO: 146935 - protein, 28 aa, Artificial Sequence
  Description of Artificial Sequence: Synthetic peptide
QESEIASTNPVGTECYGVMASTLQHEEL

SEQ ID NO: 146936 - protein, 37 aa, Artificial Sequence
  Description of Artificial Sequence: Synthetic polypeptide
EEEEIRTTNPVATEQYGSVATTNQQLQQNNNNNEQGQ

SEQ ID NO: 146937 - protein, 36 aa, Artificial Sequence
  Description of Artificial Sequence: Synthetic polypeptide
EEEEIRTTNPVATEQYGSVATTQQLQQANNNNETGT

SEQ ID NO: 146938 - protein, 33 aa, Artificial Sequence
  Description of Artificial Sequence: Synthetic polypeptide
DEECIRTTNPVAYECWGQCTTLGGDHQRGSNER

SEQ ID NO: 146939 - protein, 35 aa, Artificial Sequence
  Description of Artificial Sequence: Synthetic polypeptide
EEEEIRTTNPVATEQYGSVGADTAGQNNGGGQDEQ

SEQ ID NO: 146940 - protein, 28 aa, Artificial Sequence
  Description of Artificial Sequence: Synthetic peptide
QESEIASTNPVGTEGWGVHASTLQHGDM

SEQ ID NO: 146941 - protein, 28 aa, Artificial Sequence
  Description of Artificial Sequence: Synthetic peptide
QESEIASTNPVGTEGWGVMACTLQHGNI

SEQ ID NO: 146942 - protein, 28 aa, Artificial Sequence
  Description of Artificial Sequence: Synthetic peptide
QESEIASTNPVGTEGWGVMASTLQHGDI

SEQ ID NO: 146943 - protein, 30 aa, Artificial Sequence
  Description of Artificial Sequence: Synthetic polypeptide
QENEIATTNPVGTEGYGTMASETIQQHGDI

SEQ ID NO: 146944 - protein, 28 aa, Artificial Sequence
  Description of Artificial Sequence: Synthetic peptide
QESEIASTNPVGTEGWGVSASALQGGDI

SEQ ID NO: 146945 - protein, 35 aa, Artificial Sequence
  Description of Artificial Sequence: Synthetic polypeptide
DEEEIRTTNPVATEQYGSVSDPVGLIEPMVEQTKE

SEQ ID NO: 146946 - protein, 29 aa, Artificial Sequence
  Description of Artificial Sequence: Synthetic peptide
QESEIASTNPVGTEGWGVSASTLQNPGDI

SEQ ID NO: 146947 - protein, 29 aa, Artificial Sequence
  Description of Artificial Sequence: Synthetic peptide
QESEIASTNPVGTEGYGAMANSTLQHGDI

SEQ ID NO: 146948 - protein, 33 aa, Artificial Sequence
  Description of Artificial Sequence: Synthetic polypeptide
DEECIRTTNPVAWEQYGGQCCTITVQGGGGNNV

SEQ ID NO: 146949 - protein, 36 aa, Artificial Sequence
  Description of Artificial Sequence: Synthetic polypeptide
DEECIRTTNPVATEYYGSVSSTTPAGPNMRNGMNPV

SEQ ID NO: 146950 - protein, 29 aa, Artificial Sequence
  Description of Artificial Sequence: Synthetic peptide
QESEIASTNPVGTEGYGAMASETLQHGDI

SEQ ID NO: 146951 - protein, 35 aa, Artificial Sequence
  Description of Artificial Sequence: Synthetic polypeptide
DEECIRTTNPVATEYWYGQVTTPNVGPQNYHSNRG

SEQ ID NO: 146952 - protein, 34 aa, Artificial Sequence
  Description of Artificial Sequence: Synthetic polypeptide
DEECIRTTNPVATESYGWVVNCIQDMGSTRPGND

SEQ ID NO: 146953 - protein, 37 aa, Artificial Sequence
  Description of Artificial Sequence: Synthetic polypeptide
EEEEIRTTNPVATEQYGSVAVTVNLQQGTEQGTTDDD

SEQ ID NO: 146954 - protein, 37 aa, Artificial Sequence
  Description of Artificial Sequence: Synthetic polypeptide
EEEEIRTTNPVATEQYGSVATVVNLQQGSEQGTTDDD

SEQ ID NO: 146955 - protein, 37 aa, Artificial Sequence
  Description of Artificial Sequence: Synthetic polypeptide
EEEEIRTTNPVATEQYGSVATTQQQLQQGNNNDEQGT

SEQ ID NO: 146956 - protein, 36 aa, Artificial Sequence
  Description of Artificial Sequence: Synthetic polypeptide
EEEEIRTTNPVATEQYGSVATTQQLQQATNVAEQGN

SEQ ID NO: 146957 - protein, 29 aa, Artificial Sequence
  Description of Artificial Sequence: Synthetic peptide
QESEIASTNPVGTEGYGAMASGTLQHGDI

SEQ ID NO: 146958 - protein, 33 aa, Artificial Sequence
  Description of Artificial Sequence: Synthetic polypeptide
EEAEIRTTNPVAYEQWGSVCSTMDRDNGGDGQD

SEQ ID NO: 146959 - protein, 34 aa, Artificial Sequence
  Description of Artificial Sequence: Synthetic polypeptide
DEEEIRTTNPVATEQYGSILSPEEGIEELELNDF

SEQ ID NO: 146960 - protein, 37 aa, Artificial Sequence
  Description of Artificial Sequence: Synthetic polypeptide
FEEEIRTTNPVATEQYGSVQSEAPLMQHDRTAVEENG

SEQ ID NO: 146961 - protein, 36 aa, Artificial Sequence
  Description of Artificial Sequence: Synthetic polypeptide
DEEEIRTTNPVATEQYGSVSENPVTLNTPAEILEDN

SEQ ID NO: 146962 - protein, 35 aa, Artificial Sequence
  Description of Artificial Sequence: Synthetic polypeptide
FEEEIRTTNPVATEQYGNVMTDDDDQEEGGGNNIV

SEQ ID NO: 146963 - protein, 35 aa, Artificial Sequence
  Description of Artificial Sequence: Synthetic polypeptide
FEEEIRTTNPVATEQYGNVMTDDNDDEEEGGGNII

SEQ ID NO: 146964 - protein, 28 aa, Artificial Sequence
  Description of Artificial Sequence: Synthetic peptide
QEPEIASTNPVGTEGYGVMASTYQHGDI

SEQ ID NO: 146965 - protein, 32 aa, Artificial Sequence
  Description of Artificial Sequence: Synthetic polypeptide
ETEEIATTNPVAYEQWGTYITNDQHEHGPNDR

SEQ ID NO: 146966 - protein, 34 aa, Artificial Sequence
  Description of Artificial Sequence: Synthetic polypeptide
ETEEIATTNPVATTQWGSVAWTENGDQDNGKNQR

SEQ ID NO: 146967 - protein, 32 aa, Artificial Sequence
  Description of Artificial Sequence: Synthetic polypeptide
ETEEIATTNPCAYEHWGSVYCVDLTQREGNAR

SEQ ID NO: 146968 - protein, 31 aa, Artificial Sequence
  Description of Artificial Sequence: Synthetic polypeptide
ETEEIATTNPCAYEEWGSVYYVDLQRQEGNA

SEQ ID NO: 146969 - protein, 34 aa, Artificial Sequence
  Description of Artificial Sequence: Synthetic polypeptide
FEDEIRTTNPVATEQYGSVGDQSNEGQGGGEEGV

SEQ ID NO: 146970 - protein, 31 aa, Artificial Sequence
  Description of Artificial Sequence: Synthetic polypeptide
ETEEIATTNPCAYEEWGSVYYVDEQRGLGNR

SEQ ID NO: 146971 - protein, 28 aa, Artificial Sequence
  Description of Artificial Sequence: Synthetic peptide
QEPEIACTNPVGTEGYGVFASGLQHGDI

SEQ ID NO: 146972 - protein, 29 aa, Artificial Sequence
  Description of Artificial Sequence: Synthetic peptide
QEPEIACTNPVGTEGWGVSASTLQHDGDQ

SEQ ID NO: 146973 - protein, 35 aa, Artificial Sequence
  Description of Artificial Sequence: Synthetic polypeptide
EQEEIRTTNPVATEQWGATVSTNLEQQMGDVPEGP

SEQ ID NO: 146974 - protein, 35 aa, Artificial Sequence
  Description of Artificial Sequence: Synthetic polypeptide
EQEEIRTTNPVATEQWGATVSTNLEFQEFGVPEDP

SEQ ID NO: 146975 - protein, 35 aa, Artificial Sequence
  Description of Artificial Sequence: Synthetic polypeptide
EQEEIRTTNPVATEAYGSTVPSTAFELSTRTVNLP

SEQ ID NO: 146976 - protein, 32 aa, Artificial Sequence
  Description of Artificial Sequence: Synthetic polypeptide
ENYEIATTNPVAYERWGVVYTNLQGDHGPNQR

SEQ ID NO: 146977 - protein, 35 aa, Artificial Sequence
  Description of Artificial Sequence: Synthetic polypeptide
ENTEIATTNPVATENYGCVSTSNGLNDTERGNDRE

SEQ ID NO: 146978 - protein, 37 aa, Artificial Sequence
  Description of Artificial Sequence: Synthetic polypeptide
FEEEIRTTNPVATEQYGQVSTMTNGGDTGQEGNDDGI

SEQ ID NO: 146979 - protein, 31 aa, Artificial Sequence
  Description of Artificial Sequence: Synthetic polypeptide
ETEEIATTNPCAYEEWGSVYCVDQQRGQGNR

SEQ ID NO: 146980 - protein, 34 aa, Artificial Sequence
  Description of Artificial Sequence: Synthetic polypeptide
FEDEIRTTNPVATEQYGSVIDQSNEGQGGGEEVG

SEQ ID NO: 146981 - protein, 36 aa, Artificial Sequence
  Description of Artificial Sequence: Synthetic polypeptide
DEEEINTTNPVATEQYGSASSTTPAGPNMRNGMNPV

SEQ ID NO: 146982 - protein, 30 aa, Artificial Sequence
  Description of Artificial Sequence: Synthetic polypeptide
QEPEIATTNPVATEFYGDVVEGGQDEGEFE

SEQ ID NO: 146983 - protein, 30 aa, Artificial Sequence
  Description of Artificial Sequence: Synthetic polypeptide
QEQEIATTNPVATEQYGEASAEVCEHGEDL

SEQ ID NO: 146984 - protein, 35 aa, Artificial Sequence
  Description of Artificial Sequence: Synthetic polypeptide
QEPEIRCTNPVATEQYGCVVSETNVGDQLNDGPYR

SEQ ID NO: 146985 - protein, 36 aa, Artificial Sequence
  Description of Artificial Sequence: Synthetic polypeptide
DEEEIRTTNPVATEQYGSVSENNIVDDTQQDIEQQH

SEQ ID NO: 146986 - protein, 35 aa, Artificial Sequence
  Description of Artificial Sequence: Synthetic polypeptide
FEEEIRTTNPVATEQYGMVGSIMNLSEGGQEDEEI

SEQ ID NO: 146987 - protein, 34 aa, Artificial Sequence
  Description of Artificial Sequence: Synthetic polypeptide
FEDEIRTTNPVATEQYGVVGSNNDEMQGEGQEED

SEQ ID NO: 146988 - protein, 35 aa, Artificial Sequence
  Description of Artificial Sequence: Synthetic polypeptide
FEDEIRTTNPVATEQYGSVVTFGVNGDEGGQTQNI

SEQ ID NO: 146989 - protein, 36 aa, Artificial Sequence
  Description of Artificial Sequence: Synthetic polypeptide
FEDEIRTTNPVATEQYGSVVSTLGMEEQGEMGNGGE

SEQ ID NO: 146990 - protein, 31 aa, Artificial Sequence
  Description of Artificial Sequence: Synthetic polypeptide
QEQEIATTNPVATEQYGEVPTDCEDHEGEDL

SEQ ID NO: 146991 - protein, 34 aa, Artificial Sequence
  Description of Artificial Sequence: Synthetic polypeptide
FEDEIRTTNPVATEQYGSVVDLGMTGEGGGENTE

SEQ ID NO: 146992 - protein, 31 aa, Artificial Sequence
  Description of Artificial Sequence: Synthetic polypeptide
QEQEIATTNPVATEQYGEVPTVCEDHEGEDL

SEQ ID NO: 146993 - protein, 34 aa, Artificial Sequence
  Description of Artificial Sequence: Synthetic polypeptide
DEEEIRTTNPVATEQYGSITHTTEDHNDMENEEQ

SEQ ID NO: 146994 - protein, 29 aa, Artificial Sequence
  Description of Artificial Sequence: Synthetic peptide
QEPEIATTNPVATEQYGEAPEVCQHEKEK

SEQ ID NO: 146995 - protein, 35 aa, Artificial Sequence
  Description of Artificial Sequence: Synthetic polypeptide
FEEEIRTTNPVATEQYGMVNIMNGFEGGNGQEGND

SEQ ID NO: 146996 - protein, 35 aa, Artificial Sequence
  Description of Artificial Sequence: Synthetic polypeptide
FEEEIRTTNPVATEQYGMVSIMNGEMQEGGGEQGQ

SEQ ID NO: 146997 - protein, 35 aa, Artificial Sequence
  Description of Artificial Sequence: Synthetic polypeptide
FEEEIRTTNPVATEQYGMVSNMNIFEDDDGGNEDI

SEQ ID NO: 146998 - protein, 37 aa, Artificial Sequence
  Description of Artificial Sequence: Synthetic polypeptide
DEEEINTTNPVATEQYGNTVSCTANEFSQQSNGGNEL

SEQ ID NO: 146999 - protein, 37 aa, Artificial Sequence
  Description of Artificial Sequence: Synthetic polypeptide
FEDEIRTTNPVATEQYGSVSDGTDNDLQEGGEGQEGV

SEQ ID NO: 147000 - protein, 36 aa, Artificial Sequence
  Description of Artificial Sequence: Synthetic polypeptide
FEEEIRTTNPVATEQYGMVSTIMNGFEGGGGQEGES

SEQ ID NO: 147001 - protein, 34 aa, Artificial Sequence
  Description of Artificial Sequence: Synthetic polypeptide
DEECISTTNPVATEGYGCVCNNTNGLQNFGSDQS

SEQ ID NO: 147002 - protein, 28 aa, Artificial Sequence
  Description of Artificial Sequence: Synthetic peptide
ENNEIATTNPVAYEPWGVVSECLQHEEL

SEQ ID NO: 147003 - protein, 29 aa, Artificial Sequence
  Description of Artificial Sequence: Synthetic peptide
QEQEIATTNPVATEQYGEASAEVCEHEEK

SEQ ID NO: 147004 - protein, 28 aa, Artificial Sequence
  Description of Artificial Sequence: Synthetic peptide
ENNEIATTNPVAYECWGCVSECLQHQEA

SEQ ID NO: 147005 - protein, 35 aa, Artificial Sequence
  Description of Artificial Sequence: Synthetic polypeptide
ENEEISTTNPVATTQWGSVSKTWNEPMERGGGNRR

SEQ ID NO: 147006 - protein, 32 aa, Artificial Sequence
  Description of Artificial Sequence: Synthetic polypeptide
ENAEIATTNPVSTEQYGSVSWNEMDDRQGMDH

SEQ ID NO: 147007 - protein, 36 aa, Artificial Sequence
  Description of Artificial Sequence: Synthetic polypeptide
DEEEIRTTNPVATEQYGSISSTTPAGPNMRNNMNPV

SEQ ID NO: 147008 - protein, 35 aa, Artificial Sequence
  Description of Artificial Sequence: Synthetic polypeptide
EITEIATTNPVATEQYGSVSWNEGDQQDDRQGNDA

SEQ ID NO: 147009 - protein, 32 aa, Artificial Sequence
  Description of Artificial Sequence: Synthetic polypeptide
EIEEIATTNPVAYEQWGHVSGGEMQQTGDGNR

SEQ ID NO: 147010 - protein, 33 aa, Artificial Sequence
  Description of Artificial Sequence: Synthetic polypeptide
EIEEIATTNPVAYEQWGCVSTTNHNNDAGNNDR

SEQ ID NO: 147011 - protein, 32 aa, Artificial Sequence
  Description of Artificial Sequence: Synthetic polypeptide
EGEEIATTNPVAYEQWGSVTHTLDDQQNGTDR

SEQ ID NO: 147012 - protein, 37 aa, Artificial Sequence
  Description of Artificial Sequence: Synthetic polypeptide
FEEEIRTTNPVATEQYGSVDNTSNGQQGEGQGGNDTD

SEQ ID NO: 147013 - protein, 29 aa, Artificial Sequence
  Description of Artificial Sequence: Synthetic peptide
EEVEIATTNPVAYERWGCVYECLQHEGAD

SEQ ID NO: 147014 - protein, 34 aa, Artificial Sequence
  Description of Artificial Sequence: Synthetic polypeptide
ENEEIATTNPVATTQWGNVSKTWNPNEQQGGNNR

SEQ ID NO: 147015 - protein, 31 aa, Artificial Sequence
  Description of Artificial Sequence: Synthetic polypeptide
EEVEIATTNPVAYEQWGCVTGGGQDQGDGNR

SEQ ID NO: 147016 - protein, 28 aa, Artificial Sequence
  Description of Artificial Sequence: Synthetic peptide
EEVEIATTNPVAYECWGCVYECLQMEEA

SEQ ID NO: 147017 - protein, 29 aa, Artificial Sequence
  Description of Artificial Sequence: Synthetic peptide
EEVEIATTNPVAYECWGCVYECLQHEGDA

SEQ ID NO: 147018 - protein, 29 aa, Artificial Sequence
  Description of Artificial Sequence: Synthetic peptide
EEVEIATTNPVAYECWGCVSECLQHMEEA

SEQ ID NO: 147019 - protein, 31 aa, Artificial Sequence
  Description of Artificial Sequence: Synthetic polypeptide
QEQEIATTNPVATEQYGVMAATDLEDHGDDL

SEQ ID NO: 147020 - protein, 35 aa, Artificial Sequence
  Description of Artificial Sequence: Synthetic polypeptide
EETEIRTTNPVATEQYGSVSPLINNEIDRQNSEGQ

SEQ ID NO: 147021 - protein, 29 aa, Artificial Sequence
  Description of Artificial Sequence: Synthetic peptide
EETEIATTNPVAYECWGCVSECLQHEEAE

SEQ ID NO: 147022 - protein, 35 aa, Artificial Sequence
  Description of Artificial Sequence: Synthetic polypeptide
EETEIATTNPVATESYGCVATGNGLNDQERGGGER

SEQ ID NO: 147023 - protein, 36 aa, Artificial Sequence
  Description of Artificial Sequence: Synthetic polypeptide
FEEEIRTTNPVATEQYGSVDSPSSNLMQVQTEEVTM

SEQ ID NO: 147024 - protein, 29 aa, Artificial Sequence
  Description of Artificial Sequence: Synthetic peptide
EEVEIATTNPVAYEKWGCVYEPLQHEGEA

SEQ ID NO: 147025 - protein, 34 aa, Artificial Sequence
  Description of Artificial Sequence: Synthetic polypeptide
ENEEIATTNPVATTQWGSVSKTWNPMERNGGNVP

SEQ ID NO: 147026 - protein, 35 aa, Artificial Sequence
  Description of Artificial Sequence: Synthetic polypeptide
ENEEIATTNPVATTQWGSVSKTWNPMNEQQGMNDR

SEQ ID NO: 147027 - protein, 33 aa, Artificial Sequence
  Description of Artificial Sequence: Synthetic polypeptide
ENEEIATTNPVATTQWGSVSKTWNPNEQGQQDR

SEQ ID NO: 147028 - protein, 36 aa, Artificial Sequence
  Description of Artificial Sequence: Synthetic polypeptide
FEEEIRTTNPVATEQYGSTTCTTLLPEMQQGFGNLV

SEQ ID NO: 147029 - protein, 28 aa, Artificial Sequence
  Description of Artificial Sequence: Synthetic peptide
QEPEIACTNPVGTEGWGVSASALQHGDM

SEQ ID NO: 147030 - protein, 37 aa, Artificial Sequence
  Description of Artificial Sequence: Synthetic polypeptide
DEEEINTTNPVATERYGSTVSTLNEFSQESNGGNELD

SEQ ID NO: 147031 - protein, 37 aa, Artificial Sequence
  Description of Artificial Sequence: Synthetic polypeptide
DEEEIQSTNPVAYEQYGSVVSYTLNEGSLARVGNMAT

SEQ ID NO: 147032 - protein, 38 aa, Artificial Sequence
  Description of Artificial Sequence: Synthetic polypeptide
AEEEIRTTNPVATEQYGSVSTVVNLNNANNEQGTNPVE

SEQ ID NO: 147033 - protein, 37 aa, Artificial Sequence
  Description of Artificial Sequence: Synthetic polypeptide
DEEEIQTTNPVATEQYGIAVVPSTNLSDPRNVGSPEW

SEQ ID NO: 147034 - protein, 36 aa, Artificial Sequence
  Description of Artificial Sequence: Synthetic polypeptide
FEEEIRTTNPVATEQYGSVAGTDNFGQTNQGEGEEQ

SEQ ID NO: 147035 - protein, 28 aa, Artificial Sequence
  Description of Artificial Sequence: Synthetic peptide
QENTIATTNPVAYECYGDVSECLSHEEL

SEQ ID NO: 147036 - protein, 36 aa, Artificial Sequence
  Description of Artificial Sequence: Synthetic polypeptide
DEEEIQTTNPVAYEQYGSVPSTTDAGSTTRNGGNPM

SEQ ID NO: 147037 - protein, 32 aa, Artificial Sequence
  Description of Artificial Sequence: Synthetic polypeptide
ENEEIATTNPVAYERWGVVYTSLQGDHGGNDR

SEQ ID NO: 147038 - protein, 36 aa, Artificial Sequence
  Description of Artificial Sequence: Synthetic polypeptide
DEEEIQTTNPVAYEQYGSVPSTTPAGSTTRNEGNPV

SEQ ID NO: 147039 - protein, 36 aa, Artificial Sequence
  Description of Artificial Sequence: Synthetic polypeptide
FEEEIRTTNPVATEQYGSVASGGFGGNDGQDDDNEQ

SEQ ID NO: 147040 - protein, 37 aa, Artificial Sequence
  Description of Artificial Sequence: Synthetic polypeptide
DEEEIRTTNPVATEQYGSVSEPVNFLDPVSMPEIERH

SEQ ID NO: 147041 - protein, 34 aa, Artificial Sequence
  Description of Artificial Sequence: Synthetic polypeptide
ENEEIATTNPVAYEQWGVVCSTNLQGDHQPNTRN

SEQ ID NO: 147042 - protein, 36 aa, Artificial Sequence
  Description of Artificial Sequence: Synthetic polypeptide
DEEEIRTTNPVATEQYGSLSPTIMIGLGEFHQLQFE

SEQ ID NO: 147043 - protein, 36 aa, Artificial Sequence
  Description of Artificial Sequence: Synthetic polypeptide
DEEEIRTTNPVATEQYGSISSTTPAGPNMRNTMNPV

SEQ ID NO: 147044 - protein, 33 aa, Artificial Sequence
  Description of Artificial Sequence: Synthetic polypeptide
ENEEIATTNPVAYEQWGVVCSTEQQGDHGQNTR

SEQ ID NO: 147045 - protein, 33 aa, Artificial Sequence
  Description of Artificial Sequence: Synthetic polypeptide
ENEEIATTNPVAYEQWGVVCSTELQGDHGQNPT

SEQ ID NO: 147046 - protein, 35 aa, Artificial Sequence
  Description of Artificial Sequence: Synthetic polypeptide
FEEEIRTTNPVATEQYGSVDGTQNMDTGGEGGEEQ

SEQ ID NO: 147047 - protein, 36 aa, Artificial Sequence
  Description of Artificial Sequence: Synthetic polypeptide
FEEEIRTTNPVATEQYGRVSSTTPAGPNMRNGMNPV

SEQ ID NO: 147048 - protein, 37 aa, Artificial Sequence
  Description of Artificial Sequence: Synthetic polypeptide
DEEEIRTTNPVATEQYGSIYSEAPNLEIQINGQGQPD

SEQ ID NO: 147049 - protein, 36 aa, Artificial Sequence
  Description of Artificial Sequence: Synthetic polypeptide
DEEEIRTTNPVATEQYGSIYLTEFQHIQPRIQVIDR

SEQ ID NO: 147050 - protein, 29 aa, Artificial Sequence
  Description of Artificial Sequence: Synthetic peptide
QEQEIATTNPVATEQYGEAPHVCQHEEEK

SEQ ID NO: 147051 - protein, 35 aa, Artificial Sequence
  Description of Artificial Sequence: Synthetic polypeptide
FEEEIRTTNPVATEQYGCVSTLGFGQEGGGEGEEM

SEQ ID NO: 147052 - protein, 35 aa, Artificial Sequence
  Description of Artificial Sequence: Synthetic polypeptide
FEEEIRTTNPVATEGYGSVVSIMGDGGQRNQGEGD

SEQ ID NO: 147053 - protein, 36 aa, Artificial Sequence
  Description of Artificial Sequence: Synthetic polypeptide
DEEEIRTTNPVATEQYGSVSENGNLVEVAEAKVEEE

SEQ ID NO: 147054 - protein, 37 aa, Artificial Sequence
  Description of Artificial Sequence: Synthetic polypeptide
DEEEIRTTNPVATEQYGSIVNGTEELDDGTGSNTTQI

SEQ ID NO: 147055 - protein, 35 aa, Artificial Sequence
  Description of Artificial Sequence: Synthetic polypeptide
FEEEIRTTNPVATEGYGSVVNDVNGQQEIEEGNQG

SEQ ID NO: 147056 - protein, 36 aa, Artificial Sequence
  Description of Artificial Sequence: Synthetic polypeptide
FEEEIRTTNPVATEGYGSVVGNLDDNNDQTGGGNED

SEQ ID NO: 147057 - protein, 35 aa, Artificial Sequence
  Description of Artificial Sequence: Synthetic polypeptide
FEEEIRTTNPVATEQYGDVDSDGNEQDEGGGQTTE

SEQ ID NO: 147058 - protein, 37 aa, Artificial Sequence
  Description of Artificial Sequence: Synthetic polypeptide
DEEEINTTNPVATEQYGIAVVPSQTNLSDSRVGSPEW

SEQ ID NO: 147059 - protein, 31 aa, Artificial Sequence
  Description of Artificial Sequence: Synthetic polypeptide
QEQEIATTNPVASEQYGIVSACDLEDSGTDL

SEQ ID NO: 147060 - protein, 34 aa, Artificial Sequence
  Description of Artificial Sequence: Synthetic polypeptide
FEEEIRTTNPVATEGYGSVSIVDDMGQAEGQGED

SEQ ID NO: 147061 - protein, 34 aa, Artificial Sequence
  Description of Artificial Sequence: Synthetic polypeptide
FEEEIRTTNPVATEGYGSVSIDIMGQNEGIQGED

SEQ ID NO: 147062 - protein, 34 aa, Artificial Sequence
  Description of Artificial Sequence: Synthetic polypeptide
FEEEIRTTNPVATEGYGSVSIDDMQQENEGQGED

SEQ ID NO: 147063 - protein, 36 aa, Artificial Sequence
  Description of Artificial Sequence: Synthetic polypeptide
DEEEINTTNPVATEQYGIAVVPSTNHSDPRVGSPEF

SEQ ID NO: 147064 - protein, 34 aa, Artificial Sequence
  Description of Artificial Sequence: Synthetic polypeptide
FEEEIRTTNPVATEGYGSVSIDDMGQINEGQGET

SEQ ID NO: 147065 - protein, 37 aa, Artificial Sequence
  Description of Artificial Sequence: Synthetic polypeptide
DEEEIRTTNPVATEQYGSIVENAANQMVQVRGEQADE

SEQ ID NO: 147066 - protein, 35 aa, Artificial Sequence
  Description of Artificial Sequence: Synthetic polypeptide
FEEEIRTTNPVATEGYGSVSDGQIGQDEEGGNQDG

SEQ ID NO: 147067 - protein, 36 aa, Artificial Sequence
  Description of Artificial Sequence: Synthetic polypeptide
FEEEIRTTNPVATEGYGSVNSVTMNIGEGGQGNEDP

SEQ ID NO: 147068 - protein, 35 aa, Artificial Sequence
  Description of Artificial Sequence: Synthetic polypeptide
FEEEIRTTNPVATEGYGSVDNSANGQENIGEDEDD

SEQ ID NO: 147069 - protein, 37 aa, Artificial Sequence
  Description of Artificial Sequence: Synthetic polypeptide
DEEEIRTTNPVATEQYGSIVIEQSWAGLAPGPSNFEI

SEQ ID NO: 147070 - protein, 36 aa, Artificial Sequence
  Description of Artificial Sequence: Synthetic polypeptide
FEEEIRTTNPVATEGYGSVVTNFDDNADQTGGGNED

SEQ ID NO: 147071 - protein, 32 aa, Artificial Sequence
  Description of Artificial Sequence: Synthetic polypeptide
QEQEIATTNPCSTEQYGSVSACNLEDSEGEDL

SEQ ID NO: 147072 - protein, 37 aa, Artificial Sequence
  Description of Artificial Sequence: Synthetic polypeptide
DEEEIRTTNPVATEQYGSIVSSTPAELAPETQPEQVV

SEQ ID NO: 147073 - protein, 34 aa, Artificial Sequence
  Description of Artificial Sequence: Synthetic polypeptide
FEEEIRTTNPVATEQYGAVVNGFGNGQTDVTGGF

SEQ ID NO: 147074 - protein, 30 aa, Artificial Sequence
  Description of Artificial Sequence: Synthetic polypeptide
QEQEIASTNPVGTEGYGSVSASDLEHEGEI

SEQ ID NO: 147075 - protein, 28 aa, Artificial Sequence
  Description of Artificial Sequence: Synthetic peptide
QEQEIASTNPVGTEGYGVMALTLQHGDI

SEQ ID NO: 147076 - protein, 35 aa, Artificial Sequence
  Description of Artificial Sequence: Synthetic polypeptide
FEEEIRTTNPVATEQYGAVVDNLDNGQGEGFDGGT

SEQ ID NO: 147077 - protein, 28 aa, Artificial Sequence
  Description of Artificial Sequence: Synthetic peptide
QEQEIASTNPVGTEGYGVMASTLIHGDI

SEQ ID NO: 147078 - protein, 29 aa, Artificial Sequence
  Description of Artificial Sequence: Synthetic peptide
QEQEIASTNPVGTEGYGVMASTLQDHGDI

SEQ ID NO: 147079 - protein, 35 aa, Artificial Sequence
  Description of Artificial Sequence: Synthetic polypeptide
FEEEIRTTNPVATEQYGAVSTTGDDQDDEGGQTEG

SEQ ID NO: 147080 - protein, 29 aa, Artificial Sequence
  Description of Artificial Sequence: Synthetic peptide
QEQEIASTNPVGTEGYGVMASYTLQHGDI

SEQ ID NO: 147081 - protein, 35 aa, Artificial Sequence
  Description of Artificial Sequence: Synthetic polypeptide
FEEEIRTTNPVATEQYGAVSDELNDGEEGGGQEGN

SEQ ID NO: 147082 - protein, 36 aa, Artificial Sequence
  Description of Artificial Sequence: Synthetic polypeptide
FEEEIRTTNPVATEQYGAVVTGTQNGLEQENGGGQG

SEQ ID NO: 147083 - protein, 30 aa, Artificial Sequence
  Description of Artificial Sequence: Synthetic polypeptide
QEQEIASTNPVATEGYGVMSTTLEDHEGDI

SEQ ID NO: 147084 - protein, 29 aa, Artificial Sequence
  Description of Artificial Sequence: Synthetic peptide
QEQEIASTNPVGTEGYGVVSSTLEHEGDL

SEQ ID NO: 147085 - protein, 32 aa, Artificial Sequence
  Description of Artificial Sequence: Synthetic polypeptide
QEQEIASTNPVGTEQYGSVSATDLEDHEGEDI

SEQ ID NO: 147086 - protein, 32 aa, Artificial Sequence
  Description of Artificial Sequence: Synthetic polypeptide
QEQEIASTNPVGTEQYGSVSATDLEDHEGEDL

SEQ ID NO: 147087 - protein, 36 aa, Artificial Sequence
  Description of Artificial Sequence: Synthetic polypeptide
DEEEIRTTNPVATEQYGSIVNYTENYDDVNQSEDIA

SEQ ID NO: 147088 - protein, 33 aa, Artificial Sequence
  Description of Artificial Sequence: Synthetic polypeptide
FEEEIRTTNPVATEQYGAVMGGIGGNGNEEDFD

SEQ ID NO: 147089 - protein, 37 aa, Artificial Sequence
  Description of Artificial Sequence: Synthetic polypeptide
DEEEIRTTNPVATEQYGSIVNGTETLDDQTESNGPQI

SEQ ID NO: 147090 - protein, 38 aa, Artificial Sequence
  Description of Artificial Sequence: Synthetic polypeptide
DEEEIRTTNPVATEQYGSIVNGTEELGDDQTGSNDWQI

SEQ ID NO: 147091 - protein, 31 aa, Artificial Sequence
  Description of Artificial Sequence: Synthetic polypeptide
QEQEIATTNPCSTEQYGIVSACNLESEGEDL

SEQ ID NO: 147092 - protein, 36 aa, Artificial Sequence
  Description of Artificial Sequence: Synthetic polypeptide
DEEEINTTNPVATEQYGIAVVPSTNLSDPIVGSYEW

SEQ ID NO: 147093 - protein, 36 aa, Artificial Sequence
  Description of Artificial Sequence: Synthetic polypeptide
DEEEINTTNPVATEQYGIAVVPSTNLSDPPVGSEEV

SEQ ID NO: 147094 - protein, 36 aa, Artificial Sequence
  Description of Artificial Sequence: Synthetic polypeptide
DEEEINTTNPVATEQYGAVSSLTPAGPNMRNGMNPV

SEQ ID NO: 147095 - protein, 37 aa, Artificial Sequence
  Description of Artificial Sequence: Synthetic polypeptide
FEEEIRTTNPVATEFYGSVVSDDGNLQSQTGGGNEGE

SEQ ID NO: 147096 - protein, 33 aa, Artificial Sequence
  Description of Artificial Sequence: Synthetic polypeptide
FEEEIRSTNPVATEQYGSVNDQQNIGQGEEDEE

SEQ ID NO: 147097 - protein, 36 aa, Artificial Sequence
  Description of Artificial Sequence: Synthetic polypeptide
FEEEIRSTNPVATEQYGAVSTGTMNNGQGEGGNDEI

SEQ ID NO: 147098 - protein, 30 aa, Artificial Sequence
  Description of Artificial Sequence: Synthetic polypeptide
QEQEIATTNPVATEQYGEAPAEDCQDHGEK

SEQ ID NO: 147099 - protein, 33 aa, Artificial Sequence
  Description of Artificial Sequence: Synthetic polypeptide
FEEEIRCTNPAATEQYGSVVSEGGMGQGENGGM

SEQ ID NO: 147100 - protein, 31 aa, Artificial Sequence
  Description of Artificial Sequence: Synthetic polypeptide
QEQEIATTNPVATEQYGEAPAEDLQDHEGEK

SEQ ID NO: 147101 - protein, 30 aa, Artificial Sequence
  Description of Artificial Sequence: Synthetic polypeptide
QEQEIATTNPVATEQYGEAPAEVLQDHEEK

SEQ ID NO: 147102 - protein, 31 aa, Artificial Sequence
  Description of Artificial Sequence: Synthetic polypeptide
QEQEIATTNPVATEQYGEAPAEVLQDHEGEK

SEQ ID NO: 147103 - protein, 35 aa, Artificial Sequence
  Description of Artificial Sequence: Synthetic polypeptide
DEEEIRTTNPVATEQYGSITHTTLEDHNDESGQEQ

SEQ ID NO: 147104 - protein, 34 aa, Artificial Sequence
  Description of Artificial Sequence: Synthetic polypeptide
FEEEIRATNPVATEQYGSVVDFQNEQEDNFNNGA

SEQ ID NO: 147105 - protein, 36 aa, Artificial Sequence
  Description of Artificial Sequence: Synthetic polypeptide
FEEEIRATNPVATEQYGSVTGVDGNLQDEGGNENTD

SEQ ID NO: 147106 - protein, 35 aa, Artificial Sequence
  Description of Artificial Sequence: Synthetic polypeptide
DEEEIRTTNPVATEQYGSITHTTLEDHNDEGGDEN

SEQ ID NO: 147107 - protein, 28 aa, Artificial Sequence
  Description of Artificial Sequence: Synthetic peptide
QEQEIATTNPVATEQYGEAPEVCLHEEK

SEQ ID NO: 147108 - protein, 37 aa, Artificial Sequence
  Description of Artificial Sequence: Synthetic polypeptide
FEEEIKTTNPVATEQYGSVSIADNLDGEGQGEGNEQI

SEQ ID NO: 147109 - protein, 33 aa, Artificial Sequence
  Description of Artificial Sequence: Synthetic polypeptide
DEECISTTNPVATEGYGCVCNTNATQNFGSDQA

SEQ ID NO: 147110 - protein, 35 aa, Artificial Sequence
  Description of Artificial Sequence: Synthetic polypeptide
FEEEIRTTNPVATEQYGDVVVNGFNQGQETGGGNI

SEQ ID NO: 147111 - protein, 34 aa, Artificial Sequence
  Description of Artificial Sequence: Synthetic polypeptide
DEECISTTNPVATEGYGCVCNTMEPLQNFGSNQA

SEQ ID NO: 147112 - protein, 34 aa, Artificial Sequence
  Description of Artificial Sequence: Synthetic polypeptide
DEECISTTNPVATEGYGCVCNTGEALQYFGSNQS

SEQ ID NO: 147113 - protein, 36 aa, Artificial Sequence
  Description of Artificial Sequence: Synthetic polypeptide
DEEEIRTTNPVATEQYGSIVSTYSSEDQVYSMDDGQ

SEQ ID NO: 147114 - protein, 33 aa, Artificial Sequence
  Description of Artificial Sequence: Synthetic polypeptide
DEECISTTNPVATEGYGCVCNTEGLQYFGSDQG

SEQ ID NO: 147115 - protein, 35 aa, Artificial Sequence
  Description of Artificial Sequence: Synthetic polypeptide
DEEEIRTTNPVATEQYGSITHTTLEDHNDVENDEQ

SEQ ID NO: 147116 - protein, 36 aa, Artificial Sequence
  Description of Artificial Sequence: Synthetic polypeptide
DEEEIKTTNPVATEQYGSVVVTGFGQENDQDEDGVT

SEQ ID NO: 147117 - protein, 35 aa, Artificial Sequence
  Description of Artificial Sequence: Synthetic polypeptide
DEEEIRTTNPVATEQYGSITHTTLEDHNNEGEEQI

SEQ ID NO: 147118 - protein, 35 aa, Artificial Sequence
  Description of Artificial Sequence: Synthetic polypeptide
FEEEIRSTNPVATEQYGSVVSGSGQIGQGGGNQTQ

SEQ ID NO: 147119 - protein, 34 aa, Artificial Sequence
  Description of Artificial Sequence: Synthetic polypeptide
FEEEIRTTNPVATEQYGDVSIDIMNGEDEAENGG

SEQ ID NO: 147120 - protein, 36 aa, Artificial Sequence
  Description of Artificial Sequence: Synthetic polypeptide
FEEEIRTTNPVATEFYGSVTMTDNGIGQEDGGENGP

SEQ ID NO: 147121 - protein, 34 aa, Artificial Sequence
  Description of Artificial Sequence: Synthetic polypeptide
FEEEIRTTNPVATEQYGDVSIDIMNGEDEEGGGF

SEQ ID NO: 147122 - protein, 35 aa, Artificial Sequence
  Description of Artificial Sequence: Synthetic polypeptide
FEEEIRTTNPVATEQYGDVSIDIMNGEDGGEGNVS

SEQ ID NO: 147123 - protein, 30 aa, Artificial Sequence
  Description of Artificial Sequence: Synthetic polypeptide
QEQEIAPTNPCSTEQYGIVSCNLESEGTDL

SEQ ID NO: 147124 - protein, 32 aa, Artificial Sequence
  Description of Artificial Sequence: Synthetic polypeptide
QEQEIATTNPVATEQYGDVAGPEVGQGEGEND

SEQ ID NO: 147125 - protein, 35 aa, Artificial Sequence
  Description of Artificial Sequence: Synthetic polypeptide
FEEEIRTTNPVATEQYGDVSSINGLNGEGGGEGQG

SEQ ID NO: 147126 - protein, 35 aa, Artificial Sequence
  Description of Artificial Sequence: Synthetic polypeptide
DEEEIRTTNPVATEQYGSITHTVLEDHNDEGDEQG

SEQ ID NO: 147127 - protein, 36 aa, Artificial Sequence
  Description of Artificial Sequence: Synthetic polypeptide
FEEEIRTTNPVATEQYGDVSVDGMTNQRNDDIIGEG

SEQ ID NO: 147128 - protein, 34 aa, Artificial Sequence
  Description of Artificial Sequence: Synthetic polypeptide
FEEEIRTTNPVATEFYGSVNLETLGFGNGGENIG

SEQ ID NO: 147129 - protein, 34 aa, Artificial Sequence
  Description of Artificial Sequence: Synthetic polypeptide
FEEEIRTTNPVATEFYGSVNLETLGFGNGGEEQT

SEQ ID NO: 147130 - protein, 35 aa, Artificial Sequence
  Description of Artificial Sequence: Synthetic polypeptide
FEEEIRTTNPVATEFYGSVNDTIGQQEGQGTNIDN

SEQ ID NO: 147131 - protein, 35 aa, Artificial Sequence
  Description of Artificial Sequence: Synthetic polypeptide
FEEEIRTTNPVATEFYGSVDTGGGQGQGEEENGNL

SEQ ID NO: 147132 - protein, 36 aa, Artificial Sequence
  Description of Artificial Sequence: Synthetic polypeptide
FEEEIRTTNPVATEFYGSVDNTDNIEQPEGGGEGNN

SEQ ID NO: 147133 - protein, 30 aa, Artificial Sequence
  Description of Artificial Sequence: Synthetic polypeptide
QEQEIAPTNPCSTEQYGIVSCNLESEGEDL

SEQ ID NO: 147134 - protein, 34 aa, Artificial Sequence
  Description of Artificial Sequence: Synthetic polypeptide
FEEEIRTTNPVATDQYGVVNDNSIGQEGQGDQND

SEQ ID NO: 147135 - protein, 35 aa, Artificial Sequence
  Description of Artificial Sequence: Synthetic polypeptide
FEEEIRTTNPVATEQYGDVVNGFTGNQNEQGGGAV

SEQ ID NO: 147136 - protein, 36 aa, Artificial Sequence
  Description of Artificial Sequence: Synthetic polypeptide
FEEEIRTTNPAATEQYGSVSTPGFGNQTGGGGNGDE

SEQ ID NO: 147137 - protein, 32 aa, Artificial Sequence
  Description of Artificial Sequence: Synthetic polypeptide
FEEEIRTTNPAATEAYGSVPGDVANQGQGEEN

SEQ ID NO: 147138 - protein, 35 aa, Artificial Sequence
  Description of Artificial Sequence: Synthetic polypeptide
FEEEIRSTNPVATEQYGSVVSGGGQIGQGGGNTEQ

SEQ ID NO: 147139 - protein, 30 aa, Artificial Sequence
  Description of Artificial Sequence: Synthetic polypeptide
QENEIRTTNPVATEQWGEVSEIEMNHAEEA

SEQ ID NO: 147140 - protein, 35 aa, Artificial Sequence
  Description of Artificial Sequence: Synthetic polypeptide
EETEIATTNPVATENYGCVSTGNGLNDTERGGDER

SEQ ID NO: 147141 - protein, 29 aa, Artificial Sequence
  Description of Artificial Sequence: Synthetic peptide
QEQEIATTNPVAYECWGNVSECLQHESEE

SEQ ID NO: 147142 - protein, 33 aa, Artificial Sequence
  Description of Artificial Sequence: Synthetic polypeptide
DEECIRTTNPVAYEQYGCVCSWMEDQNFGSQQS

SEQ ID NO: 147143 - protein, 36 aa, Artificial Sequence
  Description of Artificial Sequence: Synthetic polypeptide
FEEEIRTTNPVATEQYGSVMSDFFGNQEDGIQGNFN

SEQ ID NO: 147144 - protein, 35 aa, Artificial Sequence
  Description of Artificial Sequence: Synthetic polypeptide
FEEEIRTTNPVATEQYGSVMSGMFSDEGNEGQGEG

SEQ ID NO: 147145 - protein, 35 aa, Artificial Sequence
  Description of Artificial Sequence: Synthetic polypeptide
FEEEIRTTNPVATEQYGSVMTGDEPGENQGGDEGD

SEQ ID NO: 147146 - protein, 36 aa, Artificial Sequence
  Description of Artificial Sequence: Synthetic polypeptide
EEEEIRTTNPVATEQYGVVSTTSNNNQQLQNATETG

SEQ ID NO: 147147 - protein, 31 aa, Artificial Sequence
  Description of Artificial Sequence: Synthetic polypeptide
QENEIRTTNPVSTEPYGTASMEDCQQQQGNH

SEQ ID NO: 147148 - protein, 31 aa, Artificial Sequence
  Description of Artificial Sequence: Synthetic polypeptide
QENEIRTTNPVSTEPYGTASMDIQQQHNGNH

SEQ ID NO: 147149 - protein, 36 aa, Artificial Sequence
  Description of Artificial Sequence: Synthetic polypeptide
EEEEIRTTNPVATEQYGVVSTTNQQQQQLQNATEQG

SEQ ID NO: 147150 - protein, 36 aa, Artificial Sequence
  Description of Artificial Sequence: Synthetic polypeptide
EEEEIRTTNPVATEQYGVVSTTVNNQQQLQNTTETG

SEQ ID NO: 147151 - protein, 35 aa, Artificial Sequence
  Description of Artificial Sequence: Synthetic polypeptide
FEEEIRTTNPVATEQYGSVNGVGGQGQTNEGNGGD

SEQ ID NO: 147152 - protein, 28 aa, Artificial Sequence
  Description of Artificial Sequence: Synthetic peptide
QESEIACTNPVGTEGYGEMAETLQHGDI

SEQ ID NO: 147153 - protein, 36 aa, Artificial Sequence
  Description of Artificial Sequence: Synthetic polypeptide
EEEEIRTTNPVATEQYGVVSTTNQQQNNQQGTEDTI

SEQ ID NO: 147154 - protein, 37 aa, Artificial Sequence
  Description of Artificial Sequence: Synthetic polypeptide
EEEEIRTTNPVATEQYGVVSTTNNQQQGNLQNATEEG

SEQ ID NO: 147155 - protein, 36 aa, Artificial Sequence
  Description of Artificial Sequence: Synthetic polypeptide
EEEEIRTTNPVATEQYGVVSTTNNQQNQQQGEEDEE

SEQ ID NO: 147156 - protein, 31 aa, Artificial Sequence
  Description of Artificial Sequence: Synthetic polypeptide
QENEIRTTNPVSTEPYGIISMDIQQQSNGNH

SEQ ID NO: 147157 - protein, 37 aa, Artificial Sequence
  Description of Artificial Sequence: Synthetic polypeptide
EEEEIRTTNPVATEQYGVVSTTNNQQNQNQNGTNQEE

SEQ ID NO: 147158 - protein, 36 aa, Artificial Sequence
  Description of Artificial Sequence: Synthetic polypeptide
FEEEIRTTNPVATEQYGSVNIQNNQDQQEEGDGNGQ

SEQ ID NO: 147159 - protein, 31 aa, Artificial Sequence
  Description of Artificial Sequence: Synthetic polypeptide
QENEIRTTNPVSTEGYGTISMEDIQQQQGNH

SEQ ID NO: 147160 - protein, 29 aa, Artificial Sequence
  Description of Artificial Sequence: Synthetic peptide
QESEIACTNPVGTEGWGVSASTLQTGGDI

SEQ ID NO: 147161 - protein, 37 aa, Artificial Sequence
  Description of Artificial Sequence: Synthetic polypeptide
EEEEIRTTNPVATEQYGVVSTVNNQQGNQQGGNNDDE

SEQ ID NO: 147162 - protein, 37 aa, Artificial Sequence
  Description of Artificial Sequence: Synthetic polypeptide
EEEEIRTTNPVATEQYGVVSTVNNQQNQQQIGTNQEE

SEQ ID NO: 147163 - protein, 34 aa, Artificial Sequence
  Description of Artificial Sequence: Synthetic polypeptide
DEEEIRTTNPVATEQYGSISDPVGLIETMVQTQD

SEQ ID NO: 147164 - protein, 31 aa, Artificial Sequence
  Description of Artificial Sequence: Synthetic polypeptide
QENEIRTTNPVSTEPYGTISMEDIQQQQGNH

SEQ ID NO: 147165 - protein, 32 aa, Artificial Sequence
  Description of Artificial Sequence: Synthetic polypeptide
DEECIRTTNPVAYEQYGCVLTIPVETRIQEGI

SEQ ID NO: 147166 - protein, 36 aa, Artificial Sequence
  Description of Artificial Sequence: Synthetic polypeptide
FEEEIRTTNPVATEQYGSVMGTDNFGGQGNDGEGEF

SEQ ID NO: 147167 - protein, 38 aa, Artificial Sequence
  Description of Artificial Sequence: Synthetic polypeptide
EEEEIRTTNPVATEQYGVVVTVSTTNLNLQQGNQNGTE

SEQ ID NO: 147168 - protein, 31 aa, Artificial Sequence
  Description of Artificial Sequence: Synthetic polypeptide
QENEIRTTNPVSTEPYGTISMEDCQQQQGNH

SEQ ID NO: 147169 - protein, 37 aa, Artificial Sequence
  Description of Artificial Sequence: Synthetic polypeptide
EEEEIRTTNPVATEQYGVVTVVVTNLQNQNGNQNAED

SEQ ID NO: 147170 - protein, 34 aa, Artificial Sequence
  Description of Artificial Sequence: Synthetic polypeptide
DEECIRTTNPVAYEQYGCVCSWMNPQENFGSQQS

SEQ ID NO: 147171 - protein, 36 aa, Artificial Sequence
  Description of Artificial Sequence: Synthetic polypeptide
FEEEIRTTNPVATEQYGSVMGTDNSGQTTQGEGEEQ

SEQ ID NO: 147172 - protein, 37 aa, Artificial Sequence
  Description of Artificial Sequence: Synthetic polypeptide
DEEEIRTTNPVATEQYGSISDYSDNIWQLEDSNEDRG

SEQ ID NO: 147173 - protein, 36 aa, Artificial Sequence
  Description of Artificial Sequence: Synthetic polypeptide
EEEEIRTTNPVATEQYGVVSTVVTNQQQLQEATEQG

SEQ ID NO: 147174 - protein, 36 aa, Artificial Sequence
  Description of Artificial Sequence: Synthetic polypeptide
FEEEIRTTNPVATEQYGSVMGTFNGDGNQDEGDTQG

SEQ ID NO: 147175 - protein, 36 aa, Artificial Sequence
  Description of Artificial Sequence: Synthetic polypeptide
EEEEIRTTNPVATEQYGVVSTVVNNQQQLQQSTEGG

SEQ ID NO: 147176 - protein, 36 aa, Artificial Sequence
  Description of Artificial Sequence: Synthetic polypeptide
EEEEIRTTNPVATEQYGVVSTVVNNQQQLNQATEEN

SEQ ID NO: 147177 - protein, 36 aa, Artificial Sequence
  Description of Artificial Sequence: Synthetic polypeptide
FEEEIRTTNPVATEQYGSVMGTMNGGQTNDGEGGTQ

SEQ ID NO: 147178 - protein, 37 aa, Artificial Sequence
  Description of Artificial Sequence: Synthetic polypeptide
FEEEIRTTNPVATEQYGSVMGTMNQQDQNGENGGGQG

SEQ ID NO: 147179 - protein, 37 aa, Artificial Sequence
  Description of Artificial Sequence: Synthetic polypeptide
EEEEIRTTNPVATEQYGVVSTVVNNQQGNLQEATEQG

SEQ ID NO: 147180 - protein, 37 aa, Artificial Sequence
  Description of Artificial Sequence: Synthetic polypeptide
EEEEIRTTNPVATEQYGVVSTVTNNQQLQLQNATEEG

SEQ ID NO: 147181 - protein, 36 aa, Artificial Sequence
  Description of Artificial Sequence: Synthetic polypeptide
EEEEIRTTNPVATEQYGVVSTVNQQQNQEQGTEDEE

SEQ ID NO: 147182 - protein, 31 aa, Artificial Sequence
  Description of Artificial Sequence: Synthetic polypeptide
QENEIRTTNPVSTEPYGTISMCLQQQHNGEH

SEQ ID NO: 147183 - protein, 31 aa, Artificial Sequence
  Description of Artificial Sequence: Synthetic polypeptide
QENEIRTTNPVSTECYGTVSEECIQQHNENH

SEQ ID NO: 147184 - protein, 35 aa, Artificial Sequence
  Description of Artificial Sequence: Synthetic polypeptide
EEEEIRTTNPVATESYGSVSNPVAEEIHARVGFQR

SEQ ID NO: 147185 - protein, 34 aa, Artificial Sequence
  Description of Artificial Sequence: Synthetic polypeptide
FEEEIRTTNPVATEQYGSVNMIPDQGNEEGQGEN

SEQ ID NO: 147186 - protein, 36 aa, Artificial Sequence
  Description of Artificial Sequence: Synthetic polypeptide
EEEEIRTTNPVATEQYGVVSTTNNNQQQLQNATEEG

SEQ ID NO: 147187 - protein, 37 aa, Artificial Sequence
  Description of Artificial Sequence: Synthetic polypeptide
EEEEIRTTNPVATEQYGVVATTNQQLQQGNNNDEQGD

SEQ ID NO: 147188 - protein, 37 aa, Artificial Sequence
  Description of Artificial Sequence: Synthetic polypeptide
EEEEIRTTNPVATEQYGVVATNQQQLQQGNNNDEQGS

SEQ ID NO: 147189 - protein, 36 aa, Artificial Sequence
  Description of Artificial Sequence: Synthetic polypeptide
FEEEIRTTNPVATEQYGSVNSVDQNEMQENGGEGQT

SEQ ID NO: 147190 - protein, 36 aa, Artificial Sequence
  Description of Artificial Sequence: Synthetic polypeptide
DEEEIRTTNPVATEQYGSMGVGVGNLEDNDLEIGIT

SEQ ID NO: 147191 - protein, 36 aa, Artificial Sequence
  Description of Artificial Sequence: Synthetic polypeptide
EEEEIRTTNPVATEQYGSVYTTQQLQQANNVAEEGN

SEQ ID NO: 147192 - protein, 37 aa, Artificial Sequence
  Description of Artificial Sequence: Synthetic polypeptide
FEEEIRTTNPVATEQYGSVNTQNMNQDQQNEGDENGD

SEQ ID NO: 147193 - protein, 36 aa, Artificial Sequence
  Description of Artificial Sequence: Synthetic polypeptide
FEEEIRTTNPVATEQYGSVNWTSLDTEQEDVNVDSM

SEQ ID NO: 147194 - protein, 36 aa, Artificial Sequence
  Description of Artificial Sequence: Synthetic polypeptide
FEEEIRTTNPVATEQYGSVPIPAITQMILQPQNVNE

SEQ ID NO: 147195 - protein, 37 aa, Artificial Sequence
  Description of Artificial Sequence: Synthetic polypeptide
EEEEIRTTNPVATEQYGVVATTNQQLQQGTNVTEQGS

SEQ ID NO: 147196 - protein, 37 aa, Artificial Sequence
  Description of Artificial Sequence: Synthetic polypeptide
EEEEIRTTNPVATEQYGSVYSEAPNLEIQVNEQGQPA

SEQ ID NO: 147197 - protein, 28 aa, Artificial Sequence
  Description of Artificial Sequence: Synthetic peptide
QESEIAPTNPCSSEGYGVMACNLQHGTR

SEQ ID NO: 147198 - protein, 28 aa, Artificial Sequence
  Description of Artificial Sequence: Synthetic peptide
QESEIAPTNPCSSEGYGVMACNLQSGTR

SEQ ID NO: 147199 - protein, 30 aa, Artificial Sequence
  Description of Artificial Sequence: Synthetic polypeptide
QENEIRTTNPVATEQWGEVSEVEMNAAEEA

SEQ ID NO: 147200 - protein, 30 aa, Artificial Sequence
  Description of Artificial Sequence: Synthetic polypeptide
QENEIRTTNPVATEQWGEVSEVEMNAAEDA

SEQ ID NO: 147201 - protein, 29 aa, Artificial Sequence
  Description of Artificial Sequence: Synthetic peptide
QESEIAPTNPCSSEQWGIVSCNEQDSGTR

SEQ ID NO: 147202 - protein, 30 aa, Artificial Sequence
  Description of Artificial Sequence: Synthetic polypeptide
QESEIAPTNPCSSEQWGSVSCNEPQDSGTR

SEQ ID NO: 147203 - protein, 36 aa, Artificial Sequence
  Description of Artificial Sequence: Synthetic polypeptide
FEEEIRTTNPVATEQYGSVQSAPLMEQQEAPNFNQE

SEQ ID NO: 147204 - protein, 31 aa, Artificial Sequence
  Description of Artificial Sequence: Synthetic polypeptide
QESEIAPTNPCSSEQWGSVSCNLPQSEGETR

SEQ ID NO: 147205 - protein, 35 aa, Artificial Sequence
  Description of Artificial Sequence: Synthetic polypeptide
QENEIRTTNPVATEQYGDVSSTPAGPQMRNGMEPL

SEQ ID NO: 147206 - protein, 37 aa, Artificial Sequence
  Description of Artificial Sequence: Synthetic polypeptide
EEEEIRTTNPVATEQYGVVATVTNLQQGTEQGTNQDD

SEQ ID NO: 147207 - protein, 37 aa, Artificial Sequence
  Description of Artificial Sequence: Synthetic polypeptide
EEEEIRTTNPVATEQYGVVSSTELQAGTEQGSTNQDD

SEQ ID NO: 147208 - protein, 36 aa, Artificial Sequence
  Description of Artificial Sequence: Synthetic polypeptide
QENEIRTTNPVATEQYGSVSSTTPAGPNMRNGMNPL

SEQ ID NO: 147209 - protein, 35 aa, Artificial Sequence
  Description of Artificial Sequence: Synthetic polypeptide
FEEEIRTTNPVATEQYGSVNMQNNDQEEEQDENGD

SEQ ID NO: 147210 - protein, 35 aa, Artificial Sequence
  Description of Artificial Sequence: Synthetic polypeptide
FEEEIRTTNPVATEQYGSVNMTGTTDGQQGGQGEG

SEQ ID NO: 147211 - protein, 30 aa, Artificial Sequence
  Description of Artificial Sequence: Synthetic polypeptide
QENEIRTTNPVSSEPYGTISCDIQQQNGNH

SEQ ID NO: 147212 - protein, 36 aa, Artificial Sequence
  Description of Artificial Sequence: Synthetic polypeptide
DEEEIRTTNPVATEQYGSVSEYSEYTIEHALSNFET

SEQ ID NO: 147213 - protein, 29 aa, Artificial Sequence
  Description of Artificial Sequence: Synthetic peptide
QESEIACTNPVGTEGYGVMASTLQHGDDI

SEQ ID NO: 147214 - protein, 35 aa, Artificial Sequence
  Description of Artificial Sequence: Synthetic polypeptide
FEEEIRTTNPVATEQYGSVNMTQGTQGQQEGQGEG

SEQ ID NO: 147215 - protein, 35 aa, Artificial Sequence
  Description of Artificial Sequence: Synthetic polypeptide
DEEEIRTTNPVATEQYGSIPLMVPTNTNDNEPETV

SEQ ID NO: 147216 - protein, 28 aa, Artificial Sequence
  Description of Artificial Sequence: Synthetic peptide
QESEIACTNPVGTEGYGVMASTRQHGDI

SEQ ID NO: 147217 - protein, 29 aa, Artificial Sequence
  Description of Artificial Sequence: Synthetic peptide
QESEIACTNPVGTEGYGVTASTLQGGDIA

SEQ ID NO: 147218 - protein, 37 aa, Artificial Sequence
  Description of Artificial Sequence: Synthetic polypeptide
AEEEIRTTNPVATEQYGSVSTVVNGGNNNEEGNNESD

SEQ ID NO: 147219 - protein, 28 aa, Artificial Sequence
  Description of Artificial Sequence: Synthetic peptide
QESEIAGTNPVGTEGYGVMASTLKHGDI

SEQ ID NO: 147220 - protein, 36 aa, Artificial Sequence
  Description of Artificial Sequence: Synthetic polypeptide
DEEEIRTTNPVATEQYGSMCTTPSWNSDNFLMVGME

SEQ ID NO: 147221 - protein, 28 aa, Artificial Sequence
  Description of Artificial Sequence: Synthetic peptide
QESEIAPTNPCGSEQYGIVACTLQHGDI

SEQ ID NO: 147222 - protein, 28 aa, Artificial Sequence
  Description of Artificial Sequence: Synthetic peptide
QESEIAPTNPCGSEQYGVVACTLQHGDI

SEQ ID NO: 147223 - protein, 36 aa, Artificial Sequence
  Description of Artificial Sequence: Synthetic polypeptide
DEEEIRTTNPVATEQYGSMGVGNMNETVNQEGGGQG

SEQ ID NO: 147224 - protein, 36 aa, Artificial Sequence
  Description of Artificial Sequence: Synthetic polypeptide
FEEEIRTTNPVATEQYGSVNQTTMNNGQGEGEEGTD

SEQ ID NO: 147225 - protein, 37 aa, Artificial Sequence
  Description of Artificial Sequence: Synthetic polypeptide
EEEEIRTTNPVATEQYGVVSSTNLQAGTEQGSTQTDD

SEQ ID NO: 147226 - protein, 36 aa, Artificial Sequence
  Description of Artificial Sequence: Synthetic polypeptide
FEEEIRTTNPVATEQYGSVNSDGEGQENEQGEAGGN

SEQ ID NO: 147227 - protein, 35 aa, Artificial Sequence
  Description of Artificial Sequence: Synthetic polypeptide
FEEEIRTTNPVATEQYGSVNSDGSGQENDQLEAGG

SEQ ID NO: 147228 - protein, 36 aa, Artificial Sequence
  Description of Artificial Sequence: Synthetic polypeptide
DEEEIRTTNPVATEQYGSIQEWPNTQLADRDVELRQ

SEQ ID NO: 147229 - protein, 28 aa, Artificial Sequence
  Description of Artificial Sequence: Synthetic peptide
QESEIAATNPVSTEGYGVMASLLQHGDI

SEQ ID NO: 147230 - protein, 28 aa, Artificial Sequence
  Description of Artificial Sequence: Synthetic peptide
QESEIAATNPVGTEGYGVMAYTLQHGDI

SEQ ID NO: 147231 - protein, 36 aa, Artificial Sequence
  Description of Artificial Sequence: Synthetic polypeptide
DEEEIRTTNPVATEQYGSVSEVPVDMQEEHVPVNNE

SEQ ID NO: 147232 - protein, 32 aa, Artificial Sequence
  Description of Artificial Sequence: Synthetic polypeptide
EENEIRTTNPVATDQYGSVNIMQQVHQLANSD

SEQ ID NO: 147233 - protein, 29 aa, Artificial Sequence
  Description of Artificial Sequence: Synthetic peptide
EENEIATTNPVAYEPWGEVSECLQHEHEG

SEQ ID NO: 147234 - protein, 32 aa, Artificial Sequence
  Description of Artificial Sequence: Synthetic polypeptide
QEQEIATTNPVGTEQYGSMAATDLQDHEGEDL

SEQ ID NO: 147235 - protein, 37 aa, Artificial Sequence
  Description of Artificial Sequence: Synthetic polypeptide
FEEEIRTTNPVATEQYGSVHTNENVEETQRMNVEVMY

SEQ ID NO: 147236 - protein, 29 aa, Artificial Sequence
  Description of Artificial Sequence: Synthetic peptide
EENEIATTNPVAYEPWGDVSECLQHESEE

SEQ ID NO: 147237 - protein, 36 aa, Artificial Sequence
  Description of Artificial Sequence: Synthetic polypeptide
FEEEIRTTNPVATEQYGSVIDDMNNGQGEEGQNQQT

SEQ ID NO: 147238 - protein, 29 aa, Artificial Sequence
  Description of Artificial Sequence: Synthetic peptide
EENEIATTNPVAYECWGVVSECLQHMEET

SEQ ID NO: 147239 - protein, 28 aa, Artificial Sequence
  Description of Artificial Sequence: Synthetic peptide
EENEIATTNPVAYECWGVVAECLQHEES

SEQ ID NO: 147240 - protein, 34 aa, Artificial Sequence
  Description of Artificial Sequence: Synthetic polypeptide
EENEIRTTNPVATDQYGSVNTMQQYGVQQANSDH

SEQ ID NO: 147241 - protein, 30 aa, Artificial Sequence
  Description of Artificial Sequence: Synthetic polypeptide
EENEIATTNPVAYECWGCVSECLQHMNETA

SEQ ID NO: 147242 - protein, 28 aa, Artificial Sequence
  Description of Artificial Sequence: Synthetic peptide
EENEIATTNPVAYECWGCVAEMLQHEEA

SEQ ID NO: 147243 - protein, 36 aa, Artificial Sequence
  Description of Artificial Sequence: Synthetic polypeptide
FEEEIRTTNPVATEQYGSVIDQDNNVGQEAGEGGNE

SEQ ID NO: 147244 - protein, 36 aa, Artificial Sequence
  Description of Artificial Sequence: Synthetic polypeptide
FEEEIRTTNPVATEQYGSVIFPPNMELQEMPQFNTE

SEQ ID NO: 147245 - protein, 32 aa, Artificial Sequence
  Description of Artificial Sequence: Synthetic polypeptide
QEQEIATTNPVSTEQYGSVSACDLEDSEGEDL

SEQ ID NO: 147246 - protein, 37 aa, Artificial Sequence
  Description of Artificial Sequence: Synthetic polypeptide
DEEEIRTTNPVATEQYGSVSETNCTNPENNDNELSVI

SEQ ID NO: 147247 - protein, 33 aa, Artificial Sequence
  Description of Artificial Sequence: Synthetic polypeptide
EEMEIVTTNPVATEQYGTVCSATDGPVEFEGND

SEQ ID NO: 147248 - protein, 34 aa, Artificial Sequence
  Description of Artificial Sequence: Synthetic polypeptide
EEMEIRTTNPVATEPYGSVCHKQMLLTRGGQNEA

SEQ ID NO: 147249 - protein, 36 aa, Artificial Sequence
  Description of Artificial Sequence: Synthetic polypeptide
DEEEIRTTNPVATEQYGSISNTSLLEQQIVTVVEEL

SEQ ID NO: 147250 - protein, 29 aa, Artificial Sequence
  Description of Artificial Sequence: Synthetic peptide
EENEIATTNPVAYECWGCVSECLQHEETH

SEQ ID NO: 147251 - protein, 30 aa, Artificial Sequence
  Description of Artificial Sequence: Synthetic polypeptide
EENEIRTTNPVATEQWGDVSEIEMDAAEDA

SEQ ID NO: 147252 - protein, 30 aa, Artificial Sequence
  Description of Artificial Sequence: Synthetic polypeptide
EENEIRTTNPVATEQWGDVSEIEMNAAEDA

SEQ ID NO: 147253 - protein, 31 aa, Artificial Sequence
  Description of Artificial Sequence: Synthetic polypeptide
EENEIRTTNPVATEQWGDVSEIEMNAAEDIA

SEQ ID NO: 147254 - protein, 29 aa, Artificial Sequence
  Description of Artificial Sequence: Synthetic peptide
QENEVASTNPVSTECYGNVSNTLQSREQL

SEQ ID NO: 147255 - protein, 33 aa, Artificial Sequence
  Description of Artificial Sequence: Synthetic polypeptide
EESEIRTTNPVAYEQWGSVAWNDNSGQQDDGSR

SEQ ID NO: 147256 - protein, 34 aa, Artificial Sequence
  Description of Artificial Sequence: Synthetic polypeptide
FEEEIRTTNPVATEQYGSVESQVHSMVSVMGVAN

SEQ ID NO: 147257 - protein, 30 aa, Artificial Sequence
  Description of Artificial Sequence: Synthetic polypeptide
QEQEIATTNPVGTEGYGVMASTLQHEGEDI

SEQ ID NO: 147258 - protein, 35 aa, Artificial Sequence
  Description of Artificial Sequence: Synthetic polypeptide
DEEEIRTTNPVATEQYGSVSELEPQIQQTETLLLL

SEQ ID NO: 147259 - protein, 33 aa, Artificial Sequence
  Description of Artificial Sequence: Synthetic polypeptide
EESEIRTTNPVATECWGSVSCINEPQDREFLGG

SEQ ID NO: 147260 - protein, 28 aa, Artificial Sequence
  Description of Artificial Sequence: Synthetic peptide
EESEIASTNPVGYEGYGVMASTLQHGDI

SEQ ID NO: 147261 - protein, 28 aa, Artificial Sequence
  Description of Artificial Sequence: Synthetic peptide
EESEIASTNPVGTEGYGVMASTLQHIDI

SEQ ID NO: 147262 - protein, 35 aa, Artificial Sequence
  Description of Artificial Sequence: Synthetic polypeptide
FEEEIRTTNPVATEQYGSVGAGVNDDQGQGEFTEI

SEQ ID NO: 147263 - protein, 30 aa, Artificial Sequence
  Description of Artificial Sequence: Synthetic polypeptide
QEQEIATTNPVGTEGYGVMSATTLEHGEDI

SEQ ID NO: 147264 - protein, 31 aa, Artificial Sequence
  Description of Artificial Sequence: Synthetic polypeptide
EESEIACTNPVAYEGYGEASCENLSQRVGGD

SEQ ID NO: 147265 - protein, 33 aa, Artificial Sequence
  Description of Artificial Sequence: Synthetic polypeptide
EESCIRTTNPVATEFWGSWATNNLQLYDGNDQG

SEQ ID NO: 147266 - protein, 34 aa, Artificial Sequence
  Description of Artificial Sequence: Synthetic polypeptide
FEEEIRTTNPVATEQYGSVGDDGQGNDGEMGGAG

SEQ ID NO: 147267 - protein, 34 aa, Artificial Sequence
  Description of Artificial Sequence: Synthetic polypeptide
FEEEIRTTNPVATEQYGSVGDFGQGNDDEGGAGT

SEQ ID NO: 147268 - protein, 36 aa, Artificial Sequence
  Description of Artificial Sequence: Synthetic polypeptide
DEEEIRTTNPVATEQYGSVSELEPEDEPMRMIVNEY

SEQ ID NO: 147269 - protein, 30 aa, Artificial Sequence
  Description of Artificial Sequence: Synthetic polypeptide
QENEVASTNPVATECYGDVAECLQSHVGQR

SEQ ID NO: 147270 - protein, 30 aa, Artificial Sequence
  Description of Artificial Sequence: Synthetic polypeptide
QEQEIATTNPVGTEGYGVVSSTLEHEGEDL

SEQ ID NO: 147271 - protein, 32 aa, Artificial Sequence
  Description of Artificial Sequence: Synthetic polypeptide
EENEIRTTNPVSTEPYGTISMEDIQQQQRGNH

SEQ ID NO: 147272 - protein, 30 aa, Artificial Sequence
  Description of Artificial Sequence: Synthetic polypeptide
EENEIRTTNPVATEQWGDVSEIEMNHAEDA

SEQ ID NO: 147273 - protein, 34 aa, Artificial Sequence
  Description of Artificial Sequence: Synthetic polypeptide
EEGEIRTTNPVATEQYGSVSMENDHTQELFEDGD

SEQ ID NO: 147274 - protein, 36 aa, Artificial Sequence
  Description of Artificial Sequence: Synthetic polypeptide
EEGEIRTTNPVATEQYGSVMPTTNLHVIEGSNEDVA

SEQ ID NO: 147275 - protein, 38 aa, Artificial Sequence
  Description of Artificial Sequence: Synthetic polypeptide
AEEEIRTTNPVATEQYGSVSTVVNLGNAANEQGTNNVE

SEQ ID NO: 147276 - protein, 36 aa, Artificial Sequence
  Description of Artificial Sequence: Synthetic polypeptide
DEECIRTTNPVSTERYGCTVSQTNEQSDYRVGGYRF

SEQ ID NO: 147277 - protein, 28 aa, Artificial Sequence
  Description of Artificial Sequence: Synthetic peptide
QESCIASTNPVGTEGYGVMASTLQHGDI

SEQ ID NO: 147278 - protein, 36 aa, Artificial Sequence
  Description of Artificial Sequence: Synthetic polypeptide
FEEEIRTTNPVATEQYGSVISPPNMELQEIPQEDTE

SEQ ID NO: 147279 - protein, 34 aa, Artificial Sequence
  Description of Artificial Sequence: Synthetic polypeptide
DEECISTTNPVATEQYGCVCSNTGEHQHFGSDQI

SEQ ID NO: 147280 - protein, 37 aa, Artificial Sequence
  Description of Artificial Sequence: Synthetic polypeptide
EEESIRTTNPVAYEQYGQSVNSNTNDLLQPRGSIEKH

SEQ ID NO: 147281 - protein, 35 aa, Artificial Sequence
  Description of Artificial Sequence: Synthetic polypeptide
DEEEIRTTNPVATEQYGSVSEEFVSSNVINASQVS

SEQ ID NO: 147282 - protein, 28 aa, Artificial Sequence
  Description of Artificial Sequence: Synthetic peptide
QESDIASTNPVGTEGYGVMASTLQDGDI

SEQ ID NO: 147283 - protein, 28 aa, Artificial Sequence
  Description of Artificial Sequence: Synthetic peptide
QESDIASTNPVGTEGYGVMASTLQHGDI

SEQ ID NO: 147284 - protein, 37 aa, Artificial Sequence
  Description of Artificial Sequence: Synthetic polypeptide
FEEEIRTTNPVATEQYGSVISTNGVNEGQNVEGQSGD

SEQ ID NO: 147285 - protein, 28 aa, Artificial Sequence
  Description of Artificial Sequence: Synthetic peptide
QESEIAATNPVGTEGYGVMAATLQHGDI

SEQ ID NO: 147286 - protein, 29 aa, Artificial Sequence
  Description of Artificial Sequence: Synthetic peptide
QESEIAATNPVGTEGYGVMASEPLQHGDI

SEQ ID NO: 147287 - protein, 35 aa, Artificial Sequence
  Description of Artificial Sequence: Synthetic polypeptide
EEEEIRTTNPVAVEQYGSVPTNKHSSETPMGSDRN

SEQ ID NO: 147288 - protein, 37 aa, Artificial Sequence
  Description of Artificial Sequence: Synthetic polypeptide
FEEEIRTTNPVATEQYGSVISTTMNNGQGEDGEEGTD

SEQ ID NO: 147289 - protein, 28 aa, Artificial Sequence
  Description of Artificial Sequence: Synthetic peptide
QESEIAATNPVGTEGYGVMASTLQHNDI

SEQ ID NO: 147290 - protein, 31 aa, Artificial Sequence
  Description of Artificial Sequence: Synthetic polypeptide
QENEIRTTNPVSTEPYGVIAMETLQQQNGNH

SEQ ID NO: 147291 - protein, 36 aa, Artificial Sequence
  Description of Artificial Sequence: Synthetic polypeptide
FEEEIRTTNPVATEQYGSVIVDDTMDGIGQSGTNGD

SEQ ID NO: 147292 - protein, 31 aa, Artificial Sequence
  Description of Artificial Sequence: Synthetic polypeptide
QENEIRTTNPVSTEPYGTVSMEDIQQQQGEH

SEQ ID NO: 147293 - protein, 36 aa, Artificial Sequence
  Description of Artificial Sequence: Synthetic polypeptide
FEEEIRTTNPVATEQYGSVMGEVNQEQGGGNQDDQA

SEQ ID NO: 147294 - protein, 31 aa, Artificial Sequence
  Description of Artificial Sequence: Synthetic polypeptide
QENEIRTTNPVSTEPYGTISMEDLQQQNGEH

SEQ ID NO: 147295 - protein, 36 aa, Artificial Sequence
  Description of Artificial Sequence: Synthetic polypeptide
FEEEIRTTNPVATEQYGSVMGNVGQQGQTNEGEGGD

SEQ ID NO: 147296 - protein, 28 aa, Artificial Sequence
  Description of Artificial Sequence: Synthetic peptide
QESAIASTNPVGTEGYGWMASTLQHGDI

SEQ ID NO: 147297 - protein, 36 aa, Artificial Sequence
  Description of Artificial Sequence: Synthetic polypeptide
EESVIRTTNPVATEQYGSVPSITNEQSFYPGGDNEI

SEQ ID NO: 147298 - protein, 36 aa, Artificial Sequence
  Description of Artificial Sequence: Synthetic polypeptide
EEETICTTNPVATEQYGSVSTNNNNNDQLQGTNQQD

SEQ ID NO: 147299 - protein, 28 aa, Artificial Sequence
  Description of Artificial Sequence: Synthetic peptide
QESAIASTNPVGTEGYGVMASTLQHGDI

SEQ ID NO: 147300 - protein, 34 aa, Artificial Sequence
  Description of Artificial Sequence: Synthetic polypeptide
FEEEIRTTNPVATEQYGSVINMGPDQNIEGQGEN

SEQ ID NO: 147301 - protein, 37 aa, Artificial Sequence
  Description of Artificial Sequence: Synthetic polypeptide
EEETICTTNPVATEQYGSVSTVVNTGNQLQQGTNQED

SEQ ID NO: 147302 - protein, 36 aa, Artificial Sequence
  Description of Artificial Sequence: Synthetic polypeptide
FEEEIRTTNPVATEQYGSVISCPLISQENSGEEQAQ

SEQ ID NO: 147303 - protein, 34 aa, Artificial Sequence
  Description of Artificial Sequence: Synthetic polypeptide
DEEEIRTTNPVATEQYGSVSEEVFDISTIIEEPS

SEQ ID NO: 147304 - protein, 37 aa, Artificial Sequence
  Description of Artificial Sequence: Synthetic polypeptide
EEETICTTNPVATEQYGSVSTVTTNGNQLQQGTNQDD

SEQ ID NO: 147305 - protein, 36 aa, Artificial Sequence
  Description of Artificial Sequence: Synthetic polypeptide
FEEEIRTTNPVATEQYGSVISIMNFNGQEGGDGEGG

SEQ ID NO: 147306 - protein, 37 aa, Artificial Sequence
  Description of Artificial Sequence: Synthetic polypeptide
EEETICTTNPVATEQYGSVSTVNNTNNQLQQGTNQSD

SEQ ID NO: 147307 - protein, 36 aa, Artificial Sequence
  Description of Artificial Sequence: Synthetic polypeptide
DEEEIRTTNPVATEQYGSVSEEVEVMVSTPDPVGVV

SEQ ID NO: 147308 - protein, 37 aa, Artificial Sequence
  Description of Artificial Sequence: Synthetic polypeptide
EEETICTTNPVATEQYGSVSTVNNQNNQLQQGNNQED

SEQ ID NO: 147309 - protein, 32 aa, Artificial Sequence
  Description of Artificial Sequence: Synthetic polypeptide
QEQEIRTTNPVATEQYGCYAPYALQPEGQFVQ

SEQ ID NO: 147310 - protein, 37 aa, Artificial Sequence
  Description of Artificial Sequence: Synthetic polypeptide
AEEEIRTTNPVATEQYGSVSTVVNIGNNNDEEGNESD

SEQ ID NO: 147311 - protein, 30 aa, Artificial Sequence
  Description of Artificial Sequence: Synthetic polypeptide
QEREIACTNPCSYEQYGCVSANLQSFGSDQ

SEQ ID NO: 147312 - protein, 36 aa, Artificial Sequence
  Description of Artificial Sequence: Synthetic polypeptide
EEETICTTNPVATEQYGSVSTNTNNDTNLQGTNNSD

SEQ ID NO: 147313 - protein, 37 aa, Artificial Sequence
  Description of Artificial Sequence: Synthetic polypeptide
FEEEIRTTNPVATEQYGSVISITMNGNGQDQEGIGGG

SEQ ID NO: 147314 - protein, 30 aa, Artificial Sequence
  Description of Artificial Sequence: Synthetic polypeptide
QEREIACTNPCSYEQYGCVSWNLQSGSETQ

SEQ ID NO: 147315 - protein, 36 aa, Artificial Sequence
  Description of Artificial Sequence: Synthetic polypeptide
DEEEIRTTNPVATEQYGSVSEENPEDEAMRMIVDEY

SEQ ID NO: 147316 - protein, 36 aa, Artificial Sequence
  Description of Artificial Sequence: Synthetic polypeptide
FEEEIRTTNPVATEQYGSVISPPLMEQQEIPQFNTE

SEQ ID NO: 147317 - protein, 36 aa, Artificial Sequence
  Description of Artificial Sequence: Synthetic polypeptide
FEEEIRTTNPVATEQYGSVISPPNAEQLEIPQFNTE

SEQ ID NO: 147318 - protein, 36 aa, Artificial Sequence
  Description of Artificial Sequence: Synthetic polypeptide
EEETICTTNPVATEQYGSVSTNNNNNQQLQGTNQSD

SEQ ID NO: 147319 - protein, 36 aa, Artificial Sequence
  Description of Artificial Sequence: Synthetic polypeptide
EEETICTTNPVATEQYGSVSTNNNNNDQNLQGTNSD

SEQ ID NO: 147320 - protein, 32 aa, Artificial Sequence
  Description of Artificial Sequence: Synthetic polypeptide
DEEEIATTNPVCTECWGATTSNDEDLQSGNYI

SEQ ID NO: 147321 - protein, 32 aa, Artificial Sequence
  Description of Artificial Sequence: Synthetic polypeptide
EEAEIRTTNPVAYEQWGSVATMDRDNGGEGRE

SEQ ID NO: 147322 - protein, 37 aa, Artificial Sequence
  Description of Artificial Sequence: Synthetic polypeptide
DEEEIRTTNPVATEQYGSNVVTPNGNDADQVTNDQED

SEQ ID NO: 147323 - protein, 37 aa, Artificial Sequence
  Description of Artificial Sequence: Synthetic polypeptide
AEEEIRTTNPVATESYGSVSTVTNNQLGNEQGNDTGG

SEQ ID NO: 147324 - protein, 29 aa, Artificial Sequence
  Description of Artificial Sequence: Synthetic peptide
QESEIASTNPVGTEGYGVMASTLQHGDIN

SEQ ID NO: 147325 - protein, 29 aa, Artificial Sequence
  Description of Artificial Sequence: Synthetic peptide
QESEIASTNPVGTEGYGVMASTLQHGDIP

SEQ ID NO: 147326 - protein, 29 aa, Artificial Sequence
  Description of Artificial Sequence: Synthetic peptide
QESEIASTNPVGTEGYGVMASTLQHGDIQ

SEQ ID NO: 147327 - protein, 29 aa, Artificial Sequence
  Description of Artificial Sequence: Synthetic peptide
QENEIATTNPVATEQYGEAPEVCQNHEEK

SEQ ID NO: 147328 - protein, 29 aa, Artificial Sequence
  Description of Artificial Sequence: Synthetic peptide
QESEIASTNPVGTEGYGVMASTLQHGDIS

SEQ ID NO: 147329 - protein, 29 aa, Artificial Sequence
  Description of Artificial Sequence: Synthetic peptide
QESEIASTNPVGTEGYGVMASTLQHGDIT

SEQ ID NO: 147330 - protein, 29 aa, Artificial Sequence
  Description of Artificial Sequence: Synthetic peptide
QESEIASTNPVGTEGYGVMASTLQHGDIV

SEQ ID NO: 147331 - protein, 37 aa, Artificial Sequence
  Description of Artificial Sequence: Synthetic polypeptide
AEEEIRTTNPVATESYGSVSTVTNNQLGNEQGTDGDE

SEQ ID NO: 147332 - protein, 29 aa, Artificial Sequence
  Description of Artificial Sequence: Synthetic peptide
QESEIASTNPVGTEGYGVMASTLQHGDIW

SEQ ID NO: 147333 - protein, 29 aa, Artificial Sequence
  Description of Artificial Sequence: Synthetic peptide
QESEIASTNPVGTEGYGVMASTLQHGDKI

SEQ ID NO: 147334 - protein, 37 aa, Artificial Sequence
  Description of Artificial Sequence: Synthetic polypeptide
AEEEIRTTNPVATESYGSVSTVTNNQAGNQQGTDTGN

SEQ ID NO: 147335 - protein, 29 aa, Artificial Sequence
  Description of Artificial Sequence: Synthetic peptide
QESEIASTNPVGTEGYGVMASTLQHGDLI

SEQ ID NO: 147336 - protein, 29 aa, Artificial Sequence
  Description of Artificial Sequence: Synthetic peptide
QENEIATTNPVATEQYGEAPEVCQHEWEK

SEQ ID NO: 147337 - protein, 29 aa, Artificial Sequence
  Description of Artificial Sequence: Synthetic peptide
QESEIASTNPVGTEGYGVMASTLQHGDMI

SEQ ID NO: 147338 - protein, 37 aa, Artificial Sequence
  Description of Artificial Sequence: Synthetic polypeptide
AEEEIRTTNPVATESYGSVSTVTNNQAGNNQEGNDGG

SEQ ID NO: 147339 - protein, 29 aa, Artificial Sequence
  Description of Artificial Sequence: Synthetic peptide
QESEIASTNPVGTEGYGVMASTLQHGDPI

SEQ ID NO: 147340 - protein, 29 aa, Artificial Sequence
  Description of Artificial Sequence: Synthetic peptide
QENEIATTNPVATEQYGEAPEVCQHEREK

SEQ ID NO: 147341 - protein, 29 aa, Artificial Sequence
  Description of Artificial Sequence: Synthetic peptide
QESEIASTNPVGTEGYGVMASTLQHGDIY

SEQ ID NO: 147342 - protein, 37 aa, Artificial Sequence
  Description of Artificial Sequence: Synthetic polypeptide
AEEEIRTTNPVATESYGSVSTVTNNQLGNEQGTQGGG

SEQ ID NO: 147343 - protein, 29 aa, Artificial Sequence
  Description of Artificial Sequence: Synthetic peptide
QESEIASTNPVGTEGYGVMASTLQHGDIM

SEQ ID NO: 147344 - protein, 29 aa, Artificial Sequence
  Description of Artificial Sequence: Synthetic peptide
QESEIASTNPVGTEGYGVMASTLQHGDIL

SEQ ID NO: 147345 - protein, 29 aa, Artificial Sequence
  Description of Artificial Sequence: Synthetic peptide
HEAEIATTNPVATEQYGELPEVCQFHEEK

SEQ ID NO: 147346 - protein, 36 aa, Artificial Sequence
  Description of Artificial Sequence: Synthetic polypeptide
AEEEIRTTNPVATESYGSVSTVTSNNNVEEGTNDED

SEQ ID NO: 147347 - protein, 38 aa, Artificial Sequence
  Description of Artificial Sequence: Synthetic polypeptide
DEEEIRTTNPVATEQYGSSSSTTPALGPNMREGMNPVH

SEQ ID NO: 147348 - protein, 31 aa, Artificial Sequence
  Description of Artificial Sequence: Synthetic polypeptide
QENEIATTNPVATEQYGEASEEVIQQQQGEH

SEQ ID NO: 147349 - protein, 29 aa, Artificial Sequence
  Description of Artificial Sequence: Synthetic peptide
QESEIASTNPVGTEGYGVMASTLQHGDEI

SEQ ID NO: 147350 - protein, 29 aa, Artificial Sequence
  Description of Artificial Sequence: Synthetic peptide
QESEIASTNPVGTEGYGVMASTLQHGDFI

SEQ ID NO: 147351 - protein, 37 aa, Artificial Sequence
  Description of Artificial Sequence: Synthetic polypeptide
AEEEIRTTNPVATESYGSVSTVTNNQNGNEQGNDGGQ

SEQ ID NO: 147352 - protein, 29 aa, Artificial Sequence
  Description of Artificial Sequence: Synthetic peptide
QESEIASTNPVGTEGYGVMASTLQHGDGI

SEQ ID NO: 147353 - protein, 29 aa, Artificial Sequence
  Description of Artificial Sequence: Synthetic peptide
QESEIASTNPVGTEGYGVMASTLQHGDHA

SEQ ID NO: 147354 - protein, 29 aa, Artificial Sequence
  Description of Artificial Sequence: Synthetic peptide
QESEIASTNPVGTEGYGVMASTLQHGDHI

SEQ ID NO: 147355 - protein, 29 aa, Artificial Sequence
  Description of Artificial Sequence: Synthetic peptide
QESEIASTNPVGTEGYGVMASTLQHGDIA

SEQ ID NO: 147356 - protein, 29 aa, Artificial Sequence
  Description of Artificial Sequence: Synthetic peptide
QESEIASTNPVGTEGYGVMASTLQHGDIC

SEQ ID NO: 147357 - protein, 29 aa, Artificial Sequence
  Description of Artificial Sequence: Synthetic peptide
QESEIASTNPVGTEGYGVMASTLQHGDID

SEQ ID NO: 147358 - protein, 29 aa, Artificial Sequence
  Description of Artificial Sequence: Synthetic peptide
QESEIASTNPVGTEGYGVMASTLQHGDIE

SEQ ID NO: 147359 - protein, 29 aa, Artificial Sequence
  Description of Artificial Sequence: Synthetic peptide
QESEIASTNPVGTEGYGVMASTLQHGDIF

SEQ ID NO: 147360 - protein, 29 aa, Artificial Sequence
  Description of Artificial Sequence: Synthetic peptide
QESEIASTNPVGTEGYGVMASTLQHGDIG

SEQ ID NO: 147361 - protein, 29 aa, Artificial Sequence
  Description of Artificial Sequence: Synthetic peptide
QESEIASTNPVGTEGYGVMASTLQHGDIH

SEQ ID NO: 147362 - protein, 29 aa, Artificial Sequence
  Description of Artificial Sequence: Synthetic peptide
QESEIASTNPVGTEGYGVMASTLQHGDII

SEQ ID NO: 147363 - protein, 29 aa, Artificial Sequence
  Description of Artificial Sequence: Synthetic peptide
QESEIASTNPVGTEGYGVMASTLQHGDIK

SEQ ID NO: 147364 - protein, 29 aa, Artificial Sequence
  Description of Artificial Sequence: Synthetic peptide
QESEIASTNPVGTEGYGVMASTLQHGDQI

SEQ ID NO: 147365 - protein, 29 aa, Artificial Sequence
  Description of Artificial Sequence: Synthetic peptide
QESEIASTNPVGTEGYGVMASTLQHGDDI

SEQ ID NO: 147366 - protein, 36 aa, Artificial Sequence
  Description of Artificial Sequence: Synthetic polypeptide
HEEEIRTTNPVATDQYGSVSSTTPAGPNMRNGMNPV

SEQ ID NO: 147367 - protein, 29 aa, Artificial Sequence
  Description of Artificial Sequence: Synthetic peptide
QESEIASTNPVGTEGYGVMASTLQHGDSI

SEQ ID NO: 147368 - protein, 29 aa, Artificial Sequence
  Description of Artificial Sequence: Synthetic peptide
QESEIASTNPVGTEGYGVMASTLQHGHDW

SEQ ID NO: 147369 - protein, 37 aa, Artificial Sequence
  Description of Artificial Sequence: Synthetic polypeptide
AEEEIRTTNPVATEQYGSVSTVVNQGNNDEEGTNNSD

SEQ ID NO: 147370 - protein, 29 aa, Artificial Sequence
  Description of Artificial Sequence: Synthetic peptide
QENEIATTNPVATEQYGEAPEMVCQHEEK

SEQ ID NO: 147371 - protein, 29 aa, Artificial Sequence
  Description of Artificial Sequence: Synthetic peptide
QENEIATTNPVATEQYGEAPEICQNHEDK

SEQ ID NO: 147372 - protein, 30 aa, Artificial Sequence
  Description of Artificial Sequence: Synthetic polypeptide
QENEIATTNPVATEQYGEAPEEVIQQQGEH

SEQ ID NO: 147373 - protein, 37 aa, Artificial Sequence
  Description of Artificial Sequence: Synthetic polypeptide
DTEEIRTTNPVATEQYGVVSTTNNQQGSTEQGTTNTE

SEQ ID NO: 147374 - protein, 29 aa, Artificial Sequence
  Description of Artificial Sequence: Synthetic peptide
QESEIASTNPVGTEGYGVMASTLQHGIDI

SEQ ID NO: 147375 - protein, 37 aa, Artificial Sequence
  Description of Artificial Sequence: Synthetic polypeptide
DTEEIRTTNPVATEQYGVVSTTNNQQGNNNQDEEDED

SEQ ID NO: 147376 - protein, 29 aa, Artificial Sequence
  Description of Artificial Sequence: Synthetic peptide
QESEIASTNPVGTEGYGVMASTLQHGHDI

SEQ ID NO: 147377 - protein, 29 aa, Artificial Sequence
  Description of Artificial Sequence: Synthetic peptide
QESEIASTNPVGTEGYGVMASTLQHGKDI

SEQ ID NO: 147378 - protein, 29 aa, Artificial Sequence
  Description of Artificial Sequence: Synthetic peptide
QESEIASTNPVGTEGYGVMASTLQHGLDI

SEQ ID NO: 147379 - protein, 34 aa, Artificial Sequence
  Description of Artificial Sequence: Synthetic polypeptide
DEEEIGTTNPVATEQYGCVCSWNDHQENMISDQS

SEQ ID NO: 147380 - protein, 29 aa, Artificial Sequence
  Description of Artificial Sequence: Synthetic peptide
QESEIASTNPVGTEGYGVMASTLQHGMDI

SEQ ID NO: 147381 - protein, 36 aa, Artificial Sequence
  Description of Artificial Sequence: Synthetic polypeptide
DEEEIGTTNPVATEQYGCVCSWGNDLQENFGSDTLS

SEQ ID NO: 147382 - protein, 36 aa, Artificial Sequence
  Description of Artificial Sequence: Synthetic polypeptide
HEEEIRTTNPVATEQYGSVSSTTPAGPNMRNGMIPV

SEQ ID NO: 147383 - protein, 29 aa, Artificial Sequence
  Description of Artificial Sequence: Synthetic peptide
QESEIASTNPVGTEGYGVMASTLQHGPDI

SEQ ID NO: 147384 - protein, 37 aa, Artificial Sequence
  Description of Artificial Sequence: Synthetic polypeptide
HEEEIRTTNPVATEQYGSVSSTTPAGPNMRNGMNPVV

SEQ ID NO: 147385 - protein, 29 aa, Artificial Sequence
  Description of Artificial Sequence: Synthetic peptide
QESEIASTNPVGTEGYGVMASTLQHGPYI

SEQ ID NO: 147386 - protein, 37 aa, Artificial Sequence
  Description of Artificial Sequence: Synthetic polypeptide
DTEEIRTTNPVATEQYGVVSTTNNQQGNNNNDTEDQD

SEQ ID NO: 147387 - protein, 29 aa, Artificial Sequence
  Description of Artificial Sequence: Synthetic peptide
QESEIASTNPVGTEGYGVMASTLQHGHAI

SEQ ID NO: 147388 - protein, 29 aa, Artificial Sequence
  Description of Artificial Sequence: Synthetic peptide
QESEIASTNPVGTEGYGVMASTLQHGGMI

SEQ ID NO: 147389 - protein, 35 aa, Artificial Sequence
  Description of Artificial Sequence: Synthetic polypeptide
HEEEIRTTNPVATEQYGSVSLPVNTEENRNAAPYT

SEQ ID NO: 147390 - protein, 37 aa, Artificial Sequence
  Description of Artificial Sequence: Synthetic polypeptide
AEEEIRTTNPVATESYGSVSTVTNNNLGNNQQGEDEG

SEQ ID NO: 147391 - protein, 29 aa, Artificial Sequence
  Description of Artificial Sequence: Synthetic peptide
QESEIASTNPVGTEGYGVMASTLQHGDTI

SEQ ID NO: 147392 - protein, 29 aa, Artificial Sequence
  Description of Artificial Sequence: Synthetic peptide
QESEIASTNPVGTEGYGVMASTLQHGDVA

SEQ ID NO: 147393 - protein, 29 aa, Artificial Sequence
  Description of Artificial Sequence: Synthetic peptide
QESEIASTNPVGTEGYGVMASTLQHGDVI

SEQ ID NO: 147394 - protein, 37 aa, Artificial Sequence
  Description of Artificial Sequence: Synthetic polypeptide
AEEEIRTTNPVATESYGSVSTVTNNLNNNQQGTDGGN

SEQ ID NO: 147395 - protein, 29 aa, Artificial Sequence
  Description of Artificial Sequence: Synthetic peptide
QESEIASTNPVGTEGYGVMASTLQHGDWI

SEQ ID NO: 147396 - protein, 29 aa, Artificial Sequence
  Description of Artificial Sequence: Synthetic peptide
QESEIASTNPVGTEGYGVMASTLQHGDYC

SEQ ID NO: 147397 - protein, 29 aa, Artificial Sequence
  Description of Artificial Sequence: Synthetic peptide
QESEIASTNPVGTEGYGVMASTLQHGDYI

SEQ ID NO: 147398 - protein, 29 aa, Artificial Sequence
  Description of Artificial Sequence: Synthetic peptide
QESEIASTNPVGTEGYGVMASTLQHGDYL

SEQ ID NO: 147399 - protein, 37 aa, Artificial Sequence
  Description of Artificial Sequence: Synthetic polypeptide
DTEEIRTTNPVATEQYGVVSTTNQQQQQGNATTNNTE

SEQ ID NO: 147400 - protein, 29 aa, Artificial Sequence
  Description of Artificial Sequence: Synthetic peptide
QESEIASTNPVGTEGYGVMASTLQHGEDI

SEQ ID NO: 147401 - protein, 37 aa, Artificial Sequence
  Description of Artificial Sequence: Synthetic polypeptide
AEEEIRTTNPVATESYGSVSTVTNNELGNQQGTEGGN

SEQ ID NO: 147402 - protein, 37 aa, Artificial Sequence
  Description of Artificial Sequence: Synthetic polypeptide
DTEEIRTTNPVATEQYGVVSTTNQQQQGTNTTTNVAE

SEQ ID NO: 147403 - protein, 37 aa, Artificial Sequence
  Description of Artificial Sequence: Synthetic polypeptide
DTEEIRTTNPVATEQYGVVSTTNQQQNATEQGTTNTD

SEQ ID NO: 147404 - protein, 37 aa, Artificial Sequence
  Description of Artificial Sequence: Synthetic polypeptide
DTEEIRTTNPVATEQYGVVSTTNQQQGNTEQGSTTDE

SEQ ID NO: 147405 - protein, 29 aa, Artificial Sequence
  Description of Artificial Sequence: Synthetic peptide
QESEIASTNPVGTEGYGVMASTLQHGFDI

SEQ ID NO: 147406 - protein, 35 aa, Artificial Sequence
  Description of Artificial Sequence: Synthetic polypeptide
HEEEIRTTNPVATEQYGSVSLPVETEEHRPAAPYT

SEQ ID NO: 147407 - protein, 37 aa, Artificial Sequence
  Description of Artificial Sequence: Synthetic polypeptide
DTEEIRTTNPVATEQYGVVSTTNNQQQGNQEGTTNVD

SEQ ID NO: 147408 - protein, 29 aa, Artificial Sequence
  Description of Artificial Sequence: Synthetic peptide
QESEIASTNPVGTEGYGVMASTLQHGGDI

SEQ ID NO: 147409 - protein, 37 aa, Artificial Sequence
  Description of Artificial Sequence: Synthetic polypeptide
AEEEIRTTNPVATESYGSVSTVTNNNLGNQQGTDQGG

SEQ ID NO: 147410 - protein, 33 aa, Artificial Sequence
  Description of Artificial Sequence: Synthetic polypeptide
HDPTIRTTNPVATEQYGAVSTLHQQVRVASNTT

SEQ ID NO: 147411 - protein, 29 aa, Artificial Sequence
  Description of Artificial Sequence: Synthetic peptide
QESEIASTNPVGTEGYGVMASTLQHGDAP

SEQ ID NO: 147412 - protein, 37 aa, Artificial Sequence
  Description of Artificial Sequence: Synthetic polypeptide
AEEEIRTTNPVATEQYGSVSTVVNQAGTNESGSTNAD

SEQ ID NO: 147413 - protein, 28 aa, Artificial Sequence
  Description of Artificial Sequence: Synthetic peptide
QESEIASTNPVGTEGYGVMASTLMHGDI

SEQ ID NO: 147414 - protein, 37 aa, Artificial Sequence
  Description of Artificial Sequence: Synthetic polypeptide
DTEEIRTTNPVATEQYGVVSTTVTNNQQGNNQDEDED

SEQ ID NO: 147415 - protein, 29 aa, Artificial Sequence
  Description of Artificial Sequence: Synthetic peptide
QESEIASTNPVGTEGYGVMASTLMQHGDI

SEQ ID NO: 147416 - protein, 36 aa, Artificial Sequence
  Description of Artificial Sequence: Synthetic polypeptide
AEEEIRTTNPVATESYGSVSTVVSNNNVEEGTNEEE

SEQ ID NO: 147417 - protein, 28 aa, Artificial Sequence
  Description of Artificial Sequence: Synthetic peptide
QESEIASTNPVGTEGYGVMASTLNHGDI

SEQ ID NO: 147418 - protein, 37 aa, Artificial Sequence
  Description of Artificial Sequence: Synthetic polypeptide
DTEEIRTTNPVATEQYGVVSTTTNQQQAGNTEQGTTE

SEQ ID NO: 147419 - protein, 35 aa, Artificial Sequence
  Description of Artificial Sequence: Synthetic polypeptide
DEEEIRTTNPVATEQYGSQYSVTLDVEERQLLTDG

SEQ ID NO: 147420 - protein, 29 aa, Artificial Sequence
  Description of Artificial Sequence: Synthetic peptide
QESEIASTNPVGTEGYGVMASTLNQHGDI

SEQ ID NO: 147421 - protein, 36 aa, Artificial Sequence
  Description of Artificial Sequence: Synthetic polypeptide
AEEEIRTTNPVATESYGSVSTVVSNNNVEEGTNNQD

SEQ ID NO: 147422 - protein, 36 aa, Artificial Sequence
  Description of Artificial Sequence: Synthetic polypeptide
AEEEIRTTNPVATESYGSVSTVVSNNNVEEGNNVQE

SEQ ID NO: 147423 - protein, 29 aa, Artificial Sequence
  Description of Artificial Sequence: Synthetic peptide
QESEIASTNPVGTEGYGVMASTLPQHGDI

SEQ ID NO: 147424 - protein, 36 aa, Artificial Sequence
  Description of Artificial Sequence: Synthetic polypeptide
AEEEIRTTNPVATESYGSVSTVVSNNNVEEGNNAED

SEQ ID NO: 147425 - protein, 36 aa, Artificial Sequence
  Description of Artificial Sequence: Synthetic polypeptide
AEEEIRTTNPVATESYGSVSTVVSNNNVDEEGNNQD

SEQ ID NO: 147426 - protein, 36 aa, Artificial Sequence
  Description of Artificial Sequence: Synthetic polypeptide
AEEEIRTTNPVATESYGSVSTVVSNNNVAEEGTNDQ

SEQ ID NO: 147427 - protein, 30 aa, Artificial Sequence
  Description of Artificial Sequence: Synthetic polypeptide
GENEIRTTNPVATEQWGDVSNIEMNAAEDA

SEQ ID NO: 147428 - protein, 35 aa, Artificial Sequence
  Description of Artificial Sequence: Synthetic polypeptide
DEEEIRTTNPVATEQYGSSLINTHELDRMQDETIE

SEQ ID NO: 147429 - protein, 29 aa, Artificial Sequence
  Description of Artificial Sequence: Synthetic peptide
QESEIASTNPVGTEGYGVMASTLQAGGDI

SEQ ID NO: 147430 - protein, 29 aa, Artificial Sequence
  Description of Artificial Sequence: Synthetic peptide
QESEIASTNPVGTEGYGVMASTLQAHGDI

SEQ ID NO: 147431 - protein, 28 aa, Artificial Sequence
  Description of Artificial Sequence: Synthetic peptide
QESEIASTNPVGTEGYGVMASTLPHGDI

SEQ ID NO: 147432 - protein, 37 aa, Artificial Sequence
  Description of Artificial Sequence: Synthetic polypeptide
DTEEIRTTNPVATEQYGVVSTTVVNNQQGNQDEEEEE

SEQ ID NO: 147433 - protein, 37 aa, Artificial Sequence
  Description of Artificial Sequence: Synthetic polypeptide
DTEEIRTTNPVATEQYGVVSTTVVNNQQGNQEEEDED

SEQ ID NO: 147434 - protein, 36 aa, Artificial Sequence
  Description of Artificial Sequence: Synthetic polypeptide
AEEEIRTTNPVATESYGSVSTVVSNNNVEEGTNTQD

SEQ ID NO: 147435 - protein, 37 aa, Artificial Sequence
  Description of Artificial Sequence: Synthetic polypeptide
DTEEIRTTNPVATEQYGVVSTVNNLQQQTTNNNTTQD

SEQ ID NO: 147436 - protein, 29 aa, Artificial Sequence
  Description of Artificial Sequence: Synthetic peptide
QESEIASTNPVGTEGYGVMASTLGQVGDI

SEQ ID NO: 147437 - protein, 36 aa, Artificial Sequence
  Description of Artificial Sequence: Synthetic polypeptide
AEEEIRTTNPVATESYGSVSTVVSTNNTEEGTNAQD

SEQ ID NO: 147438 - protein, 28 aa, Artificial Sequence
  Description of Artificial Sequence: Synthetic peptide
QESEIASTNPVGTEGYGVMASTLHHGDI

SEQ ID NO: 147439 - protein, 36 aa, Artificial Sequence
  Description of Artificial Sequence: Synthetic polypeptide
AEEEIRTTNPVATESYGSVSTVVSNNNVNEEGNTQD

SEQ ID NO: 147440 - protein, 37 aa, Artificial Sequence
  Description of Artificial Sequence: Synthetic polypeptide
DTEEIRTTNPVATEQYGVVSTVNNDQANGNTEQGTTE

SEQ ID NO: 147441 - protein, 29 aa, Artificial Sequence
  Description of Artificial Sequence: Synthetic peptide
QESEIASTNPVGTEGYGVMASTLHQHGDI

SEQ ID NO: 147442 - protein, 36 aa, Artificial Sequence
  Description of Artificial Sequence: Synthetic polypeptide
AEEEIRTTNPVATESYGSVSTVVSNNNVEQGTNQQM

SEQ ID NO: 147443 - protein, 38 aa, Artificial Sequence
  Description of Artificial Sequence: Synthetic polypeptide
DTEEIRTTNPVATEQYGVVSTVNLQQGNTTEQGSTNTD

SEQ ID NO: 147444 - protein, 38 aa, Artificial Sequence
  Description of Artificial Sequence: Synthetic polypeptide
DTEEIRTTNPVATEQYGVVSTVNLQQGNTGEQGNTNVD

SEQ ID NO: 147445 - protein, 28 aa, Artificial Sequence
  Description of Artificial Sequence: Synthetic peptide
QESEIASTNPVGTEGYGVMASTLIHGDI

SEQ ID NO: 147446 - protein, 29 aa, Artificial Sequence
  Description of Artificial Sequence: Synthetic peptide
QESEIASTNPVGTEGYGVMASTLIQHGDI

SEQ ID NO: 147447 - protein, 29 aa, Artificial Sequence
  Description of Artificial Sequence: Synthetic peptide
QESEIASTNPVGTEGYGVMASTLIQHGDP

SEQ ID NO: 147448 - protein, 28 aa, Artificial Sequence
  Description of Artificial Sequence: Synthetic peptide
QESEIASTNPVGTEGYGVMASTLKHGDI

SEQ ID NO: 147449 - protein, 28 aa, Artificial Sequence
  Description of Artificial Sequence: Synthetic peptide
QESEIASTNPVGTEGYGVMASTLKHGHI

SEQ ID NO: 147450 - protein, 29 aa, Artificial Sequence
  Description of Artificial Sequence: Synthetic peptide
QESEIASTNPVGTEGYGVMASTLKQHGDI

SEQ ID NO: 147451 - protein, 38 aa, Artificial Sequence
  Description of Artificial Sequence: Synthetic polypeptide
DTEEIRTTNPVATEQYGVVSTVNLQQGNNNEQGSTNED

SEQ ID NO: 147452 - protein, 28 aa, Artificial Sequence
  Description of Artificial Sequence: Synthetic peptide
QESEIASTNPVGTEGYGVMASTLLHGDI

SEQ ID NO: 147453 - protein, 29 aa, Artificial Sequence
  Description of Artificial Sequence: Synthetic peptide
QESEIASTNPVGTEGYGVMASTLLHHGDI

SEQ ID NO: 147454 - protein, 28 aa, Artificial Sequence
  Description of Artificial Sequence: Synthetic peptide
QESEIASTNPVGTEGYGVMASTLQASDI

SEQ ID NO: 147455 - protein, 28 aa, Artificial Sequence
  Description of Artificial Sequence: Synthetic peptide
GESEIASTNPIGTEGYGVMASTLQHGDI

SEQ ID NO: 147456 - protein, 29 aa, Artificial Sequence
  Description of Artificial Sequence: Synthetic peptide
QESEIASTNPVGTEGYGVMASTLQCHGDI

SEQ ID NO: 147457 - protein, 38 aa, Artificial Sequence
  Description of Artificial Sequence: Synthetic polypeptide
DTEEIRTTNPVATEQYGVVSTTTNLQQGNTEQGTTDED

SEQ ID NO: 147458 - protein, 29 aa, Artificial Sequence
  Description of Artificial Sequence: Synthetic peptide
QENEIATTNPVATEQYGEIPEDCQHNEEH

SEQ ID NO: 147459 - protein, 36 aa, Artificial Sequence
  Description of Artificial Sequence: Synthetic polypeptide
AEEEIRTTNPVATESYGSVSTVTVNNNVEEGSNNQD

SEQ ID NO: 147460 - protein, 28 aa, Artificial Sequence
  Description of Artificial Sequence: Synthetic peptide
QESEIASTNPVGTEGYGVMASTLQHADI

SEQ ID NO: 147461 - protein, 28 aa, Artificial Sequence
  Description of Artificial Sequence: Synthetic peptide
QESEIASTNPVGTEGYGVMASTLQHADN

SEQ ID NO: 147462 - protein, 29 aa, Artificial Sequence
  Description of Artificial Sequence: Synthetic peptide
QESEIASTNPVGTEGYGVMASTLQHAGDI

SEQ ID NO: 147463 - protein, 28 aa, Artificial Sequence
  Description of Artificial Sequence: Synthetic peptide
QESEIASTNPVGTEGYGVMASTLQHCDI

SEQ ID NO: 147464 - protein, 28 aa, Artificial Sequence
  Description of Artificial Sequence: Synthetic peptide
QESEIASTNPVGTEGYGVMASTLQHDDI

SEQ ID NO: 147465 - protein, 29 aa, Artificial Sequence
  Description of Artificial Sequence: Synthetic peptide
QESEIASTNPVGTEGYGVMASTLQHDGDI

SEQ ID NO: 147466 - protein, 35 aa, Artificial Sequence
  Description of Artificial Sequence: Synthetic polypeptide
DEECIRTTNPVATEQWGCVCGNTNEHNQGFGSNQS

SEQ ID NO: 147467 - protein, 28 aa, Artificial Sequence
  Description of Artificial Sequence: Synthetic peptide
QESEIASTNPVGTEGYGVMASTLQHEDI

SEQ ID NO: 147468 - protein, 29 aa, Artificial Sequence
  Description of Artificial Sequence: Synthetic peptide
QESEIASTNPVGTEGYGVMASTLQHEGDG

SEQ ID NO: 147469 - protein, 29 aa, Artificial Sequence
  Description of Artificial Sequence: Synthetic peptide
QESEIASTNPVGTEGYGVMASTLQHEGDI

SEQ ID NO: 147470 - protein, 29 aa, Artificial Sequence
  Description of Artificial Sequence: Synthetic peptide
QESEIASTNPVGTEGYGVMASTLQHEGDS

SEQ ID NO: 147471 - protein, 28 aa, Artificial Sequence
  Description of Artificial Sequence: Synthetic peptide
QESEIASTNPVGTEGYGVMASTLQHFDI

SEQ ID NO: 147472 - protein, 29 aa, Artificial Sequence
  Description of Artificial Sequence: Synthetic peptide
QESEIASTNPVGTEGYGVMASTLQHFGDI

SEQ ID NO: 147473 - protein, 29 aa, Artificial Sequence
  Description of Artificial Sequence: Synthetic peptide
QESEIASTNPVGTEGYGVMASTLQHGADI

SEQ ID NO: 147474 - protein, 29 aa, Artificial Sequence
  Description of Artificial Sequence: Synthetic peptide
QESEIASTNPVGTEGYGVMASTLQHGAIH

SEQ ID NO: 147475 - protein, 29 aa, Artificial Sequence
  Description of Artificial Sequence: Synthetic peptide
QESEIASTNPVGTEGYGVMASTLQHGDAI

SEQ ID NO: 147476 - protein, 29 aa, Artificial Sequence
  Description of Artificial Sequence: Synthetic peptide
QESEIASTNPVGTEGYGVMASTLQHGDAK

SEQ ID NO: 147477 - protein, 30 aa, Artificial Sequence
  Description of Artificial Sequence: Synthetic polypeptide
GQAEIATTNPVAYEQWGCCGTDWDQGHGNR

SEQ ID NO: 147478 - protein, 29 aa, Artificial Sequence
  Description of Artificial Sequence: Synthetic peptide
QESEIASTNPVGTEGYGVMASTLQHGQDI

SEQ ID NO: 147479 - protein, 29 aa, Artificial Sequence
  Description of Artificial Sequence: Synthetic peptide
QESEIASTNPVGTEGYGVMASTLQGHGDI

SEQ ID NO: 147480 - protein, 29 aa, Artificial Sequence
  Description of Artificial Sequence: Synthetic peptide
QESEIASTNPVGTEGYGVMASTLQGGDIH

SEQ ID NO: 147481 - protein, 28 aa, Artificial Sequence
  Description of Artificial Sequence: Synthetic peptide
QESEIASTNPVGTEGYGVMASTLQDDDI

SEQ ID NO: 147482 - protein, 38 aa, Artificial Sequence
  Description of Artificial Sequence: Synthetic polypeptide
AEEEIRTTNPVATEQYGSVSTVVNNTNNQNDNGNNNVE

SEQ ID NO: 147483 - protein, 38 aa, Artificial Sequence
  Description of Artificial Sequence: Synthetic polypeptide
DTEEIRTTNPVATEQYGVVSTTTNLQQGNTEQGTDTEE

SEQ ID NO: 147484 - protein, 29 aa, Artificial Sequence
  Description of Artificial Sequence: Synthetic peptide
GESEIASTNPVGTEGYGVMASTLQTHGDI

SEQ ID NO: 147485 - protein, 37 aa, Artificial Sequence
  Description of Artificial Sequence: Synthetic polypeptide
DEEEIRTTNPVATEQYGSSQSSTTPAGPNMRNGMNPV

SEQ ID NO: 147486 - protein, 29 aa, Artificial Sequence
  Description of Artificial Sequence: Synthetic peptide
QESEIASTNPVGTEGYGVMASTLQDHGDI

SEQ ID NO: 147487 - protein, 38 aa, Artificial Sequence
  Description of Artificial Sequence: Synthetic polypeptide
DTEEIRTTNPVATEQYGVVSTTTNLQQGNNEQGTEDEG

SEQ ID NO: 147488 - protein, 37 aa, Artificial Sequence
  Description of Artificial Sequence: Synthetic polypeptide
DTEEIRTTNPVATEQYGVVSTTTNLQQENNTEQGTTE

SEQ ID NO: 147489 - protein, 29 aa, Artificial Sequence
  Description of Artificial Sequence: Synthetic peptide
QESEIASTNPVGTEGYGVMASTLQEGGDI

SEQ ID NO: 147490 - protein, 38 aa, Artificial Sequence
  Description of Artificial Sequence: Synthetic polypeptide
DTEEIRTTNPVATEQYGVVSTTTNLQAGNTEQGTEEEQ

SEQ ID NO: 147491 - protein, 29 aa, Artificial Sequence
  Description of Artificial Sequence: Synthetic peptide
QESEIASTNPVGTEGYGVMASTLQEHGDI

SEQ ID NO: 147492 - protein, 29 aa, Artificial Sequence
  Description of Artificial Sequence: Synthetic peptide
QESEIASTNPVGTEGYGVMASTLQEHGDS

SEQ ID NO: 147493 - protein, 29 aa, Artificial Sequence
  Description of Artificial Sequence: Synthetic peptide
QESEIASTNPVGTEGYGVMASTLQFDGDI

SEQ ID NO: 147494 - protein, 30 aa, Artificial Sequence
  Description of Artificial Sequence: Synthetic polypeptide
QENEIATTNPVATEQYGEIPMDCQQQNGEH

SEQ ID NO: 147495 - protein, 29 aa, Artificial Sequence
  Description of Artificial Sequence: Synthetic peptide
QESEIASTNPVGTEGYGVMASTLQFHGDI

SEQ ID NO: 147496 - protein, 29 aa, Artificial Sequence
  Description of Artificial Sequence: Synthetic peptide
QESEIASTNPVGTEGYGVMASTLQFIGDI

SEQ ID NO: 147497 - protein, 30 aa, Artificial Sequence
  Description of Artificial Sequence: Synthetic polypeptide
QENEIATTNPVATEQYGEIPMDCQQQNEEH

SEQ ID NO: 147498 - protein, 30 aa, Artificial Sequence
  Description of Artificial Sequence: Synthetic polypeptide
QENEIATTNPVATEQYGEIPEDCQQQNEEH

SEQ ID NO: 147499 - protein, 29 aa, Artificial Sequence
  Description of Artificial Sequence: Synthetic peptide
QENEIATTNPVATEQYGEIPEDCQQNEEH

SEQ ID NO: 147500 - protein, 29 aa, Artificial Sequence
  Description of Artificial Sequence: Synthetic peptide
QESEIASTNPVGTEGYGVMASTLQGGDMI

SEQ ID NO: 147501 - protein, 37 aa, Artificial Sequence
  Description of Artificial Sequence: Synthetic polypeptide
DTEEIRTTNPVATEQYGVVSTVNNNLQNNDEEEEGDE

SEQ ID NO: 147502 - protein, 29 aa, Artificial Sequence
  Description of Artificial Sequence: Synthetic peptide
QESEIASTNPVGTEGYGVMASTLQHGQPI

SEQ ID NO: 147503 - protein, 29 aa, Artificial Sequence
  Description of Artificial Sequence: Synthetic peptide
QESEIASTNPVGTEGYGVMASTLQHGRDI

SEQ ID NO: 147504 - protein, 28 aa, Artificial Sequence
  Description of Artificial Sequence: Synthetic peptide
QESEIASTNPVGTEGYGVMASTLTHGII

SEQ ID NO: 147505 - protein, 38 aa, Artificial Sequence
  Description of Artificial Sequence: Synthetic polypeptide
DTEEIRTTNPVATEQYGSVSTVNQQQGNTESGNNNQEQ

SEQ ID NO: 147506 - protein, 38 aa, Artificial Sequence
  Description of Artificial Sequence: Synthetic polypeptide
DTEEIRTTNPVATEQYGSVSTVNQQQGNTEQGTTNQEQ

SEQ ID NO: 147507 - protein, 29 aa, Artificial Sequence
  Description of Artificial Sequence: Synthetic peptide
QESEIASTNPVGTEGYGVMASTLTQHGDI

SEQ ID NO: 147508 - protein, 38 aa, Artificial Sequence
  Description of Artificial Sequence: Synthetic polypeptide
DTEEIRTTNPVATEQYGSVSTVNQQGNTEQGSTNETQD

SEQ ID NO: 147509 - protein, 29 aa, Artificial Sequence
  Description of Artificial Sequence: Synthetic peptide
QESEIASTNPVGTEGYGVMASTLTQHGTI

SEQ ID NO: 147510 - protein, 34 aa, Artificial Sequence
  Description of Artificial Sequence: Synthetic polypeptide
HENEIRTTNPVATETYGSVSINNSLQEVHDTVPS

SEQ ID NO: 147511 - protein, 34 aa, Artificial Sequence
  Description of Artificial Sequence: Synthetic polypeptide
HENEIRTTNPVATETYGSVSNNSLQQEVHSTVPG

SEQ ID NO: 147512 - protein, 37 aa, Artificial Sequence
  Description of Artificial Sequence: Synthetic polypeptide
DTEEIRTTNPVATEQYGSVSTVNQQQQQTNATTNVAE

SEQ ID NO: 147513 - protein, 29 aa, Artificial Sequence
  Description of Artificial Sequence: Synthetic peptide
QESEIASTNPVGTEGYGVMASTLTQSGDI

SEQ ID NO: 147514 - protein, 29 aa, Artificial Sequence
  Description of Artificial Sequence: Synthetic peptide
QESEIASTNPVGTEGYGVMASTLVHGDIR

SEQ ID NO: 147515 - protein, 29 aa, Artificial Sequence
  Description of Artificial Sequence: Synthetic peptide
QESEIASTNPVGTEGYGVMASTLVQHGDD

SEQ ID NO: 147516 - protein, 29 aa, Artificial Sequence
  Description of Artificial Sequence: Synthetic peptide
QESEIASTNPVGTEGYGVMASTLVQHGDI

SEQ ID NO: 147517 - protein, 28 aa, Artificial Sequence
  Description of Artificial Sequence: Synthetic peptide
QESEIASTNPVGTEGYGVMASTLWHGDI

SEQ ID NO: 147518 - protein, 29 aa, Artificial Sequence
  Description of Artificial Sequence: Synthetic peptide
QESEIASTNPVGTEGYGVMASTLWQHGDI

SEQ ID NO: 147519 - protein, 28 aa, Artificial Sequence
  Description of Artificial Sequence: Synthetic peptide
QESEIASTNPVGTEGYGVMASTLYHGDI

SEQ ID NO: 147520 - protein, 29 aa, Artificial Sequence
  Description of Artificial Sequence: Synthetic peptide
QESEIASTNPVGTEGYGVMASTLYHRGDI

SEQ ID NO: 147521 - protein, 29 aa, Artificial Sequence
  Description of Artificial Sequence: Synthetic peptide
QESEIASTNPVGTEGYGVMASTLYQHGDI

SEQ ID NO: 147522 - protein, 28 aa, Artificial Sequence
  Description of Artificial Sequence: Synthetic peptide
QESEIASTNPVGTEGYGVMASTLVHGDI

SEQ ID NO: 147523 - protein, 28 aa, Artificial Sequence
  Description of Artificial Sequence: Synthetic peptide
QESEIASTNPVGTEGYGVMASTLTHGDI

SEQ ID NO: 147524 - protein, 29 aa, Artificial Sequence
  Description of Artificial Sequence: Synthetic peptide
QESEIASTNPVGTEGYGVMASTLSQHGDI

SEQ ID NO: 147525 - protein, 28 aa, Artificial Sequence
  Description of Artificial Sequence: Synthetic peptide
QESEIASTNPVGTEGYGVMASTLSHGDI

SEQ ID NO: 147526 - protein, 30 aa, Artificial Sequence
  Description of Artificial Sequence: Synthetic polypeptide
HENEIRTTNPVATEQWGDVSEIEMNAAEDA

SEQ ID NO: 147527 - protein, 29 aa, Artificial Sequence
  Description of Artificial Sequence: Synthetic peptide
QESEIASTNPVGTEGYGVMASTLQSHNDI

SEQ ID NO: 147528 - protein, 36 aa, Artificial Sequence
  Description of Artificial Sequence: Synthetic polypeptide
DEEEIGTTNPVATEQYGCVCSTWNDHNQENFGSDQS

SEQ ID NO: 147529 - protein, 29 aa, Artificial Sequence
  Description of Artificial Sequence: Synthetic peptide
QESEIASTNPVGTEGYGVMASTLQTHGDI

SEQ ID NO: 147530 - protein, 29 aa, Artificial Sequence
  Description of Artificial Sequence: Synthetic peptide
QESEIASTNPVGTEGYGVMASTLQVFGDI

SEQ ID NO: 147531 - protein, 30 aa, Artificial Sequence
  Description of Artificial Sequence: Synthetic polypeptide
HENEIRTTNPVATEQWGDVSRIEMNAAEDA

SEQ ID NO: 147532 - protein, 29 aa, Artificial Sequence
  Description of Artificial Sequence: Synthetic peptide
QESEIASTNPVGTEGYGVMASTLQVGDIQ

SEQ ID NO: 147533 - protein, 29 aa, Artificial Sequence
  Description of Artificial Sequence: Synthetic peptide
QESEIASTNPVGTEGYGVMASTLQVGGDI

SEQ ID NO: 147534 - protein, 29 aa, Artificial Sequence
  Description of Artificial Sequence: Synthetic peptide
QESEIASTNPVGTEGYGVMASTLQVHGDI

SEQ ID NO: 147535 - protein, 29 aa, Artificial Sequence
  Description of Artificial Sequence: Synthetic peptide
QESEIASTNPVGTEGYGVMASTLQVHGPI

SEQ ID NO: 147536 - protein, 37 aa, Artificial Sequence
  Description of Artificial Sequence: Synthetic polypeptide
AEEEIRTTNPVATEQYGVVVVVSTTQLQQGTEEGNVE

SEQ ID NO: 147537 - protein, 34 aa, Artificial Sequence
  Description of Artificial Sequence: Synthetic polypeptide
HENEIRTTNPVATETYGSVSFNELQIEVHDTVPG

SEQ ID NO: 147538 - protein, 29 aa, Artificial Sequence
  Description of Artificial Sequence: Synthetic peptide
QESEIASTNPVGTEGYGVMASTLQWHGDI

SEQ ID NO: 147539 - protein, 29 aa, Artificial Sequence
  Description of Artificial Sequence: Synthetic peptide
QESEIASTNPVGTEGYGVMASTLQYGQDI

SEQ ID NO: 147540 - protein, 30 aa, Artificial Sequence
  Description of Artificial Sequence: Synthetic polypeptide
QESEIASTNPVGTEGYGVMASTLQYHRGDI

SEQ ID NO: 147541 - protein, 28 aa, Artificial Sequence
  Description of Artificial Sequence: Synthetic peptide
QESEIASTNPVGTEGYGVMASTLRHGDI

SEQ ID NO: 147542 - protein, 28 aa, Artificial Sequence
  Description of Artificial Sequence: Synthetic peptide
QESEIASTNPVGTEGYGVMASTLRHGSI

SEQ ID NO: 147543 - protein, 29 aa, Artificial Sequence
  Description of Artificial Sequence: Synthetic peptide
QESEIASTNPVGTEGYGVMASTLRQHGDI

SEQ ID NO: 147544 - protein, 29 aa, Artificial Sequence
  Description of Artificial Sequence: Synthetic peptide
QESEIASTNPVGTEGYGVMASTLRQHGDP

SEQ ID NO: 147545 - protein, 30 aa, Artificial Sequence
  Description of Artificial Sequence: Synthetic polypeptide
QENEIATTNPVATEQYGDVSECEMNAAEDA

SEQ ID NO: 147546 - protein, 29 aa, Artificial Sequence
  Description of Artificial Sequence: Synthetic peptide
QESEIASTNPVGTEGYGVMASTLQSHGDI

SEQ ID NO: 147547 - protein, 30 aa, Artificial Sequence
  Description of Artificial Sequence: Synthetic polypeptide
QESEIASTNPVGTEGYGVMASTMLQHGGDI

SEQ ID NO: 147548 - protein, 28 aa, Artificial Sequence
  Description of Artificial Sequence: Synthetic peptide
QESEIASTNPVGTEGYGVMASTMQHGPI

SEQ ID NO: 147549 - protein, 28 aa, Artificial Sequence
  Description of Artificial Sequence: Synthetic peptide
QESEIASTNPVGTEGYGVMASTRQHGDI

SEQ ID NO: 147550 - protein, 37 aa, Artificial Sequence
  Description of Artificial Sequence: Synthetic polypeptide
AEEEIRTTNPVATEQYGVVVVVSTTNLQQGTEQGTVA

SEQ ID NO: 147551 - protein, 28 aa, Artificial Sequence
  Description of Artificial Sequence: Synthetic peptide
QESEIASTNPVGTEGYGVMASTSQHGDI

SEQ ID NO: 147552 - protein, 29 aa, Artificial Sequence
  Description of Artificial Sequence: Synthetic peptide
QESEIASTNPVGTEGYGVMASTTLPHGDI

SEQ ID NO: 147553 - protein, 30 aa, Artificial Sequence
  Description of Artificial Sequence: Synthetic polypeptide
QESEIASTNPVGTEGYGVMASTTLQHGDQI

SEQ ID NO: 147554 - protein, 37 aa, Artificial Sequence
  Description of Artificial Sequence: Synthetic polypeptide
DTEEIRTTNPVATEQYGSVSSTTPAVGPNMRNGMNPV

SEQ ID NO: 147555 - protein, 28 aa, Artificial Sequence
  Description of Artificial Sequence: Synthetic peptide
QESEIASTNPVGTEGYGVMASTTQHGAI

SEQ ID NO: 147556 - protein, 28 aa, Artificial Sequence
  Description of Artificial Sequence: Synthetic peptide
QESEIASTNPVGTEGYGVMASTTQHGDI

SEQ ID NO: 147557 - protein, 28 aa, Artificial Sequence
  Description of Artificial Sequence: Synthetic peptide
QESEIASTNPVGTEGYGVMASTRQHGDH

SEQ ID NO: 147558 - protein, 28 aa, Artificial Sequence
  Description of Artificial Sequence: Synthetic peptide
QESEIASTNPVGTEGYGVMASTTQHGKI

SEQ ID NO: 147559 - protein, 30 aa, Artificial Sequence
  Description of Artificial Sequence: Synthetic polypeptide
QESEIASTNPVGTEGYGVMASTVLQHGGDI

SEQ ID NO: 147560 - protein, 28 aa, Artificial Sequence
  Description of Artificial Sequence: Synthetic peptide
QESEIASTNPVGTEGYGVMASTVQHGDI

SEQ ID NO: 147561 - protein, 34 aa, Artificial Sequence
  Description of Artificial Sequence: Synthetic polypeptide
IEDEIRTTNPVATEQYGSVYTTVNNEREFDLPQE

SEQ ID NO: 147562 - protein, 30 aa, Artificial Sequence
  Description of Artificial Sequence: Synthetic polypeptide
QESEIASTNPVGTEGYGVMASTWLQHLGDI

SEQ ID NO: 147563 - protein, 28 aa, Artificial Sequence
  Description of Artificial Sequence: Synthetic peptide
QESEIASTNPVGTEGYGVMASTWQHGDI

SEQ ID NO: 147564 - protein, 33 aa, Artificial Sequence
  Description of Artificial Sequence: Synthetic polypeptide
DTEEIRTTNPVATEQYGSVQDVPDEVDEQEERI

SEQ ID NO: 147565 - protein, 30 aa, Artificial Sequence
  Description of Artificial Sequence: Synthetic polypeptide
QESEIASTNPVGTEGYGVMASTYLQHGDPI

SEQ ID NO: 147566 - protein, 28 aa, Artificial Sequence
  Description of Artificial Sequence: Synthetic peptide
QESEIASTNPVGTEGYGVMASTYQGGDI

SEQ ID NO: 147567 - protein, 35 aa, Artificial Sequence
  Description of Artificial Sequence: Synthetic polypeptide
DEEEIGTTNPVATEQYGCVCSTGEHDQEHFNSEQS

SEQ ID NO: 147568 - protein, 30 aa, Artificial Sequence
  Description of Artificial Sequence: Synthetic polypeptide
QESEIASTNPVGTEGYGVMASTRLQNHGDI

SEQ ID NO: 147569 - protein, 30 aa, Artificial Sequence
  Description of Artificial Sequence: Synthetic polypeptide
QESEIASTNPVGTEGYGVMASTRLQHGDIG

SEQ ID NO: 147570 - protein, 34 aa, Artificial Sequence
  Description of Artificial Sequence: Synthetic polypeptide
DEECIRTTNPVATEIYGCVCQTGELQEYFGSDQS

SEQ ID NO: 147571 - protein, 28 aa, Artificial Sequence
  Description of Artificial Sequence: Synthetic peptide
QESEIASTNPVGTEGYGVMASTNHHGDI

SEQ ID NO: 147572 - protein, 38 aa, Artificial Sequence
  Description of Artificial Sequence: Synthetic polypeptide
DTEEIRTTNPVATEQYGSVSTVNDQQGNTEQGNNEQEQ

SEQ ID NO: 147573 - protein, 32 aa, Artificial Sequence
  Description of Artificial Sequence: Synthetic polypeptide
DEECISTTNPVAYEQYGCVCSWGEHQYFGSDQ

SEQ ID NO: 147574 - protein, 29 aa, Artificial Sequence
  Description of Artificial Sequence: Synthetic peptide
QESEIASTNPVGTEGYGVMASTNQKHGDI

SEQ ID NO: 147575 - protein, 29 aa, Artificial Sequence
  Description of Artificial Sequence: Synthetic peptide
QESEIASTNPVGTEGYGVMASTPEQHGDI

SEQ ID NO: 147576 - protein, 30 aa, Artificial Sequence
  Description of Artificial Sequence: Synthetic polypeptide
QESEIASTNPVGTEGYGVMASTPLQHGDSI

SEQ ID NO: 147577 - protein, 29 aa, Artificial Sequence
  Description of Artificial Sequence: Synthetic peptide
HESEIASTNPVGTEGYGVMASTLQVHGDI

SEQ ID NO: 147578 - protein, 38 aa, Artificial Sequence
  Description of Artificial Sequence: Synthetic polypeptide
DTEEIRTTNPVATEQYGSVSTTTNLEQGNTEQGTTDEN

SEQ ID NO: 147579 - protein, 30 aa, Artificial Sequence
  Description of Artificial Sequence: Synthetic polypeptide
QESEIASTNPVGTEGYGVMASTPLQQHGDI

SEQ ID NO: 147580 - protein, 28 aa, Artificial Sequence
  Description of Artificial Sequence: Synthetic peptide
QESEIASTNPVGTEGYGVMASTPQHGDI

SEQ ID NO: 147581 - protein, 30 aa, Artificial Sequence
  Description of Artificial Sequence: Synthetic polypeptide
QESEIASTNPVGTEGYGVMASTQLKQHGDI

SEQ ID NO: 147582 - protein, 38 aa, Artificial Sequence
  Description of Artificial Sequence: Synthetic polypeptide
HESEIATTNPVATEQYGSVTSPTSNVLDQFRIGENYQK

SEQ ID NO: 147583 - protein, 37 aa, Artificial Sequence
  Description of Artificial Sequence: Synthetic polypeptide
DTEEIRTTNPVATEQYGSVSTTNQQAGTEAGTEQGQD

SEQ ID NO: 147584 - protein, 30 aa, Artificial Sequence
  Description of Artificial Sequence: Synthetic polypeptide
QESEIASTNPVGTEGYGVMASTQLQHGDKI

SEQ ID NO: 147585 - protein, 38 aa, Artificial Sequence
  Description of Artificial Sequence: Synthetic polypeptide
DTEEIRTTNPVATEQYGSVSTTNQAYGNNNQQGTNNDE

SEQ ID NO: 147586 - protein, 35 aa, Artificial Sequence
  Description of Artificial Sequence: Synthetic polypeptide
DEEEIGTTNPVATEQYGCVCSTGEHNQEFFNSDQA

SEQ ID NO: 147587 - protein, 38 aa, Artificial Sequence
  Description of Artificial Sequence: Synthetic polypeptide
DTEEIRTTNPVATEQYGSVSTTNNQQLGNGEQGTTDEE

SEQ ID NO: 147588 - protein, 28 aa, Artificial Sequence
  Description of Artificial Sequence: Synthetic peptide
QESEIASTNPVGTEGYGVMASTQQHGDI

SEQ ID NO: 147589 - protein, 30 aa, Artificial Sequence
  Description of Artificial Sequence: Synthetic polypeptide
QESEIASTNPVGTEGYGVMASTRLQHGDDI

SEQ ID NO: 147590 - protein, 28 aa, Artificial Sequence
  Description of Artificial Sequence: Synthetic peptide
QESEIASTNPVGTEGYGVMASTMQHGDI

SEQ ID NO: 147591 - protein, 34 aa, Artificial Sequence
  Description of Artificial Sequence: Synthetic polypeptide
DEECISTTNPVAYEQYGCVCSTGEDNQYFGSNQA

SEQ ID NO: 147592 - protein, 34 aa, Artificial Sequence
  Description of Artificial Sequence: Synthetic polypeptide
DEEEIGTTNPVATEQYGCVCSWEDHQEYFGSDQS

SEQ ID NO: 147593 - protein, 38 aa, Artificial Sequence
  Description of Artificial Sequence: Synthetic polypeptide
AEEEIRTTNPVATEQYGVVVVVSTTTNLQAGTEEGNTD

SEQ ID NO: 147594 - protein, 28 aa, Artificial Sequence
  Description of Artificial Sequence: Synthetic peptide
QESEIASTNPVGTEGYGVMASTLQHLDI

SEQ ID NO: 147595 - protein, 28 aa, Artificial Sequence
  Description of Artificial Sequence: Synthetic peptide
QESEIASTNPVGTEGYGVMASTLQHLDY

SEQ ID NO: 147596 - protein, 37 aa, Artificial Sequence
  Description of Artificial Sequence: Synthetic polypeptide
AEEEIRTTNPVATEQYGSVSTVVNQGNNNDEGNNTSD

SEQ ID NO: 147597 - protein, 29 aa, Artificial Sequence
  Description of Artificial Sequence: Synthetic peptide
QESEIASTNPVGTEGYGVMASTLQHLGDI

SEQ ID NO: 147598 - protein, 28 aa, Artificial Sequence
  Description of Artificial Sequence: Synthetic peptide
QESEIASTNPVGTEGYGVMASTLQHMDI

SEQ ID NO: 147599 - protein, 29 aa, Artificial Sequence
  Description of Artificial Sequence: Synthetic peptide
QESEIASTNPVGTEGYGVMASTLQHMGDI

SEQ ID NO: 147600 - protein, 28 aa, Artificial Sequence
  Description of Artificial Sequence: Synthetic peptide
QESEIASTNPVGTEGYGVMASTLQHNDI

SEQ ID NO: 147601 - protein, 29 aa, Artificial Sequence
  Description of Artificial Sequence: Synthetic peptide
QESEIASTNPVGTEGYGVMASTLQHNGDI

SEQ ID NO: 147602 - protein, 29 aa, Artificial Sequence
  Description of Artificial Sequence: Synthetic peptide
QESEIASTNPVGTEGYGVMASTLQHKGDI

SEQ ID NO: 147603 - protein, 29 aa, Artificial Sequence
  Description of Artificial Sequence: Synthetic peptide
QESEIASTNPVGTEGYGVMASTLQHNNDI

SEQ ID NO: 147604 - protein, 35 aa, Artificial Sequence
  Description of Artificial Sequence: Synthetic polypeptide
DEECISTTNPVAYEHYGQSTVAVTNELAQRGGETF

SEQ ID NO: 147605 - protein, 29 aa, Artificial Sequence
  Description of Artificial Sequence: Synthetic peptide
QESEIASTNPVGTEGYGVMASTLQHPGDI

SEQ ID NO: 147606 - protein, 29 aa, Artificial Sequence
  Description of Artificial Sequence: Synthetic peptide
QESEIASTNPVGTEGYGVMASTLQHPPRI

SEQ ID NO: 147607 - protein, 28 aa, Artificial Sequence
  Description of Artificial Sequence: Synthetic peptide
QESEIASTNPVGTEGYGVMASTLQHQDI

SEQ ID NO: 147608 - protein, 29 aa, Artificial Sequence
  Description of Artificial Sequence: Synthetic peptide
QESEIASTNPVGTEGYGVMASTLQHQGDI

SEQ ID NO: 147609 - protein, 28 aa, Artificial Sequence
  Description of Artificial Sequence: Synthetic peptide
QESEIASTNPVGTEGYGVMASTLQHRDI

SEQ ID NO: 147610 - protein, 36 aa, Artificial Sequence
  Description of Artificial Sequence: Synthetic polypeptide
AEEEIRTTNPVATESYGSVSTVQSNNNVEEGTNVQN

SEQ ID NO: 147611 - protein, 35 aa, Artificial Sequence
  Description of Artificial Sequence: Synthetic polypeptide
DEECISTTNPVAYEHYGQSTVAVTNEQAQREGERG

SEQ ID NO: 147612 - protein, 28 aa, Artificial Sequence
  Description of Artificial Sequence: Synthetic peptide
QESEIASTNPVGTEGYGVMASTLQHPDI

SEQ ID NO: 147613 - protein, 28 aa, Artificial Sequence
  Description of Artificial Sequence: Synthetic peptide
QESEIASTNPVGTEGYGVMASTLQHKDI

SEQ ID NO: 147614 - protein, 29 aa, Artificial Sequence
  Description of Artificial Sequence: Synthetic peptide
QESEIASTNPVGTEGYGVMASTLQHIGDI

SEQ ID NO: 147615 - protein, 28 aa, Artificial Sequence
  Description of Artificial Sequence: Synthetic peptide
QESEIASTNPVGTEGYGVMASTLQHIDT

SEQ ID NO: 147616 - protein, 29 aa, Artificial Sequence
  Description of Artificial Sequence: Synthetic peptide
QESEIASTNPVGTEGYGVMASTLQHGRGI

SEQ ID NO: 147617 - protein, 37 aa, Artificial Sequence
  Description of Artificial Sequence: Synthetic polypeptide
DTEEIRTTNPVATEQYGVVSTTNNQQALGNQEQGTTE

SEQ ID NO: 147618 - protein, 29 aa, Artificial Sequence
  Description of Artificial Sequence: Synthetic peptide
QESEIASTNPVGTEGYGVMASTLQHGSDI

SEQ ID NO: 147619 - protein, 37 aa, Artificial Sequence
  Description of Artificial Sequence: Synthetic polypeptide
AEEEIRTTNPVATESYGSVSTVTNLLGNNQQGEDGGN

SEQ ID NO: 147620 - protein, 29 aa, Artificial Sequence
  Description of Artificial Sequence: Synthetic peptide
QESEIASTNPVGTEGYGVMASTLQHGTDI

SEQ ID NO: 147621 - protein, 37 aa, Artificial Sequence
  Description of Artificial Sequence: Synthetic polypeptide
DTEEIRTTNPVATEQYGVVSTTNNDQQGGNTEQGTTE

SEQ ID NO: 147622 - protein, 37 aa, Artificial Sequence
  Description of Artificial Sequence: Synthetic polypeptide
DTEEIRTTNPVATEQYGVVSTTNNDQAGNTEQYGTTE

SEQ ID NO: 147623 - protein, 29 aa, Artificial Sequence
  Description of Artificial Sequence: Synthetic peptide
QESEIASTNPVGTEGYGVMASTLQHGTDV

SEQ ID NO: 147624 - protein, 34 aa, Artificial Sequence
  Description of Artificial Sequence: Synthetic polypeptide
DEECISTTNPVAYEHYGQCTVSNDNELAERGGER

SEQ ID NO: 147625 - protein, 37 aa, Artificial Sequence
  Description of Artificial Sequence: Synthetic polypeptide
DEEEIRTTNPVATEQYGSGVSPTINGEEFEQQPEAYT

SEQ ID NO: 147626 - protein, 29 aa, Artificial Sequence
  Description of Artificial Sequence: Synthetic peptide
QESEIASTNPVGTEGYGVMASTLQHGVDI

SEQ ID NO: 147627 - protein, 29 aa, Artificial Sequence
  Description of Artificial Sequence: Synthetic peptide
QESEIASTNPVGTEGYGVMASTLQHGVSI

SEQ ID NO: 147628 - protein, 29 aa, Artificial Sequence
  Description of Artificial Sequence: Synthetic peptide
QESEIASTNPVGTEGYGVMASTLQHGWDI

SEQ ID NO: 147629 - protein, 29 aa, Artificial Sequence
  Description of Artificial Sequence: Synthetic peptide
QESEIASTNPVGTEGYGVMASTLQHGYDI

SEQ ID NO: 147630 - protein, 36 aa, Artificial Sequence
  Description of Artificial Sequence: Synthetic polypeptide
AEEEIRTTNPVATESYGSVSTVSNNNVSEEGTNVQE

SEQ ID NO: 147631 - protein, 35 aa, Artificial Sequence
  Description of Artificial Sequence: Synthetic polypeptide
DEECISTTNPVAYEHYGQKTVAVTNELAQRGGERK

SEQ ID NO: 147632 - protein, 28 aa, Artificial Sequence
  Description of Artificial Sequence: Synthetic peptide
QESEIASTNPVGTEGYGVMASTLQHHDI

SEQ ID NO: 147633 - protein, 29 aa, Artificial Sequence
  Description of Artificial Sequence: Synthetic peptide
QESEIASTNPVGTEGYGVMASTLQHHGDI

SEQ ID NO: 147634 - protein, 28 aa, Artificial Sequence
  Description of Artificial Sequence: Synthetic peptide
QESEIASTNPVGTEGYGVMASTLQHIDI

SEQ ID NO: 147635 - protein, 29 aa, Artificial Sequence
  Description of Artificial Sequence: Synthetic peptide
QESEIASTNPVGTEGYGVMASTLQHRDII

SEQ ID NO: 147636 - protein, 37 aa, Artificial Sequence
  Description of Artificial Sequence: Synthetic polypeptide
DTEEIRTTNPVATEQYGVVSTTNNDQAGNQEQIGTST

SEQ ID NO: 147637 - protein, 37 aa, Artificial Sequence
  Description of Artificial Sequence: Synthetic polypeptide
DTEEIRTTNPVATEQYGVVSTTNNDQAGNQEQGGTTD

SEQ ID NO: 147638 - protein, 36 aa, Artificial Sequence
  Description of Artificial Sequence: Synthetic polypeptide
AEEEIRTTNPVATESYGSVSTVNSNNNVEEGTNQQE

SEQ ID NO: 147639 - protein, 34 aa, Artificial Sequence
  Description of Artificial Sequence: Synthetic polypeptide
DEEEIGTTNPVATEQYGCVCSWEHNQNFNSENQQ

SEQ ID NO: 147640 - protein, 29 aa, Artificial Sequence
  Description of Artificial Sequence: Synthetic peptide
QESEIASTNPVGTEGYGVMASTLQLGDIW

SEQ ID NO: 147641 - protein, 29 aa, Artificial Sequence
  Description of Artificial Sequence: Synthetic peptide
QESEIASTNPVGTEGYGVMASTLQLHGDI

SEQ ID NO: 147642 - protein, 29 aa, Artificial Sequence
  Description of Artificial Sequence: Synthetic peptide
QESEIASTNPVGTEGYGVMASTLQMHGDI

SEQ ID NO: 147643 - protein, 29 aa, Artificial Sequence
  Description of Artificial Sequence: Synthetic peptide
QESEIASTNPVGTEGYGVMASTLQNAGDI

SEQ ID NO: 147644 - protein, 29 aa, Artificial Sequence
  Description of Artificial Sequence: Synthetic peptide
QESEIASTNPVGTEGYGVMASTLQNHGDI

SEQ ID NO: 147645 - protein, 29 aa, Artificial Sequence
  Description of Artificial Sequence: Synthetic peptide
QESEIASTNPVGTEGYGVMASTLQNHGII

SEQ ID NO: 147646 - protein, 33 aa, Artificial Sequence
  Description of Artificial Sequence: Synthetic polypeptide
HEMEIVTTNPVATEQYGTVCSATDGPVEFEGND

SEQ ID NO: 147647 - protein, 33 aa, Artificial Sequence
  Description of Artificial Sequence: Synthetic polypeptide
HEMEIVTTNPVATEQYGTVCSATDGPWEFEGND

SEQ ID NO: 147648 - protein, 29 aa, Artificial Sequence
  Description of Artificial Sequence: Synthetic peptide
QESEIASTNPVGTEGYGVMASTLQPGGDI

SEQ ID NO: 147649 - protein, 29 aa, Artificial Sequence
  Description of Artificial Sequence: Synthetic peptide
QESEIASTNPVGTEGYGVMASTLQPHGDI

SEQ ID NO: 147650 - protein, 33 aa, Artificial Sequence
  Description of Artificial Sequence: Synthetic polypeptide
HEMEIVTTNPVATEQYGTVCSATGPPVEFEGND

SEQ ID NO: 147651 - protein, 29 aa, Artificial Sequence
  Description of Artificial Sequence: Synthetic peptide
QESEIASTNPVGTEGYGVMASTLQQHGDH

SEQ ID NO: 147652 - protein, 29 aa, Artificial Sequence
  Description of Artificial Sequence: Synthetic peptide
QESEIASTNPVGTEGYGVMASTLQQHGDI

SEQ ID NO: 147653 - protein, 29 aa, Artificial Sequence
  Description of Artificial Sequence: Synthetic peptide
QESEIASTNPVGTEGYGVMASTLQQHGDW

SEQ ID NO: 147654 - protein, 29 aa, Artificial Sequence
  Description of Artificial Sequence: Synthetic peptide
QESEIASTNPVGTEGYGVMASTLQQNGDI

SEQ ID NO: 147655 - protein, 33 aa, Artificial Sequence
  Description of Artificial Sequence: Synthetic polypeptide
HEMEIVTTNPVATEQYGTVCSATRGPVEFEGND

SEQ ID NO: 147656 - protein, 30 aa, Artificial Sequence
  Description of Artificial Sequence: Synthetic polypeptide
QESEIASTNPVGTEGYGVMASTLQRHGDIY

SEQ ID NO: 147657 - protein, 37 aa, Artificial Sequence
  Description of Artificial Sequence: Synthetic polypeptide
AEEEIRTTNPVATEQYGVVVVVSTTTNLQQGTEQGDV

SEQ ID NO: 147658 - protein, 29 aa, Artificial Sequence
  Description of Artificial Sequence: Synthetic peptide
QESEIASTNPVGTEGYGVMASTLQKHGDI

SEQ ID NO: 147659 - protein, 29 aa, Artificial Sequence
  Description of Artificial Sequence: Synthetic peptide
QESEIASTNPVGTEGYGVMASTLQHGRDD

SEQ ID NO: 147660 - protein, 29 aa, Artificial Sequence
  Description of Artificial Sequence: Synthetic peptide
QESEIASTNPVGTEGYGVMASTLQKGDYI

SEQ ID NO: 147661 - protein, 29 aa, Artificial Sequence
  Description of Artificial Sequence: Synthetic peptide
QESEIASTNPVGTEGYGVMASTLQHYGDI

SEQ ID NO: 147662 - protein, 35 aa, Artificial Sequence
  Description of Artificial Sequence: Synthetic polypeptide
DEECISTTNPVAYEHYGQSTVAVTNETAQRVGPRG

SEQ ID NO: 147663 - protein, 36 aa, Artificial Sequence
  Description of Artificial Sequence: Synthetic polypeptide
AEEEIRTTNPVATESYGSVSTVNQNNNVEEGTNDQD

SEQ ID NO: 147664 - protein, 37 aa, Artificial Sequence
  Description of Artificial Sequence: Synthetic polypeptide
AEEEIRTTNPVATESYGSVSTVNNNELGNQQGTDGGQ

SEQ ID NO: 147665 - protein, 36 aa, Artificial Sequence
  Description of Artificial Sequence: Synthetic polypeptide
AEEEIRTTNPVATESYGSVSTTNGNNQAEATNNATE

SEQ ID NO: 147666 - protein, 32 aa, Artificial Sequence
  Description of Artificial Sequence: Synthetic polypeptide
DEECISTTNPVAYEQWGESYQVDNEDQPGDER

SEQ ID NO: 147667 - protein, 28 aa, Artificial Sequence
  Description of Artificial Sequence: Synthetic peptide
QESEIASTNPVGTEGYGVMASTLQHSDI

SEQ ID NO: 147668 - protein, 29 aa, Artificial Sequence
  Description of Artificial Sequence: Synthetic peptide
QESEIASTNPVGTEGYGVMASTLQHSGDI

SEQ ID NO: 147669 - protein, 33 aa, Artificial Sequence
  Description of Artificial Sequence: Synthetic polypeptide
DEECISTTNPVAYEQWGESYSVDNEMQGGDQRR

SEQ ID NO: 147670 - protein, 28 aa, Artificial Sequence
  Description of Artificial Sequence: Synthetic peptide
QESEIASTNPVGTEGYGVMASTLQHTDI

SEQ ID NO: 147671 - protein, 29 aa, Artificial Sequence
  Description of Artificial Sequence: Synthetic peptide
QESEIASTNPVGTEGYGVMASTLQHTGDI

SEQ ID NO: 147672 - protein, 28 aa, Artificial Sequence
  Description of Artificial Sequence: Synthetic peptide
QESEIASTNPVGTEGYGVMASTLQHVDI

SEQ ID NO: 147673 - protein, 28 aa, Artificial Sequence
  Description of Artificial Sequence: Synthetic peptide
QESEIASTNPVGTEGYGVMASTLQHVDS

SEQ ID NO: 147674 - protein, 29 aa, Artificial Sequence
  Description of Artificial Sequence: Synthetic peptide
QESEIASTNPVGTEGYGVMASTLQHVGDI

SEQ ID NO: 147675 - protein, 36 aa, Artificial Sequence
  Description of Artificial Sequence: Synthetic polypeptide
DEECIRTTNPVATEQIGSVSSTTPAGPNMRNGMNPV

SEQ ID NO: 147676 - protein, 29 aa, Artificial Sequence
  Description of Artificial Sequence: Synthetic peptide
QESEIASTNPVGTEGYGVMASTLQHVGHI

SEQ ID NO: 147677 - protein, 28 aa, Artificial Sequence
  Description of Artificial Sequence: Synthetic peptide
QESEIASTNPVGTEGYGVMASTLQHWDI

SEQ ID NO: 147678 - protein, 29 aa, Artificial Sequence
  Description of Artificial Sequence: Synthetic peptide
QESEIASTNPVGTEGYGVMASTLQHWGDI

SEQ ID NO: 147679 - protein, 28 aa, Artificial Sequence
  Description of Artificial Sequence: Synthetic peptide
QESEIASTNPVGTEGYGVMASTLQHYDI

SEQ ID NO: 147680 - protein, 29 aa, Artificial Sequence
  Description of Artificial Sequence: Synthetic peptide
QESEIASTNPVGTEGYGVMASTLQHYGDC

SEQ ID NO: 147681 - protein, 29 aa, Artificial Sequence
  Description of Artificial Sequence: Synthetic peptide
QESEIASTNPVGTEGYGVMASTLQIHGDI

SEQ ID NO: 147682 - protein, 34 aa, Artificial Sequence
  Description of Artificial Sequence: Synthetic polypeptide
EEAEIRTTNPVAYEQWGSVASGNLQGEDANGGSN

SEQ ID NO: 147683 - protein, 30 aa, Artificial Sequence
  Description of Artificial Sequence: Synthetic polypeptide
QESEIASTNPVGTEGYGVMASTLGQHRGDI

SEQ ID NO: 147684 - protein, 29 aa, Artificial Sequence
  Description of Artificial Sequence: Synthetic peptide
QESEIASTNPVGTEGYGVMASTLGQHGDI

SEQ ID NO: 147685 - protein, 29 aa, Artificial Sequence
  Description of Artificial Sequence: Synthetic peptide
QESEIASTNPVGTEGYGVIASTLQHGSDI

SEQ ID NO: 147686 - protein, 36 aa, Artificial Sequence
  Description of Artificial Sequence: Synthetic polypeptide
DEECIRTTNPVATEQYGCVCSTGEDNAENFGSDNQS

SEQ ID NO: 147687 - protein, 29 aa, Artificial Sequence
  Description of Artificial Sequence: Synthetic peptide
QESEIASTNPVGTEGYGVIMASTLQHGDI

SEQ ID NO: 147688 - protein, 30 aa, Artificial Sequence
  Description of Artificial Sequence: Synthetic polypeptide
QESEIASTNPVGTEGYGVIMASTLQHGDNI

SEQ ID NO: 147689 - protein, 29 aa, Artificial Sequence
  Description of Artificial Sequence: Synthetic peptide
QESEIASTNPVGTEGYGVIYSTLQHGLDI

SEQ ID NO: 147690 - protein, 29 aa, Artificial Sequence
  Description of Artificial Sequence: Synthetic peptide
QESEIASTNPVGTEGYGVLASDTLQHGDI

SEQ ID NO: 147691 - protein, 29 aa, Artificial Sequence
  Description of Artificial Sequence: Synthetic peptide
QESEIASTNPVGTEGYGVLASLTLQHGDI

SEQ ID NO: 147692 - protein, 36 aa, Artificial Sequence
  Description of Artificial Sequence: Synthetic polypeptide
DTTEIRTTNPVATEQYGSVSTTNNQNNQLQGDEEAE

SEQ ID NO: 147693 - protein, 29 aa, Artificial Sequence
  Description of Artificial Sequence: Synthetic peptide
QESEIASTNPVGTEGYGVIASTLQHGFIG

SEQ ID NO: 147694 - protein, 29 aa, Artificial Sequence
  Description of Artificial Sequence: Synthetic peptide
QESEIASTNPVGTEGYGVMAASTIQHGQR

SEQ ID NO: 147695 - protein, 29 aa, Artificial Sequence
  Description of Artificial Sequence: Synthetic peptide
QESEIASTNPVGTEGYGVMAASTLQHGDG

SEQ ID NO: 147696 - protein, 29 aa, Artificial Sequence
  Description of Artificial Sequence: Synthetic peptide
QESEIASTNPVGTEGYGVMAASTLQHGDI

SEQ ID NO: 147697 - protein, 28 aa, Artificial Sequence
  Description of Artificial Sequence: Synthetic peptide
QESEIASTNPVGTEGYGVMAATLQHGDI

SEQ ID NO: 147698 - protein, 29 aa, Artificial Sequence
  Description of Artificial Sequence: Synthetic peptide
QESEIASTNPVGTEGYGVMAATPLQHGDI

SEQ ID NO: 147699 - protein, 34 aa, Artificial Sequence
  Description of Artificial Sequence: Synthetic polypeptide
DEECIRTTNPVATEQYGCVCSTEEDQEFFSSDQS

SEQ ID NO: 147700 - protein, 29 aa, Artificial Sequence
  Description of Artificial Sequence: Synthetic peptide
QESEIASTNPVGTEGYGVMAATTLQHGEI

SEQ ID NO: 147701 - protein, 29 aa, Artificial Sequence
  Description of Artificial Sequence: Synthetic peptide
QESEIASTNPVGTEGYGVMACNEQRGEDI

SEQ ID NO: 147702 - protein, 31 aa, Artificial Sequence
  Description of Artificial Sequence: Synthetic polypeptide
AEEEIRTTNPVAYEHWGCACIDDDKQRGPNH

SEQ ID NO: 147703 - protein, 33 aa, Artificial Sequence
  Description of Artificial Sequence: Synthetic polypeptide
DTTAEIATTNPVAYEQYGSVATNGTTAEGGNEN

SEQ ID NO: 147704 - protein, 28 aa, Artificial Sequence
  Description of Artificial Sequence: Synthetic peptide
QESEIASTNPVGTEGYGVIASDLQHGDI

SEQ ID NO: 147705 - protein, 28 aa, Artificial Sequence
  Description of Artificial Sequence: Synthetic peptide
QESEIASTNPVGTEGYGVIAHTLQHGDI

SEQ ID NO: 147706 - protein, 29 aa, Artificial Sequence
  Description of Artificial Sequence: Synthetic peptide
QESEIASTNPVGTEGYGVHMASTLQDGDI

SEQ ID NO: 147707 - protein, 36 aa, Artificial Sequence
  Description of Artificial Sequence: Synthetic polypeptide
DTTEIRTTNPVATEQYGVVSTTNLQQQNQQGEEEAE

SEQ ID NO: 147708 - protein, 31 aa, Artificial Sequence
  Description of Artificial Sequence: Synthetic polypeptide
AEEEIRTTNPVAYEHWGTCFCIDDDQRGNAP

SEQ ID NO: 147709 - protein, 29 aa, Artificial Sequence
  Description of Artificial Sequence: Synthetic peptide
QESEIASTNPVGTEGYGVCASTLQHGDIN

SEQ ID NO: 147710 - protein, 35 aa, Artificial Sequence
  Description of Artificial Sequence: Synthetic polypeptide
FEEEIRTTNPVAYEQYGQHIVSQYVDLTQPGEERS

SEQ ID NO: 147711 - protein, 28 aa, Artificial Sequence
  Description of Artificial Sequence: Synthetic peptide
QESEIASTNPVGTEGYGVCASTLVHGDI

SEQ ID NO: 147712 - protein, 29 aa, Artificial Sequence
  Description of Artificial Sequence: Synthetic peptide
QESEIASTNPVGTEGYGVCMASTLQHGDI

SEQ ID NO: 147713 - protein, 31 aa, Artificial Sequence
  Description of Artificial Sequence: Synthetic polypeptide
QENEIATTNPVATEYYGCVCSWALQHFESEL

SEQ ID NO: 147714 - protein, 28 aa, Artificial Sequence
  Description of Artificial Sequence: Synthetic peptide
QESEIASTNPVGTEGYGVEASTMQHGDI

SEQ ID NO: 147715 - protein, 28 aa, Artificial Sequence
  Description of Artificial Sequence: Synthetic peptide
QESEIASTNPVGTEGYGVFASTLAHGDI

SEQ ID NO: 147716 - protein, 28 aa, Artificial Sequence
  Description of Artificial Sequence: Synthetic peptide
QESEIASTNPVGTEGYGVFASTLTHGDI

SEQ ID NO: 147717 - protein, 29 aa, Artificial Sequence
  Description of Artificial Sequence: Synthetic peptide
QESEIASTNPVGTEGYGVGASTLEQHGDI

SEQ ID NO: 147718 - protein, 36 aa, Artificial Sequence
  Description of Artificial Sequence: Synthetic polypeptide
DEECIRTTNPVATEQYGCVCSTGNDNQEFFNSDTQS

SEQ ID NO: 147719 - protein, 29 aa, Artificial Sequence
  Description of Artificial Sequence: Synthetic peptide
QESEIASTNPVGTEGYGVGASTLQHGMDI

SEQ ID NO: 147720 - protein, 29 aa, Artificial Sequence
  Description of Artificial Sequence: Synthetic peptide
QESEIASTNPVGTEGYGVGMASTLQHGDI

SEQ ID NO: 147721 - protein, 28 aa, Artificial Sequence
  Description of Artificial Sequence: Synthetic peptide
QESEIASTNPVGTEGYGVHASTLLHGDI

SEQ ID NO: 147722 - protein, 34 aa, Artificial Sequence
  Description of Artificial Sequence: Synthetic polypeptide
DEECIRTTNPVATEQYGCVCSTGEHQNFPSETQS

SEQ ID NO: 147723 - protein, 36 aa, Artificial Sequence
  Description of Artificial Sequence: Synthetic polypeptide
DEEEIRTTNPVATEQYGSVSDMENGVQMQETVEPED

SEQ ID NO: 147724 - protein, 29 aa, Artificial Sequence
  Description of Artificial Sequence: Synthetic peptide
QESEIASTNPVGTEGYGVHASTLQHGDIM

SEQ ID NO: 147725 - protein, 36 aa, Artificial Sequence
  Description of Artificial Sequence: Synthetic polypeptide
DEEEIHTTNPVATEFYGSVSSTTPAGPNMRNGMNPV

SEQ ID NO: 147726 - protein, 30 aa, Artificial Sequence
  Description of Artificial Sequence: Synthetic polypeptide
QESEIASTNPVGTEGYGVMACSTGLQHGDI

SEQ ID NO: 147727 - protein, 36 aa, Artificial Sequence
  Description of Artificial Sequence: Synthetic polypeptide
DEEEIRTTNPVATEQYGSVSIDQQGDGQDGEDTGDE

SEQ ID NO: 147728 - protein, 29 aa, Artificial Sequence
  Description of Artificial Sequence: Synthetic peptide
QESEIASTNPVGTEGYGVMACSTLQHGDI

SEQ ID NO: 147729 - protein, 29 aa, Artificial Sequence
  Description of Artificial Sequence: Synthetic peptide
QESEIASTNPVGTEGYGVMACTLQHGDNI

SEQ ID NO: 147730 - protein, 36 aa, Artificial Sequence
  Description of Artificial Sequence: Synthetic polypeptide
DTEEIRTTNPVATTQYGVVATQSGTNENQQGNNNDD

SEQ ID NO: 147731 - protein, 36 aa, Artificial Sequence
  Description of Artificial Sequence: Synthetic polypeptide
DTEEIRTTNPVATTQYGVVATQSGTNDNQQGNDEDE

SEQ ID NO: 147732 - protein, 36 aa, Artificial Sequence
  Description of Artificial Sequence: Synthetic polypeptide
DTEEIRTTNPVATTQYGTVATQSGTNNQQLGNDEDT

SEQ ID NO: 147733 - protein, 28 aa, Artificial Sequence
  Description of Artificial Sequence: Synthetic peptide
QESEIASTNPVGTEGYGVMAGTLQPGDI

SEQ ID NO: 147734 - protein, 29 aa, Artificial Sequence
  Description of Artificial Sequence: Synthetic peptide
QESEIASTNPVGTEGYGVMAHSTLQHGDI

SEQ ID NO: 147735 - protein, 28 aa, Artificial Sequence
  Description of Artificial Sequence: Synthetic peptide
QESEIASTNPVGTEGYGVMAHTLQHGDI

SEQ ID NO: 147736 - protein, 28 aa, Artificial Sequence
  Description of Artificial Sequence: Synthetic peptide
QESEIASTNPVGTEGYGVMAHTLQHGDW

SEQ ID NO: 147737 - protein, 29 aa, Artificial Sequence
  Description of Artificial Sequence: Synthetic peptide
QESEIASTNPVGTEGYGVMAISTLQHGDI

SEQ ID NO: 147738 - protein, 36 aa, Artificial Sequence
  Description of Artificial Sequence: Synthetic polypeptide
DTEEIRTTNPVATTQYGVVATQSGTNNNQQGTNQDD

SEQ ID NO: 147739 - protein, 28 aa, Artificial Sequence
  Description of Artificial Sequence: Synthetic peptide
QESEIASTNPVGTEGYGVMAITLQHGDI

SEQ ID NO: 147740 - protein, 29 aa, Artificial Sequence
  Description of Artificial Sequence: Synthetic peptide
QESEIASTNPVGTEGYGVMAKSTLQHGDI

SEQ ID NO: 147741 - protein, 28 aa, Artificial Sequence
  Description of Artificial Sequence: Synthetic peptide
QESEIASTNPVGTEGYGVMAKTLQHGDI

SEQ ID NO: 147742 - protein, 37 aa, Artificial Sequence
  Description of Artificial Sequence: Synthetic polypeptide
DEEEIRTTNPVATEQYGSVSISSMVAVENRVEIENRD

SEQ ID NO: 147743 - protein, 35 aa, Artificial Sequence
  Description of Artificial Sequence: Synthetic polypeptide
DEECIRTTNPVATEQWGSVVVNCISMGSDSRPGND

SEQ ID NO: 147744 - protein, 28 aa, Artificial Sequence
  Description of Artificial Sequence: Synthetic peptide
QESEIASTNPVGTEGYGVMAKTLQVGDI

SEQ ID NO: 147745 - protein, 28 aa, Artificial Sequence
  Description of Artificial Sequence: Synthetic peptide
QESEIASTNPVGTEGYGVMALTLQHGDI

SEQ ID NO: 147746 - protein, 32 aa, Artificial Sequence
  Description of Artificial Sequence: Synthetic polypeptide
AEMEIATTNPVATEQYGTACSTDGPVEFEGND

SEQ ID NO: 147747 - protein, 36 aa, Artificial Sequence
  Description of Artificial Sequence: Synthetic polypeptide
DEECIRTTNPVATEQWGSVVVNCINMGSDQRAGNDP

SEQ ID NO: 147748 - protein, 28 aa, Artificial Sequence
  Description of Artificial Sequence: Synthetic peptide
QESEIASTNPVGTEGYGVMAKILQHGDI

SEQ ID NO: 147749 - protein, 35 aa, Artificial Sequence
  Description of Artificial Sequence: Synthetic polypeptide
DTEEIRTTNPVATTQYGVVATQSGTNTEQGNNQDD

SEQ ID NO: 147750 - protein, 36 aa, Artificial Sequence
  Description of Artificial Sequence: Synthetic polypeptide
DTEEIRTTNPVAYEQYGSVRSTTIAGANMRNGMNPV

SEQ ID NO: 147751 - protein, 28 aa, Artificial Sequence
  Description of Artificial Sequence: Synthetic peptide
QESEIASTNPVGTEGYGVMAGTLQHGDI

SEQ ID NO: 147752 - protein, 30 aa, Artificial Sequence
  Description of Artificial Sequence: Synthetic polypeptide
DTNEIRTTNPVATEQWGDVSEIEMNAAEDA

SEQ ID NO: 147753 - protein, 34 aa, Artificial Sequence
  Description of Artificial Sequence: Synthetic polypeptide
DEECIRTTNPVATEQYGCVCSSEENIENFGSDQS

SEQ ID NO: 147754 - protein, 33 aa, Artificial Sequence
  Description of Artificial Sequence: Synthetic polypeptide
DTMEIVTTNPVATEQYGTVCSATDGPVEFEGND

SEQ ID NO: 147755 - protein, 29 aa, Artificial Sequence
  Description of Artificial Sequence: Synthetic peptide
QESEIASTNPVGTEGYGVMADSTLQHGDI

SEQ ID NO: 147756 - protein, 28 aa, Artificial Sequence
  Description of Artificial Sequence: Synthetic peptide
QESEIASTNPVGTEGYGVMADTLQHGDI

SEQ ID NO: 147757 - protein, 28 aa, Artificial Sequence
  Description of Artificial Sequence: Synthetic peptide
QESEIASTNPVGTEGYGVMADTLQHGPI

SEQ ID NO: 147758 - protein, 29 aa, Artificial Sequence
  Description of Artificial Sequence: Synthetic peptide
AEMEIACTNPCSYEQYGCVSWELQSGSEQ

SEQ ID NO: 147759 - protein, 32 aa, Artificial Sequence
  Description of Artificial Sequence: Synthetic polypeptide
AEMEIACTNPVATEQYGEVCSAENPVEFEGND

SEQ ID NO: 147760 - protein, 33 aa, Artificial Sequence
  Description of Artificial Sequence: Synthetic polypeptide
AEMEIACTNPVATEQYGEVCSATDNPVEFEGND

SEQ ID NO: 147761 - protein, 29 aa, Artificial Sequence
  Description of Artificial Sequence: Synthetic peptide
QESEIASTNPVGTEGYGVMAESTLQHGAI

SEQ ID NO: 147762 - protein, 31 aa, Artificial Sequence
  Description of Artificial Sequence: Synthetic polypeptide
AEMEIACTNPVATEQYGEVCSEDGLVEFGGD

SEQ ID NO: 147763 - protein, 29 aa, Artificial Sequence
  Description of Artificial Sequence: Synthetic peptide
QESEIASTNPVGTEGYGVMAESTLQHGDI

SEQ ID NO: 147764 - protein, 28 aa, Artificial Sequence
  Description of Artificial Sequence: Synthetic peptide
QESEIASTNPVGTEGYGVMAETLQHGDI

SEQ ID NO: 147765 - protein, 31 aa, Artificial Sequence
  Description of Artificial Sequence: Synthetic polypeptide
QENEIATTNPVATESYGCVSGEALQHFDELN

SEQ ID NO: 147766 - protein, 29 aa, Artificial Sequence
  Description of Artificial Sequence: Synthetic peptide
QESEIASTNPVGTEGYGVMAFSTLQHGDI

SEQ ID NO: 147767 - protein, 35 aa, Artificial Sequence
  Description of Artificial Sequence: Synthetic polypeptide
DEECIRTTNPVATEQYGCVCSNTGEPQENFGSDQS

SEQ ID NO: 147768 - protein, 35 aa, Artificial Sequence
  Description of Artificial Sequence: Synthetic polypeptide
DEECIRTTNPVATEQYGCVCSNTGEDQEFFGSDQS

SEQ ID NO: 147769 - protein, 28 aa, Artificial Sequence
  Description of Artificial Sequence: Synthetic peptide
QESEIASTNPVGTEGYGVMAFTLQHGDI

SEQ ID NO: 147770 - protein, 29 aa, Artificial Sequence
  Description of Artificial Sequence: Synthetic peptide
QESEIASTNPVGTEGYGVMAGSTLQHGDI

SEQ ID NO: 147771 - protein, 28 aa, Artificial Sequence
  Description of Artificial Sequence: Synthetic peptide
QESEIASTNPVGTEGYGVMACTLQHGDI

SEQ ID NO: 147772 - protein, 29 aa, Artificial Sequence
  Description of Artificial Sequence: Synthetic peptide
QESEIASTNPVGTEGYGVCASTLQHAGDI

SEQ ID NO: 147773 - protein, 35 aa, Artificial Sequence
  Description of Artificial Sequence: Synthetic polypeptide
DTTEIRTTNPVATEQYGVVSTTNQQNQQQGTEEDE

SEQ ID NO: 147774 - protein, 35 aa, Artificial Sequence
  Description of Artificial Sequence: Synthetic polypeptide
DTTEIRTTNPVATEQYGVVSTTNQQQGQQGTEEAE

SEQ ID NO: 147775 - protein, 36 aa, Artificial Sequence
  Description of Artificial Sequence: Synthetic polypeptide
DEEEIRTTNPVATEQYGSGYDNTGLEVVLMNEEERN

SEQ ID NO: 147776 - protein, 34 aa, Artificial Sequence
  Description of Artificial Sequence: Synthetic polypeptide
EDEEICTTNPVATEQYGVVSTTNNQQQLQTNDDE

SEQ ID NO: 147777 - protein, 36 aa, Artificial Sequence
  Description of Artificial Sequence: Synthetic polypeptide
EDEEICTTNPVATEQYGVVSTTNNQQLQQLGGNNAD

SEQ ID NO: 147778 - protein, 35 aa, Artificial Sequence
  Description of Artificial Sequence: Synthetic polypeptide
DEEEIHTTNPVATEYYGCTVHTVPELEIRATGNEQ

SEQ ID NO: 147779 - protein, 36 aa, Artificial Sequence
  Description of Artificial Sequence: Synthetic polypeptide
EDEEICTTNPVATEQYGVVSTTNNNLNQNDNGNNSD

SEQ ID NO: 147780 - protein, 35 aa, Artificial Sequence
  Description of Artificial Sequence: Synthetic polypeptide
EDEEICTTNPVATEQYGVVSTTNNLQQQLNQTNDD

SEQ ID NO: 147781 - protein, 34 aa, Artificial Sequence
  Description of Artificial Sequence: Synthetic polypeptide
DEECIRTTNPVATEQYGCVCSWGEHNINFGSDQS

SEQ ID NO: 147782 - protein, 35 aa, Artificial Sequence
  Description of Artificial Sequence: Synthetic polypeptide
AEEEIRTTNPVAYEQWGSYWSTINPNQDGENNQND

SEQ ID NO: 147783 - protein, 35 aa, Artificial Sequence
  Description of Artificial Sequence: Synthetic polypeptide
DEECIRTTNPVATEQYGCVCSWGEPNAYFGSNTQS

SEQ ID NO: 147784 - protein, 35 aa, Artificial Sequence
  Description of Artificial Sequence: Synthetic polypeptide
FEEEIRTTNPVATEQYGVVSVGVFNGQGGGQDDDT

SEQ ID NO: 147785 - protein, 34 aa, Artificial Sequence
  Description of Artificial Sequence: Synthetic polypeptide
DEECIRTTNPVATEQYGCVCSWGEHNDNFGSQQA

SEQ ID NO: 147786 - protein, 36 aa, Artificial Sequence
  Description of Artificial Sequence: Synthetic polypeptide
EDEEICTTNPVATEQYGVVSTTNNLNQNDNGNNGSE

SEQ ID NO: 147787 - protein, 35 aa, Artificial Sequence
  Description of Artificial Sequence: Synthetic polypeptide
DEEEIRTTNPVATEQYGSVSHLIIDGVQGMQEEEQ

SEQ ID NO: 147788 - protein, 34 aa, Artificial Sequence
  Description of Artificial Sequence: Synthetic polypeptide
FEEEIRTTNPVATEQYGVVTSVGMGQNVGGIGGT

SEQ ID NO: 147789 - protein, 34 aa, Artificial Sequence
  Description of Artificial Sequence: Synthetic polypeptide
EDEEICTTNPVATEQWGTVSTTTNNQQLEQGNNE

SEQ ID NO: 147790 - protein, 35 aa, Artificial Sequence
  Description of Artificial Sequence: Synthetic polypeptide
DEEEIRATNPVATEQWGSVSQGGLGDNPAGENDGN

SEQ ID NO: 147791 - protein, 30 aa, Artificial Sequence
  Description of Artificial Sequence: Synthetic polypeptide
QESEIASTNPVGTEGYGSVSASDLEHEGEI

SEQ ID NO: 147792 - protein, 30 aa, Artificial Sequence
  Description of Artificial Sequence: Synthetic polypeptide
QESEIASTNPVGTEGYGSVSASTLEHEGDI

SEQ ID NO: 147793 - protein, 30 aa, Artificial Sequence
  Description of Artificial Sequence: Synthetic polypeptide
QESEIASTNPVGTEGYGSMSASTLQHGDPV

SEQ ID NO: 147794 - protein, 35 aa, Artificial Sequence
  Description of Artificial Sequence: Synthetic polypeptide
DEECIRTTNPVATEQYGCVCSWGETNDENFGSDQS

SEQ ID NO: 147795 - protein, 37 aa, Artificial Sequence
  Description of Artificial Sequence: Synthetic polypeptide
DEEEIRTTNPVATEQYGSNVVTPNGPDEDQERNIQEA

SEQ ID NO: 147796 - protein, 34 aa, Artificial Sequence
  Description of Artificial Sequence: Synthetic polypeptide
DEECIRTTNPVATEQYGCVSPSDAGTPTGNEDQW

SEQ ID NO: 147797 - protein, 36 aa, Artificial Sequence
  Description of Artificial Sequence: Synthetic polypeptide
DEEEIRTTNPVATEQYGSVSDNPWNCAVQFEESIQD

SEQ ID NO: 147798 - protein, 34 aa, Artificial Sequence
  Description of Artificial Sequence: Synthetic polypeptide
EEAEIRTTNPVAYEQWGAYTISPNEGDQNRAGNR

SEQ ID NO: 147799 - protein, 33 aa, Artificial Sequence
  Description of Artificial Sequence: Synthetic polypeptide
EEAEIRTTNPVAYEEWGSVATNLNGNAGEEGNQ

SEQ ID NO: 147800 - protein, 33 aa, Artificial Sequence
  Description of Artificial Sequence: Synthetic polypeptide
EEAEIQCTNPVAYEAYGSVVQSANEQDRGGNNV

SEQ ID NO: 147801 - protein, 34 aa, Artificial Sequence
  Description of Artificial Sequence: Synthetic polypeptide
FEEEIRTTNPVATEQYGVVDLGQTNQGEGGEGGG

SEQ ID NO: 147802 - protein, 30 aa, Artificial Sequence
  Description of Artificial Sequence: Synthetic polypeptide
QESEIASTNPVGTEGYGRVMASTLQHGQDI

SEQ ID NO: 147803 - protein, 32 aa, Artificial Sequence
  Description of Artificial Sequence: Synthetic polypeptide
EEAEIATTNPVAYEQWGYTISPNEGDQRTGNK

SEQ ID NO: 147804 - protein, 33 aa, Artificial Sequence
  Description of Artificial Sequence: Synthetic polypeptide
EEAEIATTNPVAYEQWGSVCSTMDNDNGGDRRE

SEQ ID NO: 147805 - protein, 34 aa, Artificial Sequence
  Description of Artificial Sequence: Synthetic polypeptide
FEEEIRTTNPVATEQYGVVDNGGQIGEGGGNGIS

SEQ ID NO: 147806 - protein, 34 aa, Artificial Sequence
  Description of Artificial Sequence: Synthetic polypeptide
EDETICTTNPVATTQYGSVSTTQQALQQGTNQQQ

SEQ ID NO: 147807 - protein, 35 aa, Artificial Sequence
  Description of Artificial Sequence: Synthetic polypeptide
FEEEIRTTNPVATEQYGVVGSTLGSGQGEGEGEET

SEQ ID NO: 147808 - protein, 33 aa, Artificial Sequence
  Description of Artificial Sequence: Synthetic polypeptide
FEEEIRTTNPVATEQYGVVMGINDNEGGDDEEE

SEQ ID NO: 147809 - protein, 35 aa, Artificial Sequence
  Description of Artificial Sequence: Synthetic polypeptide
EDETICTTNPVATTQYGSVSTTNQQLLQQGTNQQG

SEQ ID NO: 147810 - protein, 30 aa, Artificial Sequence
  Description of Artificial Sequence: Synthetic polypeptide
QESEIASTNPVGTEGYGRVMVASTLQHGDI

SEQ ID NO: 147811 - protein, 29 aa, Artificial Sequence
  Description of Artificial Sequence: Synthetic peptide
QESEIASTNPVGTEGYGSMACTLQHGEDI

SEQ ID NO: 147812 - protein, 29 aa, Artificial Sequence
  Description of Artificial Sequence: Synthetic peptide
QENEIATTNPVAYECWGNVSEQLQHEDEE

SEQ ID NO: 147813 - protein, 30 aa, Artificial Sequence
  Description of Artificial Sequence: Synthetic polypeptide
QENEIATTNPVAYEAYGKVSCEDLSQHEEL

SEQ ID NO: 147814 - protein, 30 aa, Artificial Sequence
  Description of Artificial Sequence: Synthetic polypeptide
QESEIASTNPVGTEGYGSMASTLPQHGEDI

SEQ ID NO: 147815 - protein, 36 aa, Artificial Sequence
  Description of Artificial Sequence: Synthetic polypeptide
EDEEICTTNPVATEQYGVVSTVVNDQQLQQGNNTDE

SEQ ID NO: 147816 - protein, 34 aa, Artificial Sequence
  Description of Artificial Sequence: Synthetic polypeptide
EDEEICTTNPVATEQWGTVSTTNNQQLEQGNNVE

SEQ ID NO: 147817 - protein, 29 aa, Artificial Sequence
  Description of Artificial Sequence: Synthetic peptide
QESEIASTNPVGTEGYGTMASETLQHGDI

SEQ ID NO: 147818 - protein, 34 aa, Artificial Sequence
  Description of Artificial Sequence: Synthetic polypeptide
EDEEICTTNPVATEQWGTVSTTNLQQNEQGTDED

SEQ ID NO: 147819 - protein, 35 aa, Artificial Sequence
  Description of Artificial Sequence: Synthetic polypeptide
FEEEIRTTNPVATEQYGVVVQTGGQIGQGGGNNSE

SEQ ID NO: 147820 - protein, 30 aa, Artificial Sequence
  Description of Artificial Sequence: Synthetic polypeptide
QESEIASTNPVGTEGYGVAASTMLQHGGDI

SEQ ID NO: 147821 - protein, 33 aa, Artificial Sequence
  Description of Artificial Sequence: Synthetic polypeptide
DVSEIRVTNPVATEPWGSVSCINEPKDREGENI

SEQ ID NO: 147822 - protein, 28 aa, Artificial Sequence
  Description of Artificial Sequence: Synthetic peptide
QESEIASTNPVGTEGYGVAASVLQHGDI

SEQ ID NO: 147823 - protein, 28 aa, Artificial Sequence
  Description of Artificial Sequence: Synthetic peptide
QESEIASTNPVGTEGYGVAASVLQHGEI

SEQ ID NO: 147824 - protein, 35 aa, Artificial Sequence
  Description of Artificial Sequence: Synthetic polypeptide
FEEEIRTTNPVATESYGSVSVTGEGGGQGEEENGL

SEQ ID NO: 147825 - protein, 29 aa, Artificial Sequence
  Description of Artificial Sequence: Synthetic peptide
QESEIASTNPVGTEGYGVAMASTLQHGDD

SEQ ID NO: 147826 - protein, 29 aa, Artificial Sequence
  Description of Artificial Sequence: Synthetic peptide
QESEIASTNPVGTEGYGVAMASTLQHGDI

SEQ ID NO: 147827 - protein, 36 aa, Artificial Sequence
  Description of Artificial Sequence: Synthetic polypeptide
FEEEIRTTNPVATESYGSVVDGTNMNQEEMGGANGD

SEQ ID NO: 147828 - protein, 29 aa, Artificial Sequence
  Description of Artificial Sequence: Synthetic peptide
QESEIASTNPVGTEGYGVAYSTLQHAGDI

SEQ ID NO: 147829 - protein, 34 aa, Artificial Sequence
  Description of Artificial Sequence: Synthetic polypeptide
FEEEIRTTNPVATEVYGSVDGQGNQGQGEGEDEG

SEQ ID NO: 147830 - protein, 29 aa, Artificial Sequence
  Description of Artificial Sequence: Synthetic peptide
QESEIASTNPVGTEGYGVCAHSTLQHGDI

SEQ ID NO: 147831 - protein, 35 aa, Artificial Sequence
  Description of Artificial Sequence: Synthetic polypeptide
DEEEIRTTNPVATEQYGSVSIDPVGLIETMVQTVD

SEQ ID NO: 147832 - protein, 36 aa, Artificial Sequence
  Description of Artificial Sequence: Synthetic polypeptide
DTTEIRTTNPVATEQYGVVSVVVTNQNQQAGNDEQS

SEQ ID NO: 147833 - protein, 28 aa, Artificial Sequence
  Description of Artificial Sequence: Synthetic peptide
QESEIASTNPVGTEGYGVCASGLQHGDW

SEQ ID NO: 147834 - protein, 28 aa, Artificial Sequence
  Description of Artificial Sequence: Synthetic peptide
QESEIASTNPVGTEGYGVCASKLQHGDI

SEQ ID NO: 147835 - protein, 36 aa, Artificial Sequence
  Description of Artificial Sequence: Synthetic polypeptide
DTTEIRTTNPVATEQYGVVSVTTNQQLQQQGTEEAE

SEQ ID NO: 147836 - protein, 29 aa, Artificial Sequence
  Description of Artificial Sequence: Synthetic peptide
QESEIASTNPVGTEGYGVCASMTLQHGDI

SEQ ID NO: 147837 - protein, 29 aa, Artificial Sequence
  Description of Artificial Sequence: Synthetic peptide
QESEIASTNPVGTEGYGVCASTLDQHGDK

SEQ ID NO: 147838 - protein, 36 aa, Artificial Sequence
  Description of Artificial Sequence: Synthetic polypeptide
DTTEIRTTNPVATEQYGVVSTTNQQQLQLQGTEEDE

SEQ ID NO: 147839 - protein, 35 aa, Artificial Sequence
  Description of Artificial Sequence: Synthetic polypeptide
AEEEIRTTNPVAYEQWGSYWSTINPNDQGDEGNND

SEQ ID NO: 147840 - protein, 36 aa, Artificial Sequence
  Description of Artificial Sequence: Synthetic polypeptide
DTEEIRTTNPVATTQYGSVATQSGTTTNQQGNTDDE

SEQ ID NO: 147841 - protein, 33 aa, Artificial Sequence
  Description of Artificial Sequence: Synthetic polypeptide
EAAEIATTNPVAYEQWGSVCTENKLDDLGNMDR

SEQ ID NO: 147842 - protein, 28 aa, Artificial Sequence
  Description of Artificial Sequence: Synthetic peptide
QESEIASTNPVGTEGYGVAASSLQHGDI

SEQ ID NO: 147843 - protein, 34 aa, Artificial Sequence
  Description of Artificial Sequence: Synthetic polypeptide
EDEEICTTNPVATEQWGTVSTTNLNNDEQGTNTE

SEQ ID NO: 147844 - protein, 34 aa, Artificial Sequence
  Description of Artificial Sequence: Synthetic polypeptide
EDEEICTTNPVATEQWGTVSTTNLNNDEQGTNAE

SEQ ID NO: 147845 - protein, 29 aa, Artificial Sequence
  Description of Artificial Sequence: Synthetic peptide
QESEIASTNPVGTEGYGTMASTLQHNGDI

SEQ ID NO: 147846 - protein, 29 aa, Artificial Sequence
  Description of Artificial Sequence: Synthetic peptide
QESEIASTNPVGTEGYGTMASTLQQHGDH

SEQ ID NO: 147847 - protein, 33 aa, Artificial Sequence
  Description of Artificial Sequence: Synthetic polypeptide
FEEEIRTTNPVATEQYGVVVSIEGMGGDEEEGA

SEQ ID NO: 147848 - protein, 34 aa, Artificial Sequence
  Description of Artificial Sequence: Synthetic polypeptide
DEECIRTTNPVATEQYGCVCSWEHNAYFGSQTQS

SEQ ID NO: 147849 - protein, 29 aa, Artificial Sequence
  Description of Artificial Sequence: Synthetic peptide
QESEIASTNPVGTEGYGTMMASTLQHGDI

SEQ ID NO: 147850 - protein, 34 aa, Artificial Sequence
  Description of Artificial Sequence: Synthetic polypeptide
DEEEIRATNPVATEQWGSVYHWENDHQKTDGHEN

SEQ ID NO: 147851 - protein, 30 aa, Artificial Sequence
  Description of Artificial Sequence: Synthetic polypeptide
QESEIASTNPVGTEGYGTVCATTLEFEGNI

SEQ ID NO: 147852 - protein, 35 aa, Artificial Sequence
  Description of Artificial Sequence: Synthetic polypeptide
AEEEIRTTNPVAYEQWGSYWSTINPNNQPDEGRND

SEQ ID NO: 147853 - protein, 32 aa, Artificial Sequence
  Description of Artificial Sequence: Synthetic polypeptide
EATEIRTTNPVAYEQWGEVSTNLPGMEGGGMP

SEQ ID NO: 147854 - protein, 30 aa, Artificial Sequence
  Description of Artificial Sequence: Synthetic polypeptide
QESEIASTNPVGTEGYGTVMASTLQHGSDI

SEQ ID NO: 147855 - protein, 35 aa, Artificial Sequence
  Description of Artificial Sequence: Synthetic polypeptide
EATEIATTNPVATENYGCVSTSNGLNDDERGGNHR

SEQ ID NO: 147856 - protein, 32 aa, Artificial Sequence
  Description of Artificial Sequence: Synthetic polypeptide
EAHEIATTNPVAYEQYGSVATNGQTRNPDPLT

SEQ ID NO: 147857 - protein, 35 aa, Artificial Sequence
  Description of Artificial Sequence: Synthetic polypeptide
DEEEIRATNPVATEQYGAVMGNLVGGNGQTNNQGN

SEQ ID NO: 147858 - protein, 35 aa, Artificial Sequence
  Description of Artificial Sequence: Synthetic polypeptide
EAEEIATTNPVATTQWGSVAWTENNDQDQRGMNHR

SEQ ID NO: 147859 - protein, 32 aa, Artificial Sequence
  Description of Artificial Sequence: Synthetic polypeptide
EACEIATTNPVAYEQWGEVSTNLQGMQGGGAP

SEQ ID NO: 147860 - protein, 32 aa, Artificial Sequence
  Description of Artificial Sequence: Synthetic polypeptide
EACEIATTNPVAYEQWGEVSTNLNGDQDGGMP

SEQ ID NO: 147861 - protein, 31 aa, Artificial Sequence
  Description of Artificial Sequence: Synthetic polypeptide
EACEIATTNPVAYEGWGEVSTNLGGMQGGMP

SEQ ID NO: 147862 - protein, 34 aa, Artificial Sequence
  Description of Artificial Sequence: Synthetic polypeptide
AEEEIRTTNPVAYEQWGSYWSTINPNMDEGMQND

SEQ ID NO: 147863 - protein, 37 aa, Artificial Sequence
  Description of Artificial Sequence: Synthetic polypeptide
DTEEIRTTNPVATEQYGVVSTVNNQNGNQQEGTNQVT

SEQ ID NO: 147864 - protein, 29 aa, Artificial Sequence
  Description of Artificial Sequence: Synthetic peptide
QESEIASTNPVGTEGYGVMAMSTLQHGDI

SEQ ID NO: 147865 - protein, 30 aa, Artificial Sequence
  Description of Artificial Sequence: Synthetic polypeptide
QESEIASTNPVGTEGYGVMAMSTSLQHGDI

SEQ ID NO: 147866 - protein, 30 aa, Artificial Sequence
  Description of Artificial Sequence: Synthetic polypeptide
QENEIATTNPVATESYGCVAGEALQHEEMD

SEQ ID NO: 147867 - protein, 28 aa, Artificial Sequence
  Description of Artificial Sequence: Synthetic peptide
QESEIASTNPVGTEGYGVMASTAQHGDI

SEQ ID NO: 147868 - protein, 30 aa, Artificial Sequence
  Description of Artificial Sequence: Synthetic polypeptide
QESEIASTNPVGTEGYGVMASTCLQHGDIG

SEQ ID NO: 147869 - protein, 30 aa, Artificial Sequence
  Description of Artificial Sequence: Synthetic polypeptide
QENEIATTNPVATESWGTVSEALPQHEEEL

SEQ ID NO: 147870 - protein, 29 aa, Artificial Sequence
  Description of Artificial Sequence: Synthetic peptide
QESEIASTNPVGTEGYGVMASTCMQHGDI

SEQ ID NO: 147871 - protein, 28 aa, Artificial Sequence
  Description of Artificial Sequence: Synthetic peptide
QESEIASTNPVGTEGYGVMASTCQHGDI

SEQ ID NO: 147872 - protein, 29 aa, Artificial Sequence
  Description of Artificial Sequence: Synthetic peptide
QESEIASTNPVGTEGYGVMASTDIQHGDI

SEQ ID NO: 147873 - protein, 34 aa, Artificial Sequence
  Description of Artificial Sequence: Synthetic polypeptide
GEEEIATTNPVATEQYGVVPCWDNHGQDRQGQDA

SEQ ID NO: 147874 - protein, 30 aa, Artificial Sequence
  Description of Artificial Sequence: Synthetic polypeptide
QESEIASTNPVGTEGYGVMASSTPLQHGDI

SEQ ID NO: 147875 - protein, 28 aa, Artificial Sequence
  Description of Artificial Sequence: Synthetic peptide
GEEEIATTNPVAYEQWGEAYYVEQGEEG

SEQ ID NO: 147876 - protein, 36 aa, Artificial Sequence
  Description of Artificial Sequence: Synthetic polypeptide
AEEEIRTTNPVATESYGVVSTVTNNNLNEQQGTDGG

SEQ ID NO: 147877 - protein, 37 aa, Artificial Sequence
  Description of Artificial Sequence: Synthetic polypeptide
DTEEIRTTNPVATEQYGVVSTVTNGNQQQGTNNATNE

SEQ ID NO: 147878 - protein, 37 aa, Artificial Sequence
  Description of Artificial Sequence: Synthetic polypeptide
DTEEIRTTNPVATEQYGVVSTVTNDQQGNNQQNGTNE

SEQ ID NO: 147879 - protein, 37 aa, Artificial Sequence
  Description of Artificial Sequence: Synthetic polypeptide
DTEEIRTTNPVATEQYGVVSTVSNTNQQQATNNATNE

SEQ ID NO: 147880 - protein, 28 aa, Artificial Sequence
  Description of Artificial Sequence: Synthetic peptide
QESEIASTNPVGTEGYGVMASTDQHGDI

SEQ ID NO: 147881 - protein, 29 aa, Artificial Sequence
  Description of Artificial Sequence: Synthetic peptide
QESEIASTNPVGTEGYGVMASTEHQHGDI

SEQ ID NO: 147882 - protein, 38 aa, Artificial Sequence
  Description of Artificial Sequence: Synthetic polypeptide
DEEEIRTTNPVATEQYGSQVSSTTPAGPNMRNGMNPVP

SEQ ID NO: 147883 - protein, 29 aa, Artificial Sequence
  Description of Artificial Sequence: Synthetic peptide
QESEIASTNPVGTEGYGVMASTEPQHGDI

SEQ ID NO: 147884 - protein, 35 aa, Artificial Sequence
  Description of Artificial Sequence: Synthetic polypeptide
AEEEIRTTNPVATESYGVVSTVVSNNNVEEGSNQM

SEQ ID NO: 147885 - protein, 29 aa, Artificial Sequence
  Description of Artificial Sequence: Synthetic peptide
QESEIASTNPVGTEGYGVMASSTLQKGDI

SEQ ID NO: 147886 - protein, 36 aa, Artificial Sequence
  Description of Artificial Sequence: Synthetic polypeptide
DEEEIRTTNPVATEQYGSVSITGQLDLPSESVLEVQ

SEQ ID NO: 147887 - protein, 29 aa, Artificial Sequence
  Description of Artificial Sequence: Synthetic peptide
QESEIASTNPVGTEGYGVMASSTLQHGHI

SEQ ID NO: 147888 - protein, 32 aa, Artificial Sequence
  Description of Artificial Sequence: Synthetic polypeptide
GDQEIATTNPVATEHYGSVSATDLEGHEGEDL

SEQ ID NO: 147889 - protein, 34 aa, Artificial Sequence
  Description of Artificial Sequence: Synthetic polypeptide
DEECIRTTNPVATEQWGCVCQTNEHNQGFNSQQS

SEQ ID NO: 147890 - protein, 29 aa, Artificial Sequence
  Description of Artificial Sequence: Synthetic peptide
QESEIASTNPVGTEGYGVMASNLQTHGDI

SEQ ID NO: 147891 - protein, 31 aa, Artificial Sequence
  Description of Artificial Sequence: Synthetic polypeptide
QENEIATTNPVATESYGCVSEALGQHEEELH

SEQ ID NO: 147892 - protein, 29 aa, Artificial Sequence
  Description of Artificial Sequence: Synthetic peptide
QESEIASTNPVGTEGYGVMASNTLQGGDI

SEQ ID NO: 147893 - protein, 29 aa, Artificial Sequence
  Description of Artificial Sequence: Synthetic peptide
QESEIASTNPVGTEGYGVMASNTLQHGDI

SEQ ID NO: 147894 - protein, 28 aa, Artificial Sequence
  Description of Artificial Sequence: Synthetic peptide
QESEIASTNPVGTEGYGVMASPLQHGDI

SEQ ID NO: 147895 - protein, 29 aa, Artificial Sequence
  Description of Artificial Sequence: Synthetic peptide
QESEIASTNPVGTEGYGVMASPSLQHGDI

SEQ ID NO: 147896 - protein, 29 aa, Artificial Sequence
  Description of Artificial Sequence: Synthetic peptide
QESEIASTNPVGTEGYGVMASPTLQHGDI

SEQ ID NO: 147897 - protein, 29 aa, Artificial Sequence
  Description of Artificial Sequence: Synthetic peptide
QESEIASTNPVGTEGYGVMASPTLQHGDV

SEQ ID NO: 147898 - protein, 28 aa, Artificial Sequence
  Description of Artificial Sequence: Synthetic peptide
QESEIASTNPVGTEGYGVMASQLQHGDI

SEQ ID NO: 147899 - protein, 28 aa, Artificial Sequence
  Description of Artificial Sequence: Synthetic peptide
QESEIASTNPVGTEGYGVMASQLQYGDI

SEQ ID NO: 147900 - protein, 29 aa, Artificial Sequence
  Description of Artificial Sequence: Synthetic peptide
QESEIASTNPVGTEGYGVMASQTLQHGDI

SEQ ID NO: 147901 - protein, 28 aa, Artificial Sequence
  Description of Artificial Sequence: Synthetic peptide
QESEIASTNPVGTEGYGVMASRLQHGDI

SEQ ID NO: 147902 - protein, 36 aa, Artificial Sequence
  Description of Artificial Sequence: Synthetic polypeptide
AEEEIRTTNPVATESYGVVSTVVSTNGTEQGNNQQQ

SEQ ID NO: 147903 - protein, 29 aa, Artificial Sequence
  Description of Artificial Sequence: Synthetic peptide
QESEIASTNPVGTEGYGVMASRTLQHGDI

SEQ ID NO: 147904 - protein, 28 aa, Artificial Sequence
  Description of Artificial Sequence: Synthetic peptide
QESEIASTNPVGTEGYGVMASSLQHGDI

SEQ ID NO: 147905 - protein, 29 aa, Artificial Sequence
  Description of Artificial Sequence: Synthetic peptide
QESEIASTNPVGTEGYGVMASSTLQHGDI

SEQ ID NO: 147906 - protein, 30 aa, Artificial Sequence
  Description of Artificial Sequence: Synthetic polypeptide
QESEIASTNPVGTEGYGVMASSTLQHGDNI

SEQ ID NO: 147907 - protein, 37 aa, Artificial Sequence
  Description of Artificial Sequence: Synthetic polypeptide
DTEEIRTTNPVATEQYGVVSTVSNNQQQGNNNNQNED

SEQ ID NO: 147908 - protein, 29 aa, Artificial Sequence
  Description of Artificial Sequence: Synthetic peptide
QESEIASTNPVGTEGYGVMASNLQQHGDI

SEQ ID NO: 147909 - protein, 28 aa, Artificial Sequence
  Description of Artificial Sequence: Synthetic peptide
QESEIASTNPVGTEGYGVMASTEQHGDA

SEQ ID NO: 147910 - protein, 29 aa, Artificial Sequence
  Description of Artificial Sequence: Synthetic peptide
QESEIASTNPVGTEGYGVMASTEQRGEDI

SEQ ID NO: 147911 - protein, 37 aa, Artificial Sequence
  Description of Artificial Sequence: Synthetic polypeptide
DTEEIRTTNPVATEQYGVVSTVNQNGNNQQGNTNNQT

SEQ ID NO: 147912 - protein, 28 aa, Artificial Sequence
  Description of Artificial Sequence: Synthetic peptide
QESEIASTNPVGTEGYGVMASTLAHGDI

SEQ ID NO: 147913 - protein, 29 aa, Artificial Sequence
  Description of Artificial Sequence: Synthetic peptide
QESEIASTNPVGTEGYGVMASTLAQHGDI

SEQ ID NO: 147914 - protein, 29 aa, Artificial Sequence
  Description of Artificial Sequence: Synthetic peptide
QESEIASTNPVGTEGYGVMASTLAQHGDL

SEQ ID NO: 147915 - protein, 28 aa, Artificial Sequence
  Description of Artificial Sequence: Synthetic peptide
QESEIASTNPVGTEGYGVMASTLDHGDI

SEQ ID NO: 147916 - protein, 38 aa, Artificial Sequence
  Description of Artificial Sequence: Synthetic polypeptide
DTEEIRTTNPVATEQYGVVSTVNQLQNNTTEQGSTNAD

SEQ ID NO: 147917 - protein, 38 aa, Artificial Sequence
  Description of Artificial Sequence: Synthetic polypeptide
DEEEIRTTNPVATEQYGSQVSSTTPAWGPNMRNGMNPV

SEQ ID NO: 147918 - protein, 28 aa, Artificial Sequence
  Description of Artificial Sequence: Synthetic peptide
QESEIASTNPVGTEGYGVMASTLDHGDY

SEQ ID NO: 147919 - protein, 28 aa, Artificial Sequence
  Description of Artificial Sequence: Synthetic peptide
QESEIASTNPVGTEGYGVMASTKQHGDI

SEQ ID NO: 147920 - protein, 29 aa, Artificial Sequence
  Description of Artificial Sequence: Synthetic peptide
QESEIASTNPVGTEGYGVMASTLDQHGDI

SEQ ID NO: 147921 - protein, 29 aa, Artificial Sequence
  Description of Artificial Sequence: Synthetic peptide
QESEIASTNPVGTEGYGVMASTLEQHGDI

SEQ ID NO: 147922 - protein, 28 aa, Artificial Sequence
  Description of Artificial Sequence: Synthetic peptide
QESEIASTNPVGTEGYGVMASTLFHGDI

SEQ ID NO: 147923 - protein, 29 aa, Artificial Sequence
  Description of Artificial Sequence: Synthetic peptide
QESEIASTNPVGTEGYGVMASTLFQHGDI

SEQ ID NO: 147924 - protein, 28 aa, Artificial Sequence
  Description of Artificial Sequence: Synthetic peptide
QESEIASTNPVGTEGYGVMASTLGHGDI

SEQ ID NO: 147925 - protein, 36 aa, Artificial Sequence
  Description of Artificial Sequence: Synthetic polypeptide
DTEEIRTTNPVATEQYGVVSTVNNQQQQNNNDTNQD

SEQ ID NO: 147926 - protein, 37 aa, Artificial Sequence
  Description of Artificial Sequence: Synthetic polypeptide
DTEEIRTTNPVATEQYGVVSTVNNQQNQTEQGTTNAD

SEQ ID NO: 147927 - protein, 37 aa, Artificial Sequence
  Description of Artificial Sequence: Synthetic polypeptide
DTEEIRTTNPVATEQYGVVSTVNNQNNTTEQGSTNAD

SEQ ID NO: 147928 - protein, 28 aa, Artificial Sequence
  Description of Artificial Sequence: Synthetic peptide
QESEIASTNPVGTEGYGVMASTLGHGDV

SEQ ID NO: 147929 - protein, 28 aa, Artificial Sequence
  Description of Artificial Sequence: Synthetic peptide
QESEIASTNPVGTEGYGVMASTLEHGDI

SEQ ID NO: 147930 - protein, 36 aa, Artificial Sequence
  Description of Artificial Sequence: Synthetic polypeptide
DEEEIRTTNPVATEQYGSVSCVGDSLNQPNSQIDEQ

SEQ ID NO: 147931 - protein, 37 aa, Artificial Sequence
  Description of Artificial Sequence: Synthetic polypeptide
DTEEIRTTNPVATEQYGVVSTVNQQQGTNQQGNQEED

SEQ ID NO: 147932 - protein, 37 aa, Artificial Sequence
  Description of Artificial Sequence: Synthetic polypeptide
DTEEIRTTNPVATEQYGVVSTVNQQQIGTEQGSTNTD

SEQ ID NO: 147933 - protein, 36 aa, Artificial Sequence
  Description of Artificial Sequence: Synthetic polypeptide
AEEEIRTTNPVATESYGTVSTVTNNQAGNNSTGNTE

SEQ ID NO: 147934 - protein, 29 aa, Artificial Sequence
  Description of Artificial Sequence: Synthetic peptide
QESEIASTNPVGTEGYGVMASTFLQHTDI

SEQ ID NO: 147935 - protein, 28 aa, Artificial Sequence
  Description of Artificial Sequence: Synthetic peptide
QESEIASTNPVGTEGYGVMASTFQHGDI

SEQ ID NO: 147936 - protein, 28 aa, Artificial Sequence
  Description of Artificial Sequence: Synthetic peptide
QESEIASTNPVGTEGYGVMASTFQHGEI

SEQ ID NO: 147937 - protein, 36 aa, Artificial Sequence
  Description of Artificial Sequence: Synthetic polypeptide
DEEEIRTTNPVATEQYGSVSCVVDDLNQPNSQEVEQ

SEQ ID NO: 147938 - protein, 36 aa, Artificial Sequence
  Description of Artificial Sequence: Synthetic polypeptide
DEEEIRTTNPVATEQYGSVSCVVDDLNQPNFSQIEQ

SEQ ID NO: 147939 - protein, 28 aa, Artificial Sequence
  Description of Artificial Sequence: Synthetic peptide
QESEIASTNPVGTEGYGVMASTGQHGDI

SEQ ID NO: 147940 - protein, 35 aa, Artificial Sequence
  Description of Artificial Sequence: Synthetic polypeptide
AEEEIRTTNPVATESYGTVSTTNQAGNNSTGNTED

SEQ ID NO: 147941 - protein, 30 aa, Artificial Sequence
  Description of Artificial Sequence: Synthetic polypeptide
QESEIASTNPVGTEGYGVMASTHLQHGDIE

SEQ ID NO: 147942 - protein, 30 aa, Artificial Sequence
  Description of Artificial Sequence: Synthetic polypeptide
QESEIASTNPVGTEGYGVMASTHLQQHGDI

SEQ ID NO: 147943 - protein, 37 aa, Artificial Sequence
  Description of Artificial Sequence: Synthetic polypeptide
DTEEIRTTNPVATEQYGVVSTVNTQQNTTEQGSTNVD

SEQ ID NO: 147944 - protein, 30 aa, Artificial Sequence
  Description of Artificial Sequence: Synthetic polypeptide
QESEIASTNPVGTEGYGVMASTHLYQHGDI

SEQ ID NO: 147945 - protein, 37 aa, Artificial Sequence
  Description of Artificial Sequence: Synthetic polypeptide
DTEEIRTTNPVATEQYGVVSTVNTNQEQGNTTEQGTE

SEQ ID NO: 147946 - protein, 37 aa, Artificial Sequence
  Description of Artificial Sequence: Synthetic polypeptide
DTEEIRTTNPVATEQYGVVSTVNQQQNTVEQGSTNAE

SEQ ID NO: 147947 - protein, 37 aa, Artificial Sequence
  Description of Artificial Sequence: Synthetic polypeptide
DTEEIRTTNPVATEQYGVVSTVNQQQNTTEQGSTNGD

SEQ ID NO: 147948 - protein, 28 aa, Artificial Sequence
  Description of Artificial Sequence: Synthetic peptide
QESEIASTNPVGTEGYGVMASTHQHGDI

SEQ ID NO: 147949 - protein, 30 aa, Artificial Sequence
  Description of Artificial Sequence: Synthetic polypeptide
QESEIASTNPVGTEGYGVMASTILQHGDGI

SEQ ID NO: 147950 - protein, 28 aa, Artificial Sequence
  Description of Artificial Sequence: Synthetic peptide
QESEIASTNPVGTEGYGVMASTIQHGDI

SEQ ID NO: 147951 - protein, 37 aa, Artificial Sequence
  Description of Artificial Sequence: Synthetic polypeptide
DTEEIRTTNPVATEQYGVVSTVNQQQNTNEQGTTNAD

SEQ ID NO: 147952 - protein, 28 aa, Artificial Sequence
  Description of Artificial Sequence: Synthetic peptide
QESEIASTNPVGTEGYGVMASTEQHGDI

SEQ ID NO: 147953 - protein, 38 aa, Artificial Sequence
  Description of Artificial Sequence: Synthetic polypeptide
DTEEIRTTNPVATEQYGVVSTVTNLQQGNTEQGTEDEE

SEQ ID NO: 147954 - protein, 37 aa, Artificial Sequence
  Description of Artificial Sequence: Synthetic polypeptide
DTEEIRTTNPVATEQYGVVSTVTNLQQGTEQGTEEEE

SEQ ID NO: 147955 - protein, 34 aa, Artificial Sequence
  Description of Artificial Sequence: Synthetic polypeptide
FESEIRTTNPVATNCWGSVSCINEPQDREGENGH

SEQ ID NO: 147956 - protein, 37 aa, Artificial Sequence
  Description of Artificial Sequence: Synthetic polypeptide
DTEEIRTTNPVATEQYGVVSTVVTNLQSGTEQGEDEE

SEQ ID NO: 147957 - protein, 29 aa, Artificial Sequence
  Description of Artificial Sequence: Synthetic peptide
QESEIASTNPVGTEGYGVMAPSTLQHGDI

SEQ ID NO: 147958 - protein, 30 aa, Artificial Sequence
  Description of Artificial Sequence: Synthetic polypeptide
QESEIASTNPVGTEGYGVMAPSTLQRHGDI

SEQ ID NO: 147959 - protein, 28 aa, Artificial Sequence
  Description of Artificial Sequence: Synthetic peptide
QESEIASTNPVGTEGYGVMAPTLQHGDI

SEQ ID NO: 147960 - protein, 29 aa, Artificial Sequence
  Description of Artificial Sequence: Synthetic peptide
QESEIASTNPVGTEGYGVMAQSTLQHGDI

SEQ ID NO: 147961 - protein, 28 aa, Artificial Sequence
  Description of Artificial Sequence: Synthetic peptide
QESEIASTNPVGTEGYGVMAQTLQHGDI

SEQ ID NO: 147962 - protein, 29 aa, Artificial Sequence
  Description of Artificial Sequence: Synthetic peptide
QESEIASTNPVGTEGYGVMARSTLQHGDI

SEQ ID NO: 147963 - protein, 28 aa, Artificial Sequence
  Description of Artificial Sequence: Synthetic peptide
QESEIASTNPVGTEGYGVMARTLQHGDI

SEQ ID NO: 147964 - protein, 30 aa, Artificial Sequence
  Description of Artificial Sequence: Synthetic polypeptide
QESEIASTNPVGTEGYGVMAPSTELQHGDI

SEQ ID NO: 147965 - protein, 28 aa, Artificial Sequence
  Description of Artificial Sequence: Synthetic peptide
QESEIASTNPVGTEGYGVMASALQHGDI

SEQ ID NO: 147966 - protein, 28 aa, Artificial Sequence
  Description of Artificial Sequence: Synthetic peptide
QESEIASTNPVGTEGYGVMASALQHGHI

SEQ ID NO: 147967 - protein, 30 aa, Artificial Sequence
  Description of Artificial Sequence: Synthetic polypeptide
QESEIASTNPVGTEGYGVMASATDLQHGDI

SEQ ID NO: 147968 - protein, 29 aa, Artificial Sequence
  Description of Artificial Sequence: Synthetic peptide
QESEIASTNPVGTEGYGVMASATLQHGDI

SEQ ID NO: 147969 - protein, 29 aa, Artificial Sequence
  Description of Artificial Sequence: Synthetic peptide
QESEIASTNPVGTEGYGVMASCHLQHGDI

SEQ ID NO: 147970 - protein, 28 aa, Artificial Sequence
  Description of Artificial Sequence: Synthetic peptide
QESEIASTNPVGTEGYGVMASCLQHGDI

SEQ ID NO: 147971 - protein, 37 aa, Artificial Sequence
  Description of Artificial Sequence: Synthetic polypeptide
DTEEIRTTNPVATEQYGVVSTVVTNLQAGTEQGEQTE

SEQ ID NO: 147972 - protein, 29 aa, Artificial Sequence
  Description of Artificial Sequence: Synthetic peptide
QESEIASTNPVGTEGYGVMASCTLQGGDI

SEQ ID NO: 147973 - protein, 29 aa, Artificial Sequence
  Description of Artificial Sequence: Synthetic peptide
QESEIASTNPVGTEGYGVMASCTLQHGDI

SEQ ID NO: 147974 - protein, 28 aa, Artificial Sequence
  Description of Artificial Sequence: Synthetic peptide
QESEIASTNPVGTEGYGVMASALQHGDM

SEQ ID NO: 147975 - protein, 37 aa, Artificial Sequence
  Description of Artificial Sequence: Synthetic polypeptide
DTEEIRTTNPVATEQYGVVSTVVTNLQSGTEQGTEDE

SEQ ID NO: 147976 - protein, 29 aa, Artificial Sequence
  Description of Artificial Sequence: Synthetic peptide
QESEIASTNPVGTEGYGVMANTVLQHGDI

SEQ ID NO: 147977 - protein, 38 aa, Artificial Sequence
  Description of Artificial Sequence: Synthetic polypeptide
DTEEIRTTNPVATEQYGVVSVTTTNLQAGTEQGTNTEE

SEQ ID NO: 147978 - protein, 29 aa, Artificial Sequence
  Description of Artificial Sequence: Synthetic peptide
QESEIASTNPVGTEGYGVMAMTGLQHGDI

SEQ ID NO: 147979 - protein, 36 aa, Artificial Sequence
  Description of Artificial Sequence: Synthetic polypeptide
DTEEIRTTNPVATTQYGSVATQSGTNNQQNDTNNDT

SEQ ID NO: 147980 - protein, 28 aa, Artificial Sequence
  Description of Artificial Sequence: Synthetic peptide
QESEIASTNPVGTEGYGVMAMTLQHGDI

SEQ ID NO: 147981 - protein, 29 aa, Artificial Sequence
  Description of Artificial Sequence: Synthetic peptide
QESEIASTNPVGTEGYGVMANSFLQHGDG

SEQ ID NO: 147982 - protein, 29 aa, Artificial Sequence
  Description of Artificial Sequence: Synthetic peptide
QESEIASTNPVGTEGYGVMANSTLQHGDI

SEQ ID NO: 147983 - protein, 31 aa, Artificial Sequence
  Description of Artificial Sequence: Synthetic polypeptide
QENEIATTNPVATESYGCVSGEALQHEIEMN

SEQ ID NO: 147984 - protein, 36 aa, Artificial Sequence
  Description of Artificial Sequence: Synthetic polypeptide
DTEEIRTTNPVATTQYGSVATESGTNQTNNGTNNDE

SEQ ID NO: 147985 - protein, 34 aa, Artificial Sequence
  Description of Artificial Sequence: Synthetic polypeptide
DTEEIRTTNPVATTQYGSVATEAGTNQSNENNDE

SEQ ID NO: 147986 - protein, 35 aa, Artificial Sequence
  Description of Artificial Sequence: Synthetic polypeptide
DTEEIRTTNPVATTQYGSVATEAGTNQQNTTNNDE

SEQ ID NO: 147987 - protein, 36 aa, Artificial Sequence
  Description of Artificial Sequence: Synthetic polypeptide
DTEEIRTTNPVATEQYGVVVVTVTNQQQGNQTDEED

SEQ ID NO: 147988 - protein, 30 aa, Artificial Sequence
  Description of Artificial Sequence: Synthetic polypeptide
FENEIRTTNPVATEQWGDVSEIEMNAAEDA

SEQ ID NO: 147989 - protein, 37 aa, Artificial Sequence
  Description of Artificial Sequence: Synthetic polypeptide
DTEEIRTTNPVATEQYGVVSVTVVTNLQQNTENGGTD

SEQ ID NO: 147990 - protein, 31 aa, Artificial Sequence
  Description of Artificial Sequence: Synthetic polypeptide
FENEIRTTNPVATEQWGDVSENIEMNAAEDA

SEQ ID NO: 147991 - protein, 37 aa, Artificial Sequence
  Description of Artificial Sequence: Synthetic polypeptide
DTEEIRTTNPVATEQYGVVSVTVVNNQQGNNQEEDED

SEQ ID NO: 147992 - protein, 38 aa, Artificial Sequence
  Description of Artificial Sequence: Synthetic polypeptide
DEEEIRTTNPVATEQYGSGVSSTTPAGPNMRNGMNPVS

SEQ ID NO: 147993 - protein, 37 aa, Artificial Sequence
  Description of Artificial Sequence: Synthetic polypeptide
DTEEIRTTNPVATEQYGVVSVTVTNQQQGNNDEEDED

SEQ ID NO: 147994 - protein, 28 aa, Artificial Sequence
  Description of Artificial Sequence: Synthetic peptide
QESEIASTNPVGTEGYGVMANTLQHMDI

SEQ ID NO: 147995 - protein, 37 aa, Artificial Sequence
  Description of Artificial Sequence: Synthetic polypeptide
DTEEIRTTNPVATEQYGVVSVTVTNNNNLQQGTDEED

SEQ ID NO: 147996 - protein, 29 aa, Artificial Sequence
  Description of Artificial Sequence: Synthetic peptide
QESEIASTNPVGTEGYGVMANTLQHWGDI

SEQ ID NO: 147997 - protein, 29 aa, Artificial Sequence
  Description of Artificial Sequence: Synthetic peptide
QESEIASTNPVGTEGYGVMASCTLQVGDI

SEQ ID NO: 147998 - protein, 37 aa, Artificial Sequence
  Description of Artificial Sequence: Synthetic polypeptide
DTEEIRTTNPVATEQYGVVSTVVSNNQQNGNEEDEEE

SEQ ID NO: 147999 - protein, 28 aa, Artificial Sequence
  Description of Artificial Sequence: Synthetic peptide
QESEIASTNPVGTEGYGVMASDLQEGDI

SEQ ID NO: 148000 - protein, 28 aa, Artificial Sequence
  Description of Artificial Sequence: Synthetic peptide
QESEIASTNPVGTEGYGVMASDLQHGDI

SEQ ID NO: 148001 - protein, 28 aa, Artificial Sequence
  Description of Artificial Sequence: Synthetic peptide
QESEIASTNPVGTEGYGVMASGLQFGDD

SEQ ID NO: 148002 - protein, 28 aa, Artificial Sequence
  Description of Artificial Sequence: Synthetic peptide
QESEIASTNPVGTEGYGVMASGLQHGDI

SEQ ID NO: 148003 - protein, 29 aa, Artificial Sequence
  Description of Artificial Sequence: Synthetic peptide
QESEIASTNPVGTEGYGVMASGTLQHGDI

SEQ ID NO: 148004 - protein, 28 aa, Artificial Sequence
  Description of Artificial Sequence: Synthetic peptide
QESEIASTNPVGTEGYGVMASHLQHGDI

SEQ ID NO: 148005 - protein, 37 aa, Artificial Sequence
  Description of Artificial Sequence: Synthetic polypeptide
DTEEIRTTNPVATEQYGVVSTVTNNQQGNDEEEENDT

SEQ ID NO: 148006 - protein, 37 aa, Artificial Sequence
  Description of Artificial Sequence: Synthetic polypeptide
DTEEIRTTNPVATEQYGVVSTVTNNNQQGNQQGTNTD

SEQ ID NO: 148007 - protein, 36 aa, Artificial Sequence
  Description of Artificial Sequence: Synthetic polypeptide
DTEEIRTTNPVATEQYGVVSTVTNNNNLQQATEEED

SEQ ID NO: 148008 - protein, 29 aa, Artificial Sequence
  Description of Artificial Sequence: Synthetic peptide
QESEIASTNPVGTEGYGVMASHTLQHGDI

SEQ ID NO: 148009 - protein, 29 aa, Artificial Sequence
  Description of Artificial Sequence: Synthetic peptide
QESEIASTNPVGTEGYGVMASHTLQKGDI

SEQ ID NO: 148010 - protein, 28 aa, Artificial Sequence
  Description of Artificial Sequence: Synthetic peptide
QESEIASTNPVGTEGYGVMASILQHGDI

SEQ ID NO: 148011 - protein, 29 aa, Artificial Sequence
  Description of Artificial Sequence: Synthetic peptide
QESEIASTNPVGTEGYGVMASITLQHGDI

SEQ ID NO: 148012 - protein, 28 aa, Artificial Sequence
  Description of Artificial Sequence: Synthetic peptide
QESEIASTNPVGTEGYGVMASKLQHGDI

SEQ ID NO: 148013 - protein, 37 aa, Artificial Sequence
  Description of Artificial Sequence: Synthetic polypeptide
DTEEIRTTNPVATEQYGVVSTVTNLQQQTNNNNTTDE

SEQ ID NO: 148014 - protein, 37 aa, Artificial Sequence
  Description of Artificial Sequence: Synthetic polypeptide
DTEEIRTTNPVATEQYGVVSTVTNLQQQNNNNNTTTD

SEQ ID NO: 148015 - protein, 29 aa, Artificial Sequence
  Description of Artificial Sequence: Synthetic peptide
QESEIASTNPVGTEGYGVMASKTLQHGDI

SEQ ID NO: 148016 - protein, 28 aa, Artificial Sequence
  Description of Artificial Sequence: Synthetic peptide
QESEIASTNPVGTEGYGVMASLLQHGDI

SEQ ID NO: 148017 - protein, 29 aa, Artificial Sequence
  Description of Artificial Sequence: Synthetic peptide
QESEIASTNPVGTEGYGVMASLTLQHGDI

SEQ ID NO: 148018 - protein, 28 aa, Artificial Sequence
  Description of Artificial Sequence: Synthetic peptide
QESEIASTNPVGTEGYGVMASMLQHGDI

SEQ ID NO: 148019 - protein, 29 aa, Artificial Sequence
  Description of Artificial Sequence: Synthetic peptide
QESEIASTNPVGTEGYGVMASMTLQHGDI

SEQ ID NO: 148020 - protein, 30 aa, Artificial Sequence
  Description of Artificial Sequence: Synthetic polypeptide
QESEIASTNPVGTEGYGVMASFTLQHRGDI

SEQ ID NO: 148021 - protein, 36 aa, Artificial Sequence
  Description of Artificial Sequence: Synthetic polypeptide
DTEEIRTTNPVATTQYGSVATQSGTNQTNIGNNNDT

SEQ ID NO: 148022 - protein, 36 aa, Artificial Sequence
  Description of Artificial Sequence: Synthetic polypeptide
DTEEIRTTNPVATEQYGVVSTVTNQTNLQQNEEEED

SEQ ID NO: 148023 - protein, 37 aa, Artificial Sequence
  Description of Artificial Sequence: Synthetic polypeptide
DTEEIRTTNPVATEQYGVVSTVVNDQQGNNNNQDEQD

SEQ ID NO: 148024 - protein, 29 aa, Artificial Sequence
  Description of Artificial Sequence: Synthetic peptide
QESEIASTNPVGTEGYGVMASDTLQHGDI

SEQ ID NO: 148025 - protein, 36 aa, Artificial Sequence
  Description of Artificial Sequence: Synthetic polypeptide
DTEEIRTTNPVATEQYGVVSTVVNQQAGTDEEEEDE

SEQ ID NO: 148026 - protein, 29 aa, Artificial Sequence
  Description of Artificial Sequence: Synthetic peptide
QESEIASTNPVGTEGYGVMASEHLQHGDI

SEQ ID NO: 148027 - protein, 36 aa, Artificial Sequence
  Description of Artificial Sequence: Synthetic polypeptide
DTEEIRTTNPVATEQYGVVSTVVNNQQGTDEEEEDD

SEQ ID NO: 148028 - protein, 37 aa, Artificial Sequence
  Description of Artificial Sequence: Synthetic polypeptide
DTEEIRTTNPVATEQYGVVSTVVNNQQGNNNNQDTED

SEQ ID NO: 148029 - protein, 28 aa, Artificial Sequence
  Description of Artificial Sequence: Synthetic peptide
QESEIASTNPVGTEGYGVMASELQHGDI

SEQ ID NO: 148030 - protein, 37 aa, Artificial Sequence
  Description of Artificial Sequence: Synthetic polypeptide
DTEEIRTTNPVATEQYGVVSTVVNNQQGNNEEEEDDT

SEQ ID NO: 148031 - protein, 34 aa, Artificial Sequence
  Description of Artificial Sequence: Synthetic polypeptide
FEQEIRTTNPVATEQYGSVIDQLNEGQGGLEEGG

SEQ ID NO: 148032 - protein, 35 aa, Artificial Sequence
  Description of Artificial Sequence: Synthetic polypeptide
FEQEIRTTNPVATEQYGSVIDTMNQDQGNEEGGGQ

SEQ ID NO: 148033 - protein, 29 aa, Artificial Sequence
  Description of Artificial Sequence: Synthetic peptide
QESEIASTNPVGTEGYGVMASETLQHGDI

SEQ ID NO: 148034 - protein, 29 aa, Artificial Sequence
  Description of Artificial Sequence: Synthetic peptide
QESEIASTNPVGTEGYGVMASETLQHGDK

SEQ ID NO: 148035 - protein, 29 aa, Artificial Sequence
  Description of Artificial Sequence: Synthetic peptide
QESEIASTNPVGTEGYGVMASETLQPGDI

SEQ ID NO: 148036 - protein, 37 aa, Artificial Sequence
  Description of Artificial Sequence: Synthetic polypeptide
DTEEIRTTNPVATEQYGVVSTVVNNQQGNDEEEEDTN

SEQ ID NO: 148037 - protein, 36 aa, Artificial Sequence
  Description of Artificial Sequence: Synthetic polypeptide
DTEEIRTTNPVATEQYGVVSTVVNNNNDEQGNQTTD

SEQ ID NO: 148038 - protein, 28 aa, Artificial Sequence
  Description of Artificial Sequence: Synthetic peptide
QESEIASTNPVGTEGYGVMASFLQHGDI

SEQ ID NO: 148039 - protein, 37 aa, Artificial Sequence
  Description of Artificial Sequence: Synthetic polypeptide
DTEEIRTTNPVATEQYGVVSTVVNNLQGNDEEEEDED

SEQ ID NO: 148040 - protein, 37 aa, Artificial Sequence
  Description of Artificial Sequence: Synthetic polypeptide
DTEEIRTTNPVATEQYGVVSTVVNLQQQENNNNTTND

SEQ ID NO: 148041 - protein, 29 aa, Artificial Sequence
  Description of Artificial Sequence: Synthetic peptide
QESEIASTNPVGTEGYGVMASFTLQHGDI

SEQ ID NO: 148042 - protein, 34 aa, Artificial Sequence
  Description of Artificial Sequence: Synthetic polypeptide
DEECIRTTNPVATEQWGCVCQWNELNQGFNSEQS

SEQ ID NO: 148043 - protein, 28 aa, Artificial Sequence
  Description of Artificial Sequence: Synthetic peptide
FESEIASTNPVGTEGYGVMASTLQHKDI

SEQ ID NO: 148044 - protein, 32 aa, Artificial Sequence
  Description of Artificial Sequence: Synthetic polypeptide
DESSIATTNPVAYECWGSVYNWTNDGQREGHM

SEQ ID NO: 148045 - protein, 33 aa, Artificial Sequence
  Description of Artificial Sequence: Synthetic polypeptide
DEDEIRTTNPVAYEQWGTVSWVEHDNRGGGSPR

SEQ ID NO: 148046 - protein, 34 aa, Artificial Sequence
  Description of Artificial Sequence: Synthetic polypeptide
SDPTIRTTNPVATEQYGAVSTNVHQQVRVANNTT

SEQ ID NO: 148047 - protein, 35 aa, Artificial Sequence
  Description of Artificial Sequence: Synthetic polypeptide
DEEEIRTTNPVATEQYGSVPPPLLEEETMGTLEQV

SEQ ID NO: 148048 - protein, 37 aa, Artificial Sequence
  Description of Artificial Sequence: Synthetic polypeptide
DEEEIATTNPVATEQYGSVSSTGPAGGPNSRNGMEPV

SEQ ID NO: 148049 - protein, 37 aa, Artificial Sequence
  Description of Artificial Sequence: Synthetic polypeptide
AEEEIRTTNPVATEQYGSVSTTNNNAEQGTDEENEEN

SEQ ID NO: 148050 - protein, 35 aa, Artificial Sequence
  Description of Artificial Sequence: Synthetic polypeptide
DEEEIRTTNPVATEQYGSVPPPLLEEEPMGPLEHV

SEQ ID NO: 148051 - protein, 35 aa, Artificial Sequence
  Description of Artificial Sequence: Synthetic polypeptide
DEEEIRTTNPVATEQYGSVPPPLHMDVPMGPLEQG

SEQ ID NO: 148052 - protein, 36 aa, Artificial Sequence
  Description of Artificial Sequence: Synthetic polypeptide
DEEEIRTTNPVATEQYGDVYSNGMGQFGQEGGINEI

SEQ ID NO: 148053 - protein, 36 aa, Artificial Sequence
  Description of Artificial Sequence: Synthetic polypeptide
DEEEIRTTNPVATEQYGDVYNGMGNNGQTGGGNGGI

SEQ ID NO: 148054 - protein, 35 aa, Artificial Sequence
  Description of Artificial Sequence: Synthetic polypeptide
DEEEIRTTNPVATEQYGSVPPPLDEEVPMGPLEQV

SEQ ID NO: 148055 - protein, 37 aa, Artificial Sequence
  Description of Artificial Sequence: Synthetic polypeptide
AEEEIRTTNPVATEQYGSVSTTNNNANQQQGTEEGQV

SEQ ID NO: 148056 - protein, 35 aa, Artificial Sequence
  Description of Artificial Sequence: Synthetic polypeptide
DETEIRTTNPVATEQYGATSATTPDWPNERNGNPV

SEQ ID NO: 148057 - protein, 36 aa, Artificial Sequence
  Description of Artificial Sequence: Synthetic polypeptide
DEEEIRTTNPVATEQYGDVYGQNMNAGQGGGNDEDI

SEQ ID NO: 148058 - protein, 36 aa, Artificial Sequence
  Description of Artificial Sequence: Synthetic polypeptide
DETEIRTTNPVATEQWGSVSSNTPAGPNMRNGMNPV

SEQ ID NO: 148059 - protein, 35 aa, Artificial Sequence
  Description of Artificial Sequence: Synthetic polypeptide
DEEEIRTTNPVATEQYGDVVTTDGMNNETGEQGGE

SEQ ID NO: 148060 - protein, 35 aa, Artificial Sequence
  Description of Artificial Sequence: Synthetic polypeptide
DEEEIACTNPVATEQYGSVATPHGLTGSGEENNQD

SEQ ID NO: 148061 - protein, 36 aa, Artificial Sequence
  Description of Artificial Sequence: Synthetic polypeptide
DETEIRTTNPVATEQWGSVSSNTEAGPNMRNGMNPV

SEQ ID NO: 148062 - protein, 36 aa, Artificial Sequence
  Description of Artificial Sequence: Synthetic polypeptide
DETEIRTTNPVATEQWGSVSSNTEAGPNERNGMNPV

SEQ ID NO: 148063 - protein, 37 aa, Artificial Sequence
  Description of Artificial Sequence: Synthetic polypeptide
DEEEIRTTNPVATEQYGDVVTGIQNDGFQTGGNQEET

SEQ ID NO: 148064 - protein, 36 aa, Artificial Sequence
  Description of Artificial Sequence: Synthetic polypeptide
DETEIRTTNPVATEQWGSTVSANAPDGPNMRKGPPV

SEQ ID NO: 148065 - protein, 35 aa, Artificial Sequence
  Description of Artificial Sequence: Synthetic polypeptide
DETEIRTTNPVATEQYGATAWANAEDWQERKGGYR

SEQ ID NO: 148066 - protein, 34 aa, Artificial Sequence
  Description of Artificial Sequence: Synthetic polypeptide
DEEEIRTTNPCATEPYGSTCAATNLATAPGGEMA

SEQ ID NO: 148067 - protein, 35 aa, Artificial Sequence
  Description of Artificial Sequence: Synthetic polypeptide
DEEEIRTTNPVATEQYGSVPPPLLEEGTMGPEEQV

SEQ ID NO: 148068 - protein, 35 aa, Artificial Sequence
  Description of Artificial Sequence: Synthetic polypeptide
DEEEIRTTNPVATEQYGSVPPPLLEEPPMGILEQG

SEQ ID NO: 148069 - protein, 34 aa, Artificial Sequence
  Description of Artificial Sequence: Synthetic polypeptide
NEREIRTTNPVATEQYGCVCGTNDQEIFGSDTQA

SEQ ID NO: 148070 - protein, 33 aa, Artificial Sequence
  Description of Artificial Sequence: Synthetic polypeptide
DETEIRTTNPVATEQYGSTAATEDWEEHKGEDI

SEQ ID NO: 148071 - protein, 32 aa, Artificial Sequence
  Description of Artificial Sequence: Synthetic polypeptide
DETEIRTTNPVATEQYGSTAAADWADPEGEDI

SEQ ID NO: 148072 - protein, 37 aa, Artificial Sequence
  Description of Artificial Sequence: Synthetic polypeptide
AEEEIRTTNPVATEQYGSVSTTNNNLEQGTTEDTEED

SEQ ID NO: 148073 - protein, 32 aa, Artificial Sequence
  Description of Artificial Sequence: Synthetic polypeptide
DETEIRTTNPVATEQYGSTAAADWADHEGEDI

SEQ ID NO: 148074 - protein, 31 aa, Artificial Sequence
  Description of Artificial Sequence: Synthetic polypeptide
QEGEIAPTNPVSSECYGIVSCNLQDSEGETR

SEQ ID NO: 148075 - protein, 36 aa, Artificial Sequence
  Description of Artificial Sequence: Synthetic polypeptide
DEEEIATTNPVATEQYGSVSSTTPAGPNDHEGMEPV

SEQ ID NO: 148076 - protein, 33 aa, Artificial Sequence
  Description of Artificial Sequence: Synthetic polypeptide
NEREIRTTNPVATEQYGCVCQWPLNQIFGSDQS

SEQ ID NO: 148077 - protein, 28 aa, Artificial Sequence
  Description of Artificial Sequence: Synthetic peptide
QEGEIAPTNPVGTEGYGVMACTLQHGDI

SEQ ID NO: 148078 - protein, 32 aa, Artificial Sequence
  Description of Artificial Sequence: Synthetic polypeptide
AEQEIATTNPVATEQYGEVSAEDLEDHEGEDL

SEQ ID NO: 148079 - protein, 37 aa, Artificial Sequence
  Description of Artificial Sequence: Synthetic polypeptide
AEEEIRTTNPVATEQYGSVSTTNNNLEQGTDEEEQEE

SEQ ID NO: 148080 - protein, 36 aa, Artificial Sequence
  Description of Artificial Sequence: Synthetic polypeptide
DEEEIRTTNPVATEQYGESVCVCTRASSNNGGNNET

SEQ ID NO: 148081 - protein, 34 aa, Artificial Sequence
  Description of Artificial Sequence: Synthetic polypeptide
NEREIRTTNPVATEQYGCVCWTGNDQNFGSDTQA

SEQ ID NO: 148082 - protein, 35 aa, Artificial Sequence
  Description of Artificial Sequence: Synthetic polypeptide
DEEEIRTTNPVATEQYGSVPPPLLEEVTMVQLEQV

SEQ ID NO: 148083 - protein, 35 aa, Artificial Sequence
  Description of Artificial Sequence: Synthetic polypeptide
DEEEIRTTNPVATEQYGSVPPPLLEEVNMEPLEQG

SEQ ID NO: 148084 - protein, 37 aa, Artificial Sequence
  Description of Artificial Sequence: Synthetic polypeptide
DEEEIRTTNPVATEQYGESCFSKVNGLQNPQMPAHRV

SEQ ID NO: 148085 - protein, 31 aa, Artificial Sequence
  Description of Artificial Sequence: Synthetic polypeptide
QEGEIAPTNPVATECYGIVSCNEQDSEGETG

SEQ ID NO: 148086 - protein, 36 aa, Artificial Sequence
  Description of Artificial Sequence: Synthetic polypeptide
AEEEIRTTNPVATEQYGSVSTTNNNINDEQGTTTDQ

SEQ ID NO: 148087 - protein, 34 aa, Artificial Sequence
  Description of Artificial Sequence: Synthetic polypeptide
DEEEIRTTNPVATEQYGSVPPPLLEETMPPAEQV

SEQ ID NO: 148088 - protein, 35 aa, Artificial Sequence
  Description of Artificial Sequence: Synthetic polypeptide
DETEIRTTNPVATEQWGSTSSNTPDGPNMRNGNPV

SEQ ID NO: 148089 - protein, 36 aa, Artificial Sequence
  Description of Artificial Sequence: Synthetic polypeptide
DEEEIATTNPVATEQYGSVSSTTPAGPNDHNGMEPV

SEQ ID NO: 148090 - protein, 35 aa, Artificial Sequence
  Description of Artificial Sequence: Synthetic polypeptide
DEEEIRTTNPVATEQYGDVVSVGDTGQGINIGDED

SEQ ID NO: 148091 - protein, 31 aa, Artificial Sequence
  Description of Artificial Sequence: Synthetic polypeptide
DETEIRTTNPVATEQWGDVWSEIEANAAEDA

SEQ ID NO: 148092 - protein, 35 aa, Artificial Sequence
  Description of Artificial Sequence: Synthetic polypeptide
DETEIRTTNPVATECYGSTTSSNTPDGNMRKGNYI

SEQ ID NO: 148093 - protein, 34 aa, Artificial Sequence
  Description of Artificial Sequence: Synthetic polypeptide
DEEEIRTTNPVATEQYGDVVQDNSNMVEDEGEME

SEQ ID NO: 148094 - protein, 30 aa, Artificial Sequence
  Description of Artificial Sequence: Synthetic polypeptide
QEGEIAPTNPCVYEQWGTVSCNLQSGHTDR

SEQ ID NO: 148095 - protein, 33 aa, Artificial Sequence
  Description of Artificial Sequence: Synthetic polypeptide
NEREIRTTNPVAYEAWGQVVWVTNGLSQNGGSR

SEQ ID NO: 148096 - protein, 36 aa, Artificial Sequence
  Description of Artificial Sequence: Synthetic polypeptide
DEEEIRTTNPVATEQYGDVVNQTDNMNGTGGEEEND

SEQ ID NO: 148097 - protein, 32 aa, Artificial Sequence
  Description of Artificial Sequence: Synthetic polypeptide
DETEIRTTNPVATECYGDVANACWQEHKGPYI

SEQ ID NO: 148098 - protein, 29 aa, Artificial Sequence
  Description of Artificial Sequence: Synthetic peptide
QEGEIAPTNPCVYEQWGIVSCNLQSGHTA

SEQ ID NO: 148099 - protein, 28 aa, Artificial Sequence
  Description of Artificial Sequence: Synthetic peptide
NESEIACTNPVGTEGWGVAASTLQHGDI

SEQ ID NO: 148100 - protein, 37 aa, Artificial Sequence
  Description of Artificial Sequence: Synthetic polypeptide
DEEEIATTNPVATEQYGSVSATTPAQGPNMRNGMEPV

SEQ ID NO: 148101 - protein, 29 aa, Artificial Sequence
  Description of Artificial Sequence: Synthetic peptide
NESEIASTNPVGTEGYGCVMASTDQHGDI

SEQ ID NO: 148102 - protein, 32 aa, Artificial Sequence
  Description of Artificial Sequence: Synthetic polypeptide
DETEIRTTNPVATECYGATWANEDWAPKGGYR

SEQ ID NO: 148103 - protein, 34 aa, Artificial Sequence
  Description of Artificial Sequence: Synthetic polypeptide
SEEEIRTTNPAATEQYGSVPGNDQQTGQGGEGET

SEQ ID NO: 148104 - protein, 29 aa, Artificial Sequence
  Description of Artificial Sequence: Synthetic peptide
NESEIASTNPVGTEGYGVMASTLEQHGDI

SEQ ID NO: 148105 - protein, 37 aa, Artificial Sequence
  Description of Artificial Sequence: Synthetic polypeptide
DEEEIRTTNPVATEQYGSVSSTTPAGPNMRNAMNPVI

SEQ ID NO: 148106 - protein, 30 aa, Artificial Sequence
  Description of Artificial Sequence: Synthetic polypeptide
QEGEIAPTNPCVYEQWGIVSCNLQSGGTER

SEQ ID NO: 148107 - protein, 29 aa, Artificial Sequence
  Description of Artificial Sequence: Synthetic peptide
NESEIASTNPVGTEGYGVMASTLQHGDIS

SEQ ID NO: 148108 - protein, 29 aa, Artificial Sequence
  Description of Artificial Sequence: Synthetic peptide
NESEIASTNPVGTEGYGVMASTLQHNGDI

SEQ ID NO: 148109 - protein, 35 aa, Artificial Sequence
  Description of Artificial Sequence: Synthetic polypeptide
DEEEIRTTNPVATEQYGDVVNQTDNMNGTGGEEDD

SEQ ID NO: 148110 - protein, 32 aa, Artificial Sequence
  Description of Artificial Sequence: Synthetic polypeptide
DETEIRTTNPVATECYGAVANDDWQEPKGPYI

SEQ ID NO: 148111 - protein, 32 aa, Artificial Sequence
  Description of Artificial Sequence: Synthetic polypeptide
DETEIRTTNPVATECYGVVANDDWQEPKGPYI

SEQ ID NO: 148112 - protein, 33 aa, Artificial Sequence
  Description of Artificial Sequence: Synthetic polypeptide
QEGEIAPTNPIATEQYGATVWSCENLQEPGTYR

SEQ ID NO: 148113 - protein, 36 aa, Artificial Sequence
  Description of Artificial Sequence: Synthetic polypeptide
DEEEIATTNPVATEQYGSVSATWPAGPDARNGGDPV

SEQ ID NO: 148114 - protein, 31 aa, Artificial Sequence
  Description of Artificial Sequence: Synthetic polypeptide
DETEIRTTNPVATEQWGDVWSEIEAEAAEDA

SEQ ID NO: 148115 - protein, 32 aa, Artificial Sequence
  Description of Artificial Sequence: Synthetic polypeptide
DETEIRTTNPVATEQWGDVSNEEDEANAKEDA

SEQ ID NO: 148116 - protein, 31 aa, Artificial Sequence
  Description of Artificial Sequence: Synthetic polypeptide
DETEIRTTNPVATEQWGDVSIEIEMNAAEDA

SEQ ID NO: 148117 - protein, 35 aa, Artificial Sequence
  Description of Artificial Sequence: Synthetic polypeptide
DEEEIRTTNPVATEQYGSVPPMVQLAADNMLEESQ

SEQ ID NO: 148118 - protein, 35 aa, Artificial Sequence
  Description of Artificial Sequence: Synthetic polypeptide
DEEEIRTTNPVATEQYGDVVSNMDGEMQEGGGESD

SEQ ID NO: 148119 - protein, 35 aa, Artificial Sequence
  Description of Artificial Sequence: Synthetic polypeptide
DEEEIRTTNPVATEQYGSVPPIVLLAADNMVEESI

SEQ ID NO: 148120 - protein, 35 aa, Artificial Sequence
  Description of Artificial Sequence: Synthetic polypeptide
DEEEIRTTNPVATEQYGSVPPGLEAQDDEIVLDQE

SEQ ID NO: 148121 - protein, 36 aa, Artificial Sequence
  Description of Artificial Sequence: Synthetic polypeptide
DEEEIATTNPVATEQYGSVSSMTPAGTNNRNPMEPV

SEQ ID NO: 148122 - protein, 35 aa, Artificial Sequence
  Description of Artificial Sequence: Synthetic polypeptide
DETEIRTTNPVATEQWGAVSATTEAGPNMRKGNPV

SEQ ID NO: 148123 - protein, 33 aa, Artificial Sequence
  Description of Artificial Sequence: Synthetic polypeptide
DETEIRTTNPVATEPYGTTWSAEDIQQQQKGNH

SEQ ID NO: 148124 - protein, 36 aa, Artificial Sequence
  Description of Artificial Sequence: Synthetic polypeptide
DEEEIRTTNPVATEQYGDVVSGVGDQTGQGIIGNED

SEQ ID NO: 148125 - protein, 37 aa, Artificial Sequence
  Description of Artificial Sequence: Synthetic polypeptide
DEEEIRTTNPVATEQYGDVVSGTNNMTDQFEFDGEEE

SEQ ID NO: 148126 - protein, 35 aa, Artificial Sequence
  Description of Artificial Sequence: Synthetic polypeptide
DEEEIRTTNPVATEQYGDVVSGNIMDNGEGDDDTL

SEQ ID NO: 148127 - protein, 36 aa, Artificial Sequence
  Description of Artificial Sequence: Synthetic polypeptide
DEEEIATTNPVATEQYGSVSPTGEPGINPDDGMEKV

SEQ ID NO: 148128 - protein, 31 aa, Artificial Sequence
  Description of Artificial Sequence: Synthetic polypeptide
QEGEIAPTNPVASECYGIVSCNEQDSEGETR

SEQ ID NO: 148129 - protein, 35 aa, Artificial Sequence
  Description of Artificial Sequence: Synthetic polypeptide
DEEEIRTTNPVATEQYGDVVQTDNMNITGGEEEMD

SEQ ID NO: 148130 - protein, 36 aa, Artificial Sequence
  Description of Artificial Sequence: Synthetic polypeptide
DEEEIRTTNPVATEQYGDVVQTDENMNGTGGEENDD

SEQ ID NO: 148131 - protein, 34 aa, Artificial Sequence
  Description of Artificial Sequence: Synthetic polypeptide
DEEEIRTTNPVATEQYGDVVQNGFNTTGGGGEQE

SEQ ID NO: 148132 - protein, 36 aa, Artificial Sequence
  Description of Artificial Sequence: Synthetic polypeptide
DEEEIRTTNPVATEQYGDVVQGFGTGNDQEGGDEQT

SEQ ID NO: 148133 - protein, 31 aa, Artificial Sequence
  Description of Artificial Sequence: Synthetic polypeptide
DETEIRTTNPVATEQWGDVWSEIEMNAAEPA

SEQ ID NO: 148134 - protein, 35 aa, Artificial Sequence
  Description of Artificial Sequence: Synthetic polypeptide
DEEEIRTTNPVATEQYGDVVNNMDNGEMGEGGNEE

SEQ ID NO: 148135 - protein, 36 aa, Artificial Sequence
  Description of Artificial Sequence: Synthetic polypeptide
DEEEIATTNPVATEQYGSVSSTTPAGPNDRNGMEPV

SEQ ID NO: 148136 - protein, 36 aa, Artificial Sequence
  Description of Artificial Sequence: Synthetic polypeptide
DEEEIATTNPVATEQYGSVSSTTPAGPNMRAEMNPV

SEQ ID NO: 148137 - protein, 36 aa, Artificial Sequence
  Description of Artificial Sequence: Synthetic polypeptide
NENEIRTTNPVATEQYGSVSSTTPAGPNMRNGMNPV

SEQ ID NO: 148138 - protein, 34 aa, Artificial Sequence
  Description of Artificial Sequence: Synthetic polypeptide
DEEEIACTNPVATEQYGSVATPHGETGSGEENNT

SEQ ID NO: 148139 - protein, 33 aa, Artificial Sequence
  Description of Artificial Sequence: Synthetic polypeptide
DEEEIRTTNPCATEGYGCCCSTEPAEYFGSNQS

SEQ ID NO: 148140 - protein, 37 aa, Artificial Sequence
  Description of Artificial Sequence: Synthetic polypeptide
AEEEIRTTNPVATEQYGSVVVTVSNNQLGNEQGNNDE

SEQ ID NO: 148141 - protein, 34 aa, Artificial Sequence
  Description of Artificial Sequence: Synthetic polypeptide
DEEEIRTTNPCATEGYGCCCSTGNLAYFGSDTQS

SEQ ID NO: 148142 - protein, 31 aa, Artificial Sequence
  Description of Artificial Sequence: Synthetic polypeptide
QEGEIAPTNPVSTEPYGTVSMEDLQQQNGNH

SEQ ID NO: 148143 - protein, 35 aa, Artificial Sequence
  Description of Artificial Sequence: Synthetic polypeptide
NEPEIATTNPVATEQYGSVWFTNVEVLINGQSQRV

SEQ ID NO: 148144 - protein, 34 aa, Artificial Sequence
  Description of Artificial Sequence: Synthetic polypeptide
NEPEIATTNPVATEQYGSVWPTNVEVVIGDSTRV

SEQ ID NO: 148145 - protein, 33 aa, Artificial Sequence
  Description of Artificial Sequence: Synthetic polypeptide
DEEEIRTTNPCATEGYGCCCSTEHAYFGSDNQS

SEQ ID NO: 148146 - protein, 32 aa, Artificial Sequence
  Description of Artificial Sequence: Synthetic polypeptide
DEEEIRTTNPCATEGYGCCCSWELASFGSDQS

SEQ ID NO: 148147 - protein, 32 aa, Artificial Sequence
  Description of Artificial Sequence: Synthetic polypeptide
NEQEIATTNPVATEQYGCVTATDLEDHIGEDL

SEQ ID NO: 148148 - protein, 36 aa, Artificial Sequence
  Description of Artificial Sequence: Synthetic polypeptide
DEEEIRTTNPVATEQYGSVPPPLWQEEVPMGPLEFV

SEQ ID NO: 148149 - protein, 37 aa, Artificial Sequence
  Description of Artificial Sequence: Synthetic polypeptide
DETEIRTTNPVATEQYGSVSNMNLVGDDQDQEDQDGN

SEQ ID NO: 148150 - protein, 37 aa, Artificial Sequence
  Description of Artificial Sequence: Synthetic polypeptide
DETEIRTTNPVATEQYGSVSNDDSETGDQGNEGNQGN

SEQ ID NO: 148151 - protein, 32 aa, Artificial Sequence
  Description of Artificial Sequence: Synthetic polypeptide
SEEEIRCTNPTAYECWGSVYGENDDMNRGDNR

SEQ ID NO: 148152 - protein, 32 aa, Artificial Sequence
  Description of Artificial Sequence: Synthetic polypeptide
SEEEIRCTNPTAYEQWGCVWGENDMERDGNER

SEQ ID NO: 148153 - protein, 31 aa, Artificial Sequence
  Description of Artificial Sequence: Synthetic polypeptide
SEEEIRCTNPTAYEQWGCVWGENDMHRDGSR

SEQ ID NO: 148154 - protein, 32 aa, Artificial Sequence
  Description of Artificial Sequence: Synthetic polypeptide
SEEEIRCTNPTAYEQWGCVWGENDNEHRDGNR

SEQ ID NO: 148155 - protein, 33 aa, Artificial Sequence
  Description of Artificial Sequence: Synthetic polypeptide
DEEEIRTTNPCATEGYGCCCSWNHAEYFGSNQS

SEQ ID NO: 148156 - protein, 33 aa, Artificial Sequence
  Description of Artificial Sequence: Synthetic polypeptide
DEEEIRTTNPCATEGYGCCCSSELNASFGSNQS

SEQ ID NO: 148157 - protein, 31 aa, Artificial Sequence
  Description of Artificial Sequence: Synthetic polypeptide
DEEEIATTNPVATEQYGTASEDVPVEHEEED

SEQ ID NO: 148158 - protein, 31 aa, Artificial Sequence
  Description of Artificial Sequence: Synthetic polypeptide
NENEIRTTNPVATEQWGDVSFIEMNAAEDAC

SEQ ID NO: 148159 - protein, 35 aa, Artificial Sequence
  Description of Artificial Sequence: Synthetic polypeptide
DEEEIRTTNPVATEQYGFICQYTPGEIGEEQEANR

SEQ ID NO: 148160 - protein, 36 aa, Artificial Sequence
  Description of Artificial Sequence: Synthetic polypeptide
DEEEIRTTNPVATEQYGFICQSTPNEIQEQEADNDD

SEQ ID NO: 148161 - protein, 34 aa, Artificial Sequence
  Description of Artificial Sequence: Synthetic polypeptide
DEEEIATTNPVATEQYGVSVCAAMNNDDMQGDQD

SEQ ID NO: 148162 - protein, 35 aa, Artificial Sequence
  Description of Artificial Sequence: Synthetic polypeptide
DEEEIRTTNPVATEQYGFICQCTPNGIPEEEEANR

SEQ ID NO: 148163 - protein, 35 aa, Artificial Sequence
  Description of Artificial Sequence: Synthetic polypeptide
DEEEIRTTNPVATEQYGFICQCTPNEIPEEQEANI

SEQ ID NO: 148164 - protein, 36 aa, Artificial Sequence
  Description of Artificial Sequence: Synthetic polypeptide
DEEEIRTTNPVATEQYGFICQCTPNEIGEEQEMNRD

SEQ ID NO: 148165 - protein, 36 aa, Artificial Sequence
  Description of Artificial Sequence: Synthetic polypeptide
DEEEIATTNPVATEQYGVSACSGNNDIPQDNPMENR

SEQ ID NO: 148166 - protein, 38 aa, Artificial Sequence
  Description of Artificial Sequence: Synthetic polypeptide
DEEEIRTTNPVATEQYGSVSSTTPAGGPNMRNGMNPVF

SEQ ID NO: 148167 - protein, 38 aa, Artificial Sequence
  Description of Artificial Sequence: Synthetic polypeptide
DEEEIRTTNPVATEQYGSVSSTTPAGGPNMRNGMNPVI

SEQ ID NO: 148168 - protein, 35 aa, Artificial Sequence
  Description of Artificial Sequence: Synthetic polypeptide
NENEIRATNPVATEQYGSVSVLWDNTQMENDIERN

SEQ ID NO: 148169 - protein, 35 aa, Artificial Sequence
  Description of Artificial Sequence: Synthetic polypeptide
DEEEIRTTNPVATEQYGFICQCMPNEIGQEQEANR

SEQ ID NO: 148170 - protein, 35 aa, Artificial Sequence
  Description of Artificial Sequence: Synthetic polypeptide
DEEEIACTNPVATEQYGSVATPHGDPTGSGEENNR

SEQ ID NO: 148171 - protein, 30 aa, Artificial Sequence
  Description of Artificial Sequence: Synthetic polypeptide
NENEIRTTNPVATEQWGDVSEIEMNAAEDA

SEQ ID NO: 148172 - protein, 34 aa, Artificial Sequence
  Description of Artificial Sequence: Synthetic polypeptide
AEPEIRTTNPVATEEYGCCWLNIGVLQRGMNQQE

SEQ ID NO: 148173 - protein, 32 aa, Artificial Sequence
  Description of Artificial Sequence: Synthetic polypeptide
AEPEIRTTNPVATEEYGCCWNIVDLTRGDNQE

SEQ ID NO: 148174 - protein, 31 aa, Artificial Sequence
  Description of Artificial Sequence: Synthetic polypeptide
NENEIRTTNPVATEQWGDVSEIEMNAAEDAP

SEQ ID NO: 148175 - protein, 31 aa, Artificial Sequence
  Description of Artificial Sequence: Synthetic polypeptide
NENEIRTTNPVATEQWGDVSEIEMNAAEDHA

SEQ ID NO: 148176 - protein, 37 aa, Artificial Sequence
  Description of Artificial Sequence: Synthetic polypeptide
DEEEIRTTNPVATEQYGFACQSRTPNEIQEQEANLRD

SEQ ID NO: 148177 - protein, 35 aa, Artificial Sequence
  Description of Artificial Sequence: Synthetic polypeptide
AEPEIRTTNPVATEQYGSVTPWTNLESFTQDVFQH

SEQ ID NO: 148178 - protein, 33 aa, Artificial Sequence
  Description of Artificial Sequence: Synthetic polypeptide
SEEEIRCTNPTAYEQWGSCSGENDMHRQGENDR

SEQ ID NO: 148179 - protein, 36 aa, Artificial Sequence
  Description of Artificial Sequence: Synthetic polypeptide
DETEIRTTNPVATEQYGSTSSTTPAGPNMRNGMNPV

SEQ ID NO: 148180 - protein, 33 aa, Artificial Sequence
  Description of Artificial Sequence: Synthetic polypeptide
SEEEIRCTNPTAYEQWGSTVYGEDNDMRRGDNR

SEQ ID NO: 148181 - protein, 34 aa, Artificial Sequence
  Description of Artificial Sequence: Synthetic polypeptide
SEEEIRCTNPTAYEQWGSVCSGENDDDMRQGSNR

SEQ ID NO: 148182 - protein, 35 aa, Artificial Sequence
  Description of Artificial Sequence: Synthetic polypeptide
DEEEIRTTNPVATEQYGSVPPPLMEDVDMGPLEQE

SEQ ID NO: 148183 - protein, 34 aa, Artificial Sequence
  Description of Artificial Sequence: Synthetic polypeptide
DEEEIRTTNPCATEPYGSCAATNLPATAPGGEAH

SEQ ID NO: 148184 - protein, 36 aa, Artificial Sequence
  Description of Artificial Sequence: Synthetic polypeptide
DETEIRTTNPVATEQYGSTWSTTPDGPNMRNGMNPI

SEQ ID NO: 148185 - protein, 34 aa, Artificial Sequence
  Description of Artificial Sequence: Synthetic polypeptide
DEEEIRTTNPCATEPYGSCAATNLPATAPIGEMA

SEQ ID NO: 148186 - protein, 35 aa, Artificial Sequence
  Description of Artificial Sequence: Synthetic polypeptide
DETEIRTTNPVATEQYGSTWSTTEDWPNMPNGPYI

SEQ ID NO: 148187 - protein, 35 aa, Artificial Sequence
  Description of Artificial Sequence: Synthetic polypeptide
DEEEIRTTNPVATEQYGSVPPPLLSEVTMGPLEDV

SEQ ID NO: 148188 - protein, 36 aa, Artificial Sequence
  Description of Artificial Sequence: Synthetic polypeptide
DETEIRTTNPVATEQYGSTWSTTEDGPNMRNGMNYI

SEQ ID NO: 148189 - protein, 35 aa, Artificial Sequence
  Description of Artificial Sequence: Synthetic polypeptide
DETEIRTTNPVATEQYGSTWATAPAGNERNGMNPI

SEQ ID NO: 148190 - protein, 28 aa, Artificial Sequence
  Description of Artificial Sequence: Synthetic peptide
QEGEIAPTNPVSSEQYGEVPEVLQHETK

SEQ ID NO: 148191 - protein, 33 aa, Artificial Sequence
  Description of Artificial Sequence: Synthetic polypeptide
DEEEIRTTNPCATEPYGSCAGTNHMNDSQGEAM

SEQ ID NO: 148192 - protein, 36 aa, Artificial Sequence
  Description of Artificial Sequence: Synthetic polypeptide
DEEEIATTNPVATEQYGSVSSTTPAGPNMRNGMEPV

SEQ ID NO: 148193 - protein, 35 aa, Artificial Sequence
  Description of Artificial Sequence: Synthetic polypeptide
DETEIRTTNPVATEQYGSTTSSTAPDWNMRKGPPI

SEQ ID NO: 148194 - protein, 36 aa, Artificial Sequence
  Description of Artificial Sequence: Synthetic polypeptide
DEEEIATTNPVATEQYGSVSSTTPAGPNMRNDMNPV

SEQ ID NO: 148195 - protein, 37 aa, Artificial Sequence
  Description of Artificial Sequence: Synthetic polypeptide
AEEEIRTTNPVATEQYGSVSTTNNNLNGTEQGETEED

SEQ ID NO: 148196 - protein, 36 aa, Artificial Sequence
  Description of Artificial Sequence: Synthetic polypeptide
DETEIRTTNPVATEQYGSTSSTTPDGPNMRNGMNPV

SEQ ID NO: 148197 - protein, 36 aa, Artificial Sequence
  Description of Artificial Sequence: Synthetic polypeptide
DETEIRTTNPVATEQYGSTSSTTPDGPNMRNGMNPI

SEQ ID NO: 148198 - protein, 33 aa, Artificial Sequence
  Description of Artificial Sequence: Synthetic polypeptide
NEREIRTTNPVATEQYGCVCEWNHNQIFGSDQS

SEQ ID NO: 148199 - protein, 36 aa, Artificial Sequence
  Description of Artificial Sequence: Synthetic polypeptide
DEEEIATTNPVATEQYGSVSSTTPAGPNMRAGGEPV

SEQ ID NO: 148200 - protein, 36 aa, Artificial Sequence
  Description of Artificial Sequence: Synthetic polypeptide
DEEEIATTNPVATEQYGSVSSTTPAGPNMRNGMGPV

SEQ ID NO: 148201 - protein, 36 aa, Artificial Sequence
  Description of Artificial Sequence: Synthetic polypeptide
DEEEIATTNPVATEQYGSVSSTTPAGPNNRNGMEPV

SEQ ID NO: 148202 - protein, 35 aa, Artificial Sequence
  Description of Artificial Sequence: Synthetic polypeptide
DEEEIRTTNPVATEQYGSVPPPLMEEMPMGPLEQG

SEQ ID NO: 148203 - protein, 35 aa, Artificial Sequence
  Description of Artificial Sequence: Synthetic polypeptide
DEEEIRTTNPVATEQYGSVPPPLMETVPMGPLEIG

SEQ ID NO: 148204 - protein, 36 aa, Artificial Sequence
  Description of Artificial Sequence: Synthetic polypeptide
DETEIRTTNPVATEQYGSVSATTPAGPNMRKGMPPV

SEQ ID NO: 148205 - protein, 33 aa, Artificial Sequence
  Description of Artificial Sequence: Synthetic polypeptide
SEEEIRCTNPTAYEQWGSVSGENDDDMRKGSER

SEQ ID NO: 148206 - protein, 37 aa, Artificial Sequence
  Description of Artificial Sequence: Synthetic polypeptide
DEEEIRTTNPVATEQYGEVSSTPPAEGPNMRNGMNPV

SEQ ID NO: 148207 - protein, 36 aa, Artificial Sequence
  Description of Artificial Sequence: Synthetic polypeptide
DEEEIATTNPVATEQYGSVSSTWPAGPNMRMGGLPH

SEQ ID NO: 148208 - protein, 35 aa, Artificial Sequence
  Description of Artificial Sequence: Synthetic polypeptide
NEQEIRTTNPVATEQYGSIMWVPNNTQLEGFENGD

SEQ ID NO: 148209 - protein, 33 aa, Artificial Sequence
  Description of Artificial Sequence: Synthetic polypeptide
SEEEIRCTNPTAYEQWGSVWGENDDDMRGSNER

SEQ ID NO: 148210 - protein, 34 aa, Artificial Sequence
  Description of Artificial Sequence: Synthetic polypeptide
DEEEIRTTNPVATEQYGSVPPPLVEETMMPLEQV

SEQ ID NO: 148211 - protein, 33 aa, Artificial Sequence
  Description of Artificial Sequence: Synthetic polypeptide
DEEEIRTTNPCATEPYGACAATNLATAPGGEMH

SEQ ID NO: 148212 - protein, 35 aa, Artificial Sequence
  Description of Artificial Sequence: Synthetic polypeptide
DEEEIRTTNPVATEQYGSVPPPLMEVVPMGPLEQT

SEQ ID NO: 148213 - protein, 36 aa, Artificial Sequence
  Description of Artificial Sequence: Synthetic polypeptide
DEEEIRTTNPVATEQYGEVSDGVTGLGGDNGGGQGG

SEQ ID NO: 148214 - protein, 31 aa, Artificial Sequence
  Description of Artificial Sequence: Synthetic polypeptide
AEQEIACTNPVATEQYGEVSAEDLEHEGEDL

SEQ ID NO: 148215 - protein, 33 aa, Artificial Sequence
  Description of Artificial Sequence: Synthetic polypeptide
DEEEIRTTNPCATEPYGSCAAASNLATAPGGEG

SEQ ID NO: 148216 - protein, 36 aa, Artificial Sequence
  Description of Artificial Sequence: Synthetic polypeptide
DEEEIRTTNPCATEPYGSCAASGNLGQATPGDNMGM

SEQ ID NO: 148217 - protein, 37 aa, Artificial Sequence
  Description of Artificial Sequence: Synthetic polypeptide
DETEIRTTNPVATEQYGSVNYDGPGNLQTGENENEDI

SEQ ID NO: 148218 - protein, 37 aa, Artificial Sequence
  Description of Artificial Sequence: Synthetic polypeptide
DETEIRTTNPVATEQYGSVNSDGPGNLDTGETENEDI

SEQ ID NO: 148219 - protein, 35 aa, Artificial Sequence
  Description of Artificial Sequence: Synthetic polypeptide
DETEIRTTNPVATEQYGSVGDGGQDDEGEGENNIT

SEQ ID NO: 148220 - protein, 38 aa, Artificial Sequence
  Description of Artificial Sequence: Synthetic polypeptide
DEEEIRTTNPVATEQYGETYSTPNLNVEMMREGNVELS

SEQ ID NO: 148221 - protein, 36 aa, Artificial Sequence
  Description of Artificial Sequence: Synthetic polypeptide
DEEEIATTNPVATEQYGSVSSTTPAGTNPDNGMEPV

SEQ ID NO: 148222 - protein, 34 aa, Artificial Sequence
  Description of Artificial Sequence: Synthetic polypeptide
DEEEIRTTNPCATEPYGSCAATNGLATAPGEMWN

SEQ ID NO: 148223 - protein, 33 aa, Artificial Sequence
  Description of Artificial Sequence: Synthetic polypeptide
SEEEIRCTNPTAYEQWGSTVYGENEMHRDGDNR

SEQ ID NO: 148224 - protein, 33 aa, Artificial Sequence
  Description of Artificial Sequence: Synthetic polypeptide
SEEEIRTTNPEATDQYGQVCCCDQDQKREGNDK

SEQ ID NO: 148225 - protein, 33 aa, Artificial Sequence
  Description of Artificial Sequence: Synthetic polypeptide
SEEEIRTTNPEATDQYGQVCCCDQDQKREGNSK

SEQ ID NO: 148226 - protein, 37 aa, Artificial Sequence
  Description of Artificial Sequence: Synthetic polypeptide
DEEEIRTTNPVATEQYGDVVNGFGVTNDQEGGDEQTR

SEQ ID NO: 148227 - protein, 35 aa, Artificial Sequence
  Description of Artificial Sequence: Synthetic polypeptide
DEEEIRTTNPCATEQYGQCVCGTNHNQNFGSDTAS

SEQ ID NO: 148228 - protein, 31 aa, Artificial Sequence
  Description of Artificial Sequence: Synthetic polypeptide
DETEIRTTNPIATECWGATWAENLMERGPYI

SEQ ID NO: 148229 - protein, 32 aa, Artificial Sequence
  Description of Artificial Sequence: Synthetic polypeptide
DETEIRTTNPIATECWGATTANDEDLQPGNYI

SEQ ID NO: 148230 - protein, 33 aa, Artificial Sequence
  Description of Artificial Sequence: Synthetic polypeptide
DETEIRTTNPCAYEQWGSVCYNIQEKRDQDNDS

SEQ ID NO: 148231 - protein, 33 aa, Artificial Sequence
  Description of Artificial Sequence: Synthetic polypeptide
DETEIRTTNPCAYEEWGSVAMTNDHGGRGGNTA

SEQ ID NO: 148232 - protein, 36 aa, Artificial Sequence
  Description of Artificial Sequence: Synthetic polypeptide
DEEEIRTTNPVATEQYGSVPESGSSLWPTVGMSDVL

SEQ ID NO: 148233 - protein, 34 aa, Artificial Sequence
  Description of Artificial Sequence: Synthetic polypeptide
SEEEIRTTNPVATEGYGCTSIMNVIGQGGGGNEG

SEQ ID NO: 148234 - protein, 34 aa, Artificial Sequence
  Description of Artificial Sequence: Synthetic polypeptide
DEEEIRTTNPCATEQYGQCVCQWNHQNFGSDTAA

SEQ ID NO: 148235 - protein, 32 aa, Artificial Sequence
  Description of Artificial Sequence: Synthetic polypeptide
DETEIRTTNPIATECWGAVANAEDWQERKGNI

SEQ ID NO: 148236 - protein, 31 aa, Artificial Sequence
  Description of Artificial Sequence: Synthetic polypeptide
QEGEIAPTNPCSYEQYGCTVSCGNLQSGGTR

SEQ ID NO: 148237 - protein, 33 aa, Artificial Sequence
  Description of Artificial Sequence: Synthetic polypeptide
SEEEIRTTNPVATEGYGCVCSNTEDAHFGSDTQ

SEQ ID NO: 148238 - protein, 30 aa, Artificial Sequence
  Description of Artificial Sequence: Synthetic polypeptide
QEGEIAPTNPCSYEQWGVVSKNLEQSGDHR

SEQ ID NO: 148239 - protein, 29 aa, Artificial Sequence
  Description of Artificial Sequence: Synthetic peptide
QEGEIAPTNPCSYEQWGNVSCNLQSGDTS

SEQ ID NO: 148240 - protein, 34 aa, Artificial Sequence
  Description of Artificial Sequence: Synthetic polypeptide
SEEEIRTTNPVATEGYGCVCSNTNHAENFGSDTQ

SEQ ID NO: 148241 - protein, 34 aa, Artificial Sequence
  Description of Artificial Sequence: Synthetic polypeptide
SEEEIRTTNPVATEGYGCVCSNTNHAYFGSDTQM

SEQ ID NO: 148242 - protein, 30 aa, Artificial Sequence
  Description of Artificial Sequence: Synthetic polypeptide
QEGEIAPTNPCSYEQWGIVSCNLQSGDTNM

SEQ ID NO: 148243 - protein, 35 aa, Artificial Sequence
  Description of Artificial Sequence: Synthetic polypeptide
SEEEIRTTNPVATEGYGCVCSNTNLIEYFGSDTQS

SEQ ID NO: 148244 - protein, 36 aa, Artificial Sequence
  Description of Artificial Sequence: Synthetic polypeptide
DEEEIRTTNPVATEQYGSVPENVSNLPQFQEVELTI

SEQ ID NO: 148245 - protein, 34 aa, Artificial Sequence
  Description of Artificial Sequence: Synthetic polypeptide
SEEEIRTTNPVATEGYGCVCSNSNLIHFGSDTQA

SEQ ID NO: 148246 - protein, 33 aa, Artificial Sequence
  Description of Artificial Sequence: Synthetic polypeptide
DETEIRTTNPIATECWGAVWANAEDWQERKGNI

SEQ ID NO: 148247 - protein, 31 aa, Artificial Sequence
  Description of Artificial Sequence: Synthetic polypeptide
DETEIRTTNPIATECWGAVWSEDWQEPKGPL

SEQ ID NO: 148248 - protein, 32 aa, Artificial Sequence
  Description of Artificial Sequence: Synthetic polypeptide
DETEIRTTNPIATECWGSTSATDLADHKGEDI

SEQ ID NO: 148249 - protein, 35 aa, Artificial Sequence
  Description of Artificial Sequence: Synthetic polypeptide
DETEIRTTNPVAFEQYGSVIDGGNGLEGGNGNNGN

SEQ ID NO: 148250 - protein, 35 aa, Artificial Sequence
  Description of Artificial Sequence: Synthetic polypeptide
DETEIRTTNPVAFEQYGSVIDGGNDLENGGNGNGE

SEQ ID NO: 148251 - protein, 37 aa, Artificial Sequence
  Description of Artificial Sequence: Synthetic polypeptide
DEEEIRTTNPVATEQYGSVPGTNNNNEGPETQEMMRT

SEQ ID NO: 148252 - protein, 37 aa, Artificial Sequence
  Description of Artificial Sequence: Synthetic polypeptide
DEEEIRTTNPVATEQYGSVSSTTPAGPNMRNGMKPQP

SEQ ID NO: 148253 - protein, 36 aa, Artificial Sequence
  Description of Artificial Sequence: Synthetic polypeptide
DETEIRTTNPIATEQYGSVWSTAEDGPNERKGMNYV

SEQ ID NO: 148254 - protein, 36 aa, Artificial Sequence
  Description of Artificial Sequence: Synthetic polypeptide
DETEIRTTNPIATEQYGSVSSTAEDGPNERKGMNYV

SEQ ID NO: 148255 - protein, 31 aa, Artificial Sequence
  Description of Artificial Sequence: Synthetic polypeptide
DETEIRTTNPIATEQWGAVANAENWAPGPYI

SEQ ID NO: 148256 - protein, 32 aa, Artificial Sequence
  Description of Artificial Sequence: Synthetic polypeptide
DETEIRTTNPIATEPYGTTWSMEDWAQQNGNI

SEQ ID NO: 148257 - protein, 32 aa, Artificial Sequence
  Description of Artificial Sequence: Synthetic polypeptide
DETEIRTTNPIATEPYGTTWSMEDWAQQKGNI

SEQ ID NO: 148258 - protein, 32 aa, Artificial Sequence
  Description of Artificial Sequence: Synthetic polypeptide
DETEIRTTNPIATEPYGATWSMEDWAQQKGNI

SEQ ID NO: 148259 - protein, 32 aa, Artificial Sequence
  Description of Artificial Sequence: Synthetic polypeptide
DETEIRTTNPIATECYGTVWSNAEGPAFKGND

SEQ ID NO: 148260 - protein, 34 aa, Artificial Sequence
  Description of Artificial Sequence: Synthetic polypeptide
DETEIRTTNPIATECYGSTTWSNAENLAERGPYI

SEQ ID NO: 148261 - protein, 34 aa, Artificial Sequence
  Description of Artificial Sequence: Synthetic polypeptide
SEEEIRTTNPVATEFYGSVNNMSGMDEGTGENGD

SEQ ID NO: 148262 - protein, 30 aa, Artificial Sequence
  Description of Artificial Sequence: Synthetic polypeptide
DETEIRTTNPIATECYGAVSEECWAEHEEI

SEQ ID NO: 148263 - protein, 36 aa, Artificial Sequence
  Description of Artificial Sequence: Synthetic polypeptide
DEEEIRTTNPVATEQYGSVPETVTGAINTTQVYPEY

SEQ ID NO: 148264 - protein, 32 aa, Artificial Sequence
  Description of Artificial Sequence: Synthetic polypeptide
SEEEIRTTNPVATEGYGCTSIMNEGEGGGGQE

SEQ ID NO: 148265 - protein, 33 aa, Artificial Sequence
  Description of Artificial Sequence: Synthetic polypeptide
DETEIRTTNPIATECWGSVANAEDEPQERKGNI

SEQ ID NO: 148266 - protein, 31 aa, Artificial Sequence
  Description of Artificial Sequence: Synthetic polypeptide
DETEIRTTNPIATECWGSTTSEDLMPKGPYI

SEQ ID NO: 148267 - protein, 32 aa, Artificial Sequence
  Description of Artificial Sequence: Synthetic polypeptide
DETEIRTTNPIATECWGSTSNTDLADHKGEDI

SEQ ID NO: 148268 - protein, 30 aa, Artificial Sequence
  Description of Artificial Sequence: Synthetic polypeptide
QEGEIAPTNPCSYEQWGIVSCDNLQDGDTR

SEQ ID NO: 148269 - protein, 38 aa, Artificial Sequence
  Description of Artificial Sequence: Synthetic polypeptide
DEEEIRTTNPVATEQYGSVPGTNPNNLGPETQNMMVRE

SEQ ID NO: 148270 - protein, 29 aa, Artificial Sequence
  Description of Artificial Sequence: Synthetic peptide
QEGEIAPTNPCSYEQWGEVSWNDQSGDTR

SEQ ID NO: 148271 - protein, 30 aa, Artificial Sequence
  Description of Artificial Sequence: Synthetic polypeptide
DETEIRSTNPVATECWGATTWAANWQPGPI

SEQ ID NO: 148272 - protein, 35 aa, Artificial Sequence
  Description of Artificial Sequence: Synthetic polypeptide
DETEINTTNPVATEQYGETIVSINEHSQESNGGNQ

SEQ ID NO: 148273 - protein, 35 aa, Artificial Sequence
  Description of Artificial Sequence: Synthetic polypeptide
DEEEIRTTNPCATEQYGSTPEIANLQATTQPVGQN

SEQ ID NO: 148274 - protein, 32 aa, Artificial Sequence
  Description of Artificial Sequence: Synthetic polypeptide
NETEIATTNPVAYEEWGVVSTNLQGNDQQNTD

SEQ ID NO: 148275 - protein, 36 aa, Artificial Sequence
  Description of Artificial Sequence: Synthetic polypeptide
DEEEIRTTNPVATEQYGDVNSDGQNLGMGEGGETTQ

SEQ ID NO: 148276 - protein, 31 aa, Artificial Sequence
  Description of Artificial Sequence: Synthetic polypeptide
NETEIATTNPVAYEHWGEVATNMQGNSGNDS

SEQ ID NO: 148277 - protein, 33 aa, Artificial Sequence
  Description of Artificial Sequence: Synthetic polypeptide
NETEIATTNPVAYEHWGNVSTGNLQGNSGNDDS

SEQ ID NO: 148278 - protein, 33 aa, Artificial Sequence
  Description of Artificial Sequence: Synthetic polypeptide
NETEIATTNPVAYEHWGNVSTNLPQGNSGNEDS

SEQ ID NO: 148279 - protein, 36 aa, Artificial Sequence
  Description of Artificial Sequence: Synthetic polypeptide
SEEEIRTTNPVATEQWGSVSCLDSTPAQRNQDEGMD

SEQ ID NO: 148280 - protein, 35 aa, Artificial Sequence
  Description of Artificial Sequence: Synthetic polypeptide
DEEEIRTTNPVATEQYGDVQCPTPLDVEQQLVTEH

SEQ ID NO: 148281 - protein, 34 aa, Artificial Sequence
  Description of Artificial Sequence: Synthetic polypeptide
DEEEIRTTNPVATEQYGDVMSGIGGNGDGEEFEE

SEQ ID NO: 148282 - protein, 34 aa, Artificial Sequence
  Description of Artificial Sequence: Synthetic polypeptide
SEEEIRTTNPVATEQYGCCNTSVILETRPENKEA

SEQ ID NO: 148283 - protein, 32 aa, Artificial Sequence
  Description of Artificial Sequence: Synthetic polypeptide
NETEIATTNPVAYEHWGNVSTNLQGNSGGQDS

SEQ ID NO: 148284 - protein, 31 aa, Artificial Sequence
  Description of Artificial Sequence: Synthetic polypeptide
NETEIATTNPVAYEHWGNVTTNLQGNSGDDS

SEQ ID NO: 148285 - protein, 34 aa, Artificial Sequence
  Description of Artificial Sequence: Synthetic polypeptide
SEEEIRTTNPVATEQYGCMNTSVLETTRLENKEA

SEQ ID NO: 148286 - protein, 32 aa, Artificial Sequence
  Description of Artificial Sequence: Synthetic polypeptide
SEEEIRTTNPVATEQYGCMNTSVLETYPEQKE

SEQ ID NO: 148287 - protein, 33 aa, Artificial Sequence
  Description of Artificial Sequence: Synthetic polypeptide
NETEIATTNPVAYEPWGSTSTNLNQGNDGQNTD

SEQ ID NO: 148288 - protein, 36 aa, Artificial Sequence
  Description of Artificial Sequence: Synthetic polypeptide
DEEEIACTNPVATEQYGSVCAATGVLAPGEQMEGNE

SEQ ID NO: 148289 - protein, 35 aa, Artificial Sequence
  Description of Artificial Sequence: Synthetic polypeptide
DEEEIATTNPVATEQYGSVCWVPGEATEDGTGARP

SEQ ID NO: 148290 - protein, 36 aa, Artificial Sequence
  Description of Artificial Sequence: Synthetic polypeptide
DETEIKTTNPVATEQYGAVDTDDNNEQIGGQNRGTG

SEQ ID NO: 148291 - protein, 34 aa, Artificial Sequence
  Description of Artificial Sequence: Synthetic polypeptide
DEEEIRTTNPCATEQYGSMASPVSNIVTIAVVND

SEQ ID NO: 148292 - protein, 30 aa, Artificial Sequence
  Description of Artificial Sequence: Synthetic polypeptide
DETEIRCTNPIATEQWGSTWSEDWAEPGPI

SEQ ID NO: 148293 - protein, 34 aa, Artificial Sequence
  Description of Artificial Sequence: Synthetic polypeptide
DEEEIRTTNPCATEQYGSMASPVNIVPIAVVNDQ

SEQ ID NO: 148294 - protein, 30 aa, Artificial Sequence
  Description of Artificial Sequence: Synthetic polypeptide
QEGEIAPTNPCSYEQWGETVSCNLQSGDTR

SEQ ID NO: 148295 - protein, 36 aa, Artificial Sequence
  Description of Artificial Sequence: Synthetic polypeptide
DEEEIRTTNPVATEQYGDVSSTTPAGPNMRNGMHPV

SEQ ID NO: 148296 - protein, 29 aa, Artificial Sequence
  Description of Artificial Sequence: Synthetic peptide
QEGEIAPTNPCSYEPYGIVSCNLQSGTMK

SEQ ID NO: 148297 - protein, 34 aa, Artificial Sequence
  Description of Artificial Sequence: Synthetic polypeptide
SEEEIRTTNPVATEGYGCYTSIMNEGQGGGGNIP

SEQ ID NO: 148298 - protein, 34 aa, Artificial Sequence
  Description of Artificial Sequence: Synthetic polypeptide
DETEIRCTNPVATEQYGATAWANADWQERKGGYR

SEQ ID NO: 148299 - protein, 35 aa, Artificial Sequence
  Description of Artificial Sequence: Synthetic polypeptide
SEEEIRTTNPVATEGYGDVVSIMGDLGQRNQGEGN

SEQ ID NO: 148300 - protein, 36 aa, Artificial Sequence
  Description of Artificial Sequence: Synthetic polypeptide
DEEEIRTTNPVATEQYGDVSSTTPAGPNMRNGMDPV

SEQ ID NO: 148301 - protein, 35 aa, Artificial Sequence
  Description of Artificial Sequence: Synthetic polypeptide
NETEIATTNPVATENYGCVSTSNGLNDDERGGGMR

SEQ ID NO: 148302 - protein, 37 aa, Artificial Sequence
  Description of Artificial Sequence: Synthetic polypeptide
DEEEIRTTNPVATEQYGSVPEFDSLELDQSEMVEERY

SEQ ID NO: 148303 - protein, 35 aa, Artificial Sequence
  Description of Artificial Sequence: Synthetic polypeptide
SEEEIRTTNPVATEGYGSVVMGMGDLGQRNQGEGD

SEQ ID NO: 148304 - protein, 33 aa, Artificial Sequence
  Description of Artificial Sequence: Synthetic polypeptide
SEEEIRTTNPVATEGYGTTVIMNMGQGGGGQST

SEQ ID NO: 148305 - protein, 35 aa, Artificial Sequence
  Description of Artificial Sequence: Synthetic polypeptide
DEEEIRTTNPVATEQYGSVPEAPGIVLTSGLSEQE

SEQ ID NO: 148306 - protein, 35 aa, Artificial Sequence
  Description of Artificial Sequence: Synthetic polypeptide
SEEEIRTTNPVATEIYGSVMGFTNELVNEGDGQGE

SEQ ID NO: 148307 - protein, 35 aa, Artificial Sequence
  Description of Artificial Sequence: Synthetic polypeptide
DEEEIRTTNPVATEQYGDVSNMEAYANQMQMSVQI

SEQ ID NO: 148308 - protein, 33 aa, Artificial Sequence
  Description of Artificial Sequence: Synthetic polypeptide
DETEIRCTNPIATEQYGATVWSNADWAEPKGNR

SEQ ID NO: 148309 - protein, 34 aa, Artificial Sequence
  Description of Artificial Sequence: Synthetic polypeptide
DEEEIRTTNPCATEQYGSCAASSLQAMPGDLMAM

SEQ ID NO: 148310 - protein, 33 aa, Artificial Sequence
  Description of Artificial Sequence: Synthetic polypeptide
NETEIATTNPVAYECWGNVSTNLPQGQMGDGDR

SEQ ID NO: 148311 - protein, 37 aa, Artificial Sequence
  Description of Artificial Sequence: Synthetic polypeptide
DEEEIRTTNPVATEQYGSVPCYDNLQVDQSEMVEENV

SEQ ID NO: 148312 - protein, 30 aa, Artificial Sequence
  Description of Artificial Sequence: Synthetic polypeptide
QEGEIAPTNPCSYEPYGETVSCNLSQSGTR

SEQ ID NO: 148313 - protein, 36 aa, Artificial Sequence
  Description of Artificial Sequence: Synthetic polypeptide
DEEEIRTTNPVATEQYGSVPENDANLPQFQEVELEV

SEQ ID NO: 148314 - protein, 35 aa, Artificial Sequence
  Description of Artificial Sequence: Synthetic polypeptide
DEEEIRTTNPCATEQYGCVCSWMEHNANFGSDNQA

SEQ ID NO: 148315 - protein, 37 aa, Artificial Sequence
  Description of Artificial Sequence: Synthetic polypeptide
DETEIRTTNPVAFEQYGSVIDGQTNGLQEGGNGNNGD

SEQ ID NO: 148316 - protein, 34 aa, Artificial Sequence
  Description of Artificial Sequence: Synthetic polypeptide
DEEEIRTTNPCATEQYGCVCSWENPNANFGSDQS

SEQ ID NO: 148317 - protein, 36 aa, Artificial Sequence
  Description of Artificial Sequence: Synthetic polypeptide
DEEEIATTNPVATEQYGSVSAMNPAGINMANGMNPV

SEQ ID NO: 148318 - protein, 31 aa, Artificial Sequence
  Description of Artificial Sequence: Synthetic polypeptide
QEGEIAPTNPCSYEQYGNIVSCMNDLQSGTR

SEQ ID NO: 148319 - protein, 34 aa, Artificial Sequence
  Description of Artificial Sequence: Synthetic polypeptide
NESEIRTTNPVATECWGSVSCINEPTDREGENYG

SEQ ID NO: 148320 - protein, 34 aa, Artificial Sequence
  Description of Artificial Sequence: Synthetic polypeptide
NESEIRTTNPVATEQWGAVAWTDNMQQQDRGSSQ

SEQ ID NO: 148321 - protein, 38 aa, Artificial Sequence
  Description of Artificial Sequence: Synthetic polypeptide
AEEEIRTTNPVATEQYGSVVVTTVNNLEQGTEQGNTTS

SEQ ID NO: 148322 - protein, 30 aa, Artificial Sequence
  Description of Artificial Sequence: Synthetic polypeptide
DETEIRTTNPVATECWGDVSEIEMEAAEDA

SEQ ID NO: 148323 - protein, 36 aa, Artificial Sequence
  Description of Artificial Sequence: Synthetic polypeptide
DEEEIRTTNPVATEQYGDVVDQDTMNNNEEGTNGQT

SEQ ID NO: 148324 - protein, 35 aa, Artificial Sequence
  Description of Artificial Sequence: Synthetic polypeptide
DEEEIRTTNPVATEQYGDVVDNTGLEMTMEGGTGD

SEQ ID NO: 148325 - protein, 34 aa, Artificial Sequence
  Description of Artificial Sequence: Synthetic polypeptide
DETEIRTTNPVATECWGSTVSAENEPQEPEGEPG

SEQ ID NO: 148326 - protein, 35 aa, Artificial Sequence
  Description of Artificial Sequence: Synthetic polypeptide
DEEEIRTTNPVATEQYGDVVDNMTPGQGEGGQEGF

SEQ ID NO: 148327 - protein, 36 aa, Artificial Sequence
  Description of Artificial Sequence: Synthetic polypeptide
DEEEIRTTNPVATEQYGSVPLTPLSSTPVELENPLA

SEQ ID NO: 148328 - protein, 35 aa, Artificial Sequence
  Description of Artificial Sequence: Synthetic polypeptide
NESEIRTTNPVATEQYGSVSDTAFLEHLTEPGQQD

SEQ ID NO: 148329 - protein, 35 aa, Artificial Sequence
  Description of Artificial Sequence: Synthetic polypeptide
DEEEIRTTNPVATEQYGSVPLPNPTQPQDVVLIQN

SEQ ID NO: 148330 - protein, 36 aa, Artificial Sequence
  Description of Artificial Sequence: Synthetic polypeptide
DEEEIRTTNPVATEQYGDVVDGFQNDEFQGGGNNVI

SEQ ID NO: 148331 - protein, 35 aa, Artificial Sequence
  Description of Artificial Sequence: Synthetic polypeptide
DEEEIRTTNPVATEQYGDVVDGFNGEDFELDDGQA

SEQ ID NO: 148332 - protein, 34 aa, Artificial Sequence
  Description of Artificial Sequence: Synthetic polypeptide
DEEEIRTTNPVATEQYGDVVDGFNGEDFEDGEII

SEQ ID NO: 148333 - protein, 32 aa, Artificial Sequence
  Description of Artificial Sequence: Synthetic polypeptide
DETEIRTTNPVATECWGATWANSETLQPGPYI

SEQ ID NO: 148334 - protein, 30 aa, Artificial Sequence
  Description of Artificial Sequence: Synthetic polypeptide
QEGEIAPTNPCSYEQYGKVSCCHLQSGGTR

SEQ ID NO: 148335 - protein, 32 aa, Artificial Sequence
  Description of Artificial Sequence: Synthetic polypeptide
QEGEIAPTNPCSYEQYGKVSCCNLQSTGGTNR

SEQ ID NO: 148336 - protein, 33 aa, Artificial Sequence
  Description of Artificial Sequence: Synthetic polypeptide
DETEIRTTNPVATECWGSTWANCINWQDRKGPI

SEQ ID NO: 148337 - protein, 35 aa, Artificial Sequence
  Description of Artificial Sequence: Synthetic polypeptide
DEEEIACTNPVATEQYGSVCAAMNPLNDMDGGANA

SEQ ID NO: 148338 - protein, 36 aa, Artificial Sequence
  Description of Artificial Sequence: Synthetic polypeptide
DEEEIRTTNPVATEQYGDVVGSGMGNLGETVQDDDG

SEQ ID NO: 148339 - protein, 36 aa, Artificial Sequence
  Description of Artificial Sequence: Synthetic polypeptide
SEEEIRTTNPFATEQYGSVSSTTPAGPNMRNGMNPV

SEQ ID NO: 148340 - protein, 36 aa, Artificial Sequence
  Description of Artificial Sequence: Synthetic polypeptide
DEEEIRTTNPVATEQYGDVVNGFGTNNDQEEGIEQT

SEQ ID NO: 148341 - protein, 36 aa, Artificial Sequence
  Description of Artificial Sequence: Synthetic polypeptide
DEEEIATTNPVATEQYGSVSATTPAGTNQRNPMEPV

SEQ ID NO: 148342 - protein, 36 aa, Artificial Sequence
  Description of Artificial Sequence: Synthetic polypeptide
DEEEIRTTNPVATEQYGDVVNGFGTNDQLEGGEEQT

SEQ ID NO: 148343 - protein, 36 aa, Artificial Sequence
  Description of Artificial Sequence: Synthetic polypeptide
DEEEIRTTNPVATEQYGDVVNGFGTNDQEGDDEQTV

SEQ ID NO: 148344 - protein, 36 aa, Artificial Sequence
  Description of Artificial Sequence: Synthetic polypeptide
DEEEIRTTNPVATEQYGDVVNGFGTNDQDEGGIEQD

SEQ ID NO: 148345 - protein, 32 aa, Artificial Sequence
  Description of Artificial Sequence: Synthetic polypeptide
SEEEIRTTNPIATECYGSTVANADWAEPKGNI

SEQ ID NO: 148346 - protein, 36 aa, Artificial Sequence
  Description of Artificial Sequence: Synthetic polypeptide
DEEEIRTTNPVATEQYGDVVNGFGTNDEQNGGIEET

SEQ ID NO: 148347 - protein, 36 aa, Artificial Sequence
  Description of Artificial Sequence: Synthetic polypeptide
DEEEIRTTNPVATEQYGDVVNGFGTDNDQEQGDEQT

SEQ ID NO: 148348 - protein, 37 aa, Artificial Sequence
  Description of Artificial Sequence: Synthetic polypeptide
DEEEIRTTNPVATEQYGDVVNGFGQTNDGQNGGINQT

SEQ ID NO: 148349 - protein, 36 aa, Artificial Sequence
  Description of Artificial Sequence: Synthetic polypeptide
DEEEIRTTNPVATEQYGDVVNGFGITNQQEGGDEQT

SEQ ID NO: 148350 - protein, 35 aa, Artificial Sequence
  Description of Artificial Sequence: Synthetic polypeptide
DEEEIRTTNPVATEQYGDVVNGFGDNQQEGGQEQT

SEQ ID NO: 148351 - protein, 31 aa, Artificial Sequence
  Description of Artificial Sequence: Synthetic polypeptide
QEGEIAPTNPCSYEQYGVVSCCNLQSTGGSR

SEQ ID NO: 148352 - protein, 32 aa, Artificial Sequence
  Description of Artificial Sequence: Synthetic polypeptide
NESEIATTNPVAYEQWGSVRWWNQDEQTGENH

SEQ ID NO: 148353 - protein, 31 aa, Artificial Sequence
  Description of Artificial Sequence: Synthetic polypeptide
QEGEIAPTNPCSYEQYGTTVSCNMLSQSGTR

SEQ ID NO: 148354 - protein, 36 aa, Artificial Sequence
  Description of Artificial Sequence: Synthetic polypeptide
DEEEIRTTNPVATEQYGDVVGSGMTDQFEGGGEERG

SEQ ID NO: 148355 - protein, 36 aa, Artificial Sequence
  Description of Artificial Sequence: Synthetic polypeptide
DEEEIRTTNPVATEQYGDVVGSGMGNLQTTSDDDDQ

SEQ ID NO: 148356 - protein, 37 aa, Artificial Sequence
  Description of Artificial Sequence: Synthetic polypeptide
DEEEIRTTNPVATEQYGDVVGSGMGNLQNISDEDGDE

SEQ ID NO: 148357 - protein, 36 aa, Artificial Sequence
  Description of Artificial Sequence: Synthetic polypeptide
DEEEIRTTNPVATEQYGDVVGSGMGNLQEESDDDDE

SEQ ID NO: 148358 - protein, 31 aa, Artificial Sequence
  Description of Artificial Sequence: Synthetic polypeptide
DETEIRTTNPVATECWGATTWANANWQPGPI

SEQ ID NO: 148359 - protein, 31 aa, Artificial Sequence
  Description of Artificial Sequence: Synthetic polypeptide
DETEIRTTNPVATECWGATTWANADWQPGPI

SEQ ID NO: 148360 - protein, 36 aa, Artificial Sequence
  Description of Artificial Sequence: Synthetic polypeptide
DEEEIRTTNPVATEQYGDVVDFGNLNIQDEDENGDT

SEQ ID NO: 148361 - protein, 30 aa, Artificial Sequence
  Description of Artificial Sequence: Synthetic polypeptide
DETEIRTTNPVATECWGATTWAEDWARGGI

SEQ ID NO: 148362 - protein, 33 aa, Artificial Sequence
  Description of Artificial Sequence: Synthetic polypeptide
SEEEIRTTNPVATDHYGSSCFNTNLHDGEDQDD

SEQ ID NO: 148363 - protein, 34 aa, Artificial Sequence
  Description of Artificial Sequence: Synthetic polypeptide
SEEEIRTTNPVATDSYGSCHPNTNHVHRGSDQRD

SEQ ID NO: 148364 - protein, 30 aa, Artificial Sequence
  Description of Artificial Sequence: Synthetic polypeptide
DETEIRTTNPVATEAWGDVSEIEMNAAEDA

SEQ ID NO: 148365 - protein, 34 aa, Artificial Sequence
  Description of Artificial Sequence: Synthetic polypeptide
SEEEIRTTNPVATDSYGSCHSNTNHHRQGSDQTD

SEQ ID NO: 148366 - protein, 36 aa, Artificial Sequence
  Description of Artificial Sequence: Synthetic polypeptide
DETEIRTTNPVATDQYGSVVGDTDDNDQENGNEEGD

SEQ ID NO: 148367 - protein, 35 aa, Artificial Sequence
  Description of Artificial Sequence: Synthetic polypeptide
DEEEIRTTNPCATEQYGCVCQSEELNQNFGSDTAS

SEQ ID NO: 148368 - protein, 36 aa, Artificial Sequence
  Description of Artificial Sequence: Synthetic polypeptide
DEEEIRTTNPVATEQYGSVPIANPTQPVHHVLIQNI

SEQ ID NO: 148369 - protein, 34 aa, Artificial Sequence
  Description of Artificial Sequence: Synthetic polypeptide
DEEEIRTTNPCATEQYGCVCQTGELQNFISDTAS

SEQ ID NO: 148370 - protein, 35 aa, Artificial Sequence
  Description of Artificial Sequence: Synthetic polypeptide
DETEIRTTNPVATDQYGSVVDNNDNDQEEGNEEGD

SEQ ID NO: 148371 - protein, 34 aa, Artificial Sequence
  Description of Artificial Sequence: Synthetic polypeptide
DEEEIRTTNPCATEQYGCVCSNWEHNAHFGSDQS

SEQ ID NO: 148372 - protein, 37 aa, Artificial Sequence
  Description of Artificial Sequence: Synthetic polypeptide
DEEEIRTTNPVATEQYGSVSSTTPAGPNMRNGMFPVA

SEQ ID NO: 148373 - protein, 34 aa, Artificial Sequence
  Description of Artificial Sequence: Synthetic polypeptide
DEEEIRTTNPCATEQYGCVCSNWEIAEYFGSNQS

SEQ ID NO: 148374 - protein, 34 aa, Artificial Sequence
  Description of Artificial Sequence: Synthetic polypeptide
DEEEIRTTNPCATEQYGCVCSSEHNAEYFGSDQA

SEQ ID NO: 148375 - protein, 35 aa, Artificial Sequence
  Description of Artificial Sequence: Synthetic polypeptide
SEEEIRTTNPVATECYGSVVSIMGDLGQQNEGEGT

SEQ ID NO: 148376 - protein, 35 aa, Artificial Sequence
  Description of Artificial Sequence: Synthetic polypeptide
DEEEIRTTNPCATEQYGCVCSTWGEHNAYFGSDQS

SEQ ID NO: 148377 - protein, 30 aa, Artificial Sequence
  Description of Artificial Sequence: Synthetic polypeptide
DETEIRTTNPVATDQWGDVSEIEMNAAEDA

SEQ ID NO: 148378 - protein, 35 aa, Artificial Sequence
  Description of Artificial Sequence: Synthetic polypeptide
DETEIRTTNPVAFEQYGSVIITDNGGEEGGNGNGN

SEQ ID NO: 148379 - protein, 37 aa, Artificial Sequence
  Description of Artificial Sequence: Synthetic polypeptide
DEEEIRTTNPVATEQYGSVPHPTNVLPIGQDQLMEHS

SEQ ID NO: 148380 - protein, 33 aa, Artificial Sequence
  Description of Artificial Sequence: Synthetic polypeptide
DEEEIRTTNPCATEQYGCVCSWEINANFNSDQS

SEQ ID NO: 148381 - protein, 34 aa, Artificial Sequence
  Description of Artificial Sequence: Synthetic polypeptide
NESEIRTTNPVATESWGSVSCWNISQTTGGNNPF

SEQ ID NO: 148382 - protein, 28 aa, Artificial Sequence
  Description of Artificial Sequence: Synthetic peptide
NENEIATTNPVAYECWGVCSECLQHNES

SEQ ID NO: 148383 - protein, 35 aa, Artificial Sequence
  Description of Artificial Sequence: Synthetic polypeptide
DEEEIACTNPVATEQYGSVCAANPQQEHQDGNAHQ

SEQ ID NO: 148384 - protein, 36 aa, Artificial Sequence
  Description of Artificial Sequence: Synthetic polypeptide
SEEEIRTTNPSATEQYGSVSSTTKAGPNMRNGMNPV

SEQ ID NO: 148385 - protein, 35 aa, Artificial Sequence
  Description of Artificial Sequence: Synthetic polypeptide
DEEEIRTTNPVATEQYGDVVDFGNLNGDDEDENGD

SEQ ID NO: 148386 - protein, 30 aa, Artificial Sequence
  Description of Artificial Sequence: Synthetic polypeptide
DETEIRTTNPVATECWGATTWAADWARGPI

SEQ ID NO: 148387 - protein, 30 aa, Artificial Sequence
  Description of Artificial Sequence: Synthetic polypeptide
DETEIRTTNPVATECWGATTWAADWARGGI

SEQ ID NO: 148388 - protein, 37 aa, Artificial Sequence
  Description of Artificial Sequence: Synthetic polypeptide
AEEEIRTTNPVATEQYGSVSTTNNGNQQNATEQGTDE

SEQ ID NO: 148389 - protein, 34 aa, Artificial Sequence
  Description of Artificial Sequence: Synthetic polypeptide
DETEIRTTNPVATECWGATSNAINWPQEREGENG

SEQ ID NO: 148390 - protein, 34 aa, Artificial Sequence
  Description of Artificial Sequence: Synthetic polypeptide
DETEIRTTNPVATECWGATSNAINEPQEREGENG

SEQ ID NO: 148391 - protein, 34 aa, Artificial Sequence
  Description of Artificial Sequence: Synthetic polypeptide
DETEIRTTNPVATECWGATSNAINEPQDREGENG

SEQ ID NO: 148392 - protein, 37 aa, Artificial Sequence
  Description of Artificial Sequence: Synthetic polypeptide
DEEEIRTTNPVATEQYGSVPLNNPTQAQDVIGQIQNP

SEQ ID NO: 148393 - protein, 33 aa, Artificial Sequence
  Description of Artificial Sequence: Synthetic polypeptide
DETEIRTTNPVATECWGATAWSNANLARKGGYI

SEQ ID NO: 148394 - protein, 31 aa, Artificial Sequence
  Description of Artificial Sequence: Synthetic polypeptide
DETEIRTTNPVATECWGAISAEDWQQPKGPI

SEQ ID NO: 148395 - protein, 31 aa, Artificial Sequence
  Description of Artificial Sequence: Synthetic polypeptide
DETEIRTTNPVATECWGAISAEDIQQPKGPI

SEQ ID NO: 148396 - protein, 36 aa, Artificial Sequence
  Description of Artificial Sequence: Synthetic polypeptide
DEEEIRTTNPVATEQYGDVVDDGNLNQQDEGETGTD

SEQ ID NO: 148397 - protein, 31 aa, Artificial Sequence
  Description of Artificial Sequence: Synthetic polypeptide
DETEIRTTNPVATECWGAASANWAEPKGGYI

SEQ ID NO: 148398 - protein, 35 aa, Artificial Sequence
  Description of Artificial Sequence: Synthetic polypeptide
DEEEIRTTNPVATEQYGDVVCPTPLVTEQQLVTEH

SEQ ID NO: 148399 - protein, 38 aa, Artificial Sequence
  Description of Artificial Sequence: Synthetic polypeptide
AEEEIRTTNPVATEQYGSVVVTTTNNLQAGTEGGNNTD

SEQ ID NO: 148400 - protein, 38 aa, Artificial Sequence
  Description of Artificial Sequence: Synthetic polypeptide
AEEEIRTTNPVATEQYGSVSTTNNDNLEQGSNTTNNDD

SEQ ID NO: 148401 - protein, 35 aa, Artificial Sequence
  Description of Artificial Sequence: Synthetic polypeptide
DETEIRTTNPVATEAYGSVSGGTNDGEFTGGGGTT

SEQ ID NO: 148402 - protein, 34 aa, Artificial Sequence
  Description of Artificial Sequence: Synthetic polypeptide
DETEIRTTNPVATEAWGSVSVVNNNNNDDEGENG

SEQ ID NO: 148403 - protein, 37 aa, Artificial Sequence
  Description of Artificial Sequence: Synthetic polypeptide
DEEEIRTTNPVATEQYGSVSSTTPAGPNMRNGMEPVY

SEQ ID NO: 148404 - protein, 33 aa, Artificial Sequence
  Description of Artificial Sequence: Synthetic polypeptide
DEEEIRTTNPCATEQYGCVCGSEDQNFGSDTAS

SEQ ID NO: 148405 - protein, 30 aa, Artificial Sequence
  Description of Artificial Sequence: Synthetic polypeptide
QEGEIASTNPCSSEQYGIVAANNLQSVGTR

SEQ ID NO: 148406 - protein, 34 aa, Artificial Sequence
  Description of Artificial Sequence: Synthetic polypeptide
DEEEIATTNPVAWECWGSVSCTGQAQVRTVFNNE

SEQ ID NO: 148407 - protein, 38 aa, Artificial Sequence
  Description of Artificial Sequence: Synthetic polypeptide
DEEEIRTTNPVATEQYGFSVSSTTPAMGPNMRVGMNPV

SEQ ID NO: 148408 - protein, 34 aa, Artificial Sequence
  Description of Artificial Sequence: Synthetic polypeptide
DETSICTTNPCATEQWGVVSTNTTNLQSGTNNVD

SEQ ID NO: 148409 - protein, 34 aa, Artificial Sequence
  Description of Artificial Sequence: Synthetic polypeptide
DETSICTTNPCATEQWGVVSTNNNNLQSGNNEGT

SEQ ID NO: 148410 - protein, 34 aa, Artificial Sequence
  Description of Artificial Sequence: Synthetic polypeptide
DETSICTTNPCATEQWGVVSTNNNNLQAGNNEGT

SEQ ID NO: 148411 - protein, 37 aa, Artificial Sequence
  Description of Artificial Sequence: Synthetic polypeptide
DEEEIRTTNPVATEQYGMIVGSTAGFGNQGGGEGNTG

SEQ ID NO: 148412 - protein, 35 aa, Artificial Sequence
  Description of Artificial Sequence: Synthetic polypeptide
DEEEIRTTNPVATEQYGMCSTTFGMELQTQMQLLE

SEQ ID NO: 148413 - protein, 37 aa, Artificial Sequence
  Description of Artificial Sequence: Synthetic polypeptide
DEEEIRTTNPVATEQYGMAVSSTTPAGPNMRNGMNPV

SEQ ID NO: 148414 - protein, 37 aa, Artificial Sequence
  Description of Artificial Sequence: Synthetic polypeptide
AEEEIRTTNPVATEQYGSVSTTNNQQQQQSTATNNTG

SEQ ID NO: 148415 - protein, 34 aa, Artificial Sequence
  Description of Artificial Sequence: Synthetic polypeptide
DETSICTTNPCATEQWGSVSTVVNNTQSGTNSGD

SEQ ID NO: 148416 - protein, 34 aa, Artificial Sequence
  Description of Artificial Sequence: Synthetic polypeptide
DETSICTTNPCATEQWGVVSTVVTNLQAGTNTQQ

SEQ ID NO: 148417 - protein, 34 aa, Artificial Sequence
  Description of Artificial Sequence: Synthetic polypeptide
DETSICTTNPCATEQWGSVSTVVNNNQSGTNVAD

SEQ ID NO: 148418 - protein, 37 aa, Artificial Sequence
  Description of Artificial Sequence: Synthetic polypeptide
AEEEIRTTNPVATEQYGSVSTVVTQGGNNNLGGNDDN

SEQ ID NO: 148419 - protein, 35 aa, Artificial Sequence
  Description of Artificial Sequence: Synthetic polypeptide
DEEEIRTTNPVATEQYGMAGIMTNGDGQGGEEEGN

SEQ ID NO: 148420 - protein, 38 aa, Artificial Sequence
  Description of Artificial Sequence: Synthetic polypeptide
AEEEIRTTNPVATEQYGSVSTVVTQGGNTNQLGGTNDD

SEQ ID NO: 148421 - protein, 37 aa, Artificial Sequence
  Description of Artificial Sequence: Synthetic polypeptide
AEEEIRTTNPVATEQYGSVSTVVTQGGNVNLGGNNDD

SEQ ID NO: 148422 - protein, 38 aa, Artificial Sequence
  Description of Artificial Sequence: Synthetic polypeptide
AEEEIRTTNPVATEQYGSVVVTVTTNGGNLQQGTNGDD

SEQ ID NO: 148423 - protein, 35 aa, Artificial Sequence
  Description of Artificial Sequence: Synthetic polypeptide
DEEEIRTTNPAATEQYGSVFGNFEDDEGGNQEEIG

SEQ ID NO: 148424 - protein, 35 aa, Artificial Sequence
  Description of Artificial Sequence: Synthetic polypeptide
DEEEIACTNPVATEQYGSVAMNGLTAPDNGMDTRM

SEQ ID NO: 148425 - protein, 30 aa, Artificial Sequence
  Description of Artificial Sequence: Synthetic polypeptide
AENEIRCTNPVSTEPYGEASMDIQQQNGGR

SEQ ID NO: 148426 - protein, 35 aa, Artificial Sequence
  Description of Artificial Sequence: Synthetic polypeptide
DEEEIRTTNPVATEQYGMATIMTNGDGEGGENEGN

SEQ ID NO: 148427 - protein, 34 aa, Artificial Sequence
  Description of Artificial Sequence: Synthetic polypeptide
DETSICTTNPCATEQWGVVSTVVTNLQSGTNVDE

SEQ ID NO: 148428 - protein, 34 aa, Artificial Sequence
  Description of Artificial Sequence: Synthetic polypeptide
DETSICTTNPCATEQWGVVSVVVTNLQSGTNNDD

SEQ ID NO: 148429 - protein, 36 aa, Artificial Sequence
  Description of Artificial Sequence: Synthetic polypeptide
DEEEIRTTNPVATEQYGMSGNGQTDEGQGGGTENND

SEQ ID NO: 148430 - protein, 36 aa, Artificial Sequence
  Description of Artificial Sequence: Synthetic polypeptide
DEEEIRTTNPVATEQYGMSTTVMTNGFGGDEGGQDE

SEQ ID NO: 148431 - protein, 37 aa, Artificial Sequence
  Description of Artificial Sequence: Synthetic polypeptide
DEEEIRTTNPVATEQYGMSTTVMTNGFGGDEGGNNEG

SEQ ID NO: 148432 - protein, 30 aa, Artificial Sequence
  Description of Artificial Sequence: Synthetic polypeptide
QEGEIATTNPVATECYGQVSEWSQHEEECN

SEQ ID NO: 148433 - protein, 31 aa, Artificial Sequence
  Description of Artificial Sequence: Synthetic polypeptide
QEGEIATTNPVATECYGQVSEWLEQHEEELN

SEQ ID NO: 148434 - protein, 36 aa, Artificial Sequence
  Description of Artificial Sequence: Synthetic polypeptide
DEEEIRTTNPVATEQYGMSTTVMTNGFGGDEGGEET

SEQ ID NO: 148435 - protein, 36 aa, Artificial Sequence
  Description of Artificial Sequence: Synthetic polypeptide
DEEEIRTTNPVATEQYGMSTTVMTDGFGGDEGGNIQ

SEQ ID NO: 148436 - protein, 36 aa, Artificial Sequence
  Description of Artificial Sequence: Synthetic polypeptide
DEEEIRTTNPVATEQYGMSTTGTVGDGTGQGGNDEG

SEQ ID NO: 148437 - protein, 38 aa, Artificial Sequence
  Description of Artificial Sequence: Synthetic polypeptide
AEEEIRTTNPVATEQYGSVVVTVTTNNGNLQQGTNTNQ

SEQ ID NO: 148438 - protein, 38 aa, Artificial Sequence
  Description of Artificial Sequence: Synthetic polypeptide
AEEEIRTTNPVATEQYGSVVVTVTTNNGNLQQGTNQTD

SEQ ID NO: 148439 - protein, 37 aa, Artificial Sequence
  Description of Artificial Sequence: Synthetic polypeptide
DEEEIRTTNPVATEQYGSVSSTIDYPTNTPSTQNDHF

SEQ ID NO: 148440 - protein, 33 aa, Artificial Sequence
  Description of Artificial Sequence: Synthetic polypeptide
DEEEIATTNPVAYEQWGQSVSVTGDIGQDMIAD

SEQ ID NO: 148441 - protein, 37 aa, Artificial Sequence
  Description of Artificial Sequence: Synthetic polypeptide
AEEEIRTTNPVATEQYGSVSTTNNYGNQIGTTTTDEQ

SEQ ID NO: 148442 - protein, 37 aa, Artificial Sequence
  Description of Artificial Sequence: Synthetic polypeptide
DEEEIRTTNPVATEQYGMSGTGQEDGNLEDQGGGNNG

SEQ ID NO: 148443 - protein, 36 aa, Artificial Sequence
  Description of Artificial Sequence: Synthetic polypeptide
DEEEIATTNPVAYEQWGIVPSTTLAGSNQRNGGNPV

SEQ ID NO: 148444 - protein, 35 aa, Artificial Sequence
  Description of Artificial Sequence: Synthetic polypeptide
DEEEIRTTNPVATEQYGMSGTGMETGEGAGQGNNV

SEQ ID NO: 148445 - protein, 38 aa, Artificial Sequence
  Description of Artificial Sequence: Synthetic polypeptide
AEEEIRTTNPVATEQYGSVSTTNNTNLEQGSNQQQNDD

SEQ ID NO: 148446 - protein, 36 aa, Artificial Sequence
  Description of Artificial Sequence: Synthetic polypeptide
DEEEIRTTNCVATEQYGSVYNDDTGQQTGEGQGNEG

SEQ ID NO: 148447 - protein, 36 aa, Artificial Sequence
  Description of Artificial Sequence: Synthetic polypeptide
DEEEIRTTNPVATEQYGMSGSNMNIFDTGGGGNQFQ

SEQ ID NO: 148448 - protein, 38 aa, Artificial Sequence
  Description of Artificial Sequence: Synthetic polypeptide
AEEEIRTTNPVATEQYGSVVVTVTTNNGNLQAGTNQII

SEQ ID NO: 148449 - protein, 36 aa, Artificial Sequence
  Description of Artificial Sequence: Synthetic polypeptide
DEDEIRTTNPVATEQYGAMSTIMGNPDQGGGGNEGI

SEQ ID NO: 148450 - protein, 37 aa, Artificial Sequence
  Description of Artificial Sequence: Synthetic polypeptide
DEEEIRTTNPVATEQYGMSTTVMTNGFGGDEGGVTNA

SEQ ID NO: 148451 - protein, 37 aa, Artificial Sequence
  Description of Artificial Sequence: Synthetic polypeptide
AEEEIRTTNPVATEQYGSVSTVVTSNDESGTVNNATD

SEQ ID NO: 148452 - protein, 33 aa, Artificial Sequence
  Description of Artificial Sequence: Synthetic polypeptide
DETSIATTNPTAYEQWGSYYTFDNDQGERGNAR

SEQ ID NO: 148453 - protein, 37 aa, Artificial Sequence
  Description of Artificial Sequence: Synthetic polypeptide
DEEEIRTTNPAATEQYGSVSSTTPAVGPNMRNGMNPV

SEQ ID NO: 148454 - protein, 32 aa, Artificial Sequence
  Description of Artificial Sequence: Synthetic polypeptide
NEEEIRTTNPVAYEHWGCFTWINDLQQQGQQR

SEQ ID NO: 148455 - protein, 32 aa, Artificial Sequence
  Description of Artificial Sequence: Synthetic polypeptide
NEEEIRTTNPVAYEKWGSVCWIELNQGDHKND

SEQ ID NO: 148456 - protein, 34 aa, Artificial Sequence
  Description of Artificial Sequence: Synthetic polypeptide
DETEIVTTNPVATEQYGTVCSATDDYPVEFEGND

SEQ ID NO: 148457 - protein, 35 aa, Artificial Sequence
  Description of Artificial Sequence: Synthetic polypeptide
NEEEIRTTNPVAYEPYGCVVPSTGNLQEETDTNDV

SEQ ID NO: 148458 - protein, 33 aa, Artificial Sequence
  Description of Artificial Sequence: Synthetic polypeptide
DETEIVTTNPVATEQYGTVCSAADGWVAFEGND

SEQ ID NO: 148459 - protein, 32 aa, Artificial Sequence
  Description of Artificial Sequence: Synthetic polypeptide
QEGEIATTNPCSTEQYGSVSACNLEDHEGTDL

SEQ ID NO: 148460 - protein, 33 aa, Artificial Sequence
  Description of Artificial Sequence: Synthetic polypeptide
DETEIVTTNPVATEQYGTVCSAADGPVEFEGND

SEQ ID NO: 148461 - protein, 31 aa, Artificial Sequence
  Description of Artificial Sequence: Synthetic polypeptide
DETEVASTNPVATEGYGNTANNDWQSRVGPR

SEQ ID NO: 148462 - protein, 33 aa, Artificial Sequence
  Description of Artificial Sequence: Synthetic polypeptide
DETEIVTTNPVATEQYGTVCAATDGPVEFKGND

SEQ ID NO: 148463 - protein, 34 aa, Artificial Sequence
  Description of Artificial Sequence: Synthetic polypeptide
NEEEIRTTNPVAYEQWGCSYNVVNDLDQMGHRPR

SEQ ID NO: 148464 - protein, 33 aa, Artificial Sequence
  Description of Artificial Sequence: Synthetic polypeptide
DETEIVTTNPVATEQYGAVCSATDDPEFEGPYD

SEQ ID NO: 148465 - protein, 33 aa, Artificial Sequence
  Description of Artificial Sequence: Synthetic polypeptide
DETEIVTTNPVATEQYGAVCAATDGPVEFKGND

SEQ ID NO: 148466 - protein, 34 aa, Artificial Sequence
  Description of Artificial Sequence: Synthetic polypeptide
NEEEIRTTNPVAYEQWGEYWSVINDDLQRQDIGR

SEQ ID NO: 148467 - protein, 34 aa, Artificial Sequence
  Description of Artificial Sequence: Synthetic polypeptide
NEEEIRTTNPVAYEQWGEYWTQRNDDLQRQDIDR

SEQ ID NO: 148468 - protein, 34 aa, Artificial Sequence
  Description of Artificial Sequence: Synthetic polypeptide
DEEEIATTNPVAYEQWGCVAGNGLQAAPDGSNHN

SEQ ID NO: 148469 - protein, 32 aa, Artificial Sequence
  Description of Artificial Sequence: Synthetic polypeptide
QEGEIATTNPCSTEQYGIVSACNLQDHEGTDL

SEQ ID NO: 148470 - protein, 32 aa, Artificial Sequence
  Description of Artificial Sequence: Synthetic polypeptide
DETEIVTTNPVATECYGTVWSAADDWAPEGNI

SEQ ID NO: 148471 - protein, 33 aa, Artificial Sequence
  Description of Artificial Sequence: Synthetic polypeptide
DETEIVTTNPVATEQYGTTCSATDDPVAFKGND

SEQ ID NO: 148472 - protein, 35 aa, Artificial Sequence
  Description of Artificial Sequence: Synthetic polypeptide
DEEEIACTNPVATEQYGSVASLANMGQAEDPNEDS

SEQ ID NO: 148473 - protein, 32 aa, Artificial Sequence
  Description of Artificial Sequence: Synthetic polypeptide
DETEVASTNPVATEGYGNVWAANTWQERVGPR

SEQ ID NO: 148474 - protein, 34 aa, Artificial Sequence
  Description of Artificial Sequence: Synthetic polypeptide
DEEEIACTNPVATEQYGSVASGQTDNIDPNEAAE

SEQ ID NO: 148475 - protein, 32 aa, Artificial Sequence
  Description of Artificial Sequence: Synthetic polypeptide
DETSIATTNPTAYEQWGSYYSNDNDQSGTNRN

SEQ ID NO: 148476 - protein, 36 aa, Artificial Sequence
  Description of Artificial Sequence: Synthetic polypeptide
DEEEIRTTNPVATEQYGLVSSTTPAGPNMPNGMEPV

SEQ ID NO: 148477 - protein, 32 aa, Artificial Sequence
  Description of Artificial Sequence: Synthetic polypeptide
DETSIATTNPTAYEQWGSYYSIDNDQGEGNDR

SEQ ID NO: 148478 - protein, 32 aa, Artificial Sequence
  Description of Artificial Sequence: Synthetic polypeptide
DETSIATTNPTAYEQWGSYYSFDNDQGDGNSR

SEQ ID NO: 148479 - protein, 33 aa, Artificial Sequence
  Description of Artificial Sequence: Synthetic polypeptide
DEEEIACTNPVATEQYGSVANPNDPAEPNPEMN

SEQ ID NO: 148480 - protein, 35 aa, Artificial Sequence
  Description of Artificial Sequence: Synthetic polypeptide
DEEEIRTTNPVATEQYGLVNNLTNHDEIDNTEILP

SEQ ID NO: 148481 - protein, 35 aa, Artificial Sequence
  Description of Artificial Sequence: Synthetic polypeptide
DEDEIRTTNPVATEQYGAMSIMTNGDQGGDEGEEL

SEQ ID NO: 148482 - protein, 38 aa, Artificial Sequence
  Description of Artificial Sequence: Synthetic polypeptide
DEEEIRTTNPVATEQYGLSVSSTTPAGPNMRNGMNPVQ

SEQ ID NO: 148483 - protein, 34 aa, Artificial Sequence
  Description of Artificial Sequence: Synthetic polypeptide
DEEEIACTNPVATEQYGSVANPNGDPAEANPERN

SEQ ID NO: 148484 - protein, 30 aa, Artificial Sequence
  Description of Artificial Sequence: Synthetic polypeptide
DETSIATTNPLTTAQWGSVAANNLQSGDSD

SEQ ID NO: 148485 - protein, 32 aa, Artificial Sequence
  Description of Artificial Sequence: Synthetic polypeptide
AENEIRCTNPVSTEPYGEASMEDLQQQQNGNR

SEQ ID NO: 148486 - protein, 33 aa, Artificial Sequence
  Description of Artificial Sequence: Synthetic polypeptide
DETSIATTNPCAYEQFGSVSCFPNQSQSGGNNR

SEQ ID NO: 148487 - protein, 36 aa, Artificial Sequence
  Description of Artificial Sequence: Synthetic polypeptide
DETSEIATTNPVAYEQWGSVCYSNENDLQGGRGNDA

SEQ ID NO: 148488 - protein, 34 aa, Artificial Sequence
  Description of Artificial Sequence: Synthetic polypeptide
DETQEIATTNPVAYEGWGSVATNLQGDAGNNGQG

SEQ ID NO: 148489 - protein, 34 aa, Artificial Sequence
  Description of Artificial Sequence: Synthetic polypeptide
DETPIRTTNPLAYEAFGSVSCFNELSQSGGNNRA

SEQ ID NO: 148490 - protein, 34 aa, Artificial Sequence
  Description of Artificial Sequence: Synthetic polypeptide
DETPIQTTNPVAYEQWGEVAACTVNPSQRGGNER

SEQ ID NO: 148491 - protein, 32 aa, Artificial Sequence
  Description of Artificial Sequence: Synthetic polypeptide
DETGIRTTNPCATEQWGSRSVYETSVENAGNV

SEQ ID NO: 148492 - protein, 30 aa, Artificial Sequence
  Description of Artificial Sequence: Synthetic polypeptide
DETGIRTTNPCATEQWGSRSVHYETVENNV

SEQ ID NO: 148493 - protein, 33 aa, Artificial Sequence
  Description of Artificial Sequence: Synthetic polypeptide
DETGICTTNPVAYEQYGFVSATNWEGERGWSGD

SEQ ID NO: 148494 - protein, 32 aa, Artificial Sequence
  Description of Artificial Sequence: Synthetic polypeptide
DETSIATTNPTAYEQWGSYYTFDNDQQSGENR

SEQ ID NO: 148495 - protein, 37 aa, Artificial Sequence
  Description of Artificial Sequence: Synthetic polypeptide
DEEEIRTTNPVATEQYGSVPSVTMEMHQQDVHENVMV

SEQ ID NO: 148496 - protein, 38 aa, Artificial Sequence
  Description of Artificial Sequence: Synthetic polypeptide
AEEEIRTTNPVATEQYGSVVVTVTTNQGNLQQGTNLTN

SEQ ID NO: 148497 - protein, 35 aa, Artificial Sequence
  Description of Artificial Sequence: Synthetic polypeptide
NEEEIRTTNPVATEQYGSVSVTEPNGGEWSFSQGP

SEQ ID NO: 148498 - protein, 38 aa, Artificial Sequence
  Description of Artificial Sequence: Synthetic polypeptide
AEEEIRTTNPVATEQYGSVVVVSTNNQLGNEAGTNNVS

SEQ ID NO: 148499 - protein, 35 aa, Artificial Sequence
  Description of Artificial Sequence: Synthetic polypeptide
DEEEIRTTNPVATEQYGMVNFENGQQDEGGQEGQE

SEQ ID NO: 148500 - protein, 37 aa, Artificial Sequence
  Description of Artificial Sequence: Synthetic polypeptide
AEEEIRTTNPVATEQYGSVSTTNQQQIGTEQGTTQDD

SEQ ID NO: 148501 - protein, 35 aa, Artificial Sequence
  Description of Artificial Sequence: Synthetic polypeptide
DEEEIRTTNPVATEQYGMVNFEDGQQDEGGDNGQE

SEQ ID NO: 148502 - protein, 34 aa, Artificial Sequence
  Description of Artificial Sequence: Synthetic polypeptide
DEEEIATTNPVAYEQWGSVASGALGIEHPDGDNN

SEQ ID NO: 148503 - protein, 36 aa, Artificial Sequence
  Description of Artificial Sequence: Synthetic polypeptide
DEEEIRSTNPVCTEQYGVVSSTTPNGPNMRNGMNPQ

SEQ ID NO: 148504 - protein, 35 aa, Artificial Sequence
  Description of Artificial Sequence: Synthetic polypeptide
DEEEIRSTNPVGTEGYGSVSATTPTGPQHNGMNPI

SEQ ID NO: 148505 - protein, 35 aa, Artificial Sequence
  Description of Artificial Sequence: Synthetic polypeptide
DETTIRTTNPVATEQYGSVADNTDNLIGGGDIGDG

SEQ ID NO: 148506 - protein, 33 aa, Artificial Sequence
  Description of Artificial Sequence: Synthetic polypeptide
DETVIQTTNPVAYEPWGIVAACTNPSQRGGNER

SEQ ID NO: 148507 - protein, 32 aa, Artificial Sequence
  Description of Artificial Sequence: Synthetic polypeptide
DEEEIRSTNPVSTEPYGTISMEDIQQQSNGNH

SEQ ID NO: 148508 - protein, 38 aa, Artificial Sequence
  Description of Artificial Sequence: Synthetic polypeptide
AEEEIRTTNPVATEQYGSVSTVVTNNQAGNQQGNEEGQ

SEQ ID NO: 148509 - protein, 34 aa, Artificial Sequence
  Description of Artificial Sequence: Synthetic polypeptide
DEEEIACTNPVATEQYGSVAGTPLAEAEIGTEDF

SEQ ID NO: 148510 - protein, 37 aa, Artificial Sequence
  Description of Artificial Sequence: Synthetic polypeptide
AEEEIRTTNPVATEQYGSVSTTNQQLQQNEQDEEEEV

SEQ ID NO: 148511 - protein, 30 aa, Artificial Sequence
  Description of Artificial Sequence: Synthetic polypeptide
QEGEIATTNPVSSEQYGIVSACDLEDHGEL

SEQ ID NO: 148512 - protein, 36 aa, Artificial Sequence
  Description of Artificial Sequence: Synthetic polypeptide
DEDEIRTTNPVATEQYGSVATTQAGNQIGTTEDGNE

SEQ ID NO: 148513 - protein, 35 aa, Artificial Sequence
  Description of Artificial Sequence: Synthetic polypeptide
DEEEIATTNPVAYEQWGSVAKTNDLQEQDLGQIDG

SEQ ID NO: 148514 - protein, 38 aa, Artificial Sequence
  Description of Artificial Sequence: Synthetic polypeptide
AEEEIRTTNPVATEQYGSVSTVVTNNQAGNQQGNNEDD

SEQ ID NO: 148515 - protein, 35 aa, Artificial Sequence
  Description of Artificial Sequence: Synthetic polypeptide
DEDEIRTTNPVATEQYGSNIWVREDHTQPEGEDRF

SEQ ID NO: 148516 - protein, 30 aa, Artificial Sequence
  Description of Artificial Sequence: Synthetic polypeptide
QEGEIATTNPVSSEQYGTISCDIQQQNGNH

SEQ ID NO: 148517 - protein, 34 aa, Artificial Sequence
  Description of Artificial Sequence: Synthetic polypeptide
DETVIQTTNPVAYEQWGCVAACSVNSSQRGGNER

SEQ ID NO: 148518 - protein, 36 aa, Artificial Sequence
  Description of Artificial Sequence: Synthetic polypeptide
DEEEIACTNPVATEQYGSVAATENLEAPGEQMEGAD

SEQ ID NO: 148519 - protein, 34 aa, Artificial Sequence
  Description of Artificial Sequence: Synthetic polypeptide
DEEEIACTNPVATEQYGSVAAPTNGTDSMIENDN

SEQ ID NO: 148520 - protein, 34 aa, Artificial Sequence
  Description of Artificial Sequence: Synthetic polypeptide
DEEEIACTNPVATEQYGSCAQGPTNPDAQAGGDD

SEQ ID NO: 148521 - protein, 35 aa, Artificial Sequence
  Description of Artificial Sequence: Synthetic polypeptide
DEDEIRTTNPVATEQYGSVATTQQQQQIGTTEDEE

SEQ ID NO: 148522 - protein, 36 aa, Artificial Sequence
  Description of Artificial Sequence: Synthetic polypeptide
DEDEIRTTNPVATEQYGSVATTQQQLQIGTTEEIGE

SEQ ID NO: 148523 - protein, 38 aa, Artificial Sequence
  Description of Artificial Sequence: Synthetic polypeptide
DEEEIRSTNPVAYEQYGISVVSYTLNEHALTRVGNVAM

SEQ ID NO: 148524 - protein, 34 aa, Artificial Sequence
  Description of Artificial Sequence: Synthetic polypeptide
DEEEIATTNPVAYEQWGSVCQTFEDDGRKGGTQR

SEQ ID NO: 148525 - protein, 34 aa, Artificial Sequence
  Description of Artificial Sequence: Synthetic polypeptide
DEVEIATTNPIATEQWGSIVPTNWDQHEGGQHGR

SEQ ID NO: 148526 - protein, 34 aa, Artificial Sequence
  Description of Artificial Sequence: Synthetic polypeptide
DEEEIATTNPVAYEQWGSVCQTDEHDDHRKGGTR

SEQ ID NO: 148527 - protein, 37 aa, Artificial Sequence
  Description of Artificial Sequence: Synthetic polypeptide
DEEEIRSTNPVAYEQYGKVVSCTINEGALARVGNMAT

SEQ ID NO: 148528 - protein, 35 aa, Artificial Sequence
  Description of Artificial Sequence: Synthetic polypeptide
DEEEIRTTNPVATEQYGMVNIMNEMGQEGQGGFEI

SEQ ID NO: 148529 - protein, 37 aa, Artificial Sequence
  Description of Artificial Sequence: Synthetic polypeptide
DEEEIRTTNPVATEQYGSVSSSSNWTISPRVGELEIT

SEQ ID NO: 148530 - protein, 36 aa, Artificial Sequence
  Description of Artificial Sequence: Synthetic polypeptide
DEDEIRTTNPVATEQYGSVATTQQQLQAGTTEDTEE

SEQ ID NO: 148531 - protein, 38 aa, Artificial Sequence
  Description of Artificial Sequence: Synthetic polypeptide
AEEEIRTTNPVATEQYGSVVVVTNGNLQQGSEGGVNIN

SEQ ID NO: 148532 - protein, 32 aa, Artificial Sequence
  Description of Artificial Sequence: Synthetic polypeptide
DEEEIATTNPVAYEQWGSVCMAGTENNHQMDD

SEQ ID NO: 148533 - protein, 35 aa, Artificial Sequence
  Description of Artificial Sequence: Synthetic polypeptide
DEEEIRTTNPVATEQYGMVNGSMDGEFGMGGNANI

SEQ ID NO: 148534 - protein, 35 aa, Artificial Sequence
  Description of Artificial Sequence: Synthetic polypeptide
DEEEIRTTNPVATEQYGMVNGSMDGEFGMGENETA

SEQ ID NO: 148535 - protein, 35 aa, Artificial Sequence
  Description of Artificial Sequence: Synthetic polypeptide
DEEEIRTTNPVATEQYGSVSSSVPEEIRLDEEVDQ

SEQ ID NO: 148536 - protein, 35 aa, Artificial Sequence
  Description of Artificial Sequence: Synthetic polypeptide
DEEEIRTTNPVATEQYGMVNGSMDGEEFGPGGNNT

SEQ ID NO: 148537 - protein, 35 aa, Artificial Sequence
  Description of Artificial Sequence: Synthetic polypeptide
DEEEIRTTNPVATEQYGMVNFEQGGQDEQGENEQG

SEQ ID NO: 148538 - protein, 38 aa, Artificial Sequence
  Description of Artificial Sequence: Synthetic polypeptide
AEEEIRTTNPVATEQYGSVSTVVTNNNQQLQQGEETSE

SEQ ID NO: 148539 - protein, 37 aa, Artificial Sequence
  Description of Artificial Sequence: Synthetic polypeptide
DEEEIRTTNPVATEQYGSVPSYDNTHVNQSEMVEENV

SEQ ID NO: 148540 - protein, 37 aa, Artificial Sequence
  Description of Artificial Sequence: Synthetic polypeptide
DEEEIRTTNPVATEQYGSVPSYDNHHVDQMEMVEENV

SEQ ID NO: 148541 - protein, 31 aa, Artificial Sequence
  Description of Artificial Sequence: Synthetic polypeptide
DETTIRTTNPLATEQFGQVSCMHAEGPNGNI

SEQ ID NO: 148542 - protein, 37 aa, Artificial Sequence
  Description of Artificial Sequence: Synthetic polypeptide
DEEEIRTTNPVATEQYGMVGSPTLNMMMQEEGEEEVN

SEQ ID NO: 148543 - protein, 36 aa, Artificial Sequence
  Description of Artificial Sequence: Synthetic polypeptide
AEEEIRTTNPVATEQYGSVVVVATNNNLETGTEAGT

SEQ ID NO: 148544 - protein, 34 aa, Artificial Sequence
  Description of Artificial Sequence: Synthetic polypeptide
DEDEIRTTNPVATEQYGSACATNPELNEHDDTAG

SEQ ID NO: 148545 - protein, 36 aa, Artificial Sequence
  Description of Artificial Sequence: Synthetic polypeptide
AEEEIRTTNPVATEQYGSVVVVATNLAGEQGTEAGT

SEQ ID NO: 148546 - protein, 36 aa, Artificial Sequence
  Description of Artificial Sequence: Synthetic polypeptide
AEEEIRTTNPVATEQYGSVVVVATENLNETGTEAGT

SEQ ID NO: 148547 - protein, 37 aa, Artificial Sequence
  Description of Artificial Sequence: Synthetic polypeptide
DEEEIRTTNPVATEQYGMVAQPVMMEETVLENGTLNR

SEQ ID NO: 148548 - protein, 29 aa, Artificial Sequence
  Description of Artificial Sequence: Synthetic peptide
QEGEIATTNPVATEQYGCAPAEVCQPHEK

SEQ ID NO: 148549 - protein, 38 aa, Artificial Sequence
  Description of Artificial Sequence: Synthetic polypeptide
AEEEIRTTNPVATEQYGSVVVTVTTQAGNLQQGTNQID

SEQ ID NO: 148550 - protein, 32 aa, Artificial Sequence
  Description of Artificial Sequence: Synthetic polypeptide
AENEIRCTNPVATEQWGATSNENLQEPKGGYI

SEQ ID NO: 148551 - protein, 37 aa, Artificial Sequence
  Description of Artificial Sequence: Synthetic polypeptide
DEEEIRTTNPVATEQYGMVAQPTMMSETVLENGTLNM

SEQ ID NO: 148552 - protein, 30 aa, Artificial Sequence
  Description of Artificial Sequence: Synthetic polypeptide
QEGEIATTNPVATEQWGDVSEIEMNAAEDR

SEQ ID NO: 148553 - protein, 37 aa, Artificial Sequence
  Description of Artificial Sequence: Synthetic polypeptide
AEEEIRTTNPVATEQYGSVSTTNQNMEQGTTNVATED

SEQ ID NO: 148554 - protein, 38 aa, Artificial Sequence
  Description of Artificial Sequence: Synthetic polypeptide
AEEEIRTTNPVATEQYGSVVVTVTTNQGNLQQGTTNIG

SEQ ID NO: 148555 - protein, 38 aa, Artificial Sequence
  Description of Artificial Sequence: Synthetic polypeptide
AEEEIRTTNPVATEQYGSVVVTVTTNQGNLQQGTNQIQ

SEQ ID NO: 148556 - protein, 38 aa, Artificial Sequence
  Description of Artificial Sequence: Synthetic polypeptide
AEEEIRTTNPVATEQYGSVSTVVTNTQAGNQQGNDEGD

SEQ ID NO: 148557 - protein, 35 aa, Artificial Sequence
  Description of Artificial Sequence: Synthetic polypeptide
DEEEIRTCNPVAYEAYGSTVSCFRLSQYDTVGQNE

SEQ ID NO: 148558 - protein, 34 aa, Artificial Sequence
  Description of Artificial Sequence: Synthetic polypeptide
DETSIRTTNPLATEQFGSVSCEKSLTEGLPNGRI

SEQ ID NO: 148559 - protein, 38 aa, Artificial Sequence
  Description of Artificial Sequence: Synthetic polypeptide
AEEEIRTTNPVATEQYGSVVVTVTTNQGNLQQGTNNAE

SEQ ID NO: 148560 - protein, 35 aa, Artificial Sequence
  Description of Artificial Sequence: Synthetic polypeptide
DEEEIRTTNCVATEQYGSVGNDDTGQTTEGQNNEI

SEQ ID NO: 148561 - protein, 37 aa, Artificial Sequence
  Description of Artificial Sequence: Synthetic polypeptide
DEEEIRTTNPVATEQYGMSVSSTTPAGPNMRNQMNPV

SEQ ID NO: 148562 - protein, 35 aa, Artificial Sequence
  Description of Artificial Sequence: Synthetic polypeptide
DEDEIRTTNPVATEQYGSACSAADNLQDTTPPDQM

SEQ ID NO: 148563 - protein, 34 aa, Artificial Sequence
  Description of Artificial Sequence: Synthetic polypeptide
DEEEIRTTNPCATEAYGSVALTLEHEVRDTNEAE

SEQ ID NO: 148564 - protein, 38 aa, Artificial Sequence
  Description of Artificial Sequence: Synthetic polypeptide
AEEEIRTTNPVATEQYGSVVVVNNTNLEQGSEGGNTEE

SEQ ID NO: 148565 - protein, 34 aa, Artificial Sequence
  Description of Artificial Sequence: Synthetic polypeptide
DETSIRTTNPLAYEAFGSVSCCNELSQSPGNNRA

SEQ ID NO: 148566 - protein, 37 aa, Artificial Sequence
  Description of Artificial Sequence: Synthetic polypeptide
DEEEIRTTNPVATEQYGSVPSYDALHEDQSEMVEENV

SEQ ID NO: 148567 - protein, 36 aa, Artificial Sequence
  Description of Artificial Sequence: Synthetic polypeptide
NEEEIRTTNPVATEQYGSVSPTLNMMVQEEAEEEVN

SEQ ID NO: 148568 - protein, 35 aa, Artificial Sequence
  Description of Artificial Sequence: Synthetic polypeptide
DEEEIRTTNPVATEQYGMVGSIMNTSEGGGEDEEQ

SEQ ID NO: 148569 - protein, 36 aa, Artificial Sequence
  Description of Artificial Sequence: Synthetic polypeptide
NEEEIRTTNPVATEQYGSVSPTLYMMGQEEGEEEVN

SEQ ID NO: 148570 - protein, 33 aa, Artificial Sequence
  Description of Artificial Sequence: Synthetic polypeptide
DETTIGTTNPVATEQYGSVDSDIGGQGGGQGET

SEQ ID NO: 148571 - protein, 38 aa, Artificial Sequence
  Description of Artificial Sequence: Synthetic polypeptide
AEEEIRTTNPVATEQYGSVVVVSNTNLEQGSEGGTTLG

SEQ ID NO: 148572 - protein, 30 aa, Artificial Sequence
  Description of Artificial Sequence: Synthetic polypeptide
QEGEIATTNPVATEQYGECSPTEVCTPHEK

SEQ ID NO: 148573 - protein, 36 aa, Artificial Sequence
  Description of Artificial Sequence: Synthetic polypeptide
DEEEIRTTNPVATEQYGMVGSIMNLIEDGGQEDEEG

SEQ ID NO: 148574 - protein, 30 aa, Artificial Sequence
  Description of Artificial Sequence: Synthetic polypeptide
QEGEIATTNPVATEQYGEASPTEVCIPSEK

SEQ ID NO: 148575 - protein, 33 aa, Artificial Sequence
  Description of Artificial Sequence: Synthetic polypeptide
DETTIATTNPVATEQYGSVQGFGEGDNGQEGGT

SEQ ID NO: 148576 - protein, 36 aa, Artificial Sequence
  Description of Artificial Sequence: Synthetic polypeptide
DEEEIRTTNPVATEQYGMVGSIMNILGEGGGEDEEN

SEQ ID NO: 148577 - protein, 36 aa, Artificial Sequence
  Description of Artificial Sequence: Synthetic polypeptide
AEEEIRTTNPVATEQYGSVVVVNTNVDESGVNNTTV

SEQ ID NO: 148578 - protein, 36 aa, Artificial Sequence
  Description of Artificial Sequence: Synthetic polypeptide
AEEEIRTTNPVATEQYGSVVVVNTNNSESGTVNNTV

SEQ ID NO: 148579 - protein, 37 aa, Artificial Sequence
  Description of Artificial Sequence: Synthetic polypeptide
DEEEIRTTNPVATEQYGSVPSVWMTEADELNLIETEE

SEQ ID NO: 148580 - protein, 37 aa, Artificial Sequence
  Description of Artificial Sequence: Synthetic polypeptide
AEEEIRTTNPVATEQYGSVVVVNTNLEQGSEGGTTQE

SEQ ID NO: 148581 - protein, 33 aa, Artificial Sequence
  Description of Artificial Sequence: Synthetic polypeptide
DEDEIRTTNPVATEQYGSCSAGDALGIHPDAQA

SEQ ID NO: 148582 - protein, 36 aa, Artificial Sequence
  Description of Artificial Sequence: Synthetic polypeptide
AEEEIRTTNPVATEQYGSVVVVNTNDESGTTNNNTV

SEQ ID NO: 148583 - protein, 29 aa, Artificial Sequence
  Description of Artificial Sequence: Synthetic peptide
QEGEIATTNPVATEQYGCAPMHGQDSEEN

SEQ ID NO: 148584 - protein, 35 aa, Artificial Sequence
  Description of Artificial Sequence: Synthetic polypeptide
DEEEIRTTNPVATEQYGMVGNGNMNNQDIFDNNEI

SEQ ID NO: 148585 - protein, 36 aa, Artificial Sequence
  Description of Artificial Sequence: Synthetic polypeptide
AEEEIRTTNPVATEQYGSVVVVNTNDEAGTVNNQTM

SEQ ID NO: 148586 - protein, 31 aa, Artificial Sequence
  Description of Artificial Sequence: Synthetic polypeptide
NETEIATTNPVAYEQWGSVPTPMLGDHNGEP

SEQ ID NO: 148587 - protein, 36 aa, Artificial Sequence
  Description of Artificial Sequence: Synthetic polypeptide
DEEEIRTTNPVATEQYGSVPSPWYNGNTTQQNVLDQ

SEQ ID NO: 148588 - protein, 32 aa, Artificial Sequence
  Description of Artificial Sequence: Synthetic polypeptide
DETEIVTTNPVATECYGTVWSAADDWAFEGNI

SEQ ID NO: 148589 - protein, 37 aa, Artificial Sequence
  Description of Artificial Sequence: Synthetic polypeptide
AEEEIRTTNPVATEQYGSVSTTNNQGEQIGTTTQQDE

SEQ ID NO: 148590 - protein, 34 aa, Artificial Sequence
  Description of Artificial Sequence: Synthetic polypeptide
DEDEIRTTNPVATEPYGWVCFTNAGSTDTGGNPT

SEQ ID NO: 148591 - protein, 34 aa, Artificial Sequence
  Description of Artificial Sequence: Synthetic polypeptide
DEDEIRTTNPVATEPYGSVCFMNAGSTATGGNPT

SEQ ID NO: 148592 - protein, 35 aa, Artificial Sequence
  Description of Artificial Sequence: Synthetic polypeptide
DETEIRTTNPVAVEAYGSVIITDNGGQEGGNGNGQ

SEQ ID NO: 148593 - protein, 35 aa, Artificial Sequence
  Description of Artificial Sequence: Synthetic polypeptide
DEEEIRTTNPVATEQYGGVSWDYDPMDLQSMEDFM

SEQ ID NO: 148594 - protein, 37 aa, Artificial Sequence
  Description of Artificial Sequence: Synthetic polypeptide
AEEEIRTTNPVATEQYGSVSTTNNNSEQGTNEENEES

SEQ ID NO: 148595 - protein, 37 aa, Artificial Sequence
  Description of Artificial Sequence: Synthetic polypeptide
AEEEIRTTNPVATEQYGSVSTTNNNSEQGTDEENVEG

SEQ ID NO: 148596 - protein, 37 aa, Artificial Sequence
  Description of Artificial Sequence: Synthetic polypeptide
AEEEIRTTNPVATEQYGSVSTTNNNSEQGSNQQNNDD

SEQ ID NO: 148597 - protein, 33 aa, Artificial Sequence
  Description of Artificial Sequence: Synthetic polypeptide
NEGEIRTTNPVATGHYGSVSDVLNTLTEGTDMT

SEQ ID NO: 148598 - protein, 32 aa, Artificial Sequence
  Description of Artificial Sequence: Synthetic polypeptide
DEEEIRTTNPCATEEYGCVCGTEHGHGSDTAS

SEQ ID NO: 148599 - protein, 33 aa, Artificial Sequence
  Description of Artificial Sequence: Synthetic polypeptide
DEEEIATTNPVAYAQWGTSVSATAALGQHDIAA

SEQ ID NO: 148600 - protein, 34 aa, Artificial Sequence
  Description of Artificial Sequence: Synthetic polypeptide
DEEEIRTTNPCATEEYGCVCGTGEHNARFGSNAS

SEQ ID NO: 148601 - protein, 33 aa, Artificial Sequence
  Description of Artificial Sequence: Synthetic polypeptide
DEEEIRTTNPCATEEYGCVCGWEHNAENFGSNA

SEQ ID NO: 148602 - protein, 36 aa, Artificial Sequence
  Description of Artificial Sequence: Synthetic polypeptide
DEEEIRTTNPVATEQYGSVPPTTGMNPQADFQLTTE

SEQ ID NO: 148603 - protein, 35 aa, Artificial Sequence
  Description of Artificial Sequence: Synthetic polypeptide
NEHEIRTTNPVATEQYGSVYSTVEDMQISGQEDIP

SEQ ID NO: 148604 - protein, 32 aa, Artificial Sequence
  Description of Artificial Sequence: Synthetic polypeptide
AENEIVCTNPVATEQYGTACSAENPVQFEGGR

SEQ ID NO: 148605 - protein, 34 aa, Artificial Sequence
  Description of Artificial Sequence: Synthetic polypeptide
NEMEIRTTNPVATEQYGCVSWTDVLDESTNEHFV

SEQ ID NO: 148606 - protein, 32 aa, Artificial Sequence
  Description of Artificial Sequence: Synthetic polypeptide
DEEEIRTTNPCATEEYGCVCQSEHAYFGSDAA

SEQ ID NO: 148607 - protein, 34 aa, Artificial Sequence
  Description of Artificial Sequence: Synthetic polypeptide
DEEEIRTTNPCATEEYGCVCGTEHNAHFGSNTAS

SEQ ID NO: 148608 - protein, 33 aa, Artificial Sequence
  Description of Artificial Sequence: Synthetic polypeptide
NEGEIRTTNPVATGHYGSVSDVLNQLTEGTMDM

SEQ ID NO: 148609 - protein, 33 aa, Artificial Sequence
  Description of Artificial Sequence: Synthetic polypeptide
NEGEIRTTNPVATGHYGSVSDVLENLTEGTFDT

SEQ ID NO: 148610 - protein, 33 aa, Artificial Sequence
  Description of Artificial Sequence: Synthetic polypeptide
DEEEIATTNPVAYECWGSVATTGGNTGADGMKR

SEQ ID NO: 148611 - protein, 35 aa, Artificial Sequence
  Description of Artificial Sequence: Synthetic polypeptide
DETEIRTTNPVAYEEWGSVATGMPLGDTGQGGNPR

SEQ ID NO: 148612 - protein, 36 aa, Artificial Sequence
  Description of Artificial Sequence: Synthetic polypeptide
DEEEIRTTNPVATEQYGSVPPWFYENVNLMMEVREI

SEQ ID NO: 148613 - protein, 34 aa, Artificial Sequence
  Description of Artificial Sequence: Synthetic polypeptide
NEGEIRTTNPVATEQYGSVGTPDEDLINRFEMQE

SEQ ID NO: 148614 - protein, 33 aa, Artificial Sequence
  Description of Artificial Sequence: Synthetic polypeptide
DETEIRTTNPVAYECWGTVSGDNMNQGERQGQG

SEQ ID NO: 148615 - protein, 33 aa, Artificial Sequence
  Description of Artificial Sequence: Synthetic polypeptide
DETEIRTTNPVAYECWGSVYYTDNTDGRNGDQN

SEQ ID NO: 148616 - protein, 28 aa, Artificial Sequence
  Description of Artificial Sequence: Synthetic peptide
QEGEIATTNPCSSEPYGIISMDLQSGTH

SEQ ID NO: 148617 - protein, 34 aa, Artificial Sequence
  Description of Artificial Sequence: Synthetic polypeptide
DETEIRTTNPVAYECWGSVSGGNGMEQRNGGQEP

SEQ ID NO: 148618 - protein, 34 aa, Artificial Sequence
  Description of Artificial Sequence: Synthetic polypeptide
DETEIRTTNPVAYECWGSVSGGNGMEQRNGGGAM

SEQ ID NO: 148619 - protein, 35 aa, Artificial Sequence
  Description of Artificial Sequence: Synthetic polypeptide
NEGEIRTTNPVATEQYGSVSNDDDDLEQQGQDSEV

SEQ ID NO: 148620 - protein, 35 aa, Artificial Sequence
  Description of Artificial Sequence: Synthetic polypeptide
NEGEIRTTNPVATEQYGSVSVTYNEVDEHNSNVSE

SEQ ID NO: 148621 - protein, 33 aa, Artificial Sequence
  Description of Artificial Sequence: Synthetic polypeptide
DETEIRTTNPVAYECWGSVSGGGNHQGQGGGEN

SEQ ID NO: 148622 - protein, 34 aa, Artificial Sequence
  Description of Artificial Sequence: Synthetic polypeptide
DETEIRTTNPVAYECWGSVSGDNMNQGERQGDQN

SEQ ID NO: 148623 - protein, 36 aa, Artificial Sequence
  Description of Artificial Sequence: Synthetic polypeptide
DEEEIRTTNPVATEQYGSVPPWAYMNVQGMMEVREI

SEQ ID NO: 148624 - protein, 38 aa, Artificial Sequence
  Description of Artificial Sequence: Synthetic polypeptide
DEEEIRTTNPVATEQYGHSVSSTTPAWGPNARNGMNPV

SEQ ID NO: 148625 - protein, 33 aa, Artificial Sequence
  Description of Artificial Sequence: Synthetic polypeptide
DETEIRTTNPVAYECWGCVYYTDNLDQQNGDQN

SEQ ID NO: 148626 - protein, 33 aa, Artificial Sequence
  Description of Artificial Sequence: Synthetic polypeptide
NEGEIRTTNPVATEQYGSVWDWNHEDEFMSSQR

SEQ ID NO: 148627 - protein, 37 aa, Artificial Sequence
  Description of Artificial Sequence: Synthetic polypeptide
DEEEIRTTNPVATEQYGSVPPVLLQFGSQSRNEQLHQ

SEQ ID NO: 148628 - protein, 37 aa, Artificial Sequence
  Description of Artificial Sequence: Synthetic polypeptide
AEEEIRTTNPVATEQYGSVVVTVTNLLGGTEQGTNNQ

SEQ ID NO: 148629 - protein, 33 aa, Artificial Sequence
  Description of Artificial Sequence: Synthetic polypeptide
DEEEIATTNPVAYECWGSVYCTDNQTGQGNNGV

SEQ ID NO: 148630 - protein, 34 aa, Artificial Sequence
  Description of Artificial Sequence: Synthetic polypeptide
NEMEIRTTNPVATEQYGCVSWTDVLDGESTNEFQ

SEQ ID NO: 148631 - protein, 37 aa, Artificial Sequence
  Description of Artificial Sequence: Synthetic polypeptide
DEEEIRTTNPCATEAYGVVTVVVSTNLQAGETTNVTE

SEQ ID NO: 148632 - protein, 37 aa, Artificial Sequence
  Description of Artificial Sequence: Synthetic polypeptide
AEEEIRTTNPVATEQYGSVSTTNNNQQQLEQGETEEE

SEQ ID NO: 148633 - protein, 34 aa, Artificial Sequence
  Description of Artificial Sequence: Synthetic polypeptide
NEMEIRTTNPVATEQYGCVSWTDVLNDESTNEFW

SEQ ID NO: 148634 - protein, 34 aa, Artificial Sequence
  Description of Artificial Sequence: Synthetic polypeptide
SEEEIRCTNPIAYEQWGSVSGENNDDDMRGMNTR

SEQ ID NO: 148635 - protein, 32 aa, Artificial Sequence
  Description of Artificial Sequence: Synthetic polypeptide
SEEEIRCTNPIAYEQWGSVWGENDMHRDGNTS

SEQ ID NO: 148636 - protein, 33 aa, Artificial Sequence
  Description of Artificial Sequence: Synthetic polypeptide
NEMEIRTTNPVATEQYGSVWAWNHEDEFMGSQQ

SEQ ID NO: 148637 - protein, 34 aa, Artificial Sequence
  Description of Artificial Sequence: Synthetic polypeptide
NEMEIRTTNPVATEQYGSVWAWNLDETDMSSQRP

SEQ ID NO: 148638 - protein, 35 aa, Artificial Sequence
  Description of Artificial Sequence: Synthetic polypeptide
DEEEIATTNPVAWEQYGSVSCTGPAPVMTVGNNEM

SEQ ID NO: 148639 - protein, 36 aa, Artificial Sequence
  Description of Artificial Sequence: Synthetic polypeptide
DEEEIRTTNPVATEQYGFVSSTTPAGTNMRNPMNVV

SEQ ID NO: 148640 - protein, 33 aa, Artificial Sequence
  Description of Artificial Sequence: Synthetic polypeptide
NEMEIRTTNPVATEQYGSVWSWEHEDEFMSSQR

SEQ ID NO: 148641 - protein, 35 aa, Artificial Sequence
  Description of Artificial Sequence: Synthetic polypeptide
DEEEIRTTNPVATEQYGSVPPTAWAQEFEIVLDQE

SEQ ID NO: 148642 - protein, 35 aa, Artificial Sequence
  Description of Artificial Sequence: Synthetic polypeptide
DEEEIATTNPVAWEQYGSVSCTGQAQVQPTVANNE

SEQ ID NO: 148643 - protein, 35 aa, Artificial Sequence
  Description of Artificial Sequence: Synthetic polypeptide
NEMEIRTTNPVATEQYGSVWVSPNDLESFSQSFIL

SEQ ID NO: 148644 - protein, 33 aa, Artificial Sequence
  Description of Artificial Sequence: Synthetic polypeptide
NEMEIVTTNPVATEQYGTVCSATDGMVEFEGND

SEQ ID NO: 148645 - protein, 33 aa, Artificial Sequence
  Description of Artificial Sequence: Synthetic polypeptide
NEMEIVTTNPVATEQYGTVCSATDGPVEFEGND

SEQ ID NO: 148646 - protein, 29 aa, Artificial Sequence
  Description of Artificial Sequence: Synthetic peptide
QEGEIASTNPCSYEQWGIVACNLQSHGTR

SEQ ID NO: 148647 - protein, 34 aa, Artificial Sequence
  Description of Artificial Sequence: Synthetic polypeptide
DEEEIATTNPVAWEQYGSISCQGQAQVRTVANNE

SEQ ID NO: 148648 - protein, 35 aa, Artificial Sequence
  Description of Artificial Sequence: Synthetic polypeptide
DEEEIATTNPVAWEQYGHVSCTGQAQSVRTVANNE

SEQ ID NO: 148649 - protein, 36 aa, Artificial Sequence
  Description of Artificial Sequence: Synthetic polypeptide
DEEEIATTNPVAWEQYGCSVPSCTGQAQVRTVANNE

SEQ ID NO: 148650 - protein, 34 aa, Artificial Sequence
  Description of Artificial Sequence: Synthetic polypeptide
DEEEIATTNPVAWEQDGSVSCTGQAQVDTVANNE

SEQ ID NO: 148651 - protein, 33 aa, Artificial Sequence
  Description of Artificial Sequence: Synthetic polypeptide
DEEEIATTNPVAWECYGTVSCQGQAQVRTVNNE

SEQ ID NO: 148652 - protein, 29 aa, Artificial Sequence
  Description of Artificial Sequence: Synthetic peptide
QEGEIASTNPCSYEQWGIVSCNLQSGDTE

SEQ ID NO: 148653 - protein, 29 aa, Artificial Sequence
  Description of Artificial Sequence: Synthetic peptide
QEGEIASTNPVGTEGYGVMAISTLQHGDI

SEQ ID NO: 148654 - protein, 37 aa, Artificial Sequence
  Description of Artificial Sequence: Synthetic polypeptide
DEEEIRTTNPVATEQYGGAVSSTTPAGPNMRNGMNPV

SEQ ID NO: 148655 - protein, 33 aa, Artificial Sequence
  Description of Artificial Sequence: Synthetic polypeptide
NEMEIRTTNPVATEQYGSVVVPLHIDEYGDDEQ

SEQ ID NO: 148656 - protein, 32 aa, Artificial Sequence
  Description of Artificial Sequence: Synthetic polypeptide
SEEEIRCTNPIAYEQWGCVWGENDEHRDGNAR

SEQ ID NO: 148657 - protein, 32 aa, Artificial Sequence
  Description of Artificial Sequence: Synthetic polypeptide
SEEEIRCTNPIAYEQWGCVWGENDHHRDGKNR

SEQ ID NO: 148658 - protein, 32 aa, Artificial Sequence
  Description of Artificial Sequence: Synthetic polypeptide
SEEEIRCTNPIAYEQWGCVWGENDMERDGTNR

SEQ ID NO: 148659 - protein, 33 aa, Artificial Sequence
  Description of Artificial Sequence: Synthetic polypeptide
SEEEIRCTNPIAYEQWGSACSIENDMRAGTNNR

SEQ ID NO: 148660 - protein, 36 aa, Artificial Sequence
  Description of Artificial Sequence: Synthetic polypeptide
DETEIRTTNPVATEQYGVVSGTMNDGEQAEGGGEQT

SEQ ID NO: 148661 - protein, 32 aa, Artificial Sequence
  Description of Artificial Sequence: Synthetic polypeptide
SEEEIRCTNPIAYEQWGSCSIENDMRAGTQGR

SEQ ID NO: 148662 - protein, 33 aa, Artificial Sequence
  Description of Artificial Sequence: Synthetic polypeptide
DEEEIRTTNPCATEEYGCVCQTMNHIYFGSDAA

SEQ ID NO: 148663 - protein, 37 aa, Artificial Sequence
  Description of Artificial Sequence: Synthetic polypeptide
DEEEIRTTNPVATEQYGSVCSTLGATSEVALFQNQLT

SEQ ID NO: 148664 - protein, 35 aa, Artificial Sequence
  Description of Artificial Sequence: Synthetic polypeptide
DEEEIATTNPVAWEQYGSVVSCTGQAQVITVANNE

SEQ ID NO: 148665 - protein, 36 aa, Artificial Sequence
  Description of Artificial Sequence: Synthetic polypeptide
DEEEIATTNPVAWEQYGSVVSCTGQAQQVRTVANNE

SEQ ID NO: 148666 - protein, 35 aa, Artificial Sequence
  Description of Artificial Sequence: Synthetic polypeptide
DEEEIRTTNPVATEQYGSVPPTLDDQEFEIVLLQE

SEQ ID NO: 148667 - protein, 35 aa, Artificial Sequence
  Description of Artificial Sequence: Synthetic polypeptide
DEDEIRTTNPVATEPWGVVCFTNEDQHHQGHHNDR

SEQ ID NO: 148668 - protein, 29 aa, Artificial Sequence
  Description of Artificial Sequence: Synthetic peptide
QEGEIASTNPVGTEGYGVMAWSTLQHGDI

SEQ ID NO: 148669 - protein, 34 aa, Artificial Sequence
  Description of Artificial Sequence: Synthetic polypeptide
DEDEIRTTNPVATEPWGVVCFTNEDQHERGGTEH

SEQ ID NO: 148670 - protein, 28 aa, Artificial Sequence
  Description of Artificial Sequence: Synthetic peptide
QEGEIASTNPVGTEGYGVMASTLGHGDI

SEQ ID NO: 148671 - protein, 34 aa, Artificial Sequence
  Description of Artificial Sequence: Synthetic polypeptide
NEMEIRTTNPVATEQYGSVVTTTYVDLEREDVQM

SEQ ID NO: 148672 - protein, 36 aa, Artificial Sequence
  Description of Artificial Sequence: Synthetic polypeptide
DETEIRTTNPVATEQYGSVYSNTVHCLELFGSQQED

SEQ ID NO: 148673 - protein, 35 aa, Artificial Sequence
  Description of Artificial Sequence: Synthetic polypeptide
DETEIRTTNPVATEQYGSVTPTDGSDETTQGQDRQ

SEQ ID NO: 148674 - protein, 33 aa, Artificial Sequence
  Description of Artificial Sequence: Synthetic polypeptide
NEMEIRTTNPVATEQYGSVVVPLHDEYGSDDHQ

SEQ ID NO: 148675 - protein, 33 aa, Artificial Sequence
  Description of Artificial Sequence: Synthetic polypeptide
SEEEIRCTNPIAYECWGSVSGENDDDMRGANTR

SEQ ID NO: 148676 - protein, 35 aa, Artificial Sequence
  Description of Artificial Sequence: Synthetic polypeptide
NEGEIRTTNPVATEQYGSVEWVNSNDARDVNFQRQ

SEQ ID NO: 148677 - protein, 36 aa, Artificial Sequence
  Description of Artificial Sequence: Synthetic polypeptide
DEEEIRTTNPCATEAYGVVTVSTNNLQAGTTTEGTE

SEQ ID NO: 148678 - protein, 36 aa, Artificial Sequence
  Description of Artificial Sequence: Synthetic polypeptide
DEEEIRTTNPCATEAYGVVTVSNNNLQAGTTTNTTE

SEQ ID NO: 148679 - protein, 38 aa, Artificial Sequence
  Description of Artificial Sequence: Synthetic polypeptide
AEEEIRTTNPVATEQYGSVSTVVVNNQAGNQQGTNEGD

SEQ ID NO: 148680 - protein, 36 aa, Artificial Sequence
  Description of Artificial Sequence: Synthetic polypeptide
DEEEIRTTNPVATEQYGSVPSINMGAEQVMLMADVL

SEQ ID NO: 148681 - protein, 35 aa, Artificial Sequence
  Description of Artificial Sequence: Synthetic polypeptide
DEDEIRTTNPVATEQWGTVSTEQQQGTNVATEEGT

SEQ ID NO: 148682 - protein, 32 aa, Artificial Sequence
  Description of Artificial Sequence: Synthetic polypeptide
DETEIRTTNPVAYEQWGVVYGGNDDLGGKGGA

SEQ ID NO: 148683 - protein, 34 aa, Artificial Sequence
  Description of Artificial Sequence: Synthetic polypeptide
DETEIRTTNPVAYEQWGVVVHTDNHNQQQGNGGD

SEQ ID NO: 148684 - protein, 33 aa, Artificial Sequence
  Description of Artificial Sequence: Synthetic polypeptide
DETEIRTTNPVAYEQWGVVVHTDNHNQQDGGMG

SEQ ID NO: 148685 - protein, 36 aa, Artificial Sequence
  Description of Artificial Sequence: Synthetic polypeptide
DEEEIRTTNPCATEAYGSVATTNNQQGNQQGTNTAQ

SEQ ID NO: 148686 - protein, 35 aa, Artificial Sequence
  Description of Artificial Sequence: Synthetic polypeptide
DEDEIRTTNPVATEQWGTVSTEQQIGTNNATEEGA

SEQ ID NO: 148687 - protein, 34 aa, Artificial Sequence
  Description of Artificial Sequence: Synthetic polypeptide
DEDEIRTTNPVATEQWGTVSTVIGTTNAEEGDED

SEQ ID NO: 148688 - protein, 37 aa, Artificial Sequence
  Description of Artificial Sequence: Synthetic polypeptide
DEEEIRTTNPVATEQYGSVPSFPNLELDQSEMVEEIY

SEQ ID NO: 148689 - protein, 34 aa, Artificial Sequence
  Description of Artificial Sequence: Synthetic polypeptide
DEDEIRTTNPVATEQWGTVSTEQQGNNVATEDGA

SEQ ID NO: 148690 - protein, 30 aa, Artificial Sequence
  Description of Artificial Sequence: Synthetic polypeptide
AENEIRTTNPVSTEPYGTASMEDIQQQGGH

SEQ ID NO: 148691 - protein, 35 aa, Artificial Sequence
  Description of Artificial Sequence: Synthetic polypeptide
DEDEIRTTNPVATEQWGTVSTENQAGTNVATEGGA

SEQ ID NO: 148692 - protein, 36 aa, Artificial Sequence
  Description of Artificial Sequence: Synthetic polypeptide
DEDEIRTTNPVATEQWGTVSTELQRTTNVATEDGAD

SEQ ID NO: 148693 - protein, 37 aa, Artificial Sequence
  Description of Artificial Sequence: Synthetic polypeptide
DEEEIRTTNPCATEAYGSVATTTNLQAGTESGTNVAE

SEQ ID NO: 148694 - protein, 37 aa, Artificial Sequence
  Description of Artificial Sequence: Synthetic polypeptide
AEEEIRTTNPVATEQYGSVVVTVTNNQQGNEQGTNDD

SEQ ID NO: 148695 - protein, 31 aa, Artificial Sequence
  Description of Artificial Sequence: Synthetic polypeptide
QEGEIATTNPCSSEQYGIVSCINEQDSGETR

SEQ ID NO: 148696 - protein, 36 aa, Artificial Sequence
  Description of Artificial Sequence: Synthetic polypeptide
DEEEIRTTNPVATEQYGIVSSTTPAGPNMRNGMVPV

SEQ ID NO: 148697 - protein, 36 aa, Artificial Sequence
  Description of Artificial Sequence: Synthetic polypeptide
DEEEIRTTNPCATEAYGSVATTNNQQGNQQGTNVTD

SEQ ID NO: 148698 - protein, 33 aa, Artificial Sequence
  Description of Artificial Sequence: Synthetic polypeptide
DEDEIRTTNPVATEQWGTVSTVIGTTNATENQD

SEQ ID NO: 148699 - protein, 35 aa, Artificial Sequence
  Description of Artificial Sequence: Synthetic polypeptide
DEEEIATTNPVAYEPQWGQSVASNDLLQTAGDITR

SEQ ID NO: 148700 - protein, 30 aa, Artificial Sequence
  Description of Artificial Sequence: Synthetic polypeptide
QEGEIATTNPCSSEQYGTISCNIQQQNGNH

SEQ ID NO: 148701 - protein, 36 aa, Artificial Sequence
  Description of Artificial Sequence: Synthetic polypeptide
DEEEIRTTNPVATEQYGSVPSPWYNGNTTPQEELDQ

SEQ ID NO: 148702 - protein, 36 aa, Artificial Sequence
  Description of Artificial Sequence: Synthetic polypeptide
DEEEIRTTNPCATEAYGSVATTNNDQGNQQGTNNAE

SEQ ID NO: 148703 - protein, 32 aa, Artificial Sequence
  Description of Artificial Sequence: Synthetic polypeptide
DETEIVTTNPVATECYGTVWSAADDPAFEGNI

SEQ ID NO: 148704 - protein, 33 aa, Artificial Sequence
  Description of Artificial Sequence: Synthetic polypeptide
DETEIVTTNPIATEQYGTVCSATDGPVEFKGND

SEQ ID NO: 148705 - protein, 36 aa, Artificial Sequence
  Description of Artificial Sequence: Synthetic polypeptide
DEEEIRTTNPVATEQYGSVPSPWINGNTTMQEVLDQ

SEQ ID NO: 148706 - protein, 36 aa, Artificial Sequence
  Description of Artificial Sequence: Synthetic polypeptide
DEEEIRTTNPCATEAYGSVATTNNDQGNQQGTNVAE

SEQ ID NO: 148707 - protein, 32 aa, Artificial Sequence
  Description of Artificial Sequence: Synthetic polypeptide
DETEIRTTNPVSTEPYGVCYCEDNQQQQNGNH

SEQ ID NO: 148708 - protein, 32 aa, Artificial Sequence
  Description of Artificial Sequence: Synthetic polypeptide
DETEIRTTNPVSTEPYGTISMMDIQQQPNGNH

SEQ ID NO: 148709 - protein, 32 aa, Artificial Sequence
  Description of Artificial Sequence: Synthetic polypeptide
DETEIRTTNPVSTEPYGTISMEDWQQEQNGNH

SEQ ID NO: 148710 - protein, 32 aa, Artificial Sequence
  Description of Artificial Sequence: Synthetic polypeptide
DETEIRTTNPVSTEPYGTISMEDWQQEQKGNH

SEQ ID NO: 148711 - protein, 32 aa, Artificial Sequence
  Description of Artificial Sequence: Synthetic polypeptide
DETEIRTTNPVSTEPYGTISMEDIQQQQNGNI

SEQ ID NO: 148712 - protein, 34 aa, Artificial Sequence
  Description of Artificial Sequence: Synthetic polypeptide
DEEEIRTTNPVATEQYGIVVTLVASHFENSEDKD

SEQ ID NO: 148713 - protein, 32 aa, Artificial Sequence
  Description of Artificial Sequence: Synthetic polypeptide
DETEIRTTNPVSTEPYGTISMEDIQQQQNGNH

SEQ ID NO: 148714 - protein, 32 aa, Artificial Sequence
  Description of Artificial Sequence: Synthetic polypeptide
DETEIRTTNPVAYESWGSVCPGENDQHDTNDK

SEQ ID NO: 148715 - protein, 35 aa, Artificial Sequence
  Description of Artificial Sequence: Synthetic polypeptide
DETEIRTTNPVAYESWGSVASDNNPDHQIGGNQER

SEQ ID NO: 148716 - protein, 30 aa, Artificial Sequence
  Description of Artificial Sequence: Synthetic polypeptide
AENEIRTTNPVATEQWGCVSSPEANAFSDA

SEQ ID NO: 148717 - protein, 37 aa, Artificial Sequence
  Description of Artificial Sequence: Synthetic polypeptide
DEEEIRTTNPVATEQYGSVPSPTLAMMMQEVNEEEVN

SEQ ID NO: 148718 - protein, 30 aa, Artificial Sequence
  Description of Artificial Sequence: Synthetic polypeptide
AENEIRTTNPVATEQWGDVSEIEMNAAEDA

SEQ ID NO: 148719 - protein, 34 aa, Artificial Sequence
  Description of Artificial Sequence: Synthetic polypeptide
DEDEIRTTNPVATEQWGTVSTVVIGTTNATEGDD

SEQ ID NO: 148720 - protein, 31 aa, Artificial Sequence
  Description of Artificial Sequence: Synthetic polypeptide
AENEIRTTNPVSTEPYGTISMEDIQQQNGNH

SEQ ID NO: 148721 - protein, 35 aa, Artificial Sequence
  Description of Artificial Sequence: Synthetic polypeptide
DEDEIRTTNPVATEQWGTVSTAQQQGTNVATEDGA

SEQ ID NO: 148722 - protein, 31 aa, Artificial Sequence
  Description of Artificial Sequence: Synthetic polypeptide
DEDEIRTTNPVATEQWGTSSEGEMNAAEDTA

SEQ ID NO: 148723 - protein, 35 aa, Artificial Sequence
  Description of Artificial Sequence: Synthetic polypeptide
NEEEIRTTNPVTTEHYGSVYCMPNQDQNRQGGNDL

SEQ ID NO: 148724 - protein, 33 aa, Artificial Sequence
  Description of Artificial Sequence: Synthetic polypeptide
DEEEIATTNPVAYEHYGSIISYTHGSTPGGPRA

SEQ ID NO: 148725 - protein, 36 aa, Artificial Sequence
  Description of Artificial Sequence: Synthetic polypeptide
DEEEIRTTNPCATEAYGSVTVTTTNLEAGTNNNQTE

SEQ ID NO: 148726 - protein, 35 aa, Artificial Sequence
  Description of Artificial Sequence: Synthetic polypeptide
DETEIRTTNPVAYEQWGSVCSTENDHRNDTQNGAQ

SEQ ID NO: 148727 - protein, 33 aa, Artificial Sequence
  Description of Artificial Sequence: Synthetic polypeptide
DEEEIATTNPVAYEHYGSIISYTHFSGPGGPRM

SEQ ID NO: 148728 - protein, 36 aa, Artificial Sequence
  Description of Artificial Sequence: Synthetic polypeptide
DEEEIRTTNPVATEQYGSVPQTWMNPIPMVYEVGDI

SEQ ID NO: 148729 - protein, 37 aa, Artificial Sequence
  Description of Artificial Sequence: Synthetic polypeptide
DEEEIRTTNPCATEAYGSVTVTVTTNLQAGTTTNNTE

SEQ ID NO: 148730 - protein, 37 aa, Artificial Sequence
  Description of Artificial Sequence: Synthetic polypeptide
DEEEIRTTNPCATEAYGSVTVVVTNNLQAGTTTNDTE

SEQ ID NO: 148731 - protein, 37 aa, Artificial Sequence
  Description of Artificial Sequence: Synthetic polypeptide
DEEEIRTTNPCATEAYGSVTVVVTTNLQAGNNTNGTE

SEQ ID NO: 148732 - protein, 37 aa, Artificial Sequence
  Description of Artificial Sequence: Synthetic polypeptide
DEEEIRTTNPCATEAYGSVTVVVTTNLQAGNTTTETE

SEQ ID NO: 148733 - protein, 33 aa, Artificial Sequence
  Description of Artificial Sequence: Synthetic polypeptide
NEEVIETVNPEVATEWYGSVSPDNLENIGSNQE

SEQ ID NO: 148734 - protein, 33 aa, Artificial Sequence
  Description of Artificial Sequence: Synthetic polypeptide
DEDEIRTTNPVATEQWGGCCAAANHQEAEGPRT

SEQ ID NO: 148735 - protein, 33 aa, Artificial Sequence
  Description of Artificial Sequence: Synthetic polypeptide
DEEEIATTNPVAYEHYGKVISYTPFSTEGGPRW

SEQ ID NO: 148736 - protein, 35 aa, Artificial Sequence
  Description of Artificial Sequence: Synthetic polypeptide
DEEEIATTNPVAYEHWGSVATGMQLGDTGQGGNAR

SEQ ID NO: 148737 - protein, 37 aa, Artificial Sequence
  Description of Artificial Sequence: Synthetic polypeptide
DEEEIRTTNPVATEQYGSVSSTPPAGPNMENGMGPVC

SEQ ID NO: 148738 - protein, 31 aa, Artificial Sequence
  Description of Artificial Sequence: Synthetic polypeptide
DEDEIRTTNPVATEQWGDVSEAGEMNAAEDA

SEQ ID NO: 148739 - protein, 37 aa, Artificial Sequence
  Description of Artificial Sequence: Synthetic polypeptide
DEEEIRTTNPVATEQYGSVPPWPESLPDLEQEFLSRM

SEQ ID NO: 148740 - protein, 37 aa, Artificial Sequence
  Description of Artificial Sequence: Synthetic polypeptide
NEGEIRTTNPVATEQYGSAVFYTVPNLGQPIGFSKRE

SEQ ID NO: 148741 - protein, 31 aa, Artificial Sequence
  Description of Artificial Sequence: Synthetic polypeptide
QEGEIATTNPCSSEQWGIVSCINLQDSEGTR

SEQ ID NO: 148742 - protein, 37 aa, Artificial Sequence
  Description of Artificial Sequence: Synthetic polypeptide
DEEEIRTTNPCATEAYGVVSVVVTTNLQAGTTTNVTE

SEQ ID NO: 148743 - protein, 38 aa, Artificial Sequence
  Description of Artificial Sequence: Synthetic polypeptide
AEEEIRTTNPVATEQYGSVVVTVTNNLEQGTEGGNDTN

SEQ ID NO: 148744 - protein, 36 aa, Artificial Sequence
  Description of Artificial Sequence: Synthetic polypeptide
DEEEIRTTNPCATEAYGSVATTNNDQGNQQGTNENG

SEQ ID NO: 148745 - protein, 36 aa, Artificial Sequence
  Description of Artificial Sequence: Synthetic polypeptide
DEEEIRTTNPVATEQYGSVPSALQVNEGRAMVEQFN

SEQ ID NO: 148746 - protein, 35 aa, Artificial Sequence
  Description of Artificial Sequence: Synthetic polypeptide
DEEEIATTNPVAYEHYGSVISYTHALSTPAGGPRW

SEQ ID NO: 148747 - protein, 34 aa, Artificial Sequence
  Description of Artificial Sequence: Synthetic polypeptide
DEEEIATTNPVAYEHYGSVISYTPFSTPGGTDRW

SEQ ID NO: 148748 - protein, 33 aa, Artificial Sequence
  Description of Artificial Sequence: Synthetic polypeptide
DEDEIRTTNPVATEQWGKVPSEGASMNQAEGDA

SEQ ID NO: 148749 - protein, 35 aa, Artificial Sequence
  Description of Artificial Sequence: Synthetic polypeptide
DETEIRTTNPVAYEQWGSVSNLNGDHNEGRGENSP

SEQ ID NO: 148750 - protein, 33 aa, Artificial Sequence
  Description of Artificial Sequence: Synthetic polypeptide
DEEEIATTNPVAYEHYGSVISYTPFSTPGGPPW

SEQ ID NO: 148751 - protein, 37 aa, Artificial Sequence
  Description of Artificial Sequence: Synthetic polypeptide
DEEEIRTTNPCATEAYGSVATVTNLQAGTEQGTNVNE

SEQ ID NO: 148752 - protein, 34 aa, Artificial Sequence
  Description of Artificial Sequence: Synthetic polypeptide
DETEIRTTNPVAYEQWGSVCYTQDNDQHTGGGTG

SEQ ID NO: 148753 - protein, 37 aa, Artificial Sequence
  Description of Artificial Sequence: Synthetic polypeptide
DEEEIRTTNPCATEAYGSVSVSVTTNLEAGTNNNTTA

SEQ ID NO: 148754 - protein, 35 aa, Artificial Sequence
  Description of Artificial Sequence: Synthetic polypeptide
DETEIRTTNPVAYEQWGSVCSTPNGNQGEDQNNDG

SEQ ID NO: 148755 - protein, 34 aa, Artificial Sequence
  Description of Artificial Sequence: Synthetic polypeptide
DEDEIRTTNPVATEQWGGCCATNNHQAEGGPMRN

SEQ ID NO: 148756 - protein, 32 aa, Artificial Sequence
  Description of Artificial Sequence: Synthetic polypeptide
NEEEISTTNPVATEQYGCSCSWEHQYFQSDQA

SEQ ID NO: 148757 - protein, 35 aa, Artificial Sequence
  Description of Artificial Sequence: Synthetic polypeptide
DEEEIATTNPVAYEHYGSVISYTHLSTHPGGPLRW

SEQ ID NO: 148758 - protein, 35 aa, Artificial Sequence
  Description of Artificial Sequence: Synthetic polypeptide
DETEIRTTNPVAYEQWGSVCSTENMGDQDIQDGEQ

SEQ ID NO: 148759 - protein, 37 aa, Artificial Sequence
  Description of Artificial Sequence: Synthetic polypeptide
DETEIRTTNPVAYEQWGSVCSTENLLDQDGEGRGMQP

SEQ ID NO: 148760 - protein, 36 aa, Artificial Sequence
  Description of Artificial Sequence: Synthetic polypeptide
DEEEIRTTNPVATEQYGISVVCTTRASSNNGGNNET

SEQ ID NO: 148761 - protein, 36 aa, Artificial Sequence
  Description of Artificial Sequence: Synthetic polypeptide
DETEIRTTNPVAYEQWGSVCSTENLGDQQIEDLGGQ

SEQ ID NO: 148762 - protein, 34 aa, Artificial Sequence
  Description of Artificial Sequence: Synthetic polypeptide
DEEEIATTNPVAYEHYGSVISYTHLSTEGGPLEW

SEQ ID NO: 148763 - protein, 36 aa, Artificial Sequence
  Description of Artificial Sequence: Synthetic polypeptide
DETEIRTTNPVAYEQWGSVCSTENLGDQDQHDGGQH

SEQ ID NO: 148764 - protein, 37 aa, Artificial Sequence
  Description of Artificial Sequence: Synthetic polypeptide
AEEEIRTTNPVATEQYGSVVVTVTNNNLGGTEQGNNQ

SEQ ID NO: 148765 - protein, 36 aa, Artificial Sequence
  Description of Artificial Sequence: Synthetic polypeptide
DETEIRTTNPVAYEQWGSVCSTENLGDQDIQDGGQD

SEQ ID NO: 148766 - protein, 36 aa, Artificial Sequence
  Description of Artificial Sequence: Synthetic polypeptide
DETEIRTTNPVAYEQWGSVCSTENLGDQDAQDGEQI

SEQ ID NO: 148767 - protein, 31 aa, Artificial Sequence
  Description of Artificial Sequence: Synthetic polypeptide
AESEIACTNPVATEQWGEASENEPQDREGGG

SEQ ID NO: 148768 - protein, 34 aa, Artificial Sequence
  Description of Artificial Sequence: Synthetic polypeptide
SEEEIRTTNPVATEQYGCVCGNTAHQENFGSDQA

SEQ ID NO: 148769 - protein, 35 aa, Artificial Sequence
  Description of Artificial Sequence: Synthetic polypeptide
SEEEIRTTNPVATEQYGCVCGNTGNLIENFGSQQS

SEQ ID NO: 148770 - protein, 33 aa, Artificial Sequence
  Description of Artificial Sequence: Synthetic polypeptide
QAEEIATTNPVATEQWGGCCTAANGNLDQGGER

SEQ ID NO: 148771 - protein, 34 aa, Artificial Sequence
  Description of Artificial Sequence: Synthetic polypeptide
QAEEIATTNPVATEQWGGCTVAGTNLQAEMGMRN

SEQ ID NO: 148772 - protein, 34 aa, Artificial Sequence
  Description of Artificial Sequence: Synthetic polypeptide
QAEEIATTNPVATEQWGSVSGTGPGPDNQAGNPL

SEQ ID NO: 148773 - protein, 34 aa, Artificial Sequence
  Description of Artificial Sequence: Synthetic polypeptide
DEEEIASVNPVCTEQYGVVSSTTPALPQMSGNPQ

SEQ ID NO: 148774 - protein, 34 aa, Artificial Sequence
  Description of Artificial Sequence: Synthetic polypeptide
QAEEIATTNPVATEQYGCVAGNGGLQPADGPNDQ

SEQ ID NO: 148775 - protein, 34 aa, Artificial Sequence
  Description of Artificial Sequence: Synthetic polypeptide
SEEEIRTTNPVATEQYGSVYTEDDMNNGFESLMA

SEQ ID NO: 148776 - protein, 35 aa, Artificial Sequence
  Description of Artificial Sequence: Synthetic polypeptide
DEEEIATTNPCATECYGVVCYKTNDEHQRQGNDHG

SEQ ID NO: 148777 - protein, 34 aa, Artificial Sequence
  Description of Artificial Sequence: Synthetic polypeptide
SEEEIRTTNPVATEQYGSVYTPTHMYSAEGTIDE

SEQ ID NO: 148778 - protein, 34 aa, Artificial Sequence
  Description of Artificial Sequence: Synthetic polypeptide
DETEIACTNPVATEQYGSVATPAIAQDSDGNDLF

SEQ ID NO: 148779 - protein, 36 aa, Artificial Sequence
  Description of Artificial Sequence: Synthetic polypeptide
DEEEIRTTNPVATEQYGSVSSTTPDGPAMPNGMPPV

SEQ ID NO: 148780 - protein, 34 aa, Artificial Sequence
  Description of Artificial Sequence: Synthetic polypeptide
QAEEIATTNPVATEQYGCVAGTGLQDDQGPGDNN

SEQ ID NO: 148781 - protein, 33 aa, Artificial Sequence
  Description of Artificial Sequence: Synthetic polypeptide
AESEIATTNPVATEQYGCVYVWENGIQKTGDDR

SEQ ID NO: 148782 - protein, 37 aa, Artificial Sequence
  Description of Artificial Sequence: Synthetic polypeptide
DEEEIRTTNPVATEQYGSVSSTTPDGPNMGNGDDDDD

SEQ ID NO: 148783 - protein, 35 aa, Artificial Sequence
  Description of Artificial Sequence: Synthetic polypeptide
SEEEIRTTNPVATEQYGSVYWPTHMYSEGTNDTEF

SEQ ID NO: 148784 - protein, 33 aa, Artificial Sequence
  Description of Artificial Sequence: Synthetic polypeptide
DETEIACTNPVATEQYGSVATNGEATEGGGEDT

SEQ ID NO: 148785 - protein, 33 aa, Artificial Sequence
  Description of Artificial Sequence: Synthetic polypeptide
DETEIACTNPVATEQYGSVAPNEPGQEHNNQVE

SEQ ID NO: 148786 - protein, 33 aa, Artificial Sequence
  Description of Artificial Sequence: Synthetic polypeptide
DETEIACTNPVATEQYGSVANGGNGEYGAEGGR

SEQ ID NO: 148787 - protein, 32 aa, Artificial Sequence
  Description of Artificial Sequence: Synthetic polypeptide
DETEIACTNPVATEQYGSVAATTDQDSEQDAQ

SEQ ID NO: 148788 - protein, 33 aa, Artificial Sequence
  Description of Artificial Sequence: Synthetic polypeptide
QAEEIATTNPVATEQYGCVAGTGGLQADDPNDN

SEQ ID NO: 148789 - protein, 33 aa, Artificial Sequence
  Description of Artificial Sequence: Synthetic polypeptide
SEEEIRTTNPVATEQYGSVYAVNMIGEPESDSQ

SEQ ID NO: 148790 - protein, 33 aa, Artificial Sequence
  Description of Artificial Sequence: Synthetic polypeptide
DETEIACTNPVATEQYGSVCAADNHGQDSDIER

SEQ ID NO: 148791 - protein, 35 aa, Artificial Sequence
  Description of Artificial Sequence: Synthetic polypeptide
DETEIACTNPVATEQYGSVCAANNGDEQDRSINDR

SEQ ID NO: 148792 - protein, 36 aa, Artificial Sequence
  Description of Artificial Sequence: Synthetic polypeptide
DEEEIRTTNPFATEQYGSVSSTTPAGPNMRNTMNPV

SEQ ID NO: 148793 - protein, 37 aa, Artificial Sequence
  Description of Artificial Sequence: Synthetic polypeptide
DEEEIRTTNPFATEQYGSVSSTTRAGGPNMRNGMNPV

SEQ ID NO: 148794 - protein, 32 aa, Artificial Sequence
  Description of Artificial Sequence: Synthetic polypeptide
QAEEIATTNPVATEQWGCVAGTMLQHDDNLPM

SEQ ID NO: 148795 - protein, 38 aa, Artificial Sequence
  Description of Artificial Sequence: Synthetic polypeptide
DEEEIRTTNPVATEQYGSVSSTTPAVGPNMRNGMNPVD

SEQ ID NO: 148796 - protein, 38 aa, Artificial Sequence
  Description of Artificial Sequence: Synthetic polypeptide
DEEEIRTTNPVATEQYGSVSSTTPAVGPNMRNGMNPVQ

SEQ ID NO: 148797 - protein, 35 aa, Artificial Sequence
  Description of Artificial Sequence: Synthetic polypeptide
SEEEIRTTNPVATEQYGSVWCTEDLEIMRSQVMPM

SEQ ID NO: 148798 - protein, 32 aa, Artificial Sequence
  Description of Artificial Sequence: Synthetic polypeptide
DETEIACTNPVAYEQYGSVATNGTAENPNELH

SEQ ID NO: 148799 - protein, 36 aa, Artificial Sequence
  Description of Artificial Sequence: Synthetic polypeptide
SEEEIRTTNPVATEQYGSVWCTMEDLEQMRSQVMKM

SEQ ID NO: 148800 - protein, 31 aa, Artificial Sequence
  Description of Artificial Sequence: Synthetic polypeptide
QAEEIATTNPVATEQWGCVAGTMLQHDDPPQ

SEQ ID NO: 148801 - protein, 36 aa, Artificial Sequence
  Description of Artificial Sequence: Synthetic polypeptide
SEEEIRTTNPVATEQYGSVWSYLWEMLENQISDNNE

SEQ ID NO: 148802 - protein, 33 aa, Artificial Sequence
  Description of Artificial Sequence: Synthetic polypeptide
DETEIACTNPVAYEQYGSVAATNLTGTPDGSEN

SEQ ID NO: 148803 - protein, 33 aa, Artificial Sequence
  Description of Artificial Sequence: Synthetic polypeptide
DETEIACTNPVAYEQYGCVATNLQGTPGEDQDG

SEQ ID NO: 148804 - protein, 34 aa, Artificial Sequence
  Description of Artificial Sequence: Synthetic polypeptide
DETEIACTNPVATEQYGSVCSVADNDNDGGENEH

SEQ ID NO: 148805 - protein, 34 aa, Artificial Sequence
  Description of Artificial Sequence: Synthetic polypeptide
DETEIACTNPVATEQYGSVCATNLAPDALMGDLH

SEQ ID NO: 148806 - protein, 34 aa, Artificial Sequence
  Description of Artificial Sequence: Synthetic polypeptide
DETEIACTNPVATEQYGSVCATNLAGTDGAEDGH

SEQ ID NO: 148807 - protein, 35 aa, Artificial Sequence
  Description of Artificial Sequence: Synthetic polypeptide
DETEIACTNPVATEQYGSVCAMTNHGEQTLDGARN

SEQ ID NO: 148808 - protein, 33 aa, Artificial Sequence
  Description of Artificial Sequence: Synthetic polypeptide
DETEIACTNPVATEQYGSVCAGTDPPTDDGNDP

SEQ ID NO: 148809 - protein, 34 aa, Artificial Sequence
  Description of Artificial Sequence: Synthetic polypeptide
DETEIACTNPVATEQYGSVCAGEGLQNSNNQDRH

SEQ ID NO: 148810 - protein, 32 aa, Artificial Sequence
  Description of Artificial Sequence: Synthetic polypeptide
SEEEIRTTNPVATEQYGSVYAVEMIEPESDTD

SEQ ID NO: 148811 - protein, 36 aa, Artificial Sequence
  Description of Artificial Sequence: Synthetic polypeptide
SEEEIRTTNPVATEQYGSYGVVTGDNGQGGEQEGIV

SEQ ID NO: 148812 - protein, 30 aa, Artificial Sequence
  Description of Artificial Sequence: Synthetic polypeptide
DETEIAPTNPCASEQYGIVACENWQEPGPI

SEQ ID NO: 148813 - protein, 34 aa, Artificial Sequence
  Description of Artificial Sequence: Synthetic polypeptide
SEEEIRTTNPVATEQYGVCSTDNATGEGTQASPG

SEQ ID NO: 148814 - protein, 34 aa, Artificial Sequence
  Description of Artificial Sequence: Synthetic polypeptide
SEEEIRTTNPVATESWGSVFHNENDIHERNGDHR

SEQ ID NO: 148815 - protein, 34 aa, Artificial Sequence
  Description of Artificial Sequence: Synthetic polypeptide
DEEEIATTNPVATEQYGSVCATADPPTDDMNGDP

SEQ ID NO: 148816 - protein, 31 aa, Artificial Sequence
  Description of Artificial Sequence: Synthetic polypeptide
DETEIACTNPIATEQYGETWSNEDLQPGGYI

SEQ ID NO: 148817 - protein, 31 aa, Artificial Sequence
  Description of Artificial Sequence: Synthetic polypeptide
DEEEIRTTNPIATEQYGEAANAEDWAHGPYK

SEQ ID NO: 148818 - protein, 31 aa, Artificial Sequence
  Description of Artificial Sequence: Synthetic polypeptide
DEEEIRTTNPIATEQYGEAANAEDWQHEPYK

SEQ ID NO: 148819 - protein, 29 aa, Artificial Sequence
  Description of Artificial Sequence: Synthetic peptide
QAEEIATTNPVATEQYGEAPEVCQHFEEK

SEQ ID NO: 148820 - protein, 29 aa, Artificial Sequence
  Description of Artificial Sequence: Synthetic peptide
QAEEIATTNPVATEQYGEAPLVCQHEEKI

SEQ ID NO: 148821 - protein, 35 aa, Artificial Sequence
  Description of Artificial Sequence: Synthetic polypeptide
DETDEIATTNPVAYEQWGSVSTNLNQGAMGGDMSA

SEQ ID NO: 148822 - protein, 32 aa, Artificial Sequence
  Description of Artificial Sequence: Synthetic polypeptide
DEEEIRTTNPIATEQYGETAANAEDWAHGPYK

SEQ ID NO: 148823 - protein, 33 aa, Artificial Sequence
  Description of Artificial Sequence: Synthetic polypeptide
DEEEIATTNPCAYEQWGSVCSTIDNNDDLGGEL

SEQ ID NO: 148824 - protein, 29 aa, Artificial Sequence
  Description of Artificial Sequence: Synthetic peptide
QAEEIATTNPVATEQYGEAPPEVCQHEEK

SEQ ID NO: 148825 - protein, 37 aa, Artificial Sequence
  Description of Artificial Sequence: Synthetic polypeptide
AEEEIRTTNPVATEQYGSVSTNTNNQNGTEEGTTEDE

SEQ ID NO: 148826 - protein, 36 aa, Artificial Sequence
  Description of Artificial Sequence: Synthetic polypeptide
DEEEIATTNPVATEQYGSVCASNDLPQEHQDDNAAE

SEQ ID NO: 148827 - protein, 32 aa, Artificial Sequence
  Description of Artificial Sequence: Synthetic polypeptide
DETCIRTTNPLATEQWGCVCSWELQSFGSDQS

SEQ ID NO: 148828 - protein, 37 aa, Artificial Sequence
  Description of Artificial Sequence: Synthetic polypeptide
DEEEIRTTNPIATEQYGSVSSTTPAEGPNMRNGMNPV

SEQ ID NO: 148829 - protein, 35 aa, Artificial Sequence
  Description of Artificial Sequence: Synthetic polypeptide
DEEEIATTNPVATEQYGSVCASHNNEEATDNQENH

SEQ ID NO: 148830 - protein, 36 aa, Artificial Sequence
  Description of Artificial Sequence: Synthetic polypeptide
DEEEIRTTNPIATEQYGSVSSTTPAGPNMRNKMNPA

SEQ ID NO: 148831 - protein, 37 aa, Artificial Sequence
  Description of Artificial Sequence: Synthetic polypeptide
AEEEIRTTNPVATEQYGSVSTNTNNDESIGTVNNATE

SEQ ID NO: 148832 - protein, 33 aa, Artificial Sequence
  Description of Artificial Sequence: Synthetic polypeptide
DEEEIATTNPEATDQYGQVCCCDQDQKREGNNE

SEQ ID NO: 148833 - protein, 32 aa, Artificial Sequence
  Description of Artificial Sequence: Synthetic polypeptide
DETCISTTNPLATEQFGCVCSWELQSFGSNQM

SEQ ID NO: 148834 - protein, 38 aa, Artificial Sequence
  Description of Artificial Sequence: Synthetic polypeptide
AEEEIRTTNPVATEQYGSVSTNTQNGNEQGTTNVATEE

SEQ ID NO: 148835 - protein, 36 aa, Artificial Sequence
  Description of Artificial Sequence: Synthetic polypeptide
DEEEIRTTNPIATEQWGSVSATTPDGPAERNGMNPV

SEQ ID NO: 148836 - protein, 37 aa, Artificial Sequence
  Description of Artificial Sequence: Synthetic polypeptide
AEEEIRTTNPVATEQYGSVSTNVNNENGTETGTNNTE

SEQ ID NO: 148837 - protein, 34 aa, Artificial Sequence
  Description of Artificial Sequence: Synthetic polypeptide
DETEIACTNPVATEQYGSCAQGPTNPDAQAGGRH

SEQ ID NO: 148838 - protein, 34 aa, Artificial Sequence
  Description of Artificial Sequence: Synthetic polypeptide
DETEIACTNPVATEQYGSACAATGLAPGEQMENR

SEQ ID NO: 148839 - protein, 33 aa, Artificial Sequence
  Description of Artificial Sequence: Synthetic polypeptide
SEEEIRTTNPVATESWGSVFQNENDHERNGDQE

SEQ ID NO: 148840 - protein, 33 aa, Artificial Sequence
  Description of Artificial Sequence: Synthetic polypeptide
DETEIACTNPVATEQYGETTAEENLQERKGPYI

SEQ ID NO: 148841 - protein, 34 aa, Artificial Sequence
  Description of Artificial Sequence: Synthetic polypeptide
QAEEIATTNPVATEQYGCVAGTNLQDDQLPNENN

SEQ ID NO: 148842 - protein, 35 aa, Artificial Sequence
  Description of Artificial Sequence: Synthetic polypeptide
SEEEIRTTNPVATESWGSVFSNENDHHEREGGDQR

SEQ ID NO: 148843 - protein, 38 aa, Artificial Sequence
  Description of Artificial Sequence: Synthetic polypeptide
DEEEIRTTNPVATEQYGSVNSPTMNAVEFTADQLENDD

SEQ ID NO: 148844 - protein, 35 aa, Artificial Sequence
  Description of Artificial Sequence: Synthetic polypeptide
SEEEIRTTNPVATESWGSVFSNTNDHERSGGDQHQ

SEQ ID NO: 148845 - protein, 32 aa, Artificial Sequence
  Description of Artificial Sequence: Synthetic polypeptide
DEEEIRTTNPIATECWGATTWSEEDWARGNYI

SEQ ID NO: 148846 - protein, 35 aa, Artificial Sequence
  Description of Artificial Sequence: Synthetic polypeptide
DEEEIRTTNPIATECWGSVWSTTPAGAERKGMNYV

SEQ ID NO: 148847 - protein, 36 aa, Artificial Sequence
  Description of Artificial Sequence: Synthetic polypeptide
DEEEIRTTNPVATEQYGCVSAITPAGMNMRNGMEPV

SEQ ID NO: 148848 - protein, 35 aa, Artificial Sequence
  Description of Artificial Sequence: Synthetic polypeptide
DEEEIATTNPVATEQYGSVCATNHIENIDDQDEGD

SEQ ID NO: 148849 - protein, 35 aa, Artificial Sequence
  Description of Artificial Sequence: Synthetic polypeptide
DEEEIATTNPVATEQYGSVCATNHIENIDDGDEAM

SEQ ID NO: 148850 - protein, 34 aa, Artificial Sequence
  Description of Artificial Sequence: Synthetic polypeptide
DEEEIRTTNPIATEQWGAVSATTPAGNMRNGPPV

SEQ ID NO: 148851 - protein, 34 aa, Artificial Sequence
  Description of Artificial Sequence: Synthetic polypeptide
DEEEIRTTNPIATEQWGAVWANTPAGNMRNGPPV

SEQ ID NO: 148852 - protein, 34 aa, Artificial Sequence
  Description of Artificial Sequence: Synthetic polypeptide
DEEEIRTTNPVATEQYGCVPAMDVNQFTEGSQQE

SEQ ID NO: 148853 - protein, 33 aa, Artificial Sequence
  Description of Artificial Sequence: Synthetic polypeptide
DETEIACTNPVATEQYGATTAEENLQERKGPYI

SEQ ID NO: 148854 - protein, 33 aa, Artificial Sequence
  Description of Artificial Sequence: Synthetic polypeptide
DETEIACTNPVATEQWGSVSMSGNGGQPGGPQF

SEQ ID NO: 148855 - protein, 36 aa, Artificial Sequence
  Description of Artificial Sequence: Synthetic polypeptide
DEEEIRTTNPIATEQWGSVSATTPDGPAERKGMNPV

SEQ ID NO: 148856 - protein, 34 aa, Artificial Sequence
  Description of Artificial Sequence: Synthetic polypeptide
SEEEIRTTNPVATEQYGWVNETSNSIDAQGFTYQ

SEQ ID NO: 148857 - protein, 30 aa, Artificial Sequence
  Description of Artificial Sequence: Synthetic polypeptide
DETEIASTNPVATEGWGVTANSDLQEHGDI

SEQ ID NO: 148858 - protein, 36 aa, Artificial Sequence
  Description of Artificial Sequence: Synthetic polypeptide
DEEEIRTTNPFATEQYGSVSSITPGPLVCCDGDEPD

SEQ ID NO: 148859 - protein, 37 aa, Artificial Sequence
  Description of Artificial Sequence: Synthetic polypeptide
DEEEIATTNPVATEQYGSVCATNPQLGNPDDQTGGDA

SEQ ID NO: 148860 - protein, 35 aa, Artificial Sequence
  Description of Artificial Sequence: Synthetic polypeptide
DETEIATTNPVATEQWGSVAITNQPEQDGQDNSDA

SEQ ID NO: 148861 - protein, 34 aa, Artificial Sequence
  Description of Artificial Sequence: Synthetic polypeptide
DETEIATTNPVATEQWGSVAITNPEIDHGDNSDA

SEQ ID NO: 148862 - protein, 34 aa, Artificial Sequence
  Description of Artificial Sequence: Synthetic polypeptide
DETEIATTNPVATEQWGSVAITNNPEQGQDNSAA

SEQ ID NO: 148863 - protein, 35 aa, Artificial Sequence
  Description of Artificial Sequence: Synthetic polypeptide
DETEIATTNPVATEQWGSVAITNAPEQNGDQNSDA

SEQ ID NO: 148864 - protein, 35 aa, Artificial Sequence
  Description of Artificial Sequence: Synthetic polypeptide
DETEIATTNPVATEQWGSVAIANNLDDQGGGMVRE

SEQ ID NO: 148865 - protein, 34 aa, Artificial Sequence
  Description of Artificial Sequence: Synthetic polypeptide
DETEIATTNPVATEQWGSVAGENPPGQEHNNQRE

SEQ ID NO: 148866 - protein, 32 aa, Artificial Sequence
  Description of Artificial Sequence: Synthetic polypeptide
NTEHEIATTNPVAYEQWGVVSTNLNMDGGGET

SEQ ID NO: 148867 - protein, 35 aa, Artificial Sequence
  Description of Artificial Sequence: Synthetic polypeptide
DEEEIRTTNPVATEQYGCVSTEEDHNQENFMSDQS

SEQ ID NO: 148868 - protein, 28 aa, Artificial Sequence
  Description of Artificial Sequence: Synthetic peptide
AESEIASTNPVGTEGYGVMASYLQHGDI

SEQ ID NO: 148869 - protein, 34 aa, Artificial Sequence
  Description of Artificial Sequence: Synthetic polypeptide
DETEIATTNPVATEQWGSVAANDPGAPRNQEGNH

SEQ ID NO: 148870 - protein, 34 aa, Artificial Sequence
  Description of Artificial Sequence: Synthetic polypeptide
DETEIATTNPVATEQWGSVAAANNLQEAGEPMTE

SEQ ID NO: 148871 - protein, 34 aa, Artificial Sequence
  Description of Artificial Sequence: Synthetic polypeptide
DETEIATTNPVATEQWGSTAPTNEPGQEHNNQRE

SEQ ID NO: 148872 - protein, 31 aa, Artificial Sequence
  Description of Artificial Sequence: Synthetic polypeptide
DETEIATTNPVATEQWGETTANADWQHGPYK

SEQ ID NO: 148873 - protein, 31 aa, Artificial Sequence
  Description of Artificial Sequence: Synthetic polypeptide
DETEIATTNPVATEQWGCVSEGEMNAAEDAW

SEQ ID NO: 148874 - protein, 35 aa, Artificial Sequence
  Description of Artificial Sequence: Synthetic polypeptide
DEEEIRTTNPVATEQYGSVCTEVGPVNASGETLIF

SEQ ID NO: 148875 - protein, 34 aa, Artificial Sequence
  Description of Artificial Sequence: Synthetic polypeptide
DEEEIRTTNPEATEQYGCVCGNTEDNANFGSDQS

SEQ ID NO: 148876 - protein, 33 aa, Artificial Sequence
  Description of Artificial Sequence: Synthetic polypeptide
DEEEIRTTNPEATEQYGCVCPNTEHANFGSDQS

SEQ ID NO: 148877 - protein, 31 aa, Artificial Sequence
  Description of Artificial Sequence: Synthetic polypeptide
DEEEIASVNPIATEQYGAVSNDENWAEPGPQ

SEQ ID NO: 148878 - protein, 36 aa, Artificial Sequence
  Description of Artificial Sequence: Synthetic polypeptide
AEEEIRTTNPVATEQYGSVVVSVTTNANNQEQEETD

SEQ ID NO: 148879 - protein, 29 aa, Artificial Sequence
  Description of Artificial Sequence: Synthetic peptide
AESEIASTNPVGTEGYGVMASTLQHGGDQ

SEQ ID NO: 148880 - protein, 33 aa, Artificial Sequence
  Description of Artificial Sequence: Synthetic polypeptide
DEEEIRTTNPEATCQYGCVCPTDHNQNFGSDAA

SEQ ID NO: 148881 - protein, 33 aa, Artificial Sequence
  Description of Artificial Sequence: Synthetic polypeptide
DETEIATTNPVATEQWGSVATADNPAANMPGRD

SEQ ID NO: 148882 - protein, 36 aa, Artificial Sequence
  Description of Artificial Sequence: Synthetic polypeptide
AEEEIRTTNPVATEQYGSVSTSQAGTTEQGNVNDDN

SEQ ID NO: 148883 - protein, 35 aa, Artificial Sequence
  Description of Artificial Sequence: Synthetic polypeptide
DEEEIATTNPVATEQYGSVCSAALHLPLDSDENSQ

SEQ ID NO: 148884 - protein, 31 aa, Artificial Sequence
  Description of Artificial Sequence: Synthetic polypeptide
DEEEIASTNPVSTEGYGNAAANTIQSRVGQK

SEQ ID NO: 148885 - protein, 34 aa, Artificial Sequence
  Description of Artificial Sequence: Synthetic polypeptide
DEEEIRTTNPCAYMQYGSVSSGNIGFHQGDNDDH

SEQ ID NO: 148886 - protein, 30 aa, Artificial Sequence
  Description of Artificial Sequence: Synthetic polypeptide
DEEEIRTTNPCCIAQWGCVAGTGLADGDEE

SEQ ID NO: 148887 - protein, 31 aa, Artificial Sequence
  Description of Artificial Sequence: Synthetic polypeptide
DEEEIRTTNPCCTAQWGCIAGTNGLADGDEQ

SEQ ID NO: 148888 - protein, 30 aa, Artificial Sequence
  Description of Artificial Sequence: Synthetic polypeptide
DEEEIASTNPVSTEQYGEAAAEVCQRVEEK

SEQ ID NO: 148889 - protein, 34 aa, Artificial Sequence
  Description of Artificial Sequence: Synthetic polypeptide
DETEIATTNPVATEQWGSVSGEGPPQQATNGNPV

SEQ ID NO: 148890 - protein, 31 aa, Artificial Sequence
  Description of Artificial Sequence: Synthetic polypeptide
DEEEIRTTNPCCTAQWGCVAGTGLADNGDEW

SEQ ID NO: 148891 - protein, 28 aa, Artificial Sequence
  Description of Artificial Sequence: Synthetic peptide
AESEIASTNPVGTEGYGVMASTDQHGDI

SEQ ID NO: 148892 - protein, 32 aa, Artificial Sequence
  Description of Artificial Sequence: Synthetic polypeptide
NTEHEIATTNPVAYEQWGSVATNLNGEGGETE

SEQ ID NO: 148893 - protein, 36 aa, Artificial Sequence
  Description of Artificial Sequence: Synthetic polypeptide
DEDEIRTTNPVATEHYGSVCQTNDQNQDGQHGNTKD

SEQ ID NO: 148894 - protein, 36 aa, Artificial Sequence
  Description of Artificial Sequence: Synthetic polypeptide
DETEIATTNPVATEQWGSVSATGNPLDAQGPEDGTN

SEQ ID NO: 148895 - protein, 37 aa, Artificial Sequence
  Description of Artificial Sequence: Synthetic polypeptide
DEEEIATTNPVATEQYGSVCPTDNDQGNQDGQRGDQH

SEQ ID NO: 148896 - protein, 35 aa, Artificial Sequence
  Description of Artificial Sequence: Synthetic polypeptide
DEEEIATTNPVATEQYGSVCIDTPLPDDSGDMAAN

SEQ ID NO: 148897 - protein, 36 aa, Artificial Sequence
  Description of Artificial Sequence: Synthetic polypeptide
DETEIATTNPVATEQWGSVSATGELPQAQTEPNDRH

SEQ ID NO: 148898 - protein, 35 aa, Artificial Sequence
  Description of Artificial Sequence: Synthetic polypeptide
DEEEIATTNPVATEQYGSVCGVGDDLNPDAQMGQD

SEQ ID NO: 148899 - protein, 33 aa, Artificial Sequence
  Description of Artificial Sequence: Synthetic polypeptide
NTEHEIATTNPVAYEQWGSVSTNLNHNGGEGTS

SEQ ID NO: 148900 - protein, 34 aa, Artificial Sequence
  Description of Artificial Sequence: Synthetic polypeptide
DETEIATTNPVATEQWGSVATTSNDQNNNPQNPP

SEQ ID NO: 148901 - protein, 34 aa, Artificial Sequence
  Description of Artificial Sequence: Synthetic polypeptide
DEEEIRTTNPEATEQYGCVCPTEELNANFNSDQS

SEQ ID NO: 148902 - protein, 34 aa, Artificial Sequence
  Description of Artificial Sequence: Synthetic polypeptide
DETEIATTNPVATEQWGCVAGTGQLQNRMGGELH

SEQ ID NO: 148903 - protein, 35 aa, Artificial Sequence
  Description of Artificial Sequence: Synthetic polypeptide
DETEIATTNPVATEQWGAVCPTDNNDQDQGGDNNR

SEQ ID NO: 148904 - protein, 29 aa, Artificial Sequence
  Description of Artificial Sequence: Synthetic peptide
AESEIASTNPVGTEGYGVMHASTLQHGDI

SEQ ID NO: 148905 - protein, 31 aa, Artificial Sequence
  Description of Artificial Sequence: Synthetic polypeptide
DETEIATTNPVATECWGATANSEDLQEPGDI

SEQ ID NO: 148906 - protein, 33 aa, Artificial Sequence
  Description of Artificial Sequence: Synthetic polypeptide
QAEEIATTNPVATAQWGSVSGTGNPDNADGGMR

SEQ ID NO: 148907 - protein, 34 aa, Artificial Sequence
  Description of Artificial Sequence: Synthetic polypeptide
DETEIATTNPVATASWGSVSANNAEPQDRGGENG

SEQ ID NO: 148908 - protein, 33 aa, Artificial Sequence
  Description of Artificial Sequence: Synthetic polypeptide
DETEIATTNPVATAQWGSVSATGAGGQAPGGFA

SEQ ID NO: 148909 - protein, 34 aa, Artificial Sequence
  Description of Artificial Sequence: Synthetic polypeptide
DETEIATTNPVATAQWGSVAAGNLFTPNPMGNFR

SEQ ID NO: 148910 - protein, 36 aa, Artificial Sequence
  Description of Artificial Sequence: Synthetic polypeptide
DEEEIRTTNPVATEQYGCVSSMTPAGPNMRNGMEPV

SEQ ID NO: 148911 - protein, 33 aa, Artificial Sequence
  Description of Artificial Sequence: Synthetic polypeptide
DETEIATTNPVATAAWGSVSGPNEPQDNAGGNG

SEQ ID NO: 148912 - protein, 31 aa, Artificial Sequence
  Description of Artificial Sequence: Synthetic polypeptide
DETEIATTNPICTECYGAVWANDDLQPKGPQ

SEQ ID NO: 148913 - protein, 33 aa, Artificial Sequence
  Description of Artificial Sequence: Synthetic polypeptide
QAEEIATTNPVATAQWGSVSGTGNPDTADGGNH

SEQ ID NO: 148914 - protein, 30 aa, Artificial Sequence
  Description of Artificial Sequence: Synthetic polypeptide
DETEIATTNPICTECYGAVWADDLQPKGPQ

SEQ ID NO: 148915 - protein, 32 aa, Artificial Sequence
  Description of Artificial Sequence: Synthetic polypeptide
DETEIATTNPIATEQWGATWSEENWQPKGPYR

SEQ ID NO: 148916 - protein, 32 aa, Artificial Sequence
  Description of Artificial Sequence: Synthetic polypeptide
DETEIATTNPIATEQWGATWSEENWQPKGGYR

SEQ ID NO: 148917 - protein, 36 aa, Artificial Sequence
  Description of Artificial Sequence: Synthetic polypeptide
DEEEIRTTNPEATEQYGSVSSTTPAGPNMRNGMPPV

SEQ ID NO: 148918 - protein, 32 aa, Artificial Sequence
  Description of Artificial Sequence: Synthetic polypeptide
DETEIATTNPIATECWGSVSATDLEDHKGEDL

SEQ ID NO: 148919 - protein, 32 aa, Artificial Sequence
  Description of Artificial Sequence: Synthetic polypeptide
DETEIATTNPIATECWGSVSATDLADHKGEDL

SEQ ID NO: 148920 - protein, 36 aa, Artificial Sequence
  Description of Artificial Sequence: Synthetic polypeptide
DEEEIRTTNPVATEQYGSVNSTISPDDEGSGSEEIP

SEQ ID NO: 148921 - protein, 33 aa, Artificial Sequence
  Description of Artificial Sequence: Synthetic polypeptide
DETEIATTNPCAYEQWGSVYTNLQGDHGQGDAD

SEQ ID NO: 148922 - protein, 32 aa, Artificial Sequence
  Description of Artificial Sequence: Synthetic polypeptide
DETEIATTNPCAYEQWGSVPTWENDQNNGGEQ

SEQ ID NO: 148923 - protein, 33 aa, Artificial Sequence
  Description of Artificial Sequence: Synthetic polypeptide
QAEEIATTNPVATEQWGCVAGNNLQDMGPLDNN

SEQ ID NO: 148924 - protein, 32 aa, Artificial Sequence
  Description of Artificial Sequence: Synthetic polypeptide
DETEIATTNPVATECWGATTSNDEDLQSGNYI

SEQ ID NO: 148925 - protein, 37 aa, Artificial Sequence
  Description of Artificial Sequence: Synthetic polypeptide
DEEEIRTTNPIATEQYGSVSSTTPAPGPNMRNGMNPV

SEQ ID NO: 148926 - protein, 32 aa, Artificial Sequence
  Description of Artificial Sequence: Synthetic polypeptide
QAEEIATTNPVATAQWGSVSGAGNPDNANGNN

SEQ ID NO: 148927 - protein, 31 aa, Artificial Sequence
  Description of Artificial Sequence: Synthetic polypeptide
DETEIATTNPVATECYGETWANEEDWARGPI

SEQ ID NO: 148928 - protein, 33 aa, Artificial Sequence
  Description of Artificial Sequence: Synthetic polypeptide
DEEEIRTTNPEATEQYGCVCPTEPAENFGSDQS

SEQ ID NO: 148929 - protein, 35 aa, Artificial Sequence
  Description of Artificial Sequence: Synthetic polypeptide
DETEIATTNPVATEPYGEVVHTDNKNDQRQGNDSS

SEQ ID NO: 148930 - protein, 32 aa, Artificial Sequence
  Description of Artificial Sequence: Synthetic polypeptide
DEEEIASVNPVATECYGVVANDENLQEPGPYQ

SEQ ID NO: 148931 - protein, 34 aa, Artificial Sequence
  Description of Artificial Sequence: Synthetic polypeptide
DEEEIRTTNPEATEQYGQCVCPTELNANFGSDQS

SEQ ID NO: 148932 - protein, 35 aa, Artificial Sequence
  Description of Artificial Sequence: Synthetic polypeptide
DETEIATTNPVATEHYGSVAATTNDHDQRGGTGGT

SEQ ID NO: 148933 - protein, 31 aa, Artificial Sequence
  Description of Artificial Sequence: Synthetic polypeptide
DETEIATTNPVATEGWGATANSEDLQEPGDI

SEQ ID NO: 148934 - protein, 31 aa, Artificial Sequence
  Description of Artificial Sequence: Synthetic polypeptide
DETEIATTNPVATEGWGATANSEDLQEHGDI

SEQ ID NO: 148935 - protein, 30 aa, Artificial Sequence
  Description of Artificial Sequence: Synthetic polypeptide
DETEIATTNPVATEGWGATANSDLQEHGDI

SEQ ID NO: 148936 - protein, 35 aa, Artificial Sequence
  Description of Artificial Sequence: Synthetic polypeptide
DEEEIATTNPVATEQYGSVCGMTHGGAEAPGGDNH

SEQ ID NO: 148937 - protein, 34 aa, Artificial Sequence
  Description of Artificial Sequence: Synthetic polypeptide
DEEEIATTNPVATEQYGSVCDTPGEGAGGGPADD

SEQ ID NO: 148938 - protein, 35 aa, Artificial Sequence
  Description of Artificial Sequence: Synthetic polypeptide
DEEEIATTNPVATEQYGSVCAVTNHIENIDGEEGD

SEQ ID NO: 148939 - protein, 35 aa, Artificial Sequence
  Description of Artificial Sequence: Synthetic polypeptide
DEEEIATTNPVATEQYGSVCAVGDTGANEAGPARP

SEQ ID NO: 148940 - protein, 35 aa, Artificial Sequence
  Description of Artificial Sequence: Synthetic polypeptide
DEEEIATTNPVATEQYGSVCAVGDDGNNAMGNNQM

SEQ ID NO: 148941 - protein, 34 aa, Artificial Sequence
  Description of Artificial Sequence: Synthetic polypeptide
DETEIATTNPVATECYGSVWSNTEDLEEHEGEYI

SEQ ID NO: 148942 - protein, 28 aa, Artificial Sequence
  Description of Artificial Sequence: Synthetic peptide
QAEEIATTNPVAFEQYGEAPEVCQHEEK

SEQ ID NO: 148943 - protein, 32 aa, Artificial Sequence
  Description of Artificial Sequence: Synthetic polypeptide
QAEEIATTNPVATAQWGCVAGTNGLAAGGNDF

SEQ ID NO: 148944 - protein, 35 aa, Artificial Sequence
  Description of Artificial Sequence: Synthetic polypeptide
DETEIATTNPVATECYGSVAATPNDGDREGGGQRR

SEQ ID NO: 148945 - protein, 36 aa, Artificial Sequence
  Description of Artificial Sequence: Synthetic polypeptide
DETEIATTNPVATECYGSVAATPNDGDQRNGGGQKR

SEQ ID NO: 148946 - protein, 31 aa, Artificial Sequence
  Description of Artificial Sequence: Synthetic polypeptide
DETEIATTNPVATECYGETWSNEEDWARGPI

SEQ ID NO: 148947 - protein, 35 aa, Artificial Sequence
  Description of Artificial Sequence: Synthetic polypeptide
DEEEIATTNPVATEQYGSVCATPVGGEHQDDNDAG

SEQ ID NO: 148948 - protein, 34 aa, Artificial Sequence
  Description of Artificial Sequence: Synthetic polypeptide
DEEEIASTNPVGTEQYGSVSSTTTGPQMHNGMDV

SEQ ID NO: 148949 - protein, 35 aa, Artificial Sequence
  Description of Artificial Sequence: Synthetic polypeptide
DEEEIRTTNPVATEQYGCVCSWPEHEQENFGSDQL

SEQ ID NO: 148950 - protein, 36 aa, Artificial Sequence
  Description of Artificial Sequence: Synthetic polypeptide
DEDEIRTTNPVATEHYGSVCQTNDQNQDGQGGNTEG

SEQ ID NO: 148951 - protein, 36 aa, Artificial Sequence
  Description of Artificial Sequence: Synthetic polypeptide
DEEEIRTTNPVATEQYGCVCSWGEHNQENFGSDNQG

SEQ ID NO: 148952 - protein, 35 aa, Artificial Sequence
  Description of Artificial Sequence: Synthetic polypeptide
DEEEIRTTNPVATEQYGCVCSWGEHNQEHFNSEQG

SEQ ID NO: 148953 - protein, 29 aa, Artificial Sequence
  Description of Artificial Sequence: Synthetic peptide
QCEEIATTNPVATEQYGEAPEVCQHEEKH

SEQ ID NO: 148954 - protein, 35 aa, Artificial Sequence
  Description of Artificial Sequence: Synthetic polypeptide
DEEEIRTTNPVATEQYGCVCSWGEHNQEFFGSEQA

SEQ ID NO: 148955 - protein, 36 aa, Artificial Sequence
  Description of Artificial Sequence: Synthetic polypeptide
DEEEIRTTNPVATEQYGSVNSEPNNDDENSGQEEIP

SEQ ID NO: 148956 - protein, 35 aa, Artificial Sequence
  Description of Artificial Sequence: Synthetic polypeptide
DEEEIRTTNPVATEQYGCVCSWGEHNIEGFNSEQA

SEQ ID NO: 148957 - protein, 36 aa, Artificial Sequence
  Description of Artificial Sequence: Synthetic polypeptide
DEEEIRTTNPVATEQYGCVCSWGEHNEENFGSDNDA

SEQ ID NO: 148958 - protein, 36 aa, Artificial Sequence
  Description of Artificial Sequence: Synthetic polypeptide
DEEEIRTTNPVATEQYGCVCSWGEHNAENFGSENQS

SEQ ID NO: 148959 - protein, 34 aa, Artificial Sequence
  Description of Artificial Sequence: Synthetic polypeptide
SEEEISTTNPVAYEQWGQVSSCSNMQSGDGGNRN

SEQ ID NO: 148960 - protein, 28 aa, Artificial Sequence
  Description of Artificial Sequence: Synthetic peptide
QCSEIASTNPVGTEGYGVMASTLQHGDI

SEQ ID NO: 148961 - protein, 31 aa, Artificial Sequence
  Description of Artificial Sequence: Synthetic polypeptide
AESEVASTNPVATEGYGNVSAETIQSRVGGR

SEQ ID NO: 148962 - protein, 36 aa, Artificial Sequence
  Description of Artificial Sequence: Synthetic polypeptide
DEEEIRTTNPVATEQYGSVCVPYLTEVLTNPEQSRI

SEQ ID NO: 148963 - protein, 35 aa, Artificial Sequence
  Description of Artificial Sequence: Synthetic polypeptide
SEEEIVRTTNPVAYEQWGQVSSCTNMQSADGGNGA

SEQ ID NO: 148964 - protein, 28 aa, Artificial Sequence
  Description of Artificial Sequence: Synthetic peptide
QDEEIASTNPVSTEQYGEVAEVCQHEQK

SEQ ID NO: 148965 - protein, 34 aa, Artificial Sequence
  Description of Artificial Sequence: Synthetic polypeptide
DEEEIRTTNPVATEQYGCVCSWGEHAEHFGSEQA

SEQ ID NO: 148966 - protein, 34 aa, Artificial Sequence
  Description of Artificial Sequence: Synthetic polypeptide
DEEEIRTTNPVATEQYGCVCSWGEHAEFFNSQQS

SEQ ID NO: 148967 - protein, 35 aa, Artificial Sequence
  Description of Artificial Sequence: Synthetic polypeptide
DEEEIRTTNPVATEQYGCVCSWGEDTQNFNSDTQS

SEQ ID NO: 148968 - protein, 32 aa, Artificial Sequence
  Description of Artificial Sequence: Synthetic polypeptide
DESVIATTNPVATEMWGSVAATANLQHDDQDA

SEQ ID NO: 148969 - protein, 36 aa, Artificial Sequence
  Description of Artificial Sequence: Synthetic polypeptide
DEEEIRTTNPVATEQYGCVCSWGEHETENFGSDNQS

SEQ ID NO: 148970 - protein, 28 aa, Artificial Sequence
  Description of Artificial Sequence: Synthetic peptide
QCEEIATTNPVATEQYGEAPEVCAHEEK

SEQ ID NO: 148971 - protein, 29 aa, Artificial Sequence
  Description of Artificial Sequence: Synthetic peptide
QCEEIATTNPVATEQYGEAAPEVCQHEEK

SEQ ID NO: 148972 - protein, 35 aa, Artificial Sequence
  Description of Artificial Sequence: Synthetic polypeptide
DEEEIRTTNPVATEQYGCVCSWGEHNQENFGSDQS

SEQ ID NO: 148973 - protein, 36 aa, Artificial Sequence
  Description of Artificial Sequence: Synthetic polypeptide
DEEEIRTTNPVATEQYGSVNSFNPDDEWGSGQEEIP

SEQ ID NO: 148974 - protein, 33 aa, Artificial Sequence
  Description of Artificial Sequence: Synthetic polypeptide
QAHEIATTNPVATEQYGCVAATNLTATPGGDRL

SEQ ID NO: 148975 - protein, 32 aa, Artificial Sequence
  Description of Artificial Sequence: Synthetic polypeptide
QAHEIATTNPVAYEQYGSVAITNQDNGNPEGD

SEQ ID NO: 148976 - protein, 35 aa, Artificial Sequence
  Description of Artificial Sequence: Synthetic polypeptide
DEEEIRTTNPVATEQYGCVCSWGEHNQFFNSDNQG

SEQ ID NO: 148977 - protein, 34 aa, Artificial Sequence
  Description of Artificial Sequence: Synthetic polypeptide
SEEEISTTNPVATEQYGCVCGTAHNQNFGSDNQA

SEQ ID NO: 148978 - protein, 31 aa, Artificial Sequence
  Description of Artificial Sequence: Synthetic polypeptide
AESEVACTNPVATEGYGNVSAETIQSRVGGR

SEQ ID NO: 148979 - protein, 34 aa, Artificial Sequence
  Description of Artificial Sequence: Synthetic polypeptide
SEEEISTTNPVATEQYGCVCSNWGELQNFGSEQA

SEQ ID NO: 148980 - protein, 33 aa, Artificial Sequence
  Description of Artificial Sequence: Synthetic polypeptide
SEEEISTTNPVATEQYGCVCSTGEHTNFNSNQN

SEQ ID NO: 148981 - protein, 35 aa, Artificial Sequence
  Description of Artificial Sequence: Synthetic polypeptide
SEEEISTTNPVATEQYGCVCSWGNHDQNFGSNTQS

SEQ ID NO: 148982 - protein, 32 aa, Artificial Sequence
  Description of Artificial Sequence: Synthetic polypeptide
QAHEIATTNPVAYEQYGSVSAGNLDADPNENN

SEQ ID NO: 148983 - protein, 34 aa, Artificial Sequence
  Description of Artificial Sequence: Synthetic polypeptide
DESVIATTNPVAYEQWGCYVGEDTNMDQRDGQNR

SEQ ID NO: 148984 - protein, 36 aa, Artificial Sequence
  Description of Artificial Sequence: Synthetic polypeptide
DEEEIATTNPVATEQYGSVCAMTNHGEQTLDGAQDI

SEQ ID NO: 148985 - protein, 36 aa, Artificial Sequence
  Description of Artificial Sequence: Synthetic polypeptide
DEEEIATTNPVATEQYGSVCAMTNGVLPEDHENGDD

SEQ ID NO: 148986 - protein, 31 aa, Artificial Sequence
  Description of Artificial Sequence: Synthetic polypeptide
DESVIATTNPVAYEQWGCVNGWDDQRMGNVH

SEQ ID NO: 148987 - protein, 35 aa, Artificial Sequence
  Description of Artificial Sequence: Synthetic polypeptide
DEEEIRTTNPVATEQYGCVCSWGEHNQENFGSEQS

SEQ ID NO: 148988 - protein, 35 aa, Artificial Sequence
  Description of Artificial Sequence: Synthetic polypeptide
DEEEIRTTNPVATEQYGCVCSWGEHNQENFGSEQA

SEQ ID NO: 148989 - protein, 28 aa, Artificial Sequence
  Description of Artificial Sequence: Synthetic peptide
QASEIASTNPVGTEGYGVMASTLQHGDI

SEQ ID NO: 148990 - protein, 33 aa, Artificial Sequence
  Description of Artificial Sequence: Synthetic polypeptide
DESVIATTNPVAYEQWGCVETWNDQDDRGGNHP

SEQ ID NO: 148991 - protein, 36 aa, Artificial Sequence
  Description of Artificial Sequence: Synthetic polypeptide
DEEEIRTTNPVATEQYGCVCSWGEHNQENFGSENQS

SEQ ID NO: 148992 - protein, 35 aa, Artificial Sequence
  Description of Artificial Sequence: Synthetic polypeptide
DEDEIRTTNPVATEGWGSVSVAINEGQDGEGENGN

SEQ ID NO: 148993 - protein, 36 aa, Artificial Sequence
  Description of Artificial Sequence: Synthetic polypeptide
DEEEIATTNPVATEQYGSVCAMTNNEPTGGDLENNP

SEQ ID NO: 148994 - protein, 28 aa, Artificial Sequence
  Description of Artificial Sequence: Synthetic peptide
QDEEIATTNPVATEKYGEAPEVCQHEEK

SEQ ID NO: 148995 - protein, 35 aa, Artificial Sequence
  Description of Artificial Sequence: Synthetic polypeptide
DEEEIRTTNPVATEQYGSVCVTGGHVVREDEVPDN

SEQ ID NO: 148996 - protein, 35 aa, Artificial Sequence
  Description of Artificial Sequence: Synthetic polypeptide
SEEEVRTTNPVATEQYGCVCSTGEHDQNIGSDNQN

SEQ ID NO: 148997 - protein, 34 aa, Artificial Sequence
  Description of Artificial Sequence: Synthetic polypeptide
DEEEIATTNPMATEQYGSVPTVPQEEHQQMNGPC

SEQ ID NO: 148998 - protein, 34 aa, Artificial Sequence
  Description of Artificial Sequence: Synthetic polypeptide
SEEEVSTTNPVATEQYGCVCSWEELDQNIGSNQS

SEQ ID NO: 148999 - protein, 35 aa, Artificial Sequence
  Description of Artificial Sequence: Synthetic polypeptide
DESTIRTTNPVATEFYGSVSNVSINGQGGGGDNDD

SEQ ID NO: 149000 - protein, 34 aa, Artificial Sequence
  Description of Artificial Sequence: Synthetic polypeptide
DESTIRTTNPVATECWGSVSCINEPQDRSGEGGN

SEQ ID NO: 149001 - protein, 33 aa, Artificial Sequence
  Description of Artificial Sequence: Synthetic polypeptide
DESTICTTNPVATEQYGSVDQINGQGEGGQGEG

SEQ ID NO: 149002 - protein, 36 aa, Artificial Sequence
  Description of Artificial Sequence: Synthetic polypeptide
AEEEIRTTNPVATEQYGSVVVSVTNNNNQEQEETED

SEQ ID NO: 149003 - protein, 35 aa, Artificial Sequence
  Description of Artificial Sequence: Synthetic polypeptide
DEEEIRTTNPVATEQYGSVSSWEEGQQESVFPDFD

SEQ ID NO: 149004 - protein, 35 aa, Artificial Sequence
  Description of Artificial Sequence: Synthetic polypeptide
DEEEIRTTNPVATEQYGCVCSWGEDHNQFFNSDQG

SEQ ID NO: 149005 - protein, 34 aa, Artificial Sequence
  Description of Artificial Sequence: Synthetic polypeptide
DEDEIRTTNPVATEGFGMVSAINEGQDGEGENGD

SEQ ID NO: 149006 - protein, 33 aa, Artificial Sequence
  Description of Artificial Sequence: Synthetic polypeptide
DESTEIATTNPVAYEQWGSVSGGNGNTSGEGNA

SEQ ID NO: 149007 - protein, 37 aa, Artificial Sequence
  Description of Artificial Sequence: Synthetic polypeptide
DEEEIATTNPVATEQYGSVCAMTNGELPQDSADENGM

SEQ ID NO: 149008 - protein, 37 aa, Artificial Sequence
  Description of Artificial Sequence: Synthetic polypeptide
DEEEIATTNPVATEQYGSVCAMTNGELEQDSPAENGM

SEQ ID NO: 149009 - protein, 31 aa, Artificial Sequence
  Description of Artificial Sequence: Synthetic polypeptide
AETEIACTNPVATEQWGEASNAEDWQERGPR

SEQ ID NO: 149010 - protein, 35 aa, Artificial Sequence
  Description of Artificial Sequence: Synthetic polypeptide
DEEEIRTTNPLAYEPYGSVPSCCVNIFTRTGTNND

SEQ ID NO: 149011 - protein, 35 aa, Artificial Sequence
  Description of Artificial Sequence: Synthetic polypeptide
DEEEIRTTNPLAYEPYGSVPSYCVNEIFRTGGNND

SEQ ID NO: 149012 - protein, 32 aa, Artificial Sequence
  Description of Artificial Sequence: Synthetic polypeptide
DESSIRTTNPASTEQFGSVSFSDLTQEGQQDK

SEQ ID NO: 149013 - protein, 31 aa, Artificial Sequence
  Description of Artificial Sequence: Synthetic polypeptide
QDNEIATTNPVATECYGNVSAECLQSRVEEL

SEQ ID NO: 149014 - protein, 28 aa, Artificial Sequence
  Description of Artificial Sequence: Synthetic peptide
SEELIATTNPVASEQYGEAPEVCQHIEK

SEQ ID NO: 149015 - protein, 35 aa, Artificial Sequence
  Description of Artificial Sequence: Synthetic polypeptide
DEEEIRTTNPVATEQYGCVCSWGEDHNQGFGSEQS

SEQ ID NO: 149016 - protein, 35 aa, Artificial Sequence
  Description of Artificial Sequence: Synthetic polypeptide
DEEEIRTTNPVATEQYGCVCSWGEDHNQGFNSEQM

SEQ ID NO: 149017 - protein, 35 aa, Artificial Sequence
  Description of Artificial Sequence: Synthetic polypeptide
SEEEVRTTNPVATEQYGCVCSTEEDDQENIGSNQS

SEQ ID NO: 149018 - protein, 36 aa, Artificial Sequence
  Description of Artificial Sequence: Synthetic polypeptide
DEEEIRTTNPVATEQYGCVCSWGEDPQENFGSENQS

SEQ ID NO: 149019 - protein, 34 aa, Artificial Sequence
  Description of Artificial Sequence: Synthetic polypeptide
SEEELRTTNPVATEQYGCVCSWGNHDQNIGSDQS

SEQ ID NO: 149020 - protein, 35 aa, Artificial Sequence
  Description of Artificial Sequence: Synthetic polypeptide
DEEEIRTTNPVATEQYGCVCSWGEDHQYFNSEFQF

SEQ ID NO: 149021 - protein, 35 aa, Artificial Sequence
  Description of Artificial Sequence: Synthetic polypeptide
DEEEIRTTNPVATEQYGCVCSWGEDHQNFGSQTQL

SEQ ID NO: 149022 - protein, 37 aa, Artificial Sequence
  Description of Artificial Sequence: Synthetic polypeptide
DEEEIRTTNPVATEQYGSVCVTIMQLDELAQQPQDRN

SEQ ID NO: 149023 - protein, 34 aa, Artificial Sequence
  Description of Artificial Sequence: Synthetic polypeptide
DEEEIRTTNPVATEQYGCVCSWGEDHQGFQSEQS

SEQ ID NO: 149024 - protein, 34 aa, Artificial Sequence
  Description of Artificial Sequence: Synthetic polypeptide
DESTIRTTNPVATEQYGQYSVVIGNGQGGGDEDA

SEQ ID NO: 149025 - protein, 35 aa, Artificial Sequence
  Description of Artificial Sequence: Synthetic polypeptide
DEEEIRTTNPVATEQYGCVCSWGEDHQFFGSDTQE

SEQ ID NO: 149026 - protein, 35 aa, Artificial Sequence
  Description of Artificial Sequence: Synthetic polypeptide
DEEEIRTTNPVATEQYGCVCSWGEDHQENFGSDDG

SEQ ID NO: 149027 - protein, 33 aa, Artificial Sequence
  Description of Artificial Sequence: Synthetic polypeptide
DEDEIRTTNPVATEGWGEVSAINEGGDGEGENG

SEQ ID NO: 149028 - protein, 35 aa, Artificial Sequence
  Description of Artificial Sequence: Synthetic polypeptide
DEEEIRTTNPVATEQYGCVCSWGEDHQEHFNSQQL

SEQ ID NO: 149029 - protein, 35 aa, Artificial Sequence
  Description of Artificial Sequence: Synthetic polypeptide
DEEEIRTTNPVATEQYGCVCSWGEDHNQYFNSEQS

SEQ ID NO: 149030 - protein, 35 aa, Artificial Sequence
  Description of Artificial Sequence: Synthetic polypeptide
DEEEIRTTNPVATEQYGCVCSWGEDHNQNFGSEQS

SEQ ID NO: 149031 - protein, 35 aa, Artificial Sequence
  Description of Artificial Sequence: Synthetic polypeptide
DEEEIRTTNPVATEQYGCVCSWGEDHNQNFGSDQS

SEQ ID NO: 149032 - protein, 35 aa, Artificial Sequence
  Description of Artificial Sequence: Synthetic polypeptide
SEEEVRTTNPVATEQYGCVCSNTEELDQNIGSDQA

SEQ ID NO: 149033 - protein, 34 aa, Artificial Sequence
  Description of Artificial Sequence: Synthetic polypeptide
DESTIRTTNPVATEQYGDIVSIMNNDQGGGDEDQ

SEQ ID NO: 149034 - protein, 35 aa, Artificial Sequence
  Description of Artificial Sequence: Synthetic polypeptide
DESTIRTTNPVATEQYGDIVSDMNNDQGGGDNDQG

SEQ ID NO: 149035 - protein, 35 aa, Artificial Sequence
  Description of Artificial Sequence: Synthetic polypeptide
DEEEIATTNPMATEQYGSVPPTVTQDDHWQGQNVD

SEQ ID NO: 149036 - protein, 34 aa, Artificial Sequence
  Description of Artificial Sequence: Synthetic polypeptide
DESTIRTTNPVATEQYGDIVGQMDNDQGGGDNDQ

SEQ ID NO: 149037 - protein, 35 aa, Artificial Sequence
  Description of Artificial Sequence: Synthetic polypeptide
DEDEIRTTNPVATEGWGSVSAINGGGQDGEGENEG

SEQ ID NO: 149038 - protein, 35 aa, Artificial Sequence
  Description of Artificial Sequence: Synthetic polypeptide
DEEEIRTTNPVATEQYGCVCSWGEHNQHFNSETQA

SEQ ID NO: 149039 - protein, 36 aa, Artificial Sequence
  Description of Artificial Sequence: Synthetic polypeptide
DEEEIATTNPVATEQYGSVCAMTNNEPTGIDLENGN

SEQ ID NO: 149040 - protein, 36 aa, Artificial Sequence
  Description of Artificial Sequence: Synthetic polypeptide
DEEEIATTNPVATEQYGSVCAMTNNEPTPGDLENGM

SEQ ID NO: 149041 - protein, 34 aa, Artificial Sequence
  Description of Artificial Sequence: Synthetic polypeptide
SEEEIRTTNPVAYEPYGKTVHCTNISHENSGNRC

SEQ ID NO: 149042 - protein, 34 aa, Artificial Sequence
  Description of Artificial Sequence: Synthetic polypeptide
SEEEIRTTNPVAYEPYGSTVFCTNISHENSGNTA

SEQ ID NO: 149043 - protein, 34 aa, Artificial Sequence
  Description of Artificial Sequence: Synthetic polypeptide
SEEEIRTTNPVAYEPYGSTVHCINISHNSGNERA

SEQ ID NO: 149044 - protein, 32 aa, Artificial Sequence
  Description of Artificial Sequence: Synthetic polypeptide
DETAEIATTNPVAYEQYGSVASSDQAEAPNTD

SEQ ID NO: 149045 - protein, 34 aa, Artificial Sequence
  Description of Artificial Sequence: Synthetic polypeptide
SEEEIRTTNPVAYEPYGSTVHCTNISHNSGGVRA

SEQ ID NO: 149046 - protein, 36 aa, Artificial Sequence
  Description of Artificial Sequence: Synthetic polypeptide
SEEEIRTTNPVAYEQWGCVVSSCTQNMQSADYGNRT

SEQ ID NO: 149047 - protein, 33 aa, Artificial Sequence
  Description of Artificial Sequence: Synthetic polypeptide
SEEEIRTTNPVAYEQWGHTYWIDIDIQRGMGNR

SEQ ID NO: 149048 - protein, 33 aa, Artificial Sequence
  Description of Artificial Sequence: Synthetic polypeptide
SEEEIRTTNPVAYEQWGHTYWIDIDVQRGNGHR

SEQ ID NO: 149049 - protein, 35 aa, Artificial Sequence
  Description of Artificial Sequence: Synthetic polypeptide
SEEEIRTTNPVAYEHWGQVSSCTNMQSASPGNYRA

SEQ ID NO: 149050 - protein, 32 aa, Artificial Sequence
  Description of Artificial Sequence: Synthetic polypeptide
SEEEIRTTNPVAYEQWGHVYWIDGDQRGMGHM

SEQ ID NO: 149051 - protein, 36 aa, Artificial Sequence
  Description of Artificial Sequence: Synthetic polypeptide
SEEEIRTTNPVAYEQWGQVPSCTFNMQSADPGNYRA

SEQ ID NO: 149052 - protein, 35 aa, Artificial Sequence
  Description of Artificial Sequence: Synthetic polypeptide
DETAEIATTNPVAYEQWGSVAKTNDLQEQRGGQQK

SEQ ID NO: 149053 - protein, 35 aa, Artificial Sequence
  Description of Artificial Sequence: Synthetic polypeptide
SEEEIRTTNPVAYEQWGQVSSCNNMQSADPGNYRS

SEQ ID NO: 149054 - protein, 35 aa, Artificial Sequence
  Description of Artificial Sequence: Synthetic polypeptide
SEEEIRTTNPVAYEQWGQVSSCTNMQSADGGNQTA

SEQ ID NO: 149055 - protein, 35 aa, Artificial Sequence
  Description of Artificial Sequence: Synthetic polypeptide
SEEEIRTTNPVAYEQWGQVSSCTNMQSADGGQNGN

SEQ ID NO: 149056 - protein, 33 aa, Artificial Sequence
  Description of Artificial Sequence: Synthetic polypeptide
QAEEIATTNPVAYEQYGSVATAGTQTRNGDEAL

SEQ ID NO: 149057 - protein, 35 aa, Artificial Sequence
  Description of Artificial Sequence: Synthetic polypeptide
SEEEIRTTNPVAYEQWGQVSSCTNMQSGDGGNEIN

SEQ ID NO: 149058 - protein, 36 aa, Artificial Sequence
  Description of Artificial Sequence: Synthetic polypeptide
SEEEIRTTNPVAYEQWGQVSSCTNMQSGDGTGLNRN

SEQ ID NO: 149059 - protein, 33 aa, Artificial Sequence
  Description of Artificial Sequence: Synthetic polypeptide
SEEEIRTTNPVAYEQWGHVYWIDIDDQRGMGVR

SEQ ID NO: 149060 - protein, 35 aa, Artificial Sequence
  Description of Artificial Sequence: Synthetic polypeptide
SEEEIRTTNPVAYEGWGQVVCSCTNMQSADYGNRA

SEQ ID NO: 149061 - protein, 36 aa, Artificial Sequence
  Description of Artificial Sequence: Synthetic polypeptide
DEEEIRTTNPVATEQYGCVCSWGETNQENFNSENQT

SEQ ID NO: 149062 - protein, 35 aa, Artificial Sequence
  Description of Artificial Sequence: Synthetic polypeptide
SEEEIRTTNPVAYEAWGQVSSCTNMQSADHGNTRA

SEQ ID NO: 149063 - protein, 34 aa, Artificial Sequence
  Description of Artificial Sequence: Synthetic polypeptide
DEDEIRTTNPVATEHWGCVSGGNADDTRGGNGNS

SEQ ID NO: 149064 - protein, 39 aa, Artificial Sequence
  Description of Artificial Sequence: Synthetic polypeptide
AEEEIRTTNPVATEQYGSVSTNTANLQNGNNEQGNNVVE

SEQ ID NO: 149065 - protein, 34 aa, Artificial Sequence
  Description of Artificial Sequence: Synthetic polypeptide
DEEEIRTTNPIAYEQWGSLVPCTGLSARGGSMPE

SEQ ID NO: 149066 - protein, 33 aa, Artificial Sequence
  Description of Artificial Sequence: Synthetic polypeptide
DEEEIATTNPEATDQYGQVCCCDQDQKREGNSA

SEQ ID NO: 149067 - protein, 33 aa, Artificial Sequence
  Description of Artificial Sequence: Synthetic polypeptide
DETAIRTTNPLATEQFGSVISCEKSLEGPNGRI

SEQ ID NO: 149068 - protein, 34 aa, Artificial Sequence
  Description of Artificial Sequence: Synthetic polypeptide
DEEEIRTTNPVATEQYGCVCSWMEHAEYFNSQQS

SEQ ID NO: 149069 - protein, 35 aa, Artificial Sequence
  Description of Artificial Sequence: Synthetic polypeptide
DEEEIRTTNPVATEQYGCVCSWGPHNQNFNSDNQS

SEQ ID NO: 149070 - protein, 35 aa, Artificial Sequence
  Description of Artificial Sequence: Synthetic polypeptide
DEEEIATTNPVATEQYGSVCAPTNPEAPGAQIWDN

SEQ ID NO: 149071 - protein, 37 aa, Artificial Sequence
  Description of Artificial Sequence: Synthetic polypeptide
AEEEIRTTNPVATEQYGSVSTNPNNENSTETGTNDTE

SEQ ID NO: 149072 - protein, 35 aa, Artificial Sequence
  Description of Artificial Sequence: Synthetic polypeptide
QAEEIATTNPVATEQYGSVCADTNPLQGMGPDQFA

SEQ ID NO: 149073 - protein, 35 aa, Artificial Sequence
  Description of Artificial Sequence: Synthetic polypeptide
QAEEIATTNPVATEQYGSVCSTGPGPLDSMGNDEE

SEQ ID NO: 149074 - protein, 36 aa, Artificial Sequence
  Description of Artificial Sequence: Synthetic polypeptide
QAEEIATTNPVATEQYGSVCSTNHGPLDSGENNDHD

SEQ ID NO: 149075 - protein, 35 aa, Artificial Sequence
  Description of Artificial Sequence: Synthetic polypeptide
DEEEIRTTNPVATEQYGCVCSWGNHAENFNSDNQS

SEQ ID NO: 149076 - protein, 36 aa, Artificial Sequence
  Description of Artificial Sequence: Synthetic polypeptide
QAEEIATTNPVATEQYGSVCSTNPGPLDSMIGNDEH

SEQ ID NO: 149077 - protein, 35 aa, Artificial Sequence
  Description of Artificial Sequence: Synthetic polypeptide
AESEIRTTNPVATECWGASVSVCINEPQDREGENG

SEQ ID NO: 149078 - protein, 37 aa, Artificial Sequence
  Description of Artificial Sequence: Synthetic polypeptide
DEEEIRTTNPVATEQYGSVSSTTPTGPDMRNGMPPVI

SEQ ID NO: 149079 - protein, 35 aa, Artificial Sequence
  Description of Artificial Sequence: Synthetic polypeptide
DETAEIATTNPVAYEQYGSVCATNNQDAVGGNQDA

SEQ ID NO: 149080 - protein, 36 aa, Artificial Sequence
  Description of Artificial Sequence: Synthetic polypeptide
DETAEIATTNPVAYEQYGSVCAGTNNQDAVRGNQVD

SEQ ID NO: 149081 - protein, 32 aa, Artificial Sequence
  Description of Artificial Sequence: Synthetic polypeptide
QAEEIATTNPVAYEPYGSVATPPQANPTNGRD

SEQ ID NO: 149082 - protein, 35 aa, Artificial Sequence
  Description of Artificial Sequence: Synthetic polypeptide
SEEEIRTTNPVAYEQWGQVSSCTTNMQSGDGGERN

SEQ ID NO: 149083 - protein, 34 aa, Artificial Sequence
  Description of Artificial Sequence: Synthetic polypeptide
DETAEIATTNPVAYEQWGCVYSGNQHQDIGGNER

SEQ ID NO: 149084 - protein, 35 aa, Artificial Sequence
  Description of Artificial Sequence: Synthetic polypeptide
SEEEIRTTNPVAYEQWGQVVASCANMQSMQIGNRT

SEQ ID NO: 149085 - protein, 36 aa, Artificial Sequence
  Description of Artificial Sequence: Synthetic polypeptide
SEEEIRTTNPVAYEQWGQVVISCTNMQSSVYGGNRA

SEQ ID NO: 149086 - protein, 34 aa, Artificial Sequence
  Description of Artificial Sequence: Synthetic polypeptide
QAEEIATTNPVAYEQYGSVVAANNLQDGGPNDEM

SEQ ID NO: 149087 - protein, 35 aa, Artificial Sequence
  Description of Artificial Sequence: Synthetic polypeptide
DEEEIRTTNPVATEQYGCVCSWGEHQESFNSDTQF

SEQ ID NO: 149088 - protein, 34 aa, Artificial Sequence
  Description of Artificial Sequence: Synthetic polypeptide
DEEEIRTTNPVATEQYGCVCSWGEHQENFFSEAG

SEQ ID NO: 149089 - protein, 35 aa, Artificial Sequence
  Description of Artificial Sequence: Synthetic polypeptide
DEEEIRTTNPVATEQYGCVCSWGEHQEHFNSDNQT

SEQ ID NO: 149090 - protein, 32 aa, Artificial Sequence
  Description of Artificial Sequence: Synthetic polypeptide
DESVIRTTNPVAYEQWGVCYVGEQNDNDGQNR

SEQ ID NO: 149091 - protein, 33 aa, Artificial Sequence
  Description of Artificial Sequence: Synthetic polypeptide
DESVIRTTNPVAYEQWGCYYGEGNMDQRDGSNR

SEQ ID NO: 149092 - protein, 35 aa, Artificial Sequence
  Description of Artificial Sequence: Synthetic polypeptide
DEEEIRTTNPVATEQYGCVCSWGEHQEHFISDNQS

SEQ ID NO: 149093 - protein, 34 aa, Artificial Sequence
  Description of Artificial Sequence: Synthetic polypeptide
SEEEIRTTNPVAYWSYSTSVTSNTNLEQSGDQSQ

SEQ ID NO: 149094 - protein, 35 aa, Artificial Sequence
  Description of Artificial Sequence: Synthetic polypeptide
DEEEIRTTNPVATEQYGCVCSWGEHNTENFNSDQA

SEQ ID NO: 149095 - protein, 35 aa, Artificial Sequence
  Description of Artificial Sequence: Synthetic polypeptide
DEEEIRTTNPVATEQYGCVCSWGEHNQSFNSETQY

SEQ ID NO: 149096 - protein, 35 aa, Artificial Sequence
  Description of Artificial Sequence: Synthetic polypeptide
DEEEIRTTNPVATEQYGCVCSWGEHNQSFNSDNQS

SEQ ID NO: 149097 - protein, 35 aa, Artificial Sequence
  Description of Artificial Sequence: Synthetic polypeptide
DEEEIRTTNPVATEQYGCVCSWGEHNQNFNSENQA

SEQ ID NO: 149098 - protein, 35 aa, Artificial Sequence
  Description of Artificial Sequence: Synthetic polypeptide
DEEEIRTTNPVATEQYGCVCSWGEHNQNFNSDTQG

SEQ ID NO: 149099 - protein, 32 aa, Artificial Sequence
  Description of Artificial Sequence: Synthetic polypeptide
QAEEIATTNPVGTEQWGGCCATNLQMVPMGER

SEQ ID NO: 149100 - protein, 32 aa, Artificial Sequence
  Description of Artificial Sequence: Synthetic polypeptide
QAEEIATTNPVGTEQWGGCCTAITNLQMPGQR

SEQ ID NO: 149101 - protein, 36 aa, Artificial Sequence
  Description of Artificial Sequence: Synthetic polypeptide
DEEEIATTNPVATEQYGSVCAMTNPEPTGGDLANGM

SEQ ID NO: 149102 - protein, 33 aa, Artificial Sequence
  Description of Artificial Sequence: Synthetic polypeptide
AESEIRTTNPVAYECWGSVWYINEQQDRLGENG

SEQ ID NO: 149103 - protein, 35 aa, Artificial Sequence
  Description of Artificial Sequence: Synthetic polypeptide
DEEEIRTTNPVATEQYGCVCSWGEHNQNFNSDNQA

SEQ ID NO: 149104 - protein, 34 aa, Artificial Sequence
  Description of Artificial Sequence: Synthetic polypeptide
DEEEIRTTNPVATEQYGCVCSWGEHNQNFISDQT

SEQ ID NO: 149105 - protein, 33 aa, Artificial Sequence
  Description of Artificial Sequence: Synthetic polypeptide
DESVIYTTNPVATECWGSLSCINEPQEREGKNG

SEQ ID NO: 149106 - protein, 39 aa, Artificial Sequence
  Description of Artificial Sequence: Synthetic polypeptide
AEEEIRTTNPVATEQYGSVSTNTANLQNGNVEQGTNNVE

SEQ ID NO: 149107 - protein, 35 aa, Artificial Sequence
  Description of Artificial Sequence: Synthetic polypeptide
QAEEIATTNPVAYEQYGSVCAANNLQDQGGGMNRN

SEQ ID NO: 149108 - protein, 29 aa, Artificial Sequence
  Description of Artificial Sequence: Synthetic peptide
DEEEIATTNPIATEQYGEAPEVWAHKEEK

SEQ ID NO: 149109 - protein, 33 aa, Artificial Sequence
  Description of Artificial Sequence: Synthetic polypeptide
QAEEIATTNPVAYEQYGSVATGHGQDSNGNFVN

SEQ ID NO: 149110 - protein, 35 aa, Artificial Sequence
  Description of Artificial Sequence: Synthetic polypeptide
SEEEIRTTNPVAYEQWGQVVSSCMNMQSADPGNRP

SEQ ID NO: 149111 - protein, 35 aa, Artificial Sequence
  Description of Artificial Sequence: Synthetic polypeptide
SEEEIRTTNPVAYEQWGQVVSSCTFMQSADTGNRA

SEQ ID NO: 149112 - protein, 35 aa, Artificial Sequence
  Description of Artificial Sequence: Synthetic polypeptide
SEEEIRTTNPVAYEQWGQVVSSCTNMQSADPGLRY

SEQ ID NO: 149113 - protein, 36 aa, Artificial Sequence
  Description of Artificial Sequence: Synthetic polypeptide
SEEEIRTTNPVAYEQWGQVVSSCTNMQSADYGMNRS

SEQ ID NO: 149114 - protein, 36 aa, Artificial Sequence
  Description of Artificial Sequence: Synthetic polypeptide
SEEEIRTTNPVAYEQWGQVVSSCTNMQSADYTGNRA

SEQ ID NO: 149115 - protein, 35 aa, Artificial Sequence
  Description of Artificial Sequence: Synthetic polypeptide
SEEEIRTTNPVAYEQWGQVVSSCTNMQSADYVNRE

SEQ ID NO: 149116 - protein, 36 aa, Artificial Sequence
  Description of Artificial Sequence: Synthetic polypeptide
SEEEIRTTNPVAYEQWGQVVSSCTNMQSPDYGENRA

SEQ ID NO: 149117 - protein, 36 aa, Artificial Sequence
  Description of Artificial Sequence: Synthetic polypeptide
SEEEIRTTNPVAYEQWGQVVSSCTVNMQSAQPGNRA

SEQ ID NO: 149118 - protein, 35 aa, Artificial Sequence
  Description of Artificial Sequence: Synthetic polypeptide
SEEEIRTTNPVAYEQWGQVVYSCTNMQSADYGNIT

SEQ ID NO: 149119 - protein, 35 aa, Artificial Sequence
  Description of Artificial Sequence: Synthetic polypeptide
DEEEIRTTNPVATEQYGCVCSWGEPQENFNSEPQS

SEQ ID NO: 149120 - protein, 33 aa, Artificial Sequence
  Description of Artificial Sequence: Synthetic polypeptide
QAEEIATTNPVAYEQYGSVATNDGQTPQGGTEE

SEQ ID NO: 149121 - protein, 33 aa, Artificial Sequence
  Description of Artificial Sequence: Synthetic polypeptide
QAEEIATTNPVAYEQYGSVATNLADTPGDEAAM

SEQ ID NO: 149122 - protein, 33 aa, Artificial Sequence
  Description of Artificial Sequence: Synthetic polypeptide
SEEEIRTTNPVAYEQWGSVCSNWEHQEQDMQRR

SEQ ID NO: 149123 - protein, 34 aa, Artificial Sequence
  Description of Artificial Sequence: Synthetic polypeptide
DEEEIRTTNPVATEQYGCVCSWGEPQENFISEQS

SEQ ID NO: 149124 - protein, 35 aa, Artificial Sequence
  Description of Artificial Sequence: Synthetic polypeptide
DEEEIATTNPVATEQYGSVCAPIENLIHADEMNNW

SEQ ID NO: 149125 - protein, 36 aa, Artificial Sequence
  Description of Artificial Sequence: Synthetic polypeptide
SEEEIRTTNPVAYEQYGCVVPSYTNLQEGTGTIPVY

SEQ ID NO: 149126 - protein, 35 aa, Artificial Sequence
  Description of Artificial Sequence: Synthetic polypeptide
SEEEIRTTNPVAYEQYGKTVSCTNMFTRTLDNELF

SEQ ID NO: 149127 - protein, 35 aa, Artificial Sequence
  Description of Artificial Sequence: Synthetic polypeptide
DEEEIRTTNPVATEQYGCVCSWGELNENFNSENQG

SEQ ID NO: 149128 - protein, 35 aa, Artificial Sequence
  Description of Artificial Sequence: Synthetic polypeptide
DEEEIRTTNPVATEQYGCVCSWGEHTENFGSDTQL

SEQ ID NO: 149129 - protein, 34 aa, Artificial Sequence
  Description of Artificial Sequence: Synthetic polypeptide
DEEEIACTNPVATEQYGSCAAPNLQEAENQNEEN

SEQ ID NO: 149130 - protein, 35 aa, Artificial Sequence
  Description of Artificial Sequence: Synthetic polypeptide
DETEIATTNPVATEQWGTVSATANALDTAHQNNQR

SEQ ID NO: 149131 - protein, 35 aa, Artificial Sequence
  Description of Artificial Sequence: Synthetic polypeptide
DEEEIASTNPVGTEQYGSVSSTTPTGPQMRNGMDV

SEQ ID NO: 149132 - protein, 33 aa, Artificial Sequence
  Description of Artificial Sequence: Synthetic polypeptide
DETEIATTNPVAYEQWGTVCSTELQGDLQNGQQ

SEQ ID NO: 149133 - protein, 33 aa, Artificial Sequence
  Description of Artificial Sequence: Synthetic polypeptide
DETEIATTNPVAYEQWGTSCSATADLGQHDIAR

SEQ ID NO: 149134 - protein, 37 aa, Artificial Sequence
  Description of Artificial Sequence: Synthetic polypeptide
DEEEIRTTNPVATEQYGCVTSTTMADNAEHFGSNPVM

SEQ ID NO: 149135 - protein, 35 aa, Artificial Sequence
  Description of Artificial Sequence: Synthetic polypeptide
DETEIATTNPVAYEQWGSVYSNDNDMQEGRGGNSP

SEQ ID NO: 149136 - protein, 37 aa, Artificial Sequence
  Description of Artificial Sequence: Synthetic polypeptide
DEEEIRTTNPVATEQYGCVTSTTGAHNAEHFGSNPVA

SEQ ID NO: 149137 - protein, 32 aa, Artificial Sequence
  Description of Artificial Sequence: Synthetic polypeptide
DETEIATTNPVAYEQWGSVTSAANQSDNNPPT

SEQ ID NO: 149138 - protein, 34 aa, Artificial Sequence
  Description of Artificial Sequence: Synthetic polypeptide
DETEIATTNPVAYEQWGSVTGENGNDQGNMGNQR

SEQ ID NO: 149139 - protein, 37 aa, Artificial Sequence
  Description of Artificial Sequence: Synthetic polypeptide
DEEEIRTTNPVATEQYGCVTSTTGADNNEYFGSNPVA

SEQ ID NO: 149140 - protein, 36 aa, Artificial Sequence
  Description of Artificial Sequence: Synthetic polypeptide
DEEEIRTTNPVATEQYGCVTSTTMADNAEYFGSDPV

SEQ ID NO: 149141 - protein, 35 aa, Artificial Sequence
  Description of Artificial Sequence: Synthetic polypeptide
DEEEIACTNPVATEQYGSVCATNPQENPDDQGGEM

SEQ ID NO: 149142 - protein, 35 aa, Artificial Sequence
  Description of Artificial Sequence: Synthetic polypeptide
FEEEIRTTNPVATEQYGAVVDNSDNGQGEGDDQLT

SEQ ID NO: 149143 - protein, 36 aa, Artificial Sequence
  Description of Artificial Sequence: Synthetic polypeptide
DEEEIRTTNPCATEQYGSVIEPTNQHQQITGVFPAV

SEQ ID NO: 149144 - protein, 34 aa, Artificial Sequence
  Description of Artificial Sequence: Synthetic polypeptide
DEEEIACTNPVATEQYGSVCATPEEAGDSGENAE

SEQ ID NO: 149145 - protein, 36 aa, Artificial Sequence
  Description of Artificial Sequence: Synthetic polypeptide
SEEEIRTTNPVATEQYGSVASYLWEMLERQIENNEE

SEQ ID NO: 149146 - protein, 37 aa, Artificial Sequence
  Description of Artificial Sequence: Synthetic polypeptide
DEEEIRTTNPCATEQYGSVIEPTNSHQQITDGVNPTP

SEQ ID NO: 149147 - protein, 34 aa, Artificial Sequence
  Description of Artificial Sequence: Synthetic polypeptide
DEEEIACTNPVATEQYGSVCAVGDDGNNQMGDQN

SEQ ID NO: 149148 - protein, 34 aa, Artificial Sequence
  Description of Artificial Sequence: Synthetic polypeptide
DETEIATTNPVAYEQWGSVSTTNANQGAMGGDMS

SEQ ID NO: 149149 - protein, 35 aa, Artificial Sequence
  Description of Artificial Sequence: Synthetic polypeptide
DEEEIACTNPVATEQYGSVCSATLALQNHQDAEAN

SEQ ID NO: 149150 - protein, 35 aa, Artificial Sequence
  Description of Artificial Sequence: Synthetic polypeptide
DEEEIACTNPVATEQYGSVCATNPQLNPDDQGEGM

SEQ ID NO: 149151 - protein, 35 aa, Artificial Sequence
  Description of Artificial Sequence: Synthetic polypeptide
SEEEIRTTNPVATEQYGSTVYTPTHMYSEGTNDIF

SEQ ID NO: 149152 - protein, 36 aa, Artificial Sequence
  Description of Artificial Sequence: Synthetic polypeptide
DEEEIRTTNPVATEQYGCVTSTTPADDAEHFGSNPV

SEQ ID NO: 149153 - protein, 33 aa, Artificial Sequence
  Description of Artificial Sequence: Synthetic polypeptide
DETEIATTNPVAYEQWGVVSGGNGLQDHPNGGS

SEQ ID NO: 149154 - protein, 35 aa, Artificial Sequence
  Description of Artificial Sequence: Synthetic polypeptide
DETEIATTNPVAYEQYGSVCASNDLPQEHQDGNEA

SEQ ID NO: 149155 - protein, 34 aa, Artificial Sequence
  Description of Artificial Sequence: Synthetic polypeptide
DETEIATTNPVAYEQYGSVCAADNGDEYGMDINR

SEQ ID NO: 149156 - protein, 35 aa, Artificial Sequence
  Description of Artificial Sequence: Synthetic polypeptide
DETEIATTNPVAYEQYGSVATTGHLQAAPGEIMNN

SEQ ID NO: 149157 - protein, 36 aa, Artificial Sequence
  Description of Artificial Sequence: Synthetic polypeptide
DEEEIRTTNPVATEQYGCVTSTTPADNTEHFGSDPV

SEQ ID NO: 149158 - protein, 34 aa, Artificial Sequence
  Description of Artificial Sequence: Synthetic polypeptide
SEEEIRTTNPVATEQYGSCYTPTHMYSEGTNDEQ

SEQ ID NO: 149159 - protein, 33 aa, Artificial Sequence
  Description of Artificial Sequence: Synthetic polypeptide
SEEEIRTTNPVATEQYGSFPYEHDERPEDNQQM

SEQ ID NO: 149160 - protein, 34 aa, Artificial Sequence
  Description of Artificial Sequence: Synthetic polypeptide
DEEEIATTNPVATEQYGSVCSVDNNHNIDHSEEA

SEQ ID NO: 149161 - protein, 37 aa, Artificial Sequence
  Description of Artificial Sequence: Synthetic polypeptide
AEEEIRTTNPVATEQYGSVSTTNGQQQNNNIGTEEME

SEQ ID NO: 149162 - protein, 32 aa, Artificial Sequence
  Description of Artificial Sequence: Synthetic polypeptide
SEEEIRTTNPVATEQYGSSAPAHIQEHQFDIF

SEQ ID NO: 149163 - protein, 34 aa, Artificial Sequence
  Description of Artificial Sequence: Synthetic polypeptide
DEEEIACTNPVATEQYGSVCATNPEANANQTEGT

SEQ ID NO: 149164 - protein, 35 aa, Artificial Sequence
  Description of Artificial Sequence: Synthetic polypeptide
DETEIATTNPVAYEQYGSVAPANEPGQEHNGNQRE

SEQ ID NO: 149165 - protein, 37 aa, Artificial Sequence
  Description of Artificial Sequence: Synthetic polypeptide
DEEEIRTTNPVATEQYGSVSSTTPAGPNMRNIMNPVG

SEQ ID NO: 149166 - protein, 33 aa, Artificial Sequence
  Description of Artificial Sequence: Synthetic polypeptide
DETEIATTNPVAYEQYGSVAITHDTTAEGGNDQ

SEQ ID NO: 149167 - protein, 37 aa, Artificial Sequence
  Description of Artificial Sequence: Synthetic polypeptide
DEEEIRTTNPVATEQYGCVTSTTPADNDENFGSNPVA

SEQ ID NO: 149168 - protein, 33 aa, Artificial Sequence
  Description of Artificial Sequence: Synthetic polypeptide
DETEIATTNPVAYEQYGSVAIAGNPPQSPGDSE

SEQ ID NO: 149169 - protein, 37 aa, Artificial Sequence
  Description of Artificial Sequence: Synthetic polypeptide
DEEEIRTTNPVATEQYGCVTSTTPADNAERFGSQPVQ

SEQ ID NO: 149170 - protein, 35 aa, Artificial Sequence
  Description of Artificial Sequence: Synthetic polypeptide
DEEEIACTNPVATEQYGSVCATNPEQQANQTEGTP

SEQ ID NO: 149171 - protein, 34 aa, Artificial Sequence
  Description of Artificial Sequence: Synthetic polypeptide
DETEIATTNPVAYEQYGSVAAITNDTTAEGGNDD

SEQ ID NO: 149172 - protein, 33 aa, Artificial Sequence
  Description of Artificial Sequence: Synthetic polypeptide
DETEIATTNPVAYEQYGSVAAAGGQDSGGNDYK

SEQ ID NO: 149173 - protein, 31 aa, Artificial Sequence
  Description of Artificial Sequence: Synthetic polypeptide
AESEIACTNPVAYEPYGEASCENLSQRVGGL

SEQ ID NO: 149174 - protein, 34 aa, Artificial Sequence
  Description of Artificial Sequence: Synthetic polypeptide
DETEIATTNPVAYEQYGSVCATNNEQDATATGDL

SEQ ID NO: 149175 - protein, 36 aa, Artificial Sequence
  Description of Artificial Sequence: Synthetic polypeptide
DEEEIRTTNPCATEQYGSVIEPTTHQQITQGVNPAP

SEQ ID NO: 149176 - protein, 35 aa, Artificial Sequence
  Description of Artificial Sequence: Synthetic polypeptide
DEEEIACTNPVATEQYGSVCSMPQDNGTPGDENTD

SEQ ID NO: 149177 - protein, 35 aa, Artificial Sequence
  Description of Artificial Sequence: Synthetic polypeptide
DEEEIRTTNPCATEQYGSVSPENGEEEPLISEVVE

SEQ ID NO: 149178 - protein, 32 aa, Artificial Sequence
  Description of Artificial Sequence: Synthetic polypeptide
DETEIATTNPVAYEQWGSVPTPMLGNDHQNEG

SEQ ID NO: 149179 - protein, 33 aa, Artificial Sequence
  Description of Artificial Sequence: Synthetic polypeptide
DETEIATTNPVAYEQWGSVPTGPMLGEVGGNEG

SEQ ID NO: 149180 - protein, 35 aa, Artificial Sequence
  Description of Artificial Sequence: Synthetic polypeptide
DEEEIRTTNPCATEQYGSVSPENGEQESLPIEVVG

SEQ ID NO: 149181 - protein, 34 aa, Artificial Sequence
  Description of Artificial Sequence: Synthetic polypeptide
DETEIATTNPVAYEQWGSVPTDPNMLGEDTGNEQ

SEQ ID NO: 149182 - protein, 35 aa, Artificial Sequence
  Description of Artificial Sequence: Synthetic polypeptide
DEEEIRTTNPCATEQYGSVSPENGEQETLPPEVYE

SEQ ID NO: 149183 - protein, 35 aa, Artificial Sequence
  Description of Artificial Sequence: Synthetic polypeptide
DEEEIRTTNPCATEQYGSVSPENGEQMPLPPEVKE

SEQ ID NO: 149184 - protein, 35 aa, Artificial Sequence
  Description of Artificial Sequence: Synthetic polypeptide
DEEEIRTTNPCATEQYGSVSPENGYQEPLPPVVVE

SEQ ID NO: 149185 - protein, 35 aa, Artificial Sequence
  Description of Artificial Sequence: Synthetic polypeptide
DEEEIRTTNPCATEQYGSVSPANGEQEPLPPEPKE

SEQ ID NO: 149186 - protein, 36 aa, Artificial Sequence
  Description of Artificial Sequence: Synthetic polypeptide
DEEEIRTTNPCATEQYGSVSPENLGEQEPLPPEVVE

SEQ ID NO: 149187 - protein, 34 aa, Artificial Sequence
  Description of Artificial Sequence: Synthetic polypeptide
DETEIATTNPVAYEQWGSVCSTNDNQGEDHNQGY

SEQ ID NO: 149188 - protein, 35 aa, Artificial Sequence
  Description of Artificial Sequence: Synthetic polypeptide
DEEEIRTTNPCATEQYGSVSPVNGEQEPLPPEVVD

SEQ ID NO: 149189 - protein, 37 aa, Artificial Sequence
  Description of Artificial Sequence: Synthetic polypeptide
DEEEIRTTNPCATEQYGSVSSTTPAGPNMRNGMNPVE

SEQ ID NO: 149190 - protein, 37 aa, Artificial Sequence
  Description of Artificial Sequence: Synthetic polypeptide
DEEEIRTTNPCATEQYGSVSSTTPANGPNMRNGMVLV

SEQ ID NO: 149191 - protein, 35 aa, Artificial Sequence
  Description of Artificial Sequence: Synthetic polypeptide
SEEEIRTTNPVATEQYGSVCVSKTDIAESIEGDQE

SEQ ID NO: 149192 - protein, 36 aa, Artificial Sequence
  Description of Artificial Sequence: Synthetic polypeptide
DEEEIRTTNPCATEQYGSVSVSNNNIGTEQGNNQDG

SEQ ID NO: 149193 - protein, 36 aa, Artificial Sequence
  Description of Artificial Sequence: Synthetic polypeptide
DEEEIRTTNPCATEQYGSVSVVVNGIGTEQGTNNDD

SEQ ID NO: 149194 - protein, 36 aa, Artificial Sequence
  Description of Artificial Sequence: Synthetic polypeptide
DEEEIRTTNPCATEQYGSVSVVVNQISTEQGTNEDE

SEQ ID NO: 149195 - protein, 35 aa, Artificial Sequence
  Description of Artificial Sequence: Synthetic polypeptide
DEEEIRTTNPCATEQYGSVSPTMTGEEAVFGVEVD

SEQ ID NO: 149196 - protein, 36 aa, Artificial Sequence
  Description of Artificial Sequence: Synthetic polypeptide
SEEEIRTTNPVATEQYGSVCPSKTDLAESIEGDPQE

SEQ ID NO: 149197 - protein, 37 aa, Artificial Sequence
  Description of Artificial Sequence: Synthetic polypeptide
SEEEIRTTNPVATEQYGSVCGSVTGGSNGQGGEQEQA

SEQ ID NO: 149198 - protein, 34 aa, Artificial Sequence
  Description of Artificial Sequence: Synthetic polypeptide
DETEIATTNPVAYEQWGSVSGPNGNQGEGQNGLD

SEQ ID NO: 149199 - protein, 31 aa, Artificial Sequence
  Description of Artificial Sequence: Synthetic polypeptide
AESEIACTNPVAYEQWGEAYENYLQRGEGDR

SEQ ID NO: 149200 - protein, 36 aa, Artificial Sequence
  Description of Artificial Sequence: Synthetic polypeptide
DEEEIACTNPVATEQYGSVCSPVGDGLNPDAQMGQR

SEQ ID NO: 149201 - protein, 31 aa, Artificial Sequence
  Description of Artificial Sequence: Synthetic polypeptide
QEGEIAPTNPCSTEQYGIVSTDLEDSEGEDR

SEQ ID NO: 149202 - protein, 34 aa, Artificial Sequence
  Description of Artificial Sequence: Synthetic polypeptide
DEEEIRTTNPCATEQYGSVPEADLQAFEFPVIVN

SEQ ID NO: 149203 - protein, 36 aa, Artificial Sequence
  Description of Artificial Sequence: Synthetic polypeptide
DEEEIATTNPVATEQYGSVCSVDNNHNIDAMGMFNW

SEQ ID NO: 149204 - protein, 35 aa, Artificial Sequence
  Description of Artificial Sequence: Synthetic polypeptide
DEEEIATTNPVATEQYGSVCSVADTGQEDANENKM

SEQ ID NO: 149205 - protein, 35 aa, Artificial Sequence
  Description of Artificial Sequence: Synthetic polypeptide
DEEEIATTNPVATEQYGSVCSVADPNDNDGGEMDN

SEQ ID NO: 149206 - protein, 35 aa, Artificial Sequence
  Description of Artificial Sequence: Synthetic polypeptide
DEEEIRTTNPCATEQYGSVPEIAGLQATTGPVGQN

SEQ ID NO: 149207 - protein, 35 aa, Artificial Sequence
  Description of Artificial Sequence: Synthetic polypeptide
DEEEIACTNPVATEQYGSVCSVADTLQEDAGEHKM

SEQ ID NO: 149208 - protein, 34 aa, Artificial Sequence
  Description of Artificial Sequence: Synthetic polypeptide
DETEIATTNPVAYEQWGSVSGPNPGNQGGMNGED

SEQ ID NO: 149209 - protein, 37 aa, Artificial Sequence
  Description of Artificial Sequence: Synthetic polypeptide
AEEEIRTTNPVATEQYGSVSTTNGNDNNNNIGTNLED

SEQ ID NO: 149210 - protein, 34 aa, Artificial Sequence
  Description of Artificial Sequence: Synthetic polypeptide
DETEIATTNPVAYEQWGSVSGPNGNQTNGMNGDD

SEQ ID NO: 149211 - protein, 37 aa, Artificial Sequence
  Description of Artificial Sequence: Synthetic polypeptide
AEEEIRTTNPVATEQYGSVSTTNGNDENNNIGTNQQD

SEQ ID NO: 149212 - protein, 34 aa, Artificial Sequence
  Description of Artificial Sequence: Synthetic polypeptide
NETEIRTTNPVAYECWGSVYYTDNGDQTRNGDNN

SEQ ID NO: 149213 - protein, 35 aa, Artificial Sequence
  Description of Artificial Sequence: Synthetic polypeptide
NETEIRTTNPVAYEQWGSVCSTDNNDNHHRGNNDH

SEQ ID NO: 149214 - protein, 33 aa, Artificial Sequence
  Description of Artificial Sequence: Synthetic polypeptide
DETEIATTNPVAYEQWGSVSGPNGNQGEMNGDV

SEQ ID NO: 149215 - protein, 36 aa, Artificial Sequence
  Description of Artificial Sequence: Synthetic polypeptide
DEEEIRTTNPCATEQYGSVPMEGANLQATTGPVGQN

SEQ ID NO: 149216 - protein, 35 aa, Artificial Sequence
  Description of Artificial Sequence: Synthetic polypeptide
DEEEIRTTNPCATEQYGSVPPEAELQANTSKVGQN

SEQ ID NO: 149217 - protein, 35 aa, Artificial Sequence
  Description of Artificial Sequence: Synthetic polypeptide
NETEIRTTNPVAYEQWGSVCSTDNNDQHHIGNNDI

SEQ ID NO: 149218 - protein, 36 aa, Artificial Sequence
  Description of Artificial Sequence: Synthetic polypeptide
DEEEIACTNPVATEQYGSVCSMNPQPNGAGIGNADD

SEQ ID NO: 149219 - protein, 32 aa, Artificial Sequence
  Description of Artificial Sequence: Synthetic polypeptide
DETEIATTNPVAYEQYGSVCATNPEADATLTD

SEQ ID NO: 149220 - protein, 34 aa, Artificial Sequence
  Description of Artificial Sequence: Synthetic polypeptide
DETEIATTNPVAYEQYGSVCTGPDGQPEGGDNDN

SEQ ID NO: 149221 - protein, 37 aa, Artificial Sequence
  Description of Artificial Sequence: Synthetic polypeptide
DEEEIRTTNPVATEQYGCVTSTTPAGNAERFGSDPQG

SEQ ID NO: 149222 - protein, 35 aa, Artificial Sequence
  Description of Artificial Sequence: Synthetic polypeptide
DETEICTTNPVAYEQWGSVCSTENLGDQDIEQGGQ

SEQ ID NO: 149223 - protein, 34 aa, Artificial Sequence
  Description of Artificial Sequence: Synthetic polypeptide
DETEICTTNPVAYEQWGSVCPTDNQQGQMGNNEV

SEQ ID NO: 149224 - protein, 35 aa, Artificial Sequence
  Description of Artificial Sequence: Synthetic polypeptide
DEEEIACTNPVATEQYGSVCAGTGHGQNEMGNNQH

SEQ ID NO: 149225 - protein, 35 aa, Artificial Sequence
  Description of Artificial Sequence: Synthetic polypeptide
SEEEIRTTNPVATEQYGCVCSTGEHNEENFNSDQE

SEQ ID NO: 149226 - protein, 35 aa, Artificial Sequence
  Description of Artificial Sequence: Synthetic polypeptide
SEEEIRTTNPVATEQYGCVCSTGEHNQNFGSDTQS

SEQ ID NO: 149227 - protein, 36 aa, Artificial Sequence
  Description of Artificial Sequence: Synthetic polypeptide
DEEEIRTTNPVATEQYGDVFGNVMTAGQGGGNDEDD

SEQ ID NO: 149228 - protein, 34 aa, Artificial Sequence
  Description of Artificial Sequence: Synthetic polypeptide
SEEEIRTTNPVATEQYGCVCSTGEHTENFNSEQN

SEQ ID NO: 149229 - protein, 34 aa, Artificial Sequence
  Description of Artificial Sequence: Synthetic polypeptide
DEEEIATTNPVATEQYGSVCTTPGPDDSGDGMGM

SEQ ID NO: 149230 - protein, 34 aa, Artificial Sequence
  Description of Artificial Sequence: Synthetic polypeptide
DETEICTTNPVAYEQWGSVCSTIDDHHQMGGNVD

SEQ ID NO: 149231 - protein, 34 aa, Artificial Sequence
  Description of Artificial Sequence: Synthetic polypeptide
DETEICTTNPVAYEHWGSVATGGQLGDHQGGNQR

SEQ ID NO: 149232 - protein, 34 aa, Artificial Sequence
  Description of Artificial Sequence: Synthetic polypeptide
DEEEIACTNPVATEQYGSVCAHNHHEAPDNQERH

SEQ ID NO: 149233 - protein, 35 aa, Artificial Sequence
  Description of Artificial Sequence: Synthetic polypeptide
SEEEIRTTNPVATEQYGCVCSTGPHDQNFGSDTQA

SEQ ID NO: 149234 - protein, 34 aa, Artificial Sequence
  Description of Artificial Sequence: Synthetic polypeptide
DEEEIATTNPVATEQYGSVCTTDTPGPDDSGDMM

SEQ ID NO: 149235 - protein, 35 aa, Artificial Sequence
  Description of Artificial Sequence: Synthetic polypeptide
DEEEIRTTNPVATEQYGDVCSPMEAIVNQMQMSVQ

SEQ ID NO: 149236 - protein, 37 aa, Artificial Sequence
  Description of Artificial Sequence: Synthetic polypeptide
DEEEIRTTNPVATEQYGSVCSTSEVLTDMPENVEENA

SEQ ID NO: 149237 - protein, 30 aa, Artificial Sequence
  Description of Artificial Sequence: Synthetic polypeptide
QEGEIAPTNPCSWEQWGIVSCNLQGSGDTR

SEQ ID NO: 149238 - protein, 36 aa, Artificial Sequence
  Description of Artificial Sequence: Synthetic polypeptide
DEEEIRTTNPVATEQYGSVNWWNPNVQLTQMVQLAD

SEQ ID NO: 149239 - protein, 35 aa, Artificial Sequence
  Description of Artificial Sequence: Synthetic polypeptide
SEEEIRTTNPVATEQYGCVCSTWEHQESFNSENQS

SEQ ID NO: 149240 - protein, 34 aa, Artificial Sequence
  Description of Artificial Sequence: Synthetic polypeptide
DEEEIACTNPVATEQYGSVCAGTNPAGTGAEDGH

SEQ ID NO: 149241 - protein, 35 aa, Artificial Sequence
  Description of Artificial Sequence: Synthetic polypeptide
DEEEIRTTNPVATEQYGDVICPTPLVEAQQLVTEH

SEQ ID NO: 149242 - protein, 35 aa, Artificial Sequence
  Description of Artificial Sequence: Synthetic polypeptide
DEEEIRTTNPVATEQYGDVICPTPLVSEQQAVTEH

SEQ ID NO: 149243 - protein, 34 aa, Artificial Sequence
  Description of Artificial Sequence: Synthetic polypeptide
DETEICTTNPVAYEQWGSVSNTNGLNGEHDNGES

SEQ ID NO: 149244 - protein, 34 aa, Artificial Sequence
  Description of Artificial Sequence: Synthetic polypeptide
DEEEIATTNPVATEQYGSVCTTPGPDDSGDMAAN

SEQ ID NO: 149245 - protein, 35 aa, Artificial Sequence
  Description of Artificial Sequence: Synthetic polypeptide
DEEEIATTNPVATEQYGSVCTTPGPDDSGDGSVNN

SEQ ID NO: 149246 - protein, 34 aa, Artificial Sequence
  Description of Artificial Sequence: Synthetic polypeptide
DEEEIRTTNPVATEQYGDVMGGMGGNGQGEEIFG

SEQ ID NO: 149247 - protein, 34 aa, Artificial Sequence
  Description of Artificial Sequence: Synthetic polypeptide
SEEEIRTTNPVATEQYGCVCGTGAAHQNFGSDQA

SEQ ID NO: 149248 - protein, 34 aa, Artificial Sequence
  Description of Artificial Sequence: Synthetic polypeptide
DETEICTTNPVAYEQWGVVVPTDNGDQAGGNMTR

SEQ ID NO: 149249 - protein, 33 aa, Artificial Sequence
  Description of Artificial Sequence: Synthetic polypeptide
DETEICTTNPVAYEQWGVVSSTNMQLNDEHGDF

SEQ ID NO: 149250 - protein, 35 aa, Artificial Sequence
  Description of Artificial Sequence: Synthetic polypeptide
SEEEIRTTNPVATEQYGCVCGTGAHNTNFGSDNQA

SEQ ID NO: 149251 - protein, 33 aa, Artificial Sequence
  Description of Artificial Sequence: Synthetic polypeptide
DETEICTTNPVAYEQWGTVATNDGNQGQAGNAE

SEQ ID NO: 149252 - protein, 34 aa, Artificial Sequence
  Description of Artificial Sequence: Synthetic polypeptide
DETEICTTNPVAYEQWGSVYGITNDLGNHGGNDS

SEQ ID NO: 149253 - protein, 35 aa, Artificial Sequence
  Description of Artificial Sequence: Synthetic polypeptide
SEEEIRTTNPVATEQYGCVCGTGAHQENFGSDNQA

SEQ ID NO: 149254 - protein, 31 aa, Artificial Sequence
  Description of Artificial Sequence: Synthetic polypeptide
NETEIRCTNPTAYECWGSVYGENDMHRGDNR

SEQ ID NO: 149255 - protein, 34 aa, Artificial Sequence
  Description of Artificial Sequence: Synthetic polypeptide
SEEEIRTTNPVATEQYGCVCGTMAHQNFGSDTQA

SEQ ID NO: 149256 - protein, 32 aa, Artificial Sequence
  Description of Artificial Sequence: Synthetic polypeptide
SEEEIRTTNPVATEQYGCVCGWAHQNFISDQA

SEQ ID NO: 149257 - protein, 33 aa, Artificial Sequence
  Description of Artificial Sequence: Synthetic polypeptide
DEEEIRTTNPVATEQYGDVMGGIGGNEGGEEIY

SEQ ID NO: 149258 - protein, 34 aa, Artificial Sequence
  Description of Artificial Sequence: Synthetic polypeptide
SEEEIRTTNPVATEQYGCVCSNTEHQENFPSEQP

SEQ ID NO: 149259 - protein, 35 aa, Artificial Sequence
  Description of Artificial Sequence: Synthetic polypeptide
SEEEIRTTNPVATEQYGCVCSNTGEHQNFGSDTQS

SEQ ID NO: 149260 - protein, 35 aa, Artificial Sequence
  Description of Artificial Sequence: Synthetic polypeptide
SEEEIRTTNPVATEQYGCVCSNWGEHQNFGSDNQA

SEQ ID NO: 149261 - protein, 34 aa, Artificial Sequence
  Description of Artificial Sequence: Synthetic polypeptide
DEEEIACTNPVATEQYGSVCADIHDTSGEEMNRD

SEQ ID NO: 149262 - protein, 35 aa, Artificial Sequence
  Description of Artificial Sequence: Synthetic polypeptide
DEEEIRTTNPVATEQYGDVISGNNMDTGEGGGEMG

SEQ ID NO: 149263 - protein, 36 aa, Artificial Sequence
  Description of Artificial Sequence: Synthetic polypeptide
SEEEIRTTNPVATEQYGCVCSTWNEHQENFNSENQA

SEQ ID NO: 149264 - protein, 33 aa, Artificial Sequence
  Description of Artificial Sequence: Synthetic polypeptide
SEEEIRTTNPVATEQYGCVCSWEHAENNSDFQA

SEQ ID NO: 149265 - protein, 37 aa, Artificial Sequence
  Description of Artificial Sequence: Synthetic polypeptide
DEEEIRTTNPVATEQYGSVCSTSEVLVDTWNNVEENA

SEQ ID NO: 149266 - protein, 37 aa, Artificial Sequence
  Description of Artificial Sequence: Synthetic polypeptide
DEEEIRTTNPVATEQYGSVSSTTPAGPNMRNGMPPVN

SEQ ID NO: 149267 - protein, 34 aa, Artificial Sequence
  Description of Artificial Sequence: Synthetic polypeptide
SEEEIRTTNPVATEQYGCYSYTSVDEANGNEDSI

SEQ ID NO: 149268 - protein, 33 aa, Artificial Sequence
  Description of Artificial Sequence: Synthetic polypeptide
SEEEIRTTNPVATEQYGCYTITSVDENGNEESI

SEQ ID NO: 149269 - protein, 32 aa, Artificial Sequence
  Description of Artificial Sequence: Synthetic polypeptide
DETEIATTNPVAYERWGEVCSGEGNQRGENDH

SEQ ID NO: 149270 - protein, 36 aa, Artificial Sequence
  Description of Artificial Sequence: Synthetic polypeptide
SEEEIRTTNPVATEQYGDMGSVNGTLQGGGQGENGQ

SEQ ID NO: 149271 - protein, 34 aa, Artificial Sequence
  Description of Artificial Sequence: Synthetic polypeptide
DETEIATTNPVAYEQYGVVYCTDLHQNPDGGNAE

SEQ ID NO: 149272 - protein, 34 aa, Artificial Sequence
  Description of Artificial Sequence: Synthetic polypeptide
DETEIATTNPVAYEQYGTVYCTDNNLGQDAGGSD

SEQ ID NO: 149273 - protein, 36 aa, Artificial Sequence
  Description of Artificial Sequence: Synthetic polypeptide
SEEEIRTTNPVATEQYGMVSSTTPAGPNMRNGMNPV

SEQ ID NO: 149274 - protein, 36 aa, Artificial Sequence
  Description of Artificial Sequence: Synthetic polypeptide
SEEEIRTTNPVATEQYGQCVCSTGNHDQNFGSDTQS

SEQ ID NO: 149275 - protein, 35 aa, Artificial Sequence
  Description of Artificial Sequence: Synthetic polypeptide
DEEEIACTNPVATEQYGSVCATGLGAPGEQMEGRH

SEQ ID NO: 149276 - protein, 34 aa, Artificial Sequence
  Description of Artificial Sequence: Synthetic polypeptide
SEEEIRTTNPVATEQYGQCVCSWEHQENFGSEDS

SEQ ID NO: 149277 - protein, 37 aa, Artificial Sequence
  Description of Artificial Sequence: Synthetic polypeptide
DEEEIRTTNPVATEQYGCVTSTTPATNNEHFGSNPVQ

SEQ ID NO: 149278 - protein, 36 aa, Artificial Sequence
  Description of Artificial Sequence: Synthetic polypeptide
DEEEIRTTNPVATEQYGCVTSTTPAPNAEHFGSQPV

SEQ ID NO: 149279 - protein, 38 aa, Artificial Sequence
  Description of Artificial Sequence: Synthetic polypeptide
AEEEIRTTNPVATEQYGSVSTTNGTNLEQGSNQNNNED

SEQ ID NO: 149280 - protein, 34 aa, Artificial Sequence
  Description of Artificial Sequence: Synthetic polypeptide
DETEIATTNPVAYEQYGSVSAGNPQQAVPGDDHQ

SEQ ID NO: 149281 - protein, 37 aa, Artificial Sequence
  Description of Artificial Sequence: Synthetic polypeptide
AEEEIRTTNPVATEQYGSVSTTNGTNDEQGSNQNNDD

SEQ ID NO: 149282 - protein, 35 aa, Artificial Sequence
  Description of Artificial Sequence: Synthetic polypeptide
DEEEIACTNPVATEQYGSVCATHLEQPDDQTEGIA

SEQ ID NO: 149283 - protein, 34 aa, Artificial Sequence
  Description of Artificial Sequence: Synthetic polypeptide
DEEEIACTNPVATEQYGSVCATHPENQANQTEGT

SEQ ID NO: 149284 - protein, 36 aa, Artificial Sequence
  Description of Artificial Sequence: Synthetic polypeptide
DEEEIRTTNPVATEQYGCVTSTTPAHNAEHFGSDTV

SEQ ID NO: 149285 - protein, 35 aa, Artificial Sequence
  Description of Artificial Sequence: Synthetic polypeptide
DEEEIACTNPVATEQYGSVCATNHTEGRDLANMAM

SEQ ID NO: 149286 - protein, 34 aa, Artificial Sequence
  Description of Artificial Sequence: Synthetic polypeptide
SEEEIRTTNPVATEQYGCYSWTSVDEINLNEESI

SEQ ID NO: 149287 - protein, 35 aa, Artificial Sequence
  Description of Artificial Sequence: Synthetic polypeptide
DEEEIRTTNPVATEQYGSVNTDSQMEPQQEQEDEL

SEQ ID NO: 149288 - protein, 33 aa, Artificial Sequence
  Description of Artificial Sequence: Synthetic polypeptide
DETEIATTNPVAYERWGSVAHTLDGDQDRNGNS

SEQ ID NO: 149289 - protein, 37 aa, Artificial Sequence
  Description of Artificial Sequence: Synthetic polypeptide
DEEEIRTTNPVATEQYGCVTSTWPATNAEHFGSNPQA

SEQ ID NO: 149290 - protein, 37 aa, Artificial Sequence
  Description of Artificial Sequence: Synthetic polypeptide
DEEEIRTTNPVATEQYGSVSSTTPAGPNMRNGMPPVV

SEQ ID NO: 149291 - protein, 35 aa, Artificial Sequence
  Description of Artificial Sequence: Synthetic polypeptide
DEEEIATTNPVATEQYGSVCTDTPLPDDSGDDSEN

SEQ ID NO: 149292 - protein, 36 aa, Artificial Sequence
  Description of Artificial Sequence: Synthetic polypeptide
DEEEIATTNPVATEQYGSVCSVPNLPLDSMIENAED

SEQ ID NO: 149293 - protein, 36 aa, Artificial Sequence
  Description of Artificial Sequence: Synthetic polypeptide
DEEEIRTTNPCATEQYGSVCEIANLQADTTGPVGQN

SEQ ID NO: 149294 - protein, 34 aa, Artificial Sequence
  Description of Artificial Sequence: Synthetic polypeptide
DEEEIRTTNPVATEQYGCWCSWPNDHQYFDSDQS

SEQ ID NO: 149295 - protein, 35 aa, Artificial Sequence
  Description of Artificial Sequence: Synthetic polypeptide
DEEEIRTTNPVATEQYGSVNVDGFGQENDQDEDGT

SEQ ID NO: 149296 - protein, 31 aa, Artificial Sequence
  Description of Artificial Sequence: Synthetic polypeptide
AESEIACTNPVAYEAYGEASCDNLSQRVGGS

SEQ ID NO: 149297 - protein, 36 aa, Artificial Sequence
  Description of Artificial Sequence: Synthetic polypeptide
DETEICTTNPVATEQYGIAVVPSTNLSDPRVGSPEW

SEQ ID NO: 149298 - protein, 36 aa, Artificial Sequence
  Description of Artificial Sequence: Synthetic polypeptide
DEEEIRTTNPVATEQYGCVYAGNGDVQIDNPDGNNP

SEQ ID NO: 149299 - protein, 32 aa, Artificial Sequence
  Description of Artificial Sequence: Synthetic polypeptide
DETEICTTNPCAYEQWGSVCYNIEEKRDGNDS

SEQ ID NO: 149300 - protein, 36 aa, Artificial Sequence
  Description of Artificial Sequence: Synthetic polypeptide
DEEEIRTTNPCATEQYGSVIEPATHLQITQGFQPAP

SEQ ID NO: 149301 - protein, 36 aa, Artificial Sequence
  Description of Artificial Sequence: Synthetic polypeptide
DEEEIRTTNPCATEQYGSVIEPSNQHQQITGVNFTP

SEQ ID NO: 149302 - protein, 35 aa, Artificial Sequence
  Description of Artificial Sequence: Synthetic polypeptide
DEEEIACTNPVATEQYGSVCAMNNGLEPTDSMGER

SEQ ID NO: 149303 - protein, 37 aa, Artificial Sequence
  Description of Artificial Sequence: Synthetic polypeptide
DEEEIRTTNPCATEQYGSVIEPTLNIHQQITGVNPAP

SEQ ID NO: 149304 - protein, 33 aa, Artificial Sequence
  Description of Artificial Sequence: Synthetic polypeptide
SEEEIRTTNPVATEQYGCYDTSVDEANGNEESI

SEQ ID NO: 149305 - protein, 36 aa, Artificial Sequence
  Description of Artificial Sequence: Synthetic polypeptide
DEEEIACTNPVATEQYGSVCAMTNNELTQDSDENGM

SEQ ID NO: 149306 - protein, 33 aa, Artificial Sequence
  Description of Artificial Sequence: Synthetic polypeptide
SEEEIRTTNPVATEQYGCYSSLVDEANGNEESI

SEQ ID NO: 149307 - protein, 34 aa, Artificial Sequence
  Description of Artificial Sequence: Synthetic polypeptide
SEEEIRTTNPVATEQYGCYSTSVDDENSGNEESI

SEQ ID NO: 149308 - protein, 34 aa, Artificial Sequence
  Description of Artificial Sequence: Synthetic polypeptide
SEEEIRTTNPVATEQYGCYSTSVDEANNGNEPSI

SEQ ID NO: 149309 - protein, 34 aa, Artificial Sequence
  Description of Artificial Sequence: Synthetic polypeptide
SEEEIRTTNPVATEQYGCYSTSVHDEWNGNEESI

SEQ ID NO: 149310 - protein, 36 aa, Artificial Sequence
  Description of Artificial Sequence: Synthetic polypeptide
DEEEIATTNPVATEQYGSVCSMAGGTLQDAGEPKMQ

SEQ ID NO: 149311 - protein, 35 aa, Artificial Sequence
  Description of Artificial Sequence: Synthetic polypeptide
DETEIATTNPVAYEQWGSVCSGTNDNQGEGQQERA

SEQ ID NO: 149312 - protein, 37 aa, Artificial Sequence
  Description of Artificial Sequence: Synthetic polypeptide
DEEEIRTTNPCATEQYGTVSTVVNLQAGTEQGTTQDD

SEQ ID NO: 149313 - protein, 36 aa, Artificial Sequence
  Description of Artificial Sequence: Synthetic polypeptide
AEEEIRTTNPVATEQYGSVVVSVTTNNTEQGETEDT

SEQ ID NO: 149314 - protein, 33 aa, Artificial Sequence
  Description of Artificial Sequence: Synthetic polypeptide
DEEEIRTTNPCAYEPYGSCAGTNYHMNRQNEAM

SEQ ID NO: 149315 - protein, 35 aa, Artificial Sequence
  Description of Artificial Sequence: Synthetic polypeptide
DETEIATTNPVATEQYGSVCAAQNGDEQDRSIADR

SEQ ID NO: 149316 - protein, 34 aa, Artificial Sequence
  Description of Artificial Sequence: Synthetic polypeptide
DETEIATTNPVATEQYGSVCAANNGDEQTMDINF

SEQ ID NO: 149317 - protein, 36 aa, Artificial Sequence
  Description of Artificial Sequence: Synthetic polypeptide
DETEIATTNPVATEQYGSVCAANNGDEQDRSIQNRQ

SEQ ID NO: 149318 - protein, 33 aa, Artificial Sequence
  Description of Artificial Sequence: Synthetic polypeptide
DEEEIRTTNPCAYEPYGSCAGTTNHMNRQGEAM

SEQ ID NO: 149319 - protein, 35 aa, Artificial Sequence
  Description of Artificial Sequence: Synthetic polypeptide
DETEIATTNPVATEQYGSVCAANNGDEQDRSIDQR

SEQ ID NO: 149320 - protein, 37 aa, Artificial Sequence
  Description of Artificial Sequence: Synthetic polypeptide
DEEEIATTNPVATEQYGSVCSPMPNNQNEAMIGDGRN

SEQ ID NO: 149321 - protein, 34 aa, Artificial Sequence
  Description of Artificial Sequence: Synthetic polypeptide
DETEIATTNPVATEQYGSVCAATAQLDAAENNGQ

SEQ ID NO: 149322 - protein, 35 aa, Artificial Sequence
  Description of Artificial Sequence: Synthetic polypeptide
DETEIATTNPVATEQYGSVCAANNGDEQDASINRN

SEQ ID NO: 149323 - protein, 35 aa, Artificial Sequence
  Description of Artificial Sequence: Synthetic polypeptide
DEEEIASTNPVATEQYGSVSSTTPTGPNMRNGMDV

SEQ ID NO: 149324 - protein, 33 aa, Artificial Sequence
  Description of Artificial Sequence: Synthetic polypeptide
DEEEIRTTNPCAYEPYGSVAASNHGRGGDIEAP

SEQ ID NO: 149325 - protein, 35 aa, Artificial Sequence
  Description of Artificial Sequence: Synthetic polypeptide
DETEIATTNPVATEQYGSVCAAMNPLNDMDGNNHN

SEQ ID NO: 149326 - protein, 36 aa, Artificial Sequence
  Description of Artificial Sequence: Synthetic polypeptide
AEEEIRTTNPVATEQYGSVVVSVTTNNQEQETTEDE

SEQ ID NO: 149327 - protein, 36 aa, Artificial Sequence
  Description of Artificial Sequence: Synthetic polypeptide
DEEEIASTNPVATEQYGSVSSTTPTGPNMRNGMNPV

SEQ ID NO: 149328 - protein, 34 aa, Artificial Sequence
  Description of Artificial Sequence: Synthetic polypeptide
DETEIATTNPVATEQYGSVCAAMHGQDSGENDHF

SEQ ID NO: 149329 - protein, 34 aa, Artificial Sequence
  Description of Artificial Sequence: Synthetic polypeptide
DETEIATTNPVATEQYGSVCAAMHGQDSGEGNHD

SEQ ID NO: 149330 - protein, 33 aa, Artificial Sequence
  Description of Artificial Sequence: Synthetic polypeptide
DEEEIRTTNPCAYEQWGSVCYNIEEDRDGQMDD

SEQ ID NO: 149331 - protein, 34 aa, Artificial Sequence
  Description of Artificial Sequence: Synthetic polypeptide
DETEIATTNPVATEQYGSVCAANNGDEDGMDIIR

SEQ ID NO: 149332 - protein, 35 aa, Artificial Sequence
  Description of Artificial Sequence: Synthetic polypeptide
DETEIATTNPVATEQYGSVCAGENEPGQEHNNQRE

SEQ ID NO: 149333 - protein, 34 aa, Artificial Sequence
  Description of Artificial Sequence: Synthetic polypeptide
DETEIATTNPVATEQYGSVCAGPDGQPEGGDNSD

SEQ ID NO: 149334 - protein, 36 aa, Artificial Sequence
  Description of Artificial Sequence: Synthetic polypeptide
DETEIATTNPVATEQYGSVCAMNNGELIQDSDGNGN

SEQ ID NO: 149335 - protein, 30 aa, Artificial Sequence
  Description of Artificial Sequence: Synthetic polypeptide
DEEEIASTNPVATEQWGDVSEIEMNAAEDQ

SEQ ID NO: 149336 - protein, 37 aa, Artificial Sequence
  Description of Artificial Sequence: Synthetic polypeptide
AEEEIRTTNPVATEQYGSVSTTANNNDEQGNNENGQD

SEQ ID NO: 149337 - protein, 34 aa, Artificial Sequence
  Description of Artificial Sequence: Synthetic polypeptide
DEEEIRTTNPCAYEEYGSVAYTNEHSGRGGPFAM

SEQ ID NO: 149338 - protein, 35 aa, Artificial Sequence
  Description of Artificial Sequence: Synthetic polypeptide
NSEAICTTNPVATEQWGETVSFTNLSQDNTVGNNR

SEQ ID NO: 149339 - protein, 34 aa, Artificial Sequence
  Description of Artificial Sequence: Synthetic polypeptide
DEEEIRTTNPCAYEGYGSCSCQNELSGRGGDQAC

SEQ ID NO: 149340 - protein, 35 aa, Artificial Sequence
  Description of Artificial Sequence: Synthetic polypeptide
DETEIATTNPVATEQYGSVCSSTPQEGENTDDMKW

SEQ ID NO: 149341 - protein, 34 aa, Artificial Sequence
  Description of Artificial Sequence: Synthetic polypeptide
DEEEIRTTNPCAYEGYGSCSCTNETSGRGGDQQC

SEQ ID NO: 149342 - protein, 36 aa, Artificial Sequence
  Description of Artificial Sequence: Synthetic polypeptide
DETEIATTNPVATEQYGSVCSATNTGTEHQDGAEMK

SEQ ID NO: 149343 - protein, 34 aa, Artificial Sequence
  Description of Artificial Sequence: Synthetic polypeptide
DETEIATTNPVATEQYGSVCAVGDIGNNADGNQV

SEQ ID NO: 149344 - protein, 34 aa, Artificial Sequence
  Description of Artificial Sequence: Synthetic polypeptide
DETEIATTNPVATEQYGSVCAVGDIGENNRGNQV

SEQ ID NO: 149345 - protein, 36 aa, Artificial Sequence
  Description of Artificial Sequence: Synthetic polypeptide
DETEIATTNPVATEQYGSVCATNPQLNPDDQTGGDD

SEQ ID NO: 149346 - protein, 35 aa, Artificial Sequence
  Description of Artificial Sequence: Synthetic polypeptide
DETEIATTNPVATEQYGSVCATNPMQPDNQTEGTM

SEQ ID NO: 149347 - protein, 38 aa, Artificial Sequence
  Description of Artificial Sequence: Synthetic polypeptide
DEEEIATTNPVATEQYGSVCSPTGNGQEPTDDGMGSRM

SEQ ID NO: 149348 - protein, 36 aa, Artificial Sequence
  Description of Artificial Sequence: Synthetic polypeptide
DETEIATTNPVATEQYGSVCAMTNNQLNDSGDNQVH

SEQ ID NO: 149349 - protein, 36 aa, Artificial Sequence
  Description of Artificial Sequence: Synthetic polypeptide
DETEIATTNPVATEQYGSVCAMTNNQDNDSPGNQVH

SEQ ID NO: 149350 - protein, 36 aa, Artificial Sequence
  Description of Artificial Sequence: Synthetic polypeptide
DETEIATTNPVATEQYGSVCAMTNHGEQTLDGEQRH

SEQ ID NO: 149351 - protein, 32 aa, Artificial Sequence
  Description of Artificial Sequence: Synthetic polypeptide
DEEEIRTTNPCAYEPYGSCAGTNHMNNSNAAM

SEQ ID NO: 149352 - protein, 32 aa, Artificial Sequence
  Description of Artificial Sequence: Synthetic polypeptide
DEEEIRTTNPCAYEPYGSCAGTNHMNPQENAM

SEQ ID NO: 149353 - protein, 37 aa, Artificial Sequence
  Description of Artificial Sequence: Synthetic polypeptide
AEEEIRTTNPVATEQYGSVSTSTQNMEQGTTNVATEQ

SEQ ID NO: 149354 - protein, 33 aa, Artificial Sequence
  Description of Artificial Sequence: Synthetic polypeptide
DEEEIRTTNPCAYEQWGSVCYNIEEMQEGQMDS

SEQ ID NO: 149355 - protein, 37 aa, Artificial Sequence
  Description of Artificial Sequence: Synthetic polypeptide
AEEEIRTTNPVATEQYGSVSTTANNNDEQGNNNNEQG

SEQ ID NO: 149356 - protein, 34 aa, Artificial Sequence
  Description of Artificial Sequence: Synthetic polypeptide
DETEIATTNPVATEQYGSVCAADTDQDMSIDNRD

SEQ ID NO: 149357 - protein, 34 aa, Artificial Sequence
  Description of Artificial Sequence: Synthetic polypeptide
DETEIATTNPVATEQYGSVCAADNGGEMAMDINR

SEQ ID NO: 149358 - protein, 33 aa, Artificial Sequence
  Description of Artificial Sequence: Synthetic polypeptide
DETEIATTNPVATEQYGSTWSNADLADHKGEYI

SEQ ID NO: 149359 - protein, 33 aa, Artificial Sequence
  Description of Artificial Sequence: Synthetic polypeptide
DETEIATTNPVATEQYGSTWSAADLADHKGEYI

SEQ ID NO: 149360 - protein, 33 aa, Artificial Sequence
  Description of Artificial Sequence: Synthetic polypeptide
DETEIATTNPVATEQYGSTVSAADWADHKGEYL

SEQ ID NO: 149361 - protein, 33 aa, Artificial Sequence
  Description of Artificial Sequence: Synthetic polypeptide
DETEIATTNPVATEQYGSTSNAEDLEDHEGEYL

SEQ ID NO: 149362 - protein, 35 aa, Artificial Sequence
  Description of Artificial Sequence: Synthetic polypeptide
DEEEIRTTNPCAYEQYGTCAAGTNLQATPGDNEAM

SEQ ID NO: 149363 - protein, 31 aa, Artificial Sequence
  Description of Artificial Sequence: Synthetic polypeptide
DEEEIRTTNPCAYMPQYGQTPTDDQRDATMA

SEQ ID NO: 149364 - protein, 34 aa, Artificial Sequence
  Description of Artificial Sequence: Synthetic polypeptide
DEEEIATTNPVATEQYGSVCSMNQSNDMVPDDQD

SEQ ID NO: 149365 - protein, 35 aa, Artificial Sequence
  Description of Artificial Sequence: Synthetic polypeptide
DETEIATTNPVATEQYGSACAATNPQADSPMGHRM

SEQ ID NO: 149366 - protein, 33 aa, Artificial Sequence
  Description of Artificial Sequence: Synthetic polypeptide
DETEIATTNPVATEQYGSTWSNADLADPKGEYI

SEQ ID NO: 149367 - protein, 29 aa, Artificial Sequence
  Description of Artificial Sequence: Synthetic peptide
DETEIATTNPVATEQYGEAPEVWAEHEEK

SEQ ID NO: 149368 - protein, 32 aa, Artificial Sequence
  Description of Artificial Sequence: Synthetic polypeptide
DEEEIRTTNPCAYMQYGSVSSGEIGFHGDDDM

SEQ ID NO: 149369 - protein, 34 aa, Artificial Sequence
  Description of Artificial Sequence: Synthetic polypeptide
DETEIATTNPVATEQYGCVCTIEGNQDQGGKGQE

SEQ ID NO: 149370 - protein, 36 aa, Artificial Sequence
  Description of Artificial Sequence: Synthetic polypeptide
DETEIATTNPVATEQYGCVAATTNVNQTPSGDNNRQ

SEQ ID NO: 149371 - protein, 33 aa, Artificial Sequence
  Description of Artificial Sequence: Synthetic polypeptide
DEEEIRTTNPCAYMQYGSVSSGGIGFHGDNSHH

SEQ ID NO: 149372 - protein, 34 aa, Artificial Sequence
  Description of Artificial Sequence: Synthetic polypeptide
DETEIATTNPVATEQYGCVAATGSLAPDNQMGFP

SEQ ID NO: 149373 - protein, 35 aa, Artificial Sequence
  Description of Artificial Sequence: Synthetic polypeptide
DETEIATTNPVATEQYGCVAATANEPTQGGGMERH

SEQ ID NO: 149374 - protein, 32 aa, Artificial Sequence
  Description of Artificial Sequence: Synthetic polypeptide
DETEIATTNPVATEQYGCVAANGPEPDMNLNH

SEQ ID NO: 149375 - protein, 33 aa, Artificial Sequence
  Description of Artificial Sequence: Synthetic polypeptide
DETEIATTNPVATEQYGCVAANGDADTGGDPRN

SEQ ID NO: 149376 - protein, 34 aa, Artificial Sequence
  Description of Artificial Sequence: Synthetic polypeptide
DEEEIRTTNPCAYMQYGSVSLSGNIGFHGDNSDH

SEQ ID NO: 149377 - protein, 33 aa, Artificial Sequence
  Description of Artificial Sequence: Synthetic polypeptide
DEEEIRTTNPCAYEQYGSCSVGDIGFHGDNQDD

SEQ ID NO: 149378 - protein, 36 aa, Artificial Sequence
  Description of Artificial Sequence: Synthetic polypeptide
DEEEIRTTNPCAYEQYGSCAATGNHLQATPGDNMAM

SEQ ID NO: 149379 - protein, 33 aa, Artificial Sequence
  Description of Artificial Sequence: Synthetic polypeptide
DEEEIRTTNPCAYEQWGVVPTWENDQANGGGEQ

SEQ ID NO: 149380 - protein, 35 aa, Artificial Sequence
  Description of Artificial Sequence: Synthetic polypeptide
DEEEIATTNPVATEQYGSVCSPADNNHNIDAMGMD

SEQ ID NO: 149381 - protein, 35 aa, Artificial Sequence
  Description of Artificial Sequence: Synthetic polypeptide
DETEIATTNPVATEQYGSVCAADNGDETGMDINRL

SEQ ID NO: 149382 - protein, 35 aa, Artificial Sequence
  Description of Artificial Sequence: Synthetic polypeptide
DETEIATTNPVATEQYGSVCAADNGDEQTMDINRV

SEQ ID NO: 149383 - protein, 34 aa, Artificial Sequence
  Description of Artificial Sequence: Synthetic polypeptide
DETEIATTNPVATEQYGSVCAADNGDEQMDITNH

SEQ ID NO: 149384 - protein, 34 aa, Artificial Sequence
  Description of Artificial Sequence: Synthetic polypeptide
DETEIATTNPVATEQYGSVCAADNGDEQGMDINS

SEQ ID NO: 149385 - protein, 35 aa, Artificial Sequence
  Description of Artificial Sequence: Synthetic polypeptide
DETEIATTNPVATEQYGSVCAADNGDEQGMDDNFR

SEQ ID NO: 149386 - protein, 35 aa, Artificial Sequence
  Description of Artificial Sequence: Synthetic polypeptide
DETEIATTNPVATEQYGSVCAADNGDEPGMDINSR

SEQ ID NO: 149387 - protein, 35 aa, Artificial Sequence
  Description of Artificial Sequence: Synthetic polypeptide
DETEIATTNPVATEQYGSVCAADNGDEMGMDIENR

SEQ ID NO: 149388 - protein, 35 aa, Artificial Sequence
  Description of Artificial Sequence: Synthetic polypeptide
DETEIATTNPVATEQYGSVCAADNGDEAGMDPNQR

SEQ ID NO: 149389 - protein, 35 aa, Artificial Sequence
  Description of Artificial Sequence: Synthetic polypeptide
DETEIATTNPVATEQYGSVCAADNGDEAGMAINHR

SEQ ID NO: 149390 - protein, 37 aa, Artificial Sequence
  Description of Artificial Sequence: Synthetic polypeptide
AEEEIRTTNPVATEQYGSVVVSVTTNNNQEQNEETTD

SEQ ID NO: 149391 - protein, 33 aa, Artificial Sequence
  Description of Artificial Sequence: Synthetic polypeptide
DEEEIRTTNPCAYEQWGSVCYNIEQGDQDNHDV

SEQ ID NO: 149392 - protein, 37 aa, Artificial Sequence
  Description of Artificial Sequence: Synthetic polypeptide
DEEEIATTNPVATEQYGSVCSMTNNGPQDHQDDNNVM

SEQ ID NO: 149393 - protein, 37 aa, Artificial Sequence
  Description of Artificial Sequence: Synthetic polypeptide
AEEEIRTTNPVATEQYGSVVVSVTTNNGQEQGEETED

SEQ ID NO: 149394 - protein, 35 aa, Artificial Sequence
  Description of Artificial Sequence: Synthetic polypeptide
DEEEIATTNPVATEQYGSVCSMPQSNDMVPDDQRD

SEQ ID NO: 149395 - protein, 34 aa, Artificial Sequence
  Description of Artificial Sequence: Synthetic polypeptide
DEEEIRTTNPCAYEQWGSVYCNDNDQHRGGHDHA

SEQ ID NO: 149396 - protein, 37 aa, Artificial Sequence
  Description of Artificial Sequence: Synthetic polypeptide
AEEEIRTTNPVATEQYGSVSTSTNEQLGSEEGTTEDE

SEQ ID NO: 149397 - protein, 35 aa, Artificial Sequence
  Description of Artificial Sequence: Synthetic polypeptide
DEEEIRTTNPCAYEQWGSVYCTDNDQHHAGHNHES

SEQ ID NO: 149398 - protein, 34 aa, Artificial Sequence
  Description of Artificial Sequence: Synthetic polypeptide
DETEIATTNPVATEQYGSVAANNTPTQEHNNQAE

SEQ ID NO: 149399 - protein, 34 aa, Artificial Sequence
  Description of Artificial Sequence: Synthetic polypeptide
DETEIATTNPVATEQYGSVCAADNHGQDSDINND

SEQ ID NO: 149400 - protein, 34 aa, Artificial Sequence
  Description of Artificial Sequence: Synthetic polypeptide
DEEEIRTTNPCAYEEWGSVAMTLNDHAGGRGQNA

SEQ ID NO: 149401 - protein, 34 aa, Artificial Sequence
  Description of Artificial Sequence: Synthetic polypeptide
DEEEIRTTNPCAYEEWGSVAMTLNDHAGGRGNTD

SEQ ID NO: 149402 - protein, 28 aa, Artificial Sequence
  Description of Artificial Sequence: Synthetic peptide
QEGEIAPTNPCSSETYGIVSCNNQSGTY

SEQ ID NO: 149403 - protein, 37 aa, Artificial Sequence
  Description of Artificial Sequence: Synthetic polypeptide
SEEEIRTTNPVATEQYGSVNMDTNGQDQTDEGQNEGI

SEQ ID NO: 149404 - protein, 37 aa, Artificial Sequence
  Description of Artificial Sequence: Synthetic polypeptide
DEEEIRTTNPVATEQYGSVNSWNPYVGQLTQMVQEAD

SEQ ID NO: 149405 - protein, 37 aa, Artificial Sequence
  Description of Artificial Sequence: Synthetic polypeptide
DEEEIRTTNPVATEQYGSVNSWNPNVEALTQMVQEAD

SEQ ID NO: 149406 - protein, 35 aa, Artificial Sequence
  Description of Artificial Sequence: Synthetic polypeptide
SEEEIRTTNPVATEQYGSVNNTTEIDDEGGMENVN

SEQ ID NO: 149407 - protein, 37 aa, Artificial Sequence
  Description of Artificial Sequence: Synthetic polypeptide
DEEEIRTTNPVATEQYGSVNSVVEMVQHARNLPANDP

SEQ ID NO: 149408 - protein, 33 aa, Artificial Sequence
  Description of Artificial Sequence: Synthetic polypeptide
DETEIATTNPVAYEKWGSVSGGNNGNAGNDNQR

SEQ ID NO: 149409 - protein, 35 aa, Artificial Sequence
  Description of Artificial Sequence: Synthetic polypeptide
NNEEIRTTNPVATEQYGIVSWVPQNLQQDGGPEMI

SEQ ID NO: 149410 - protein, 37 aa, Artificial Sequence
  Description of Artificial Sequence: Synthetic polypeptide
SEEEIRTTNPVATEQYGSVNSTTPAGPNMENGMNDDQ

SEQ ID NO: 149411 - protein, 37 aa, Artificial Sequence
  Description of Artificial Sequence: Synthetic polypeptide
SEEEIRTTNPVATEQYGSVNMDTNGQDQNDEGQNNGQ

SEQ ID NO: 149412 - protein, 36 aa, Artificial Sequence
  Description of Artificial Sequence: Synthetic polypeptide
NNEEIRTTNPVATEQYGSVSSTTPAGPNMRNGMNPV

SEQ ID NO: 149413 - protein, 37 aa, Artificial Sequence
  Description of Artificial Sequence: Synthetic polypeptide
DEEEIRTTNPCATEQYGVVSTVNGQAGTEQGSTNQDD

SEQ ID NO: 149414 - protein, 31 aa, Artificial Sequence
  Description of Artificial Sequence: Synthetic polypeptide
QEGEIAPTNPCSTEQYGIVSACNLQDSEGTL

SEQ ID NO: 149415 - protein, 32 aa, Artificial Sequence
  Description of Artificial Sequence: Synthetic polypeptide
DETEIATTNPVAYEEWGSVTGGNGNHGNDGAR

SEQ ID NO: 149416 - protein, 34 aa, Artificial Sequence
  Description of Artificial Sequence: Synthetic polypeptide
NNEEIRTTNPVATEQYGVCVWTQELNQDGDPEME

SEQ ID NO: 149417 - protein, 37 aa, Artificial Sequence
  Description of Artificial Sequence: Synthetic polypeptide
DEEEIRTTNPCATEQYGVVSTVNNQAGTNQGGTNQDD

SEQ ID NO: 149418 - protein, 34 aa, Artificial Sequence
  Description of Artificial Sequence: Synthetic polypeptide
DETEIATTNPVAYECWGSVSCGNPLPDDDGMNPR

SEQ ID NO: 149419 - protein, 33 aa, Artificial Sequence
  Description of Artificial Sequence: Synthetic polypeptide
DETEIATTNPVAYECWGSVAWTDDGLQRGGGES

SEQ ID NO: 149420 - protein, 34 aa, Artificial Sequence
  Description of Artificial Sequence: Synthetic polypeptide
NNEEIRTTNPVATEQYGVVIVTQNAQQDGGPEMI

SEQ ID NO: 149421 - protein, 34 aa, Artificial Sequence
  Description of Artificial Sequence: Synthetic polypeptide
DETEIATTNPVAYEHWGEVVSGDHNGEQRGENPR

SEQ ID NO: 149422 - protein, 37 aa, Artificial Sequence
  Description of Artificial Sequence: Synthetic polypeptide
DEEEIRTTNPCATEQYGVVSTTSNQQAGTEQGTNQDD

SEQ ID NO: 149423 - protein, 38 aa, Artificial Sequence
  Description of Artificial Sequence: Synthetic polypeptide
DEEEIRTTNPCATEQYGVVSTTNNLQAGNEQGTEQGSE

SEQ ID NO: 149424 - protein, 38 aa, Artificial Sequence
  Description of Artificial Sequence: Synthetic polypeptide
DEEEIRTTNPCATEQYGVVSTTNLQAGNLLQGTTEAGS

SEQ ID NO: 149425 - protein, 31 aa, Artificial Sequence
  Description of Artificial Sequence: Synthetic polypeptide
DETEIATTNPVAYEQWGSVCGTPGEDGEEDK

SEQ ID NO: 149426 - protein, 36 aa, Artificial Sequence
  Description of Artificial Sequence: Synthetic polypeptide
DEEEIRTTNPCATEQYGVVATTVNNTNLQAGTQEED

SEQ ID NO: 149427 - protein, 36 aa, Artificial Sequence
  Description of Artificial Sequence: Synthetic polypeptide
SEEEIRTTNPVATEQYGSVIDDQSNEGQEGGNENGG

SEQ ID NO: 149428 - protein, 37 aa, Artificial Sequence
  Description of Artificial Sequence: Synthetic polypeptide
SEEEIRTTNPVATEQYGSVIDGNVDDEDQRGGQTGNG

SEQ ID NO: 149429 - protein, 33 aa, Artificial Sequence
  Description of Artificial Sequence: Synthetic polypeptide
DETEIATTNPVAYEQWGSTSTNGNGNAGGNDMS

SEQ ID NO: 149430 - protein, 37 aa, Artificial Sequence
  Description of Artificial Sequence: Synthetic polypeptide
DEEEIRTTNPVATEQYGSVCSTTPAGNIENFGSQPVI

SEQ ID NO: 149431 - protein, 35 aa, Artificial Sequence
  Description of Artificial Sequence: Synthetic polypeptide
SEEEIRTTNPVATEQYGSVIDQSNSEGEGGGENGG

SEQ ID NO: 149432 - protein, 37 aa, Artificial Sequence
  Description of Artificial Sequence: Synthetic polypeptide
SEEEIRTTNPVATEQYGSVIMTNPDGQNMQNGENDGD

SEQ ID NO: 149433 - protein, 36 aa, Artificial Sequence
  Description of Artificial Sequence: Synthetic polypeptide
SEEEIRTTNPVATEQYGSVINDDNVGEGQGGNNEEF

SEQ ID NO: 149434 - protein, 37 aa, Artificial Sequence
  Description of Artificial Sequence: Synthetic polypeptide
DEEEIRTTNPVATEQYGSVNSYTTNEDDENSGQEEIS

SEQ ID NO: 149435 - protein, 34 aa, Artificial Sequence
  Description of Artificial Sequence: Synthetic polypeptide
DETEIATTNPVAYEQWGEVSTNLNQGAMGGDMSM

SEQ ID NO: 149436 - protein, 35 aa, Artificial Sequence
  Description of Artificial Sequence: Synthetic polypeptide
DEEEIRTTNPCATEQYGVVATVNNQNQQQGTEEED

SEQ ID NO: 149437 - protein, 34 aa, Artificial Sequence
  Description of Artificial Sequence: Synthetic polypeptide
DETEIATTNPVAYEQWGEVSGGNGPLQDTQGNLG

SEQ ID NO: 149438 - protein, 36 aa, Artificial Sequence
  Description of Artificial Sequence: Synthetic polypeptide
DEEEIRTTNPCATEQYGVVATVVVNGNLQAGTQEED

SEQ ID NO: 149439 - protein, 36 aa, Artificial Sequence
  Description of Artificial Sequence: Synthetic polypeptide
DEEEIRTTNPCATEQYGVVATVVVNQNLQQGTEEED

SEQ ID NO: 149440 - protein, 36 aa, Artificial Sequence
  Description of Artificial Sequence: Synthetic polypeptide
DEEEIRTTNPCATEQYGVVAVTVTNTNLQQGTDEED

SEQ ID NO: 149441 - protein, 36 aa, Artificial Sequence
  Description of Artificial Sequence: Synthetic polypeptide
DEEEIRTTNPCATEQYGVVAVTVTTTNLQAGTDEED

SEQ ID NO: 149442 - protein, 33 aa, Artificial Sequence
  Description of Artificial Sequence: Synthetic polypeptide
AESEIACTNPVAYEQYGEVASCEPNLSQRVGGS

SEQ ID NO: 149443 - protein, 36 aa, Artificial Sequence
  Description of Artificial Sequence: Synthetic polypeptide
DEEEIRTTNPCATEQYGVVAVVVNTGNLQAGTDEED

SEQ ID NO: 149444 - protein, 33 aa, Artificial Sequence
  Description of Artificial Sequence: Synthetic polypeptide
DEEEIACTNPVAYEQYGCVATNLADTGMGDEEG

SEQ ID NO: 149445 - protein, 33 aa, Artificial Sequence
  Description of Artificial Sequence: Synthetic polypeptide
DEEEIACTNPVAYEQYGCVATNLADTPMEDERG

SEQ ID NO: 149446 - protein, 37 aa, Artificial Sequence
  Description of Artificial Sequence: Synthetic polypeptide
AEEEIRTTNPVATEQYGSVSTTLQLNDNEEIGTTDDN

SEQ ID NO: 149447 - protein, 38 aa, Artificial Sequence
  Description of Artificial Sequence: Synthetic polypeptide
DEEEIRTTNPCATEQYGVVSTVNQLQAGNETGTEQGNE

SEQ ID NO: 149448 - protein, 34 aa, Artificial Sequence
  Description of Artificial Sequence: Synthetic polypeptide
DEEEIACTNPVAYEQYGSVATNNLEAEAPPDNDD

SEQ ID NO: 149449 - protein, 33 aa, Artificial Sequence
  Description of Artificial Sequence: Synthetic polypeptide
DEEEIACTNPVAYEQYGSVATNPANGAPMEGTP

SEQ ID NO: 149450 - protein, 37 aa, Artificial Sequence
  Description of Artificial Sequence: Synthetic polypeptide
AEEEIRTTNPVATEQYGSVSTTDQQGNSDEQGTNVTE

SEQ ID NO: 149451 - protein, 30 aa, Artificial Sequence
  Description of Artificial Sequence: Synthetic polypeptide
AESEIASTNPVGTEGWGVAASTNLQHGDSI

SEQ ID NO: 149452 - protein, 28 aa, Artificial Sequence
  Description of Artificial Sequence: Synthetic peptide
AESEIASTNPVGTEGWGVATSTLQHGDL

SEQ ID NO: 149453 - protein, 35 aa, Artificial Sequence
  Description of Artificial Sequence: Synthetic polypeptide
DEEEIACTNPVAYEQYGSVCAATGLAPGEQMEGNY

SEQ ID NO: 149454 - protein, 36 aa, Artificial Sequence
  Description of Artificial Sequence: Synthetic polypeptide
DETEIATTNPVATEQYGSVSSTWDAGPNMRMGGNPY

SEQ ID NO: 149455 - protein, 34 aa, Artificial Sequence
  Description of Artificial Sequence: Synthetic polypeptide
NNEEIRTTNPVATEQYGVVWVNANLQQDGGPEMI

SEQ ID NO: 149456 - protein, 34 aa, Artificial Sequence
  Description of Artificial Sequence: Synthetic polypeptide
NNEEIRTTNPVATEQYGVVWVPQNLLQDGGPEMI

SEQ ID NO: 149457 - protein, 35 aa, Artificial Sequence
  Description of Artificial Sequence: Synthetic polypeptide
NNEEIRTTNPVATEQYGVVWVTQNLQQDGGPEMII

SEQ ID NO: 149458 - protein, 33 aa, Artificial Sequence
  Description of Artificial Sequence: Synthetic polypeptide
NNEEIRTTNPVATEQYGVVWVTQNVTDGGPEMI

SEQ ID NO: 149459 - protein, 33 aa, Artificial Sequence
  Description of Artificial Sequence: Synthetic polypeptide
NNEEIRTTNPVATEQYGVVWVTQVLPDGGPEMI

SEQ ID NO: 149460 - protein, 37 aa, Artificial Sequence
  Description of Artificial Sequence: Synthetic polypeptide
DEEEIATTNPVATEQYGSVCSPVGNGLPLDSGEGNHL

SEQ ID NO: 149461 - protein, 31 aa, Artificial Sequence
  Description of Artificial Sequence: Synthetic polypeptide
DEEEIAPTNPCSSEQYGIVSTTALPNSGTPV

SEQ ID NO: 149462 - protein, 37 aa, Artificial Sequence
  Description of Artificial Sequence: Synthetic polypeptide
SEEEIRTTNPVATEQYGSVSSTTPAIGPNMRNGMNPV

SEQ ID NO: 149463 - protein, 36 aa, Artificial Sequence
  Description of Artificial Sequence: Synthetic polypeptide
DEEEIATTNPVATEQYGSVCSPVGDDLNPDAQMGQE

SEQ ID NO: 149464 - protein, 35 aa, Artificial Sequence
  Description of Artificial Sequence: Synthetic polypeptide
DETEIATTNPVATEQYGSVCSVADPNDNDGGENDH

SEQ ID NO: 149465 - protein, 31 aa, Artificial Sequence
  Description of Artificial Sequence: Synthetic polypeptide
NPEEIATTNPVAYEQWGSVAKTLEQTNGDEP

SEQ ID NO: 149466 - protein, 33 aa, Artificial Sequence
  Description of Artificial Sequence: Synthetic polypeptide
DEEEIRTTNPCAYEEWGSVAMDNDHNGGRGGNA

SEQ ID NO: 149467 - protein, 32 aa, Artificial Sequence
  Description of Artificial Sequence: Synthetic polypeptide
DEEEIRTTNPCATTQYGTVATEQYGSTTDQSE

SEQ ID NO: 149468 - protein, 33 aa, Artificial Sequence
  Description of Artificial Sequence: Synthetic polypeptide
DETEIATTNPVAYEQWGSVCSGENDQHLTNGMP

SEQ ID NO: 149469 - protein, 35 aa, Artificial Sequence
  Description of Artificial Sequence: Synthetic polypeptide
DEEEIRTTNPCATESYGSVPILTFNNHPRQVVGAP

SEQ ID NO: 149470 - protein, 34 aa, Artificial Sequence
  Description of Artificial Sequence: Synthetic polypeptide
DEEEIRTTNPCATESYGSVALTFGNHNPRQVVAP

SEQ ID NO: 149471 - protein, 36 aa, Artificial Sequence
  Description of Artificial Sequence: Synthetic polypeptide
DEEEIRTTNPCATEQYGVVSTVNQQAGTEQGTTQDQ

SEQ ID NO: 149472 - protein, 34 aa, Artificial Sequence
  Description of Artificial Sequence: Synthetic polypeptide
DETEIATTNPVATEVWGSVCYTNDLQDQGGQKDE

SEQ ID NO: 149473 - protein, 38 aa, Artificial Sequence
  Description of Artificial Sequence: Synthetic polypeptide
DEEEIRTTNPCATEQYGVVSTVNTLQAGNQQGTEEGNE

SEQ ID NO: 149474 - protein, 37 aa, Artificial Sequence
  Description of Artificial Sequence: Synthetic polypeptide
DEEEIRTTNPCATEQYGVVSTVSNNQAGTEQGTNQED

SEQ ID NO: 149475 - protein, 38 aa, Artificial Sequence
  Description of Artificial Sequence: Synthetic polypeptide
DEEEIRTTNPCATEQYGVVSTVTNNNNQQLQQGTNVAE

SEQ ID NO: 149476 - protein, 38 aa, Artificial Sequence
  Description of Artificial Sequence: Synthetic polypeptide
DEEEIRTTNPCATEQYGVVSTVVNNNLNQLQQGTNSTE

SEQ ID NO: 149477 - protein, 38 aa, Artificial Sequence
  Description of Artificial Sequence: Synthetic polypeptide
DEEEIRTTNPCATEQYGVVSTVVTTNLQQLQQGTNVEE

SEQ ID NO: 149478 - protein, 36 aa, Artificial Sequence
  Description of Artificial Sequence: Synthetic polypeptide
DEEEIRTTNPCATEQYGVVSVSNNQAGTEQGTNQDE

SEQ ID NO: 149479 - protein, 33 aa, Artificial Sequence
  Description of Artificial Sequence: Synthetic polypeptide
DETEIATTNPVATEQYGTVCAANDGPVNDDGND

SEQ ID NO: 149480 - protein, 33 aa, Artificial Sequence
  Description of Artificial Sequence: Synthetic polypeptide
DETEIATTNPVATEQYGSVWANADWEDHEGEDI

SEQ ID NO: 149481 - protein, 37 aa, Artificial Sequence
  Description of Artificial Sequence: Synthetic polypeptide
DEEEIRTTNPCATEQYGVVSVVVNNNNQLQQGTNSAE

SEQ ID NO: 149482 - protein, 38 aa, Artificial Sequence
  Description of Artificial Sequence: Synthetic polypeptide
DEEEIRTTNPCATEQYGVVSVVVTTNLQQNEQGTNVAE

SEQ ID NO: 149483 - protein, 36 aa, Artificial Sequence
  Description of Artificial Sequence: Synthetic polypeptide
SEEEIRTTNPVATEQYGSVSINLYDNQMESTQDIPN

SEQ ID NO: 149484 - protein, 38 aa, Artificial Sequence
  Description of Artificial Sequence: Synthetic polypeptide
DEEEIRTTNPCATEQYGVVSVVVTTTNQQLQQGTNVAE

SEQ ID NO: 149485 - protein, 38 aa, Artificial Sequence
  Description of Artificial Sequence: Synthetic polypeptide
DEEEIRTTNPCATEQYGVVSVVVVSNTQQLQQGTNVAE

SEQ ID NO: 149486 - protein, 28 aa, Artificial Sequence
  Description of Artificial Sequence: Synthetic peptide
QEGEIAPTNPCSTEQWGAVSADWQSGTI

SEQ ID NO: 149487 - protein, 36 aa, Artificial Sequence
  Description of Artificial Sequence: Synthetic polypeptide
SEEEIRTTNPVATEQYGSVSNTTPDGPNMGNGDDDV

SEQ ID NO: 149488 - protein, 33 aa, Artificial Sequence
  Description of Artificial Sequence: Synthetic polypeptide
DEEEIRTTNPCATESYGSVALTFEDHPRQVVAP

SEQ ID NO: 149489 - protein, 37 aa, Artificial Sequence
  Description of Artificial Sequence: Synthetic polypeptide
SEEEIRTTNPVATEQYGSVSPTNNSGLLIIQDQVDTE

SEQ ID NO: 149490 - protein, 32 aa, Artificial Sequence
  Description of Artificial Sequence: Synthetic polypeptide
AESEIAPTNPVAYEQYGETASCENLSQRVGGS

SEQ ID NO: 149491 - protein, 35 aa, Artificial Sequence
  Description of Artificial Sequence: Synthetic polypeptide
DEEEIATTNPVAYEQWGSVCSTNDLGEHPQQNDGG

SEQ ID NO: 149492 - protein, 33 aa, Artificial Sequence
  Description of Artificial Sequence: Synthetic polypeptide
DEVEIATTNPVATASWGSVSANNEPQDQGGENG

SEQ ID NO: 149493 - protein, 34 aa, Artificial Sequence
  Description of Artificial Sequence: Synthetic polypeptide
DEEEIACTNPVATEQYGSCAAGPPNPDAQAGGRI

SEQ ID NO: 149494 - protein, 36 aa, Artificial Sequence
  Description of Artificial Sequence: Synthetic polypeptide
DEDEIRTTNPVAYEQWGSVCSTDNGINLGQQGEGQN

SEQ ID NO: 149495 - protein, 36 aa, Artificial Sequence
  Description of Artificial Sequence: Synthetic polypeptide
DEVEIRTTNPVATEWYGSVSSTTPAGPNMRNGWNPV

SEQ ID NO: 149496 - protein, 37 aa, Artificial Sequence
  Description of Artificial Sequence: Synthetic polypeptide
AEEEIRTTNPVATEQYGSVSTVTENAEQGTTNVATED

SEQ ID NO: 149497 - protein, 36 aa, Artificial Sequence
  Description of Artificial Sequence: Synthetic polypeptide
DEDEIRTTNPVAYEQWGSVCSTDNGIGTGQGGMGRN

SEQ ID NO: 149498 - protein, 30 aa, Artificial Sequence
  Description of Artificial Sequence: Synthetic polypeptide
QENEIASTNPVSTECYGNVSANCIQSREQL

SEQ ID NO: 149499 - protein, 34 aa, Artificial Sequence
  Description of Artificial Sequence: Synthetic polypeptide
DEVEIRTTNPVATESYGSVIDVGNNGQGEGQGQE

SEQ ID NO: 149500 - protein, 36 aa, Artificial Sequence
  Description of Artificial Sequence: Synthetic polypeptide
AEEEIRTTNPVATEQYGSVSTVTDQYGSEEGTTEDD

SEQ ID NO: 149501 - protein, 35 aa, Artificial Sequence
  Description of Artificial Sequence: Synthetic polypeptide
DEVEIRTTNPVATESYGSVIDDTGNNGQGEGGGQE

SEQ ID NO: 149502 - protein, 36 aa, Artificial Sequence
  Description of Artificial Sequence: Synthetic polypeptide
DEDEIRTTNPVAYEQWGSVCSTDNGINTGQQGMGER

SEQ ID NO: 149503 - protein, 37 aa, Artificial Sequence
  Description of Artificial Sequence: Synthetic polypeptide
AEEEIRTTNPVATEQYGSVSTVTDQQNGNEQGTEDED

SEQ ID NO: 149504 - protein, 37 aa, Artificial Sequence
  Description of Artificial Sequence: Synthetic polypeptide
AEEEIRTTNPVATEQYGSVSTVTDQNNGNLQGTEDEE

SEQ ID NO: 149505 - protein, 34 aa, Artificial Sequence
  Description of Artificial Sequence: Synthetic polypeptide
DEVEIRTTNPVATEQYGVVTTMGDTGEGGGENGE

SEQ ID NO: 149506 - protein, 35 aa, Artificial Sequence
  Description of Artificial Sequence: Synthetic polypeptide
DEEEIRGTNPVATEQWGTSDVVGDQLIRGGGNDGQ

SEQ ID NO: 149507 - protein, 28 aa, Artificial Sequence
  Description of Artificial Sequence: Synthetic peptide
QENEIASTNPVSTECYGDVAECLQHEEL

SEQ ID NO: 149508 - protein, 33 aa, Artificial Sequence
  Description of Artificial Sequence: Synthetic polypeptide
DEEEIATTNPVAYEQYGSVATAGTPTANNDDEA

SEQ ID NO: 149509 - protein, 35 aa, Artificial Sequence
  Description of Artificial Sequence: Synthetic polypeptide
DEEEIATTNPVAYEQYGSVANTNAGTPTANNDERE

SEQ ID NO: 149510 - protein, 31 aa, Artificial Sequence
  Description of Artificial Sequence: Synthetic polypeptide
SEEEIASVNPVCTEQYGCVCSWELQSFGDQS

SEQ ID NO: 149511 - protein, 32 aa, Artificial Sequence
  Description of Artificial Sequence: Synthetic polypeptide
SEEEIASVNPVCTEQYGCVCSWGNHQSFGSNQ

SEQ ID NO: 149512 - protein, 35 aa, Artificial Sequence
  Description of Artificial Sequence: Synthetic polypeptide
DEEEIRTTNPVATEQYGSVSPTLEEATIPFTEEQD

SEQ ID NO: 149513 - protein, 37 aa, Artificial Sequence
  Description of Artificial Sequence: Synthetic polypeptide
DEEEIRTTNPVATEQYGSVSPTLAMMMQPEYNEEEVN

SEQ ID NO: 149514 - protein, 35 aa, Artificial Sequence
  Description of Artificial Sequence: Synthetic polypeptide
DEVEIRTTNPVAYEQWGSVCSTTNGNDNHQGDNVM

SEQ ID NO: 149515 - protein, 37 aa, Artificial Sequence
  Description of Artificial Sequence: Synthetic polypeptide
DEEEIRTTNPVATEQYGSVSPTLAMMMQEEQNEEEVI

SEQ ID NO: 149516 - protein, 32 aa, Artificial Sequence
  Description of Artificial Sequence: Synthetic polypeptide
NEDEIATTNPVAYEQWGSVRWWNQDDQTGNHP

SEQ ID NO: 149517 - protein, 28 aa, Artificial Sequence
  Description of Artificial Sequence: Synthetic peptide
QENEIASVNPVCTECYGVVSECLQHEEQ

SEQ ID NO: 149518 - protein, 38 aa, Artificial Sequence
  Description of Artificial Sequence: Synthetic polypeptide
AEEEIRTTNPVATEQYGSVSTVTLQLNGNEEIGTTEDE

SEQ ID NO: 149519 - protein, 37 aa, Artificial Sequence
  Description of Artificial Sequence: Synthetic polypeptide
AEEEIRTTNPVATEQYGSVSTVTLQLNDNEEIGTTDD

SEQ ID NO: 149520 - protein, 32 aa, Artificial Sequence
  Description of Artificial Sequence: Synthetic polypeptide
AENEIACTNPVATEQYGEAYCENLHDGRGDGR

SEQ ID NO: 149521 - protein, 37 aa, Artificial Sequence
  Description of Artificial Sequence: Synthetic polypeptide
DEEEIRTTNPVATEQYGSVQSITQYLQPMQESVEFED

SEQ ID NO: 149522 - protein, 37 aa, Artificial Sequence
  Description of Artificial Sequence: Synthetic polypeptide
AEEEIRTTNPVATEQYGSVSTVTGTNLEQGTTQQQED

SEQ ID NO: 149523 - protein, 37 aa, Artificial Sequence
  Description of Artificial Sequence: Synthetic polypeptide
AEEEIRTTNPVATEQYGSVSTVTGNVEQGTNNVTDEQ

SEQ ID NO: 149524 - protein, 33 aa, Artificial Sequence
  Description of Artificial Sequence: Synthetic polypeptide
DEEEIATTNPVAYEQYGSVATAGTPTANNDEDG

SEQ ID NO: 149525 - protein, 36 aa, Artificial Sequence
  Description of Artificial Sequence: Synthetic polypeptide
DEEEIRGTNPVATEQWGQSVNSNTLGIERGGGNEDG

SEQ ID NO: 149526 - protein, 35 aa, Artificial Sequence
  Description of Artificial Sequence: Synthetic polypeptide
DEEEIRGTNPVATEQWGQSVSNTLGIETGGGNEDI

SEQ ID NO: 149527 - protein, 29 aa, Artificial Sequence
  Description of Artificial Sequence: Synthetic peptide
QENEIASTNPVSTEGYGTMASTLQQHGDI

SEQ ID NO: 149528 - protein, 37 aa, Artificial Sequence
  Description of Artificial Sequence: Synthetic polypeptide
AEEEIRTTNPVATEQYGSVSTVTGNDEQGSTEQGTDT

SEQ ID NO: 149529 - protein, 29 aa, Artificial Sequence
  Description of Artificial Sequence: Synthetic peptide
QENEIASTNPVSTEGYGTMASTLQHNGDI

SEQ ID NO: 149530 - protein, 37 aa, Artificial Sequence
  Description of Artificial Sequence: Synthetic polypeptide
DEEEIRTTNPVATEQYGQSVEFSNLVMEMQPQNEEVF

SEQ ID NO: 149531 - protein, 36 aa, Artificial Sequence
  Description of Artificial Sequence: Synthetic polypeptide
DEDEIRTTNPVAYEQWGSVCSTDNGINTGQQGNGPN

SEQ ID NO: 149532 - protein, 37 aa, Artificial Sequence
  Description of Artificial Sequence: Synthetic polypeptide
AEEEIRTTNPVATEQYGSVSTVTENQQGSETGTTEDD

SEQ ID NO: 149533 - protein, 37 aa, Artificial Sequence
  Description of Artificial Sequence: Synthetic polypeptide
AEEEIRTTNPVATEQYGSVSTVTENQGNSEQGNNTTD

SEQ ID NO: 149534 - protein, 36 aa, Artificial Sequence
  Description of Artificial Sequence: Synthetic polypeptide
DEEEIRTTNPVATEQYGSVSPTITVMEFEQQPEAYT

SEQ ID NO: 149535 - protein, 34 aa, Artificial Sequence
  Description of Artificial Sequence: Synthetic polypeptide
DEEEIACTNPVATEQYGCVATNLTAEDPIEDENP

SEQ ID NO: 149536 - protein, 33 aa, Artificial Sequence
  Description of Artificial Sequence: Synthetic polypeptide
DEEEIATTNPVAYEQYGSVATAGTPTDNNDEAM

SEQ ID NO: 149537 - protein, 32 aa, Artificial Sequence
  Description of Artificial Sequence: Synthetic polypeptide
SEEEIASVNPVCTEQYGQVVCSSNLQSFGSQQ

SEQ ID NO: 149538 - protein, 37 aa, Artificial Sequence
  Description of Artificial Sequence: Synthetic polypeptide
AEEEIRTTNPVATEQYGSVSTVTANQSTTEQGSTNEG

SEQ ID NO: 149539 - protein, 35 aa, Artificial Sequence
  Description of Artificial Sequence: Synthetic polypeptide
DEEEIRTTNPVATEQYGSVQPWMNHEEREMIDVDL

SEQ ID NO: 149540 - protein, 37 aa, Artificial Sequence
  Description of Artificial Sequence: Synthetic polypeptide
AEEEIRTTNPVATEQYGVVSTTLGQAGNTEAGTNQDE

SEQ ID NO: 149541 - protein, 35 aa, Artificial Sequence
  Description of Artificial Sequence: Synthetic polypeptide
DEDEIRTTNPVAYEQWGSVCSQTENDMGDTQNGGA

SEQ ID NO: 149542 - protein, 31 aa, Artificial Sequence
  Description of Artificial Sequence: Synthetic polypeptide
AENEIACTNPVATEQYGEISENIQQQQNGGH

SEQ ID NO: 149543 - protein, 38 aa, Artificial Sequence
  Description of Artificial Sequence: Synthetic polypeptide
AEEEIRTTNPVATEQYGSVSTVSTNNQQGNQQGNNEGE

SEQ ID NO: 149544 - protein, 34 aa, Artificial Sequence
  Description of Artificial Sequence: Synthetic polypeptide
DEDEIRTTNPVAYEQWGSVCSNENDQGDTQNGSA

SEQ ID NO: 149545 - protein, 38 aa, Artificial Sequence
  Description of Artificial Sequence: Synthetic polypeptide
AEEEIRTTNPVATEQYGSVSTVSTNNQAGNQQGNQEGD

SEQ ID NO: 149546 - protein, 37 aa, Artificial Sequence
  Description of Artificial Sequence: Synthetic polypeptide
AEEEIRTTNPVATEQYGVVSTTGNQQQGNNNNDESED

SEQ ID NO: 149547 - protein, 36 aa, Artificial Sequence
  Description of Artificial Sequence: Synthetic polypeptide
DEEEIRTTNPVATEQYGSVQPWMNTHIVRANIDVDL

SEQ ID NO: 149548 - protein, 36 aa, Artificial Sequence
  Description of Artificial Sequence: Synthetic polypeptide
DEEEIRGTNPVATEQYGSVCTEYSGEIEESMGMNRL

SEQ ID NO: 149549 - protein, 37 aa, Artificial Sequence
  Description of Artificial Sequence: Synthetic polypeptide
AEEEIRTTNPVATEQYGVVSTTENNNQQGTNNNNQLN

SEQ ID NO: 149550 - protein, 36 aa, Artificial Sequence
  Description of Artificial Sequence: Synthetic polypeptide
AEEEIRTTNPVATEQYGVVSTTDQQGNSEQGTNVDE

SEQ ID NO: 149551 - protein, 36 aa, Artificial Sequence
  Description of Artificial Sequence: Synthetic polypeptide
DEEEIRTTNPVATEQYGSVQPVMNNDEQVIMPVNEV

SEQ ID NO: 149552 - protein, 35 aa, Artificial Sequence
  Description of Artificial Sequence: Synthetic polypeptide
DEEEIRGTNPVATEQYGSVGDDVNNSGMEGNEQGQ

SEQ ID NO: 149553 - protein, 36 aa, Artificial Sequence
  Description of Artificial Sequence: Synthetic polypeptide
DEEEIRGTNPVATEQYGSVGNFNLEDQEEEGGGDEG

SEQ ID NO: 149554 - protein, 33 aa, Artificial Sequence
  Description of Artificial Sequence: Synthetic polypeptide
DEDEIRTTNPVAYEQWGSVCSNEDQGDTQNGGA

SEQ ID NO: 149555 - protein, 36 aa, Artificial Sequence
  Description of Artificial Sequence: Synthetic polypeptide
DEEEIRGTNPVATEQYGSVISTTPDGPNMDNGEFDD

SEQ ID NO: 149556 - protein, 34 aa, Artificial Sequence
  Description of Artificial Sequence: Synthetic polypeptide
DEEEIACTNPVATEQYGCVATPHGLTGSGEENND

SEQ ID NO: 149557 - protein, 37 aa, Artificial Sequence
  Description of Artificial Sequence: Synthetic polypeptide
AEEEIRTTNPVATEQYGVVSTTENQQAGNQQGNQEED

SEQ ID NO: 149558 - protein, 36 aa, Artificial Sequence
  Description of Artificial Sequence: Synthetic polypeptide
AEEEIRTTNPVATEQYGVVSTTLQLNDNEEIGTTDD

SEQ ID NO: 149559 - protein, 28 aa, Artificial Sequence
  Description of Artificial Sequence: Synthetic peptide
QENEIASTNPVGTECYGDVASCLQHEEL

SEQ ID NO: 149560 - protein, 34 aa, Artificial Sequence
  Description of Artificial Sequence: Synthetic polypeptide
DEEEIRGTNPVATEQYGNVLMTVGCVEVAGENQP

SEQ ID NO: 149561 - protein, 28 aa, Artificial Sequence
  Description of Artificial Sequence: Synthetic peptide
QENEIASTNPVGTEGYGVVAETLQHEDL

SEQ ID NO: 149562 - protein, 36 aa, Artificial Sequence
  Description of Artificial Sequence: Synthetic polypeptide
DEDEIRTTNPVAYEQWGSVCSTDNDINGGQQGMGRN

SEQ ID NO: 149563 - protein, 31 aa, Artificial Sequence
  Description of Artificial Sequence: Synthetic polypeptide
SEEEIASVNPVCTEQYGVVCSWELQSISNQS

SEQ ID NO: 149564 - protein, 37 aa, Artificial Sequence
  Description of Artificial Sequence: Synthetic polypeptide
DEVEIRTTNPVATEQYGSVYSDMDNEGGQGGEIENEE

SEQ ID NO: 149565 - protein, 31 aa, Artificial Sequence
  Description of Artificial Sequence: Synthetic polypeptide
SEEEIASVNPVCTEQYGVVCSWEPQSSGSNQ

SEQ ID NO: 149566 - protein, 28 aa, Artificial Sequence
  Description of Artificial Sequence: Synthetic peptide
QENEIASTNPVGTEGYGVMASTLEIGDI

SEQ ID NO: 149567 - protein, 37 aa, Artificial Sequence
  Description of Artificial Sequence: Synthetic polypeptide
AEEEIRTTNPVATEQYGVVSTTLQQGNTEQGTMEEAD

SEQ ID NO: 149568 - protein, 35 aa, Artificial Sequence
  Description of Artificial Sequence: Synthetic polypeptide
DEVEIRTTNPVATEQYGSVVNSVGNNGEFTNTGQE

SEQ ID NO: 149569 - protein, 39 aa, Artificial Sequence
  Description of Artificial Sequence: Synthetic polypeptide
AEEEIRTTNPVATEQYGSVSTVTANLQNGNTEQGNNAVE

SEQ ID NO: 149570 - protein, 35 aa, Artificial Sequence
  Description of Artificial Sequence: Synthetic polypeptide
DEVEIRTTNPVATEQYGSVVNSVGNGEFTNDEGQG

SEQ ID NO: 149571 - protein, 29 aa, Artificial Sequence
  Description of Artificial Sequence: Synthetic peptide
QENEIASTNPVGTEGYGVMASETLQHGDI

SEQ ID NO: 149572 - protein, 35 aa, Artificial Sequence
  Description of Artificial Sequence: Synthetic polypeptide
DEVEIRTTNPVATEQYGSVVNNVGSGEFTNQGQGQ

SEQ ID NO: 149573 - protein, 35 aa, Artificial Sequence
  Description of Artificial Sequence: Synthetic polypeptide
DEVEIRTTNPVATEQYGSVVNNVGNGEFTNQGEGY

SEQ ID NO: 149574 - protein, 28 aa, Artificial Sequence
  Description of Artificial Sequence: Synthetic peptide
QENEIASTNPVGTEGYGVMAETLQHGDI

SEQ ID NO: 149575 - protein, 29 aa, Artificial Sequence
  Description of Artificial Sequence: Synthetic peptide
QENEIASTNPVGTEGYGTMASETLQHGDI

SEQ ID NO: 149576 - protein, 28 aa, Artificial Sequence
  Description of Artificial Sequence: Synthetic peptide
QENEIASTNPVGTECYGVVASCLQHEEL

SEQ ID NO: 149577 - protein, 28 aa, Artificial Sequence
  Description of Artificial Sequence: Synthetic peptide
QENEIASTNPVGTECYGVVAETLQHEDL

SEQ ID NO: 149578 - protein, 28 aa, Artificial Sequence
  Description of Artificial Sequence: Synthetic peptide
QENEIASTNPVGTECYGVMASTLQHEEI

SEQ ID NO: 149579 - protein, 36 aa, Artificial Sequence
  Description of Artificial Sequence: Synthetic polypeptide
DEVEIRTTNPVATEQYGSVVDTDNQEGQDEQGGEIA

SEQ ID NO: 149580 - protein, 37 aa, Artificial Sequence
  Description of Artificial Sequence: Synthetic polypeptide
DEDEIRTTNPVAYEQWGSVCSTDNGGHTGQQGGNHRN

SEQ ID NO: 149581 - protein, 32 aa, Artificial Sequence
  Description of Artificial Sequence: Synthetic polypeptide
DEVEIRTTNPVSTEPYGTISMEDIQQQQNGNH

SEQ ID NO: 149582 - protein, 37 aa, Artificial Sequence
  Description of Artificial Sequence: Synthetic polypeptide
DEEEIRTTNPVATEQYGQSVSSTTPAGPNMRNGMSPV

SEQ ID NO: 149583 - protein, 34 aa, Artificial Sequence
  Description of Artificial Sequence: Synthetic polypeptide
DEEEIRGTNPVATEQWGDVVTGGQLINGGGNDGQ

SEQ ID NO: 149584 - protein, 30 aa, Artificial Sequence
  Description of Artificial Sequence: Synthetic polypeptide
QENEIATTNPVATECWGDVSCICLQHEEEG

SEQ ID NO: 149585 - protein, 34 aa, Artificial Sequence
  Description of Artificial Sequence: Synthetic polypeptide
DEWEIVTTNPVATEQYGTVCSATDGAPVEFEGND

SEQ ID NO: 149586 - protein, 31 aa, Artificial Sequence
  Description of Artificial Sequence: Synthetic polypeptide
QENEIATTNPVATECWGDVSCICLPQREEEG

SEQ ID NO: 149587 - protein, 32 aa, Artificial Sequence
  Description of Artificial Sequence: Synthetic polypeptide
DEWEIRTTNPVSTEPYGTISMEDIQQQQNGNH

SEQ ID NO: 149588 - protein, 35 aa, Artificial Sequence
  Description of Artificial Sequence: Synthetic polypeptide
DEEEIRTTNPVATEQYGQWVVCTRASSNNGGNNET

SEQ ID NO: 149589 - protein, 37 aa, Artificial Sequence
  Description of Artificial Sequence: Synthetic polypeptide
DEEEIRTTNPVATEQYGSVQSSMNLGLEWENLQNEDI

SEQ ID NO: 149590 - protein, 36 aa, Artificial Sequence
  Description of Artificial Sequence: Synthetic polypeptide
DEEEIRTTNPVATEQYGSVQSSLSIMIETVEQSDRD

SEQ ID NO: 149591 - protein, 37 aa, Artificial Sequence
  Description of Artificial Sequence: Synthetic polypeptide
DEEEIRTTNPVATEQYGSVQSSHNLGLELENLQLNDP

SEQ ID NO: 149592 - protein, 33 aa, Artificial Sequence
  Description of Artificial Sequence: Synthetic polypeptide
DEWEIVTTNPVATEQYGTVCSATDGPVEFEGVD

SEQ ID NO: 149593 - protein, 36 aa, Artificial Sequence
  Description of Artificial Sequence: Synthetic polypeptide
DEEEIRTTNPVATEQYGSVCCMLAMNLEPAQDEMID

SEQ ID NO: 149594 - protein, 38 aa, Artificial Sequence
  Description of Artificial Sequence: Synthetic polypeptide
DEEEIRTTNPVATEQYGSVQSPTQEALQPMLEGVEFDD

SEQ ID NO: 149595 - protein, 31 aa, Artificial Sequence
  Description of Artificial Sequence: Synthetic polypeptide
QENEIATTNPVATEAYGCVCSWELQHLSELA

SEQ ID NO: 149596 - protein, 36 aa, Artificial Sequence
  Description of Artificial Sequence: Synthetic polypeptide
DEEEIRTTNPVATEQYGSVQSPTATLPMEAESEMQV

SEQ ID NO: 149597 - protein, 30 aa, Artificial Sequence
  Description of Artificial Sequence: Synthetic polypeptide
QENEIATTNPVATEAYGCVCSWEHQHFIEL

SEQ ID NO: 149598 - protein, 36 aa, Artificial Sequence
  Description of Artificial Sequence: Synthetic polypeptide
DEWEIRTTNPVATEQYGQVSSTTPAGPNMRNGMNPV

SEQ ID NO: 149599 - protein, 30 aa, Artificial Sequence
  Description of Artificial Sequence: Synthetic polypeptide
QENEIATTNPVATEAYGCVCSWEDQHISEL

SEQ ID NO: 149600 - protein, 31 aa, Artificial Sequence
  Description of Artificial Sequence: Synthetic polypeptide
DEWEIRTTNPVATEQWGDRVSEIEMNAAEDA

SEQ ID NO: 149601 - protein, 31 aa, Artificial Sequence
  Description of Artificial Sequence: Synthetic polypeptide
DEWEIRTTNPVATEQWGDMVSEIEMNAAEDA

SEQ ID NO: 149602 - protein, 37 aa, Artificial Sequence
  Description of Artificial Sequence: Synthetic polypeptide
DEEEIRTTNPVATEQYGSVQSPTQYDQPMLETVENED

SEQ ID NO: 149603 - protein, 33 aa, Artificial Sequence
  Description of Artificial Sequence: Synthetic polypeptide
DEWEIVTTNPVATEQYGTVSSATDGPHEFEGRD

SEQ ID NO: 149604 - protein, 33 aa, Artificial Sequence
  Description of Artificial Sequence: Synthetic polypeptide
NEAEIRTTNPVAYEQWGSVCVTWDQDGQDHGNM

SEQ ID NO: 149605 - protein, 35 aa, Artificial Sequence
  Description of Artificial Sequence: Synthetic polypeptide
DEDEIRTTNPVAYEQWGSVCSTENDRQGDTQNGMA

SEQ ID NO: 149606 - protein, 33 aa, Artificial Sequence
  Description of Artificial Sequence: Synthetic polypeptide
NEAEIRTTNPVAYEQWGCTVSGDNGNHQNGQNP

SEQ ID NO: 149607 - protein, 34 aa, Artificial Sequence
  Description of Artificial Sequence: Synthetic polypeptide
DEDEIRTTNPVAYEQWGSVCSTEPDMGDTQNGMA

SEQ ID NO: 149608 - protein, 36 aa, Artificial Sequence
  Description of Artificial Sequence: Synthetic polypeptide
DEEEIRTTNPVATEQYGSAAEPTQPGGLQVQENIVV

SEQ ID NO: 149609 - protein, 35 aa, Artificial Sequence
  Description of Artificial Sequence: Synthetic polypeptide
DEDEIRTTNPVAYEQWGSVCSTENVDQNDTQNGGG

SEQ ID NO: 149610 - protein, 33 aa, Artificial Sequence
  Description of Artificial Sequence: Synthetic polypeptide
DEYEICTVNPVAYERYGKVSTNELSTEFVGNNL

SEQ ID NO: 149611 - protein, 36 aa, Artificial Sequence
  Description of Artificial Sequence: Synthetic polypeptide
DEDEIRTTNPVAYEQWGSVCSTENQGLTGDTQNGGA

SEQ ID NO: 149612 - protein, 36 aa, Artificial Sequence
  Description of Artificial Sequence: Synthetic polypeptide
DEDEIRTTNPVAYEQWGSVCSTENNDQRNDTQNGAE

SEQ ID NO: 149613 - protein, 30 aa, Artificial Sequence
  Description of Artificial Sequence: Synthetic polypeptide
QENEIATTNPVATECWGDVSECLQNAAEDL

SEQ ID NO: 149614 - protein, 36 aa, Artificial Sequence
  Description of Artificial Sequence: Synthetic polypeptide
DEDEIRTTNPVAYEQWGSVCSTENLLDQDINGGGDQ

SEQ ID NO: 149615 - protein, 36 aa, Artificial Sequence
  Description of Artificial Sequence: Synthetic polypeptide
DEDEIRTTNPVAYEQWGSVCSTENLGDQDIQGEGDQ

SEQ ID NO: 149616 - protein, 36 aa, Artificial Sequence
  Description of Artificial Sequence: Synthetic polypeptide
DEEEIRTTNPVATEQYGSAAENLCQQHIQNVEENEQ

SEQ ID NO: 149617 - protein, 32 aa, Artificial Sequence
  Description of Artificial Sequence: Synthetic polypeptide
DEYEIATTNPVAYMQWGVVPTWENDQDQGNDS

SEQ ID NO: 149618 - protein, 36 aa, Artificial Sequence
  Description of Artificial Sequence: Synthetic polypeptide
DEDEIRTTNPVAYEQWGSVCSTENLDQQNDTQNGQQ

SEQ ID NO: 149619 - protein, 36 aa, Artificial Sequence
  Description of Artificial Sequence: Synthetic polypeptide
DEDEIRTTNPVAYEQWGSVCSTENHDQRNDTQGGAQ

SEQ ID NO: 149620 - protein, 37 aa, Artificial Sequence
  Description of Artificial Sequence: Synthetic polypeptide
DEEEIRTTNPVATEQYGSAAENLCNQQWIQNGEENEQ

SEQ ID NO: 149621 - protein, 37 aa, Artificial Sequence
  Description of Artificial Sequence: Synthetic polypeptide
DEEEIRTTNPVATEQYGSAAENLCNQHIFNSGEENEQ

SEQ ID NO: 149622 - protein, 36 aa, Artificial Sequence
  Description of Artificial Sequence: Synthetic polypeptide
DEDEIRTTNPVAYEQWGSVCSTENGQQRNDTQNGDA

SEQ ID NO: 149623 - protein, 37 aa, Artificial Sequence
  Description of Artificial Sequence: Synthetic polypeptide
DEEEIRTTNPVATEQYGRVYSPTVMIGPNMANGMNPV

SEQ ID NO: 149624 - protein, 35 aa, Artificial Sequence
  Description of Artificial Sequence: Synthetic polypeptide
DEDEIRTTNPVAYEQWGSVCSTENEDQNDTQNNGA

SEQ ID NO: 149625 - protein, 36 aa, Artificial Sequence
  Description of Artificial Sequence: Synthetic polypeptide
DEWEIRTTNPVATECYGSVSSTTPAGPNMRNGMNPV

SEQ ID NO: 149626 - protein, 36 aa, Artificial Sequence
  Description of Artificial Sequence: Synthetic polypeptide
DEEEIRTTNPVATEQYGSVCCTTANMEAAEDENLPP

SEQ ID NO: 149627 - protein, 30 aa, Artificial Sequence
  Description of Artificial Sequence: Synthetic polypeptide
DEWEIRTTNPTATEQWGDVSEIEMNAAEDA

SEQ ID NO: 149628 - protein, 36 aa, Artificial Sequence
  Description of Artificial Sequence: Synthetic polypeptide
DEDEIRTTNPVAYEQWGSVCSTENDGEREDTQRGSQ

SEQ ID NO: 149629 - protein, 34 aa, Artificial Sequence
  Description of Artificial Sequence: Synthetic polypeptide
DEEEIRTTNPVATEQYGSVCMPEPEDNMGGQSID

SEQ ID NO: 149630 - protein, 32 aa, Artificial Sequence
  Description of Artificial Sequence: Synthetic polypeptide
SEEEIACTNPVATEQYGSVCAANNLHDSLDHL

SEQ ID NO: 149631 - protein, 33 aa, Artificial Sequence
  Description of Artificial Sequence: Synthetic polypeptide
SEEEIACTNPVATEQYGSVCAATNNLHDSLDAL

SEQ ID NO: 149632 - protein, 37 aa, Artificial Sequence
  Description of Artificial Sequence: Synthetic polypeptide
DEEEIRTTNPVATEQYGSVQSPANVVIQQQNMVNTEQ

SEQ ID NO: 149633 - protein, 33 aa, Artificial Sequence
  Description of Artificial Sequence: Synthetic polypeptide
SEEEIACTNPVATEQYGSVCATNNLHDSLDEHQ

SEQ ID NO: 149634 - protein, 35 aa, Artificial Sequence
  Description of Artificial Sequence: Synthetic polypeptide
DEEEIRTTNPVATEQYGSVCMPESLQQHFPEAIEF

SEQ ID NO: 149635 - protein, 33 aa, Artificial Sequence
  Description of Artificial Sequence: Synthetic polypeptide
DEVEITTTNPVATEQYGVVVAANAGMEGGGNQG

SEQ ID NO: 149636 - protein, 35 aa, Artificial Sequence
  Description of Artificial Sequence: Synthetic polypeptide
DEEEIRTTNPVATEQYGSVCMPESLQQMDPVEIEK

SEQ ID NO: 149637 - protein, 35 aa, Artificial Sequence
  Description of Artificial Sequence: Synthetic polypeptide
DEEEIRTTNPVATEQYGSVQSPAITLPMEESEMQL

SEQ ID NO: 149638 - protein, 34 aa, Artificial Sequence
  Description of Artificial Sequence: Synthetic polypeptide
SEEEIACTNPVATEQYGSVCATNPQLGHDSLDHQ

SEQ ID NO: 149639 - protein, 37 aa, Artificial Sequence
  Description of Artificial Sequence: Synthetic polypeptide
DEEEIRTTNPVATEQYGSVCMTSEVLTDTQTNVEENA

SEQ ID NO: 149640 - protein, 37 aa, Artificial Sequence
  Description of Artificial Sequence: Synthetic polypeptide
DEEEIRTTNPVATEQYGSVSPTGVPTSIVRVTNGPQL

SEQ ID NO: 149641 - protein, 36 aa, Artificial Sequence
  Description of Artificial Sequence: Synthetic polypeptide
DEEEIRTTNPVATEQYGSVCNNEVELEVLDNDNTQD

SEQ ID NO: 149642 - protein, 34 aa, Artificial Sequence
  Description of Artificial Sequence: Synthetic polypeptide
DEEEIRGTNPVATEQWGAVVAGGQLIRGGGNDGG

SEQ ID NO: 149643 - protein, 38 aa, Artificial Sequence
  Description of Artificial Sequence: Synthetic polypeptide
AEEEIRTTNPVATEQYGSVSTVTNDQLGNVEQGTNDED

SEQ ID NO: 149644 - protein, 34 aa, Artificial Sequence
  Description of Artificial Sequence: Synthetic polypeptide
NEDEIATTNPVATEQYGCVCTIEGQDQHGQNDHR

SEQ ID NO: 149645 - protein, 36 aa, Artificial Sequence
  Description of Artificial Sequence: Synthetic polypeptide
DEDEIRTTNPVAYEQWGSVCSTDNLLDQDPGGGDQN

SEQ ID NO: 149646 - protein, 37 aa, Artificial Sequence
  Description of Artificial Sequence: Synthetic polypeptide
AEEEIRTTNPVATEQYGVVSTTNLNLQQNANQQGTDE

SEQ ID NO: 149647 - protein, 32 aa, Artificial Sequence
  Description of Artificial Sequence: Synthetic polypeptide
DEVEIRTTNPVSTEPYGTISMPDIQQQQNGNH

SEQ ID NO: 149648 - protein, 35 aa, Artificial Sequence
  Description of Artificial Sequence: Synthetic polypeptide
DEEEIRGTNPVATEGWGVSVNSGGQLIRGGGNDGQ

SEQ ID NO: 149649 - protein, 37 aa, Artificial Sequence
  Description of Artificial Sequence: Synthetic polypeptide
DEEEIRGTNPVATEQYGSVMQTNQGQNVEMGMNGQGG

SEQ ID NO: 149650 - protein, 38 aa, Artificial Sequence
  Description of Artificial Sequence: Synthetic polypeptide
AEEEIRTTNPVATEQYGSVSTVTNGNLGGTEQGTTQNQ

SEQ ID NO: 149651 - protein, 38 aa, Artificial Sequence
  Description of Artificial Sequence: Synthetic polypeptide
AEEEIRTTNPVATEQYGSVSTVTNGNQAGTEQGTNQNQ

SEQ ID NO: 149652 - protein, 37 aa, Artificial Sequence
  Description of Artificial Sequence: Synthetic polypeptide
DEEEIRTTNPVATEQYGSVQSPLQMLQPMLEGVEFED

SEQ ID NO: 149653 - protein, 35 aa, Artificial Sequence
  Description of Artificial Sequence: Synthetic polypeptide
DEDEIRTTNPVAYEQWGSVCSTELHDQNDTQNGGA

SEQ ID NO: 149654 - protein, 34 aa, Artificial Sequence
  Description of Artificial Sequence: Synthetic polypeptide
DEDEIRTTNPVAYEQWGSVCSTEIDQGHTQNGGA

SEQ ID NO: 149655 - protein, 35 aa, Artificial Sequence
  Description of Artificial Sequence: Synthetic polypeptide
DEEEIRTTNPVATEQYGSVCEMPESLQQHPVEVEG

SEQ ID NO: 149656 - protein, 36 aa, Artificial Sequence
  Description of Artificial Sequence: Synthetic polypeptide
DEEEIRTTNPVATEQYGSVCEVTQTGLEELVGTEIE

SEQ ID NO: 149657 - protein, 35 aa, Artificial Sequence
  Description of Artificial Sequence: Synthetic polypeptide
DEDEIRTTNPVAYEQWGSVCSTDNQRDQDIEGGDD

SEQ ID NO: 149658 - protein, 33 aa, Artificial Sequence
  Description of Artificial Sequence: Synthetic polypeptide
NEAEISTTNPVAYEQWGSTSTNNNQGDQGQNDA

SEQ ID NO: 149659 - protein, 32 aa, Artificial Sequence
  Description of Artificial Sequence: Synthetic polypeptide
NEAEISTTNPVAYEQWGSVAKTLEQTNGDGQR

SEQ ID NO: 149660 - protein, 30 aa, Artificial Sequence
  Description of Artificial Sequence: Synthetic polypeptide
QENEIATTNPVASEQWGDVSEIEMNAAGDR

SEQ ID NO: 149661 - protein, 36 aa, Artificial Sequence
  Description of Artificial Sequence: Synthetic polypeptide
DEEEIRGTNPVATEAYGSVSITMDTNGEDEGQGGEG

SEQ ID NO: 149662 - protein, 30 aa, Artificial Sequence
  Description of Artificial Sequence: Synthetic polypeptide
QENEIATTNPVASEQWGDVSCIEMNAAGDR

SEQ ID NO: 149663 - protein, 34 aa, Artificial Sequence
  Description of Artificial Sequence: Synthetic polypeptide
DEDEIRTTNPVAYEQWGSVCSTDNNDHHNGTGDW

SEQ ID NO: 149664 - protein, 35 aa, Artificial Sequence
  Description of Artificial Sequence: Synthetic polypeptide
DEEEIRGTNPVATEAYGSVSITVDTGEDEGQGGET

SEQ ID NO: 149665 - protein, 35 aa, Artificial Sequence
  Description of Artificial Sequence: Synthetic polypeptide
DEDEIRTTNPVAYEQWGSVCSTDNMNDQDIEGGDQ

SEQ ID NO: 149666 - protein, 33 aa, Artificial Sequence
  Description of Artificial Sequence: Synthetic polypeptide
DEVNEIATTNPVAYEGWGSVATNEQGNDMGGSR

SEQ ID NO: 149667 - protein, 35 aa, Artificial Sequence
  Description of Artificial Sequence: Synthetic polypeptide
DEEEIRTTNPVATEQYGSVQSPIMFAEEITGDLGL

SEQ ID NO: 149668 - protein, 36 aa, Artificial Sequence
  Description of Artificial Sequence: Synthetic polypeptide
DEEEIRGTNPVATECYGSVSTEMDNNGQGEGQTGDE

SEQ ID NO: 149669 - protein, 34 aa, Artificial Sequence
  Description of Artificial Sequence: Synthetic polypeptide
DEVEIVTTNPVATEQYGVVVSATDGEEEGEGQND

SEQ ID NO: 149670 - protein, 34 aa, Artificial Sequence
  Description of Artificial Sequence: Synthetic polypeptide
DEVEIVTTNPVATEQYGTVVSATDGDDEEGGGND

SEQ ID NO: 149671 - protein, 34 aa, Artificial Sequence
  Description of Artificial Sequence: Synthetic polypeptide
DEEEIRGTNPVATEFYGTVNNMTENIFNGGGNDD

SEQ ID NO: 149672 - protein, 35 aa, Artificial Sequence
  Description of Artificial Sequence: Synthetic polypeptide
DEDEIRTTNPVAYEQWGSVCSTFNDNQNDTQNGAA

SEQ ID NO: 149673 - protein, 34 aa, Artificial Sequence
  Description of Artificial Sequence: Synthetic polypeptide
DEEEIATTNPVAYEQYGSVANMNDTATGNGGEHT

SEQ ID NO: 149674 - protein, 30 aa, Artificial Sequence
  Description of Artificial Sequence: Synthetic polypeptide
SEEEIATTNPVATASWGCVAGTGLAATDHR

SEQ ID NO: 149675 - protein, 35 aa, Artificial Sequence
  Description of Artificial Sequence: Synthetic polypeptide
DEEEIRTTNPVATEQYGQCVCSWGEHNQNFGSDQG

SEQ ID NO: 149676 - protein, 34 aa, Artificial Sequence
  Description of Artificial Sequence: Synthetic polypeptide
DEDEIRTTNPVAYEEWGSVCTIENMQDHQGGNHK

SEQ ID NO: 149677 - protein, 35 aa, Artificial Sequence
  Description of Artificial Sequence: Synthetic polypeptide
DEDEIRTTNPVAYEEWGSVCSTENDQRNDTQNGTQ

SEQ ID NO: 149678 - protein, 34 aa, Artificial Sequence
  Description of Artificial Sequence: Synthetic polypeptide
DEDEIRTTNPVAYECWGVVCSTDNGNERDGDIRR

SEQ ID NO: 149679 - protein, 35 aa, Artificial Sequence
  Description of Artificial Sequence: Synthetic polypeptide
DEEEIRTTNPVATEQYGQCVCSWGEHNQNFGSDQA

SEQ ID NO: 149680 - protein, 36 aa, Artificial Sequence
  Description of Artificial Sequence: Synthetic polypeptide
DEEEIATTNPVAYEQYGSACSPANPLQEAEIGNENF

SEQ ID NO: 149681 - protein, 35 aa, Artificial Sequence
  Description of Artificial Sequence: Synthetic polypeptide
DEEEIRTTNPVATEQYGQCVCSWGEHNQGFNSDQA

SEQ ID NO: 149682 - protein, 33 aa, Artificial Sequence
  Description of Artificial Sequence: Synthetic polypeptide
DEDEIRTTNPVAYECWGSVYCTENQGGNQGNND

SEQ ID NO: 149683 - protein, 36 aa, Artificial Sequence
  Description of Artificial Sequence: Synthetic polypeptide
DEEEIRTTNPVATEQYGQCVCSWGEHNQNFGSENQM

SEQ ID NO: 149684 - protein, 34 aa, Artificial Sequence
  Description of Artificial Sequence: Synthetic polypeptide
DEDEIRTTNPVAYECWGSVWYINEQQDRLGENIG

SEQ ID NO: 149685 - protein, 38 aa, Artificial Sequence
  Description of Artificial Sequence: Synthetic polypeptide
AEEEIRTTNPVATEQYGSVSTVVSNAGNQNGNNNNQTD

SEQ ID NO: 149686 - protein, 33 aa, Artificial Sequence
  Description of Artificial Sequence: Synthetic polypeptide
DEDEIRTTNPVAYECWGSVTGGNNQQDSGGNEH

SEQ ID NO: 149687 - protein, 34 aa, Artificial Sequence
  Description of Artificial Sequence: Synthetic polypeptide
DEDEIRTTNPVAYECWGSVSVINLGEMGDRNGPP

SEQ ID NO: 149688 - protein, 33 aa, Artificial Sequence
  Description of Artificial Sequence: Synthetic polypeptide
SEEEIATTNPVATEQYGSVCAANNLHDSLDKHH

SEQ ID NO: 149689 - protein, 33 aa, Artificial Sequence
  Description of Artificial Sequence: Synthetic polypeptide
SEEEIATTNPVATEQYGSVCAANPLHNDSLDHQ

SEQ ID NO: 149690 - protein, 33 aa, Artificial Sequence
  Description of Artificial Sequence: Synthetic polypeptide
SEEEIATTNPVATEQYGSVCAATGEEAIDEMNN

SEQ ID NO: 149691 - protein, 33 aa, Artificial Sequence
  Description of Artificial Sequence: Synthetic polypeptide
AENEIACTNPVATEQYGSASSTTAGPNRNGMNV

SEQ ID NO: 149692 - protein, 33 aa, Artificial Sequence
  Description of Artificial Sequence: Synthetic polypeptide
DEDEIRTTNPVAYECWGSVCVNDGSGNRGGDAR

SEQ ID NO: 149693 - protein, 38 aa, Artificial Sequence
  Description of Artificial Sequence: Synthetic polypeptide
AEEEIRTTNPVATEQYGSVSTVVSNAGEQLGTNNNNTD

SEQ ID NO: 149694 - protein, 35 aa, Artificial Sequence
  Description of Artificial Sequence: Synthetic polypeptide
DEEEIRTTNPVATEQYGQCVCSWGEHNQNFGSQQS

SEQ ID NO: 149695 - protein, 37 aa, Artificial Sequence
  Description of Artificial Sequence: Synthetic polypeptide
AEEEIRTTNPVATEQYGSVSTVQANQNGNDEGNNVAE

SEQ ID NO: 149696 - protein, 34 aa, Artificial Sequence
  Description of Artificial Sequence: Synthetic polypeptide
DEDEIRTTNPVAYEKWGEVATTQNLQGEGDGNTP

SEQ ID NO: 149697 - protein, 37 aa, Artificial Sequence
  Description of Artificial Sequence: Synthetic polypeptide
DEEEIRTTNPVATEQYGQCVCSWGELNQENFGSENQS

SEQ ID NO: 149698 - protein, 36 aa, Artificial Sequence
  Description of Artificial Sequence: Synthetic polypeptide
DEEEIRTTNPVATEQYGQCVCSWGELEQNFGSETQL

SEQ ID NO: 149699 - protein, 35 aa, Artificial Sequence
  Description of Artificial Sequence: Synthetic polypeptide
DEEEIRTTNPVATEQYGQCVCSWGELENFGSETQA

SEQ ID NO: 149700 - protein, 36 aa, Artificial Sequence
  Description of Artificial Sequence: Synthetic polypeptide
DEEEIRTTNPVATEQYGSVQPPPLMEEVPMGNLEQG

SEQ ID NO: 149701 - protein, 35 aa, Artificial Sequence
  Description of Artificial Sequence: Synthetic polypeptide
DEEEIRTTNPVATEQYGQCVCSWGEHQHFGSETQG

SEQ ID NO: 149702 - protein, 35 aa, Artificial Sequence
  Description of Artificial Sequence: Synthetic polypeptide
DEEEIRTTNPVATEQYGQCVCSWGEHQFFNSEFQS

SEQ ID NO: 149703 - protein, 37 aa, Artificial Sequence
  Description of Artificial Sequence: Synthetic polypeptide
AEEEIRTTNPVATEQYGVVSTNTNNLNGTELGNNNLI

SEQ ID NO: 149704 - protein, 36 aa, Artificial Sequence
  Description of Artificial Sequence: Synthetic polypeptide
AEEEIRTTNPVATEQYGVVSTNTNNENSETGNNNTD

SEQ ID NO: 149705 - protein, 35 aa, Artificial Sequence
  Description of Artificial Sequence: Synthetic polypeptide
DEEEIRTTNPVATEQYGQCVCSWGEHQFFGSDTQG

SEQ ID NO: 149706 - protein, 36 aa, Artificial Sequence
  Description of Artificial Sequence: Synthetic polypeptide
AEEEIRTTNPVATEQYGVVSTNTNDENSEQGTNVTE

SEQ ID NO: 149707 - protein, 36 aa, Artificial Sequence
  Description of Artificial Sequence: Synthetic polypeptide
DEEEIRTTNPVATEQYGSVQPNGPLHMMTEHVTTNE

SEQ ID NO: 149708 - protein, 36 aa, Artificial Sequence
  Description of Artificial Sequence: Synthetic polypeptide
DEEEIRTTNPVATEQYGQCVCSWGEHQEYFGSDNQS

SEQ ID NO: 149709 - protein, 29 aa, Artificial Sequence
  Description of Artificial Sequence: Synthetic peptide
QENEIAPTNPCSSEQYGIVSCNLQNAEDA

SEQ ID NO: 149710 - protein, 32 aa, Artificial Sequence
  Description of Artificial Sequence: Synthetic polypeptide
DEDEIRTTNPVAYEPWGSVCPGENDQDDTNHK

SEQ ID NO: 149711 - protein, 36 aa, Artificial Sequence
  Description of Artificial Sequence: Synthetic polypeptide
DEEEIRTTNPVATEQYGSVCPWMMTQTTVNLVMDEG

SEQ ID NO: 149712 - protein, 33 aa, Artificial Sequence
  Description of Artificial Sequence: Synthetic polypeptide
DEDEIRTTNPVAYEKWGEVSTTNHNNDAGNNME

SEQ ID NO: 149713 - protein, 28 aa, Artificial Sequence
  Description of Artificial Sequence: Synthetic peptide
QENEIAMTNPVAYECYGDVSECEQHEEL

SEQ ID NO: 149714 - protein, 35 aa, Artificial Sequence
  Description of Artificial Sequence: Synthetic polypeptide
DEEEIRTTNPVATEQYGQCVCSWGEHNQSFNSEQS

SEQ ID NO: 149715 - protein, 35 aa, Artificial Sequence
  Description of Artificial Sequence: Synthetic polypeptide
DEEEIRTTNPVATEQYGQCVCSWGEHNQNFNSDQS

SEQ ID NO: 149716 - protein, 34 aa, Artificial Sequence
  Description of Artificial Sequence: Synthetic polypeptide
DEEEIATTNPVAYEQYGSACSAPLNQNHDDGSLH

SEQ ID NO: 149717 - protein, 33 aa, Artificial Sequence
  Description of Artificial Sequence: Synthetic polypeptide
DEDEIRTTNPVAYEQWGCVCDNNDQMDEGGNVD

SEQ ID NO: 149718 - protein, 38 aa, Artificial Sequence
  Description of Artificial Sequence: Synthetic polypeptide
AEEEIRTTNPVATEQYGSVSTVVSNGGTQLGTNNNQTD

SEQ ID NO: 149719 - protein, 33 aa, Artificial Sequence
  Description of Artificial Sequence: Synthetic polypeptide
DEDEIRTTNPVAYECWGSVAWTDQNDDRGGGQS

SEQ ID NO: 149720 - protein, 35 aa, Artificial Sequence
  Description of Artificial Sequence: Synthetic polypeptide
DEEEIRTTNPVATEQYGQCVCSWGEHIHFGSENQS

SEQ ID NO: 149721 - protein, 35 aa, Artificial Sequence
  Description of Artificial Sequence: Synthetic polypeptide
DEEEIRTTNPVATEQYGQCVCSWGEDTQNFNSNQN

SEQ ID NO: 149722 - protein, 35 aa, Artificial Sequence
  Description of Artificial Sequence: Synthetic polypeptide
DEDEIRTTNPVATTQYGVVSTTQNGTEQYGSTEDQ

SEQ ID NO: 149723 - protein, 35 aa, Artificial Sequence
  Description of Artificial Sequence: Synthetic polypeptide
DEEEIRTTNPVATEQYGQCVCSWGEDQNFNSEPQG

SEQ ID NO: 149724 - protein, 38 aa, Artificial Sequence
  Description of Artificial Sequence: Synthetic polypeptide
AEEEIRTTNPVATEQYGSVSTVVSNGTEQLGNNNNQTD

SEQ ID NO: 149725 - protein, 35 aa, Artificial Sequence
  Description of Artificial Sequence: Synthetic polypeptide
DEDEIRTTNPVATTQYGVVSTTNIGTEQYGSTEDE

SEQ ID NO: 149726 - protein, 38 aa, Artificial Sequence
  Description of Artificial Sequence: Synthetic polypeptide
AEEEIRTTNPVATEQYGSVSTVNTNNQQGNQQGTNEGD

SEQ ID NO: 149727 - protein, 34 aa, Artificial Sequence
  Description of Artificial Sequence: Synthetic polypeptide
DEDEIRTTNPVATTQYGVVSTQQNGTEQGSTEDE

SEQ ID NO: 149728 - protein, 33 aa, Artificial Sequence
  Description of Artificial Sequence: Synthetic polypeptide
DEDEIRTTNPVAYEAWGSVCPENDLNQENGDDA

SEQ ID NO: 149729 - protein, 37 aa, Artificial Sequence
  Description of Artificial Sequence: Synthetic polypeptide
AEEEIRTTNPVATEQYGSVSTVNTNNDESGTVNNNTQ

SEQ ID NO: 149730 - protein, 37 aa, Artificial Sequence
  Description of Artificial Sequence: Synthetic polypeptide
DEEEIRTTNPVATEQYGSVQPNAVELDVQMIEPPNIL

SEQ ID NO: 149731 - protein, 37 aa, Artificial Sequence
  Description of Artificial Sequence: Synthetic polypeptide
DEVEIRTTNPVATEQYGSVSDNDDGQQEQGGNGNIQG

SEQ ID NO: 149732 - protein, 34 aa, Artificial Sequence
  Description of Artificial Sequence: Synthetic polypeptide
DEDEIRTTNPVATTQYGVVSTNNNATEQGSTQDE

SEQ ID NO: 149733 - protein, 32 aa, Artificial Sequence
  Description of Artificial Sequence: Synthetic polypeptide
SEEEIATTNPVAYEQWGHVYWIDGDQRGAGHR

SEQ ID NO: 149734 - protein, 35 aa, Artificial Sequence
  Description of Artificial Sequence: Synthetic polypeptide
SEEEIATTNPVAYEQWGQVSSCTTNMQSADPGNRA

SEQ ID NO: 149735 - protein, 36 aa, Artificial Sequence
  Description of Artificial Sequence: Synthetic polypeptide
DEDEIRTTNPVATTQYGVVSTNLQQLQQATNVATEN

SEQ ID NO: 149736 - protein, 34 aa, Artificial Sequence
  Description of Artificial Sequence: Synthetic polypeptide
DEEEIATTNPVAYEQYGSACQAANDLQAAEANDM

SEQ ID NO: 149737 - protein, 34 aa, Artificial Sequence
  Description of Artificial Sequence: Synthetic polypeptide
DEEEIATTNPVAYEQYGSACNTMPEQNSMNGENN

SEQ ID NO: 149738 - protein, 37 aa, Artificial Sequence
  Description of Artificial Sequence: Synthetic polypeptide
AEEEIRTTNPVATEQYGSVSTVNTNNDEAGSVNNQTT

SEQ ID NO: 149739 - protein, 38 aa, Artificial Sequence
  Description of Artificial Sequence: Synthetic polypeptide
AEEEIRTTNPVATEQYGSVSTVNTQGGNGNQLGGNNDD

SEQ ID NO: 149740 - protein, 34 aa, Artificial Sequence
  Description of Artificial Sequence: Synthetic polypeptide
DEDEIRTTNPVAYEAWGSVSGPNGNTDRGNNEDS

SEQ ID NO: 149741 - protein, 35 aa, Artificial Sequence
  Description of Artificial Sequence: Synthetic polypeptide
DEEEIATTNPVAYEQYGSACSAANPGPLDAGGNDH

SEQ ID NO: 149742 - protein, 34 aa, Artificial Sequence
  Description of Artificial Sequence: Synthetic polypeptide
SEEEIATTNPVATEQYGSVCAGDGGLDEDNDNRN

SEQ ID NO: 149743 - protein, 36 aa, Artificial Sequence
  Description of Artificial Sequence: Synthetic polypeptide
SEEEIATTNPVATEQYGSVCAGTENLTAGDVSENMD

SEQ ID NO: 149744 - protein, 33 aa, Artificial Sequence
  Description of Artificial Sequence: Synthetic polypeptide
DEDEIRTTNPVAYECWGSVAWNDDGDQRGGGQS

SEQ ID NO: 149745 - protein, 34 aa, Artificial Sequence
  Description of Artificial Sequence: Synthetic polypeptide
SEEEIATTNPVATEQYGSVCAMTEGGQVAPPNPH

SEQ ID NO: 149746 - protein, 34 aa, Artificial Sequence
  Description of Artificial Sequence: Synthetic polypeptide
SEEEIATTNPVATEQYGSVCAMTEGGQVAPPVRE

SEQ ID NO: 149747 - protein, 36 aa, Artificial Sequence
  Description of Artificial Sequence: Synthetic polypeptide
SEEEIATTNPVATEQYGSVCAMTENGADAQIGDNDK

SEQ ID NO: 149748 - protein, 34 aa, Artificial Sequence
  Description of Artificial Sequence: Synthetic polypeptide
DEDEIRTTNPVAYECWGCVYSDNHNTQNDGDNER

SEQ ID NO: 149749 - protein, 35 aa, Artificial Sequence
  Description of Artificial Sequence: Synthetic polypeptide
DEDEIRTTNPVAYECWGCVSGGGNHGNQRGEGNMR

SEQ ID NO: 149750 - protein, 35 aa, Artificial Sequence
  Description of Artificial Sequence: Synthetic polypeptide
SEEEIATTNPVATEQYGSVCAMTENGEADAIGDNP

SEQ ID NO: 149751 - protein, 33 aa, Artificial Sequence
  Description of Artificial Sequence: Synthetic polypeptide
SEEEIATTNPVATEQYGSVCAMTEPGAVAIDNN

SEQ ID NO: 149752 - protein, 36 aa, Artificial Sequence
  Description of Artificial Sequence: Synthetic polypeptide
SEEEIATTNPVATEQYGSVCAMTNNELNPDDSNGNP

SEQ ID NO: 149753 - protein, 36 aa, Artificial Sequence
  Description of Artificial Sequence: Synthetic polypeptide
DEVEIRTTNPVATEQYGSVSSTTPAGPNMRNKMNPV

SEQ ID NO: 149754 - protein, 35 aa, Artificial Sequence
  Description of Artificial Sequence: Synthetic polypeptide
SEEEIATTNPVATEQYGSVCAMTNNEPTGGDLENG

SEQ ID NO: 149755 - protein, 35 aa, Artificial Sequence
  Description of Artificial Sequence: Synthetic polypeptide
DEEEIATTNPVAYEQYGSACSANPQQEHQDGTARQ

SEQ ID NO: 149756 - protein, 34 aa, Artificial Sequence
  Description of Artificial Sequence: Synthetic polypeptide
SEEEIATTNPVATEQYGSVCATHPEQQANQTEGT

SEQ ID NO: 149757 - protein, 37 aa, Artificial Sequence
  Description of Artificial Sequence: Synthetic polypeptide
DEEEIRTTNPVATEQYGSVCSATLALPTNHQDDIAAE

SEQ ID NO: 149758 - protein, 34 aa, Artificial Sequence
  Description of Artificial Sequence: Synthetic polypeptide
DEEEIATTNPVAYEQYGSACSAGLDNHAGEDTNN

SEQ ID NO: 149759 - protein, 36 aa, Artificial Sequence
  Description of Artificial Sequence: Synthetic polypeptide
DEEEIRTTNPVATEQYGQCVCSWGEHNQEGFNSDQG

SEQ ID NO: 149760 - protein, 35 aa, Artificial Sequence
  Description of Artificial Sequence: Synthetic polypeptide
DEVEIRTTNPVATEQYGSVSPLDDVSIGFQEGVAF

SEQ ID NO: 149761 - protein, 34 aa, Artificial Sequence
  Description of Artificial Sequence: Synthetic polypeptide
DEDEIRTTNPVAYECWGSVCFTNEDLDDRNGDQH

SEQ ID NO: 149762 - protein, 33 aa, Artificial Sequence
  Description of Artificial Sequence: Synthetic polypeptide
DEDEIRTTNPVAYEQWGCVCDNNDQMDEGNNAQ

SEQ ID NO: 149763 - protein, 33 aa, Artificial Sequence
  Description of Artificial Sequence: Synthetic polypeptide
DEDEIRTTNPVAYEQWGCVCDNNDQMDGGGNAG

SEQ ID NO: 149764 - protein, 37 aa, Artificial Sequence
  Description of Artificial Sequence: Synthetic polypeptide
DEEEIRTTNPVATEQYGQCVCSWGETNQENFGSENQA

SEQ ID NO: 149765 - protein, 37 aa, Artificial Sequence
  Description of Artificial Sequence: Synthetic polypeptide
AEEEIRTTNPVATEQYGSVSTVQQQLNGNDEGNNDES

SEQ ID NO: 149766 - protein, 36 aa, Artificial Sequence
  Description of Artificial Sequence: Synthetic polypeptide
NEEAIRTTNPVATEQWGETVHSNTNLSQDNTVGNNA

SEQ ID NO: 149767 - protein, 37 aa, Artificial Sequence
  Description of Artificial Sequence: Synthetic polypeptide
NEEAIRTTNPVATEQWGETVPSNTNPLSQDLTVGNNR

SEQ ID NO: 149768 - protein, 36 aa, Artificial Sequence
  Description of Artificial Sequence: Synthetic polypeptide
DEEEIRGTNPVATEQYGSVPSQNGGIVPLEIVEGVH

SEQ ID NO: 149769 - protein, 30 aa, Artificial Sequence
  Description of Artificial Sequence: Synthetic polypeptide
SEEEIATTNPVATEQYGCAPMHGTDSEGEK

SEQ ID NO: 149770 - protein, 33 aa, Artificial Sequence
  Description of Artificial Sequence: Synthetic polypeptide
DEDEIRTTNPVAYEQWGSVCPEDTGQHGGNANT

SEQ ID NO: 149771 - protein, 34 aa, Artificial Sequence
  Description of Artificial Sequence: Synthetic polypeptide
DEEEIATTNPVAYEQYGSVAINNLSNDDSGDDMS

SEQ ID NO: 149772 - protein, 34 aa, Artificial Sequence
  Description of Artificial Sequence: Synthetic polypeptide
DEEEIATTNPVAYEQYGSVAIANNDTQDQVNDML

SEQ ID NO: 149773 - protein, 35 aa, Artificial Sequence
  Description of Artificial Sequence: Synthetic polypeptide
SEEEIATTNPVATEQWGSVSGTGNPPQAQASNDSQ

SEQ ID NO: 149774 - protein, 34 aa, Artificial Sequence
  Description of Artificial Sequence: Synthetic polypeptide
DEDEIRTTNPVAYEQWGSVCGDHNLQDPGEQHDS

SEQ ID NO: 149775 - protein, 36 aa, Artificial Sequence
  Description of Artificial Sequence: Synthetic polypeptide
DEEEIRGTNPVATEQYGSVQDTVNNSGMEGNENGGQ

SEQ ID NO: 149776 - protein, 37 aa, Artificial Sequence
  Description of Artificial Sequence: Synthetic polypeptide
AEEEIRTTNPVATEQYGSVSTVQQNQNGNDEGTNVED

SEQ ID NO: 149777 - protein, 33 aa, Artificial Sequence
  Description of Artificial Sequence: Synthetic polypeptide
DEDEIRTTNPVAYEQWGSVAYSLPPEGPDGNTE

SEQ ID NO: 149778 - protein, 34 aa, Artificial Sequence
  Description of Artificial Sequence: Synthetic polypeptide
DEDEIRTTNPVAYEQWGSVATTNQGNQTNDMNMP

SEQ ID NO: 149779 - protein, 30 aa, Artificial Sequence
  Description of Artificial Sequence: Synthetic polypeptide
SEEEIATTNPVATEQYGCYCPWVDQHFSEQ

SEQ ID NO: 149780 - protein, 30 aa, Artificial Sequence
  Description of Artificial Sequence: Synthetic polypeptide
SEEEIATTNPVATEQYGEALPEWVCQHEVK

SEQ ID NO: 149781 - protein, 35 aa, Artificial Sequence
  Description of Artificial Sequence: Synthetic polypeptide
NEEAIRTTNPVATEQYGCVCSPTMNEHTGNENLDE

SEQ ID NO: 149782 - protein, 36 aa, Artificial Sequence
  Description of Artificial Sequence: Synthetic polypeptide
DEEEIRTTNPVATEQYGSVSPTMNMFMPPVSEEEDM

SEQ ID NO: 149783 - protein, 33 aa, Artificial Sequence
  Description of Artificial Sequence: Synthetic polypeptide
DEDEIRTTNPVAYEQWGSVCGDHNHQQPGQMDS

SEQ ID NO: 149784 - protein, 35 aa, Artificial Sequence
  Description of Artificial Sequence: Synthetic polypeptide
SEEEIATTNPVATEQWGSVSGTGNPPQAEASPNDS

SEQ ID NO: 149785 - protein, 34 aa, Artificial Sequence
  Description of Artificial Sequence: Synthetic polypeptide
SEEEIATTNPVATEQWGSVSGTGNPPQAEASADA

SEQ ID NO: 149786 - protein, 36 aa, Artificial Sequence
  Description of Artificial Sequence: Synthetic polypeptide
NEEAIRTTNPVATEQFGQETVSTNLSQDNTVGNNIY

SEQ ID NO: 149787 - protein, 31 aa, Artificial Sequence
  Description of Artificial Sequence: Synthetic polypeptide
SEEEIATTNPVATASWGCVAGTGLARGDQDI

SEQ ID NO: 149788 - protein, 29 aa, Artificial Sequence
  Description of Artificial Sequence: Synthetic peptide
QENEIASTNPVATEQYGDMASIEQNHGDA

SEQ ID NO: 149789 - protein, 35 aa, Artificial Sequence
  Description of Artificial Sequence: Synthetic polypeptide
DEEEIACTNPVATEQYGNTAASTNPQEAGMPMGER

SEQ ID NO: 149790 - protein, 30 aa, Artificial Sequence
  Description of Artificial Sequence: Synthetic polypeptide
QENEIASTNPVATEQWGDVSSIEQNHAGDA

SEQ ID NO: 149791 - protein, 34 aa, Artificial Sequence
  Description of Artificial Sequence: Synthetic polypeptide
DEEEIATTNPVAYEQYGSVANAGNLEERTMQDSQ

SEQ ID NO: 149792 - protein, 37 aa, Artificial Sequence
  Description of Artificial Sequence: Synthetic polypeptide
DEEEIRTTNPVATEQYGSVQPTPTLQNSTVGDVEVCD

SEQ ID NO: 149793 - protein, 35 aa, Artificial Sequence
  Description of Artificial Sequence: Synthetic polypeptide
DEDEIRTTNPVAYEQWGSVCSNDNDGEQPGGQSRR

SEQ ID NO: 149794 - protein, 35 aa, Artificial Sequence
  Description of Artificial Sequence: Synthetic polypeptide
DEDEIRTTNPVAYEQWGSVCSGENDQRQDTQNGSQ

SEQ ID NO: 149795 - protein, 33 aa, Artificial Sequence
  Description of Artificial Sequence: Synthetic polypeptide
DEEEIACTNPVATEQYGSACAAANGLDTMPDNE

SEQ ID NO: 149796 - protein, 34 aa, Artificial Sequence
  Description of Artificial Sequence: Synthetic polypeptide
DEDEIRTTNPVAYEQWGSVCSGENDQHDTNDTSP

SEQ ID NO: 149797 - protein, 37 aa, Artificial Sequence
  Description of Artificial Sequence: Synthetic polypeptide
DEEEIRTTNPVATEQYGSVQPTPNLLNSTVGDVEVVD

SEQ ID NO: 149798 - protein, 33 aa, Artificial Sequence
  Description of Artificial Sequence: Synthetic polypeptide
NEDEVATTNPVAYEQWGSTCSTWEHLDQRVGNN

SEQ ID NO: 149799 - protein, 34 aa, Artificial Sequence
  Description of Artificial Sequence: Synthetic polypeptide
DEEEIRTTNPVATEQYGQCVVSIGDENGTDQFDE

SEQ ID NO: 149800 - protein, 35 aa, Artificial Sequence
  Description of Artificial Sequence: Synthetic polypeptide
NEEAEIATTNPVAYEQWGSVCSTNDHQDRDGGDQP

SEQ ID NO: 149801 - protein, 34 aa, Artificial Sequence
  Description of Artificial Sequence: Synthetic polypeptide
DEDEIRTTNPVAYEQWGSVCQTFEDWGQKGGTER

SEQ ID NO: 149802 - protein, 33 aa, Artificial Sequence
  Description of Artificial Sequence: Synthetic polypeptide
SEEEIATTNPVATEQWGSVAAHALPDNENNDPR

SEQ ID NO: 149803 - protein, 34 aa, Artificial Sequence
  Description of Artificial Sequence: Synthetic polypeptide
DEEEIATTNPVAYEQYGSVAMNDTATGNGIDEHP

SEQ ID NO: 149804 - protein, 37 aa, Artificial Sequence
  Description of Artificial Sequence: Synthetic polypeptide
DEEEIRTTNPVATEQYGQCVTSTTPATNAEHFGSNPV

SEQ ID NO: 149805 - protein, 35 aa, Artificial Sequence
  Description of Artificial Sequence: Synthetic polypeptide
NEEAIRTTNPVATEAYGETVSWNLSQDNTVGNNIY

SEQ ID NO: 149806 - protein, 36 aa, Artificial Sequence
  Description of Artificial Sequence: Synthetic polypeptide
NEEAIRTTNPVATEQYGETVASTNLSPDNTVGNNIY

SEQ ID NO: 149807 - protein, 36 aa, Artificial Sequence
  Description of Artificial Sequence: Synthetic polypeptide
DEEEIRGTNPVATEQYGSVSNVPNDEQEEHVPVNME

SEQ ID NO: 149808 - protein, 36 aa, Artificial Sequence
  Description of Artificial Sequence: Synthetic polypeptide
NEEAIRTTNPVATEQYGETVSTGWLSQDNTVGNNIY

SEQ ID NO: 149809 - protein, 36 aa, Artificial Sequence
  Description of Artificial Sequence: Synthetic polypeptide
NEEAIRTTNPVATEQYGIETVSNNLSQDNTVGNNIY

SEQ ID NO: 149810 - protein, 34 aa, Artificial Sequence
  Description of Artificial Sequence: Synthetic polypeptide
DEEEIATTNPVAYEQYGSVAAAANGLDVNNPPTK

SEQ ID NO: 149811 - protein, 34 aa, Artificial Sequence
  Description of Artificial Sequence: Synthetic polypeptide
DEDEIRTTNPVAYEQWGEVCSTENDMQDTQNGGK

SEQ ID NO: 149812 - protein, 34 aa, Artificial Sequence
  Description of Artificial Sequence: Synthetic polypeptide
DEDEIRTTNPVAYEQWGEVCSTENDMGDTQSGGD

SEQ ID NO: 149813 - protein, 34 aa, Artificial Sequence
  Description of Artificial Sequence: Synthetic polypeptide
DEDEIRTTNPVAYEQWGEVCSTENDMGDQQNGGA

SEQ ID NO: 149814 - protein, 35 aa, Artificial Sequence
  Description of Artificial Sequence: Synthetic polypeptide
DEEEIRTTNPVATEQYGQCVCSWPHQENFGSEPQG

SEQ ID NO: 149815 - protein, 34 aa, Artificial Sequence
  Description of Artificial Sequence: Synthetic polypeptide
DEDEIRTTNPVAYEQWGEVASGDNNGDQRGDGGA

SEQ ID NO: 149816 - protein, 35 aa, Artificial Sequence
  Description of Artificial Sequence: Synthetic polypeptide
DEEEIRTTNPVATEQYGQCVCSWMEHQENFGSEQS

SEQ ID NO: 149817 - protein, 31 aa, Artificial Sequence
  Description of Artificial Sequence: Synthetic polypeptide
QENEIAPTNPVSSEQYGIISCENLQQSNGNH

SEQ ID NO: 149818 - protein, 34 aa, Artificial Sequence
  Description of Artificial Sequence: Synthetic polypeptide
DEDEIRTTNPVAYEQWGEVAGDNNGDQRNGNNQA

SEQ ID NO: 149819 - protein, 35 aa, Artificial Sequence
  Description of Artificial Sequence: Synthetic polypeptide
DEEEIRTTNPVATEQYGQCVCSWMEHNQNFGSEQS

SEQ ID NO: 149820 - protein, 35 aa, Artificial Sequence
  Description of Artificial Sequence: Synthetic polypeptide
SEEEIATTNPVATEQYGSVANANNLPQEAPGEIAN

SEQ ID NO: 149821 - protein, 28 aa, Artificial Sequence
  Description of Artificial Sequence: Synthetic peptide
QENEIAPTNPVSSEPYGIISCNIQQGTH

SEQ ID NO: 149822 - protein, 36 aa, Artificial Sequence
  Description of Artificial Sequence: Synthetic polypeptide
DEEEIRTTNPVATEQYGQCVCSWGPHQENFGSENQF

SEQ ID NO: 149823 - protein, 34 aa, Artificial Sequence
  Description of Artificial Sequence: Synthetic polypeptide
DEDEIRTTNPVAYEQWGCVSTTNAGNQNDMNNPK

SEQ ID NO: 149824 - protein, 37 aa, Artificial Sequence
  Description of Artificial Sequence: Synthetic polypeptide
DEEEIRTTNPVATEQYGSVQPTESTGVEPNMLLVEVA

SEQ ID NO: 149825 - protein, 36 aa, Artificial Sequence
  Description of Artificial Sequence: Synthetic polypeptide
DEEEIRTTNPVATEQYGQCVCSWGETNQENFNSDQS

SEQ ID NO: 149826 - protein, 35 aa, Artificial Sequence
  Description of Artificial Sequence: Synthetic polypeptide
DEEEIRTTNPVATEQYGSVCPPPLLEELMGPLEQV

SEQ ID NO: 149827 - protein, 36 aa, Artificial Sequence
  Description of Artificial Sequence: Synthetic polypeptide
DEEEIRTTNPVATEQYGSVCPQAELPEERELMNVVE

SEQ ID NO: 149828 - protein, 33 aa, Artificial Sequence
  Description of Artificial Sequence: Synthetic polypeptide
NEEEIACTNPVATEQWGTCSATHLAPDQMGQRM

SEQ ID NO: 149829 - protein, 35 aa, Artificial Sequence
  Description of Artificial Sequence: Synthetic polypeptide
DEDEIRTTNPVAYEQWGEVCSTENQDLGDTQNGGA

SEQ ID NO: 149830 - protein, 31 aa, Artificial Sequence
  Description of Artificial Sequence: Synthetic polypeptide
SEEEIATTNPVATASWGCVAGNGLARDQDQR

SEQ ID NO: 149831 - protein, 35 aa, Artificial Sequence
  Description of Artificial Sequence: Synthetic polypeptide
DEEEIRGTNPVATEQYGSVTPNPNEQGNVGQLQVD

SEQ ID NO: 149832 - protein, 38 aa, Artificial Sequence
  Description of Artificial Sequence: Synthetic polypeptide
AEEEIRTTNPVATEQYGSVSTVQNQQLNGNDEGNNVED

SEQ ID NO: 149833 - protein, 37 aa, Artificial Sequence
  Description of Artificial Sequence: Synthetic polypeptide
DEEEIRTTNPVATEQYGSVSPTMTANEFAADHLENDD

SEQ ID NO: 149834 - protein, 33 aa, Artificial Sequence
  Description of Artificial Sequence: Synthetic polypeptide
DEDEIRTTNPVAYEQWGSSYYSPNMLQQMDSKM

SEQ ID NO: 149835 - protein, 35 aa, Artificial Sequence
  Description of Artificial Sequence: Synthetic polypeptide
NEEAIRTTNPVATEQYGSVSPPINEHTGNEMLIDE

SEQ ID NO: 149836 - protein, 37 aa, Artificial Sequence
  Description of Artificial Sequence: Synthetic polypeptide
DEEEIRGTNPVATEQYGSVSSTTPAVGPNMKNGMNPV

SEQ ID NO: 149837 - protein, 30 aa, Artificial Sequence
  Description of Artificial Sequence: Synthetic polypeptide
SEEEIATTNPVATEQYGEFCPWVDQHFEEA

SEQ ID NO: 149838 - protein, 38 aa, Artificial Sequence
  Description of Artificial Sequence: Synthetic polypeptide
AEEEIRTTNPVATEQYGSVSTVQQNGNQQGTTNVATED

SEQ ID NO: 149839 - protein, 34 aa, Artificial Sequence
  Description of Artificial Sequence: Synthetic polypeptide
DEDEIRTTNPVAYEQWGNVSTTNAGNQQNDHNME

SEQ ID NO: 149840 - protein, 35 aa, Artificial Sequence
  Description of Artificial Sequence: Synthetic polypeptide
DEDEIRTTNPVAYEQWGNVCSTENDQRNDTQNGDA

SEQ ID NO: 149841 - protein, 33 aa, Artificial Sequence
  Description of Artificial Sequence: Synthetic polypeptide
DEDEIRTTNPVAYEQWGEVTGDNNGDQRGQGDA

SEQ ID NO: 149842 - protein, 37 aa, Artificial Sequence
  Description of Artificial Sequence: Synthetic polypeptide
DEEEIRGTNPVATEQYGSVSSTTPDGPNMGNGENIDP

SEQ ID NO: 149843 - protein, 37 aa, Artificial Sequence
  Description of Artificial Sequence: Synthetic polypeptide
AEEEIRTTNPVATEQYGSVSTVQQNGEQGTTNVATED

SEQ ID NO: 149844 - protein, 34 aa, Artificial Sequence
  Description of Artificial Sequence: Synthetic polypeptide
SEEEIATTNPVATEQYGSCPATHLEAPDDQDGRM

SEQ ID NO: 149845 - protein, 31 aa, Artificial Sequence
  Description of Artificial Sequence: Synthetic polypeptide
AENEIACTNPVATEQYGETTSEEDLAPKGGR

SEQ ID NO: 149846 - protein, 32 aa, Artificial Sequence
  Description of Artificial Sequence: Synthetic polypeptide
DEDEIRTTNPVAYEQWGEVSGGDGNHGGGEQE

SEQ ID NO: 149847 - protein, 35 aa, Artificial Sequence
  Description of Artificial Sequence: Synthetic polypeptide
NEEAIRTTNPVATERYGETVSTRLSQDNTVGNNIY

SEQ ID NO: 149848 - protein, 29 aa, Artificial Sequence
  Description of Artificial Sequence: Synthetic peptide
QENEIASTNPVATEGWGVVSSTEMAAGDA

SEQ ID NO: 149849 - protein, 35 aa, Artificial Sequence
  Description of Artificial Sequence: Synthetic polypeptide
SEEEIATTNPVATEQYGSVAATPHLEADNQMENNH

SEQ ID NO: 149850 - protein, 35 aa, Artificial Sequence
  Description of Artificial Sequence: Synthetic polypeptide
NEEAIRTTNPVAYEQYGETVSTYLSQDNTVGNNIY

SEQ ID NO: 149851 - protein, 35 aa, Artificial Sequence
  Description of Artificial Sequence: Synthetic polypeptide
DEEEIRGTNPVATEQYGSVSYSMTNFNNTFDELED

SEQ ID NO: 149852 - protein, 34 aa, Artificial Sequence
  Description of Artificial Sequence: Synthetic polypeptide
DEDEIRTTNPVAYEQWGEVCSTNDGQHQGGQGTT

SEQ ID NO: 149853 - protein, 35 aa, Artificial Sequence
  Description of Artificial Sequence: Synthetic polypeptide
DEVEIRTTNPVATEQYGSVNVTANMNGEMVELNEV

SEQ ID NO: 149854 - protein, 37 aa, Artificial Sequence
  Description of Artificial Sequence: Synthetic polypeptide
DEEEIRTTNPVATEQYGSACATNPELGGEHQDDGEAG

SEQ ID NO: 149855 - protein, 31 aa, Artificial Sequence
  Description of Artificial Sequence: Synthetic polypeptide
SEEEIACTNPVATEQYGCAPIHGQDSEGENH

SEQ ID NO: 149856 - protein, 35 aa, Artificial Sequence
  Description of Artificial Sequence: Synthetic polypeptide
DEDEIRTTNPVAYEQWGSVSTTNAGNQNIDANMPE

SEQ ID NO: 149857 - protein, 30 aa, Artificial Sequence
  Description of Artificial Sequence: Synthetic polypeptide
SECEICATNPCTTEIYGVVATSTNNQNGDI

SEQ ID NO: 149858 - protein, 34 aa, Artificial Sequence
  Description of Artificial Sequence: Synthetic polypeptide
MESEIRTTNPVATETWGSVDCINEPQDREGEGND

SEQ ID NO: 149859 - protein, 34 aa, Artificial Sequence
  Description of Artificial Sequence: Synthetic polypeptide
DEDEIRTTNPVAYEQWGSVSTTNAGNANDHNMPN

SEQ ID NO: 149860 - protein, 34 aa, Artificial Sequence
  Description of Artificial Sequence: Synthetic polypeptide
METEIRTTNPVATEFYGSVTGTDGDEGNGQTGEG

SEQ ID NO: 149861 - protein, 34 aa, Artificial Sequence
  Description of Artificial Sequence: Synthetic polypeptide
METEIRTTNPVATETWGSVDCINEPQDREGENGD

SEQ ID NO: 149862 - protein, 36 aa, Artificial Sequence
  Description of Artificial Sequence: Synthetic polypeptide
DEEEIRTTNPVATEQYGSVSPNSNDAPDYDQTIEED

SEQ ID NO: 149863 - protein, 34 aa, Artificial Sequence
  Description of Artificial Sequence: Synthetic polypeptide
METEIRTTNPVSTEQYGSVVTGNNGQGEGGQTGG

SEQ ID NO: 149864 - protein, 33 aa, Artificial Sequence
  Description of Artificial Sequence: Synthetic polypeptide
MESEIRTTNPVATETWGSVDCINEPGDREGERG

SEQ ID NO: 149865 - protein, 30 aa, Artificial Sequence
  Description of Artificial Sequence: Synthetic polypeptide
SECEICATNPCTTEIYGVVSTSTLQNQGDI

SEQ ID NO: 149866 - protein, 34 aa, Artificial Sequence
  Description of Artificial Sequence: Synthetic polypeptide
MNNEIRTTNPVATEQYGEVVMSAELEQQRPQNDG

SEQ ID NO: 149867 - protein, 36 aa, Artificial Sequence
  Description of Artificial Sequence: Synthetic polypeptide
MQSEIATTNPVATEQYGSVSPTSNVSDQRIGENYQK

SEQ ID NO: 149868 - protein, 38 aa, Artificial Sequence
  Description of Artificial Sequence: Synthetic polypeptide
AEEEIRTTNPVATEQYGSVSTVTNNQNNQNQQGNNTED

SEQ ID NO: 149869 - protein, 38 aa, Artificial Sequence
  Description of Artificial Sequence: Synthetic polypeptide
AEEEIRTTNPVATEQYGSVSTVTNNQNNQNDNGTNNDE

SEQ ID NO: 149870 - protein, 38 aa, Artificial Sequence
  Description of Artificial Sequence: Synthetic polypeptide
AEEEIRTTNPVATEQYGSVSTVTNNQNNQGEIGNNTED

SEQ ID NO: 149871 - protein, 36 aa, Artificial Sequence
  Description of Artificial Sequence: Synthetic polypeptide
AEEEIRTTNPVATEQYGVVSTTNQQQQQQNGTTEDN

SEQ ID NO: 149872 - protein, 38 aa, Artificial Sequence
  Description of Artificial Sequence: Synthetic polypeptide
AEEEIRTTNPVATEQYGSVSTVTNNQNNNGENGNNDED

SEQ ID NO: 149873 - protein, 37 aa, Artificial Sequence
  Description of Artificial Sequence: Synthetic polypeptide
AEEEIRTTNPVATEQYGVVSTTNQQQLQNQATTNATD

SEQ ID NO: 149874 - protein, 29 aa, Artificial Sequence
  Description of Artificial Sequence: Synthetic peptide
SECEICATNPCTTEIYGVVSTSTNQNGDT

SEQ ID NO: 149875 - protein, 29 aa, Artificial Sequence
  Description of Artificial Sequence: Synthetic peptide
SECEICATNPCTTEIYGVVATSTLQTGDN

SEQ ID NO: 149876 - protein, 34 aa, Artificial Sequence
  Description of Artificial Sequence: Synthetic polypeptide
SECEIATTNPVATEPYGSVCYNNDDQDQGHNDRE

SEQ ID NO: 149877 - protein, 35 aa, Artificial Sequence
  Description of Artificial Sequence: Synthetic polypeptide
DEEEIRTTNPVATEQYGSAVDSPWQELNVPIMQLE

SEQ ID NO: 149878 - protein, 38 aa, Artificial Sequence
  Description of Artificial Sequence: Synthetic polypeptide
AEEEIRTTNPVATEQYGSVSTVTNNQNQQGEQGNNDET

SEQ ID NO: 149879 - protein, 34 aa, Artificial Sequence
  Description of Artificial Sequence: Synthetic polypeptide
DEDEIRTTNPVAYEQWGSVSTTNAGNTNDHNMNE

SEQ ID NO: 149880 - protein, 34 aa, Artificial Sequence
  Description of Artificial Sequence: Synthetic polypeptide
DEEEIACTNPVATEQWGCVAMTNLNPDDGMGDRH

SEQ ID NO: 149881 - protein, 36 aa, Artificial Sequence
  Description of Artificial Sequence: Synthetic polypeptide
SEAEIRTTNPVATEQYGSVSVTAANQQTGYSEEVES

SEQ ID NO: 149882 - protein, 36 aa, Artificial Sequence
  Description of Artificial Sequence: Synthetic polypeptide
SEAEIRTTNPVATEQYGSVVDTIMLEELQNGNEEVF

SEQ ID NO: 149883 - protein, 35 aa, Artificial Sequence
  Description of Artificial Sequence: Synthetic polypeptide
DEDEIRTTNPVAYEQWGSVSTTNAGNQQNDMNDPK

SEQ ID NO: 149884 - protein, 34 aa, Artificial Sequence
  Description of Artificial Sequence: Synthetic polypeptide
SEAEIRTTNPVAYEPYGSTVHCTNISEENSGNRA

SEQ ID NO: 149885 - protein, 36 aa, Artificial Sequence
  Description of Artificial Sequence: Synthetic polypeptide
MESEIRTTNPVATEQYGSVSWPNGLNNQFDNNQEKG

SEQ ID NO: 149886 - protein, 35 aa, Artificial Sequence
  Description of Artificial Sequence: Synthetic polypeptide
SEAEIRTTNPVAYEQWGQVSSCTNMQSADGAGNRA

SEQ ID NO: 149887 - protein, 35 aa, Artificial Sequence
  Description of Artificial Sequence: Synthetic polypeptide
DEDEIRTTNPVAYEQWGSVSTTNAGNQNQDHNMLE

SEQ ID NO: 149888 - protein, 35 aa, Artificial Sequence
  Description of Artificial Sequence: Synthetic polypeptide
SEAEIRTTNPVAYEQWGQVVSSCTNMQSSDYGNRA

SEQ ID NO: 149889 - protein, 35 aa, Artificial Sequence
  Description of Artificial Sequence: Synthetic polypeptide
DEDEIRTTNPVAYEQWGSVSTTNAGNQNIDMNGDQ

SEQ ID NO: 149890 - protein, 38 aa, Artificial Sequence
  Description of Artificial Sequence: Synthetic polypeptide
AEEEIRTTNPVATEQYGSVSTVTNNQNQNNEIGNNDET

SEQ ID NO: 149891 - protein, 35 aa, Artificial Sequence
  Description of Artificial Sequence: Synthetic polypeptide
MESEIRTTNPVATEQYGSVSWPWGLNQFDNNQEHG

SEQ ID NO: 149892 - protein, 35 aa, Artificial Sequence
  Description of Artificial Sequence: Synthetic polypeptide
DEDEIRTTNPVAYEQWGSVSTTNAGNQNIDHNQGG

SEQ ID NO: 149893 - protein, 34 aa, Artificial Sequence
  Description of Artificial Sequence: Synthetic polypeptide
MESEIRTTNPVATERYGETTSCTNAHSQVRGGDS

SEQ ID NO: 149894 - protein, 36 aa, Artificial Sequence
  Description of Artificial Sequence: Synthetic polypeptide
DEEEIRTTNPVATEQYGSAVGPTPEDQQMPLVNEDE

SEQ ID NO: 149895 - protein, 35 aa, Artificial Sequence
  Description of Artificial Sequence: Synthetic polypeptide
DEEEIRTTNPVATEQYGSAVGPAPDVQQMPLQNED

SEQ ID NO: 149896 - protein, 36 aa, Artificial Sequence
  Description of Artificial Sequence: Synthetic polypeptide
DEEEIRTTNPVATEQYGSAVEPTFGEQQLEMLENAF

SEQ ID NO: 149897 - protein, 38 aa, Artificial Sequence
  Description of Artificial Sequence: Synthetic polypeptide
AEEEIRTTNPVATEQYGSVSTVTNNQNNGNEEGNNTED

SEQ ID NO: 149898 - protein, 37 aa, Artificial Sequence
  Description of Artificial Sequence: Synthetic polypeptide
MESEIRTTNPVATEQYGSVSNWPTPGLNQFDNNQERG

SEQ ID NO: 149899 - protein, 34 aa, Artificial Sequence
  Description of Artificial Sequence: Synthetic polypeptide
DEEEIRCTNPVATEQYGCVCSWEDHNDHFGSDTQ

SEQ ID NO: 149900 - protein, 34 aa, Artificial Sequence
  Description of Artificial Sequence: Synthetic polypeptide
DEEEIRCTNPVATEQYGCVCSWEDNIHFGSDTQS

SEQ ID NO: 149901 - protein, 37 aa, Artificial Sequence
  Description of Artificial Sequence: Synthetic polypeptide
DEEEIRTTNPVATEQYGSVAWPFSTLENPRQFQEMDD

SEQ ID NO: 149902 - protein, 34 aa, Artificial Sequence
  Description of Artificial Sequence: Synthetic polypeptide
DEDEIRTTNPVAYEQWGSVSGGPGNHQGNGGGEN

SEQ ID NO: 149903 - protein, 34 aa, Artificial Sequence
  Description of Artificial Sequence: Synthetic polypeptide
DEDEIRTTNPVAYEQWGSVSGGNGNSAGGEGNTS

SEQ ID NO: 149904 - protein, 34 aa, Artificial Sequence
  Description of Artificial Sequence: Synthetic polypeptide
NDEEIRTTNPVATEQYGCVCSTELNANFGSDTQS

SEQ ID NO: 149905 - protein, 34 aa, Artificial Sequence
  Description of Artificial Sequence: Synthetic polypeptide
DEDEIRTTNPVAYEQWGSVSGGHGNHQGEGGGGN

SEQ ID NO: 149906 - protein, 38 aa, Artificial Sequence
  Description of Artificial Sequence: Synthetic polypeptide
AEEEIRTTNPVATEQYGSVSTVTNNQLGGTEQGTNQNS

SEQ ID NO: 149907 - protein, 31 aa, Artificial Sequence
  Description of Artificial Sequence: Synthetic polypeptide
AENEIACTNPVATEQYGEASEPAGPNRGGPR

SEQ ID NO: 149908 - protein, 34 aa, Artificial Sequence
  Description of Artificial Sequence: Synthetic polypeptide
DEDEIRTTNPVAYEQWGSVSGGGPNHQGEGGGLT

SEQ ID NO: 149909 - protein, 35 aa, Artificial Sequence
  Description of Artificial Sequence: Synthetic polypeptide
DEDEIRTTNPVAYEQWGSVSGGQGPNHQGQGNGEN

SEQ ID NO: 149910 - protein, 37 aa, Artificial Sequence
  Description of Artificial Sequence: Synthetic polypeptide
AEEEIRTTNPVATEQYGVVSTTNNQQQQNQNGTTNAT

SEQ ID NO: 149911 - protein, 38 aa, Artificial Sequence
  Description of Artificial Sequence: Synthetic polypeptide
AEEEIRTTNPVATEQYGSVSTVTNNQAGNTQNGNNEGD

SEQ ID NO: 149912 - protein, 38 aa, Artificial Sequence
  Description of Artificial Sequence: Synthetic polypeptide
AEEEIRTTNPVATEQYGSVSTVTNNQAGNQQTGNNNGD

SEQ ID NO: 149913 - protein, 38 aa, Artificial Sequence
  Description of Artificial Sequence: Synthetic polypeptide
AEEEIRTTNPVATEQYGSVSTVTNNQAGNQQQGNEEGD

SEQ ID NO: 149914 - protein, 34 aa, Artificial Sequence
  Description of Artificial Sequence: Synthetic polypeptide
DEDEIRTTNPVAYEQWGSVSGGGNHQTGEGGGIQ

SEQ ID NO: 149915 - protein, 34 aa, Artificial Sequence
  Description of Artificial Sequence: Synthetic polypeptide
DEDEIRTTNPVAYEQWGSVSGGGNHQQGQGGMEN

SEQ ID NO: 149916 - protein, 34 aa, Artificial Sequence
  Description of Artificial Sequence: Synthetic polypeptide
DEDEIRTTNPVAYEQWGSVSGGGNHQQGEGGGSN

SEQ ID NO: 149917 - protein, 32 aa, Artificial Sequence
  Description of Artificial Sequence: Synthetic polypeptide
DEEEIACTNPVATEQWGSVSMSGDGNPAGVPM

SEQ ID NO: 149918 - protein, 34 aa, Artificial Sequence
  Description of Artificial Sequence: Synthetic polypeptide
DEEEIRCTNPVATEQYGDVVGFGQQDEGGQNSTP

SEQ ID NO: 149919 - protein, 35 aa, Artificial Sequence
  Description of Artificial Sequence: Synthetic polypeptide
DEEEIRCTNPVATEQYGDVVEGTAGQQDEGGQNST

SEQ ID NO: 149920 - protein, 36 aa, Artificial Sequence
  Description of Artificial Sequence: Synthetic polypeptide
DEEEIRTTNPVATEQYGSVAVSVDEQIENTEEAVIM

SEQ ID NO: 149921 - protein, 33 aa, Artificial Sequence
  Description of Artificial Sequence: Synthetic polypeptide
DEEEIRCTNPVATEQYGCVCSWNHDHFISDTQS

SEQ ID NO: 149922 - protein, 34 aa, Artificial Sequence
  Description of Artificial Sequence: Synthetic polypeptide
DEEEIRCTNPVATEQYGCVCSWNHAEHFGSDTQS

SEQ ID NO: 149923 - protein, 37 aa, Artificial Sequence
  Description of Artificial Sequence: Synthetic polypeptide
AEEEIRTTNPVATEQYGVVSTTNQQLQQQATNVATEH

SEQ ID NO: 149924 - protein, 32 aa, Artificial Sequence
  Description of Artificial Sequence: Synthetic polypeptide
SECKIRPTNPTATEQYGAVAVEMNGMPRGNDR

SEQ ID NO: 149925 - protein, 37 aa, Artificial Sequence
  Description of Artificial Sequence: Synthetic polypeptide
AEEEIRTTNPVATEQYGVVSTTNQQLQQGTEAGVTQD

SEQ ID NO: 149926 - protein, 38 aa, Artificial Sequence
  Description of Artificial Sequence: Synthetic polypeptide
DEEEIRTTNPVATEQYGSVATVNNNNLQQGEADEEDEG

SEQ ID NO: 149927 - protein, 29 aa, Artificial Sequence
  Description of Artificial Sequence: Synthetic peptide
QENEIATTNPVATECYGDVSECEMNAEEA

SEQ ID NO: 149928 - protein, 29 aa, Artificial Sequence
  Description of Artificial Sequence: Synthetic peptide
QENEIATTNPVATECYGDVSECEMHAEEA

SEQ ID NO: 149929 - protein, 36 aa, Artificial Sequence
  Description of Artificial Sequence: Synthetic polypeptide
AEEEIRTTNPVATEQYGVVSTTNQQGNSEQGTTVSE

SEQ ID NO: 149930 - protein, 30 aa, Artificial Sequence
  Description of Artificial Sequence: Synthetic polypeptide
SEDEIATTNPVATASWGCVAGTGLARSDQR

SEQ ID NO: 149931 - protein, 36 aa, Artificial Sequence
  Description of Artificial Sequence: Synthetic polypeptide
DEEEIRTTNPVATEQYGSVATVNNNQLLEEEDEEDE

SEQ ID NO: 149932 - protein, 37 aa, Artificial Sequence
  Description of Artificial Sequence: Synthetic polypeptide
AEEEIRTTNPVATEQYGVVSTTNQQAGTDEQGTNQDD

SEQ ID NO: 149933 - protein, 34 aa, Artificial Sequence
  Description of Artificial Sequence: Synthetic polypeptide
SEDEICTTNPVAYEQWGQVSSCTNMQSADGGNRA

SEQ ID NO: 149934 - protein, 38 aa, Artificial Sequence
  Description of Artificial Sequence: Synthetic polypeptide
AEEEIRTTNPVATEQYGSVSTVTNNQLQGTEQGTTEDQ

SEQ ID NO: 149935 - protein, 38 aa, Artificial Sequence
  Description of Artificial Sequence: Synthetic polypeptide
AEEEIRTTNPVATEQYGSVSTVTNNQLNQQQATNNTTE

SEQ ID NO: 149936 - protein, 36 aa, Artificial Sequence
  Description of Artificial Sequence: Synthetic polypeptide
DEEEIRTTNPVATEQYGSVSPPINTGVIDNAVANLF

SEQ ID NO: 149937 - protein, 38 aa, Artificial Sequence
  Description of Artificial Sequence: Synthetic polypeptide
AEEEIRTTNPVATEQYGSVSTVTNNQLNLQNNNNNEQG

SEQ ID NO: 149938 - protein, 38 aa, Artificial Sequence
  Description of Artificial Sequence: Synthetic polypeptide
DEEEIRTTNPVATEQYGSVATVNPNQQLGNEEDEEDED

SEQ ID NO: 149939 - protein, 36 aa, Artificial Sequence
  Description of Artificial Sequence: Synthetic polypeptide
AEEEIRTTNPVATEQYGVVSTTNQGNQIGTTGQGDQ

SEQ ID NO: 149940 - protein, 37 aa, Artificial Sequence
  Description of Artificial Sequence: Synthetic polypeptide
DEEEIRTTNPVATEQYGSVATVQQQLQAGTEEGTTDD

SEQ ID NO: 149941 - protein, 37 aa, Artificial Sequence
  Description of Artificial Sequence: Synthetic polypeptide
DEEEIRTTNPVATEQYGSVATVQQQLQAGTEQGTEEQ

SEQ ID NO: 149942 - protein, 33 aa, Artificial Sequence
  Description of Artificial Sequence: Synthetic polypeptide
SECEIRPTNPTATEQYGAVAVEMNGSMSRGNDR

SEQ ID NO: 149943 - protein, 37 aa, Artificial Sequence
  Description of Artificial Sequence: Synthetic polypeptide
DEEEIRTTNPVATEQYGSVATTNNNLEAGTEGGTTEG

SEQ ID NO: 149944 - protein, 36 aa, Artificial Sequence
  Description of Artificial Sequence: Synthetic polypeptide
MESEIRTTNPVATEQYGSVGPWSNVHDQRIGENYQK

SEQ ID NO: 149945 - protein, 35 aa, Artificial Sequence
  Description of Artificial Sequence: Synthetic polypeptide
DEDEIRTTNPVAYEQWGSVSTTNAGTQQNDHNMNE

SEQ ID NO: 149946 - protein, 35 aa, Artificial Sequence
  Description of Artificial Sequence: Synthetic polypeptide
DEDEIRTTNPVAYEQWGSYWSTINPNQNDVEGNNA

SEQ ID NO: 149947 - protein, 37 aa, Artificial Sequence
  Description of Artificial Sequence: Synthetic polypeptide
AEEEIRTTNPVATEQYGSVSTVTNQNNGTEQGNNQED

SEQ ID NO: 149948 - protein, 37 aa, Artificial Sequence
  Description of Artificial Sequence: Synthetic polypeptide
AEEEIRTTNPVATEQYGSVSTVTNQNNANEQGNNTED

SEQ ID NO: 149949 - protein, 35 aa, Artificial Sequence
  Description of Artificial Sequence: Synthetic polypeptide
DEEEIRTTNPVATEQYGSAVVNLVSHFENSLEEFQ

SEQ ID NO: 149950 - protein, 32 aa, Artificial Sequence
  Description of Artificial Sequence: Synthetic polypeptide
SEAEIACTNPVATEQYGSVCATNNLHDSLDVM

SEQ ID NO: 149951 - protein, 33 aa, Artificial Sequence
  Description of Artificial Sequence: Synthetic polypeptide
SEAEIACTNPVATESYGCVATNLQEAEGGNMDD

SEQ ID NO: 149952 - protein, 35 aa, Artificial Sequence
  Description of Artificial Sequence: Synthetic polypeptide
DEEEIATTNPVAYEQYGSVSVAPHLNEAPDGMARN

SEQ ID NO: 149953 - protein, 38 aa, Artificial Sequence
  Description of Artificial Sequence: Synthetic polypeptide
DEEEIRTTNPVATEQYGSAVSYVMNDEGAQRQMDGAVE

SEQ ID NO: 149954 - protein, 36 aa, Artificial Sequence
  Description of Artificial Sequence: Synthetic polypeptide
AEEEIRTTNPVATEQYGVVSTTNSNTNSEEGTNTNE

SEQ ID NO: 149955 - protein, 37 aa, Artificial Sequence
  Description of Artificial Sequence: Synthetic polypeptide
DEEEIRTTNPVATEQYGSAVSWVMTDEQAQRQMIMVE

SEQ ID NO: 149956 - protein, 37 aa, Artificial Sequence
  Description of Artificial Sequence: Synthetic polypeptide
AEEEIRTTNPVATEQYGSVSTVTNQNGNQLQGTEDEE

SEQ ID NO: 149957 - protein, 36 aa, Artificial Sequence
  Description of Artificial Sequence: Synthetic polypeptide
DEEEIRTTNPVATEQYGSVSPMAPELEAMEGELMME

SEQ ID NO: 149958 - protein, 37 aa, Artificial Sequence
  Description of Artificial Sequence: Synthetic polypeptide
DEEEIRTTNPVATEQYGSAVSWVMRDEGAQRQMQNVE

SEQ ID NO: 149959 - protein, 37 aa, Artificial Sequence
  Description of Artificial Sequence: Synthetic polypeptide
DEEEIRTTNPVATEQYGSAVSWVATDEGAQRQMIQVE

SEQ ID NO: 149960 - protein, 32 aa, Artificial Sequence
  Description of Artificial Sequence: Synthetic polypeptide
DEDEIRTTNPVAYEQWGSVVIVNGNDHGTTDM

SEQ ID NO: 149961 - protein, 34 aa, Artificial Sequence
  Description of Artificial Sequence: Synthetic polypeptide
MEQEIRTTNPVATEQYGSVWPTDDEQEFGQTEMF

SEQ ID NO: 149962 - protein, 36 aa, Artificial Sequence
  Description of Artificial Sequence: Synthetic polypeptide
DEEEIRTTNPVATEQYGSVSPMGDHNQPMEVNDDNF

SEQ ID NO: 149963 - protein, 32 aa, Artificial Sequence
  Description of Artificial Sequence: Synthetic polypeptide
SEAEIATTNPVATEQYGSVCAANNLHDSLDHM

SEQ ID NO: 149964 - protein, 38 aa, Artificial Sequence
  Description of Artificial Sequence: Synthetic polypeptide
AEEEIRTTNPVATEQYGSVSTVTNQNLGGTEQGTNQEQ

SEQ ID NO: 149965 - protein, 36 aa, Artificial Sequence
  Description of Artificial Sequence: Synthetic polypeptide
DEEEIATTNPVAYEQYGSVVAAAAGELQDRLGQNDS

SEQ ID NO: 149966 - protein, 35 aa, Artificial Sequence
  Description of Artificial Sequence: Synthetic polypeptide
DEEEIATTNPVAYEQYGTVATMNGGQQNGDQRGEA

SEQ ID NO: 149967 - protein, 33 aa, Artificial Sequence
  Description of Artificial Sequence: Synthetic polypeptide
DEDEIRTTNPVAYEQWGTVSGGGNHQGEGGGLN

SEQ ID NO: 149968 - protein, 35 aa, Artificial Sequence
  Description of Artificial Sequence: Synthetic polypeptide
DEEEIATTNPVAYETYGSVPWTDDSLFTERGNEEF

SEQ ID NO: 149969 - protein, 35 aa, Artificial Sequence
  Description of Artificial Sequence: Synthetic polypeptide
DEEEIATTNPVAYETYGSVPTYLELFTVRSGNEEF

SEQ ID NO: 149970 - protein, 33 aa, Artificial Sequence
  Description of Artificial Sequence: Synthetic polypeptide
MENEITTTNPVATEQYGNVSVTGGGQGDGIGEQ

SEQ ID NO: 149971 - protein, 34 aa, Artificial Sequence
  Description of Artificial Sequence: Synthetic polypeptide
DEEEIATTNPVAYERWGEVCSTNDIQGHQGNNEE

SEQ ID NO: 149972 - protein, 36 aa, Artificial Sequence
  Description of Artificial Sequence: Synthetic polypeptide
DEEEIRTTNPVATEQYGSVSPIQDLPHHIPPPNTGI

SEQ ID NO: 149973 - protein, 33 aa, Artificial Sequence
  Description of Artificial Sequence: Synthetic polypeptide
SEACEIATTNPVAYEGWGSVATNLQGDTGGNEN

SEQ ID NO: 149974 - protein, 37 aa, Artificial Sequence
  Description of Artificial Sequence: Synthetic polypeptide
DEEEIRTTNPVATEQYGSAYMSPTTTENTSVGEENQA

SEQ ID NO: 149975 - protein, 29 aa, Artificial Sequence
  Description of Artificial Sequence: Synthetic peptide
SEAEIACTNPCSYEQYGCVSWNPQSGEQA

SEQ ID NO: 149976 - protein, 37 aa, Artificial Sequence
  Description of Artificial Sequence: Synthetic polypeptide
DEEEIRTTNPVATEQYGSAYLSYTVNEDDSMSQDGDD

SEQ ID NO: 149977 - protein, 37 aa, Artificial Sequence
  Description of Artificial Sequence: Synthetic polypeptide
DEEEIRTTNPVATEQYGSAYLSPTTNENGSVGEENQF

SEQ ID NO: 149978 - protein, 35 aa, Artificial Sequence
  Description of Artificial Sequence: Synthetic polypeptide
DEEEIRTTNPVATEQYGSAYHTTLEDHNDETDETQ

SEQ ID NO: 149979 - protein, 34 aa, Artificial Sequence
  Description of Artificial Sequence: Synthetic polypeptide
DEEEIATTNPVAYERWGEVCSTNDEQQHQGNNEE

SEQ ID NO: 149980 - protein, 35 aa, Artificial Sequence
  Description of Artificial Sequence: Synthetic polypeptide
DEEEIATTNPVAYEQYGYSVMETIPDELDWRGIEG

SEQ ID NO: 149981 - protein, 37 aa, Artificial Sequence
  Description of Artificial Sequence: Synthetic polypeptide
DEEEIRTTNPVATEQYGSVSPLFNALQQEDLLMFVHE

SEQ ID NO: 149982 - protein, 35 aa, Artificial Sequence
  Description of Artificial Sequence: Synthetic polypeptide
MEPEICTTNPVATEQYGSVTDTGGNLVEEMGNGEE

SEQ ID NO: 149983 - protein, 35 aa, Artificial Sequence
  Description of Artificial Sequence: Synthetic polypeptide
DEDEIRTTNPVAYEQWGTVSTMNMLGDEHGGNGHN

SEQ ID NO: 149984 - protein, 33 aa, Artificial Sequence
  Description of Artificial Sequence: Synthetic polypeptide
DEEEIATTNPVAYEQYGTVATNEGGNHGGTGMS

SEQ ID NO: 149985 - protein, 34 aa, Artificial Sequence
  Description of Artificial Sequence: Synthetic polypeptide
DMEEIGTTNPVATEQYGVVSWFTAALQEKPEVQQ

SEQ ID NO: 149986 - protein, 36 aa, Artificial Sequence
  Description of Artificial Sequence: Synthetic polypeptide
MEQEIRTTNPVAFEQYGSVVNGQNDLDQRGEQRGIP

SEQ ID NO: 149987 - protein, 34 aa, Artificial Sequence
  Description of Artificial Sequence: Synthetic polypeptide
SEAEIATTNPVATEQYGSVCAMTHQLDETDGTGR

SEQ ID NO: 149988 - protein, 35 aa, Artificial Sequence
  Description of Artificial Sequence: Synthetic polypeptide
DEEEIRTTNPVATEQYGSVSPMIEEQDQMVEVMIY

SEQ ID NO: 149989 - protein, 34 aa, Artificial Sequence
  Description of Artificial Sequence: Synthetic polypeptide
SEAEIATTNPVATEQYGSVCAMTNGLEATDITGR

SEQ ID NO: 149990 - protein, 35 aa, Artificial Sequence
  Description of Artificial Sequence: Synthetic polypeptide
SEAEIATTNPVATEQYGSVCAMTNPLEPTDGTGER

SEQ ID NO: 149991 - protein, 32 aa, Artificial Sequence
  Description of Artificial Sequence: Synthetic polypeptide
SEAEIATTNPVAYEQYGSVTSAANQSDNNPPT

SEQ ID NO: 149992 - protein, 34 aa, Artificial Sequence
  Description of Artificial Sequence: Synthetic polypeptide
DEEEIACTNPVATEQWGCVAGTGQLQNRMGGPLH

SEQ ID NO: 149993 - protein, 38 aa, Artificial Sequence
  Description of Artificial Sequence: Synthetic polypeptide
AEEEIRTTNPVATEQYGSVSTVTNNTNNNNQEGTNNVE

SEQ ID NO: 149994 - protein, 38 aa, Artificial Sequence
  Description of Artificial Sequence: Synthetic polypeptide
AEEEIRTTNPVATEQYGSVSTVTNNQSGNTEQGNNDEE

SEQ ID NO: 149995 - protein, 34 aa, Artificial Sequence
  Description of Artificial Sequence: Synthetic polypeptide
DEEEIACTNPVATEQWGCVAGTGQLQNRMGGTAI

SEQ ID NO: 149996 - protein, 30 aa, Artificial Sequence
  Description of Artificial Sequence: Synthetic polypeptide
MESEIRTTNPVATEQWGDVSEIEMNAAEDA

SEQ ID NO: 149997 - protein, 33 aa, Artificial Sequence
  Description of Artificial Sequence: Synthetic polypeptide
SEAEIRCTNPCATEQYGCVTSNEVHLMRENQRG

SEQ ID NO: 149998 - protein, 31 aa, Artificial Sequence
  Description of Artificial Sequence: Synthetic polypeptide
SEAEIRCTNPIATEQYGCVCSWELANFGSDQ

SEQ ID NO: 149999 - protein, 38 aa, Artificial Sequence
  Description of Artificial Sequence: Synthetic polypeptide
DEEEIRTTNPVATEQYGSAVQPTAVELDVQAITPGNIL

SEQ ID NO: 150000 - protein, 38 aa, Artificial Sequence
  Description of Artificial Sequence: Synthetic polypeptide
AEEEIRTTNPVATEQYGSVSTVTNNQQNNGDEAGNEDE

SEQ ID NO: 150001 - protein, 38 aa, Artificial Sequence
  Description of Artificial Sequence: Synthetic polypeptide
AEEEIRTTNPVATEQYGSVSTVTNNQQNGTEQGNNVED

SEQ ID NO: 150002 - protein, 38 aa, Artificial Sequence
  Description of Artificial Sequence: Synthetic polypeptide
MESEIRTTNPVATEQYGASVVSPTINVLDQRIGEDYQK

SEQ ID NO: 150003 - protein, 37 aa, Artificial Sequence
  Description of Artificial Sequence: Synthetic polypeptide
AEEEIRTTNPVATEQYGSVSTVTNNQQGSEEGTTEDE

SEQ ID NO: 150004 - protein, 38 aa, Artificial Sequence
  Description of Artificial Sequence: Synthetic polypeptide
AEEEIRTTNPVATEQYGSVSTVTNNQQGNQQNGNNQGD

SEQ ID NO: 150005 - protein, 33 aa, Artificial Sequence
  Description of Artificial Sequence: Synthetic polypeptide
MESEIRTTNPVATEQYGCVQTEVPNDSDGGDQM

SEQ ID NO: 150006 - protein, 38 aa, Artificial Sequence
  Description of Artificial Sequence: Synthetic polypeptide
AEEEIRTTNPVATEQYGSVSTVTNNQQGNQEIGNNEGD

SEQ ID NO: 150007 - protein, 36 aa, Artificial Sequence
  Description of Artificial Sequence: Synthetic polypeptide
MESEIRTTNPVATEQYGCVVSITNDLLDLGDDEENQ

SEQ ID NO: 150008 - protein, 35 aa, Artificial Sequence
  Description of Artificial Sequence: Synthetic polypeptide
MESEIRTTNPVATEQYGCVVSTYDLLQLGGEEESQ

SEQ ID NO: 150009 - protein, 33 aa, Artificial Sequence
  Description of Artificial Sequence: Synthetic polypeptide
DHSDIRTTNPVATECWGSVSCIQECQDREGENG

SEQ ID NO: 150010 - protein, 33 aa, Artificial Sequence
  Description of Artificial Sequence: Synthetic polypeptide
SEAEIATTNPVAYEQYGSVSAGNLDNSNHENDN

SEQ ID NO: 150011 - protein, 36 aa, Artificial Sequence
  Description of Artificial Sequence: Synthetic polypeptide
DEEEIRTTNPVATEQYGSVSPSELHLPQVTTETDVP

SEQ ID NO: 150012 - protein, 37 aa, Artificial Sequence
  Description of Artificial Sequence: Synthetic polypeptide
DEEEIRTTNPVATEQYGSVATTLQQLQAGTEAGTEEG

SEQ ID NO: 150013 - protein, 30 aa, Artificial Sequence
  Description of Artificial Sequence: Synthetic polypeptide
DLCEIRTTNPVATEQWGDVSEIEMNAAEDA

SEQ ID NO: 150014 - protein, 34 aa, Artificial Sequence
  Description of Artificial Sequence: Synthetic polypeptide
DEDEIRTTNPVAYEQWGSVVINPGEGLNDTDNER

SEQ ID NO: 150015 - protein, 36 aa, Artificial Sequence
  Description of Artificial Sequence: Synthetic polypeptide
MEREIRTTNPVATEQYGSVSSTTPAGPNMRNGMNPV

SEQ ID NO: 150016 - protein, 29 aa, Artificial Sequence
  Description of Artificial Sequence: Synthetic peptide
MESEIASTNPVGTEGYGVMARSTLQHGDI

SEQ ID NO: 150017 - protein, 33 aa, Artificial Sequence
  Description of Artificial Sequence: Synthetic polypeptide
DEEEIATTNPVAYEQYGSVSCAMNYESDDQMEQ

SEQ ID NO: 150018 - protein, 32 aa, Artificial Sequence
  Description of Artificial Sequence: Synthetic polypeptide
SEAEIATTNPVAYDSYGMVPSCCAEHSQRGNR

SEQ ID NO: 150019 - protein, 30 aa, Artificial Sequence
  Description of Artificial Sequence: Synthetic polypeptide
QENEIATTNPVATECYGDVSECLMNHAEDA

SEQ ID NO: 150020 - protein, 31 aa, Artificial Sequence
  Description of Artificial Sequence: Synthetic polypeptide
DLSEVASTNPVATEGYGNVAANTIQSRVGQR

SEQ ID NO: 150021 - protein, 29 aa, Artificial Sequence
  Description of Artificial Sequence: Synthetic peptide
MESEIASTNPVGTEGYGVMASTLQNHGDI

SEQ ID NO: 150022 - protein, 33 aa, Artificial Sequence
  Description of Artificial Sequence: Synthetic polypeptide
SEAEIATTNPVAYEQWGSVSEGNGQPAGDNSDA

SEQ ID NO: 150023 - protein, 34 aa, Artificial Sequence
  Description of Artificial Sequence: Synthetic polypeptide
SEAEIATTNPVAYEQWGSVSTNLNQGAMGGDMST

SEQ ID NO: 150024 - protein, 34 aa, Artificial Sequence
  Description of Artificial Sequence: Synthetic polypeptide
SEAEIATTNPVAYEQYGSTVAGNGLQNSMGNPDE

SEQ ID NO: 150025 - protein, 34 aa, Artificial Sequence
  Description of Artificial Sequence: Synthetic polypeptide
DEDEIRTTNPVAYEQWGSVTGGNMGNDRNGDNGD

SEQ ID NO: 150026 - protein, 33 aa, Artificial Sequence
  Description of Artificial Sequence: Synthetic polypeptide
SEAEIATTNPVAYEQYGSVAITNDTTAEGGNDD

SEQ ID NO: 150027 - protein, 37 aa, Artificial Sequence
  Description of Artificial Sequence: Synthetic polypeptide
DEEEIRTTNPVATEQYGSVSPMMNAVEFAADQMENDD

SEQ ID NO: 150028 - protein, 36 aa, Artificial Sequence
  Description of Artificial Sequence: Synthetic polypeptide
DEEEIRTTNPVATEQYGSAVSPANMVVSHNEVENPT

SEQ ID NO: 150029 - protein, 33 aa, Artificial Sequence
  Description of Artificial Sequence: Synthetic polypeptide
MESEIRTTNPVATEAWGSMDCANEPQDREGENG

SEQ ID NO: 150030 - protein, 35 aa, Artificial Sequence
  Description of Artificial Sequence: Synthetic polypeptide
DEDEIRTTNPVAYEQWGSVSWGLNNMQDAGGNGHS

SEQ ID NO: 150031 - protein, 36 aa, Artificial Sequence
  Description of Artificial Sequence: Synthetic polypeptide
DLEEIRTTNPVATEQYGSVSSTTPAGPDMRNGMSPV

SEQ ID NO: 150032 - protein, 35 aa, Artificial Sequence
  Description of Artificial Sequence: Synthetic polypeptide
DLDEIRTTNPVATECWGSVSCINFEPQDREGENGH

SEQ ID NO: 150033 - protein, 34 aa, Artificial Sequence
  Description of Artificial Sequence: Synthetic polypeptide
DEEEIRCTNPVATEQYGCVCSSGEPQNFNSENQL

SEQ ID NO: 150034 - protein, 30 aa, Artificial Sequence
  Description of Artificial Sequence: Synthetic polypeptide
SEEEIACTNPVATEQYGCAPMHGQDSDGED

SEQ ID NO: 150035 - protein, 31 aa, Artificial Sequence
  Description of Artificial Sequence: Synthetic polypeptide
QENEIATTNPVATECYGDVSAEDCPQHEENL

SEQ ID NO: 150036 - protein, 30 aa, Artificial Sequence
  Description of Artificial Sequence: Synthetic polypeptide
QENEIATTNPVATECYGDVSAECPQHEEEL

SEQ ID NO: 150037 - protein, 37 aa, Artificial Sequence
  Description of Artificial Sequence: Synthetic polypeptide
AEEEIRTTNPVATEQYGSVSTVTNNMEQGTNNVEEED

SEQ ID NO: 150038 - protein, 35 aa, Artificial Sequence
  Description of Artificial Sequence: Synthetic polypeptide
DEDEIRTTNPVAYEQWGSVCSVDNHDQPGQGPNEH

SEQ ID NO: 150039 - protein, 35 aa, Artificial Sequence
  Description of Artificial Sequence: Synthetic polypeptide
DEDEIRTTNPVAYEQWGSVCSTWNMDQNDTQNGGA

SEQ ID NO: 150040 - protein, 37 aa, Artificial Sequence
  Description of Artificial Sequence: Synthetic polypeptide
AEEEIRTTNPVATEQYGVVSTTNNNQQGNQQGNNQTQ

SEQ ID NO: 150041 - protein, 34 aa, Artificial Sequence
  Description of Artificial Sequence: Synthetic polypeptide
DEEEIACTNPVATEQYGCVAATNPTQIDLDENAD

SEQ ID NO: 150042 - protein, 29 aa, Artificial Sequence
  Description of Artificial Sequence: Synthetic peptide
QENEIATTNPVATECYGDVAAECLAPEEI

SEQ ID NO: 150043 - protein, 34 aa, Artificial Sequence
  Description of Artificial Sequence: Synthetic polypeptide
DEDEIRTTNPVAYEQWGSVCSTTEDQGDTQNGGF

SEQ ID NO: 150044 - protein, 35 aa, Artificial Sequence
  Description of Artificial Sequence: Synthetic polypeptide
DEDEIRTTNPVAYEQWGSVCSTTDTQNGDTQNGGA

SEQ ID NO: 150045 - protein, 36 aa, Artificial Sequence
  Description of Artificial Sequence: Synthetic polypeptide
DEYEIRTTNPVATEQYGSVMPTNGNDETTQSGQDHQ

SEQ ID NO: 150046 - protein, 37 aa, Artificial Sequence
  Description of Artificial Sequence: Synthetic polypeptide
DEYEIRTTNPVATEQYGSVCSTTIMLEELHNGNEEVF

SEQ ID NO: 150047 - protein, 37 aa, Artificial Sequence
  Description of Artificial Sequence: Synthetic polypeptide
AEEEIRTTNPVATEQYGSVSTVTNNLNSNNNNNNNTD

SEQ ID NO: 150048 - protein, 33 aa, Artificial Sequence
  Description of Artificial Sequence: Synthetic polypeptide
NEAEIRTTNPVATEQYGCVSSVTEIRFFSDNTI

SEQ ID NO: 150049 - protein, 36 aa, Artificial Sequence
  Description of Artificial Sequence: Synthetic polypeptide
DEYEIRTTNPVATEQYGSVCSQIMLEELRNDNEEVF

SEQ ID NO: 150050 - protein, 37 aa, Artificial Sequence
  Description of Artificial Sequence: Synthetic polypeptide
DEYEIRTTNPVATEQYGSVCSCTIMLEELNNGNEEVF

SEQ ID NO: 150051 - protein, 36 aa, Artificial Sequence
  Description of Artificial Sequence: Synthetic polypeptide
DEEEIRTTNPVATEQYGSVCAMNMGNLEPADIPNDA

SEQ ID NO: 150052 - protein, 34 aa, Artificial Sequence
  Description of Artificial Sequence: Synthetic polypeptide
DEEEIRTTNPVATEQYGSANNVIVNDDDPSMEDN

SEQ ID NO: 150053 - protein, 34 aa, Artificial Sequence
  Description of Artificial Sequence: Synthetic polypeptide
DEEEIACTNPVATEQYGCVAGTNNSHQEADMIER

SEQ ID NO: 150054 - protein, 36 aa, Artificial Sequence
  Description of Artificial Sequence: Synthetic polypeptide
DEEEIRTTNPVATEQYGSVCAMNNGLNQTAMWPMEN

SEQ ID NO: 150055 - protein, 37 aa, Artificial Sequence
  Description of Artificial Sequence: Synthetic polypeptide
AEEEIRTTNPVATEQYGVVSTTNNNLQQNEQGTEQGD

SEQ ID NO: 150056 - protein, 34 aa, Artificial Sequence
  Description of Artificial Sequence: Synthetic polypeptide
NEAEIRTTNPVATEPYGSVFVWINEQDRKMGGDQ

SEQ ID NO: 150057 - protein, 34 aa, Artificial Sequence
  Description of Artificial Sequence: Synthetic polypeptide
DEYEIRTTNPVATEQYGSVNAENDHTQEQFEDGD

SEQ ID NO: 150058 - protein, 30 aa, Artificial Sequence
  Description of Artificial Sequence: Synthetic polypeptide
QENEIATTNPVATECYGDVAECLCQHSEEL

SEQ ID NO: 150059 - protein, 34 aa, Artificial Sequence
  Description of Artificial Sequence: Synthetic polypeptide
DEDEIRTTNPVAYEQWGSVCYNQDIMGGGGMENR

SEQ ID NO: 150060 - protein, 35 aa, Artificial Sequence
  Description of Artificial Sequence: Synthetic polypeptide
NEAEIRCTNPVATEQYGSCQYSVTNQEQQGENNQH

SEQ ID NO: 150061 - protein, 30 aa, Artificial Sequence
  Description of Artificial Sequence: Synthetic polypeptide
QENEIATTNPVATECYGDVAEDLQEHKEEL

SEQ ID NO: 150062 - protein, 34 aa, Artificial Sequence
  Description of Artificial Sequence: Synthetic polypeptide
DEDEIRTTNPVAYEQWGSVCYNQDDMGQGGQERR

SEQ ID NO: 150063 - protein, 37 aa, Artificial Sequence
  Description of Artificial Sequence: Synthetic polypeptide
AEEEIRTTNPVATEQYGVVSTTNNNSNQQGNGNNQDD

SEQ ID NO: 150064 - protein, 34 aa, Artificial Sequence
  Description of Artificial Sequence: Synthetic polypeptide
DEDEIRTTNPVAYEQWGSVCYNNPDGHHGGDNQR

SEQ ID NO: 150065 - protein, 36 aa, Artificial Sequence
  Description of Artificial Sequence: Synthetic polypeptide
NEAEIRTTNPVATEAWGSVCSKTNDDLDQRNSGDMA

SEQ ID NO: 150066 - protein, 37 aa, Artificial Sequence
  Description of Artificial Sequence: Synthetic polypeptide
DEEEIRTTNPVATEQYGSANSTANPDDLGLSGQEEIG

SEQ ID NO: 150067 - protein, 34 aa, Artificial Sequence
  Description of Artificial Sequence: Synthetic polypeptide
DEDEIRTTNPVAYEQWGSVCYNNDGHHGGNNQRM

SEQ ID NO: 150068 - protein, 38 aa, Artificial Sequence
  Description of Artificial Sequence: Synthetic polypeptide
AEEEIRTTNPVATEQYGSVSTVTNNNLNSENIGTNTTE

SEQ ID NO: 150069 - protein, 30 aa, Artificial Sequence
  Description of Artificial Sequence: Synthetic polypeptide
QENEIATTNPVATECYGDVAECLQEHKEEL

SEQ ID NO: 150070 - protein, 38 aa, Artificial Sequence
  Description of Artificial Sequence: Synthetic polypeptide
AEEEIRTTNPVATEQYGSVSTVTNNNLGGTEQGTNQDD

SEQ ID NO: 150071 - protein, 33 aa, Artificial Sequence
  Description of Artificial Sequence: Synthetic polypeptide
DEDEIRTTNPVAYEQWGSVCYNNDGGHNGNGQS

SEQ ID NO: 150072 - protein, 36 aa, Artificial Sequence
  Description of Artificial Sequence: Synthetic polypeptide
DEYEIRTTNPVATEQYGSVSPAINTGVIDNQVANLN

SEQ ID NO: 150073 - protein, 37 aa, Artificial Sequence
  Description of Artificial Sequence: Synthetic polypeptide
AEEEIRTTNPVATEQYGVVSTTNNNQQQGNTEQGQEV

SEQ ID NO: 150074 - protein, 38 aa, Artificial Sequence
  Description of Artificial Sequence: Synthetic polypeptide
AEEEIRTTNPVATEQYGSVSTVTNNNLAGTEQGTNTNQ

SEQ ID NO: 150075 - protein, 34 aa, Artificial Sequence
  Description of Artificial Sequence: Synthetic polypeptide
DEDEIRTTNPVAYEQWGSVCYMNDQHDQQGGNAM

SEQ ID NO: 150076 - protein, 35 aa, Artificial Sequence
  Description of Artificial Sequence: Synthetic polypeptide
DEYEIRTTNPVATEQYGSVSFTDMINSRMEVSFED

SEQ ID NO: 150077 - protein, 38 aa, Artificial Sequence
  Description of Artificial Sequence: Synthetic polypeptide
AEEEIRTTNPVATEQYGSVSTVTNNNDQAGTTEENTDN

SEQ ID NO: 150078 - protein, 36 aa, Artificial Sequence
  Description of Artificial Sequence: Synthetic polypeptide
DEEEIRTTNPVATEQYGSVCAMNNGNLEPPADIPNA

SEQ ID NO: 150079 - protein, 34 aa, Artificial Sequence
  Description of Artificial Sequence: Synthetic polypeptide
DEDEIRTTNPVAYEQWGSVCYNQDIMGLGGNDQR

SEQ ID NO: 150080 - protein, 34 aa, Artificial Sequence
  Description of Artificial Sequence: Synthetic polypeptide
DEEEIACTNPVATEQYGCVAGTNSHQEADIGIEQ

SEQ ID NO: 150081 - protein, 37 aa, Artificial Sequence
  Description of Artificial Sequence: Synthetic polypeptide
AEEEIRTTNPVATEQYGVVSTTNNNLEQGTNEENEEE

SEQ ID NO: 150082 - protein, 37 aa, Artificial Sequence
  Description of Artificial Sequence: Synthetic polypeptide
AEEEIRTTNPVATEQYGSVSTVTNNDEQGSTEENIAE

SEQ ID NO: 150083 - protein, 37 aa, Artificial Sequence
  Description of Artificial Sequence: Synthetic polypeptide
AEEEIRTTNPVATEQYGSVSTVTNNDEQGSTDENNDE

SEQ ID NO: 150084 - protein, 35 aa, Artificial Sequence
  Description of Artificial Sequence: Synthetic polypeptide
DEEEIRTTNPVATEQYGSAHHTTLEDHNDLEADEQ

SEQ ID NO: 150085 - protein, 37 aa, Artificial Sequence
  Description of Artificial Sequence: Synthetic polypeptide
DEEEIRCTNPVATEQYGSVSNGSNGQSGQEGGENDTQ

SEQ ID NO: 150086 - protein, 33 aa, Artificial Sequence
  Description of Artificial Sequence: Synthetic polypeptide
DEEEIACTNPVATEQYGCVATNLADAPAEDTAQ

SEQ ID NO: 150087 - protein, 36 aa, Artificial Sequence
  Description of Artificial Sequence: Synthetic polypeptide
DEEEIRTTNPVATEQYGSAGSFVTDYLTVEVVTEND

SEQ ID NO: 150088 - protein, 36 aa, Artificial Sequence
  Description of Artificial Sequence: Synthetic polypeptide
DEEEIRTTNPVATEQYGSAGPTIPENDEGGIENNDN

SEQ ID NO: 150089 - protein, 33 aa, Artificial Sequence
  Description of Artificial Sequence: Synthetic polypeptide
NEAEIRTTNPVATGHYGSVSDCLENLTEGTFDI

SEQ ID NO: 150090 - protein, 33 aa, Artificial Sequence
  Description of Artificial Sequence: Synthetic polypeptide
DEYEIGTTNPVATEQYGVVANANAGMEGGNGNQ

SEQ ID NO: 150091 - protein, 33 aa, Artificial Sequence
  Description of Artificial Sequence: Synthetic polypeptide
NEAEIRTTNPVAYEAWGCVSTNLNAGDTQNDTS

SEQ ID NO: 150092 - protein, 35 aa, Artificial Sequence
  Description of Artificial Sequence: Synthetic polypeptide
DEEEIRTTNPVATEQYGSADHPVMMAENHQLSHIG

SEQ ID NO: 150093 - protein, 30 aa, Artificial Sequence
  Description of Artificial Sequence: Synthetic polypeptide
SEEEIACTNPVATEQWGCVAGTGLINMMAD

SEQ ID NO: 150094 - protein, 32 aa, Artificial Sequence
  Description of Artificial Sequence: Synthetic polypeptide
SEEEIACTNPVATEQWGCVAGTMLQHSDDNPQ

SEQ ID NO: 150095 - protein, 29 aa, Artificial Sequence
  Description of Artificial Sequence: Synthetic peptide
QENEIATTNPVATECYGATAECWQHGEYL

SEQ ID NO: 150096 - protein, 34 aa, Artificial Sequence
  Description of Artificial Sequence: Synthetic polypeptide
DEDEIRTTNPVAYEQWGSVCSTIVDQGDTQNGGA

SEQ ID NO: 150097 - protein, 36 aa, Artificial Sequence
  Description of Artificial Sequence: Synthetic polypeptide
DEEEIRTTNPVATEQYGSACATNPELQEHQDDQDAG

SEQ ID NO: 150098 - protein, 35 aa, Artificial Sequence
  Description of Artificial Sequence: Synthetic polypeptide
DEEEIRTTNPVATEQYGSACATNPELIEHPDDAAG

SEQ ID NO: 150099 - protein, 38 aa, Artificial Sequence
  Description of Artificial Sequence: Synthetic polypeptide
AEEEIRTTNPVATEQYGSVSTVTNLQLQQSATTNEEDE

SEQ ID NO: 150100 - protein, 34 aa, Artificial Sequence
  Description of Artificial Sequence: Synthetic polypeptide
DEEEIATTNPVAYEQYGSVCAATNGEEMMGMPEG

SEQ ID NO: 150101 - protein, 34 aa, Artificial Sequence
  Description of Artificial Sequence: Synthetic polypeptide
DEYEIGTTNPVATEQYGVVSAAGNAGMEGGGNGG

SEQ ID NO: 150102 - protein, 34 aa, Artificial Sequence
  Description of Artificial Sequence: Synthetic polypeptide
DEYEIGTTNPVATEQYGVVVAANAGMQEGNGNGG

SEQ ID NO: 150103 - protein, 36 aa, Artificial Sequence
  Description of Artificial Sequence: Synthetic polypeptide
AEEEIRTTNPVATEQYGSVSTVTNNDEQGSTEETQD

SEQ ID NO: 150104 - protein, 37 aa, Artificial Sequence
  Description of Artificial Sequence: Synthetic polypeptide
AEEEIRTTNPVATEQYGSVSTVTNNLLNSNNTNNNTD

SEQ ID NO: 150105 - protein, 33 aa, Artificial Sequence
  Description of Artificial Sequence: Synthetic polypeptide
DEEEIACTNPVATEQYGCVAGTNSHQEADMIEN

SEQ ID NO: 150106 - protein, 36 aa, Artificial Sequence
  Description of Artificial Sequence: Synthetic polypeptide
DEEEIRTTNPVATEQYGSAMWETGNDQAQELNELEV

SEQ ID NO: 150107 - protein, 31 aa, Artificial Sequence
  Description of Artificial Sequence: Synthetic polypeptide
SEEEIACTNPVATASWGCVAGTGLAVRGDQR

SEQ ID NO: 150108 - protein, 30 aa, Artificial Sequence
  Description of Artificial Sequence: Synthetic polypeptide
SEEEIACTNPVATASWGCVAGTNLAPSDQR

SEQ ID NO: 150109 - protein, 34 aa, Artificial Sequence
  Description of Artificial Sequence: Synthetic polypeptide
DEEEIACTNPVATEQYGCVAGTNSHQEADMMARE

SEQ ID NO: 150110 - protein, 34 aa, Artificial Sequence
  Description of Artificial Sequence: Synthetic polypeptide
DEEEIACTNPVATEQYGCVATHHNAEAEHNGDNF

SEQ ID NO: 150111 - protein, 35 aa, Artificial Sequence
  Description of Artificial Sequence: Synthetic polypeptide
DEEEIRTTNPVATEQYGSVCAPIMLDPNAQAVQVV

SEQ ID NO: 150112 - protein, 32 aa, Artificial Sequence
  Description of Artificial Sequence: Synthetic polypeptide
DEYEIRTTNPVATEQWGCVTSEVEENIAEDEA

SEQ ID NO: 150113 - protein, 37 aa, Artificial Sequence
  Description of Artificial Sequence: Synthetic polypeptide
AEEEIRTTNPVATEQYGVVSTTNNLNQQQAATEQGTE

SEQ ID NO: 150114 - protein, 36 aa, Artificial Sequence
  Description of Artificial Sequence: Synthetic polypeptide
DEEEIRTTNPVATEQYGSAISPLEVAHIQIEIGNAQ

SEQ ID NO: 150115 - protein, 38 aa, Artificial Sequence
  Description of Artificial Sequence: Synthetic polypeptide
AEEEIRTTNPVATEQYGSVSTVTNNDEQQIGTEGNNDD

SEQ ID NO: 150116 - protein, 34 aa, Artificial Sequence
  Description of Artificial Sequence: Synthetic polypeptide
DEEEIRTTNPVATEQYGSAIGPIVAVQIGMVPEQ

SEQ ID NO: 150117 - protein, 36 aa, Artificial Sequence
  Description of Artificial Sequence: Synthetic polypeptide
AEEEIRTTNPVATEQYGVVSTTNNLEQGTDEATEED

SEQ ID NO: 150118 - protein, 33 aa, Artificial Sequence
  Description of Artificial Sequence: Synthetic polypeptide
AENEIACTNPVATEQYGEASSTTALPNRNGMNV

SEQ ID NO: 150119 - protein, 35 aa, Artificial Sequence
  Description of Artificial Sequence: Synthetic polypeptide
DEYEIRCTNPVATEQYGSVSWTYVDLEQNSFEDDI

SEQ ID NO: 150120 - protein, 35 aa, Artificial Sequence
  Description of Artificial Sequence: Synthetic polypeptide
DEEEIATTNPVAYEQYGSVCAGNNGLADRPGDEAM

SEQ ID NO: 150121 - protein, 37 aa, Artificial Sequence
  Description of Artificial Sequence: Synthetic polypeptide
AEEEIRTTNPVATEQYGSVSTVTNNDEQGTDEENTDT

SEQ ID NO: 150122 - protein, 36 aa, Artificial Sequence
  Description of Artificial Sequence: Synthetic polypeptide
AEEEIRTTNPVATEQYGVVSTTNNANQQQGTEEGQI

SEQ ID NO: 150123 - protein, 28 aa, Artificial Sequence
  Description of Artificial Sequence: Synthetic peptide
QENEIATTNPVATECYGDAPEVCQHEEL

SEQ ID NO: 150124 - protein, 37 aa, Artificial Sequence
  Description of Artificial Sequence: Synthetic polypeptide
AEEEIRTTNPVATEQYGSVSTVTNNNNATDEGNNNVE

SEQ ID NO: 150125 - protein, 34 aa, Artificial Sequence
  Description of Artificial Sequence: Synthetic polypeptide
DEDEIRTTNPVAYEQWGSVCYNQDMAGGGGNDNR

SEQ ID NO: 150126 - protein, 37 aa, Artificial Sequence
  Description of Artificial Sequence: Synthetic polypeptide
AEEEIRTTNPVATEQYGSVSTVTNNNNDTELGGNNLI

SEQ ID NO: 150127 - protein, 34 aa, Artificial Sequence
  Description of Artificial Sequence: Synthetic polypeptide
DEYEIVTTNPVATEQYGTVVSAGDGNEEGEGNGD

SEQ ID NO: 150128 - protein, 33 aa, Artificial Sequence
  Description of Artificial Sequence: Synthetic polypeptide
DEYEIVTTNPVATEQYGTVCSATDGPVEFEGPD

SEQ ID NO: 150129 - protein, 33 aa, Artificial Sequence
  Description of Artificial Sequence: Synthetic polypeptide
DEYEIVTTNPVATEQYGTVCSATDGPVEFEGLD

SEQ ID NO: 150130 - protein, 37 aa, Artificial Sequence
  Description of Artificial Sequence: Synthetic polypeptide
DEEEIRTTNPVATEQYGSVCAANQNLIATPEADENRM

SEQ ID NO: 150131 - protein, 36 aa, Artificial Sequence
  Description of Artificial Sequence: Synthetic polypeptide
AEEEIRTTNPVATEQYGVVSTTNNQQGQQSTTTTTD

SEQ ID NO: 150132 - protein, 35 aa, Artificial Sequence
  Description of Artificial Sequence: Synthetic polypeptide
DEDEIRTTNPVAYEQWGSVSGDNPLGDRQDSNGDN

SEQ ID NO: 150133 - protein, 32 aa, Artificial Sequence
  Description of Artificial Sequence: Synthetic polypeptide
DEYEIRTTNPVSTEPYGTISMKDIQQQQNGNH

SEQ ID NO: 150134 - protein, 32 aa, Artificial Sequence
  Description of Artificial Sequence: Synthetic polypeptide
DEYEIRTTNPVSTEPYGTISMEDIQQQQNGNH

SEQ ID NO: 150135 - protein, 35 aa, Artificial Sequence
  Description of Artificial Sequence: Synthetic polypeptide
DEYEIVTTNPVATEQYGTVVSATDGGNEEFEGEND

SEQ ID NO: 150136 - protein, 36 aa, Artificial Sequence
  Description of Artificial Sequence: Synthetic polypeptide
DEEEIRTTNPVATEQYGSVCAATMGSEQTAEGPQEH

SEQ ID NO: 150137 - protein, 32 aa, Artificial Sequence
  Description of Artificial Sequence: Synthetic polypeptide
DEYEIRTTNPVSTEPYGKISMEDIQQQQNGNH

SEQ ID NO: 150138 - protein, 37 aa, Artificial Sequence
  Description of Artificial Sequence: Synthetic polypeptide
AEEEIRTTNPVATEQYGVVSTTNNQQANSEEGTNTND

SEQ ID NO: 150139 - protein, 36 aa, Artificial Sequence
  Description of Artificial Sequence: Synthetic polypeptide
DEYEIRTTNPVGTEQYGSVSSTTPAGPNMRNGMNPV

SEQ ID NO: 150140 - protein, 35 aa, Artificial Sequence
  Description of Artificial Sequence: Synthetic polypeptide
DEDEIRTTNPVAYEQWGSVSGDNNDNNGQRGEEDS

SEQ ID NO: 150141 - protein, 30 aa, Artificial Sequence
  Description of Artificial Sequence: Synthetic polypeptide
QENEIATTNPVATECYGDVCSEDCPQHEED

SEQ ID NO: 150142 - protein, 34 aa, Artificial Sequence
  Description of Artificial Sequence: Synthetic polypeptide
NDEEISTTNPVATEQYGVVCSWGNLQNFGSDTQS

SEQ ID NO: 150143 - protein, 36 aa, Artificial Sequence
  Description of Artificial Sequence: Synthetic polypeptide
DEEEIRTTNPVATEQYGSVSPTAHSEIQQQAELQYI

SEQ ID NO: 150144 - protein, 34 aa, Artificial Sequence
  Description of Artificial Sequence: Synthetic polypeptide
NDENEIATTNPVAYEQWGSVAWTDNHQDMQGMNM

SEQ ID NO: 150145 - protein, 32 aa, Artificial Sequence
  Description of Artificial Sequence: Synthetic polypeptide
DEYEIRTTNPVSTEPYGTISMEDIQIQQNGNH

SEQ ID NO: 150146 - protein, 37 aa, Artificial Sequence
  Description of Artificial Sequence: Synthetic polypeptide
DEEEIRTTNPVATEQYGSASSTTPAGPNMRNGMNPVI

SEQ ID NO: 150147 - protein, 36 aa, Artificial Sequence
  Description of Artificial Sequence: Synthetic polypeptide
DEEEIRTTNPVATEQYGSASSTTPAGPNMRNTMNPV

SEQ ID NO: 150148 - protein, 38 aa, Artificial Sequence
  Description of Artificial Sequence: Synthetic polypeptide
AEEEIRTTNPVATEQYGSVSTVTNNQAGNNQAGNQEGD

SEQ ID NO: 150149 - protein, 31 aa, Artificial Sequence
  Description of Artificial Sequence: Synthetic polypeptide
QENEIATTNPVATECYGDVSAECLVQHEEEL

SEQ ID NO: 150150 - protein, 34 aa, Artificial Sequence
  Description of Artificial Sequence: Synthetic polypeptide
DEEEIACTNPVATEQWGSVSMSGNGNPAGVPNVM

SEQ ID NO: 150151 - protein, 34 aa, Artificial Sequence
  Description of Artificial Sequence: Synthetic polypeptide
SEDEIRTTNPVAYEQWGSVCPTDNQQGQMGNNNP

SEQ ID NO: 150152 - protein, 37 aa, Artificial Sequence
  Description of Artificial Sequence: Synthetic polypeptide
DEEEIRTTNPVATEQYGSVSPSLEATHQTNLIVNDQE

SEQ ID NO: 150153 - protein, 34 aa, Artificial Sequence
  Description of Artificial Sequence: Synthetic polypeptide
SEDEIRTTNPVAYEQWGSVCSTEQGLGDAQNGGA

SEQ ID NO: 150154 - protein, 35 aa, Artificial Sequence
  Description of Artificial Sequence: Synthetic polypeptide
SEDEIRTTNPVAYEQWGSVCSTMNDQRNDTQNGDA

SEQ ID NO: 150155 - protein, 34 aa, Artificial Sequence
  Description of Artificial Sequence: Synthetic polypeptide
SEDEIRTTNPVAYEQWGSVCYNQDQMGGGGNDIR

SEQ ID NO: 150156 - protein, 37 aa, Artificial Sequence
  Description of Artificial Sequence: Synthetic polypeptide
DEEEIRTTNPVATEQYGSASTHSNILEIEMEVQEDQD

SEQ ID NO: 150157 - protein, 34 aa, Artificial Sequence
  Description of Artificial Sequence: Synthetic polypeptide
SEDEIRTTNPVAYEQWGSVSTTNAGNQNDHNMSG

SEQ ID NO: 150158 - protein, 35 aa, Artificial Sequence
  Description of Artificial Sequence: Synthetic polypeptide
NDEEIRTTNPVATEQYGVVCSWENHNQENFGSNQS

SEQ ID NO: 150159 - protein, 33 aa, Artificial Sequence
  Description of Artificial Sequence: Synthetic polypeptide
SEDEIRTTNPVAYEQWGVVSGGGNLQDHPNGGS

SEQ ID NO: 150160 - protein, 34 aa, Artificial Sequence
  Description of Artificial Sequence: Synthetic polypeptide
DEDEIRTTNPVAYEQWGSVSGGGGNHQGEPGGEN

SEQ ID NO: 150161 - protein, 38 aa, Artificial Sequence
  Description of Artificial Sequence: Synthetic polypeptide
AEEEIRTTNPVATEQYGSVSTVTNNQAGNQQIGTNEDD

SEQ ID NO: 150162 - protein, 30 aa, Artificial Sequence
  Description of Artificial Sequence: Synthetic polypeptide
QENEIATTNPVATECYGDVSAECIQSHEEL

SEQ ID NO: 150163 - protein, 38 aa, Artificial Sequence
  Description of Artificial Sequence: Synthetic polypeptide
AEEEIRTTNPVATEQYGSVSTVTNNQAGNQQIGNQEGN

SEQ ID NO: 150164 - protein, 32 aa, Artificial Sequence
  Description of Artificial Sequence: Synthetic polypeptide
SEEAIRCTNPCATEQYWGCVTSNEVLMRENQD

SEQ ID NO: 150165 - protein, 38 aa, Artificial Sequence
  Description of Artificial Sequence: Synthetic polypeptide
AEEEIRTTNPVATEQYGSVSTVTNNQAGNQQAGNNEDG

SEQ ID NO: 150166 - protein, 34 aa, Artificial Sequence
  Description of Artificial Sequence: Synthetic polypeptide
DEDEIRTTNPVAYEQWGSVSGGDGGNHQGTGGHN

SEQ ID NO: 150167 - protein, 36 aa, Artificial Sequence
  Description of Artificial Sequence: Synthetic polypeptide
DEEEIRTTNPVATEQYGSVSPSSNIGGQITQLVLLN

SEQ ID NO: 150168 - protein, 32 aa, Artificial Sequence
  Description of Artificial Sequence: Synthetic polypeptide
QENEIATTNPVATECYGDVCSAEDGPQHEGNL

SEQ ID NO: 150169 - protein, 36 aa, Artificial Sequence
  Description of Artificial Sequence: Synthetic polypeptide
NDETEIATTNPVATENYGCVSTSNGLNDTERGGGER

SEQ ID NO: 150170 - protein, 36 aa, Artificial Sequence
  Description of Artificial Sequence: Synthetic polypeptide
DEEEIRCTNPVATEQYGQCVCSMTEDDFQGFGSNQA

SEQ ID NO: 150171 - protein, 37 aa, Artificial Sequence
  Description of Artificial Sequence: Synthetic polypeptide
DEEEIRCTNPVATEQYGQCVCSMTGNDNQGFGSNTQA

SEQ ID NO: 150172 - protein, 36 aa, Artificial Sequence
  Description of Artificial Sequence: Synthetic polypeptide
DEEEIRTTNPVATEQYGSASLCTPVGLQVSMVEELA

SEQ ID NO: 150173 - protein, 35 aa, Artificial Sequence
  Description of Artificial Sequence: Synthetic polypeptide
NEAEIATTNPVAYEQWGSVCSTNDLGEHQRDNTEG

SEQ ID NO: 150174 - protein, 38 aa, Artificial Sequence
  Description of Artificial Sequence: Synthetic polypeptide
AEEEIRTTNPVATEQYGSVSTVTNNNQGGTEQGTNQQQ

SEQ ID NO: 150175 - protein, 35 aa, Artificial Sequence
  Description of Artificial Sequence: Synthetic polypeptide
DEDEIRTTNPVAYEQWGSVCYTLDNDQQGTGGSNS

SEQ ID NO: 150176 - protein, 36 aa, Artificial Sequence
  Description of Artificial Sequence: Synthetic polypeptide
DEEEIRCTNPVATEQYGSVNTDNTNGQNGQEEQGEE

SEQ ID NO: 150177 - protein, 34 aa, Artificial Sequence
  Description of Artificial Sequence: Synthetic polypeptide
NEAEIATTNPVAYEQWGSVSATLRNGEDQRNGDA

SEQ ID NO: 150178 - protein, 33 aa, Artificial Sequence
  Description of Artificial Sequence: Synthetic polypeptide
DEDEIRTTNPVAYEQWGSVCYTDTQGDTQNGDQ

SEQ ID NO: 150179 - protein, 36 aa, Artificial Sequence
  Description of Artificial Sequence: Synthetic polypeptide
DEDEIRTTNPVAYEQWGSVCYTDNHDDGKQGGQNRG

SEQ ID NO: 150180 - protein, 33 aa, Artificial Sequence
  Description of Artificial Sequence: Synthetic polypeptide
DEDEIRTTNPVAYEQWGSVCYNTDGDQGNNHAN

SEQ ID NO: 150181 - protein, 37 aa, Artificial Sequence
  Description of Artificial Sequence: Synthetic polypeptide
AEEEIRTTNPVATEQYGSVSTVTNNNNQQQIGTTTDT

SEQ ID NO: 150182 - protein, 38 aa, Artificial Sequence
  Description of Artificial Sequence: Synthetic polypeptide
AEEEIRTTNPVATEQYGSVSTVTNNNNQQNEQNGNGDD

SEQ ID NO: 150183 - protein, 35 aa, Artificial Sequence
  Description of Artificial Sequence: Synthetic polypeptide
DEEEIRTTNPVATEQYGSAQQNVMAENEEVILANV

SEQ ID NO: 150184 - protein, 35 aa, Artificial Sequence
  Description of Artificial Sequence: Synthetic polypeptide
DEEEIRTTNPVATEQYGSAQFITVGEEQPEGEVEN

SEQ ID NO: 150185 - protein, 33 aa, Artificial Sequence
  Description of Artificial Sequence: Synthetic polypeptide
NEAEIATTNPVAYEQWGSVYSSDNMLDQNGMSG

SEQ ID NO: 150186 - protein, 38 aa, Artificial Sequence
  Description of Artificial Sequence: Synthetic polypeptide
AEEEIRTTNPVATEQYGSVSTVTNNNNQNQEQGTNAVD

SEQ ID NO: 150187 - protein, 33 aa, Artificial Sequence
  Description of Artificial Sequence: Synthetic polypeptide
NEAEIATTNPVAYEQWGSVYSSDNMLDQNNDAR

SEQ ID NO: 150188 - protein, 35 aa, Artificial Sequence
  Description of Artificial Sequence: Synthetic polypeptide
DEEEIRTTNPVATEQYGSAQFITMGEVQPEGEVEI

SEQ ID NO: 150189 - protein, 34 aa, Artificial Sequence
  Description of Artificial Sequence: Synthetic polypeptide
DEDEIRTTNPVAYEQWGSVCYNQDQMGGGGTDAR

SEQ ID NO: 150190 - protein, 34 aa, Artificial Sequence
  Description of Artificial Sequence: Synthetic polypeptide
NEAEIQCTNPVAYEQYGSVVQSCNEQTRGGNNVQ

SEQ ID NO: 150191 - protein, 35 aa, Artificial Sequence
  Description of Artificial Sequence: Synthetic polypeptide
DEDEIRTTNPVAYEQWGSVCYTLQDIMGGGGNDER

SEQ ID NO: 150192 - protein, 35 aa, Artificial Sequence
  Description of Artificial Sequence: Synthetic polypeptide
DEEEIRTTNPVATEQYGSASTMNIAYETETEETDT

SEQ ID NO: 150193 - protein, 36 aa, Artificial Sequence
  Description of Artificial Sequence: Synthetic polypeptide
DEYEIRTTNPVATEQYGSVSTTLNDLNISSLIDHFD

SEQ ID NO: 150194 - protein, 33 aa, Artificial Sequence
  Description of Artificial Sequence: Synthetic polypeptide
SEECISTTNPVATEQYGCVCSWNPQENFGSDQS

SEQ ID NO: 150195 - protein, 35 aa, Artificial Sequence
  Description of Artificial Sequence: Synthetic polypeptide
DEEEIRCTNPVATEQYGQCVCSNWEHQNFGSENQL

SEQ ID NO: 150196 - protein, 32 aa, Artificial Sequence
  Description of Artificial Sequence: Synthetic polypeptide
QENEIATTNPVATECYGDVCSAEDCPQHEGNL

SEQ ID NO: 150197 - protein, 30 aa, Artificial Sequence
  Description of Artificial Sequence: Synthetic polypeptide
QENEIATTNPVATECYGDVCSAECLEHEED

SEQ ID NO: 150198 - protein, 29 aa, Artificial Sequence
  Description of Artificial Sequence: Synthetic peptide
NEAEIAPTNPCSYEQWGITSCNLQSGDTR

SEQ ID NO: 150199 - protein, 35 aa, Artificial Sequence
  Description of Artificial Sequence: Synthetic polypeptide
NEAEIATTNPVATEQYGEVSWNDNHQQQDGHGGNR

SEQ ID NO: 150200 - protein, 38 aa, Artificial Sequence
  Description of Artificial Sequence: Synthetic polypeptide
AEEEIRTTNPVATEQYGSVSTVTNNNQNSNNNGTNDTD

SEQ ID NO: 150201 - protein, 33 aa, Artificial Sequence
  Description of Artificial Sequence: Synthetic polypeptide
DEYEIRTTNPVATEQYGSVYCEYDMNRSTQEEL

SEQ ID NO: 150202 - protein, 30 aa, Artificial Sequence
  Description of Artificial Sequence: Synthetic polypeptide
QENEIATTNPVATECYGDVCSAECLEFEED

SEQ ID NO: 150203 - protein, 34 aa, Artificial Sequence
  Description of Artificial Sequence: Synthetic polypeptide
DEEEIACTNPVATEQYGCSNATGNPLPAPMENHN

SEQ ID NO: 150204 - protein, 36 aa, Artificial Sequence
  Description of Artificial Sequence: Synthetic polypeptide
DEYEIRTTNPVATEQYGSVTPTNGDETTQSGQDPSQ

SEQ ID NO: 150205 - protein, 37 aa, Artificial Sequence
  Description of Artificial Sequence: Synthetic polypeptide
AEEEIRTTNPVATEQYGVVSTTNNQLQAGTEAGSTQD

SEQ ID NO: 150206 - protein, 35 aa, Artificial Sequence
  Description of Artificial Sequence: Synthetic polypeptide
DEYEIRTTNPVATEQYGSVTPTDGDETTQSGQDLQ

SEQ ID NO: 150207 - protein, 36 aa, Artificial Sequence
  Description of Artificial Sequence: Synthetic polypeptide
DEEEIRTTNPVATEQYGSASPCEVAHIQQTQGNAAQ

SEQ ID NO: 150208 - protein, 37 aa, Artificial Sequence
  Description of Artificial Sequence: Synthetic polypeptide
AEEEIRTTNPVATEQYGVVSTTNNQLLGNEQGTEEGD

SEQ ID NO: 150209 - protein, 36 aa, Artificial Sequence
  Description of Artificial Sequence: Synthetic polypeptide
AEEEIRTTNPVATEQYGVVSTTNNQLGSEEGTTEDD

SEQ ID NO: 150210 - protein, 33 aa, Artificial Sequence
  Description of Artificial Sequence: Synthetic polypeptide
NEAEIATTNPVATEQYGVVCTIEDQHQGQNNHD

SEQ ID NO: 150211 - protein, 32 aa, Artificial Sequence
  Description of Artificial Sequence: Synthetic polypeptide
SEECISTTNPVATEQYGCVCSWEPQNFGSQQS

SEQ ID NO: 150212 - protein, 35 aa, Artificial Sequence
  Description of Artificial Sequence: Synthetic polypeptide
DEDEIRTTNPVAYEQWGSVCYTNQDIMGGGGNGNR

SEQ ID NO: 150213 - protein, 36 aa, Artificial Sequence
  Description of Artificial Sequence: Synthetic polypeptide
DEEEIATTNPVAYEQYGSVCATNPQLNPDDQTGGEH

SEQ ID NO: 150214 - protein, 36 aa, Artificial Sequence
  Description of Artificial Sequence: Synthetic polypeptide
DEEEIRTTNPVATEQYGSASLHSNILEIENVVEDQD

SEQ ID NO: 150215 - protein, 33 aa, Artificial Sequence
  Description of Artificial Sequence: Synthetic polypeptide
MENEITTTNPVATEQYGNVSVTGGGQGDGGGGT

SEQ ID NO: 150216 - protein, 36 aa, Artificial Sequence
  Description of Artificial Sequence: Synthetic polypeptide
DEEEIRTTNPVATEQYGSVQPHTMNIESQQNVMQEA

SEQ ID NO: 150217 - protein, 35 aa, Artificial Sequence
  Description of Artificial Sequence: Synthetic polypeptide
DEEEIRTTNPVATEQYGQCVCSWGEDEENFGSNQP

SEQ ID NO: 150218 - protein, 36 aa, Artificial Sequence
  Description of Artificial Sequence: Synthetic polypeptide
DEDEIRTTNPVATEQYGVVATTNAELQIGTTETGSE

SEQ ID NO: 150219 - protein, 38 aa, Artificial Sequence
  Description of Artificial Sequence: Synthetic polypeptide
AEEEIRTTNPVATEQYGSVVVVVTNNNLNNQAGNNNNQ

SEQ ID NO: 150220 - protein, 33 aa, Artificial Sequence
  Description of Artificial Sequence: Synthetic polypeptide
DEDEIRTTNPVATEQYGSVYADHEQESMQDASV

SEQ ID NO: 150221 - protein, 38 aa, Artificial Sequence
  Description of Artificial Sequence: Synthetic polypeptide
AEEEIRTTNPVATEQYGSVVVVVTNNNLGQETGNVEDE

SEQ ID NO: 150222 - protein, 36 aa, Artificial Sequence
  Description of Artificial Sequence: Synthetic polypeptide
DEEEIRTTNPVATEQYGQCVCSMTEDQENFNSDNQA

SEQ ID NO: 150223 - protein, 34 aa, Artificial Sequence
  Description of Artificial Sequence: Synthetic polypeptide
QEHEIRTTNPVAYEQWGSVSCWNASQTAGGNNSF

SEQ ID NO: 150224 - protein, 36 aa, Artificial Sequence
  Description of Artificial Sequence: Synthetic polypeptide
QEHEIRTTNPVATEQYGSVSSTTPAGPNMRNGMNPV

SEQ ID NO: 150225 - protein, 38 aa, Artificial Sequence
  Description of Artificial Sequence: Synthetic polypeptide
AEEEIRTTNPVATEQYGSVSTVVSTNGNQNGNTNNQTD

SEQ ID NO: 150226 - protein, 38 aa, Artificial Sequence
  Description of Artificial Sequence: Synthetic polypeptide
AEEEIRTTNPVATEQYGSVSTTVANLQNATEQGTVIVE

SEQ ID NO: 150227 - protein, 35 aa, Artificial Sequence
  Description of Artificial Sequence: Synthetic polypeptide
NEEEIRTTNPVATEQYGCSCSTMEHNQNFQSDTQS

SEQ ID NO: 150228 - protein, 37 aa, Artificial Sequence
  Description of Artificial Sequence: Synthetic polypeptide
DEEEIRTTNPVATEQYGSVQDPNTNLLDHQNVVDPLV

SEQ ID NO: 150229 - protein, 37 aa, Artificial Sequence
  Description of Artificial Sequence: Synthetic polypeptide
DEDEIRTTNPVATEQYGSVSTVVNNQQQGQEGTEEQD

SEQ ID NO: 150230 - protein, 34 aa, Artificial Sequence
  Description of Artificial Sequence: Synthetic polypeptide
NEEEIRTTNPVATEQYGCSCSWGEDDQNFQSDQS

SEQ ID NO: 150231 - protein, 37 aa, Artificial Sequence
  Description of Artificial Sequence: Synthetic polypeptide
AEEEIRTTNPVATEQYGSVSTVVTDGGNNNLGGNDTA

SEQ ID NO: 150232 - protein, 37 aa, Artificial Sequence
  Description of Artificial Sequence: Synthetic polypeptide
AEEEIRTTNPVATEQYGSVSTTTQQLQQNIATNVATE

SEQ ID NO: 150233 - protein, 37 aa, Artificial Sequence
  Description of Artificial Sequence: Synthetic polypeptide
AEEEIRTTNPVATEQYGSVSTTTQNNMEQGTNNVTEL

SEQ ID NO: 150234 - protein, 38 aa, Artificial Sequence
  Description of Artificial Sequence: Synthetic polypeptide
DEEEIRTTNPVATEQYGSVQCWTSTNQEEEPQIPDERI

SEQ ID NO: 150235 - protein, 35 aa, Artificial Sequence
  Description of Artificial Sequence: Synthetic polypeptide
DEEEIRTTNPVATEQYGQCVCSDWEHNQGFNSEQS

SEQ ID NO: 150236 - protein, 36 aa, Artificial Sequence
  Description of Artificial Sequence: Synthetic polypeptide
DEEEIRTTNPVATEQYGQCVCSMSNHQENFGSETQS

SEQ ID NO: 150237 - protein, 36 aa, Artificial Sequence
  Description of Artificial Sequence: Synthetic polypeptide
DEDEIRTTNPVATEQYGVVATTQLQQQIGTTEQGNE

SEQ ID NO: 150238 - protein, 39 aa, Artificial Sequence
  Description of Artificial Sequence: Synthetic polypeptide
AEEEIRTTNPVATEQYGSVSTTVANLQNATTEQGTNNVE

SEQ ID NO: 150239 - protein, 36 aa, Artificial Sequence
  Description of Artificial Sequence: Synthetic polypeptide
DEEEIRTTNPVATEQYGQCVCSMTEEDNQNFGSEQA

SEQ ID NO: 150240 - protein, 37 aa, Artificial Sequence
  Description of Artificial Sequence: Synthetic polypeptide
DEEEIRTTNPVATEQYGQCVCSMTEHNQENFGSNTQA

SEQ ID NO: 150241 - protein, 35 aa, Artificial Sequence
  Description of Artificial Sequence: Synthetic polypeptide
DEVEIATTNPVATEVWGSVCYTNDLQDQGQQNDEH

SEQ ID NO: 150242 - protein, 33 aa, Artificial Sequence
  Description of Artificial Sequence: Synthetic polypeptide
DEVEIATTNPVATEVWGSVCYNNDDQDHGDEDR

SEQ ID NO: 150243 - protein, 31 aa, Artificial Sequence
  Description of Artificial Sequence: Synthetic polypeptide
AENEIATTNPVATEGYGCVCSWELQHISEQA

SEQ ID NO: 150244 - protein, 31 aa, Artificial Sequence
  Description of Artificial Sequence: Synthetic polypeptide
AENEIATTNPVATEGYGCVSSELNQHFESEL

SEQ ID NO: 150245 - protein, 33 aa, Artificial Sequence
  Description of Artificial Sequence: Synthetic polypeptide
DEVEIATTNPVATEQYGVVCAANDGPAEDDGND

SEQ ID NO: 150246 - protein, 33 aa, Artificial Sequence
  Description of Artificial Sequence: Synthetic polypeptide
DEVEIATTNPVATEQYGTVCSATDGPVEFDIND

SEQ ID NO: 150247 - protein, 33 aa, Artificial Sequence
  Description of Artificial Sequence: Synthetic polypeptide
DEVEIATTNPVATEQYGTVCSATDGGVEPENND

SEQ ID NO: 150248 - protein, 28 aa, Artificial Sequence
  Description of Artificial Sequence: Synthetic peptide
QEKEIAATNPVATEQYGEAPEVCQHEEK

SEQ ID NO: 150249 - protein, 35 aa, Artificial Sequence
  Description of Artificial Sequence: Synthetic polypeptide
DEVEIATTNPVATEQYGSVVSATDLEDGEGQEDTE

SEQ ID NO: 150250 - protein, 38 aa, Artificial Sequence
  Description of Artificial Sequence: Synthetic polypeptide
DEDEIRTTNPVATEQYGVVSTSNGNLQQGIGTTEQNED

SEQ ID NO: 150251 - protein, 29 aa, Artificial Sequence
  Description of Artificial Sequence: Synthetic peptide
QEIEIATTNPVATEQYGEAPEVKCQHEEK

SEQ ID NO: 150252 - protein, 36 aa, Artificial Sequence
  Description of Artificial Sequence: Synthetic polypeptide
DEEEIRTTNPVATEQYGSVQEITMGEEQPEGEVSEI

SEQ ID NO: 150253 - protein, 37 aa, Artificial Sequence
  Description of Artificial Sequence: Synthetic polypeptide
DEVEIATTNPVATEQYGSVSWNEGDQQDIERGGGGSR

SEQ ID NO: 150254 - protein, 37 aa, Artificial Sequence
  Description of Artificial Sequence: Synthetic polypeptide
DEVEIATTNPVATEQYGSVSWNEGDLQGQERGGGGSQ

SEQ ID NO: 150255 - protein, 28 aa, Artificial Sequence
  Description of Artificial Sequence: Synthetic peptide
QEIEIASTNPVGTEGYGVMAMTLQHGDI

SEQ ID NO: 150256 - protein, 37 aa, Artificial Sequence
  Description of Artificial Sequence: Synthetic polypeptide
DEEEIRTTNPVATEQYGQCVCSMTEEHNQNFGSDNQM

SEQ ID NO: 150257 - protein, 37 aa, Artificial Sequence
  Description of Artificial Sequence: Synthetic polypeptide
AEEEIRTTNPVATEQYGSVSTTVDNGNNSEEGNNQED

SEQ ID NO: 150258 - protein, 30 aa, Artificial Sequence
  Description of Artificial Sequence: Synthetic polypeptide
AENEIATTNPVATEPYGEISMEDIQQQGGH

SEQ ID NO: 150259 - protein, 30 aa, Artificial Sequence
  Description of Artificial Sequence: Synthetic polypeptide
QEHEIATTNPVATEQYGCAPMHGQDSEGED

SEQ ID NO: 150260 - protein, 36 aa, Artificial Sequence
  Description of Artificial Sequence: Synthetic polypeptide
DEEEIRTTNPVATEQYGQCVCSMTEPHQEYFGSEQS

SEQ ID NO: 150261 - protein, 36 aa, Artificial Sequence
  Description of Artificial Sequence: Synthetic polypeptide
DEEEIRTTNPVATEQYGQCVCSDTEHNQEHFNSDQS

SEQ ID NO: 150262 - protein, 37 aa, Artificial Sequence
  Description of Artificial Sequence: Synthetic polypeptide
DEDEIRTTNPVATEQYGSVSTVTNNQQQNQQGTTEDT

SEQ ID NO: 150263 - protein, 29 aa, Artificial Sequence
  Description of Artificial Sequence: Synthetic peptide
QEHEIASTNPVGTEGYGVMASDTLQHGDI

SEQ ID NO: 150264 - protein, 29 aa, Artificial Sequence
  Description of Artificial Sequence: Synthetic peptide
QEHEIASTNPVGTEGYGVHASTLQHGDIQ

SEQ ID NO: 150265 - protein, 29 aa, Artificial Sequence
  Description of Artificial Sequence: Synthetic peptide
QEHEIASTNPVGTEGWGVSASTLQHGDEI

SEQ ID NO: 150266 - protein, 35 aa, Artificial Sequence
  Description of Artificial Sequence: Synthetic polypeptide
NEEEIRTTNPVATEQYGCVCSTAENHDEFFGSDQS

SEQ ID NO: 150267 - protein, 36 aa, Artificial Sequence
  Description of Artificial Sequence: Synthetic polypeptide
DEVEIATTNPVATEQYGSVCADTNPLTNPTNGNLTE

SEQ ID NO: 150268 - protein, 35 aa, Artificial Sequence
  Description of Artificial Sequence: Synthetic polypeptide
DEVEIATTNPVATEQYGSVCADTNPGIEHGDNMAE

SEQ ID NO: 150269 - protein, 29 aa, Artificial Sequence
  Description of Artificial Sequence: Synthetic peptide
QEHEIASTNPCSYEQWGIVACNLQSGMTR

SEQ ID NO: 150270 - protein, 36 aa, Artificial Sequence
  Description of Artificial Sequence: Synthetic polypeptide
DEEEIRTTNPVATEQYGSVCSPLTLPDSISNEEPEE

SEQ ID NO: 150271 - protein, 36 aa, Artificial Sequence
  Description of Artificial Sequence: Synthetic polypeptide
DEEEIRTTNPVATEQYGQCVCGNTGNLIEYFGSDQS

SEQ ID NO: 150272 - protein, 37 aa, Artificial Sequence
  Description of Artificial Sequence: Synthetic polypeptide
DEEEIRTTNPVATEQYGSVSQVVVFLDPVSMTNVERH

SEQ ID NO: 150273 - protein, 35 aa, Artificial Sequence
  Description of Artificial Sequence: Synthetic polypeptide
DEEEIACTNPVATEQYGSACATNPLAEAEMGNDNA

SEQ ID NO: 150274 - protein, 37 aa, Artificial Sequence
  Description of Artificial Sequence: Synthetic polypeptide
DEEEIRTTNPVATEQYGSVSRPSEAGPNMQNGMQDVV

SEQ ID NO: 150275 - protein, 29 aa, Artificial Sequence
  Description of Artificial Sequence: Synthetic peptide
QEHEIAPTNPCSYEQWGIVSCNLQSGDTA

SEQ ID NO: 150276 - protein, 37 aa, Artificial Sequence
  Description of Artificial Sequence: Synthetic polypeptide
AEEEIRTTNPVATEQYGSVSTTTNNTEIGSTNQNEQQ

SEQ ID NO: 150277 - protein, 35 aa, Artificial Sequence
  Description of Artificial Sequence: Synthetic polypeptide
DEEEIRTTNPVATEQYGQCTCSWNEHQNFGSDTQS

SEQ ID NO: 150278 - protein, 36 aa, Artificial Sequence
  Description of Artificial Sequence: Synthetic polypeptide
DEEEIRTTNPVATEQYGSVQCTVELPQFQTFMQLEE

SEQ ID NO: 150279 - protein, 38 aa, Artificial Sequence
  Description of Artificial Sequence: Synthetic polypeptide
AEEEIRTTNPVATEQYGSVSTTTNNQQQANEQGNNANE

SEQ ID NO: 150280 - protein, 38 aa, Artificial Sequence
  Description of Artificial Sequence: Synthetic polypeptide
AEEEIRTTNPVATEQYGSVSTTTNNQNNNQLQGTNTTD

SEQ ID NO: 150281 - protein, 35 aa, Artificial Sequence
  Description of Artificial Sequence: Synthetic polypeptide
DEEEIRTTNPVATEQYGSVSRENDDHADYASDLEH

SEQ ID NO: 150282 - protein, 28 aa, Artificial Sequence
  Description of Artificial Sequence: Synthetic peptide
QEHEIASTNPVGTEGYGVMASTFQHGDI

SEQ ID NO: 150283 - protein, 28 aa, Artificial Sequence
  Description of Artificial Sequence: Synthetic peptide
QEHEIASTNPVGTEGYGVMASTLAHGDI

SEQ ID NO: 150284 - protein, 35 aa, Artificial Sequence
  Description of Artificial Sequence: Synthetic polypeptide
NEEEIRTTNPVATEQYGCVCSSGELNDEFFGSNQM

SEQ ID NO: 150285 - protein, 38 aa, Artificial Sequence
  Description of Artificial Sequence: Synthetic polypeptide
DEDEIRTTNPVATEQYGSVSTVTNNQQQGNQQGTEEDT

SEQ ID NO: 150286 - protein, 33 aa, Artificial Sequence
  Description of Artificial Sequence: Synthetic polypeptide
NEEEIRTTNPVATEQYGCVCSAEEHDEFGSDQS

SEQ ID NO: 150287 - protein, 35 aa, Artificial Sequence
  Description of Artificial Sequence: Synthetic polypeptide
DEEEIRTTNPVATEQYGQCVCSAGEHQNFGSDTQP

SEQ ID NO: 150288 - protein, 34 aa, Artificial Sequence
  Description of Artificial Sequence: Synthetic polypeptide
DEEEIRTTNPVATEQYGQCVCQWEHQENFGSEQS

SEQ ID NO: 150289 - protein, 37 aa, Artificial Sequence
  Description of Artificial Sequence: Synthetic polypeptide
AEEEIRTTNPVATEQYGSVSTTTNQQQQNANEQGTDE

SEQ ID NO: 150290 - protein, 35 aa, Artificial Sequence
  Description of Artificial Sequence: Synthetic polypeptide
NEEEIRTTNPVATEQYGCVCSAENLNAEFFGSDQS

SEQ ID NO: 150291 - protein, 38 aa, Artificial Sequence
  Description of Artificial Sequence: Synthetic polypeptide
DEDEIRTTNPVATEQYGSVSTVNNNQQGNQQGNNETND

SEQ ID NO: 150292 - protein, 38 aa, Artificial Sequence
  Description of Artificial Sequence: Synthetic polypeptide
DEDEIRTTNPVATEQYGSVSTVNNNQNGNQQGTINTNG

SEQ ID NO: 150293 - protein, 34 aa, Artificial Sequence
  Description of Artificial Sequence: Synthetic polypeptide
NEEEIRTTNPVATEQYGCVCSAGEHDEFFGSNAA

SEQ ID NO: 150294 - protein, 34 aa, Artificial Sequence
  Description of Artificial Sequence: Synthetic polypeptide
NEEEIRTTNPVATEQYGCVCSAGNHAEFFGSDAA

SEQ ID NO: 150295 - protein, 35 aa, Artificial Sequence
  Description of Artificial Sequence: Synthetic polypeptide
DEEEIRTTNPVATEQYGQCVCPMTEHQENFGSEQN

SEQ ID NO: 150296 - protein, 38 aa, Artificial Sequence
  Description of Artificial Sequence: Synthetic polypeptide
DEDEIRTTNPVATEQYGSVSTTVVNNQQQGNIGTTEDE

SEQ ID NO: 150297 - protein, 35 aa, Artificial Sequence
  Description of Artificial Sequence: Synthetic polypeptide
DEEEIRTTNPVATEQYGQCVCGTGEHQEGFGSDQA

SEQ ID NO: 150298 - protein, 35 aa, Artificial Sequence
  Description of Artificial Sequence: Synthetic polypeptide
DEEEIRTTNPVATEQYGQCVCGSGEHNQNFGSEQA

SEQ ID NO: 150299 - protein, 28 aa, Artificial Sequence
  Description of Artificial Sequence: Synthetic peptide
QEHEIASTNPVGTEGYGVMASTWQHGDI

SEQ ID NO: 150300 - protein, 38 aa, Artificial Sequence
  Description of Artificial Sequence: Synthetic polypeptide
DEEEIRTTNPVATEQYGSVQCWTSTNFEQINMIPDERE

SEQ ID NO: 150301 - protein, 36 aa, Artificial Sequence
  Description of Artificial Sequence: Synthetic polypeptide
DEEEIRTTNPVATEQYGSVQCWTSNNLGNPIPDESF

SEQ ID NO: 150302 - protein, 38 aa, Artificial Sequence
  Description of Artificial Sequence: Synthetic polypeptide
DEDEIRTTNPVATEQYGSVSTTVNNQNTNQQGTTNTNG

SEQ ID NO: 150303 - protein, 38 aa, Artificial Sequence
  Description of Artificial Sequence: Synthetic polypeptide
DEDEIRTTNPVATEQYGSVSTTVNNNQQQLQQGTEEDT

SEQ ID NO: 150304 - protein, 37 aa, Artificial Sequence
  Description of Artificial Sequence: Synthetic polypeptide
DEDEIRTTNPVATEQYGSVSTVTNQQNQNQQGTEEDT

SEQ ID NO: 150305 - protein, 36 aa, Artificial Sequence
  Description of Artificial Sequence: Synthetic polypeptide
DEEEIRTTNPVATEQYGQCVCSMTESHNQNFGSEQS

SEQ ID NO: 150306 - protein, 34 aa, Artificial Sequence
  Description of Artificial Sequence: Synthetic polypeptide
NEEEIRTTNPVATEQYGCSCSNTGEHQYFQSDQA

SEQ ID NO: 150307 - protein, 36 aa, Artificial Sequence
  Description of Artificial Sequence: Synthetic polypeptide
NEEEIRTTNPVATEQYGCSCSNTGEHNQYFQSDNQS

SEQ ID NO: 150308 - protein, 37 aa, Artificial Sequence
  Description of Artificial Sequence: Synthetic polypeptide
AEEEIRTTNPVATEQYGSVVVVVTTDQNQQGIGNNLG

SEQ ID NO: 150309 - protein, 34 aa, Artificial Sequence
  Description of Artificial Sequence: Synthetic polypeptide
DEVEIATTNPVAYECWGCVSTNLAQGNAGENDGM

SEQ ID NO: 150310 - protein, 30 aa, Artificial Sequence
  Description of Artificial Sequence: Synthetic polypeptide
QEMEIACTNPCSYEQYGCVSWEELQSGSER

SEQ ID NO: 150311 - protein, 32 aa, Artificial Sequence
  Description of Artificial Sequence: Synthetic polypeptide
DEVEIATTNPVAYEAWGVCSTNDQHGQGGNDA

SEQ ID NO: 150312 - protein, 33 aa, Artificial Sequence
  Description of Artificial Sequence: Synthetic polypeptide
NEEEIRTTNPCAYEQWGSVYCTDNDEHRGHDVA

SEQ ID NO: 150313 - protein, 36 aa, Artificial Sequence
  Description of Artificial Sequence: Synthetic polypeptide
DEEEIRTTNPVATEQYGQCVCSNTEHNQNFGSETQF

SEQ ID NO: 150314 - protein, 38 aa, Artificial Sequence
  Description of Artificial Sequence: Synthetic polypeptide
DEEEIRTTNPVATEQYGSVSQPIPASGPNMQNGMNPVV

SEQ ID NO: 150315 - protein, 36 aa, Artificial Sequence
  Description of Artificial Sequence: Synthetic polypeptide
DEEEIRTTNPVATEQYGSVQFDTMGMEEQPNGEVEI

SEQ ID NO: 150316 - protein, 37 aa, Artificial Sequence
  Description of Artificial Sequence: Synthetic polypeptide
AEEEIRTTNPVATEQYGSVVVVVTTDTNNQGIGTNLE

SEQ ID NO: 150317 - protein, 38 aa, Artificial Sequence
  Description of Artificial Sequence: Synthetic polypeptide
AEEEIRTTNPVATEQYGSVSTTVQNLNNADEQGTNPVE

SEQ ID NO: 150318 - protein, 36 aa, Artificial Sequence
  Description of Artificial Sequence: Synthetic polypeptide
AEEEIRTTNPVATEQYGSVSTTVNTNNVETGTDTDT

SEQ ID NO: 150319 - protein, 31 aa, Artificial Sequence
  Description of Artificial Sequence: Synthetic polypeptide
QEMEIACTNPCSYEQYGCVSNWNLQSGSERA

SEQ ID NO: 150320 - protein, 37 aa, Artificial Sequence
  Description of Artificial Sequence: Synthetic polypeptide
DEEEIRTTNPVATEQYGQCVCSNTEENQEHFGSENQL

SEQ ID NO: 150321 - protein, 37 aa, Artificial Sequence
  Description of Artificial Sequence: Synthetic polypeptide
DEEEIRTTNPVATEQYGSVSQPQPAGPNMQNDPNPVV

SEQ ID NO: 150322 - protein, 30 aa, Artificial Sequence
  Description of Artificial Sequence: Synthetic polypeptide
AENEIATTNPVATECYGCVSWEHQHESELS

SEQ ID NO: 150323 - protein, 33 aa, Artificial Sequence
  Description of Artificial Sequence: Synthetic polypeptide
DEVEIATTNPVAYDQYGMTVPSCCAEHSQQGNR

SEQ ID NO: 150324 - protein, 38 aa, Artificial Sequence
  Description of Artificial Sequence: Synthetic polypeptide
DEEEIRTTNPVATEQYGSVSQPSNAAGPNMQNGMNDVV

SEQ ID NO: 150325 - protein, 31 aa, Artificial Sequence
  Description of Artificial Sequence: Synthetic polypeptide
QEMEIACTNPCSYEQYGCVCSWNLQESGSQR

SEQ ID NO: 150326 - protein, 37 aa, Artificial Sequence
  Description of Artificial Sequence: Synthetic polypeptide
DEEEIRTTNPVATEQYGQCVCSNTEHNAENFGSENQF

SEQ ID NO: 150327 - protein, 37 aa, Artificial Sequence
  Description of Artificial Sequence: Synthetic polypeptide
AEEEIRTTNPVATEQYGSVVVVVTTDTNNQIGTNQDD

SEQ ID NO: 150328 - protein, 30 aa, Artificial Sequence
  Description of Artificial Sequence: Synthetic polypeptide
QEMEIACTNPCSYEQYGCVSWGNLQSGSEA

SEQ ID NO: 150329 - protein, 29 aa, Artificial Sequence
  Description of Artificial Sequence: Synthetic peptide
QEMEIACTNPCSYEQYGCVSWNHQSGSVQ

SEQ ID NO: 150330 - protein, 35 aa, Artificial Sequence
  Description of Artificial Sequence: Synthetic polypeptide
DEEEIRTTNPVATEQYGSVSQLNEIEVEPDVEYDT

SEQ ID NO: 150331 - protein, 35 aa, Artificial Sequence
  Description of Artificial Sequence: Synthetic polypeptide
DEEEIRTTNPVATEQYGSVQFISMGEEQPETEVEI

SEQ ID NO: 150332 - protein, 36 aa, Artificial Sequence
  Description of Artificial Sequence: Synthetic polypeptide
DEEEIRTTNPVATEQYGSVQFISMGEEQPEGEVPEQ

SEQ ID NO: 150333 - protein, 38 aa, Artificial Sequence
  Description of Artificial Sequence: Synthetic polypeptide
AEEEIRTTNPVATEQYGSVVVVVTTNLLGNQEGNNNDG

SEQ ID NO: 150334 - protein, 37 aa, Artificial Sequence
  Description of Artificial Sequence: Synthetic polypeptide
DEEEIRTTNPVATEQYGSVSQMNLGDSHAQPNVVFVA

SEQ ID NO: 150335 - protein, 38 aa, Artificial Sequence
  Description of Artificial Sequence: Synthetic polypeptide
AEEEIRTTNPVATEQYGSVVVVVTTNLGQQGNNQEDTE

SEQ ID NO: 150336 - protein, 38 aa, Artificial Sequence
  Description of Artificial Sequence: Synthetic polypeptide
AEEEIRTTNPVATEQYGSVSTVAQLGNAQNEQGTNNVE

SEQ ID NO: 150337 - protein, 37 aa, Artificial Sequence
  Description of Artificial Sequence: Synthetic polypeptide
DEEEIRTTNPVATEQYGSVSQMNLGLEHTQPNVVFVA

SEQ ID NO: 150338 - protein, 36 aa, Artificial Sequence
  Description of Artificial Sequence: Synthetic polypeptide
DEEEIRTTNPVATEQYGSVSQMNLSPPTPEVSELKN

SEQ ID NO: 150339 - protein, 38 aa, Artificial Sequence
  Description of Artificial Sequence: Synthetic polypeptide
DEDEIRTTNPVATEQYGVVSTTNNLQLGNQQGNNNQND

SEQ ID NO: 150340 - protein, 38 aa, Artificial Sequence
  Description of Artificial Sequence: Synthetic polypeptide
DEDEIRTTNPVATEQYGVVSTTNNLQAGNQQGTNQTND

SEQ ID NO: 150341 - protein, 34 aa, Artificial Sequence
  Description of Artificial Sequence: Synthetic polypeptide
DEEEIATTNPVAYEQWGSVSTVNPGNDETNENIK

SEQ ID NO: 150342 - protein, 37 aa, Artificial Sequence
  Description of Artificial Sequence: Synthetic polypeptide
AEEEIRTTNPVATEQYGSVVVVVTTNLGNNEGENAED

SEQ ID NO: 150343 - protein, 38 aa, Artificial Sequence
  Description of Artificial Sequence: Synthetic polypeptide
DEDEIRTTNPVATEQYGVVSTTNNLQAGNQQGNENQED

SEQ ID NO: 150344 - protein, 34 aa, Artificial Sequence
  Description of Artificial Sequence: Synthetic polypeptide
DEVEIATTNPVAYEGWGSVATTNQEQGNDMGNER

SEQ ID NO: 150345 - protein, 38 aa, Artificial Sequence
  Description of Artificial Sequence: Synthetic polypeptide
DEEEIRTTNPVATEQYGSVCSNTSLVHTDTQENVEEER

SEQ ID NO: 150346 - protein, 32 aa, Artificial Sequence
  Description of Artificial Sequence: Synthetic polypeptide
DEVEIATTNPVAYEGWGSVATNPQGNDMGGEE

SEQ ID NO: 150347 - protein, 37 aa, Artificial Sequence
  Description of Artificial Sequence: Synthetic polypeptide
AEEEIRTTNPVATEQYGSVVVVVTTNGNQQGEGNNTE

SEQ ID NO: 150348 - protein, 32 aa, Artificial Sequence
  Description of Artificial Sequence: Synthetic polypeptide
DEVEIATTNPVAYEGWGSVATNEQGNDMGGEL

SEQ ID NO: 150349 - protein, 36 aa, Artificial Sequence
  Description of Artificial Sequence: Synthetic polypeptide
DEEEIRTTNPVATEQYGQCVCSNTEEHQHFGSDTQT

SEQ ID NO: 150350 - protein, 37 aa, Artificial Sequence
  Description of Artificial Sequence: Synthetic polypeptide
DEEEIRTTNPVATEQYGSVSQPSPAGPNMPNGMNDVL

SEQ ID NO: 150351 - protein, 30 aa, Artificial Sequence
  Description of Artificial Sequence: Synthetic polypeptide
QEMEIACTNPCSYEQYGCVCSWALQSGSER

SEQ ID NO: 150352 - protein, 37 aa, Artificial Sequence
  Description of Artificial Sequence: Synthetic polypeptide
DEEEIRTTNPVATEQYGSVSQPSPAQPNMQNGMEDVV

SEQ ID NO: 150353 - protein, 32 aa, Artificial Sequence
  Description of Artificial Sequence: Synthetic polypeptide
DEVEIATTNPVATTQWGMVRTWDQGQQGQQER

SEQ ID NO: 150354 - protein, 33 aa, Artificial Sequence
  Description of Artificial Sequence: Synthetic polypeptide
DEVEIATTNPVATTQWGMVRTWDQGQQGQNETR

SEQ ID NO: 150355 - protein, 37 aa, Artificial Sequence
  Description of Artificial Sequence: Synthetic polypeptide
AEEEIRTTNPVATEQYGSVSTTVNNNNQQQGTEQGQE

SEQ ID NO: 150356 - protein, 38 aa, Artificial Sequence
  Description of Artificial Sequence: Synthetic polypeptide
AEEEIRTTNPVATEQYGSVVVVVTNNNLQNNEGQNTED

SEQ ID NO: 150357 - protein, 37 aa, Artificial Sequence
  Description of Artificial Sequence: Synthetic polypeptide
AEEEIRTTNPVATEQYGSVSTTVNNNEQGTNQQNELG

SEQ ID NO: 150358 - protein, 37 aa, Artificial Sequence
  Description of Artificial Sequence: Synthetic polypeptide
AEEEIRTTNPVATEQYGSVSTTVNNNEQGTNNQNETF

SEQ ID NO: 150359 - protein, 37 aa, Artificial Sequence
  Description of Artificial Sequence: Synthetic polypeptide
AEEEIRTTNPVATEQYGSVSTTVNNNEQGTNNNNELL

SEQ ID NO: 150360 - protein, 37 aa, Artificial Sequence
  Description of Artificial Sequence: Synthetic polypeptide
AEEEIRTTNPVATEQYGSVSTTVNNNEQGTNNNDEQF

SEQ ID NO: 150361 - protein, 29 aa, Artificial Sequence
  Description of Artificial Sequence: Synthetic peptide
QELEIATTNPVATEQYGEAPEVCQGHEEK

SEQ ID NO: 150362 - protein, 37 aa, Artificial Sequence
  Description of Artificial Sequence: Synthetic polypeptide
DEEEIRTTNPVATEQYGSVCSPENTHDMPEQNEQNNQ

SEQ ID NO: 150363 - protein, 37 aa, Artificial Sequence
  Description of Artificial Sequence: Synthetic polypeptide
DEEEIRTTNPVATEQYGSVSQPVVFLDPVSMPNVERQ

SEQ ID NO: 150364 - protein, 36 aa, Artificial Sequence
  Description of Artificial Sequence: Synthetic polypeptide
DEEEIRTTNPVATEQYGQCVCSMWEHNQENFGSNQS

SEQ ID NO: 150365 - protein, 36 aa, Artificial Sequence
  Description of Artificial Sequence: Synthetic polypeptide
DEEEIRTTNPVATEQYGSVSQSSNIGVQETQLSLLG

SEQ ID NO: 150366 - protein, 35 aa, Artificial Sequence
  Description of Artificial Sequence: Synthetic polypeptide
DEEEIRTTNPVATEQYGQCVCSMWEDQNFGSETQD

SEQ ID NO: 150367 - protein, 35 aa, Artificial Sequence
  Description of Artificial Sequence: Synthetic polypeptide
DEEEIRTTNPVATEQYGQCVCSMWEDHQNFNSDQA

SEQ ID NO: 150368 - protein, 31 aa, Artificial Sequence
  Description of Artificial Sequence: Synthetic polypeptide
AENEIATTNPVATEGYGCVCSNWALQHESEL

SEQ ID NO: 150369 - protein, 29 aa, Artificial Sequence
  Description of Artificial Sequence: Synthetic peptide
QEKEIATTNPVATEQYGEAPEGVCQHEEK

SEQ ID NO: 150370 - protein, 35 aa, Artificial Sequence
  Description of Artificial Sequence: Synthetic polypeptide
NEEEIRTTNPVATEQYGCSCSNTELNQENFQSDQA

SEQ ID NO: 150371 - protein, 31 aa, Artificial Sequence
  Description of Artificial Sequence: Synthetic polypeptide
AENEIATTNPVATEGYGCVCSWALQHMSELA

SEQ ID NO: 150372 - protein, 35 aa, Artificial Sequence
  Description of Artificial Sequence: Synthetic polypeptide
QELETATTNPVATEQYGSVSTGDNGDQRIGGDTGD

SEQ ID NO: 150373 - protein, 38 aa, Artificial Sequence
  Description of Artificial Sequence: Synthetic polypeptide
AEEEIRTTNPVATEQYGSVSTTTNNQLQNTEQGTTEDE

SEQ ID NO: 150374 - protein, 33 aa, Artificial Sequence
  Description of Artificial Sequence: Synthetic polypeptide
DEVEIATTNPVATTQWGMVRTWEDHQQHGQNER

SEQ ID NO: 150375 - protein, 32 aa, Artificial Sequence
  Description of Artificial Sequence: Synthetic polypeptide
DEVEIATTNPVATTQWGMVVRTWDQHQQGNEM

SEQ ID NO: 150376 - protein, 36 aa, Artificial Sequence
  Description of Artificial Sequence: Synthetic polypeptide
DEEEIRTTNPVATEQYGQCVCSNTEEHNIFFGSDQA

SEQ ID NO: 150377 - protein, 31 aa, Artificial Sequence
  Description of Artificial Sequence: Synthetic polypeptide
QEMEIACTNPCSYEQYGCVCSSGNLQSGSER

SEQ ID NO: 150378 - protein, 37 aa, Artificial Sequence
  Description of Artificial Sequence: Synthetic polypeptide
AEEEIRTTNPVATEQYGSVVVVVTTDGNQQAIGTNDE

SEQ ID NO: 150379 - protein, 36 aa, Artificial Sequence
  Description of Artificial Sequence: Synthetic polypeptide
DEEEIRTTNPVATEQYGQCVCSNTEDNQENFNSDQA

SEQ ID NO: 150380 - protein, 36 aa, Artificial Sequence
  Description of Artificial Sequence: Synthetic polypeptide
DEEEIRTTNPVATEQYGQCVCSNTEDHNQNFGSEQF

SEQ ID NO: 150381 - protein, 37 aa, Artificial Sequence
  Description of Artificial Sequence: Synthetic polypeptide
DEEEIRTTNPVATEQYGSVSQPTFAGPNEQNAMADVV

SEQ ID NO: 150382 - protein, 36 aa, Artificial Sequence
  Description of Artificial Sequence: Synthetic polypeptide
AEEEIRTTNPVATEQYGSVSTTVNQNGSEQGTTAEE

SEQ ID NO: 150383 - protein, 38 aa, Artificial Sequence
  Description of Artificial Sequence: Synthetic polypeptide
DEEEIRTTNPVATEQYGSVSQPTPAEGPVEQNGMNDVV

SEQ ID NO: 150384 - protein, 37 aa, Artificial Sequence
  Description of Artificial Sequence: Synthetic polypeptide
DEEEIRTTNPVATEQYGQCVCSNTEDHNQNFGSDNQS

SEQ ID NO: 150385 - protein, 37 aa, Artificial Sequence
  Description of Artificial Sequence: Synthetic polypeptide
AEEEIRTTNPVATEQYGSVVVVVTNQQQNNEGQNEED

SEQ ID NO: 150386 - protein, 37 aa, Artificial Sequence
  Description of Artificial Sequence: Synthetic polypeptide
NEEEIRTTNPVATEQWGHSNVSYTANELQHIPGGQFE

SEQ ID NO: 150387 - protein, 37 aa, Artificial Sequence
  Description of Artificial Sequence: Synthetic polypeptide
DEEEIRTTNPVATEQYGSVSQPTPAGPNEQNLMPDVV

SEQ ID NO: 150388 - protein, 37 aa, Artificial Sequence
  Description of Artificial Sequence: Synthetic polypeptide
AEEEIRTTNPVATEQYGSVSTTVNQGNQEGTEQGTSQ

SEQ ID NO: 150389 - protein, 37 aa, Artificial Sequence
  Description of Artificial Sequence: Synthetic polypeptide
AEEEIRTTNPVATEQYGSVSTTVNQAGTNEQGTNDEE

SEQ ID NO: 150390 - protein, 37 aa, Artificial Sequence
  Description of Artificial Sequence: Synthetic polypeptide
DEEEIRTTNPVATEQYGSVSQPTPAGPNMINAMNDVV

SEQ ID NO: 150391 - protein, 37 aa, Artificial Sequence
  Description of Artificial Sequence: Synthetic polypeptide
AEEEIRTTNPVATEQYGSVSTTVNNSEQGTNNTNEEF

SEQ ID NO: 150392 - protein, 36 aa, Artificial Sequence
  Description of Artificial Sequence: Synthetic polypeptide
NEEEIRTTNPVATEQWGSTVSYAGAMLSDEFGGNRG

SEQ ID NO: 150393 - protein, 38 aa, Artificial Sequence
  Description of Artificial Sequence: Synthetic polypeptide
AEEEIRTTNPVATEQYGSVVVVVTNNQLQQGEGNEETE

SEQ ID NO: 150394 - protein, 37 aa, Artificial Sequence
  Description of Artificial Sequence: Synthetic polypeptide
AEEEIRTTNPVATEQYGSVVVVVTNNNQNNEGQNDED

SEQ ID NO: 150395 - protein, 35 aa, Artificial Sequence
  Description of Artificial Sequence: Synthetic polypeptide
DEEEIRTTNPVATEQYGSVQEPVNAGHERNDSVVH

SEQ ID NO: 150396 - protein, 37 aa, Artificial Sequence
  Description of Artificial Sequence: Synthetic polypeptide
AEEEIRTTNPVATEQYGSVVVVVTTNLNNDEEGNVDE

SEQ ID NO: 150397 - protein, 35 aa, Artificial Sequence
  Description of Artificial Sequence: Synthetic polypeptide
NEEEIRTTNPVATEQYGQCSCSTGEHNQHFQSDQA

SEQ ID NO: 150398 - protein, 36 aa, Artificial Sequence
  Description of Artificial Sequence: Synthetic polypeptide
DEEEIRTTNPVATEQYGQCTCSMTENDSQNIGSEQS

SEQ ID NO: 150399 - protein, 36 aa, Artificial Sequence
  Description of Artificial Sequence: Synthetic polypeptide
AEEEIRTTNPVATEQYGSVSTTQQLNDNEEIGTTDQ

SEQ ID NO: 150400 - protein, 34 aa, Artificial Sequence
  Description of Artificial Sequence: Synthetic polypeptide
DEEEIATTNPVAYEQWGSVSGNGNGNSQGEGDTT

SEQ ID NO: 150401 - protein, 34 aa, Artificial Sequence
  Description of Artificial Sequence: Synthetic polypeptide
DEEEIACTNPVATEQYGSASLANMGQAEDPNEAM

SEQ ID NO: 150402 - protein, 33 aa, Artificial Sequence
  Description of Artificial Sequence: Synthetic polypeptide
DEEEIATTNPVAYEQWGSVSGNGNGNSGEGTTS

SEQ ID NO: 150403 - protein, 36 aa, Artificial Sequence
  Description of Artificial Sequence: Synthetic polypeptide
AEEEIRTTNPVATEQYGSVSTTQNQAGTEIGTTDEE

SEQ ID NO: 150404 - protein, 37 aa, Artificial Sequence
  Description of Artificial Sequence: Synthetic polypeptide
DEEEIRTTNPVATEQYGSVSSLMPMLLEQILNENNSE

SEQ ID NO: 150405 - protein, 37 aa, Artificial Sequence
  Description of Artificial Sequence: Synthetic polypeptide
DEDEIRTTNPVATEQYGSVSSTTPAGPNMRNGMNPVQ

SEQ ID NO: 150406 - protein, 33 aa, Artificial Sequence
  Description of Artificial Sequence: Synthetic polypeptide
DEEEIATTNPVAYEQWGSVSGGNGNSNGEGVTS

SEQ ID NO: 150407 - protein, 37 aa, Artificial Sequence
  Description of Artificial Sequence: Synthetic polypeptide
DEEEIRTTNPVATEQYGSVPTYDNLHVDTSEMVEENV

SEQ ID NO: 150408 - protein, 36 aa, Artificial Sequence
  Description of Artificial Sequence: Synthetic polypeptide
NEEEIRTTNPVATEQYGSVGDFNNNNEQEGNGQGNA

SEQ ID NO: 150409 - protein, 36 aa, Artificial Sequence
  Description of Artificial Sequence: Synthetic polypeptide
DEEEIRSTNPVATEQYGSVSPTLNMMMMEENEEEVN

SEQ ID NO: 150410 - protein, 35 aa, Artificial Sequence
  Description of Artificial Sequence: Synthetic polypeptide
DEEEIRTTNPVATEQYGSVPTQGTQAQVATPVEGL

SEQ ID NO: 150411 - protein, 36 aa, Artificial Sequence
  Description of Artificial Sequence: Synthetic polypeptide
DEEEIRSTNPVATEQYGSVSSSYPAGPNMRNGMNPV

SEQ ID NO: 150412 - protein, 36 aa, Artificial Sequence
  Description of Artificial Sequence: Synthetic polypeptide
DEDEIRTTNPVATEQYGSVSSTTPAGPNMRNGMGPV

SEQ ID NO: 150413 - protein, 35 aa, Artificial Sequence
  Description of Artificial Sequence: Synthetic polypeptide
QEGEIRTTNPCATEQYGIVSSTTAGPNMRNGMNPR

SEQ ID NO: 150414 - protein, 35 aa, Artificial Sequence
  Description of Artificial Sequence: Synthetic polypeptide
DEEEIRSTNPVATEQYGSVVDGFNGEDEEDDGNGS

SEQ ID NO: 150415 - protein, 35 aa, Artificial Sequence
  Description of Artificial Sequence: Synthetic polypeptide
DEVEIATTNPVATECYGCVYCTNLDQDHDDPRGMV

SEQ ID NO: 150416 - protein, 35 aa, Artificial Sequence
  Description of Artificial Sequence: Synthetic polypeptide
DEVEIATTNPVATECYGCVYCTNLDQDHDDNRGES

SEQ ID NO: 150417 - protein, 36 aa, Artificial Sequence
  Description of Artificial Sequence: Synthetic polypeptide
AEEEIRTTNPVATEQYGSVVVVTTNDESGTVNNNTQ

SEQ ID NO: 150418 - protein, 37 aa, Artificial Sequence
  Description of Artificial Sequence: Synthetic polypeptide
AEEEIRTTNPVATEQYGSVSTVVTDGGNNNLGGNNDD

SEQ ID NO: 150419 - protein, 31 aa, Artificial Sequence
  Description of Artificial Sequence: Synthetic polypeptide
QEGEIRTTNPCSTEPYGIISMDLQQQSNGTR

SEQ ID NO: 150420 - protein, 36 aa, Artificial Sequence
  Description of Artificial Sequence: Synthetic polypeptide
DEEEIRTTNPVATEQYGMVSVEGMGELGQGQEGEGI

SEQ ID NO: 150421 - protein, 30 aa, Artificial Sequence
  Description of Artificial Sequence: Synthetic polypeptide
QEGEIRTTNPVATEQWGDVSEIEMNAAEDA

SEQ ID NO: 150422 - protein, 35 aa, Artificial Sequence
  Description of Artificial Sequence: Synthetic polypeptide
DEEEIRSTNPVATEQYGDVVNDNFDQNGEDENEQG

SEQ ID NO: 150423 - protein, 35 aa, Artificial Sequence
  Description of Artificial Sequence: Synthetic polypeptide
DEEEIRSTNPVATEQYGDVVQTDNMNGTGGNEEGD

SEQ ID NO: 150424 - protein, 35 aa, Artificial Sequence
  Description of Artificial Sequence: Synthetic polypeptide
DEEEIRTTNPVATEQYGSVPWMPTTAITEPENENE

SEQ ID NO: 150425 - protein, 35 aa, Artificial Sequence
  Description of Artificial Sequence: Synthetic polypeptide
DEEEIRSTNPVATEQYGDVVVDDTNMGNEGQEDNG

SEQ ID NO: 150426 - protein, 35 aa, Artificial Sequence
  Description of Artificial Sequence: Synthetic polypeptide
DEEEIRSTNPVATEQYGEVSDGVTGLGGDGGGEGG

SEQ ID NO: 150427 - protein, 38 aa, Artificial Sequence
  Description of Artificial Sequence: Synthetic polypeptide
DEEEIRTTNPVATEQYGSVCSSTSEVHTDTQENVEGER

SEQ ID NO: 150428 - protein, 38 aa, Artificial Sequence
  Description of Artificial Sequence: Synthetic polypeptide
DEEEIRTTNPVATEQYGSVPWATPLGPSQVRPQSNVDD

SEQ ID NO: 150429 - protein, 37 aa, Artificial Sequence
  Description of Artificial Sequence: Synthetic polypeptide
DEEEIRTTNPVATEQYGNSVSSTTPAGPNMRNGMSPV

SEQ ID NO: 150430 - protein, 35 aa, Artificial Sequence
  Description of Artificial Sequence: Synthetic polypeptide
DEEEIACTNPVATEQYGSACSAPNLQDSPDEAANQ

SEQ ID NO: 150431 - protein, 36 aa, Artificial Sequence
  Description of Artificial Sequence: Synthetic polypeptide
DEEEIACTNPVATEQYGSACSATNNEQDAGGDNNQA

SEQ ID NO: 150432 - protein, 36 aa, Artificial Sequence
  Description of Artificial Sequence: Synthetic polypeptide
DEEEIACTNPVATEQYGSACSATNNEQDQGGDQNEA

SEQ ID NO: 150433 - protein, 36 aa, Artificial Sequence
  Description of Artificial Sequence: Synthetic polypeptide
DEEEIRTTNPVATEQYGMYTIMTNGQDQGGGENEGN

SEQ ID NO: 150434 - protein, 36 aa, Artificial Sequence
  Description of Artificial Sequence: Synthetic polypeptide
DEEEIRTTNPVATEQYGSVPVTMPVHVQTPQQNNVN

SEQ ID NO: 150435 - protein, 30 aa, Artificial Sequence
  Description of Artificial Sequence: Synthetic polypeptide
QEGEIRTTNPISTECYGAVWSNCDLAPGTI

SEQ ID NO: 150436 - protein, 37 aa, Artificial Sequence
  Description of Artificial Sequence: Synthetic polypeptide
AEEEIRTTNPVATEQYGSVSTTQQQQNQQNIGTTEAG

SEQ ID NO: 150437 - protein, 37 aa, Artificial Sequence
  Description of Artificial Sequence: Synthetic polypeptide
AEEEIRTTNPVATEQYGSVSTTQQQLQQNATEQGTEE

SEQ ID NO: 150438 - protein, 30 aa, Artificial Sequence
  Description of Artificial Sequence: Synthetic polypeptide
QEGEIRTTNPCSTEQYGIISCDIQQQSGTH

SEQ ID NO: 150439 - protein, 30 aa, Artificial Sequence
  Description of Artificial Sequence: Synthetic polypeptide
QEGEIRTTNPCSTEQYGIISCDIQQQQGTH

SEQ ID NO: 150440 - protein, 34 aa, Artificial Sequence
  Description of Artificial Sequence: Synthetic polypeptide
DEVEIATTNPVATECYGCVYCTNLDNHDDNRGMV

SEQ ID NO: 150441 - protein, 37 aa, Artificial Sequence
  Description of Artificial Sequence: Synthetic polypeptide
DEEEIRTTNPVATEQYGNVMSDGVNDQDEGGQENDEF

SEQ ID NO: 150442 - protein, 35 aa, Artificial Sequence
  Description of Artificial Sequence: Synthetic polypeptide
DEEEIRSTNPVATEQYGSVVIDNGQGEEFNDEGQE

SEQ ID NO: 150443 - protein, 37 aa, Artificial Sequence
  Description of Artificial Sequence: Synthetic polypeptide
DEDEIRTTNPVATEQYGSVSATTPAQGTNQGNPMEPV

SEQ ID NO: 150444 - protein, 33 aa, Artificial Sequence
  Description of Artificial Sequence: Synthetic polypeptide
DEEEIATTNPVAYEQWGSVSGGNGNESGEGDGK

SEQ ID NO: 150445 - protein, 30 aa, Artificial Sequence
  Description of Artificial Sequence: Synthetic polypeptide
QEGEIRPTNPVATEQWGDVSEIEQNAAEDA

SEQ ID NO: 150446 - protein, 34 aa, Artificial Sequence
  Description of Artificial Sequence: Synthetic polypeptide
DEEEIRTTNPVATEQYGMVSIMDGFIGGQGQEGQ

SEQ ID NO: 150447 - protein, 37 aa, Artificial Sequence
  Description of Artificial Sequence: Synthetic polypeptide
DEDEIRTTNPVATEQYGSVCAMNNGLNQTAPGPMENN

SEQ ID NO: 150448 - protein, 34 aa, Artificial Sequence
  Description of Artificial Sequence: Synthetic polypeptide
DEEEIRTTNPVATEQYGMVSIMDGEMTEGGGEVG

SEQ ID NO: 150449 - protein, 34 aa, Artificial Sequence
  Description of Artificial Sequence: Synthetic polypeptide
DEEEIATTNPVAYEQWGSVSGGNGLNSPGDGGTS

SEQ ID NO: 150450 - protein, 35 aa, Artificial Sequence
  Description of Artificial Sequence: Synthetic polypeptide
DEEEIRTTNPVATEQYGMVSIMDGEMQGGLGGEQG

SEQ ID NO: 150451 - protein, 35 aa, Artificial Sequence
  Description of Artificial Sequence: Synthetic polypeptide
DEEEIRTTNPVATEQYGMVSIMDGEMQEGGVEQGS

SEQ ID NO: 150452 - protein, 36 aa, Artificial Sequence
  Description of Artificial Sequence: Synthetic polypeptide
DEDEIRTTNPVATEQYGSVCATNPELGNEHDDNLAG

SEQ ID NO: 150453 - protein, 35 aa, Artificial Sequence
  Description of Artificial Sequence: Synthetic polypeptide
DEEEIRTTNPVATEQYGMVSIMDGEMQEGGGGGQG

SEQ ID NO: 150454 - protein, 30 aa, Artificial Sequence
  Description of Artificial Sequence: Synthetic polypeptide
QEGEIRPTNPCSTEQWGIVSEILQNAAGDA

SEQ ID NO: 150455 - protein, 34 aa, Artificial Sequence
  Description of Artificial Sequence: Synthetic polypeptide
DEEEIATTNPVAYEQWGSVSGEGQGNHQGGGELG

SEQ ID NO: 150456 - protein, 38 aa, Artificial Sequence
  Description of Artificial Sequence: Synthetic polypeptide
AEEEIRTTNPVATEQYGSVSTVVTNIGTQTGNNNNQTD

SEQ ID NO: 150457 - protein, 39 aa, Artificial Sequence
  Description of Artificial Sequence: Synthetic polypeptide
AEEEIRTTNPVATEQYGSVSTVVTNLQAGNQQLGNNEGD

SEQ ID NO: 150458 - protein, 37 aa, Artificial Sequence
  Description of Artificial Sequence: Synthetic polypeptide
AEEEIRTTNPVATEQYGSVVVVTNNQLGNEAGNNNVQ

SEQ ID NO: 150459 - protein, 34 aa, Artificial Sequence
  Description of Artificial Sequence: Synthetic polypeptide
DEEEIACTNPVATEQYGSCAAGNGDPREHQNERE

SEQ ID NO: 150460 - protein, 35 aa, Artificial Sequence
  Description of Artificial Sequence: Synthetic polypeptide
DEEEIRTTNPVATEQYGSVSSPVPEYIRFDEEVDQ

SEQ ID NO: 150461 - protein, 35 aa, Artificial Sequence
  Description of Artificial Sequence: Synthetic polypeptide
DEEEIRTTNPVATEQYGMVSIEGMGDQGEGEEMDT

SEQ ID NO: 150462 - protein, 35 aa, Artificial Sequence
  Description of Artificial Sequence: Synthetic polypeptide
DEDEIRTTNPVATEQYGSVCAATAQLAANAENDNN

SEQ ID NO: 150463 - protein, 35 aa, Artificial Sequence
  Description of Artificial Sequence: Synthetic polypeptide
DEEEIACTNPVATEQYGSCAAATNLTATDAQEGAP

SEQ ID NO: 150464 - protein, 37 aa, Artificial Sequence
  Description of Artificial Sequence: Synthetic polypeptide
AEEEIRTTNPVATEQYGSVSTVVTDQGNNNLGGNDDE

SEQ ID NO: 150465 - protein, 34 aa, Artificial Sequence
  Description of Artificial Sequence: Synthetic polypeptide
DEEEIATTNPVAYEQWGSVSGGNGNESGEGRGTS

SEQ ID NO: 150466 - protein, 37 aa, Artificial Sequence
  Description of Artificial Sequence: Synthetic polypeptide
DEDEIRTTNPVATEQYGSVSATTPAGTNQGNLMEGVE

SEQ ID NO: 150467 - protein, 36 aa, Artificial Sequence
  Description of Artificial Sequence: Synthetic polypeptide
DEEEIRSTNPVATEQYGVVSSTTPAGPNMRNGMNPV

SEQ ID NO: 150468 - protein, 33 aa, Artificial Sequence
  Description of Artificial Sequence: Synthetic polypeptide
DEEEIATTNPVAYEQWGSVSGGNGNSGDEGGDS

SEQ ID NO: 150469 - protein, 34 aa, Artificial Sequence
  Description of Artificial Sequence: Synthetic polypeptide
DEEEIATTNPVAYEQWGSVSGGNGNIQGEGDDTS

SEQ ID NO: 150470 - protein, 33 aa, Artificial Sequence
  Description of Artificial Sequence: Synthetic polypeptide
DEEEIATTNPVAYEQWGSVSGGNGNHGEGGLTS

SEQ ID NO: 150471 - protein, 36 aa, Artificial Sequence
  Description of Artificial Sequence: Synthetic polypeptide
DEEEIRTTNPVATEQYGMVSSTTPAGPNMRNGMLPV

SEQ ID NO: 150472 - protein, 36 aa, Artificial Sequence
  Description of Artificial Sequence: Synthetic polypeptide
DEEEIRSTNPVATEQYGYVSSTTPAGPNMRNGMNPV

SEQ ID NO: 150473 - protein, 34 aa, Artificial Sequence
  Description of Artificial Sequence: Synthetic polypeptide
DEDEIRTTNPVATEQYGSVCSPEDDGEFYEDTNQ

SEQ ID NO: 150474 - protein, 34 aa, Artificial Sequence
  Description of Artificial Sequence: Synthetic polypeptide
DEEEIACTNPVATEQYGSCAAATNDADTAGGENN

SEQ ID NO: 150475 - protein, 37 aa, Artificial Sequence
  Description of Artificial Sequence: Synthetic polypeptide
DEDEIRTTNPVATEQYGSVCSAANNNLQDRTTPPDDE

SEQ ID NO: 150476 - protein, 33 aa, Artificial Sequence
  Description of Artificial Sequence: Synthetic polypeptide
DEVEIATTNPVATDQYGVVSTDGEQGGQGEQGD

SEQ ID NO: 150477 - protein, 37 aa, Artificial Sequence
  Description of Artificial Sequence: Synthetic polypeptide
DEDEIRTTNPVATEQYGSVCSAANNLAQDRTTPPDLE

SEQ ID NO: 150478 - protein, 33 aa, Artificial Sequence
  Description of Artificial Sequence: Synthetic polypeptide
DEVEIATTNPVATDQYGVVSTDDEQGGQGEGET

SEQ ID NO: 150479 - protein, 38 aa, Artificial Sequence
  Description of Artificial Sequence: Synthetic polypeptide
AEEEIRTTNPVATEQYGSVSTTNTNNLEQGSNQNNNDE

SEQ ID NO: 150480 - protein, 38 aa, Artificial Sequence
  Description of Artificial Sequence: Synthetic polypeptide
AEEEIRTTNPVATEQYGSVSTTNTNNLEQGSNNNNNDD

SEQ ID NO: 150481 - protein, 33 aa, Artificial Sequence
  Description of Artificial Sequence: Synthetic polypeptide
DEEEIATTNPVAYEQWGSVSGGNGNGAGEGKTS

SEQ ID NO: 150482 - protein, 35 aa, Artificial Sequence
  Description of Artificial Sequence: Synthetic polypeptide
DEEEIACTNPVATEQYGSCAAATNLATAPGGEDNN

SEQ ID NO: 150483 - protein, 35 aa, Artificial Sequence
  Description of Artificial Sequence: Synthetic polypeptide
DEEEIACTNPVATEQYGSCAAATNLATAPQGEHNH

SEQ ID NO: 150484 - protein, 35 aa, Artificial Sequence
  Description of Artificial Sequence: Synthetic polypeptide
DEEEIACTNPVATEQYGSCAAATNLQEAPLGEAAE

SEQ ID NO: 150485 - protein, 35 aa, Artificial Sequence
  Description of Artificial Sequence: Synthetic polypeptide
DEVEIATTNPVATECWGSVCFTNEDLTDGQRGGTM

SEQ ID NO: 150486 - protein, 37 aa, Artificial Sequence
  Description of Artificial Sequence: Synthetic polypeptide
AEEEIRTTNPVATEQYGSVSTTSQAGNANEQGTNNGG

SEQ ID NO: 150487 - protein, 36 aa, Artificial Sequence
  Description of Artificial Sequence: Synthetic polypeptide
DEEEIRTTNPVATEQYGNVMSDGVNDTDEDGQENGQ

SEQ ID NO: 150488 - protein, 39 aa, Artificial Sequence
  Description of Artificial Sequence: Synthetic polypeptide
AEEEIRTTNPVATEQYGSVSTTSTAGNLEQGTEGGNVTD

SEQ ID NO: 150489 - protein, 34 aa, Artificial Sequence
  Description of Artificial Sequence: Synthetic polypeptide
DEVEIATTNPVATEQYGCVTGGNLGEAQGEGMSP

SEQ ID NO: 150490 - protein, 38 aa, Artificial Sequence
  Description of Artificial Sequence: Synthetic polypeptide
AEEEIRTTNPVATEQYGSVVVVVNTNLEQGSEGGNEGD

SEQ ID NO: 150491 - protein, 37 aa, Artificial Sequence
  Description of Artificial Sequence: Synthetic polypeptide
DEEEIRTTNPVATEQYGQCQVCSTEEHQENFGSDNQM

SEQ ID NO: 150492 - protein, 35 aa, Artificial Sequence
  Description of Artificial Sequence: Synthetic polypeptide
DEVEIATTNPVATEQYGCVCTIEGNQDQRGQGEQD

SEQ ID NO: 150493 - protein, 35 aa, Artificial Sequence
  Description of Artificial Sequence: Synthetic polypeptide
DEEEIRTTNPVATEQYGQCIVCSWGEHQNFGSDQS

SEQ ID NO: 150494 - protein, 35 aa, Artificial Sequence
  Description of Artificial Sequence: Synthetic polypeptide
DEEEIRTTNPVATEQYGQCICSNTEHQSFGSETQL

SEQ ID NO: 150495 - protein, 35 aa, Artificial Sequence
  Description of Artificial Sequence: Synthetic polypeptide
DEVEIATTNPVATEQYGCVCTIDGNQDQRGQGESG

SEQ ID NO: 150496 - protein, 38 aa, Artificial Sequence
  Description of Artificial Sequence: Synthetic polypeptide
AEEEIRTTNPVATEQYGSVVVVVNTNLEQGSEEGNTLS

SEQ ID NO: 150497 - protein, 36 aa, Artificial Sequence
  Description of Artificial Sequence: Synthetic polypeptide
DEEEIRTTNPVATEQYGSVCSPNNSEHVLVMEAEEY

SEQ ID NO: 150498 - protein, 37 aa, Artificial Sequence
  Description of Artificial Sequence: Synthetic polypeptide
AEEEIRTTNPVATEQYGSVVVVTVNQNNTQQGTNNDG

SEQ ID NO: 150499 - protein, 38 aa, Artificial Sequence
  Description of Artificial Sequence: Synthetic polypeptide
AEEEIRTTNPVATEQYGSVVVVTVNNLQNNEQGTNTND

SEQ ID NO: 150500 - protein, 36 aa, Artificial Sequence
  Description of Artificial Sequence: Synthetic polypeptide
DEEEIRPTNPVATESYGSVSSTTPAGPNMRNGMNPV

SEQ ID NO: 150501 - protein, 36 aa, Artificial Sequence
  Description of Artificial Sequence: Synthetic polypeptide
DEEEIRQTNPVATEQYGSVSSTTPAGPNMRNAMNPV

SEQ ID NO: 150502 - protein, 37 aa, Artificial Sequence
  Description of Artificial Sequence: Synthetic polypeptide
AEEEIRTTNPVATEQYGSVVVVTVNAQGNQAGTNNDE

SEQ ID NO: 150503 - protein, 33 aa, Artificial Sequence
  Description of Artificial Sequence: Synthetic polypeptide
DEVEIATTNPVATEQYGCVCAATDGGVEPEGND

SEQ ID NO: 150504 - protein, 34 aa, Artificial Sequence
  Description of Artificial Sequence: Synthetic polypeptide
QEGETCTTNPVATEQYGSVSTGDGDQRIGGEAGD

SEQ ID NO: 150505 - protein, 38 aa, Artificial Sequence
  Description of Artificial Sequence: Synthetic polypeptide
AEEEIRTTNPVATEQYGSVVVVTTVNQLGNQAGTNNDE

SEQ ID NO: 150506 - protein, 34 aa, Artificial Sequence
  Description of Artificial Sequence: Synthetic polypeptide
DEEEIRSTNPVATDQYGVVNDNSIGQNGQGDNAT

SEQ ID NO: 150507 - protein, 35 aa, Artificial Sequence
  Description of Artificial Sequence: Synthetic polypeptide
DEEEIRTTNPVATEQYGNVVQTDNMNGTGGDEEGG

SEQ ID NO: 150508 - protein, 37 aa, Artificial Sequence
  Description of Artificial Sequence: Synthetic polypeptide
AEEEIRTTNPVATEQYGSVSTTTNNMEQGTNNVTEEA

SEQ ID NO: 150509 - protein, 33 aa, Artificial Sequence
  Description of Artificial Sequence: Synthetic polypeptide
QEGVIACTNPVATEQYGSVSMNNNQTAGGPNGS

SEQ ID NO: 150510 - protein, 37 aa, Artificial Sequence
  Description of Artificial Sequence: Synthetic polypeptide
AEEEIRTTNPVATEQYGSVSTTTNNNNDTEQGTNDDE

SEQ ID NO: 150511 - protein, 36 aa, Artificial Sequence
  Description of Artificial Sequence: Synthetic polypeptide
AEEEIRTTNPVATEQYGSVVVVVTNDESGSVNNQTV

SEQ ID NO: 150512 - protein, 37 aa, Artificial Sequence
  Description of Artificial Sequence: Synthetic polypeptide
AEEEIRTTNPVATEQYGSVVVVVTNAQQGNTDENEEV

SEQ ID NO: 150513 - protein, 36 aa, Artificial Sequence
  Description of Artificial Sequence: Synthetic polypeptide
DEEEIRTTNPVATEQYGQCSCSWGEPLQEYFNSDQS

SEQ ID NO: 150514 - protein, 37 aa, Artificial Sequence
  Description of Artificial Sequence: Synthetic polypeptide
AEEEIRTTNPVATEQYGSVVVVVTNAQQGATDENNEG

SEQ ID NO: 150515 - protein, 36 aa, Artificial Sequence
  Description of Artificial Sequence: Synthetic polypeptide
DEVEIATTNPVATEQYGSVAITENDQDDQRQDGDHS

SEQ ID NO: 150516 - protein, 36 aa, Artificial Sequence
  Description of Artificial Sequence: Synthetic polypeptide
NEEEIRTTNPVATEQYGSASSTTPAGPNMRNGMNPV

SEQ ID NO: 150517 - protein, 35 aa, Artificial Sequence
  Description of Artificial Sequence: Synthetic polypeptide
DEVEIATTNPVATEQYGSVAANPNGLTNGNPTPDH

SEQ ID NO: 150518 - protein, 34 aa, Artificial Sequence
  Description of Artificial Sequence: Synthetic polypeptide
DEVEIATTNPVATEQYGSVAANNGDVTTDDGNEE

SEQ ID NO: 150519 - protein, 36 aa, Artificial Sequence
  Description of Artificial Sequence: Synthetic polypeptide
AEEEIRTTNPVATEQYGSVVVVVTNAQQGATDEEEV

SEQ ID NO: 150520 - protein, 36 aa, Artificial Sequence
  Description of Artificial Sequence: Synthetic polypeptide
AEEEIRTTNPVATEQYGSVVVVVTNANQANDENEED

SEQ ID NO: 150521 - protein, 36 aa, Artificial Sequence
  Description of Artificial Sequence: Synthetic polypeptide
DEVEIATTNPVATEQYGSACAATNPQEADSGMGNRM

SEQ ID NO: 150522 - protein, 37 aa, Artificial Sequence
  Description of Artificial Sequence: Synthetic polypeptide
AEEEIRTTNPVATEQYGSVSTTTNNNQQIGTTTTDEQ

SEQ ID NO: 150523 - protein, 38 aa, Artificial Sequence
  Description of Artificial Sequence: Synthetic polypeptide
AEEEIRTTNPVATEQYGSVVVVVSTNLEQGSEGGVTLN

SEQ ID NO: 150524 - protein, 34 aa, Artificial Sequence
  Description of Artificial Sequence: Synthetic polypeptide
AENEIATTNPVATEQYGSASSTTPAGPNRNGMNV

SEQ ID NO: 150525 - protein, 38 aa, Artificial Sequence
  Description of Artificial Sequence: Synthetic polypeptide
AEEEIRTTNPVATEQYGSVVVVVNTNLEQGSEGGNTNQ

SEQ ID NO: 150526 - protein, 38 aa, Artificial Sequence
  Description of Artificial Sequence: Synthetic polypeptide
AEEEIRTTNPVATEQYGSVVVVVNTNLEQGSEGGNNDE

SEQ ID NO: 150527 - protein, 37 aa, Artificial Sequence
  Description of Artificial Sequence: Synthetic polypeptide
AEEEIRTTNPVATEQYGSVSTTTNNNNQQQIGTTEGE

SEQ ID NO: 150528 - protein, 31 aa, Artificial Sequence
  Description of Artificial Sequence: Synthetic polypeptide
QEGVIAPTNPCSYEQYGKVSCNLSQSVGTNR

SEQ ID NO: 150529 - protein, 38 aa, Artificial Sequence
  Description of Artificial Sequence: Synthetic polypeptide
AEEEIRTTNPVATEQYGSVSTTTNNNNQNQLQGTNNVD

SEQ ID NO: 150530 - protein, 37 aa, Artificial Sequence
  Description of Artificial Sequence: Synthetic polypeptide
DEEEIRTTNPVATEQYGSVCSPVDNNHNIDAMGMGRG

SEQ ID NO: 150531 - protein, 35 aa, Artificial Sequence
  Description of Artificial Sequence: Synthetic polypeptide
DEVEIATTNPVATEQWGVVCPTDNNDQDQGGDNVR

SEQ ID NO: 150532 - protein, 38 aa, Artificial Sequence
  Description of Artificial Sequence: Synthetic polypeptide
DEDEIRTTNPVATEQYGSVSTTNNNQQGNQQGTQETEN

SEQ ID NO: 150533 - protein, 35 aa, Artificial Sequence
  Description of Artificial Sequence: Synthetic polypeptide
DEVEIATTNPVATEQWGSVCPTDNNDQDQGGDNTN

SEQ ID NO: 150534 - protein, 31 aa, Artificial Sequence
  Description of Artificial Sequence: Synthetic polypeptide
AENEIATTNPVSTEQYGEASEEDIQQQQGNH

SEQ ID NO: 150535 - protein, 38 aa, Artificial Sequence
  Description of Artificial Sequence: Synthetic polypeptide
AEEEIRTTNPVATEQYGSVVVVTTNNNLNNQQGTNNAD

SEQ ID NO: 150536 - protein, 36 aa, Artificial Sequence
  Description of Artificial Sequence: Synthetic polypeptide
AEEEIRTTNPVATEQYGSVVVVTTNNNLLAGTDEED

SEQ ID NO: 150537 - protein, 38 aa, Artificial Sequence
  Description of Artificial Sequence: Synthetic polypeptide
AEEEIRTTNPVATEQYGSVVVVTTNNLQQGTESGNNTD

SEQ ID NO: 150538 - protein, 34 aa, Artificial Sequence
  Description of Artificial Sequence: Synthetic polypeptide
QEGEIRTTNPVATEQYGSVSTMPDDNQNSSQEIL

SEQ ID NO: 150539 - protein, 37 aa, Artificial Sequence
  Description of Artificial Sequence: Synthetic polypeptide
DEEEIRTTNPVATEQYGSVSSFTPAIGPNMRVGMVPV

SEQ ID NO: 150540 - protein, 37 aa, Artificial Sequence
  Description of Artificial Sequence: Synthetic polypeptide
DEEEIRTTNPVATEQYGNVSSTTPAPGPNMRNGMNPV

SEQ ID NO: 150541 - protein, 35 aa, Artificial Sequence
  Description of Artificial Sequence: Synthetic polypeptide
DEEEIRTTNPVATEQYGSVQATMEGLDLALESEGE

SEQ ID NO: 150542 - protein, 37 aa, Artificial Sequence
  Description of Artificial Sequence: Synthetic polypeptide
AEEEIRTTNPVATEQYGSVVVVTTNNLNLQAGTDEEQ

SEQ ID NO: 150543 - protein, 35 aa, Artificial Sequence
  Description of Artificial Sequence: Synthetic polypeptide
DEEEIRSTNPVATEQYGAVNNDENFDQMGEDENIG

SEQ ID NO: 150544 - protein, 31 aa, Artificial Sequence
  Description of Artificial Sequence: Synthetic polypeptide
AENEIATTNPVSTEQYGEASMEDIQQQQGNH

SEQ ID NO: 150545 - protein, 36 aa, Artificial Sequence
  Description of Artificial Sequence: Synthetic polypeptide
DEEEIATTNPVAYEQWGSVSSTTGQGPNMRNGMNAH

SEQ ID NO: 150546 - protein, 36 aa, Artificial Sequence
  Description of Artificial Sequence: Synthetic polypeptide
DEEEIRTTNPVATEQYGNVMTTVNFNGQEGGGQDEG

SEQ ID NO: 150547 - protein, 35 aa, Artificial Sequence
  Description of Artificial Sequence: Synthetic polypeptide
DEEEIRTTNPVATEQYGSVPYLNWINEELVGILDQ

SEQ ID NO: 150548 - protein, 35 aa, Artificial Sequence
  Description of Artificial Sequence: Synthetic polypeptide
DEEEIRTTNPVATEQYGSVPWVPTVAITWPENENE

SEQ ID NO: 150549 - protein, 35 aa, Artificial Sequence
  Description of Artificial Sequence: Synthetic polypeptide
DEVEIATTNPVATEHYGSVCQTNDQQDNRGQGKED

SEQ ID NO: 150550 - protein, 35 aa, Artificial Sequence
  Description of Artificial Sequence: Synthetic polypeptide
DEVEIATTNPVATEHYGSVCQTNDQQDNRGQDDAT

SEQ ID NO: 150551 - protein, 34 aa, Artificial Sequence
  Description of Artificial Sequence: Synthetic polypeptide
DEEEIACTNPVATEQYGSACSAPNLPEAEAEGDS

SEQ ID NO: 150552 - protein, 35 aa, Artificial Sequence
  Description of Artificial Sequence: Synthetic polypeptide
DEEEIACTNPVATEQYGSACSAPNLPEAEAQGGDF

SEQ ID NO: 150553 - protein, 36 aa, Artificial Sequence
  Description of Artificial Sequence: Synthetic polypeptide
DEVEIATTNPVATEIYGSVCSNWNDGQDRQGMDTER

SEQ ID NO: 150554 - protein, 37 aa, Artificial Sequence
  Description of Artificial Sequence: Synthetic polypeptide
AEEEIRTTNPVATEQYGSVVVVVTNDTNNQQIGTNLD

SEQ ID NO: 150555 - protein, 35 aa, Artificial Sequence
  Description of Artificial Sequence: Synthetic polypeptide
QEGEIRTTNPVATEQYGSVSWTMMDLNTNSQEDIF

SEQ ID NO: 150556 - protein, 36 aa, Artificial Sequence
  Description of Artificial Sequence: Synthetic polypeptide
DEEEIRTTNPVATEQYGSVQCMPESLQQLNPVEIEF

SEQ ID NO: 150557 - protein, 35 aa, Artificial Sequence
  Description of Artificial Sequence: Synthetic polypeptide
DEVEIATTNPVATEQWGSVCPTDNNDHDQGGDNVH

SEQ ID NO: 150558 - protein, 38 aa, Artificial Sequence
  Description of Artificial Sequence: Synthetic polypeptide
DEDEIRTTNPVATEQYGSVSTTNNNQQGNQQGTNNQEN

SEQ ID NO: 150559 - protein, 33 aa, Artificial Sequence
  Description of Artificial Sequence: Synthetic polypeptide
DEVEIATTNPVATEQWGSVAGSNPANPNPGAQP

SEQ ID NO: 150560 - protein, 38 aa, Artificial Sequence
  Description of Artificial Sequence: Synthetic polypeptide
DEDEIRTTNPVATEQYGSVSTTNNNQQGNNQGNNNTND

SEQ ID NO: 150561 - protein, 38 aa, Artificial Sequence
  Description of Artificial Sequence: Synthetic polypeptide
DEDEIRTTNPVATEQYGSVSTTNNNQNGNQQGTNVTNG

SEQ ID NO: 150562 - protein, 38 aa, Artificial Sequence
  Description of Artificial Sequence: Synthetic polypeptide
DEDEIRTTNPVATEQYGSVSTTNNNQNGNQQGTATTED

SEQ ID NO: 150563 - protein, 32 aa, Artificial Sequence
  Description of Artificial Sequence: Synthetic polypeptide
DEVEIATTNPVATEQWGCVSGEGEMNAAEDND

SEQ ID NO: 150564 - protein, 36 aa, Artificial Sequence
  Description of Artificial Sequence: Synthetic polypeptide
DEVEIATTNPVATEPYGSVSWNDNGLQDKGGHGDNQ

SEQ ID NO: 150565 - protein, 38 aa, Artificial Sequence
  Description of Artificial Sequence: Synthetic polypeptide
DEDEIRTTNPVATEQYGSVSTTNNNQGGNQQGTGNTNG

SEQ ID NO: 150566 - protein, 31 aa, Artificial Sequence
  Description of Artificial Sequence: Synthetic polypeptide
AENEIATTNPVATEYYGCVCSWELNQHESEL

SEQ ID NO: 150567 - protein, 38 aa, Artificial Sequence
  Description of Artificial Sequence: Synthetic polypeptide
DEDEIRTTNPVATEQYGSVSTTNNNQAGNQQGTNQNNQ

SEQ ID NO: 150568 - protein, 32 aa, Artificial Sequence
  Description of Artificial Sequence: Synthetic polypeptide
DEVEIATTNPVATEPWGTVAAMANDQVSNDTR

SEQ ID NO: 150569 - protein, 35 aa, Artificial Sequence
  Description of Artificial Sequence: Synthetic polypeptide
DEEEIRSTNPVATECYGSVYGQTNFNFGEGDGGND

SEQ ID NO: 150570 - protein, 35 aa, Artificial Sequence
  Description of Artificial Sequence: Synthetic polypeptide
DEEEIRSTNPVATEGYGAVVNDNGNLQGGEFTNNN

SEQ ID NO: 150571 - protein, 36 aa, Artificial Sequence
  Description of Artificial Sequence: Synthetic polypeptide
DEEEIRSTNPVATEGYGSVSATTPTGPQMHNGMNPI

SEQ ID NO: 150572 - protein, 39 aa, Artificial Sequence
  Description of Artificial Sequence: Synthetic polypeptide
DEDEIRTTNPVATEQYGSVSTTLNLQAGNNEQGSTNVAE

SEQ ID NO: 150573 - protein, 35 aa, Artificial Sequence
  Description of Artificial Sequence: Synthetic polypeptide
QEGEIRTTNPVATEQYGSVSWTVGDENQNSQEHIF

SEQ ID NO: 150574 - protein, 35 aa, Artificial Sequence
  Description of Artificial Sequence: Synthetic polypeptide
QEGEIRTTNPVATEQYGSVSWTMPIENQNSQEDIF

SEQ ID NO: 150575 - protein, 35 aa, Artificial Sequence
  Description of Artificial Sequence: Synthetic polypeptide
QEGEIRTTNPVATEQYGSVSWTMPDLNQNSQEHIF

SEQ ID NO: 150576 - protein, 31 aa, Artificial Sequence
  Description of Artificial Sequence: Synthetic polypeptide
AENEIATTNPVSTEPYGEISMENIQQQNGNH

SEQ ID NO: 150577 - protein, 34 aa, Artificial Sequence
  Description of Artificial Sequence: Synthetic polypeptide
DEDEIRTTNPVATTQYGVVSNLQAGTEQGSTEDD

SEQ ID NO: 150578 - protein, 36 aa, Artificial Sequence
  Description of Artificial Sequence: Synthetic polypeptide
DEEEIRTTNPVATEQYGSVSQLMELRQEQDELDLVQ

SEQ ID NO: 150579 - protein, 37 aa, Artificial Sequence
  Description of Artificial Sequence: Synthetic polypeptide
AEEEIRTTNPVATEQYGSVVVVVTTNLNNEQGNNSED

SEQ ID NO: 150580 - protein, 37 aa, Artificial Sequence
  Description of Artificial Sequence: Synthetic polypeptide
DEEEIRTTNPVATEQYGSVQLTESTAQEDNMLTVEVA

SEQ ID NO: 150581 - protein, 32 aa, Artificial Sequence
  Description of Artificial Sequence: Synthetic polypeptide
QEMEIVTTNPVATEQYGTVCSATDGPEHEEND

SEQ ID NO: 150582 - protein, 32 aa, Artificial Sequence
  Description of Artificial Sequence: Synthetic polypeptide
QEMEIVTTNPVATEQYGTVCSATDGCEFEEND

SEQ ID NO: 150583 - protein, 33 aa, Artificial Sequence
  Description of Artificial Sequence: Synthetic polypeptide
QEMEIVTTNPVATEQYGTVCSATDCPVEFEGND

SEQ ID NO: 150584 - protein, 36 aa, Artificial Sequence
  Description of Artificial Sequence: Synthetic polypeptide
DEEEIRTTNPVATEQYGQCVCSTGEHNQNFNSDTQL

SEQ ID NO: 150585 - protein, 37 aa, Artificial Sequence
  Description of Artificial Sequence: Synthetic polypeptide
DEDEIRTTNPVATEQYGVVSTVVTTTNNDQAGSTNGQ

SEQ ID NO: 150586 - protein, 35 aa, Artificial Sequence
  Description of Artificial Sequence: Synthetic polypeptide
DEEEIRTTNPVATEQYGQCVCSTGEHNQNFISDQL

SEQ ID NO: 150587 - protein, 36 aa, Artificial Sequence
  Description of Artificial Sequence: Synthetic polypeptide
DEEEIRTTNPVATEQYGQCVCSTGEHNQNFGSQTQS

SEQ ID NO: 150588 - protein, 37 aa, Artificial Sequence
  Description of Artificial Sequence: Synthetic polypeptide
DEEEIRTTNPVATEQYGSVQLTESTAVEPNLLLVEVM

SEQ ID NO: 150589 - protein, 37 aa, Artificial Sequence
  Description of Artificial Sequence: Synthetic polypeptide
DEEEIRTTNPVATEQYGSVSPTSPGIGQNTQSMVPIM

SEQ ID NO: 150590 - protein, 35 aa, Artificial Sequence
  Description of Artificial Sequence: Synthetic polypeptide
DEEEIRTTNPVATEQYGQCVCSTGEHNQFFISDQE

SEQ ID NO: 150591 - protein, 36 aa, Artificial Sequence
  Description of Artificial Sequence: Synthetic polypeptide
DEEEIRTTNPVATEQYGQCVCSTGEHNQEHFNSDQS

SEQ ID NO: 150592 - protein, 37 aa, Artificial Sequence
  Description of Artificial Sequence: Synthetic polypeptide
DEDEIRTTNPVATEQYGVVSTVVSNQQALGNNNDEDD

SEQ ID NO: 150593 - protein, 37 aa, Artificial Sequence
  Description of Artificial Sequence: Synthetic polypeptide
AEEEIRTTNPVATEQYGSVSTVNNNDEQGSTQENEDD

SEQ ID NO: 150594 - protein, 37 aa, Artificial Sequence
  Description of Artificial Sequence: Synthetic polypeptide
DEEEIRTTNPVATEQYGQCVCSTGEHNQEGFNSDTQA

SEQ ID NO: 150595 - protein, 37 aa, Artificial Sequence
  Description of Artificial Sequence: Synthetic polypeptide
DEDEIRTTNPVATEQYGVVSTVVNTTNNLQAGSTDEN

SEQ ID NO: 150596 - protein, 37 aa, Artificial Sequence
  Description of Artificial Sequence: Synthetic polypeptide
DEEEIRTTNPVATEQYGQCVCSTGEHNQEGFNSDNQD

SEQ ID NO: 150597 - protein, 36 aa, Artificial Sequence
  Description of Artificial Sequence: Synthetic polypeptide
DEVEIRTTNPVATDQYGSVVDTDNNDQEEGSNEEGD

SEQ ID NO: 150598 - protein, 37 aa, Artificial Sequence
  Description of Artificial Sequence: Synthetic polypeptide
DEDEIRTTNPVATEQYGVVSTVVTNQQLIGNNNQEDD

SEQ ID NO: 150599 - protein, 32 aa, Artificial Sequence
  Description of Artificial Sequence: Synthetic polypeptide
QEMEIVTTNPVATEQYGTVCSATDGPEHEENL

SEQ ID NO: 150600 - protein, 33 aa, Artificial Sequence
  Description of Artificial Sequence: Synthetic polypeptide
QEMEIVTTNPVATEQYGTVCSATDGPVEFEGND

SEQ ID NO: 150601 - protein, 32 aa, Artificial Sequence
  Description of Artificial Sequence: Synthetic polypeptide
AENEIACTNPVAYEQYGETASCENLSQGVGGR

SEQ ID NO: 150602 - protein, 38 aa, Artificial Sequence
  Description of Artificial Sequence: Synthetic polypeptide
DEDEIRTTNPVATEQYGVVSVVVVTNLQAGNNNNEEDE

SEQ ID NO: 150603 - protein, 37 aa, Artificial Sequence
  Description of Artificial Sequence: Synthetic polypeptide
DEEEIRTTNPVATEQYGQCVCSTGNHNQENFNSDTQS

SEQ ID NO: 150604 - protein, 36 aa, Artificial Sequence
  Description of Artificial Sequence: Synthetic polypeptide
DEEEIRTTNPVATEQYGQCVCSTGETNQNFGSETQG

SEQ ID NO: 150605 - protein, 32 aa, Artificial Sequence
  Description of Artificial Sequence: Synthetic polypeptide
QEMEIVTTNPVATEQYGTVCSTDGPVEFEGEK

SEQ ID NO: 150606 - protein, 33 aa, Artificial Sequence
  Description of Artificial Sequence: Synthetic polypeptide
QEMEIVTTNPVATEQYGTVCSATDGPVQFEGED

SEQ ID NO: 150607 - protein, 34 aa, Artificial Sequence
  Description of Artificial Sequence: Synthetic polypeptide
NEEEIATTNPVATEQYGSCPATDHLEQPDDQGQD

SEQ ID NO: 150608 - protein, 33 aa, Artificial Sequence
  Description of Artificial Sequence: Synthetic polypeptide
NEEEIATTNPVATEQYGSCPATDHLEVPDDQGR

SEQ ID NO: 150609 - protein, 37 aa, Artificial Sequence
  Description of Artificial Sequence: Synthetic polypeptide
DEEEIRTTNPVATEQYGQCVCSTGELEQENFNSETQA

SEQ ID NO: 150610 - protein, 35 aa, Artificial Sequence
  Description of Artificial Sequence: Synthetic polypeptide
NEEEIATTNPVATEQYGSCPATHLEAPDDQAGQRN

SEQ ID NO: 150611 - protein, 35 aa, Artificial Sequence
  Description of Artificial Sequence: Synthetic polypeptide
NEEEIATTNPVATEQYGSCPATHLEAPDDQDGGRH

SEQ ID NO: 150612 - protein, 33 aa, Artificial Sequence
  Description of Artificial Sequence: Synthetic polypeptide
AENEIACTNPVAYEQYGEASCEGNLSQRTVGGR

SEQ ID NO: 150613 - protein, 33 aa, Artificial Sequence
  Description of Artificial Sequence: Synthetic polypeptide
NEEEIATTNPVATEQYGSCPATHLEAPDDQGQH

SEQ ID NO: 150614 - protein, 33 aa, Artificial Sequence
  Description of Artificial Sequence: Synthetic polypeptide
QEMEIVTTNPVATEQYGTVCSATDGPVEFHGND

SEQ ID NO: 150615 - protein, 38 aa, Artificial Sequence
  Description of Artificial Sequence: Synthetic polypeptide
DEDEIRTTNPVATEQYGVVSTVVVTNLQAGNNNNATDE

SEQ ID NO: 150616 - protein, 38 aa, Artificial Sequence
  Description of Artificial Sequence: Synthetic polypeptide
DEDEIRTTNPVATEQYGVVSTVVVTNLQAGNNNAEEDD

SEQ ID NO: 150617 - protein, 38 aa, Artificial Sequence
  Description of Artificial Sequence: Synthetic polypeptide
DEDEIRTTNPVATEQYGVVSTVVVTNLQAGNNEDEEDE

SEQ ID NO: 150618 - protein, 34 aa, Artificial Sequence
  Description of Artificial Sequence: Synthetic polypeptide
NEEEIATTNPVATEQYGSCPATHVLEAPDDQGQR

SEQ ID NO: 150619 - protein, 33 aa, Artificial Sequence
  Description of Artificial Sequence: Synthetic polypeptide
AENEIACTNPVAYEQYGEISCEQNELSQRVGGR

SEQ ID NO: 150620 - protein, 32 aa, Artificial Sequence
  Description of Artificial Sequence: Synthetic polypeptide
QEMEIVTTNPVATEQYGTVCSATDGPVEFGEL

SEQ ID NO: 150621 - protein, 37 aa, Artificial Sequence
  Description of Artificial Sequence: Synthetic polypeptide
DEDEIRTTNPVATEQYGVVSTVVNTQNLNQAGTTESG

SEQ ID NO: 150622 - protein, 37 aa, Artificial Sequence
  Description of Artificial Sequence: Synthetic polypeptide
DEEEIRTTNPVATEQYGSVQLTPNSQAQAQDNEQGVI

SEQ ID NO: 150623 - protein, 36 aa, Artificial Sequence
  Description of Artificial Sequence: Synthetic polypeptide
DEEEIRTTNPVATEQYGQCVCSTGEHNENFGSQTQS

SEQ ID NO: 150624 - protein, 35 aa, Artificial Sequence
  Description of Artificial Sequence: Synthetic polypeptide
DEEEIRTTNPVATEQYGSVQLNANEEHLTTVEMLQ

SEQ ID NO: 150625 - protein, 34 aa, Artificial Sequence
  Description of Artificial Sequence: Synthetic polypeptide
NEEEIATTNPVATEQYGSVAGTNPTAEAIGTEDK

SEQ ID NO: 150626 - protein, 36 aa, Artificial Sequence
  Description of Artificial Sequence: Synthetic polypeptide
DEEEIRTTNPVATEQYGQCVCSTETNQENFNSDNQN

SEQ ID NO: 150627 - protein, 35 aa, Artificial Sequence
  Description of Artificial Sequence: Synthetic polypeptide
DEEEIRGTNPVATEQYGVVMGDDENDNEQDEGTNG

SEQ ID NO: 150628 - protein, 35 aa, Artificial Sequence
  Description of Artificial Sequence: Synthetic polypeptide
DEEEIRGTNPVATEQYGVVMGIDDENDNGQDEGNG

SEQ ID NO: 150629 - protein, 34 aa, Artificial Sequence
  Description of Artificial Sequence: Synthetic polypeptide
SEEEIRATNPVAYEQWGQVCSCTNMQSADGGERN

SEQ ID NO: 150630 - protein, 36 aa, Artificial Sequence
  Description of Artificial Sequence: Synthetic polypeptide
DEEEIRGTNPVATEQYGVVSDNMGQIFNEGGGNDQG

SEQ ID NO: 150631 - protein, 35 aa, Artificial Sequence
  Description of Artificial Sequence: Synthetic polypeptide
DEEEIRTTNPVATEQYGQCVCSTEHQENFTSETQS

SEQ ID NO: 150632 - protein, 35 aa, Artificial Sequence
  Description of Artificial Sequence: Synthetic polypeptide
DEEEIRTTNPVATEQYGQCVCSTEHNQNFPSETQS

SEQ ID NO: 150633 - protein, 36 aa, Artificial Sequence
  Description of Artificial Sequence: Synthetic polypeptide
DEVEICTTNPVATEQYGSVVSVTGGQLQEEMGQGTI

SEQ ID NO: 150634 - protein, 35 aa, Artificial Sequence
  Description of Artificial Sequence: Synthetic polypeptide
NEEEIATTNPVATEQYGSVANANNLPAEAPGENMN

SEQ ID NO: 150635 - protein, 34 aa, Artificial Sequence
  Description of Artificial Sequence: Synthetic polypeptide
NEEEIATTNPVATEQYGSVANTGNGEYGAETGHN

SEQ ID NO: 150636 - protein, 36 aa, Artificial Sequence
  Description of Artificial Sequence: Synthetic polypeptide
DEEEIRTTNPVATEQYGSVSPTTTEGMEMEGDVFLQ

SEQ ID NO: 150637 - protein, 38 aa, Artificial Sequence
  Description of Artificial Sequence: Synthetic polypeptide
AEEEIRTTNPVATEQYGSVVVVVTTNTLQQGNNNNTTE

SEQ ID NO: 150638 - protein, 37 aa, Artificial Sequence
  Description of Artificial Sequence: Synthetic polypeptide
DEDEIRTTNPVATEQYGVVSTVTTNQQALGNNNQEDD

SEQ ID NO: 150639 - protein, 35 aa, Artificial Sequence
  Description of Artificial Sequence: Synthetic polypeptide
DEEEIRTTNPVATEQYGQCVCSTEHNQENFISQQP

SEQ ID NO: 150640 - protein, 36 aa, Artificial Sequence
  Description of Artificial Sequence: Synthetic polypeptide
DEEEIRTTNPVATEQYGSVSPTTTNEGMEMEAQFLQ

SEQ ID NO: 150641 - protein, 36 aa, Artificial Sequence
  Description of Artificial Sequence: Synthetic polypeptide
DEEEIRTTNPVATEQYGQCVCSTEHNQENFGSETQA

SEQ ID NO: 150642 - protein, 37 aa, Artificial Sequence
  Description of Artificial Sequence: Synthetic polypeptide
AEEEIRTTNPVATEQYGSVVVVVTTNQQQGETGTNTD

SEQ ID NO: 150643 - protein, 36 aa, Artificial Sequence
  Description of Artificial Sequence: Synthetic polypeptide
NEEEIATTNPVATEQYGSVANANNLPQEAPGESMNN

SEQ ID NO: 150644 - protein, 37 aa, Artificial Sequence
  Description of Artificial Sequence: Synthetic polypeptide
DEDEIRTTNPVATEQYGVVSTVVNNDQAGSTNQEGTE

SEQ ID NO: 150645 - protein, 35 aa, Artificial Sequence
  Description of Artificial Sequence: Synthetic polypeptide
DEEEIRTTNPVATEQYGQCVCSTGAHIENFNSDQS

SEQ ID NO: 150646 - protein, 33 aa, Artificial Sequence
  Description of Artificial Sequence: Synthetic polypeptide
SEEEIRATNPVATEGYGCTSIMNITGQGGGGNE

SEQ ID NO: 150647 - protein, 31 aa, Artificial Sequence
  Description of Artificial Sequence: Synthetic polypeptide
QEMEIVTTNPVATEQYGTVCSAECPVEFGEL

SEQ ID NO: 150648 - protein, 38 aa, Artificial Sequence
  Description of Artificial Sequence: Synthetic polypeptide
DEDEIRTTNPVATEQYGVVSTVVNTNLQAGNQNDTEDE

SEQ ID NO: 150649 - protein, 37 aa, Artificial Sequence
  Description of Artificial Sequence: Synthetic polypeptide
DEEEIRTTNPVATEQYGQCVCSTGEHDQEGFISDNQA

SEQ ID NO: 150650 - protein, 38 aa, Artificial Sequence
  Description of Artificial Sequence: Synthetic polypeptide
DEDEIRTTNPVATEQYGVVSTVVNTNLQAGNNNQDEED

SEQ ID NO: 150651 - protein, 35 aa, Artificial Sequence
  Description of Artificial Sequence: Synthetic polypeptide
DEEEIRTTNPVATEQYGQCVCSTGEHAENFGSDQA

SEQ ID NO: 150652 - protein, 35 aa, Artificial Sequence
  Description of Artificial Sequence: Synthetic polypeptide
DEVEIRSTNPVATEQYGSVITDNNTGNDEGEGGNQ

SEQ ID NO: 150653 - protein, 36 aa, Artificial Sequence
  Description of Artificial Sequence: Synthetic polypeptide
DEVEIRSTNPVATEQYGSVITDNNGQNDEGEGGNGT

SEQ ID NO: 150654 - protein, 34 aa, Artificial Sequence
  Description of Artificial Sequence: Synthetic polypeptide
DEVEIKTTNPVATEQYGVVVSATDGPEEGEGNDT

SEQ ID NO: 150655 - protein, 36 aa, Artificial Sequence
  Description of Artificial Sequence: Synthetic polypeptide
DEEEIRTTNPVATEQYGQCVCSTGEDTNQNFGSEQY

SEQ ID NO: 150656 - protein, 34 aa, Artificial Sequence
  Description of Artificial Sequence: Synthetic polypeptide
DEVEIKTTNPVATEQYGSVVNNVGNGEFTNQGQI

SEQ ID NO: 150657 - protein, 35 aa, Artificial Sequence
  Description of Artificial Sequence: Synthetic polypeptide
DEVEIKTTNPVATEQYGSVVGNDGTNEGQTGGQDI

SEQ ID NO: 150658 - protein, 36 aa, Artificial Sequence
  Description of Artificial Sequence: Synthetic polypeptide
DEVEIKTTNPVATEQYGSVIVVGFGTNEQTGNQNIF

SEQ ID NO: 150659 - protein, 36 aa, Artificial Sequence
  Description of Artificial Sequence: Synthetic polypeptide
DEVEIKTTNPVATEQYGSVIVVGFGTNEQTGGQNTG

SEQ ID NO: 150660 - protein, 34 aa, Artificial Sequence
  Description of Artificial Sequence: Synthetic polypeptide
DEVEIKTTNPVATDQYGVVSTGDEGGNGQGEEND

SEQ ID NO: 150661 - protein, 37 aa, Artificial Sequence
  Description of Artificial Sequence: Synthetic polypeptide
DEDEIRTTNPVATEQYGVVSTVVNNQQANGNNNDEDE

SEQ ID NO: 150662 - protein, 37 aa, Artificial Sequence
  Description of Artificial Sequence: Synthetic polypeptide
DEDEIRTTNPVATEQYGVVSTVVNNQNQLQAGTTESG

SEQ ID NO: 150663 - protein, 37 aa, Artificial Sequence
  Description of Artificial Sequence: Synthetic polypeptide
DEDEIRTTNPVATEQYGVVSTVVNNNQNGEEEEEEND

SEQ ID NO: 150664 - protein, 36 aa, Artificial Sequence
  Description of Artificial Sequence: Synthetic polypeptide
DEEEIRTTNPVATEQYGQCVCSTGEDQEFFGSDTQA

SEQ ID NO: 150665 - protein, 37 aa, Artificial Sequence
  Description of Artificial Sequence: Synthetic polypeptide
DEEEIRTTNPVATEQYGQCVCSTGEDLQENFISNNQA

SEQ ID NO: 150666 - protein, 38 aa, Artificial Sequence
  Description of Artificial Sequence: Synthetic polypeptide
DEDEIRTTNPVATEQYGVVSTVVNTNLQAGTNNEDEDE

SEQ ID NO: 150667 - protein, 32 aa, Artificial Sequence
  Description of Artificial Sequence: Synthetic polypeptide
NEEEIATTNPVATEQYGCAPMHGQDSEGENKD

SEQ ID NO: 150668 - protein, 37 aa, Artificial Sequence
  Description of Artificial Sequence: Synthetic polypeptide
DEEEIRTTNPVATEQYGQCVCSTGNTNQENFNSENQS

SEQ ID NO: 150669 - protein, 30 aa, Artificial Sequence
  Description of Artificial Sequence: Synthetic polypeptide
NEEEIATTNPVATEQYGCAPEHGQDSEEKH

SEQ ID NO: 150670 - protein, 38 aa, Artificial Sequence
  Description of Artificial Sequence: Synthetic polypeptide
AEEEIRTTNPVATEQYGSVSTVVSNNGNQIGTTTNQTD

SEQ ID NO: 150671 - protein, 38 aa, Artificial Sequence
  Description of Artificial Sequence: Synthetic polypeptide
AEEEIRTTNPVATEQYGSVSTVVSNNGNQLGGNNNQTD

SEQ ID NO: 150672 - protein, 36 aa, Artificial Sequence
  Description of Artificial Sequence: Synthetic polypeptide
AEEEIRTTNPVATEQYGVVATTNQQQGNNQAGNNAA

SEQ ID NO: 150673 - protein, 36 aa, Artificial Sequence
  Description of Artificial Sequence: Synthetic polypeptide
AEEEIRTTNPVATEQYGVVATTNNQQGNQQGTNQEE

SEQ ID NO: 150674 - protein, 33 aa, Artificial Sequence
  Description of Artificial Sequence: Synthetic polypeptide
DEEEIATTNPVAYEQYGSACAAANGLDTMPDNQ

SEQ ID NO: 150675 - protein, 36 aa, Artificial Sequence
  Description of Artificial Sequence: Synthetic polypeptide
AEEEIRTTNPVATEQYGVVATTNDQAGNQIGTNQEE

SEQ ID NO: 150676 - protein, 36 aa, Artificial Sequence
  Description of Artificial Sequence: Synthetic polypeptide
DEEEIRTTNPVATEQYGSVCSFPNEHIVHSEGVVDF

SEQ ID NO: 150677 - protein, 37 aa, Artificial Sequence
  Description of Artificial Sequence: Synthetic polypeptide
DEEEIRTTNPVATEQYGSVQNTMTSNVFMSEGNSEYE

SEQ ID NO: 150678 - protein, 34 aa, Artificial Sequence
  Description of Artificial Sequence: Synthetic polypeptide
DEEEIRTTNPVATEQYGQCVCSWEEHAFFGSDQP

SEQ ID NO: 150679 - protein, 36 aa, Artificial Sequence
  Description of Artificial Sequence: Synthetic polypeptide
DEEEIRGTNPVATEQYGSVTPTPNEHQGNTAQTQND

SEQ ID NO: 150680 - protein, 33 aa, Artificial Sequence
  Description of Artificial Sequence: Synthetic polypeptide
DEVEIRTTNPVATEQYGSVCSLVSHFEISEEKN

SEQ ID NO: 150681 - protein, 37 aa, Artificial Sequence
  Description of Artificial Sequence: Synthetic polypeptide
AEEEIRTTNPVATEQYGSVSTVNQNGEEQAIGTEEGS

SEQ ID NO: 150682 - protein, 32 aa, Artificial Sequence
  Description of Artificial Sequence: Synthetic polypeptide
NEEEIASVNPVCTEQYGCVVCTDNGLQSEGDQ

SEQ ID NO: 150683 - protein, 36 aa, Artificial Sequence
  Description of Artificial Sequence: Synthetic polypeptide
DEEEIRTTNPVATEQYGSVQNPAIQIQGQNMVNTNQ

SEQ ID NO: 150684 - protein, 36 aa, Artificial Sequence
  Description of Artificial Sequence: Synthetic polypeptide
DEEEIRGTNPVATEQYGSVTPTPNEHQGNVGQVQII

SEQ ID NO: 150685 - protein, 37 aa, Artificial Sequence
  Description of Artificial Sequence: Synthetic polypeptide
DEDEIRTTNPVATTQYGSVSTTNLQQLQQATNVATEM

SEQ ID NO: 150686 - protein, 36 aa, Artificial Sequence
  Description of Artificial Sequence: Synthetic polypeptide
DEEEIRTTNPVATEQYGQCVCSTWGEHNQGFGSEQS

SEQ ID NO: 150687 - protein, 31 aa, Artificial Sequence
  Description of Artificial Sequence: Synthetic polypeptide
QENCIATTNPVATECYGMVSSECLEQHGEEL

SEQ ID NO: 150688 - protein, 31 aa, Artificial Sequence
  Description of Artificial Sequence: Synthetic polypeptide
NEEEIASVNPVCTEQWGCVVCSDNGQSGNTQ

SEQ ID NO: 150689 - protein, 35 aa, Artificial Sequence
  Description of Artificial Sequence: Synthetic polypeptide
DEEEIRTTNPVATEQYGQCVCSWEEHNQNFGSDQA

SEQ ID NO: 150690 - protein, 35 aa, Artificial Sequence
  Description of Artificial Sequence: Synthetic polypeptide
DEVEIRTTNPVATEQYGSVDNGNDQQNEEGGEEVF

SEQ ID NO: 150691 - protein, 37 aa, Artificial Sequence
  Description of Artificial Sequence: Synthetic polypeptide
DEVEIRTTNPVATEQYGSVDSTQNAMNQDGEGQTGED

SEQ ID NO: 150692 - protein, 35 aa, Artificial Sequence
  Description of Artificial Sequence: Synthetic polypeptide
DEEEIRTTNPVATEQYGQCVCSWGEDDQNFNSDQS

SEQ ID NO: 150693 - protein, 35 aa, Artificial Sequence
  Description of Artificial Sequence: Synthetic polypeptide
DEVEIRTTNPVATEQYGSVNDQGNDQQEEGGEQDT

SEQ ID NO: 150694 - protein, 35 aa, Artificial Sequence
  Description of Artificial Sequence: Synthetic polypeptide
DEEEIATTNPVAYEQYGSACNPANPLQEAEIGNDN

SEQ ID NO: 150695 - protein, 35 aa, Artificial Sequence
  Description of Artificial Sequence: Synthetic polypeptide
DEEEIRTTNPVATEQYGQCVCSWETQENFNSDTQN

SEQ ID NO: 150696 - protein, 34 aa, Artificial Sequence
  Description of Artificial Sequence: Synthetic polypeptide
DEEEIATTNPVAYEQYGSACATMPGLNSMNGENN

SEQ ID NO: 150697 - protein, 35 aa, Artificial Sequence
  Description of Artificial Sequence: Synthetic polypeptide
DEEEIATTNPVAYEQYGSACATMNLQNSMNEENNN

SEQ ID NO: 150698 - protein, 37 aa, Artificial Sequence
  Description of Artificial Sequence: Synthetic polypeptide
DEEEIRTTNPVATEQYGSVQPFAVPLDIQMIEPGNIL

SEQ ID NO: 150699 - protein, 34 aa, Artificial Sequence
  Description of Artificial Sequence: Synthetic polypeptide
DEEEIATTNPVAYEQYGSACAATNNNQTAGGTGT

SEQ ID NO: 150700 - protein, 38 aa, Artificial Sequence
  Description of Artificial Sequence: Synthetic polypeptide
AEEEIRTTNPVATEQYGVVSTNANLQNGNQEQGNNAVE

SEQ ID NO: 150701 - protein, 34 aa, Artificial Sequence
  Description of Artificial Sequence: Synthetic polypeptide
DEDEIRTTNPVATTQYGVVATNCATEQYGSTEDD

SEQ ID NO: 150702 - protein, 36 aa, Artificial Sequence
  Description of Artificial Sequence: Synthetic polypeptide
DEEEIRTTNPVATEQYGSVQNVTSDMQEETVPVNNE

SEQ ID NO: 150703 - protein, 35 aa, Artificial Sequence
  Description of Artificial Sequence: Synthetic polypeptide
DEEEIRTTNPVATEQYGQCVCSWEHNQENFNSNQL

SEQ ID NO: 150704 - protein, 35 aa, Artificial Sequence
  Description of Artificial Sequence: Synthetic polypeptide
DEEEIRTTNPVATEQYGQCVCSWEHETENFGSDQA

SEQ ID NO: 150705 - protein, 36 aa, Artificial Sequence
  Description of Artificial Sequence: Synthetic polypeptide
DEEEIRTTNPVATEQYGQCVCSWEELQENFGSEPQG

SEQ ID NO: 150706 - protein, 36 aa, Artificial Sequence
  Description of Artificial Sequence: Synthetic polypeptide
DEEEIRTTNPVATEQYGQCVCSWEELNQENFNSEQQ

SEQ ID NO: 150707 - protein, 35 aa, Artificial Sequence
  Description of Artificial Sequence: Synthetic polypeptide
DEEEIRTTNPVATEQYGQCVCSWEELNAHFGSQQS

SEQ ID NO: 150708 - protein, 36 aa, Artificial Sequence
  Description of Artificial Sequence: Synthetic polypeptide
DEEEIRTTNPVATEQYGQCVCSWEELDQENFGSDQS

SEQ ID NO: 150709 - protein, 35 aa, Artificial Sequence
  Description of Artificial Sequence: Synthetic polypeptide
DEEEIRTTNPVATEQYGQCVCSWEELAENFGSQQA

SEQ ID NO: 150710 - protein, 35 aa, Artificial Sequence
  Description of Artificial Sequence: Synthetic polypeptide
DEEEIRTTNPVATEQYGQCVCSWEEHQNFTSDNQD

SEQ ID NO: 150711 - protein, 32 aa, Artificial Sequence
  Description of Artificial Sequence: Synthetic polypeptide
NEEEIATTNPVATAQWGSVAAGGGDEAGNMRN

SEQ ID NO: 150712 - protein, 37 aa, Artificial Sequence
  Description of Artificial Sequence: Synthetic polypeptide
DEDEIRTTNPVATTQYGSVSTNTNQQLQNATNVATEQ

SEQ ID NO: 150713 - protein, 36 aa, Artificial Sequence
  Description of Artificial Sequence: Synthetic polypeptide
DEEEIRTTNPVATEQYGQCVCSTWEHNQENFNSDQY

SEQ ID NO: 150714 - protein, 35 aa, Artificial Sequence
  Description of Artificial Sequence: Synthetic polypeptide
DEEEIATTNPVAYEQYGSACAAAMNLQNSMNGENN

SEQ ID NO: 150715 - protein, 35 aa, Artificial Sequence
  Description of Artificial Sequence: Synthetic polypeptide
DEVEIRTTNPVATEQYGDVSTDGGNMTVGVGGDQE

SEQ ID NO: 150716 - protein, 35 aa, Artificial Sequence
  Description of Artificial Sequence: Synthetic polypeptide
DEEEIRGTNPVATEQYGSVYLFENQHDPQIQTIDR

SEQ ID NO: 150717 - protein, 30 aa, Artificial Sequence
  Description of Artificial Sequence: Synthetic polypeptide
QEMEIVTTNPVGTEQYGTVAATDTPEHGDI

SEQ ID NO: 150718 - protein, 31 aa, Artificial Sequence
  Description of Artificial Sequence: Synthetic polypeptide
NEEEIATTNPVATEQWGSVAANPGATAPPEM

SEQ ID NO: 150719 - protein, 37 aa, Artificial Sequence
  Description of Artificial Sequence: Synthetic polypeptide
DEEEIRTTNPVATEQYGSVQLWESTAVEDNPLLVEVA

SEQ ID NO: 150720 - protein, 38 aa, Artificial Sequence
  Description of Artificial Sequence: Synthetic polypeptide
AEEEIRTTNPVATEQYGTVSTTVANLQNATEQGTNMVE

SEQ ID NO: 150721 - protein, 30 aa, Artificial Sequence
  Description of Artificial Sequence: Synthetic polypeptide
QEMEIVTTNPVGTEQYGTVAATDTPEFGDI

SEQ ID NO: 150722 - protein, 30 aa, Artificial Sequence
  Description of Artificial Sequence: Synthetic polypeptide
QEMEIVTTNPVGTEQYGTVAATDGPEFGDI

SEQ ID NO: 150723 - protein, 36 aa, Artificial Sequence
  Description of Artificial Sequence: Synthetic polypeptide
DEEEIRTTNPVATEQYGSVQLTPWTDVPLQHMMDPQ

SEQ ID NO: 150724 - protein, 36 aa, Artificial Sequence
  Description of Artificial Sequence: Synthetic polypeptide
AEEEIRTTNPVATEQYGTVSTNNNNNNQQLQQNTET

SEQ ID NO: 150725 - protein, 38 aa, Artificial Sequence
  Description of Artificial Sequence: Synthetic polypeptide
AEEEIRTTNPVATEQYGSVSTVNNNNNNQQDNGNNNVE

SEQ ID NO: 150726 - protein, 38 aa, Artificial Sequence
  Description of Artificial Sequence: Synthetic polypeptide
AEEEIRTTNPVATEQYGSVSTVVSNNGNQNGTTNNTTD

SEQ ID NO: 150727 - protein, 31 aa, Artificial Sequence
  Description of Artificial Sequence: Synthetic polypeptide
QEMEIVTTNPVATEQYGTVSTDVPVEFEEEK

SEQ ID NO: 150728 - protein, 36 aa, Artificial Sequence
  Description of Artificial Sequence: Synthetic polypeptide
DEDEIRTTNPVATMQYGSVSSTTPAGPNMRNGMNPV

SEQ ID NO: 150729 - protein, 35 aa, Artificial Sequence
  Description of Artificial Sequence: Synthetic polypeptide
DEEEIRTTNPVATEQYGQCVCSTMEHENFGSETQP

SEQ ID NO: 150730 - protein, 38 aa, Artificial Sequence
  Description of Artificial Sequence: Synthetic polypeptide
AEEEIRTTNPVATEQYGSVSTVNNNNLEQGSNQSNNDD

SEQ ID NO: 150731 - protein, 34 aa, Artificial Sequence
  Description of Artificial Sequence: Synthetic polypeptide
DEDEIRTTNPVATEVWGSVCYNNEQQQDGGQNSP

SEQ ID NO: 150732 - protein, 35 aa, Artificial Sequence
  Description of Artificial Sequence: Synthetic polypeptide
DEDEIRTTNPVATESYGSVVDNNGLDQQDGQTGQG

SEQ ID NO: 150733 - protein, 36 aa, Artificial Sequence
  Description of Artificial Sequence: Synthetic polypeptide
DEDEIRTTNPVATESYGSVNDTNDNGQEEQTGGGNE

SEQ ID NO: 150734 - protein, 36 aa, Artificial Sequence
  Description of Artificial Sequence: Synthetic polypeptide
DEEEIRGTNPVATEQYGSVVSTTPDGPNMGNGEGDG

SEQ ID NO: 150735 - protein, 32 aa, Artificial Sequence
  Description of Artificial Sequence: Synthetic polypeptide
QEMEIVTTNPCASEQYGTVCSATNPVESEGND

SEQ ID NO: 150736 - protein, 37 aa, Artificial Sequence
  Description of Artificial Sequence: Synthetic polypeptide
DEEEIRGTNPVATEQYGSVVSSTTPDGPNMGEGENIG

SEQ ID NO: 150737 - protein, 33 aa, Artificial Sequence
  Description of Artificial Sequence: Synthetic polypeptide
NEEEIATTNPVATEQWGCVAGNGLDNNNGDNQY

SEQ ID NO: 150738 - protein, 35 aa, Artificial Sequence
  Description of Artificial Sequence: Synthetic polypeptide
DEVEIRTTNPVATEQYGSASPWNGPQETQIEDNGY

SEQ ID NO: 150739 - protein, 37 aa, Artificial Sequence
  Description of Artificial Sequence: Synthetic polypeptide
DEEEIRTTNPVATEQYGQCVCSTTPADNTENFGMNPV

SEQ ID NO: 150740 - protein, 37 aa, Artificial Sequence
  Description of Artificial Sequence: Synthetic polypeptide
DEDEIRTTNPVATTQYGSVSTNLQQLQQATTNVATEA

SEQ ID NO: 150741 - protein, 36 aa, Artificial Sequence
  Description of Artificial Sequence: Synthetic polypeptide
DEEEIRTTNPVATEQYGSVCSLMNPMIESEGSLQSI

SEQ ID NO: 150742 - protein, 37 aa, Artificial Sequence
  Description of Artificial Sequence: Synthetic polypeptide
DEEEIRTTNPVATEQYGQCVCSTTGEHNQNFGSENQM

SEQ ID NO: 150743 - protein, 36 aa, Artificial Sequence
  Description of Artificial Sequence: Synthetic polypeptide
AEEEIRTTNPVATEQYGTVVVTVTNNNQEQGETNND

SEQ ID NO: 150744 - protein, 36 aa, Artificial Sequence
  Description of Artificial Sequence: Synthetic polypeptide
DEEEIRTTNPVATEQYGQCVCSTTGEHNQNFGSDQA

SEQ ID NO: 150745 - protein, 33 aa, Artificial Sequence
  Description of Artificial Sequence: Synthetic polypeptide
NEEEIATTNPVATEMWGSVAATANGENNANSRA

SEQ ID NO: 150746 - protein, 36 aa, Artificial Sequence
  Description of Artificial Sequence: Synthetic polypeptide
DEEEIRTTNPVATEQYGQCVCSTTGEDDQNFGSEQP

SEQ ID NO: 150747 - protein, 36 aa, Artificial Sequence
  Description of Artificial Sequence: Synthetic polypeptide
DEEEIRTTNPVATEQYGQCVCSTTEHNQNFGSDTQL

SEQ ID NO: 150748 - protein, 36 aa, Artificial Sequence
  Description of Artificial Sequence: Synthetic polypeptide
DEEEIRTTNPVATEQYGQCVCSTTEEHDQHFNSDQY

SEQ ID NO: 150749 - protein, 36 aa, Artificial Sequence
  Description of Artificial Sequence: Synthetic polypeptide
DEEEIRTTNPVATEQYGQCVCSTSEHQEFFGSDTQD

SEQ ID NO: 150750 - protein, 36 aa, Artificial Sequence
  Description of Artificial Sequence: Synthetic polypeptide
DEEEIRTTNPVATEQYGQCVCSTPEPQENFNSENQS

SEQ ID NO: 150751 - protein, 35 aa, Artificial Sequence
  Description of Artificial Sequence: Synthetic polypeptide
DEEEIRTTNPVATEQYGSVQMPMNMQAQEETQVVI

SEQ ID NO: 150752 - protein, 37 aa, Artificial Sequence
  Description of Artificial Sequence: Synthetic polypeptide
AEEEIRTTNPVATEQYGTVSTVTNQQAGNQQGNNEGD

SEQ ID NO: 150753 - protein, 32 aa, Artificial Sequence
  Description of Artificial Sequence: Synthetic polypeptide
QEMEIVTTNPVGTEQYGTVCSATDGPEFEGNI

SEQ ID NO: 150754 - protein, 36 aa, Artificial Sequence
  Description of Artificial Sequence: Synthetic polypeptide
DEVEIRTTNPVATEQYGDVVSIVNEGQVGEGGNEET

SEQ ID NO: 150755 - protein, 37 aa, Artificial Sequence
  Description of Artificial Sequence: Synthetic polypeptide
AEEEIRTTNPVATEQYGSVSTVNNNVDEAGSVNNQTT

SEQ ID NO: 150756 - protein, 38 aa, Artificial Sequence
  Description of Artificial Sequence: Synthetic polypeptide
AEEEIRTTNPVATEQYGSVSTVNNNTQAGNQQGNNEGD

SEQ ID NO: 150757 - protein, 36 aa, Artificial Sequence
  Description of Artificial Sequence: Synthetic polypeptide
DEEEIRGTNPVATEQYGSVVMGQDDENDNFQDEGNG

SEQ ID NO: 150758 - protein, 35 aa, Artificial Sequence
  Description of Artificial Sequence: Synthetic polypeptide
DEEEIRTTNPVATEQYGSVSQLGLVVVVESSQQEA

SEQ ID NO: 150759 - protein, 38 aa, Artificial Sequence
  Description of Artificial Sequence: Synthetic polypeptide
DEEEIRTTNPVATEQYGSVCSNNMDNQIGCGQNVNENE

SEQ ID NO: 150760 - protein, 32 aa, Artificial Sequence
  Description of Artificial Sequence: Synthetic polypeptide
DEEEIATTNPVAYEQWGVVSGGNGNVGDGGTS

SEQ ID NO: 150761 - protein, 36 aa, Artificial Sequence
  Description of Artificial Sequence: Synthetic polypeptide
DEEEIRTTNPVATEQYGSVSPWVPTSAITETENENE

SEQ ID NO: 150762 - protein, 29 aa, Artificial Sequence
  Description of Artificial Sequence: Synthetic peptide
NEEEIATTNPVAYEQYGEAPEVCQHEPEK

SEQ ID NO: 150763 - protein, 35 aa, Artificial Sequence
  Description of Artificial Sequence: Synthetic polypeptide
DEEEIATTNPVAYEQWGTSVSVTNDIGQHMIAERN

SEQ ID NO: 150764 - protein, 31 aa, Artificial Sequence
  Description of Artificial Sequence: Synthetic polypeptide
AENEIATTNPVATECYGCVCSWELQHTSELA

SEQ ID NO: 150765 - protein, 36 aa, Artificial Sequence
  Description of Artificial Sequence: Synthetic polypeptide
DEEEIRTTNPVATEQYGSVQFITVGMEQPETGEVEI

SEQ ID NO: 150766 - protein, 32 aa, Artificial Sequence
  Description of Artificial Sequence: Synthetic polypeptide
SEEEIRCTNPIATEQYGCVCSWNDHANFGSDQ

SEQ ID NO: 150767 - protein, 36 aa, Artificial Sequence
  Description of Artificial Sequence: Synthetic polypeptide
DEEEIRTTNPVATEQYGSVQFITMGSEQPEFGEVEI

SEQ ID NO: 150768 - protein, 33 aa, Artificial Sequence
  Description of Artificial Sequence: Synthetic polypeptide
SEEEIRCTNPIATEQYGCVCSWNHAEYFGSNQA

SEQ ID NO: 150769 - protein, 31 aa, Artificial Sequence
  Description of Artificial Sequence: Synthetic polypeptide
QEMEIATTNPVATECYGTVCSAECPVQFENL

SEQ ID NO: 150770 - protein, 36 aa, Artificial Sequence
  Description of Artificial Sequence: Synthetic polypeptide
DEEEIRTTNPVATEQYGSVQFITMGQEQPEGEVTEI

SEQ ID NO: 150771 - protein, 32 aa, Artificial Sequence
  Description of Artificial Sequence: Synthetic polypeptide
SEEEIRCTNPIATEQYGCVCSWNHAYFNSDQA

SEQ ID NO: 150772 - protein, 33 aa, Artificial Sequence
  Description of Artificial Sequence: Synthetic polypeptide
SEEEIRCTNPIATEQYGCVCSWNHNAENFGSNQ

SEQ ID NO: 150773 - protein, 32 aa, Artificial Sequence
  Description of Artificial Sequence: Synthetic polypeptide
SEEEIRCTNPIATEQYGCVCSWNHTYFGSDQS

SEQ ID NO: 150774 - protein, 35 aa, Artificial Sequence
  Description of Artificial Sequence: Synthetic polypeptide
DEVEIATTNPVAYEQWGSVSHTMNPDQGQQGDHSR

SEQ ID NO: 150775 - protein, 34 aa, Artificial Sequence
  Description of Artificial Sequence: Synthetic polypeptide
DEVEIATTNPVAYEQWGSVSGNPNEGQDMGNNEV

SEQ ID NO: 150776 - protein, 34 aa, Artificial Sequence
  Description of Artificial Sequence: Synthetic polypeptide
DEEEIATTNPVAYEQWGTSVSATADLGNHDIARN

SEQ ID NO: 150777 - protein, 33 aa, Artificial Sequence
  Description of Artificial Sequence: Synthetic polypeptide
SEEEIRCTNPIATEQYGCVCSWNLEANFGSDQS

SEQ ID NO: 150778 - protein, 34 aa, Artificial Sequence
  Description of Artificial Sequence: Synthetic polypeptide
DEVEIATTNPVAYEQWGSVSANDPGAPRNQEGNN

SEQ ID NO: 150779 - protein, 37 aa, Artificial Sequence
  Description of Artificial Sequence: Synthetic polypeptide
DEEEIRTTNPVATEQYGSVSPYHLALPQSEENPLIEL

SEQ ID NO: 150780 - protein, 28 aa, Artificial Sequence
  Description of Artificial Sequence: Synthetic peptide
NEEEIATTNPVAYEQWGWAYYVEQHDQG

SEQ ID NO: 150781 - protein, 33 aa, Artificial Sequence
  Description of Artificial Sequence: Synthetic polypeptide
SEEEIRCTNPIATEQYGCVCSWGEHNANFGSNQ

SEQ ID NO: 150782 - protein, 33 aa, Artificial Sequence
  Description of Artificial Sequence: Synthetic polypeptide
SEEEIRCTNPIATEQYGCVCSWENPANFGSNQA

SEQ ID NO: 150783 - protein, 32 aa, Artificial Sequence
  Description of Artificial Sequence: Synthetic polypeptide
NEEEIATTNPVAYEQWGSLSCFEHDQRQGGEN

SEQ ID NO: 150784 - protein, 33 aa, Artificial Sequence
  Description of Artificial Sequence: Synthetic polypeptide
NEEEIATTNPVAYEQWGSVLWWNQDEQTGDMRS

SEQ ID NO: 150785 - protein, 30 aa, Artificial Sequence
  Description of Artificial Sequence: Synthetic polypeptide
QEMEIATTNPVATEQYGEACSTDVCEHEEK

SEQ ID NO: 150786 - protein, 35 aa, Artificial Sequence
  Description of Artificial Sequence: Synthetic polypeptide
DEVEIATTNPVAYEQWGSVYKTDEQLQERQGDNVE

SEQ ID NO: 150787 - protein, 29 aa, Artificial Sequence
  Description of Artificial Sequence: Synthetic peptide
QEMEIATTNPVATEQYGEACPEVCQHEEK

SEQ ID NO: 150788 - protein, 29 aa, Artificial Sequence
  Description of Artificial Sequence: Synthetic peptide
QEMEIATTNPVATEQYGEACPEVCQHEED

SEQ ID NO: 150789 - protein, 33 aa, Artificial Sequence
  Description of Artificial Sequence: Synthetic polypeptide
SEEEIRCTNPIATEQYGCVCSNWNPANFGSNQS

SEQ ID NO: 150790 - protein, 31 aa, Artificial Sequence
  Description of Artificial Sequence: Synthetic polypeptide
QEMEIATTNPVATEGYGCVCSWELQHSSELA

SEQ ID NO: 150791 - protein, 32 aa, Artificial Sequence
  Description of Artificial Sequence: Synthetic polypeptide
NEEEIATTNPVAYEQWGSVRWWNDDEQTGGGH

SEQ ID NO: 150792 - protein, 36 aa, Artificial Sequence
  Description of Artificial Sequence: Synthetic polypeptide
DEEEIRTTNPVATEQYGSVSPWIAAEFMLQMETEVT

SEQ ID NO: 150793 - protein, 33 aa, Artificial Sequence
  Description of Artificial Sequence: Synthetic polypeptide
NEEEIATTNPVAYEQWGSVRWWNPDDEQTGNHD

SEQ ID NO: 150794 - protein, 32 aa, Artificial Sequence
  Description of Artificial Sequence: Synthetic polypeptide
QEMEIATTNPVATECYGTVCSATDGLEFEEND

SEQ ID NO: 150795 - protein, 33 aa, Artificial Sequence
  Description of Artificial Sequence: Synthetic polypeptide
SEEEIRCTNPIATEQYGCVCSWELANFGSNNQS

SEQ ID NO: 150796 - protein, 35 aa, Artificial Sequence
  Description of Artificial Sequence: Synthetic polypeptide
DEEEIRTTNPVATEQYGSVQFTTMGEEQPEAEVEI

SEQ ID NO: 150797 - protein, 34 aa, Artificial Sequence
  Description of Artificial Sequence: Synthetic polypeptide
DEVEIATTNPVAYEQWGSVSTTNGNDNHGGDDVR

SEQ ID NO: 150798 - protein, 36 aa, Artificial Sequence
  Description of Artificial Sequence: Synthetic polypeptide
DEEEIRTTNPVATEQYGSVSPWMIENDGAAMNELEQ

SEQ ID NO: 150799 - protein, 35 aa, Artificial Sequence
  Description of Artificial Sequence: Synthetic polypeptide
DEEEIRTTNPVATEQYGSVSPWMMTQTTVHLVEEG

SEQ ID NO: 150800 - protein, 32 aa, Artificial Sequence
  Description of Artificial Sequence: Synthetic polypeptide
SEEEIRCTNPIATEQYGCVCSWELMSFGSDQS

SEQ ID NO: 150801 - protein, 33 aa, Artificial Sequence
  Description of Artificial Sequence: Synthetic polypeptide
SEEEIRCTNPIATEQYGCVCSWELNANFGSNQI

SEQ ID NO: 150802 - protein, 32 aa, Artificial Sequence
  Description of Artificial Sequence: Synthetic polypeptide
SEEEIRCTNPIATEQYGCVCSWNPNANFGSEQ

SEQ ID NO: 150803 - protein, 36 aa, Artificial Sequence
  Description of Artificial Sequence: Synthetic polypeptide
DEEEIRTTNPVATEQYGQCVCSNWEHNQGFGSENQG

SEQ ID NO: 150804 - protein, 33 aa, Artificial Sequence
  Description of Artificial Sequence: Synthetic polypeptide
DEVEIATTNPVAYEQWGSVCSTWDLGDTGGDAG

SEQ ID NO: 150805 - protein, 36 aa, Artificial Sequence
  Description of Artificial Sequence: Synthetic polypeptide
DEEEIRTTNPVATEQYGSVQFITMGEEQPTGEVPEE

SEQ ID NO: 150806 - protein, 36 aa, Artificial Sequence
  Description of Artificial Sequence: Synthetic polypeptide
DEEEIRTTNPVATEQYGQCVCSNTGEPQENFGSEQS

SEQ ID NO: 150807 - protein, 32 aa, Artificial Sequence
  Description of Artificial Sequence: Synthetic polypeptide
QEMEIAPTNPVATEQYGIVCSATDGLEFEGTD

SEQ ID NO: 150808 - protein, 37 aa, Artificial Sequence
  Description of Artificial Sequence: Synthetic polypeptide
DEEEIRTTNPVATEQYGSVSQENLGLSHAQPFVVQVD

SEQ ID NO: 150809 - protein, 32 aa, Artificial Sequence
  Description of Artificial Sequence: Synthetic polypeptide
DEVEIATTNPVAYEQWGCVCDNDLKGQGDMER

SEQ ID NO: 150810 - protein, 38 aa, Artificial Sequence
  Description of Artificial Sequence: Synthetic polypeptide
AEEEIRTTNPVATEQYGSVVVVVTTNLNQQGNGNNETE

SEQ ID NO: 150811 - protein, 31 aa, Artificial Sequence
  Description of Artificial Sequence: Synthetic polypeptide
DEVEIATTNPVAYEQWGCVCDNDLGHQVDEM

SEQ ID NO: 150812 - protein, 36 aa, Artificial Sequence
  Description of Artificial Sequence: Synthetic polypeptide
DEEEIRTTNPVATEQYGSVQFITMGEEEQPEGEGEI

SEQ ID NO: 150813 - protein, 32 aa, Artificial Sequence
  Description of Artificial Sequence: Synthetic polypeptide
DEVEIATTNPVAYEQWGCTSTNWNQGDGDDSS

SEQ ID NO: 150814 - protein, 33 aa, Artificial Sequence
  Description of Artificial Sequence: Synthetic polypeptide
DEVEIATTNPVAYEQWGSTVTGNDSQNGGDNGG

SEQ ID NO: 150815 - protein, 38 aa, Artificial Sequence
  Description of Artificial Sequence: Synthetic polypeptide
DEEEIRTTNPVATEQYGQCVCSNTGELNQEFFGSDNQE

SEQ ID NO: 150816 - protein, 37 aa, Artificial Sequence
  Description of Artificial Sequence: Synthetic polypeptide
DEDEIRTTNPVATEQYGVVSTTNNQQQGNQQGTEDND

SEQ ID NO: 150817 - protein, 37 aa, Artificial Sequence
  Description of Artificial Sequence: Synthetic polypeptide
AEEEIRTTNPVATEQYGSVVVVVTTNLNQGTNEENDD

SEQ ID NO: 150818 - protein, 32 aa, Artificial Sequence
  Description of Artificial Sequence: Synthetic polypeptide
DEVEIATTNPVAYEPWGTATTNLQGNAGEGER

SEQ ID NO: 150819 - protein, 33 aa, Artificial Sequence
  Description of Artificial Sequence: Synthetic polypeptide
DEVEIATTNPVAYEPWGSVYCTDRDLTDDRGNM

SEQ ID NO: 150820 - protein, 36 aa, Artificial Sequence
  Description of Artificial Sequence: Synthetic polypeptide
DEEEIRTTNPVATEQYGQCVCSNTGEHNQSFGSDQA

SEQ ID NO: 150821 - protein, 36 aa, Artificial Sequence
  Description of Artificial Sequence: Synthetic polypeptide
DEEEIRTTNPVATEQYGQCVCSNTGEHNQNFGSQQS

SEQ ID NO: 150822 - protein, 36 aa, Artificial Sequence
  Description of Artificial Sequence: Synthetic polypeptide
DEEEIRTTNPVATEQYGSVQFISMGESQPEGLVPEI

SEQ ID NO: 150823 - protein, 38 aa, Artificial Sequence
  Description of Artificial Sequence: Synthetic polypeptide
DEDEIRTTNPVATEQYGVVSTTNNQQLGNQQGTNNTNE

SEQ ID NO: 150824 - protein, 31 aa, Artificial Sequence
  Description of Artificial Sequence: Synthetic polypeptide
DEVEIATTNPVAYEQWGCSWTNGMMEDGNQQ

SEQ ID NO: 150825 - protein, 37 aa, Artificial Sequence
  Description of Artificial Sequence: Synthetic polypeptide
DEEEIRTTNPVATEQYGQCVCSNTGEPQESFGSDNQP

SEQ ID NO: 150826 - protein, 37 aa, Artificial Sequence
  Description of Artificial Sequence: Synthetic polypeptide
DEEEIRTTNPVATEQYGQCVCSNTGYHQENFGSQNQA

SEQ ID NO: 150827 - protein, 36 aa, Artificial Sequence
  Description of Artificial Sequence: Synthetic polypeptide
DEEEIRTTNPVATEQYGQCVCSNTGYHQSFNSDTQS

SEQ ID NO: 150828 - protein, 35 aa, Artificial Sequence
  Description of Artificial Sequence: Synthetic polypeptide
DEEEIRTTNPVATEQYGSVQFITMGEEQPSPEVEI

SEQ ID NO: 150829 - protein, 34 aa, Artificial Sequence
  Description of Artificial Sequence: Synthetic polypeptide
DEVEIATTNPVAYEQWGSVCSTNDHDHPNNGREV

SEQ ID NO: 150830 - protein, 35 aa, Artificial Sequence
  Description of Artificial Sequence: Synthetic polypeptide
DEVEIATTNPVAYEQWGSVCSTNDHDHPNNGNQER

SEQ ID NO: 150831 - protein, 34 aa, Artificial Sequence
  Description of Artificial Sequence: Synthetic polypeptide
DEVEIATTNPVAYEQWGSVCSTNDHDHPNGQERG

SEQ ID NO: 150832 - protein, 34 aa, Artificial Sequence
  Description of Artificial Sequence: Synthetic polypeptide
DEVEIATTNPVAYEQWGSVCSTNDHDHPNGERER

SEQ ID NO: 150833 - protein, 34 aa, Artificial Sequence
  Description of Artificial Sequence: Synthetic polypeptide
DEVEIATTNPVAYEQWGSVCSTNDHDHPNGEHRA

SEQ ID NO: 150834 - protein, 37 aa, Artificial Sequence
  Description of Artificial Sequence: Synthetic polypeptide
DEEEIRTTNPVATEQYGQCVCSNTNEHEQGFISDNQS

SEQ ID NO: 150835 - protein, 33 aa, Artificial Sequence
  Description of Artificial Sequence: Synthetic polypeptide
DEVEIATTNPVAYEQWGSVCSTNDHDHPGGQEP

SEQ ID NO: 150836 - protein, 34 aa, Artificial Sequence
  Description of Artificial Sequence: Synthetic polypeptide
DEVEIATTNPVAYEQWGSVCSTNDGDHPNTGQHR

SEQ ID NO: 150837 - protein, 37 aa, Artificial Sequence
  Description of Artificial Sequence: Synthetic polypeptide
DEEEIRTTNPVATEQYGQCVCSNTNEHEQGFGSETDS

SEQ ID NO: 150838 - protein, 32 aa, Artificial Sequence
  Description of Artificial Sequence: Synthetic polypeptide
QEMEIAPTNPVSTEQYGIVCSACNLVESEGND

SEQ ID NO: 150839 - protein, 37 aa, Artificial Sequence
  Description of Artificial Sequence: Synthetic polypeptide
AEEEIRTTNPVATEQYGSVVVVVTTNLQNNEGQEGEM

SEQ ID NO: 150840 - protein, 37 aa, Artificial Sequence
  Description of Artificial Sequence: Synthetic polypeptide
AEEEIRTTNPVATEQYGSVVVVVTTNLQNNEGQDEEV

SEQ ID NO: 150841 - protein, 36 aa, Artificial Sequence
  Description of Artificial Sequence: Synthetic polypeptide
DEEEIRTTNPVATEQYGSVQFITMGEEQPEGEVLDI

SEQ ID NO: 150842 - protein, 33 aa, Artificial Sequence
  Description of Artificial Sequence: Synthetic polypeptide
DEEEIATTNPVAYEQWGSVTGPNIGNQGGMGGD

SEQ ID NO: 150843 - protein, 33 aa, Artificial Sequence
  Description of Artificial Sequence: Synthetic polypeptide
DEVEIATTNPVAYEQWGSVCSGENDQNDTNDHK

SEQ ID NO: 150844 - protein, 33 aa, Artificial Sequence
  Description of Artificial Sequence: Synthetic polypeptide
DEVEIATTNPVAYEQWGSVCPTDQGQQQGNGGV

SEQ ID NO: 150845 - protein, 33 aa, Artificial Sequence
  Description of Artificial Sequence: Synthetic polypeptide
DEVEIATTNPVAYEQWGSVCDGDDLRNNDRGNA

SEQ ID NO: 150846 - protein, 37 aa, Artificial Sequence
  Description of Artificial Sequence: Synthetic polypeptide
AEEEIRTTNPVATEQYGSVVVVVTTNLQNNEAGQTEE

SEQ ID NO: 150847 - protein, 37 aa, Artificial Sequence
  Description of Artificial Sequence: Synthetic polypeptide
AEEEIRTTNPVATEQYGSVSTVDQAGNNVEEGNNNSD

SEQ ID NO: 150848 - protein, 35 aa, Artificial Sequence
  Description of Artificial Sequence: Synthetic polypeptide
DEEEIRTTNPVATEQYGQCVCSNWEHNQNFGSDQP

SEQ ID NO: 150849 - protein, 35 aa, Artificial Sequence
  Description of Artificial Sequence: Synthetic polypeptide
DEEEIRTTNPVATEQYGQCVCSNWEHNQNFGSDQS

SEQ ID NO: 150850 - protein, 28 aa, Artificial Sequence
  Description of Artificial Sequence: Synthetic peptide
QEMEIATTNPVATEQYGEAPEVCEHEEK

SEQ ID NO: 150851 - protein, 36 aa, Artificial Sequence
  Description of Artificial Sequence: Synthetic polypeptide
AEEEIRTTNPVATEQYGSVVVVVTTNNTNNEGQNED

SEQ ID NO: 150852 - protein, 36 aa, Artificial Sequence
  Description of Artificial Sequence: Synthetic polypeptide
DEEEIRGTNPVATEWYGSVSSTTPAGPNMRNGMNPV

SEQ ID NO: 150853 - protein, 35 aa, Artificial Sequence
  Description of Artificial Sequence: Synthetic polypeptide
NEEEIATTNPVATEQYGSVCAANGLEYDPDGTNDP

SEQ ID NO: 150854 - protein, 33 aa, Artificial Sequence
  Description of Artificial Sequence: Synthetic polypeptide
DEVEIATTNPVAYERWGCVSTNWQGNDSGNTEG

SEQ ID NO: 150855 - protein, 37 aa, Artificial Sequence
  Description of Artificial Sequence: Synthetic polypeptide
DEEEIRTTNPVATEQYGSVSPTWLNMEQVSFPQSQEQ

SEQ ID NO: 150856 - protein, 36 aa, Artificial Sequence
  Description of Artificial Sequence: Synthetic polypeptide
DEEEIRTTNPVATEQYGQCVCSSNHEQENFNSDNQS

SEQ ID NO: 150857 - protein, 36 aa, Artificial Sequence
  Description of Artificial Sequence: Synthetic polypeptide
DEEEIRTTNPVATEQYGQCVCSSMEHQENGNSDNQL

SEQ ID NO: 150858 - protein, 29 aa, Artificial Sequence
  Description of Artificial Sequence: Synthetic peptide
QEMEIATTNPVGTEQYGTMCSSTPEFGDI

SEQ ID NO: 150859 - protein, 36 aa, Artificial Sequence
  Description of Artificial Sequence: Synthetic polypeptide
DEEEIRTTNPVATEQYGQCVCSTEDHEQYFGSETQA

SEQ ID NO: 150860 - protein, 36 aa, Artificial Sequence
  Description of Artificial Sequence: Synthetic polypeptide
DEEEIRTTNPVATEQYGQCVCSSGEHNQNFGSENQS

SEQ ID NO: 150861 - protein, 31 aa, Artificial Sequence
  Description of Artificial Sequence: Synthetic polypeptide
QEMEIATTNPVGTEQYGTMCSATTPVEFGND

SEQ ID NO: 150862 - protein, 35 aa, Artificial Sequence
  Description of Artificial Sequence: Synthetic polypeptide
DEEEIRTTNPVATEQYGQCVCSSGEHNQGFGSDQS

SEQ ID NO: 150863 - protein, 36 aa, Artificial Sequence
  Description of Artificial Sequence: Synthetic polypeptide
DEVEIATTNPVAYEQYGTVCSYTDGLVEEQRGMNES

SEQ ID NO: 150864 - protein, 36 aa, Artificial Sequence
  Description of Artificial Sequence: Synthetic polypeptide
DEVEIATTNPVAYEQYGTVCSYTDGLNEEQRNGNES

SEQ ID NO: 150865 - protein, 36 aa, Artificial Sequence
  Description of Artificial Sequence: Synthetic polypeptide
DEVEIATTNPVAYEQYGTVCSYTDGLNEEDQRGNES

SEQ ID NO: 150866 - protein, 36 aa, Artificial Sequence
  Description of Artificial Sequence: Synthetic polypeptide
DEEEIRTTNPVATEQYGQCVCSSGALQENFNSDNQS

SEQ ID NO: 150867 - protein, 35 aa, Artificial Sequence
  Description of Artificial Sequence: Synthetic polypeptide
DEEEIRTTNPVATEQYGQCVCSSENQENFNSETQA

SEQ ID NO: 150868 - protein, 37 aa, Artificial Sequence
  Description of Artificial Sequence: Synthetic polypeptide
AEEEIRTTNPVATEQYGSVVVVVTTNNQQGEEGTNIP

SEQ ID NO: 150869 - protein, 35 aa, Artificial Sequence
  Description of Artificial Sequence: Synthetic polypeptide
DEEEIRTTNPVATEQYGQCVCSSGEHNQHFNSDQL

SEQ ID NO: 150870 - protein, 37 aa, Artificial Sequence
  Description of Artificial Sequence: Synthetic polypeptide
AEEEIRTTNPVATEQYGSVVVVVTTNQGNEQGGNNQE

SEQ ID NO: 150871 - protein, 37 aa, Artificial Sequence
  Description of Artificial Sequence: Synthetic polypeptide
AEEEIRTTNPVATEQYGSVVVVVTTNQLGGNNGNNDD

SEQ ID NO: 150872 - protein, 33 aa, Artificial Sequence
  Description of Artificial Sequence: Synthetic polypeptide
SEEEIRCTNPCATEQYGCVCSWNDAYFGSNTQA

SEQ ID NO: 150873 - protein, 37 aa, Artificial Sequence
  Description of Artificial Sequence: Synthetic polypeptide
DEEEIRTTNPVATEQYGSVCSNPPHNNGAFQTGTELE

SEQ ID NO: 150874 - protein, 33 aa, Artificial Sequence
  Description of Artificial Sequence: Synthetic polypeptide
DEVEICTTNPTATEQYGEVISEANPQELGVDTH

SEQ ID NO: 150875 - protein, 38 aa, Artificial Sequence
  Description of Artificial Sequence: Synthetic polypeptide
DEDEIRTTNPVATEQYGVVSTVTNNNLQQAGNNNDEDD

SEQ ID NO: 150876 - protein, 36 aa, Artificial Sequence
  Description of Artificial Sequence: Synthetic polypeptide
DEEEIRTTNPVATEQYGQCVCSTEEHNQEYFGSDQS

SEQ ID NO: 150877 - protein, 37 aa, Artificial Sequence
  Description of Artificial Sequence: Synthetic polypeptide
AEEEIRTTNPVATEQYGSVVVVVTTNQNQDEGNVEDE

SEQ ID NO: 150878 - protein, 36 aa, Artificial Sequence
  Description of Artificial Sequence: Synthetic polypeptide
DEEEIRTTNPVATEQYGQCVCSTEEHNQENFGSDQA

SEQ ID NO: 150879 - protein, 38 aa, Artificial Sequence
  Description of Artificial Sequence: Synthetic polypeptide
DEDEIRTTNPVATEQYGVVSTVTNNNLQAGNNNNDEDD

SEQ ID NO: 150880 - protein, 37 aa, Artificial Sequence
  Description of Artificial Sequence: Synthetic polypeptide
DEEEIRTTNPVATEQYGQCVCSTEEHNQEHFGSDNQS

SEQ ID NO: 150881 - protein, 36 aa, Artificial Sequence
  Description of Artificial Sequence: Synthetic polypeptide
DEEEIRTTNPVATEQYGQCVCSTEEHNENFGSDPQA

SEQ ID NO: 150882 - protein, 37 aa, Artificial Sequence
  Description of Artificial Sequence: Synthetic polypeptide
DEEEIRTTNPVATEQYGQCVCSTEEHNAENFGSQNQS

SEQ ID NO: 150883 - protein, 32 aa, Artificial Sequence
  Description of Artificial Sequence: Synthetic polypeptide
DEVEIATTNPVAYESWGCTSTNQNQGNDNDGR

SEQ ID NO: 150884 - protein, 36 aa, Artificial Sequence
  Description of Artificial Sequence: Synthetic polypeptide
DEEEIRTTNPVATEQYGSVCSNSVNMEVPRPFSDQD

SEQ ID NO: 150885 - protein, 37 aa, Artificial Sequence
  Description of Artificial Sequence: Synthetic polypeptide
DEEEIRTTNPVATEQYGQCVCSTEEDLQESFNSDTQA

SEQ ID NO: 150886 - protein, 38 aa, Artificial Sequence
  Description of Artificial Sequence: Synthetic polypeptide
AEEEIRTTNPVATEQYGSVVVVVTTNQLQQGNNQNTTE

SEQ ID NO: 150887 - protein, 32 aa, Artificial Sequence
  Description of Artificial Sequence: Synthetic polypeptide
SEEEIRCTNPCATEGYGCVCSWELNANFGSNQ

SEQ ID NO: 150888 - protein, 33 aa, Artificial Sequence
  Description of Artificial Sequence: Synthetic polypeptide
SEEEIRCTNPCATEQYGCVCSTWELNANFGSDQ

SEQ ID NO: 150889 - protein, 32 aa, Artificial Sequence
  Description of Artificial Sequence: Synthetic polypeptide
SEEEIRCTNPCATEQYGCVCSWEDNAHFGSDQ

SEQ ID NO: 150890 - protein, 32 aa, Artificial Sequence
  Description of Artificial Sequence: Synthetic polypeptide
SEEEIRCTNPCATEQYGCVCSWETANFGSDQS

SEQ ID NO: 150891 - protein, 33 aa, Artificial Sequence
  Description of Artificial Sequence: Synthetic polypeptide
DEVEIATTNPVAYERWGSVYSTELQGNDNDGES

SEQ ID NO: 150892 - protein, 33 aa, Artificial Sequence
  Description of Artificial Sequence: Synthetic polypeptide
QEMEIATTNPVATEQYGVVCAATDTLVEFEGND

SEQ ID NO: 150893 - protein, 35 aa, Artificial Sequence
  Description of Artificial Sequence: Synthetic polypeptide
DEEEIRTTNPVATEQYGQCVCSSEEHNQFFNSDQA

SEQ ID NO: 150894 - protein, 33 aa, Artificial Sequence
  Description of Artificial Sequence: Synthetic polypeptide
QEMEIATTNPVATEQYGVVCAATDGLVEFEGND

SEQ ID NO: 150895 - protein, 37 aa, Artificial Sequence
  Description of Artificial Sequence: Synthetic polypeptide
AEEEIRTTNPVATEQYGSVVVVVTTNNQNQENGTNFN

SEQ ID NO: 150896 - protein, 31 aa, Artificial Sequence
  Description of Artificial Sequence: Synthetic polypeptide
DEVEIATTNPVAYEQYGSTVAANGDDNPAAP

SEQ ID NO: 150897 - protein, 31 aa, Artificial Sequence
  Description of Artificial Sequence: Synthetic polypeptide
QEMEIATTNPVATEQYGTVCPAEGPVQHENK

SEQ ID NO: 150898 - protein, 32 aa, Artificial Sequence
  Description of Artificial Sequence: Synthetic polypeptide
NEEEIATTNPVAYEKWGSVCWIELGQVDHGND

SEQ ID NO: 150899 - protein, 32 aa, Artificial Sequence
  Description of Artificial Sequence: Synthetic polypeptide
NEEEIATTNPVAYEQWGCLSCFEHDQRQNGMR

SEQ ID NO: 150900 - protein, 31 aa, Artificial Sequence
  Description of Artificial Sequence: Synthetic polypeptide
DEVEIATTNPVAYEQWGYCQEDLVGGMNNRT

SEQ ID NO: 150901 - protein, 32 aa, Artificial Sequence
  Description of Artificial Sequence: Synthetic polypeptide
DEVEIATTNPVAYEQWGYCQEDLTNRGMNNDR

SEQ ID NO: 150902 - protein, 33 aa, Artificial Sequence
  Description of Artificial Sequence: Synthetic polypeptide
DEVEIATTNPVAYEQWGVVSGTNMQLNDEHGGF

SEQ ID NO: 150903 - protein, 31 aa, Artificial Sequence
  Description of Artificial Sequence: Synthetic polypeptide
QEMEIATTNPVATEQYGEVCSTDVCEHEEEK

SEQ ID NO: 150904 - protein, 35 aa, Artificial Sequence
  Description of Artificial Sequence: Synthetic polypeptide
DEEEIATTNPVAYEQWGTVCSTENGNNQGDGGNDQ

SEQ ID NO: 150905 - protein, 31 aa, Artificial Sequence
  Description of Artificial Sequence: Synthetic polypeptide
SEEEIRCTNPIATEQWGATVWAENWAERGPI

SEQ ID NO: 150906 - protein, 33 aa, Artificial Sequence
  Description of Artificial Sequence: Synthetic polypeptide
SEEEIRCTNPIATEQWGSTVWSNAENWMEPGPR

SEQ ID NO: 150907 - protein, 34 aa, Artificial Sequence
  Description of Artificial Sequence: Synthetic polypeptide
DEVEIATTNPVAYEQWGTVVPTENDGDRNGDNNR

SEQ ID NO: 150908 - protein, 28 aa, Artificial Sequence
  Description of Artificial Sequence: Synthetic peptide
NEEEIATTNPVAYEQWGEAYEVEQHEEG

SEQ ID NO: 150909 - protein, 29 aa, Artificial Sequence
  Description of Artificial Sequence: Synthetic peptide
NEEEIATTNPVAYEQWGEAYYVEQNNNQG

SEQ ID NO: 150910 - protein, 35 aa, Artificial Sequence
  Description of Artificial Sequence: Synthetic polypeptide
DEEEIRTTNPVATEQYGQCVCSNWETQENFNSQQA

SEQ ID NO: 150911 - protein, 29 aa, Artificial Sequence
  Description of Artificial Sequence: Synthetic peptide
QEMEIATTNPVATEQYGEAPEVCQHEEKK

SEQ ID NO: 150912 - protein, 29 aa, Artificial Sequence
  Description of Artificial Sequence: Synthetic peptide
NEEEIATTNPVAYEQWGEAYYVEQPEGHG

SEQ ID NO: 150913 - protein, 29 aa, Artificial Sequence
  Description of Artificial Sequence: Synthetic peptide
NEEEIATTNPVAYEQWGEAYYVEQPHNEG

SEQ ID NO: 150914 - protein, 36 aa, Artificial Sequence
  Description of Artificial Sequence: Synthetic polypeptide
DEEEIRTTNPVATEQYGSVSPVVVAALMEEGSMEED

SEQ ID NO: 150915 - protein, 32 aa, Artificial Sequence
  Description of Artificial Sequence: Synthetic polypeptide
DEVEIATTNPVAYEQYGSTVAANGDQNPQAAM

SEQ ID NO: 150916 - protein, 38 aa, Artificial Sequence
  Description of Artificial Sequence: Synthetic polypeptide
DEDEIRTTNPVATEQYGVVSTVTNQQLQLAGNEEGQDG

SEQ ID NO: 150917 - protein, 38 aa, Artificial Sequence
  Description of Artificial Sequence: Synthetic polypeptide
AEEEIRTTNPVATEQYGSVSTVLQNNTEQGTTNVATEQ

SEQ ID NO: 150918 - protein, 33 aa, Artificial Sequence
  Description of Artificial Sequence: Synthetic polypeptide
DEVEIATTNPVAYEQYGSVATHGQAVPGDSVDN

SEQ ID NO: 150919 - protein, 36 aa, Artificial Sequence
  Description of Artificial Sequence: Synthetic polypeptide
DEEEIRTTNPVATEQYGQCVCSNWGEWHQNFGSNQS

SEQ ID NO: 150920 - protein, 37 aa, Artificial Sequence
  Description of Artificial Sequence: Synthetic polypeptide
DEEEIRTTNPVATEQYGSVSPVENVGTQEENEVIEFY

SEQ ID NO: 150921 - protein, 36 aa, Artificial Sequence
  Description of Artificial Sequence: Synthetic polypeptide
DEEEIRTTNPVATEQYGQCVCSNWGETQNFGSNNQQ

SEQ ID NO: 150922 - protein, 36 aa, Artificial Sequence
  Description of Artificial Sequence: Synthetic polypeptide
DEEEIRTTNPVATEQYGQCVCSNWGELNQNFNSDQA

SEQ ID NO: 150923 - protein, 35 aa, Artificial Sequence
  Description of Artificial Sequence: Synthetic polypeptide
DEEEIRTTNPVATEQYGQCVCSNWGEHQSFGSDQM

SEQ ID NO: 150924 - protein, 38 aa, Artificial Sequence
  Description of Artificial Sequence: Synthetic polypeptide
AEEEIRTTNPVATEQYGSVVVVVTTNNLQQGNTNNETE

SEQ ID NO: 150925 - protein, 38 aa, Artificial Sequence
  Description of Artificial Sequence: Synthetic polypeptide
AEEEIRTTNPVATEQYGSVVVVVTTNNLQQGNNQETTE

SEQ ID NO: 150926 - protein, 33 aa, Artificial Sequence
  Description of Artificial Sequence: Synthetic polypeptide
QEMEIATTNPVATEQYGVVCAASDTLVEFEGND

SEQ ID NO: 150927 - protein, 36 aa, Artificial Sequence
  Description of Artificial Sequence: Synthetic polypeptide
DEEEIRTTNPVATEQYGSVQGVSQTLEINVFTETGG

SEQ ID NO: 150928 - protein, 38 aa, Artificial Sequence
  Description of Artificial Sequence: Synthetic polypeptide
AEEEIRTTNPVATEQYGSVVVVVTTNNLQQGEGGNQTE

SEQ ID NO: 150929 - protein, 35 aa, Artificial Sequence
  Description of Artificial Sequence: Synthetic polypeptide
DEEEIATTNPVAYEQWGVVCSNQNDGNQDRQGNEP

SEQ ID NO: 150930 - protein, 36 aa, Artificial Sequence
  Description of Artificial Sequence: Synthetic polypeptide
DEEEIRTTNPVATEQYGSVSPVMMEDVLTAPNMSMT

SEQ ID NO: 150931 - protein, 37 aa, Artificial Sequence
  Description of Artificial Sequence: Synthetic polypeptide
AEEEIRTTNPVATEQYGSVVVVVTTNNLQNNEGQDET

SEQ ID NO: 150932 - protein, 38 aa, Artificial Sequence
  Description of Artificial Sequence: Synthetic polypeptide
AEEEIRTTNPVATEQYGSVSTVVSNQQNQEGTTNNQTD

SEQ ID NO: 150933 - protein, 34 aa, Artificial Sequence
  Description of Artificial Sequence: Synthetic polypeptide
NEEEIATTNPVATEQYGVVPCWDNHGQDRQGGKS

SEQ ID NO: 150934 - protein, 37 aa, Artificial Sequence
  Description of Artificial Sequence: Synthetic polypeptide
AEEEIRTTNPVATEQYGSVVVVVTTNNDEQNGNNNDQ

SEQ ID NO: 150935 - protein, 32 aa, Artificial Sequence
  Description of Artificial Sequence: Synthetic polypeptide
SEEEIRCTNPIATEGYGCVCSWNHAHFGSNQA

SEQ ID NO: 150936 - protein, 33 aa, Artificial Sequence
  Description of Artificial Sequence: Synthetic polypeptide
QEMEIATTNPVATEQYGTVCSATDGPVQFEGED

SEQ ID NO: 150937 - protein, 31 aa, Artificial Sequence
  Description of Artificial Sequence: Synthetic polypeptide
QEMEIATTNPVATEQYGTVCSATDGPEHEEL

SEQ ID NO: 150938 - protein, 33 aa, Artificial Sequence
  Description of Artificial Sequence: Synthetic polypeptide
DEVEIATTNPVAYEQYGSVAATNNEQDATLTGD

SEQ ID NO: 150939 - protein, 35 aa, Artificial Sequence
  Description of Artificial Sequence: Synthetic polypeptide
DEEEIRTTNPVATEQYGSVSPGIAYPEDEMETNVT

SEQ ID NO: 150940 - protein, 28 aa, Artificial Sequence
  Description of Artificial Sequence: Synthetic peptide
DDSEVASVNPVSTEGYGNVANTIQRGNQ

SEQ ID NO: 150941 - protein, 33 aa, Artificial Sequence
  Description of Artificial Sequence: Synthetic polypeptide
DEMEIVTTNPVATEQYGQVCSAEDGPVEFEGND

SEQ ID NO: 150942 - protein, 35 aa, Artificial Sequence
  Description of Artificial Sequence: Synthetic polypeptide
DEEEISTTNPVATEQYGCVCSTESHFQENFNSEQA

SEQ ID NO: 150943 - protein, 39 aa, Artificial Sequence
  Description of Artificial Sequence: Synthetic polypeptide
DEEEIRTTNPVATEQYGVVSTVVSTNLQQAIGTTEQGQD

SEQ ID NO: 150944 - protein, 33 aa, Artificial Sequence
  Description of Artificial Sequence: Synthetic polypeptide
DDEEIASTNPVSTEQYGNVAANTINMRNGMNPR

SEQ ID NO: 150945 - protein, 35 aa, Artificial Sequence
  Description of Artificial Sequence: Synthetic polypeptide
DEEEIRTTNPVAYEQYGCVCSMTEHNQNFNSDNQA

SEQ ID NO: 150946 - protein, 35 aa, Artificial Sequence
  Description of Artificial Sequence: Synthetic polypeptide
DEEEISTTNPVATEQYGCVCSTGAHNQENFGSDQS

SEQ ID NO: 150947 - protein, 34 aa, Artificial Sequence
  Description of Artificial Sequence: Synthetic polypeptide
DEEEIRTTNPVAYEQYGCVCSMTEHAENFGSDQS

SEQ ID NO: 150948 - protein, 34 aa, Artificial Sequence
  Description of Artificial Sequence: Synthetic polypeptide
DEEEIRTTNPVAYEQYGCVCSDWEHQENFNSDQS

SEQ ID NO: 150949 - protein, 38 aa, Artificial Sequence
  Description of Artificial Sequence: Synthetic polypeptide
DEEEIRTTNPVATEQYGTSWVSSTTPAGPRMRNGMNPV

SEQ ID NO: 150950 - protein, 38 aa, Artificial Sequence
  Description of Artificial Sequence: Synthetic polypeptide
DEEEIRTTNPVATEQYGVVSTVVSTNNNAEAGNTEQGS

SEQ ID NO: 150951 - protein, 36 aa, Artificial Sequence
  Description of Artificial Sequence: Synthetic polypeptide
DEEEISTTNPVATEQYGCVCSTGEADQENFGSENQS

SEQ ID NO: 150952 - protein, 34 aa, Artificial Sequence
  Description of Artificial Sequence: Synthetic polypeptide
DEEEISTTNPVATEQYGCVCSTGEDANFNSNTQS

SEQ ID NO: 150953 - protein, 36 aa, Artificial Sequence
  Description of Artificial Sequence: Synthetic polypeptide
DEEEISTTNPVATEQYGCVCSTGEDHNQFFGSDNQS

SEQ ID NO: 150954 - protein, 37 aa, Artificial Sequence
  Description of Artificial Sequence: Synthetic polypeptide
DEEEIRTTNPVATEQYGTSVMFTTPAIPNMRNGMNPV

SEQ ID NO: 150955 - protein, 35 aa, Artificial Sequence
  Description of Artificial Sequence: Synthetic polypeptide
DEEEISTTNPVATEQYGCVCSTGEDNAENFNSDQA

SEQ ID NO: 150956 - protein, 35 aa, Artificial Sequence
  Description of Artificial Sequence: Synthetic polypeptide
DEEEISTTNPVATEQYGCVCSTGEDNQEFFGSDQA

SEQ ID NO: 150957 - protein, 35 aa, Artificial Sequence
  Description of Artificial Sequence: Synthetic polypeptide
DEEEISTTNPVATEQYGCVCSTGEDNQENFGSDQA

SEQ ID NO: 150958 - protein, 35 aa, Artificial Sequence
  Description of Artificial Sequence: Synthetic polypeptide
DEEEISTTNPVATEQYGCVCSTGEDQENFNSDNAL

SEQ ID NO: 150959 - protein, 33 aa, Artificial Sequence
  Description of Artificial Sequence: Synthetic polypeptide
DDEEIASTNPVSTEGYGSVSSTNPTINMRNGQV

SEQ ID NO: 150960 - protein, 33 aa, Artificial Sequence
  Description of Artificial Sequence: Synthetic polypeptide
DDEEIASTNPVSTEGYGSVSSTNPTGNMRNGQV

SEQ ID NO: 150961 - protein, 35 aa, Artificial Sequence
  Description of Artificial Sequence: Synthetic polypeptide
DEHEICTTNPVATECYGEVSTGNEGNQGGHGNTND

SEQ ID NO: 150962 - protein, 37 aa, Artificial Sequence
  Description of Artificial Sequence: Synthetic polypeptide
DEEEIRTTNPVATEQYGVVSTVVSNQQGNNQDEQGTT

SEQ ID NO: 150963 - protein, 35 aa, Artificial Sequence
  Description of Artificial Sequence: Synthetic polypeptide
DEEEISTTNPVATEQYGCVCSTEHNEENFGSDTQA

SEQ ID NO: 150964 - protein, 36 aa, Artificial Sequence
  Description of Artificial Sequence: Synthetic polypeptide
DEHEINTTNPVATEQYGQTVVSINELSQESNGGNQF

SEQ ID NO: 150965 - protein, 35 aa, Artificial Sequence
  Description of Artificial Sequence: Synthetic polypeptide
DEEEISTTNPVATEQYGCVCSTEHNQENFNSENQS

SEQ ID NO: 150966 - protein, 35 aa, Artificial Sequence
  Description of Artificial Sequence: Synthetic polypeptide
DEHEINTTNPVATEQYGKTVVSINELSFESNGGNQ

SEQ ID NO: 150967 - protein, 36 aa, Artificial Sequence
  Description of Artificial Sequence: Synthetic polypeptide
DEHEINTTNPVATEQYGETVVSINELSQEANGGTNQ

SEQ ID NO: 150968 - protein, 35 aa, Artificial Sequence
  Description of Artificial Sequence: Synthetic polypeptide
DEEEISTTNPVATEQYGCVCSTEHNTENFNSNTQS

SEQ ID NO: 150969 - protein, 34 aa, Artificial Sequence
  Description of Artificial Sequence: Synthetic polypeptide
DEEEIRTTNPVAYEQYGCVCSNWEHNQNFNSDQS

SEQ ID NO: 150970 - protein, 34 aa, Artificial Sequence
  Description of Artificial Sequence: Synthetic polypeptide
DEHEIKTTNPVAWEQWGSVSCWNISQIAGGNNSF

SEQ ID NO: 150971 - protein, 35 aa, Artificial Sequence
  Description of Artificial Sequence: Synthetic polypeptide
DEEEISTTNPVATEQYGCVCSTGEEHQENFGSDTQ

SEQ ID NO: 150972 - protein, 30 aa, Artificial Sequence
  Description of Artificial Sequence: Synthetic polypeptide
DEHEIITTNPVATEQWGDVSEIEMNAAEDA

SEQ ID NO: 150973 - protein, 36 aa, Artificial Sequence
  Description of Artificial Sequence: Synthetic polypeptide
DEEEIRTTNPVAYEQYGCVCSNTNEDHQEGFGSEQM

SEQ ID NO: 150974 - protein, 36 aa, Artificial Sequence
  Description of Artificial Sequence: Synthetic polypeptide
DEEEIRTTNPVAYEQYGCVCSNTENHEQENFGSDQS

SEQ ID NO: 150975 - protein, 35 aa, Artificial Sequence
  Description of Artificial Sequence: Synthetic polypeptide
DEEEIRTTNPVAYEQYGCVCSNTEEHQSFGSDTQS

SEQ ID NO: 150976 - protein, 35 aa, Artificial Sequence
  Description of Artificial Sequence: Synthetic polypeptide
DEEEIRTTNPVAYEQYGCVCSNTEEHQEHFGSDQT

SEQ ID NO: 150977 - protein, 35 aa, Artificial Sequence
  Description of Artificial Sequence: Synthetic polypeptide
DEEEIRTTNPVAYEQYGCVCSNTEEHNQNFGSEQF

SEQ ID NO: 150978 - protein, 33 aa, Artificial Sequence
  Description of Artificial Sequence: Synthetic polypeptide
DDEEIASTNPVSTEGYGNVSSTNPTIQMRNGQV

SEQ ID NO: 150979 - protein, 35 aa, Artificial Sequence
  Description of Artificial Sequence: Synthetic polypeptide
DEEEIRTTNPVAYEQYGCVCSNTEEHEQAFNSDQS

SEQ ID NO: 150980 - protein, 36 aa, Artificial Sequence
  Description of Artificial Sequence: Synthetic polypeptide
DEEEIRTTNPVAYEQYGCVCSNSNEHNQNFGSENQS

SEQ ID NO: 150981 - protein, 33 aa, Artificial Sequence
  Description of Artificial Sequence: Synthetic polypeptide
DEHEICTVNPVAYEQYGKVSTTELSTEFVGNNH

SEQ ID NO: 150982 - protein, 35 aa, Artificial Sequence
  Description of Artificial Sequence: Synthetic polypeptide
DEEEISTTNPVATEQYGCVCSTEHNAENFNSDTQS

SEQ ID NO: 150983 - protein, 34 aa, Artificial Sequence
  Description of Artificial Sequence: Synthetic polypeptide
DEEEISTTNPVATEQYGCVCSTGEHAENFNSDQS

SEQ ID NO: 150984 - protein, 32 aa, Artificial Sequence
  Description of Artificial Sequence: Synthetic polypeptide
DDEEIASTNPVSTEQYGNVAANTINMRNGMQR

SEQ ID NO: 150985 - protein, 38 aa, Artificial Sequence
  Description of Artificial Sequence: Synthetic polypeptide
DEEEIRTTNPVATEQYGVVSTVVSTNQAGNQQGTEQGQ

SEQ ID NO: 150986 - protein, 34 aa, Artificial Sequence
  Description of Artificial Sequence: Synthetic polypeptide
DEMEIVTTNPVATEQYGTVCSTTDAPVEFEGNPD

SEQ ID NO: 150987 - protein, 34 aa, Artificial Sequence
  Description of Artificial Sequence: Synthetic polypeptide
DEMEIVTTNPVATEQYGTVCSTTDGGVEFEGMNV

SEQ ID NO: 150988 - protein, 33 aa, Artificial Sequence
  Description of Artificial Sequence: Synthetic polypeptide
DEEEIRTTNPVAYEQYGCVCGSELNQYFDSDQS

SEQ ID NO: 150989 - protein, 35 aa, Artificial Sequence
  Description of Artificial Sequence: Synthetic polypeptide
DEMEIVTTNPVATEQYGTVCSTTEEPNEFFGSNDQ

SEQ ID NO: 150990 - protein, 35 aa, Artificial Sequence
  Description of Artificial Sequence: Synthetic polypeptide
DEEEISTTNPVATEQYGCVCSTGELTESFNSDTQY

SEQ ID NO: 150991 - protein, 34 aa, Artificial Sequence
  Description of Artificial Sequence: Synthetic polypeptide
DDEEIASTNPVSTEQYGNVSSTNAGPNMRVGNPV

SEQ ID NO: 150992 - protein, 39 aa, Artificial Sequence
  Description of Artificial Sequence: Synthetic polypeptide
DEEEIRTTNPVATEQYGVVSTVVSTNQQQLGNNDEEQED

SEQ ID NO: 150993 - protein, 34 aa, Artificial Sequence
  Description of Artificial Sequence: Synthetic polypeptide
DEMEIVTTNPVATEQYGTVCSTTGEPDEFEGNDS

SEQ ID NO: 150994 - protein, 37 aa, Artificial Sequence
  Description of Artificial Sequence: Synthetic polypeptide
DEEEIRTTNPVATEQYGVVSTVVSTQQAGNNEEEDEL

SEQ ID NO: 150995 - protein, 35 aa, Artificial Sequence
  Description of Artificial Sequence: Synthetic polypeptide
DEEEISTTNPVATEQYGCVCSTGETQENFNSDTQS

SEQ ID NO: 150996 - protein, 36 aa, Artificial Sequence
  Description of Artificial Sequence: Synthetic polypeptide
DEEEISTTNPVATEQYGCVCSTGNDDNQENFGSDQS

SEQ ID NO: 150997 - protein, 36 aa, Artificial Sequence
  Description of Artificial Sequence: Synthetic polypeptide
DEEEISTTNPVATEQYGCVCSTGNDHEQNFGSDTQD

SEQ ID NO: 150998 - protein, 34 aa, Artificial Sequence
  Description of Artificial Sequence: Synthetic polypeptide
DDEEIASTNPVSTEQYGNVSSTNTGPNMRVGNPV

SEQ ID NO: 150999 - protein, 36 aa, Artificial Sequence
  Description of Artificial Sequence: Synthetic polypeptide
DEEEISTTNPVATEQYGCVCSTGNDHFQENFGSEFA

SEQ ID NO: 151000 - protein, 34 aa, Artificial Sequence
  Description of Artificial Sequence: Synthetic polypeptide
DDEEIASTNPVSTEQYGNVSSTNTGPNSRVGNPV

SEQ ID NO: 151001 - protein, 34 aa, Artificial Sequence
  Description of Artificial Sequence: Synthetic polypeptide
DEMEIVTTNPVATEQYGTVCSTTGEPNAFFGSED

SEQ ID NO: 151002 - protein, 34 aa, Artificial Sequence
  Description of Artificial Sequence: Synthetic polypeptide
DEMEIVTTNPVATEQYGTVCSTTDAGVEFEGMNV

SEQ ID NO: 151003 - protein, 35 aa, Artificial Sequence
  Description of Artificial Sequence: Synthetic polypeptide
DEEEISTTNPVATEQYGCVCSTGELNENFGSDTQS

SEQ ID NO: 151004 - protein, 35 aa, Artificial Sequence
  Description of Artificial Sequence: Synthetic polypeptide
DEEEISTTNPVATEQYGCVCSTGELNAENFNSDQP

SEQ ID NO: 151005 - protein, 35 aa, Artificial Sequence
  Description of Artificial Sequence: Synthetic polypeptide
DEEEISTTNPVATEQYGCVCSTGELNAENFGSEQA

SEQ ID NO: 151006 - protein, 37 aa, Artificial Sequence
  Description of Artificial Sequence: Synthetic polypeptide
DEEEIRTTNPVATEQYGTSPSSTTPAGPNMRNGMNPV

SEQ ID NO: 151007 - protein, 34 aa, Artificial Sequence
  Description of Artificial Sequence: Synthetic polypeptide
DEEEISTTNPVATEQYGCVCSTGEHNEHFNSQQN

SEQ ID NO: 151008 - protein, 35 aa, Artificial Sequence
  Description of Artificial Sequence: Synthetic polypeptide
DEEEISTTNPVATEQYGCVCSTGEHNIENFGSDQS

SEQ ID NO: 151009 - protein, 36 aa, Artificial Sequence
  Description of Artificial Sequence: Synthetic polypeptide
DEEEISTTNPVATEQYGCVCSTGEHNQEGFGSDNQV

SEQ ID NO: 151010 - protein, 35 aa, Artificial Sequence
  Description of Artificial Sequence: Synthetic polypeptide
DEEEISTTNPVATEQYGCVCSTGEHNQEGFISDQS

SEQ ID NO: 151011 - protein, 38 aa, Artificial Sequence
  Description of Artificial Sequence: Synthetic polypeptide
DEEEIRTTNPVATEQYGVVSTVVSTNNTNQQQATNNEE

SEQ ID NO: 151012 - protein, 36 aa, Artificial Sequence
  Description of Artificial Sequence: Synthetic polypeptide
DEEEISTTNPVATEQYGCVCSTGEHNQENFGSQNQT

SEQ ID NO: 151013 - protein, 36 aa, Artificial Sequence
  Description of Artificial Sequence: Synthetic polypeptide
DEAEIATTNPVAYEQYGSVCMSNNLPQDHGGDNEAE

SEQ ID NO: 151014 - protein, 34 aa, Artificial Sequence
  Description of Artificial Sequence: Synthetic polypeptide
DEEEISTTNPVATEQYGCVCSTGEHDQFFFSDQI

SEQ ID NO: 151015 - protein, 36 aa, Artificial Sequence
  Description of Artificial Sequence: Synthetic polypeptide
DEEEISTTNPVATEQYGCVCSTGEHNQEYFGSDNQS

SEQ ID NO: 151016 - protein, 35 aa, Artificial Sequence
  Description of Artificial Sequence: Synthetic polypeptide
DEEEISTTNPVATEQYGCVCSTGEHNQFFISNNQT

SEQ ID NO: 151017 - protein, 35 aa, Artificial Sequence
  Description of Artificial Sequence: Synthetic polypeptide
DEEEISTTNPVATEQYGCVCSTGEHNQNFISDNQS

SEQ ID NO: 151018 - protein, 35 aa, Artificial Sequence
  Description of Artificial Sequence: Synthetic polypeptide
DEEEISTTNPVATEQYGCVCSTGEHNQNFNSDTQA

SEQ ID NO: 151019 - protein, 35 aa, Artificial Sequence
  Description of Artificial Sequence: Synthetic polypeptide
DEEEISTTNPVATEQYGCVCSTGEHNQYSNSDNQS

SEQ ID NO: 151020 - protein, 34 aa, Artificial Sequence
  Description of Artificial Sequence: Synthetic polypeptide
DEEEISTTNPVATEQYGCVCSTGEHQSFISDTQQ

SEQ ID NO: 151021 - protein, 34 aa, Artificial Sequence
  Description of Artificial Sequence: Synthetic polypeptide
DEEEIRTTNPVAYEQYGCVCQNTNDNQNFDSDQS

SEQ ID NO: 151022 - protein, 34 aa, Artificial Sequence
  Description of Artificial Sequence: Synthetic polypeptide
DEEEIRTTNPVAYEQYGCVCGWGNLQYFDSDTQS

SEQ ID NO: 151023 - protein, 36 aa, Artificial Sequence
  Description of Artificial Sequence: Synthetic polypeptide
DEEEISTTNPVATEQYGCVCSTGELHFQENFGSEQA

SEQ ID NO: 151024 - protein, 35 aa, Artificial Sequence
  Description of Artificial Sequence: Synthetic polypeptide
DEEEISTTNPVATEQYGCVCSTGEHNQEYFNSQQG

SEQ ID NO: 151025 - protein, 36 aa, Artificial Sequence
  Description of Artificial Sequence: Synthetic polypeptide
DEEEISTTNPVATEQYGCVCSTGNHNQENFNSDTQS

SEQ ID NO: 151026 - protein, 34 aa, Artificial Sequence
  Description of Artificial Sequence: Synthetic polypeptide
DEHEINTTNPVATESWGSVSCGNISQTTGGNNPF

SEQ ID NO: 151027 - protein, 34 aa, Artificial Sequence
  Description of Artificial Sequence: Synthetic polypeptide
DEEEISTTNPVATEQYGCVCSTEHDQEFFFSDQS

SEQ ID NO: 151028 - protein, 34 aa, Artificial Sequence
  Description of Artificial Sequence: Synthetic polypeptide
DEMEIVTTNPVATEQYGTVCSDTMEPVEFFGSND

SEQ ID NO: 151029 - protein, 33 aa, Artificial Sequence
  Description of Artificial Sequence: Synthetic polypeptide
DEMEIVTTNPVATEQYGTVCSDWDGPVEFEGND

SEQ ID NO: 151030 - protein, 33 aa, Artificial Sequence
  Description of Artificial Sequence: Synthetic polypeptide
DEMEIVTTNPVATEQYGTVCSFRAGPVEFEGND

SEQ ID NO: 151031 - protein, 34 aa, Artificial Sequence
  Description of Artificial Sequence: Synthetic polypeptide
DEMEIVTTNPVATEQYGTVCSITDGPVEFEGAND

SEQ ID NO: 151032 - protein, 34 aa, Artificial Sequence
  Description of Artificial Sequence: Synthetic polypeptide
DEMEIVTTNPVATEQYGTVCSMTDGPVEAEGVNS

SEQ ID NO: 151033 - protein, 34 aa, Artificial Sequence
  Description of Artificial Sequence: Synthetic polypeptide
DEMEIVTTNPVATEQYGTVCSMTDGPVEFEGNDK

SEQ ID NO: 151034 - protein, 33 aa, Artificial Sequence
  Description of Artificial Sequence: Synthetic polypeptide
DEMEIVTTNPVATEQYGTVCSNADGPVEFEGNI

SEQ ID NO: 151035 - protein, 34 aa, Artificial Sequence
  Description of Artificial Sequence: Synthetic polypeptide
DEMEIVTTNPVATEQYGTVCSNTDGKPVEFEGND

SEQ ID NO: 151036 - protein, 35 aa, Artificial Sequence
  Description of Artificial Sequence: Synthetic polypeptide
DEMEIVTTNPVATEQYGTVCSNTGEPNANFGSNDA

SEQ ID NO: 151037 - protein, 35 aa, Artificial Sequence
  Description of Artificial Sequence: Synthetic polypeptide
DEEEISTTNPVATEQYGCVCSSGEDQENFGSDNQA

SEQ ID NO: 151038 - protein, 35 aa, Artificial Sequence
  Description of Artificial Sequence: Synthetic polypeptide
DEMEIVTTNPVATEQYGTVCSNTGEPNIFEGSNQS

SEQ ID NO: 151039 - protein, 35 aa, Artificial Sequence
  Description of Artificial Sequence: Synthetic polypeptide
DEEEISTTNPVATEQYGCVCSSGEHNQGFGSENQS

SEQ ID NO: 151040 - protein, 34 aa, Artificial Sequence
  Description of Artificial Sequence: Synthetic polypeptide
DEMEIVTTNPVATEQYGTVCSNTMEPVEFFGNDA

SEQ ID NO: 151041 - protein, 34 aa, Artificial Sequence
  Description of Artificial Sequence: Synthetic polypeptide
DEMEIVTTNPVATEQYGTVCSNTPEPDEFEGNDA

SEQ ID NO: 151042 - protein, 34 aa, Artificial Sequence
  Description of Artificial Sequence: Synthetic polypeptide
DEEEISTTNPVATEQYGCVCSSGEHNQNFGSQQS

SEQ ID NO: 151043 - protein, 34 aa, Artificial Sequence
  Description of Artificial Sequence: Synthetic polypeptide
DEEEISTTNPVATEQYGCVCSSGEHQGFISDNQS

SEQ ID NO: 151044 - protein, 34 aa, Artificial Sequence
  Description of Artificial Sequence: Synthetic polypeptide
DEEEISTTNPVATEQYGCVCSSGEHQHFGSQTQA

SEQ ID NO: 151045 - protein, 33 aa, Artificial Sequence
  Description of Artificial Sequence: Synthetic polypeptide
DEMEIVTTNPVATEQYGTVCSDTDGPVEFEGYD

SEQ ID NO: 151046 - protein, 33 aa, Artificial Sequence
  Description of Artificial Sequence: Synthetic polypeptide
DEMEIVTTNPVATEQYGTVCSDTDGPVEFEAND

SEQ ID NO: 151047 - protein, 33 aa, Artificial Sequence
  Description of Artificial Sequence: Synthetic polypeptide
DEMEIVTTNPVATEQYGTVCSAYDGPVEFEGND

SEQ ID NO: 151048 - protein, 33 aa, Artificial Sequence
  Description of Artificial Sequence: Synthetic polypeptide
DEMEIVTTNPVATEQYGTVCSAWGGPKEFEGND

SEQ ID NO: 151049 - protein, 34 aa, Artificial Sequence
  Description of Artificial Sequence: Synthetic polypeptide
DEEEISTTNPVATEQYGCVCSSEEHNANFGSDQA

SEQ ID NO: 151050 - protein, 35 aa, Artificial Sequence
  Description of Artificial Sequence: Synthetic polypeptide
DEEEISTTNPVATEQYGCVCSSEEHNQNFGSQNQS

SEQ ID NO: 151051 - protein, 35 aa, Artificial Sequence
  Description of Artificial Sequence: Synthetic polypeptide
DEEEISTTNPVATEQYGCVCSSEELNQENFGSDQS

SEQ ID NO: 151052 - protein, 35 aa, Artificial Sequence
  Description of Artificial Sequence: Synthetic polypeptide
DEEEISTTNPVATEQYGCVCSSEHNIEFFGSDNQS

SEQ ID NO: 151053 - protein, 35 aa, Artificial Sequence
  Description of Artificial Sequence: Synthetic polypeptide
DEEEISTTNPVATEQYGCVCSSEHNQENFGSDNQA

SEQ ID NO: 151054 - protein, 34 aa, Artificial Sequence
  Description of Artificial Sequence: Synthetic polypeptide
DEEEISTTNPVATEQYGCVCSSEHNQENFGSQQA

SEQ ID NO: 151055 - protein, 33 aa, Artificial Sequence
  Description of Artificial Sequence: Synthetic polypeptide
DEEEISTTNPVATEQYGCVCSSEHNQNFISQQS

SEQ ID NO: 151056 - protein, 34 aa, Artificial Sequence
  Description of Artificial Sequence: Synthetic polypeptide
DEEEISTTNPVATEQYGCVCSSEHQESFGSDTQA

SEQ ID NO: 151057 - protein, 35 aa, Artificial Sequence
  Description of Artificial Sequence: Synthetic polypeptide
DEEEISTTNPVATEQYGCVCSSGELFQENFGSDQS

SEQ ID NO: 151058 - protein, 34 aa, Artificial Sequence
  Description of Artificial Sequence: Synthetic polypeptide
DEMEIVTTNPVATEQYGTVCSATQGPVEFEGNDN

SEQ ID NO: 151059 - protein, 34 aa, Artificial Sequence
  Description of Artificial Sequence: Synthetic polypeptide
DEMEIVTTNPVATEQYGTVCSATRGPVEFEGCND

SEQ ID NO: 151060 - protein, 33 aa, Artificial Sequence
  Description of Artificial Sequence: Synthetic polypeptide
DEMEIVTTNPVATEQYGTVCSATSGPVEFEVND

SEQ ID NO: 151061 - protein, 34 aa, Artificial Sequence
  Description of Artificial Sequence: Synthetic polypeptide
DEMEIVTTNPVATEQYGTVCSATSGPVEVEGNND

SEQ ID NO: 151062 - protein, 34 aa, Artificial Sequence
  Description of Artificial Sequence: Synthetic polypeptide
DEHEIRTTNPCATECYGCVATTNGNDPREGGNTS

SEQ ID NO: 151063 - protein, 33 aa, Artificial Sequence
  Description of Artificial Sequence: Synthetic polypeptide
DEMEIVTTNPVATEQYGTVCSATYGPVEFEGQD

SEQ ID NO: 151064 - protein, 33 aa, Artificial Sequence
  Description of Artificial Sequence: Synthetic polypeptide
DEMEIVTTNPVATEQYGTVCSAVDGPVEFEGND

SEQ ID NO: 151065 - protein, 33 aa, Artificial Sequence
  Description of Artificial Sequence: Synthetic polypeptide
DEMEIVTTNPVATEQYGTVCSAVDGPVESEGND

SEQ ID NO: 151066 - protein, 33 aa, Artificial Sequence
  Description of Artificial Sequence: Synthetic polypeptide
DEMEIVTTNPVATEQYGTVCSAWDGPVEFEGND

SEQ ID NO: 151067 - protein, 34 aa, Artificial Sequence
  Description of Artificial Sequence: Synthetic polypeptide
DEMEIVTTNPVATEQYGTVCSATQGPVEFEGRND

SEQ ID NO: 151068 - protein, 34 aa, Artificial Sequence
  Description of Artificial Sequence: Synthetic polypeptide
DEEEISTTNPVATEQYGCVCSTEHDQGFISETQS

SEQ ID NO: 151069 - protein, 33 aa, Artificial Sequence
  Description of Artificial Sequence: Synthetic polypeptide
DEMEIVTTNPVATEQYGTVCSNWGEPVEFFGNQ

SEQ ID NO: 151070 - protein, 34 aa, Artificial Sequence
  Description of Artificial Sequence: Synthetic polypeptide
DEMEIVTTNPVATEQYGTVCSPTDGPVEFEGNND

SEQ ID NO: 151071 - protein, 35 aa, Artificial Sequence
  Description of Artificial Sequence: Synthetic polypeptide
DEEEISTTNPVATEQYGCVCSTEEDHNQSFGSDQA

SEQ ID NO: 151072 - protein, 35 aa, Artificial Sequence
  Description of Artificial Sequence: Synthetic polypeptide
DEEEISTTNPVATEQYGCVCSTEEDHNQYFNSDQD

SEQ ID NO: 151073 - protein, 36 aa, Artificial Sequence
  Description of Artificial Sequence: Synthetic polypeptide
DEEEISTTNPVATEQYGCVCSTEEDNQEGFNSDNQD

SEQ ID NO: 151074 - protein, 35 aa, Artificial Sequence
  Description of Artificial Sequence: Synthetic polypeptide
DEEEISTTNPVATEQYGCVCSTEEDNTENFGSEQV

SEQ ID NO: 151075 - protein, 34 aa, Artificial Sequence
  Description of Artificial Sequence: Synthetic polypeptide
DEEEISTTNPVATEQYGCVCSTEEHINFGSDPAS

SEQ ID NO: 151076 - protein, 35 aa, Artificial Sequence
  Description of Artificial Sequence: Synthetic polypeptide
DEEEISTTNPVATEQYGCVCSTEEHNAYFNSDNQD

SEQ ID NO: 151077 - protein, 36 aa, Artificial Sequence
  Description of Artificial Sequence: Synthetic polypeptide
DEEEISTTNPVATEQYGCVCSTEEHNQESFGSDNQA

SEQ ID NO: 151078 - protein, 35 aa, Artificial Sequence
  Description of Artificial Sequence: Synthetic polypeptide
DEEEISTTNPVATEQYGCVCSTEEHNQESSNSDQF

SEQ ID NO: 151079 - protein, 36 aa, Artificial Sequence
  Description of Artificial Sequence: Synthetic polypeptide
DEEEISTTNPVATEQYGCVCSTEEHNQEYFGSDNQQ

SEQ ID NO: 151080 - protein, 34 aa, Artificial Sequence
  Description of Artificial Sequence: Synthetic polypeptide
DEEEIRTTNPVAYEQYGCVCSNWGEHQSFGSDQS

SEQ ID NO: 151081 - protein, 35 aa, Artificial Sequence
  Description of Artificial Sequence: Synthetic polypeptide
DEEEISTTNPVATEQYGCVCSTEELNANFNSDTQS

SEQ ID NO: 151082 - protein, 38 aa, Artificial Sequence
  Description of Artificial Sequence: Synthetic polypeptide
DEEEIRTTNPVATEQYGVVSTVVSNNQAGNQNGNEEDE

SEQ ID NO: 151083 - protein, 35 aa, Artificial Sequence
  Description of Artificial Sequence: Synthetic polypeptide
DEEEISTTNPVATEQYGCVCSTEEPHNQNFGSEQL

SEQ ID NO: 151084 - protein, 32 aa, Artificial Sequence
  Description of Artificial Sequence: Synthetic polypeptide
DDEEIASTNPVSTEGYGNVAANTIQMRNGMQR

SEQ ID NO: 151085 - protein, 36 aa, Artificial Sequence
  Description of Artificial Sequence: Synthetic polypeptide
DEEEISTTNPVATEQYGCVCSTEESLNQENFGSEFA

SEQ ID NO: 151086 - protein, 35 aa, Artificial Sequence
  Description of Artificial Sequence: Synthetic polypeptide
DEEEISTTNPVATEQYGCVCSTEETNQESFNSDQD

SEQ ID NO: 151087 - protein, 38 aa, Artificial Sequence
  Description of Artificial Sequence: Synthetic polypeptide
DEEEIRTTNPVATEQYGVVSTVVSNNQQLGNQDEEDED

SEQ ID NO: 151088 - protein, 35 aa, Artificial Sequence
  Description of Artificial Sequence: Synthetic polypeptide
DEEEISTTNPVATEQYGCVCSTEDPNQENFNSQQS

SEQ ID NO: 151089 - protein, 34 aa, Artificial Sequence
  Description of Artificial Sequence: Synthetic polypeptide
DEEEIRTTNPVAYEQYGCVCSSGEHQNFGSETQS

SEQ ID NO: 151090 - protein, 33 aa, Artificial Sequence
  Description of Artificial Sequence: Synthetic polypeptide
DEEEIRTTNPVAYEQYGCVCSSGEHQNFISDQS

SEQ ID NO: 151091 - protein, 36 aa, Artificial Sequence
  Description of Artificial Sequence: Synthetic polypeptide
DEEEISTTNPVATEQYGCVCSTEDLNQENFNSETQA

SEQ ID NO: 151092 - protein, 33 aa, Artificial Sequence
  Description of Artificial Sequence: Synthetic polypeptide
DEMEIVTTNPVATEQYGTVCSPTDGPVEFEIND

SEQ ID NO: 151093 - protein, 34 aa, Artificial Sequence
  Description of Artificial Sequence: Synthetic polypeptide
DEEEISTTNPVATEQYGCVCSSGPDQENFNSDQA

SEQ ID NO: 151094 - protein, 34 aa, Artificial Sequence
  Description of Artificial Sequence: Synthetic polypeptide
DEMEIVTTNPVATEQYGTVCSPTDGPVEYFEGND

SEQ ID NO: 151095 - protein, 34 aa, Artificial Sequence
  Description of Artificial Sequence: Synthetic polypeptide
DEEEISTTNPVATEQYGCVCSSMEHNQNFNSNQS

SEQ ID NO: 151096 - protein, 35 aa, Artificial Sequence
  Description of Artificial Sequence: Synthetic polypeptide
DEEEIRTTNPVAYEQYGCVCSTGEHQEGFGSDTQS

SEQ ID NO: 151097 - protein, 34 aa, Artificial Sequence
  Description of Artificial Sequence: Synthetic polypeptide
DEMEIVTTNPVATEQYGTVCSRTDGPVEFEGHND

SEQ ID NO: 151098 - protein, 29 aa, Artificial Sequence
  Description of Artificial Sequence: Synthetic peptide
DDSEVACTNPVSTEGYGEVANTIQSRGQR

SEQ ID NO: 151099 - protein, 36 aa, Artificial Sequence
  Description of Artificial Sequence: Synthetic polypeptide
DEEEIRTTNPVAYEQYGCVCSTGEHDQENFGSDNQS

SEQ ID NO: 151100 - protein, 35 aa, Artificial Sequence
  Description of Artificial Sequence: Synthetic polypeptide
DEEEISTTNPVATEQYGCVCSSGELNQNFNSQNQS

SEQ ID NO: 151101 - protein, 34 aa, Artificial Sequence
  Description of Artificial Sequence: Synthetic polypeptide
DEMEIVTTNPVATEQYGTVCSRTDGPVETFEGND

SEQ ID NO: 151102 - protein, 34 aa, Artificial Sequence
  Description of Artificial Sequence: Synthetic polypeptide
DEEEISTTNPVATEQYGCVCSTEAHQENFMSQQA

SEQ ID NO: 151103 - protein, 35 aa, Artificial Sequence
  Description of Artificial Sequence: Synthetic polypeptide
DEEEIRTTNPVAYEQYGCVCSTEEHNQENFGSQQS

SEQ ID NO: 151104 - protein, 34 aa, Artificial Sequence
  Description of Artificial Sequence: Synthetic polypeptide
DEEEISTTNPVATEQYGCVCSTEDHAEHFGSEQA

SEQ ID NO: 151105 - protein, 36 aa, Artificial Sequence
  Description of Artificial Sequence: Synthetic polypeptide
DEEEISTTNPVATEQYGCVCSTEDHFQENFGSENFS

SEQ ID NO: 151106 - protein, 35 aa, Artificial Sequence
  Description of Artificial Sequence: Synthetic polypeptide
DEEEISTTNPVATEQYGCVCSTEDHNQENFGSDQS

SEQ ID NO: 151107 - protein, 35 aa, Artificial Sequence
  Description of Artificial Sequence: Synthetic polypeptide
DEEEISTTNPVATEQYGCVCSTEDHNQSFNSDNQE

SEQ ID NO: 151108 - protein, 35 aa, Artificial Sequence
  Description of Artificial Sequence: Synthetic polypeptide
DEEEIRTTNPVAYEQYGCVCSTEEDHEQAFGSEQS

SEQ ID NO: 151109 - protein, 36 aa, Artificial Sequence
  Description of Artificial Sequence: Synthetic polypeptide
DEEEISTTNPVATEQYGCVCSTEDLNQENFISENQS

SEQ ID NO: 151110 - protein, 35 aa, Artificial Sequence
  Description of Artificial Sequence: Synthetic polypeptide
DEEEIRTTNPVAYEQYGCVCSTGEDHQEGFGSDQG

SEQ ID NO: 151111 - protein, 34 aa, Artificial Sequence
  Description of Artificial Sequence: Synthetic polypeptide
DEEEISTTNPVATEQYGCVCSSEEDQEFFGSQQA

SEQ ID NO: 151112 - protein, 35 aa, Artificial Sequence
  Description of Artificial Sequence: Synthetic polypeptide
DEEEIRTTNPVAYEQYGCTVQACTDLSTKLSGVPR

SEQ ID NO: 151113 - protein, 35 aa, Artificial Sequence
  Description of Artificial Sequence: Synthetic polypeptide
DEMEIVTTNPVATEQYGTVCSTTGEPNEFFGSNAS

SEQ ID NO: 151114 - protein, 34 aa, Artificial Sequence
  Description of Artificial Sequence: Synthetic polypeptide
DEMEIVTTNPVATEQYGVTVCSATDGPVVFEGND

SEQ ID NO: 151115 - protein, 34 aa, Artificial Sequence
  Description of Artificial Sequence: Synthetic polypeptide
DEMEIVTTNPVATEQYGVTVCSATDGVVEFEGND

SEQ ID NO: 151116 - protein, 35 aa, Artificial Sequence
  Description of Artificial Sequence: Synthetic polypeptide
DEEEISTTNPVATEQYGCVCSTWGEHNQHFNSDQA

SEQ ID NO: 151117 - protein, 38 aa, Artificial Sequence
  Description of Artificial Sequence: Synthetic polypeptide
DEEEIRTTNPVATEQYGVVSTVVSTTQQAGNQQGEEDE

SEQ ID NO: 151118 - protein, 36 aa, Artificial Sequence
  Description of Artificial Sequence: Synthetic polypeptide
DEEEISTTNPVATEQYGCVCSTYDHNQENFGSENQS

SEQ ID NO: 151119 - protein, 33 aa, Artificial Sequence
  Description of Artificial Sequence: Synthetic polypeptide
DEMEIVTTNPVATEQYGVVCAATDGPVEFEGND

SEQ ID NO: 151120 - protein, 36 aa, Artificial Sequence
  Description of Artificial Sequence: Synthetic polypeptide
DEEEIRTTNPVAYEQWGSVSGGLPAEGNMRNGMGDV

SEQ ID NO: 151121 - protein, 36 aa, Artificial Sequence
  Description of Artificial Sequence: Synthetic polypeptide
DEEEIRTTNPVAYEQWGSVSGGEQQGGNQRNGMNSY

SEQ ID NO: 151122 - protein, 32 aa, Artificial Sequence
  Description of Artificial Sequence: Synthetic polypeptide
DEMEIVTTNPVATEQYGVVCAATDGPVEHGDD

SEQ ID NO: 151123 - protein, 36 aa, Artificial Sequence
  Description of Artificial Sequence: Synthetic polypeptide
DEEEIRTTNPVAYEQWGSVSGGEQGGGNMRNGMNSH

SEQ ID NO: 151124 - protein, 36 aa, Artificial Sequence
  Description of Artificial Sequence: Synthetic polypeptide
DEEEIRTTNPVAYEQWGSVSGGEPTGPNMQNGGGPM

SEQ ID NO: 151125 - protein, 33 aa, Artificial Sequence
  Description of Artificial Sequence: Synthetic polypeptide
DEEEISTTNPVATEQYGCVCSWEDAENFNSEQS

SEQ ID NO: 151126 - protein, 34 aa, Artificial Sequence
  Description of Artificial Sequence: Synthetic polypeptide
DEMEIVTTNPVATEQYGWTVCSATDGPVEFEGND

SEQ ID NO: 151127 - protein, 34 aa, Artificial Sequence
  Description of Artificial Sequence: Synthetic polypeptide
DEMEIVTTNPVATEQYGWVCSATDGTPVEFEGND

SEQ ID NO: 151128 - protein, 35 aa, Artificial Sequence
  Description of Artificial Sequence: Synthetic polypeptide
DEEEISTTNPVATEQYGCVCSWEDHNQNFGSDNQS

SEQ ID NO: 151129 - protein, 34 aa, Artificial Sequence
  Description of Artificial Sequence: Synthetic polypeptide
DEEEISTTNPVATEQYGCVCSWEDHNQNFGSDQS

SEQ ID NO: 151130 - protein, 34 aa, Artificial Sequence
  Description of Artificial Sequence: Synthetic polypeptide
DEMEIVTTNPVATEQYGYTVCSATDGPVEFEGND

SEQ ID NO: 151131 - protein, 34 aa, Artificial Sequence
  Description of Artificial Sequence: Synthetic polypeptide
DEHEIATTNPVAYEQWGSVSTTGPAQGLTGNDGS

SEQ ID NO: 151132 - protein, 34 aa, Artificial Sequence
  Description of Artificial Sequence: Synthetic polypeptide
DEMEIVTTNPVATEQYGVTVCSATDGPVEFEGND

SEQ ID NO: 151133 - protein, 36 aa, Artificial Sequence
  Description of Artificial Sequence: Synthetic polypeptide
DEEEISTTNPVATEQYGCVCSTWGEDQENFGSENQS

SEQ ID NO: 151134 - protein, 34 aa, Artificial Sequence
  Description of Artificial Sequence: Synthetic polypeptide
DEHEIATTNPVAYEQWGSVSTTGPTQGLMGNDGQ

SEQ ID NO: 151135 - protein, 33 aa, Artificial Sequence
  Description of Artificial Sequence: Synthetic polypeptide
DEMEIVTTNPVATEQYGTVWSASDGPVEFEGND

SEQ ID NO: 151136 - protein, 34 aa, Artificial Sequence
  Description of Artificial Sequence: Synthetic polypeptide
DEMEIVTTNPVATEQYGTVWSATDGPVEFEGNDD

SEQ ID NO: 151137 - protein, 33 aa, Artificial Sequence
  Description of Artificial Sequence: Synthetic polypeptide
DEMEIVTTNPVATEQYGTVWSNADGPVAFEGNI

SEQ ID NO: 151138 - protein, 33 aa, Artificial Sequence
  Description of Artificial Sequence: Synthetic polypeptide
DEMEIVTTNPVATEQYGTVWSNADGPVEFEGNI

SEQ ID NO: 151139 - protein, 32 aa, Artificial Sequence
  Description of Artificial Sequence: Synthetic polypeptide
DENEIRTTNPVSTEPYGTISQEDIQQQQNGNH

SEQ ID NO: 151140 - protein, 33 aa, Artificial Sequence
  Description of Artificial Sequence: Synthetic polypeptide
DEMEIVTTNPVATEQYGTYCSATDGPVEFEGND

SEQ ID NO: 151141 - protein, 33 aa, Artificial Sequence
  Description of Artificial Sequence: Synthetic polypeptide
DEMEIVTTNPVATEQYGTYCSATDGPVEFEGNT

SEQ ID NO: 151142 - protein, 34 aa, Artificial Sequence
  Description of Artificial Sequence: Synthetic polypeptide
DEMEIVTTNPVATEQYGTYVCSATDGPVEFEGND

SEQ ID NO: 151143 - protein, 34 aa, Artificial Sequence
  Description of Artificial Sequence: Synthetic polypeptide
DEMEIVTTNPVATEQYGYTVCSATDGPVEFEGNL

SEQ ID NO: 151144 - protein, 33 aa, Artificial Sequence
  Description of Artificial Sequence: Synthetic polypeptide
DEHEIATTNPVAYEQWGSVTGNNGNQGAGNGQD

SEQ ID NO: 151145 - protein, 34 aa, Artificial Sequence
  Description of Artificial Sequence: Synthetic polypeptide
DEMEIVTTNPVATEQYGTYVCSATDGPVEFKGND

SEQ ID NO: 151146 - protein, 32 aa, Artificial Sequence
  Description of Artificial Sequence: Synthetic polypeptide
DENEIRTTNPVSTEPYGTISQEDIQQQINGNH

SEQ ID NO: 151147 - protein, 33 aa, Artificial Sequence
  Description of Artificial Sequence: Synthetic polypeptide
DEMEIVTTNPVATEQYGVACSATDIPVEQEGTD

SEQ ID NO: 151148 - protein, 32 aa, Artificial Sequence
  Description of Artificial Sequence: Synthetic polypeptide
DEMEIVTTNPVATEQYGVMAATDGPVEHEGND

SEQ ID NO: 151149 - protein, 31 aa, Artificial Sequence
  Description of Artificial Sequence: Synthetic polypeptide
DEMEIVTTNPVATEQYGVMAATDGPVEHGDD

SEQ ID NO: 151150 - protein, 31 aa, Artificial Sequence
  Description of Artificial Sequence: Synthetic polypeptide
DEMEIVTTNPVATEQYGVMCAATGPVEHGDD

SEQ ID NO: 151151 - protein, 32 aa, Artificial Sequence
  Description of Artificial Sequence: Synthetic polypeptide
DENEIRTTNPVSTEPYGTISQEDIQQGQNGNH

SEQ ID NO: 151152 - protein, 33 aa, Artificial Sequence
  Description of Artificial Sequence: Synthetic polypeptide
DENEIRTTNPVSTEPYGTISPMVDIQQQQNGNH

SEQ ID NO: 151153 - protein, 33 aa, Artificial Sequence
  Description of Artificial Sequence: Synthetic polypeptide
DEHEIATTNPVAYEQWGSVTGMNGNQGGMNGDD

SEQ ID NO: 151154 - protein, 34 aa, Artificial Sequence
  Description of Artificial Sequence: Synthetic polypeptide
DEMEIVTTNPVATEQYGTVVCSATWGPVEFEGND

SEQ ID NO: 151155 - protein, 35 aa, Artificial Sequence
  Description of Artificial Sequence: Synthetic polypeptide
DEMEIVTTNPVATEQYGYTVCSATDGPVEFEGNRD

SEQ ID NO: 151156 - protein, 35 aa, Artificial Sequence
  Description of Artificial Sequence: Synthetic polypeptide
DEHEIATTNPVAYEQWGSVSKTDEQLQEQPGNNDQ

SEQ ID NO: 151157 - protein, 34 aa, Artificial Sequence
  Description of Artificial Sequence: Synthetic polypeptide
DEEEISTTNPVATEQYGCVCSWEELNANFNSEQD

SEQ ID NO: 151158 - protein, 33 aa, Artificial Sequence
  Description of Artificial Sequence: Synthetic polypeptide
DEEEISTTNPVATEQYGCVCSWEHAENFGSDQA

SEQ ID NO: 151159 - protein, 34 aa, Artificial Sequence
  Description of Artificial Sequence: Synthetic polypeptide
DEEEISTTNPVATEQYGCVCSWEHFQENFNSDQS

SEQ ID NO: 151160 - protein, 34 aa, Artificial Sequence
  Description of Artificial Sequence: Synthetic polypeptide
DEEEISTTNPVATEQYGCVCSWEHNANFGSEFQS

SEQ ID NO: 151161 - protein, 34 aa, Artificial Sequence
  Description of Artificial Sequence: Synthetic polypeptide
DEEEISTTNPVATEQYGCVCSWEHNIENFNSDQA

SEQ ID NO: 151162 - protein, 35 aa, Artificial Sequence
  Description of Artificial Sequence: Synthetic polypeptide
DEEEISTTNPVATEQYGCVCSWEHNQEGFGSDNQA

SEQ ID NO: 151163 - protein, 33 aa, Artificial Sequence
  Description of Artificial Sequence: Synthetic polypeptide
DEMEIVTTNPVATEVYGTVCSATDSPVEFEGND

SEQ ID NO: 151164 - protein, 33 aa, Artificial Sequence
  Description of Artificial Sequence: Synthetic polypeptide
DEMEIVTTNPVATEWYGTVCSATDGPVEFEGND

SEQ ID NO: 151165 - protein, 35 aa, Artificial Sequence
  Description of Artificial Sequence: Synthetic polypeptide
DEEEISTTNPVATEQYGCVCSWEHNQENFGSDNQA

SEQ ID NO: 151166 - protein, 35 aa, Artificial Sequence
  Description of Artificial Sequence: Synthetic polypeptide
DEEEISTTNPVATEQYGCVCSWEHNQENFGSQNQS

SEQ ID NO: 151167 - protein, 34 aa, Artificial Sequence
  Description of Artificial Sequence: Synthetic polypeptide
DEEEISTTNPVATEQYGCVCSWEHNQEYFNSDQS

SEQ ID NO: 151168 - protein, 33 aa, Artificial Sequence
  Description of Artificial Sequence: Synthetic polypeptide
DEEEISTTNPVATEQYGCVCSWEHNQNFISDQS

SEQ ID NO: 151169 - protein, 34 aa, Artificial Sequence
  Description of Artificial Sequence: Synthetic polypeptide
DEEEISTTNPVATEQYGCVCSWEHNQNFNSDFQS

SEQ ID NO: 151170 - protein, 34 aa, Artificial Sequence
  Description of Artificial Sequence: Synthetic polypeptide
DEEEISTTNPVATEQYGCVCSWEHNQNFNSDTQV

SEQ ID NO: 151171 - protein, 33 aa, Artificial Sequence
  Description of Artificial Sequence: Synthetic polypeptide
DEHEIATTNPVAYEQWGSVAHPLDDRQNMGGNH

SEQ ID NO: 151172 - protein, 34 aa, Artificial Sequence
  Description of Artificial Sequence: Synthetic polypeptide
DEEEISTTNPVATEQYGCVCSWEHNQYFNSENQA

SEQ ID NO: 151173 - protein, 32 aa, Artificial Sequence
  Description of Artificial Sequence: Synthetic polypeptide
DENEIRTTNPVSTEPYGTISPEDIQQQQNGNH

SEQ ID NO: 151174 - protein, 33 aa, Artificial Sequence
  Description of Artificial Sequence: Synthetic polypeptide
DEMEIVTTNPVATEVYGTVCSATDGPVEFPGND

SEQ ID NO: 151175 - protein, 33 aa, Artificial Sequence
  Description of Artificial Sequence: Synthetic polypeptide
DEMEIVTTNPVATEVYGTVCSATDGPVEFEGND

SEQ ID NO: 151176 - protein, 33 aa, Artificial Sequence
  Description of Artificial Sequence: Synthetic polypeptide
DEMEIVTTNPVATEVYGTVCSATDGPVEAEGND

SEQ ID NO: 151177 - protein, 33 aa, Artificial Sequence
  Description of Artificial Sequence: Synthetic polypeptide
DEMEIVTTNPVATEVYGTVCSATDGPGEFEGND

SEQ ID NO: 151178 - protein, 35 aa, Artificial Sequence
  Description of Artificial Sequence: Synthetic polypeptide
DEHEIATTNPVAYEQWGSVSKTDEQLQEPQGDNHE

SEQ ID NO: 151179 - protein, 36 aa, Artificial Sequence
  Description of Artificial Sequence: Synthetic polypeptide
DEHEIATTNPVAYEQWGSVSKNNEQLQERSGDNQNQ

SEQ ID NO: 151180 - protein, 34 aa, Artificial Sequence
  Description of Artificial Sequence: Synthetic polypeptide
DEHEIATTNPVAYEQWGSVSHPLNDDRQNMGANH

SEQ ID NO: 151181 - protein, 34 aa, Artificial Sequence
  Description of Artificial Sequence: Synthetic polypeptide
DEHEIATTNPVAYEQWGSVSGDNNDNNPRGDNTM

SEQ ID NO: 151182 - protein, 34 aa, Artificial Sequence
  Description of Artificial Sequence: Synthetic polypeptide
DEHEIATTNPVAYEQWGSVPTGPNGNQGAGNGDD

SEQ ID NO: 151183 - protein, 33 aa, Artificial Sequence
  Description of Artificial Sequence: Synthetic polypeptide
DEHEIATTNPVAYEQWGSVCYNNDGHRDGNNQQ

SEQ ID NO: 151184 - protein, 35 aa, Artificial Sequence
  Description of Artificial Sequence: Synthetic polypeptide
DEHEIATTNPVAYEQWGSVCSTTENDQGEDPNDSR

SEQ ID NO: 151185 - protein, 33 aa, Artificial Sequence
  Description of Artificial Sequence: Synthetic polypeptide
DEMEIVTTNPVATERYGTVCSATDGPVEFEGND

SEQ ID NO: 151186 - protein, 34 aa, Artificial Sequence
  Description of Artificial Sequence: Synthetic polypeptide
DEMEIVTTNPVATEQYGYTVCSATDTPVEFEGER

SEQ ID NO: 151187 - protein, 34 aa, Artificial Sequence
  Description of Artificial Sequence: Synthetic polypeptide
DEHEIATTNPVAYEQWGSVCSTNDNQGEDHNAGD

SEQ ID NO: 151188 - protein, 33 aa, Artificial Sequence
  Description of Artificial Sequence: Synthetic polypeptide
DEMEIVTTNPVATESYGTVCSATDGPVEFEGND

SEQ ID NO: 151189 - protein, 33 aa, Artificial Sequence
  Description of Artificial Sequence: Synthetic polypeptide
DEMEIVTTNPVATESYGTVCSATDGPVEFEGNG

SEQ ID NO: 151190 - protein, 33 aa, Artificial Sequence
  Description of Artificial Sequence: Synthetic polypeptide
DEHEIATTNPVAYEQWGSVCSMENDQHDTNDHK

SEQ ID NO: 151191 - protein, 33 aa, Artificial Sequence
  Description of Artificial Sequence: Synthetic polypeptide
DEMEIVTTNPVATESYGTVCSMTDGPVEFEGND

SEQ ID NO: 151192 - protein, 33 aa, Artificial Sequence
  Description of Artificial Sequence: Synthetic polypeptide
DEMEIVTTNPVATETYGTVCSATDGPSEFEGND

SEQ ID NO: 151193 - protein, 34 aa, Artificial Sequence
  Description of Artificial Sequence: Synthetic polypeptide
DEEEISTTNPVATEQYGCVCSWEEHNQNFGSDQM

SEQ ID NO: 151194 - protein, 34 aa, Artificial Sequence
  Description of Artificial Sequence: Synthetic polypeptide
DEEEISTTNPVATEQYGCVCSWEEHQYFNSDTQS

SEQ ID NO: 151195 - protein, 33 aa, Artificial Sequence
  Description of Artificial Sequence: Synthetic polypeptide
DEMEIVTTNPVATETYGTVCSATDGPVEFEGND

SEQ ID NO: 151196 - protein, 35 aa, Artificial Sequence
  Description of Artificial Sequence: Synthetic polypeptide
DEEEISTTNPVATEQYGCVCSWEEDLQENFGSEQS

SEQ ID NO: 151197 - protein, 35 aa, Artificial Sequence
  Description of Artificial Sequence: Synthetic polypeptide
DEEEIRTTNPVAYEQYGCTCSMTEELNQSIGSDQA

SEQ ID NO: 151198 - protein, 34 aa, Artificial Sequence
  Description of Artificial Sequence: Synthetic polypeptide
DEMEIVTTNPVATEQYGTVVCSATDGPWEFEGND

SEQ ID NO: 151199 - protein, 34 aa, Artificial Sequence
  Description of Artificial Sequence: Synthetic polypeptide
DEMEIVTTNPVATEQYGTVVCSATDGPVEFGGND

SEQ ID NO: 151200 - protein, 33 aa, Artificial Sequence
  Description of Artificial Sequence: Synthetic polypeptide
DEMEIVTTNPVATEQYGTVCYATDGPFEFEGND

SEQ ID NO: 151201 - protein, 33 aa, Artificial Sequence
  Description of Artificial Sequence: Synthetic polypeptide
DEMEIVTTNPVATEQYGTVCYATDGPVEFEGND

SEQ ID NO: 151202 - protein, 35 aa, Artificial Sequence
  Description of Artificial Sequence: Synthetic polypeptide
DEHEIATTNPVAYEQWGVVSGNNDDEQRGGGGGNR

SEQ ID NO: 151203 - protein, 33 aa, Artificial Sequence
  Description of Artificial Sequence: Synthetic polypeptide
DEMEIVTTNPVATEQYGTVCYATDGPVEFTGND

SEQ ID NO: 151204 - protein, 33 aa, Artificial Sequence
  Description of Artificial Sequence: Synthetic polypeptide
DEMEIVTTNPVATEQYGTVCYATWGPVEFEGND

SEQ ID NO: 151205 - protein, 35 aa, Artificial Sequence
  Description of Artificial Sequence: Synthetic polypeptide
DEHEIATTNPVAYEQWGVVSGGNDTEQRGEGGGNR

SEQ ID NO: 151206 - protein, 33 aa, Artificial Sequence
  Description of Artificial Sequence: Synthetic polypeptide
DEMEIVTTNPVATEQYGTVDVATDGPVEFEGND

SEQ ID NO: 151207 - protein, 33 aa, Artificial Sequence
  Description of Artificial Sequence: Synthetic polypeptide
DEMEIVTTNPVATEQYGTVFAATDGPVEFEGND

SEQ ID NO: 151208 - protein, 34 aa, Artificial Sequence
  Description of Artificial Sequence: Synthetic polypeptide
DEMEIVTTNPVATEQYGTVGSATDGPVEVFEGND

SEQ ID NO: 151209 - protein, 33 aa, Artificial Sequence
  Description of Artificial Sequence: Synthetic polypeptide
DEMEIVTTNPVATEQYGTVKSAEDGPVEFEGND

SEQ ID NO: 151210 - protein, 34 aa, Artificial Sequence
  Description of Artificial Sequence: Synthetic polypeptide
DEMEIVTTNPVATEQYGTVKSATDGPVEFEGNDG

SEQ ID NO: 151211 - protein, 33 aa, Artificial Sequence
  Description of Artificial Sequence: Synthetic polypeptide
DEMEIVTTNPVATEQYGTVKSATDGPVEFERND

SEQ ID NO: 151212 - protein, 33 aa, Artificial Sequence
  Description of Artificial Sequence: Synthetic polypeptide
DEMEIVTTNPVATEQYGTVLSATDGPVEFEFND

SEQ ID NO: 151213 - protein, 34 aa, Artificial Sequence
  Description of Artificial Sequence: Synthetic polypeptide
DEMEIVTTNPVATEQYGTVLSATDGPVEFEGNDK

SEQ ID NO: 151214 - protein, 33 aa, Artificial Sequence
  Description of Artificial Sequence: Synthetic polypeptide
DEMEIVTTNPVATEQYGTVMSAEDGPVEFEGND

SEQ ID NO: 151215 - protein, 33 aa, Artificial Sequence
  Description of Artificial Sequence: Synthetic polypeptide
DEMEIVTTNPVATEQYGTVMSALDGPVEFEGND

SEQ ID NO: 151216 - protein, 34 aa, Artificial Sequence
  Description of Artificial Sequence: Synthetic polypeptide
DEMEIVTTNPVATEQYGTVNSATDGRPVEFEGND

SEQ ID NO: 151217 - protein, 35 aa, Artificial Sequence
  Description of Artificial Sequence: Synthetic polypeptide
DEEEIRTTNPVAYEQWGYTNVNYVNELQHRTGGDS

SEQ ID NO: 151218 - protein, 33 aa, Artificial Sequence
  Description of Artificial Sequence: Synthetic polypeptide
DEMEIVTTNPVATEQYGTVCWATDGPVYFEGND

SEQ ID NO: 151219 - protein, 33 aa, Artificial Sequence
  Description of Artificial Sequence: Synthetic polypeptide
DEMEIVTTNPVATEQYGTVCWATDGPVEFEGND

SEQ ID NO: 151220 - protein, 35 aa, Artificial Sequence
  Description of Artificial Sequence: Synthetic polypeptide
DEEEISTTNPVATEQYGCVCSTMEHQENFGSQTQL

SEQ ID NO: 151221 - protein, 35 aa, Artificial Sequence
  Description of Artificial Sequence: Synthetic polypeptide
DDEEIASTNPVSTEQYGSVSSTNPAGPNMRNGNPV

SEQ ID NO: 151222 - protein, 33 aa, Artificial Sequence
  Description of Artificial Sequence: Synthetic polypeptide
DEMEIVTTNPVATEQYGTVCSTTGEPVEFFGDD

SEQ ID NO: 151223 - protein, 34 aa, Artificial Sequence
  Description of Artificial Sequence: Synthetic polypeptide
DEMEIVTTNPVATEQYGTVCSTTGEPVEYEGSND

SEQ ID NO: 151224 - protein, 35 aa, Artificial Sequence
  Description of Artificial Sequence: Synthetic polypeptide
DEEEISTTNPVATEQYGCVCSTGPDLAENFNSEQS

SEQ ID NO: 151225 - protein, 34 aa, Artificial Sequence
  Description of Artificial Sequence: Synthetic polypeptide
DEMEIVTTNPVATEQYGTVCSVTDGDPVEFEGND

SEQ ID NO: 151226 - protein, 33 aa, Artificial Sequence
  Description of Artificial Sequence: Synthetic polypeptide
DEMEIVTTNPVATEQYGTVCSVTDGPVEFEGKD

SEQ ID NO: 151227 - protein, 35 aa, Artificial Sequence
  Description of Artificial Sequence: Synthetic polypeptide
DEEEISTTNPVATEQYGCVCSTGPHQENFGSDTQS

SEQ ID NO: 151228 - protein, 33 aa, Artificial Sequence
  Description of Artificial Sequence: Synthetic polypeptide
DEMEIVTTNPVATEQYGTVCSVTDGPVEFEYND

SEQ ID NO: 151229 - protein, 31 aa, Artificial Sequence
  Description of Artificial Sequence: Synthetic polypeptide
DEMEIVTTNPVATEQYGTVPAEDGPVEFEND

SEQ ID NO: 151230 - protein, 33 aa, Artificial Sequence
  Description of Artificial Sequence: Synthetic polypeptide
DEMEIVTTNPVATEQYGTVCSWTDGPVEFEGYD

SEQ ID NO: 151231 - protein, 33 aa, Artificial Sequence
  Description of Artificial Sequence: Synthetic polypeptide
DEMEIVTTNPVATEQYGTVCTATDGPVEFEGND

SEQ ID NO: 151232 - protein, 34 aa, Artificial Sequence
  Description of Artificial Sequence: Synthetic polypeptide
DEEEISTTNPVATEQYGCVCSTGPTAEHFNSEQS

SEQ ID NO: 151233 - protein, 35 aa, Artificial Sequence
  Description of Artificial Sequence: Synthetic polypeptide
DEEEISTTNPVATEQYGCVCSTGYHNQEGFGSEQA

SEQ ID NO: 151234 - protein, 33 aa, Artificial Sequence
  Description of Artificial Sequence: Synthetic polypeptide
DEMEIVTTNPVATEQYGTVCTATDGPVEFQGND

SEQ ID NO: 151235 - protein, 33 aa, Artificial Sequence
  Description of Artificial Sequence: Synthetic polypeptide
DEMEIVTTNPVATEQYGTVCVATDGPVEFEGND

SEQ ID NO: 151236 - protein, 35 aa, Artificial Sequence
  Description of Artificial Sequence: Synthetic polypeptide
DEEEISTTNPVATEQYGCVCSTMEDQENFNSDNQS

SEQ ID NO: 151237 - protein, 35 aa, Artificial Sequence
  Description of Artificial Sequence: Synthetic polypeptide
DEEEISTTNPVATEQYGCVCSTMEHNQEHFNSDQA

SEQ ID NO: 151238 - protein, 35 aa, Artificial Sequence
  Description of Artificial Sequence: Synthetic polypeptide
DEEEISTTNPVATEQYGCVCSTMEHNQNFNSDTQG

SEQ ID NO: 151239 - protein, 33 aa, Artificial Sequence
  Description of Artificial Sequence: Synthetic polypeptide
DEMEIVTTNPVATEQYGTVCSWTDGPVEFEPND

SEQ ID NO: 151240 - protein, 35 aa, Artificial Sequence
  Description of Artificial Sequence: Synthetic polypeptide
DEEEISTTNPVATEQYGCVCSTWEHNQENFGSDQA

SEQ ID NO: 151241 - protein, 36 aa, Artificial Sequence
  Description of Artificial Sequence: Synthetic polypeptide
DEEEIRTTNPVAYEQWGTVSTTTGQGPNMRNGMNAV

SEQ ID NO: 151242 - protein, 32 aa, Artificial Sequence
  Description of Artificial Sequence: Synthetic polypeptide
DEMEIVTTNPVATEQYGTVPATDGPVEFEEND

SEQ ID NO: 151243 - protein, 35 aa, Artificial Sequence
  Description of Artificial Sequence: Synthetic polypeptide
DEEEISTTNPVATEQYGCVCSTTEHDQGFISDNQS

SEQ ID NO: 151244 - protein, 35 aa, Artificial Sequence
  Description of Artificial Sequence: Synthetic polypeptide
DEEEISTTNPVATEQYGCVCSTTEHQEYFGSDTQL

SEQ ID NO: 151245 - protein, 33 aa, Artificial Sequence
  Description of Artificial Sequence: Synthetic polypeptide
DEHEIATTNPVAYEQWGSVTGPNGNQGAGTGRD

SEQ ID NO: 151246 - protein, 35 aa, Artificial Sequence
  Description of Artificial Sequence: Synthetic polypeptide
DEEEISTTNPVATEQYGCVCSTTGEHDQHFNSDQY

SEQ ID NO: 151247 - protein, 36 aa, Artificial Sequence
  Description of Artificial Sequence: Synthetic polypeptide
DEEEISTTNPVATEQYGCVCSTTGEHNANFGSENQS

SEQ ID NO: 151248 - protein, 36 aa, Artificial Sequence
  Description of Artificial Sequence: Synthetic polypeptide
DEEEISTTNPVATEQYGCVCSTTGEHNQFFGSQNQT

SEQ ID NO: 151249 - protein, 36 aa, Artificial Sequence
  Description of Artificial Sequence: Synthetic polypeptide
DEEEISTTNPVATEQYGCVCSTTGEHNQSFGSDNQA

SEQ ID NO: 151250 - protein, 34 aa, Artificial Sequence
  Description of Artificial Sequence: Synthetic polypeptide
DEEEISTTNPVATEQYGCVCSTTGEHQNFFSEQS

SEQ ID NO: 151251 - protein, 36 aa, Artificial Sequence
  Description of Artificial Sequence: Synthetic polypeptide
DEEEISTTNPVATEQYGCVCSTTGELQEGFGSEFQG

SEQ ID NO: 151252 - protein, 36 aa, Artificial Sequence
  Description of Artificial Sequence: Synthetic polypeptide
DEEEIRTTNPVAYEQWGSVSGNEPAGGNMRNGMNPH

SEQ ID NO: 151253 - protein, 36 aa, Artificial Sequence
  Description of Artificial Sequence: Synthetic polypeptide
DEEEIRTTNPVAYEQWGSVSGGNPAGGNMRNGMNMG

SEQ ID NO: 151254 - protein, 36 aa, Artificial Sequence
  Description of Artificial Sequence: Synthetic polypeptide
DEEEIRTTNPVAYEQWGSVSGGLPTGGNMRNGMNDT

SEQ ID NO: 151255 - protein, 33 aa, Artificial Sequence
  Description of Artificial Sequence: Synthetic polypeptide
DEHEIATTNPVAYEQWGSVTGPNGNQGAGNGTA

SEQ ID NO: 151256 - protein, 35 aa, Artificial Sequence
  Description of Artificial Sequence: Synthetic polypeptide
DEEEISTTNPVATEQYGCVCSTWEDHQENFGSEQS

SEQ ID NO: 151257 - protein, 35 aa, Artificial Sequence
  Description of Artificial Sequence: Synthetic polypeptide
DEEEISTTNPVATEQYGCVCSTWEDHQNFNSENQA

SEQ ID NO: 151258 - protein, 34 aa, Artificial Sequence
  Description of Artificial Sequence: Synthetic polypeptide
DEMEIVTTNPVATEQYGTVTSATDGPVEGFEGND

SEQ ID NO: 151259 - protein, 34 aa, Artificial Sequence
  Description of Artificial Sequence: Synthetic polypeptide
DEMEIVTTNPVATEQYGTVVCSATDGPVEFEGND

SEQ ID NO: 151260 - protein, 35 aa, Artificial Sequence
  Description of Artificial Sequence: Synthetic polypeptide
DEEEISTTNPVATEQYGCVCSTTEEHNQHFGSDQS

SEQ ID NO: 151261 - protein, 33 aa, Artificial Sequence
  Description of Artificial Sequence: Synthetic polypeptide
DEHEIATTNPVAYEQWGSVTGPNGNQGEGNGGY

SEQ ID NO: 151262 - protein, 33 aa, Artificial Sequence
  Description of Artificial Sequence: Synthetic polypeptide
DEHEIATTNPVAYEQWGSVTGPNGNQGIGNGQT

SEQ ID NO: 151263 - protein, 35 aa, Artificial Sequence
  Description of Artificial Sequence: Synthetic polypeptide
DEMEIVTTNPVATEQYGTVSSTTPAPVEREGMNPD

SEQ ID NO: 151264 - protein, 34 aa, Artificial Sequence
  Description of Artificial Sequence: Synthetic polypeptide
DEMEIVTTNPVATEQYGTVQSATDGDPVVFEGND

SEQ ID NO: 151265 - protein, 34 aa, Artificial Sequence
  Description of Artificial Sequence: Synthetic polypeptide
DEMEIVTTNPVATEQYGTVQSATSGPVEFEGTND

SEQ ID NO: 151266 - protein, 31 aa, Artificial Sequence
  Description of Artificial Sequence: Synthetic polypeptide
DDSEVACTNPVATEGYGEVSAETIQSRVGGR

SEQ ID NO: 151267 - protein, 35 aa, Artificial Sequence
  Description of Artificial Sequence: Synthetic polypeptide
DEAEIATTNPVAYEQYGSVSATANGQEHQGDQAEE

SEQ ID NO: 151268 - protein, 36 aa, Artificial Sequence
  Description of Artificial Sequence: Synthetic polypeptide
DEEEIRTTNPVATEQYGTISSTMPAIPQMQNGMNPH

SEQ ID NO: 151269 - protein, 35 aa, Artificial Sequence
  Description of Artificial Sequence: Synthetic polypeptide
DEHEIATTNPVAYEQWGTVSGGNDTEQRGGEGGNR

SEQ ID NO: 151270 - protein, 32 aa, Artificial Sequence
  Description of Artificial Sequence: Synthetic polypeptide
DEHEIATTNPVAYEQWGTISHTDNHQREDAGT

SEQ ID NO: 151271 - protein, 33 aa, Artificial Sequence
  Description of Artificial Sequence: Synthetic polypeptide
DEMEIVTTNPVATEQYGTVSATDGPVEFEGEDL

SEQ ID NO: 151272 - protein, 33 aa, Artificial Sequence
  Description of Artificial Sequence: Synthetic polypeptide
DEHEIATTNPVAYEQWGVSTGPNGNQGAGNGQD

SEQ ID NO: 151273 - protein, 31 aa, Artificial Sequence
  Description of Artificial Sequence: Synthetic polypeptide
DDSEIVTTNPVSTEGYGTVAATGPVERVGQR

SEQ ID NO: 151274 - protein, 35 aa, Artificial Sequence
  Description of Artificial Sequence: Synthetic polypeptide
DEAEIATTNPVAYEQYGTVATQNGGQQNGNQRGEA

SEQ ID NO: 151275 - protein, 34 aa, Artificial Sequence
  Description of Artificial Sequence: Synthetic polypeptide
DEEEISTTNPVATEQYGCVCSTPDHANFNSETQA

SEQ ID NO: 151276 - protein, 35 aa, Artificial Sequence
  Description of Artificial Sequence: Synthetic polypeptide
DEMEIVTTNPVATEQYGTVSSATPAGPEMRNGMND

SEQ ID NO: 151277 - protein, 37 aa, Artificial Sequence
  Description of Artificial Sequence: Synthetic polypeptide
DEEEIRTTNPVAYEQWGSVSSTTPQDGPNMRNGMNHV

SEQ ID NO: 151278 - protein, 37 aa, Artificial Sequence
  Description of Artificial Sequence: Synthetic polypeptide
DEEEIRTTNPVAYEQWGSVSSTTPQDGPNMRGGMGAV

SEQ ID NO: 151279 - protein, 36 aa, Artificial Sequence
  Description of Artificial Sequence: Synthetic polypeptide
DEEEIRTTNPVAYEQWGSVSSTTGQGPNMRNGMTGV

SEQ ID NO: 151280 - protein, 35 aa, Artificial Sequence
  Description of Artificial Sequence: Synthetic polypeptide
DEMEIVTTNPVATEQYGTVSSATPAPPNMFEGMND

SEQ ID NO: 151281 - protein, 34 aa, Artificial Sequence
  Description of Artificial Sequence: Synthetic polypeptide
DEMEIVTTNPVATEQYGTVSSTTDAPVEFEGNPD

SEQ ID NO: 151282 - protein, 35 aa, Artificial Sequence
  Description of Artificial Sequence: Synthetic polypeptide
DEAEIATTNPVAYEQYGSVSWTDDSTFTVRWGNEF

SEQ ID NO: 151283 - protein, 32 aa, Artificial Sequence
  Description of Artificial Sequence: Synthetic polypeptide
DENEIRTTNPVSTEPYGTISPEDIPQQQNGNH

SEQ ID NO: 151284 - protein, 35 aa, Artificial Sequence
  Description of Artificial Sequence: Synthetic polypeptide
DEEEISTTNPVATEQYGCVCSSEEDNQGFGSENQS

SEQ ID NO: 151285 - protein, 34 aa, Artificial Sequence
  Description of Artificial Sequence: Synthetic polypeptide
DEEEISTTNPVATEQYGCVCSSEDQENFNSENQS

SEQ ID NO: 151286 - protein, 34 aa, Artificial Sequence
  Description of Artificial Sequence: Synthetic polypeptide
DEMEIVTTNPVATEQYGTVCSATDGPVEFEGNCC

SEQ ID NO: 151287 - protein, 34 aa, Artificial Sequence
  Description of Artificial Sequence: Synthetic polypeptide
DEMEIVTTNPVATEQYGTVCSATDGPVEFEGNCD

SEQ ID NO: 151288 - protein, 36 aa, Artificial Sequence
  Description of Artificial Sequence: Synthetic polypeptide
DEEEISTTNPVATEQYGCVCSNTMEHNQNFGSENQS

SEQ ID NO: 151289 - protein, 35 aa, Artificial Sequence
  Description of Artificial Sequence: Synthetic polypeptide
DEEEISTTNPVATEQYGCVCSNTMEPQNFGSETQA

SEQ ID NO: 151290 - protein, 34 aa, Artificial Sequence
  Description of Artificial Sequence: Synthetic polypeptide
DEMEIVTTNPVATEQYGTVCSATDGPVEFEGNDA

SEQ ID NO: 151291 - protein, 32 aa, Artificial Sequence
  Description of Artificial Sequence: Synthetic polypeptide
DENEIRTTNPVSTEPYGTISQMEDIQQQNGNH

SEQ ID NO: 151292 - protein, 34 aa, Artificial Sequence
  Description of Artificial Sequence: Synthetic polypeptide
DEMEIVTTNPVATEQYGTVCSATDGPVEFEGNDC

SEQ ID NO: 151293 - protein, 34 aa, Artificial Sequence
  Description of Artificial Sequence: Synthetic polypeptide
DEMEIVTTNPVATEQYGTVCSATDGPVEFEGNDD

SEQ ID NO: 151294 - protein, 34 aa, Artificial Sequence
  Description of Artificial Sequence: Synthetic polypeptide
DEMEIVTTNPVATEQYGTVCSATDGPVEFEGNDE

SEQ ID NO: 151295 - protein, 34 aa, Artificial Sequence
  Description of Artificial Sequence: Synthetic polypeptide
DEMEIVTTNPVATEQYGTVCSATDGPVEFEGNDF

SEQ ID NO: 151296 - protein, 34 aa, Artificial Sequence
  Description of Artificial Sequence: Synthetic polypeptide
DEMEIVTTNPVATEQYGTVCSATDGPVEFEGNDG

SEQ ID NO: 151297 - protein, 34 aa, Artificial Sequence
  Description of Artificial Sequence: Synthetic polypeptide
DEMEIVTTNPVATEQYGTVCSATDGPVEFEGNDH

SEQ ID NO: 151298 - protein, 34 aa, Artificial Sequence
  Description of Artificial Sequence: Synthetic polypeptide
DEMEIVTTNPVATEQYGTVCSATDGPVEFEGNDI

SEQ ID NO: 151299 - protein, 34 aa, Artificial Sequence
  Description of Artificial Sequence: Synthetic polypeptide
DEMEIVTTNPVATEQYGTVCSATDGPVEFEGNDK

SEQ ID NO: 151300 - protein, 34 aa, Artificial Sequence
  Description of Artificial Sequence: Synthetic polypeptide
DEMEIVTTNPVATEQYGTVCSATDGPVEFEGNDL

SEQ ID NO: 151301 - protein, 34 aa, Artificial Sequence
  Description of Artificial Sequence: Synthetic polypeptide
DEMEIVTTNPVATEQYGTVCSATDGPVEFEGNDM

SEQ ID NO: 151302 - protein, 34 aa, Artificial Sequence
  Description of Artificial Sequence: Synthetic polypeptide
DEMEIVTTNPVATEQYGTVCSATDGPVEFEGNDN

SEQ ID NO: 151303 - protein, 34 aa, Artificial Sequence
  Description of Artificial Sequence: Synthetic polypeptide
DEMEIVTTNPVATEQYGTVCSATDGPVEFEGNAN

SEQ ID NO: 151304 - protein, 34 aa, Artificial Sequence
  Description of Artificial Sequence: Synthetic polypeptide
DEMEIVTTNPVATEQYGTVCSATDGPVEFEGNAD

SEQ ID NO: 151305 - protein, 34 aa, Artificial Sequence
  Description of Artificial Sequence: Synthetic polypeptide
DEMEIVTTNPVATEQYGTVCSATDGPVEFEGMND

SEQ ID NO: 151306 - protein, 33 aa, Artificial Sequence
  Description of Artificial Sequence: Synthetic polypeptide
DEMEIVTTNPVATEQYGTVCSATDGPVEFEGMD

SEQ ID NO: 151307 - protein, 34 aa, Artificial Sequence
  Description of Artificial Sequence: Synthetic polypeptide
DEMEIVTTNPVATEQYGTVCSATDGPVEFEGFND

SEQ ID NO: 151308 - protein, 33 aa, Artificial Sequence
  Description of Artificial Sequence: Synthetic polypeptide
DEMEIVTTNPVATEQYGTVCSATDGPVEFEGGD

SEQ ID NO: 151309 - protein, 34 aa, Artificial Sequence
  Description of Artificial Sequence: Synthetic polypeptide
DEMEIVTTNPVATEQYGTVCSATDGPVEFEGGND

SEQ ID NO: 151310 - protein, 32 aa, Artificial Sequence
  Description of Artificial Sequence: Synthetic polypeptide
DENEIRTTNPVSTEPYGTISREDIQWQQNGNH

SEQ ID NO: 151311 - protein, 33 aa, Artificial Sequence
  Description of Artificial Sequence: Synthetic polypeptide
DEMEIVTTNPVATEQYGTVCSATDGPVEFEGHD

SEQ ID NO: 151312 - protein, 34 aa, Artificial Sequence
  Description of Artificial Sequence: Synthetic polypeptide
DEMEIVTTNPVATEQYGTVCSATDGPVEFEGHND

SEQ ID NO: 151313 - protein, 33 aa, Artificial Sequence
  Description of Artificial Sequence: Synthetic polypeptide
DEMEIVTTNPVATEQYGTVCSATDGPVEFEGID

SEQ ID NO: 151314 - protein, 35 aa, Artificial Sequence
  Description of Artificial Sequence: Synthetic polypeptide
DEEEISTTNPVATEQYGCVCSNTGYHNQNFGSQQS

SEQ ID NO: 151315 - protein, 34 aa, Artificial Sequence
  Description of Artificial Sequence: Synthetic polypeptide
DEMEIVTTNPVATEQYGTVCSATDGPVEFEGNDP

SEQ ID NO: 151316 - protein, 32 aa, Artificial Sequence
  Description of Artificial Sequence: Synthetic polypeptide
DENEIRTTNPVSTEPYGTISREDIQTQQNGNH

SEQ ID NO: 151317 - protein, 34 aa, Artificial Sequence
  Description of Artificial Sequence: Synthetic polypeptide
DEMEIVTTNPVATEQYGTVCSATDGPVEFEGIND

SEQ ID NO: 151318 - protein, 32 aa, Artificial Sequence
  Description of Artificial Sequence: Synthetic polypeptide
DENEIRTTNPVSTEPYGTISREDHQQQQNGNH

SEQ ID NO: 151319 - protein, 33 aa, Artificial Sequence
  Description of Artificial Sequence: Synthetic polypeptide
DEMEIVTTNPVATEQYGTVCSATDGPVEFEGKD

SEQ ID NO: 151320 - protein, 34 aa, Artificial Sequence
  Description of Artificial Sequence: Synthetic polypeptide
DEMEIVTTNPVATEQYGTVCSATDGPVEFEGKND

SEQ ID NO: 151321 - protein, 33 aa, Artificial Sequence
  Description of Artificial Sequence: Synthetic polypeptide
DEMEIVTTNPVATEQYGTVCSATDGPVEFEGLD

SEQ ID NO: 151322 - protein, 34 aa, Artificial Sequence
  Description of Artificial Sequence: Synthetic polypeptide
DEMEIVTTNPVATEQYGTVCSATDGPVEFEGLND

SEQ ID NO: 151323 - protein, 34 aa, Artificial Sequence
  Description of Artificial Sequence: Synthetic polypeptide
DEEEISTTNPVATEQYGCVCSNTMEHEYFGSDQP

SEQ ID NO: 151324 - protein, 34 aa, Artificial Sequence
  Description of Artificial Sequence: Synthetic polypeptide
DEMEIVTTNPVATEQYGTVCSATDGPVEFEGLNG

SEQ ID NO: 151325 - protein, 32 aa, Artificial Sequence
  Description of Artificial Sequence: Synthetic polypeptide
DENEIRTTNPVSTEPYGTISREDIQQQQNGNH

SEQ ID NO: 151326 - protein, 33 aa, Artificial Sequence
  Description of Artificial Sequence: Synthetic polypeptide
DEMEIVTTNPVATEQYGTVCSATDGPVEFEGFD

SEQ ID NO: 151327 - protein, 34 aa, Artificial Sequence
  Description of Artificial Sequence: Synthetic polypeptide
DEMEIVTTNPVATEQYGTVCSATDGPVEFEGNDQ

SEQ ID NO: 151328 - protein, 34 aa, Artificial Sequence
  Description of Artificial Sequence: Synthetic polypeptide
DEMEIVTTNPVATEQYGTVCSATDGPVEFEGNDT

SEQ ID NO: 151329 - protein, 34 aa, Artificial Sequence
  Description of Artificial Sequence: Synthetic polypeptide
DEMEIVTTNPVATEQYGTVCSATDGPVEFEGNWD

SEQ ID NO: 151330 - protein, 34 aa, Artificial Sequence
  Description of Artificial Sequence: Synthetic polypeptide
DEMEIVTTNPVATEQYGTVCSATDGPVEFEGNYD

SEQ ID NO: 151331 - protein, 33 aa, Artificial Sequence
  Description of Artificial Sequence: Synthetic polypeptide
DEMEIVTTNPVATEQYGTVCSATDGPVEFEGPD

SEQ ID NO: 151332 - protein, 34 aa, Artificial Sequence
  Description of Artificial Sequence: Synthetic polypeptide
DEMEIVTTNPVATEQYGTVCSATDGPVEFEGPND

SEQ ID NO: 151333 - protein, 35 aa, Artificial Sequence
  Description of Artificial Sequence: Synthetic polypeptide
DEEEISTTNPVATEQYGCVCSNWEDHQNFGSENQS

SEQ ID NO: 151334 - protein, 35 aa, Artificial Sequence
  Description of Artificial Sequence: Synthetic polypeptide
DEEEISTTNPVATEQYGCVCSNWEDQENFGSENQG

SEQ ID NO: 151335 - protein, 33 aa, Artificial Sequence
  Description of Artificial Sequence: Synthetic polypeptide
DEMEIVTTNPVATEQYGTVCSATDGPVEFEGQD

SEQ ID NO: 151336 - protein, 34 aa, Artificial Sequence
  Description of Artificial Sequence: Synthetic polypeptide
DEMEIVTTNPVATEQYGTVCSATDGPVEFEGQND

SEQ ID NO: 151337 - protein, 33 aa, Artificial Sequence
  Description of Artificial Sequence: Synthetic polypeptide
DEMEIVTTNPVATEQYGTVCSATDGPVEFEGRD

SEQ ID NO: 151338 - protein, 34 aa, Artificial Sequence
  Description of Artificial Sequence: Synthetic polypeptide
DEMEIVTTNPVATEQYGTVCSATDGPVEFEGRND

SEQ ID NO: 151339 - protein, 33 aa, Artificial Sequence
  Description of Artificial Sequence: Synthetic polypeptide
DEMEIVTTNPVATEQYGTVCSATDGPVEFEGSD

SEQ ID NO: 151340 - protein, 34 aa, Artificial Sequence
  Description of Artificial Sequence: Synthetic polypeptide
DEMEIVTTNPVATEQYGTVCSATDGPVEFEGSNA

SEQ ID NO: 151341 - protein, 34 aa, Artificial Sequence
  Description of Artificial Sequence: Synthetic polypeptide
DEMEIVTTNPVATEQYGTVCSATDGPVEFEGSND

SEQ ID NO: 151342 - protein, 33 aa, Artificial Sequence
  Description of Artificial Sequence: Synthetic polypeptide
DEMEIVTTNPVATEQYGTVCSATDGPVEFEGTD

SEQ ID NO: 151343 - protein, 34 aa, Artificial Sequence
  Description of Artificial Sequence: Synthetic polypeptide
DEMEIVTTNPVATEQYGTVCSATDGPVEFEGTND

SEQ ID NO: 151344 - protein, 33 aa, Artificial Sequence
  Description of Artificial Sequence: Synthetic polypeptide
DEMEIVTTNPVATEQYGTVCSATDGPVEFEGVD

SEQ ID NO: 151345 - protein, 34 aa, Artificial Sequence
  Description of Artificial Sequence: Synthetic polypeptide
DEMEIVTTNPVATEQYGTVCSATDGPVEFEGVND

SEQ ID NO: 151346 - protein, 34 aa, Artificial Sequence
  Description of Artificial Sequence: Synthetic polypeptide
DEMEIVTTNPVATEQYGTVCSATDGPVEFEGNVD

SEQ ID NO: 151347 - protein, 34 aa, Artificial Sequence
  Description of Artificial Sequence: Synthetic polypeptide
DEMEIVTTNPVATEQYGTVCSATDGPVEFEGNTF

SEQ ID NO: 151348 - protein, 34 aa, Artificial Sequence
  Description of Artificial Sequence: Synthetic polypeptide
DEMEIVTTNPVATEQYGTVCSATDGPVEFEGNTD

SEQ ID NO: 151349 - protein, 34 aa, Artificial Sequence
  Description of Artificial Sequence: Synthetic polypeptide
DEMEIVTTNPVATEQYGTVCSATDGPVEFEGNSD

SEQ ID NO: 151350 - protein, 34 aa, Artificial Sequence
  Description of Artificial Sequence: Synthetic polypeptide
DEMEIVTTNPVATEQYGTVCSATDGPVEFEGNDV

SEQ ID NO: 151351 - protein, 34 aa, Artificial Sequence
  Description of Artificial Sequence: Synthetic polypeptide
DEMEIVTTNPVATEQYGTVCSATDGPVEFEGNDW

SEQ ID NO: 151352 - protein, 34 aa, Artificial Sequence
  Description of Artificial Sequence: Synthetic polypeptide
DEMEIVTTNPVATEQYGTVCSATDGPVEFEGNDY

SEQ ID NO: 151353 - protein, 34 aa, Artificial Sequence
  Description of Artificial Sequence: Synthetic polypeptide
DEMEIVTTNPVATEQYGTVCSATDGPVEFEGNED

SEQ ID NO: 151354 - protein, 34 aa, Artificial Sequence
  Description of Artificial Sequence: Synthetic polypeptide
DEMEIVTTNPVATEQYGTVCSATDGPVEFEGNFD

SEQ ID NO: 151355 - protein, 34 aa, Artificial Sequence
  Description of Artificial Sequence: Synthetic polypeptide
DEMEIVTTNPVATEQYGTVCSATDGPVEFEGNGD

SEQ ID NO: 151356 - protein, 34 aa, Artificial Sequence
  Description of Artificial Sequence: Synthetic polypeptide
DEMEIVTTNPVATEQYGTVCSATDGPVEFEGNHD

SEQ ID NO: 151357 - protein, 34 aa, Artificial Sequence
  Description of Artificial Sequence: Synthetic polypeptide
DEMEIVTTNPVATEQYGTVCSATDGPVEFEGNID

SEQ ID NO: 151358 - protein, 34 aa, Artificial Sequence
  Description of Artificial Sequence: Synthetic polypeptide
DEMEIVTTNPVATEQYGTVCSATDGPVEFEGNDS

SEQ ID NO: 151359 - protein, 34 aa, Artificial Sequence
  Description of Artificial Sequence: Synthetic polypeptide
DEEEIRTTNPVAYEQYGCVCSWGEHQFFNSDNQE

SEQ ID NO: 151360 - protein, 34 aa, Artificial Sequence
  Description of Artificial Sequence: Synthetic polypeptide
DEMEIVTTNPVATEQYGTVCSATDGPVEFEGNLD

SEQ ID NO: 151361 - protein, 34 aa, Artificial Sequence
  Description of Artificial Sequence: Synthetic polypeptide
DEMEIVTTNPVATEQYGTVCSATDGPVEFEGNMD

SEQ ID NO: 151362 - protein, 34 aa, Artificial Sequence
  Description of Artificial Sequence: Synthetic polypeptide
DEMEIVTTNPVATEQYGTVCSATDGPVEFEGNND

SEQ ID NO: 151363 - protein, 34 aa, Artificial Sequence
  Description of Artificial Sequence: Synthetic polypeptide
DEMEIVTTNPVATEQYGTVCSATDGPVEFEGNPD

SEQ ID NO: 151364 - protein, 34 aa, Artificial Sequence
  Description of Artificial Sequence: Synthetic polypeptide
DEMEIVTTNPVATEQYGTVCSATDGPVEFEGNQD

SEQ ID NO: 151365 - protein, 34 aa, Artificial Sequence
  Description of Artificial Sequence: Synthetic polypeptide
DEMEIVTTNPVATEQYGTVCSATDGPVEFEGNQM

SEQ ID NO: 151366 - protein, 34 aa, Artificial Sequence
  Description of Artificial Sequence: Synthetic polypeptide
DEEEISTTNPVATEQYGCVCSNWEAHQNFGSEQA

SEQ ID NO: 151367 - protein, 32 aa, Artificial Sequence
  Description of Artificial Sequence: Synthetic polypeptide
DEAEIATTNPVAYEQYGSTTAGNGDQNQQNDQ

SEQ ID NO: 151368 - protein, 34 aa, Artificial Sequence
  Description of Artificial Sequence: Synthetic polypeptide
DEMEIVTTNPVATEQYGTVCSATDGPVEFEGNKD

SEQ ID NO: 151369 - protein, 33 aa, Artificial Sequence
  Description of Artificial Sequence: Synthetic polypeptide
DEMEIVTTNPVATEQYGTVCSATDGPVEFEGVQ

SEQ ID NO: 151370 - protein, 34 aa, Artificial Sequence
  Description of Artificial Sequence: Synthetic polypeptide
DEMEIVTTNPVATEQYGTVCSATDGPVEFEGEND

SEQ ID NO: 151371 - protein, 34 aa, Artificial Sequence
  Description of Artificial Sequence: Synthetic polypeptide
DEMEIVTTNPVATEQYGTVCSATDGPVEFEGDND

SEQ ID NO: 151372 - protein, 33 aa, Artificial Sequence
  Description of Artificial Sequence: Synthetic polypeptide
DENEIRTTNPVSTEPYGTISTPAIQQQQNGNPV

SEQ ID NO: 151373 - protein, 34 aa, Artificial Sequence
  Description of Artificial Sequence: Synthetic polypeptide
DEAAIRTTNPVATEQYGCFCSTTEHNINFGSNQA

SEQ ID NO: 151374 - protein, 34 aa, Artificial Sequence
  Description of Artificial Sequence: Synthetic polypeptide
DEMEIVTTNPVATEQYGTVCSATDGPIEFEGEND

SEQ ID NO: 151375 - protein, 34 aa, Artificial Sequence
  Description of Artificial Sequence: Synthetic polypeptide
DEMEIVTTNPVATEQYGTVCSATDGPIEFFEGND

SEQ ID NO: 151376 - protein, 35 aa, Artificial Sequence
  Description of Artificial Sequence: Synthetic polypeptide
DEAEIATTNPVAYEQYGCVATVANDLQTAMGPNEE

SEQ ID NO: 151377 - protein, 34 aa, Artificial Sequence
  Description of Artificial Sequence: Synthetic polypeptide
DEMEIVTTNPVATEQYGTVCSATDGPPEFEGMND

SEQ ID NO: 151378 - protein, 33 aa, Artificial Sequence
  Description of Artificial Sequence: Synthetic polypeptide
DENEIRTTNPVSTEPYGTISTMEDSQQQQNGNH

SEQ ID NO: 151379 - protein, 33 aa, Artificial Sequence
  Description of Artificial Sequence: Synthetic polypeptide
DENEIRTTNPVSTEPYGTISTMEDIQQQQNGNH

SEQ ID NO: 151380 - protein, 34 aa, Artificial Sequence
  Description of Artificial Sequence: Synthetic polypeptide
DEMEIVTTNPVATEQYGTVCSATDGPPEFEGNPD

SEQ ID NO: 151381 - protein, 33 aa, Artificial Sequence
  Description of Artificial Sequence: Synthetic polypeptide
DENEIRTTNPVSTEPYGTISTLEDISQQQNGNH

SEQ ID NO: 151382 - protein, 35 aa, Artificial Sequence
  Description of Artificial Sequence: Synthetic polypeptide
DEAEIRTTNPVATEQYGSVCSSQISTLFPHNNMID

SEQ ID NO: 151383 - protein, 35 aa, Artificial Sequence
  Description of Artificial Sequence: Synthetic polypeptide
DEAEIRTTNPVATEQYGSVCSSQISLHFPHNMISD

SEQ ID NO: 151384 - protein, 35 aa, Artificial Sequence
  Description of Artificial Sequence: Synthetic polypeptide
DEAEIRTTNPVATEQYGSVCSSQISLFPHNMIYDV

SEQ ID NO: 151385 - protein, 38 aa, Artificial Sequence
  Description of Artificial Sequence: Synthetic polypeptide
DEEEIRTTNPVATEQYGVVSTVVNTNLQQGTTEEEEED

SEQ ID NO: 151386 - protein, 34 aa, Artificial Sequence
  Description of Artificial Sequence: Synthetic polypeptide
DEMEIVTTNPVATEQYGTVCSATDGPPVEFEGND

SEQ ID NO: 151387 - protein, 34 aa, Artificial Sequence
  Description of Artificial Sequence: Synthetic polypeptide
DEMEIVTTNPVATEQYGTVCSATDGPPVEFEGNF

SEQ ID NO: 151388 - protein, 33 aa, Artificial Sequence
  Description of Artificial Sequence: Synthetic polypeptide
DEAEIATTNPVAYEQYGSTATNHLTGTPDGSEN

SEQ ID NO: 151389 - protein, 34 aa, Artificial Sequence
  Description of Artificial Sequence: Synthetic polypeptide
DEMEIVTTNPVATEQYGTVCSATDGPHEFEGCND

SEQ ID NO: 151390 - protein, 36 aa, Artificial Sequence
  Description of Artificial Sequence: Synthetic polypeptide
DEEEISTTNPVATEQYGCVCSNTGELQENFGSETQA

SEQ ID NO: 151391 - protein, 36 aa, Artificial Sequence
  Description of Artificial Sequence: Synthetic polypeptide
DEEEISTTNPVATEQYGCVCSNTGELNQNFNSQTQA

SEQ ID NO: 151392 - protein, 34 aa, Artificial Sequence
  Description of Artificial Sequence: Synthetic polypeptide
DEMEIVTTNPVATEQYGTVCSATDGPGEFEGNMD

SEQ ID NO: 151393 - protein, 33 aa, Artificial Sequence
  Description of Artificial Sequence: Synthetic polypeptide
DENEIRTTNPVSTEPYGTISVMEDIQQQQNGNH

SEQ ID NO: 151394 - protein, 33 aa, Artificial Sequence
  Description of Artificial Sequence: Synthetic polypeptide
DENEIRTTNPVSTEPYGTISVEDIQQQQNGYNH

SEQ ID NO: 151395 - protein, 33 aa, Artificial Sequence
  Description of Artificial Sequence: Synthetic polypeptide
DEMEIVTTNPVATEQYGTVCSATDGIVEFEGQD

SEQ ID NO: 151396 - protein, 34 aa, Artificial Sequence
  Description of Artificial Sequence: Synthetic polypeptide
DEMEIVTTNPVATEQYGTVCSATDGKPVEFEGND

SEQ ID NO: 151397 - protein, 34 aa, Artificial Sequence
  Description of Artificial Sequence: Synthetic polypeptide
DEMEIVTTNPVATEQYGTVCSATDGKPVEFGGND

SEQ ID NO: 151398 - protein, 35 aa, Artificial Sequence
  Description of Artificial Sequence: Synthetic polypeptide
DEMEIVTTNPVATEQYGTVCSATDGLPVEVFEGND

SEQ ID NO: 151399 - protein, 35 aa, Artificial Sequence
  Description of Artificial Sequence: Synthetic polypeptide
DEMEIVTTNPVATEQYGTVCSATDGLVEDFEGNDD

SEQ ID NO: 151400 - protein, 34 aa, Artificial Sequence
  Description of Artificial Sequence: Synthetic polypeptide
DEMEIVTTNPVATEQYGTVCSATDGMPVEFEGND

SEQ ID NO: 151401 - protein, 33 aa, Artificial Sequence
  Description of Artificial Sequence: Synthetic polypeptide
DEMEIVTTNPVATEQYGTVCSATDGPSEFEAND

SEQ ID NO: 151402 - protein, 34 aa, Artificial Sequence
  Description of Artificial Sequence: Synthetic polypeptide
DEMEIVTTNPVATEQYGTVCSATDGMVEEFEGND

SEQ ID NO: 151403 - protein, 36 aa, Artificial Sequence
  Description of Artificial Sequence: Synthetic polypeptide
DEEEISTTNPVATEQYGCVCSNTGEHQEGFGSDNQA

SEQ ID NO: 151404 - protein, 36 aa, Artificial Sequence
  Description of Artificial Sequence: Synthetic polypeptide
DEEEISTTNPVATEQYGCVCSNTGEHQENSGSNTQL

SEQ ID NO: 151405 - protein, 34 aa, Artificial Sequence
  Description of Artificial Sequence: Synthetic polypeptide
DEEEISTTNPVATEQYGCVCSNTGEHQHFTSDQN

SEQ ID NO: 151406 - protein, 35 aa, Artificial Sequence
  Description of Artificial Sequence: Synthetic polypeptide
DEEEISTTNPVATEQYGCVCSNTGEHQNFNSDNQS

SEQ ID NO: 151407 - protein, 34 aa, Artificial Sequence
  Description of Artificial Sequence: Synthetic polypeptide
DEMEIVTTNPVATEQYGTVCSATDGPAEFEGMND

SEQ ID NO: 151408 - protein, 34 aa, Artificial Sequence
  Description of Artificial Sequence: Synthetic polypeptide
DEMEIVTTNPVATEQYGTVCSATDGPEDFEGNDD

SEQ ID NO: 151409 - protein, 37 aa, Artificial Sequence
  Description of Artificial Sequence: Synthetic polypeptide
DEEEIRTTNPVATEQYGTVSSTTPAAGPNMRNGMNPV

SEQ ID NO: 151410 - protein, 35 aa, Artificial Sequence
  Description of Artificial Sequence: Synthetic polypeptide
DEEEISTTNPVATEQYGCVCSNTGELEEYFGSDQP

SEQ ID NO: 151411 - protein, 34 aa, Artificial Sequence
  Description of Artificial Sequence: Synthetic polypeptide
DEMEIVTTNPVATEQYGTVCSATDGMVEFEGNAD

SEQ ID NO: 151412 - protein, 33 aa, Artificial Sequence
  Description of Artificial Sequence: Synthetic polypeptide
DEMEIVTTNPVATEQYGTVCSATDGPVEFEGED

SEQ ID NO: 151413 - protein, 34 aa, Artificial Sequence
  Description of Artificial Sequence: Synthetic polypeptide
DEMEIVTTNPVATEQYGTVCSATDGPSEFEGAND

SEQ ID NO: 151414 - protein, 34 aa, Artificial Sequence
  Description of Artificial Sequence: Synthetic polypeptide
DEMEIVTTNPVATEQYGTVCSATDGPTEFFEGND

SEQ ID NO: 151415 - protein, 33 aa, Artificial Sequence
  Description of Artificial Sequence: Synthetic polypeptide
DEMEIVTTNPVATEQYGTVCSATDGPVEFAGDD

SEQ ID NO: 151416 - protein, 33 aa, Artificial Sequence
  Description of Artificial Sequence: Synthetic polypeptide
DEMEIVTTNPVATEQYGTVCSATDGPVEFEAND

SEQ ID NO: 151417 - protein, 33 aa, Artificial Sequence
  Description of Artificial Sequence: Synthetic polypeptide
DEMEIVTTNPVATEQYGTVCSATDGPVEFEANN

SEQ ID NO: 151418 - protein, 33 aa, Artificial Sequence
  Description of Artificial Sequence: Synthetic polypeptide
DEMEIVTTNPVATEQYGTVCSATDGPVEFEANT

SEQ ID NO: 151419 - protein, 35 aa, Artificial Sequence
  Description of Artificial Sequence: Synthetic polypeptide
DEEEISTTNPVATEQYGCVCSNTGPDQENFGSEQA

SEQ ID NO: 151420 - protein, 33 aa, Artificial Sequence
  Description of Artificial Sequence: Synthetic polypeptide
DEMEIVTTNPVATEQYGTVCSATDGPVEFECNC

SEQ ID NO: 151421 - protein, 33 aa, Artificial Sequence
  Description of Artificial Sequence: Synthetic polypeptide
DEMEIVTTNPVATEQYGTVCSATDGPVEFECND

SEQ ID NO: 151422 - protein, 33 aa, Artificial Sequence
  Description of Artificial Sequence: Synthetic polypeptide
DEMEIVTTNPVATEQYGTVCSATDGPVEFEDND

SEQ ID NO: 151423 - protein, 32 aa, Artificial Sequence
  Description of Artificial Sequence: Synthetic polypeptide
DEMEIVTTNPVATEQYGTVCSATDGPVEFEED

SEQ ID NO: 151424 - protein, 33 aa, Artificial Sequence
  Description of Artificial Sequence: Synthetic polypeptide
DEMEIVTTNPVATEQYGTVCSATDGPVEFEEND

SEQ ID NO: 151425 - protein, 33 aa, Artificial Sequence
  Description of Artificial Sequence: Synthetic polypeptide
DEMEIVTTNPVATEQYGTVCSATDGPVEFEFND

SEQ ID NO: 151426 - protein, 33 aa, Artificial Sequence
  Description of Artificial Sequence: Synthetic polypeptide
DEMEIVTTNPVATEQYGTVCSATDGPVEFEGAD

SEQ ID NO: 151427 - protein, 34 aa, Artificial Sequence
  Description of Artificial Sequence: Synthetic polypeptide
DEMEIVTTNPVATEQYGTVCSATDGPVEFEGAND

SEQ ID NO: 151428 - protein, 33 aa, Artificial Sequence
  Description of Artificial Sequence: Synthetic polypeptide
DEMEIVTTNPVATEQYGTVCSATDGPVEFEGAV

SEQ ID NO: 151429 - protein, 33 aa, Artificial Sequence
  Description of Artificial Sequence: Synthetic polypeptide
DEMEIVTTNPVATEQYGTVCSATDGPVEFEGCD

SEQ ID NO: 151430 - protein, 34 aa, Artificial Sequence
  Description of Artificial Sequence: Synthetic polypeptide
DEMEIVTTNPVATEQYGTVCSATDGPVEFEGCND

SEQ ID NO: 151431 - protein, 33 aa, Artificial Sequence
  Description of Artificial Sequence: Synthetic polypeptide
DEMEIVTTNPVATEQYGTVCSATDGPVEFEGDD

SEQ ID NO: 151432 - protein, 34 aa, Artificial Sequence
  Description of Artificial Sequence: Synthetic polypeptide
DEMEIVTTNPVATEQYGTVCSATDGPVEEFEGND

SEQ ID NO: 151433 - protein, 33 aa, Artificial Sequence
  Description of Artificial Sequence: Synthetic polypeptide
DEMEIVTTNPVATEQYGTVCSATDGPVEEEDND

SEQ ID NO: 151434 - protein, 37 aa, Artificial Sequence
  Description of Artificial Sequence: Synthetic polypeptide
DEEEISTTNPVATEQYGCVCSNTGNHNQENFGSDNQA

SEQ ID NO: 151435 - protein, 34 aa, Artificial Sequence
  Description of Artificial Sequence: Synthetic polypeptide
DEMEIVTTNPVATEQYGTVCSATDGPVEDFEGND

SEQ ID NO: 151436 - protein, 34 aa, Artificial Sequence
  Description of Artificial Sequence: Synthetic polypeptide
DEMEIVTTNPVATEQYGTVCSATDGPVAFEGNLD

SEQ ID NO: 151437 - protein, 33 aa, Artificial Sequence
  Description of Artificial Sequence: Synthetic polypeptide
DEMEIVTTNPVATEQYGTVCSATDGPVAFEGVD

SEQ ID NO: 151438 - protein, 33 aa, Artificial Sequence
  Description of Artificial Sequence: Synthetic polypeptide
DEMEIVTTNPVATEQYGTVCSATDGPVCFEGKD

SEQ ID NO: 151439 - protein, 33 aa, Artificial Sequence
  Description of Artificial Sequence: Synthetic polypeptide
DEMEIVTTNPVATEQYGTVCSATDGPVDFEGVD

SEQ ID NO: 151440 - protein, 34 aa, Artificial Sequence
  Description of Artificial Sequence: Synthetic polypeptide
DEMEIVTTNPVATEQYGTVCSATDGPVDMFEGND

SEQ ID NO: 151441 - protein, 38 aa, Artificial Sequence
  Description of Artificial Sequence: Synthetic polypeptide
DEEEIRTTNPVATEQYGVVSTVVNTNNQAGNQQNTEDE

SEQ ID NO: 151442 - protein, 34 aa, Artificial Sequence
  Description of Artificial Sequence: Synthetic polypeptide
DEMEIVTTNPVATEQYGTVCSATDGPVEACEGND

SEQ ID NO: 151443 - protein, 33 aa, Artificial Sequence
  Description of Artificial Sequence: Synthetic polypeptide
DEMEIVTTNPVATEQYGTVCSATDGPVEAEEND

SEQ ID NO: 151444 - protein, 33 aa, Artificial Sequence
  Description of Artificial Sequence: Synthetic polypeptide
DEMEIVTTNPVATEQYGTVCSATDGPTEFETND

SEQ ID NO: 151445 - protein, 33 aa, Artificial Sequence
  Description of Artificial Sequence: Synthetic polypeptide
DENEIRTTNPVSTEPYGTISSMEAIPNQQNGNH

SEQ ID NO: 151446 - protein, 35 aa, Artificial Sequence
  Description of Artificial Sequence: Synthetic polypeptide
DEAEIRTTNPVATEQYGSVCSSQISELFPHNMIDN

SEQ ID NO: 151447 - protein, 32 aa, Artificial Sequence
  Description of Artificial Sequence: Synthetic polypeptide
DENEIRTTNPVSTEPYGTISSEDIQQQQNGNH

SEQ ID NO: 151448 - protein, 32 aa, Artificial Sequence
  Description of Artificial Sequence: Synthetic polypeptide
DENEIRTTNPVSTEPYGTISSEDIQQQHNGNH

SEQ ID NO: 151449 - protein, 32 aa, Artificial Sequence
  Description of Artificial Sequence: Synthetic polypeptide
DENEIRTTNPVSTEPYGTISSEDIQIQQNGNH

SEQ ID NO: 151450 - protein, 32 aa, Artificial Sequence
  Description of Artificial Sequence: Synthetic polypeptide
DENEIRTTNPVSTEPYGTISSEDIIQEQNGNS

SEQ ID NO: 151451 - protein, 34 aa, Artificial Sequence
  Description of Artificial Sequence: Synthetic polypeptide
DEMEIVTTNPVATEQYGTVCSATDGPVEAFEGND

SEQ ID NO: 151452 - protein, 33 aa, Artificial Sequence
  Description of Artificial Sequence: Synthetic polypeptide
DEMEIVTTNPVATEQYGTVCSATDGPVECEHND

SEQ ID NO: 151453 - protein, 34 aa, Artificial Sequence
  Description of Artificial Sequence: Synthetic polypeptide
DEMEIVTTNPVATEQYGTVCSATDGPVECFEGND

SEQ ID NO: 151454 - protein, 32 aa, Artificial Sequence
  Description of Artificial Sequence: Synthetic polypeptide
DENEIRTTNPVSTEPYGTISSEMIQQQQNGNH

SEQ ID NO: 151455 - protein, 35 aa, Artificial Sequence
  Description of Artificial Sequence: Synthetic polypeptide
DEMEIVTTNPVATEQYGTVCSATPAPPNMFEGMND

SEQ ID NO: 151456 - protein, 33 aa, Artificial Sequence
  Description of Artificial Sequence: Synthetic polypeptide
DEMEIVTTNPVATEQYGTVCSATDGPVEFEGWD

SEQ ID NO: 151457 - protein, 35 aa, Artificial Sequence
  Description of Artificial Sequence: Synthetic polypeptide
DEMEIVTTNPVATEQYGTVCSATDGPVEFEGWNDR

SEQ ID NO: 151458 - protein, 34 aa, Artificial Sequence
  Description of Artificial Sequence: Synthetic polypeptide
DEMEIVTTNPVATEQYGTVCSATDGRPVEFEGND

SEQ ID NO: 151459 - protein, 34 aa, Artificial Sequence
  Description of Artificial Sequence: Synthetic polypeptide
DEMEIVTTNPVATEQYGTVCSATDGRPVQFEKND

SEQ ID NO: 151460 - protein, 34 aa, Artificial Sequence
  Description of Artificial Sequence: Synthetic polypeptide
DEMEIVTTNPVATEQYGTVCSATDGRVEMFEGND

SEQ ID NO: 151461 - protein, 37 aa, Artificial Sequence
  Description of Artificial Sequence: Synthetic polypeptide
DEEEIRTTNPVATEQYGVVSTVVNTTNLQQNEEDEED

SEQ ID NO: 151462 - protein, 34 aa, Artificial Sequence
  Description of Artificial Sequence: Synthetic polypeptide
DEMEIVTTNPVATEQYGTVCSATDGSPVEFEGND

SEQ ID NO: 151463 - protein, 34 aa, Artificial Sequence
  Description of Artificial Sequence: Synthetic polypeptide
DEMEIVTTNPVATEQYGTVCSATDGTPVEFEGND

SEQ ID NO: 151464 - protein, 34 aa, Artificial Sequence
  Description of Artificial Sequence: Synthetic polypeptide
DEMEIVTTNPVATEQYGTVCSATDGVPVEFEGND

SEQ ID NO: 151465 - protein, 34 aa, Artificial Sequence
  Description of Artificial Sequence: Synthetic polypeptide
DEMEIVTTNPVATEQYGTVCSATDGWPVEFEGND

SEQ ID NO: 151466 - protein, 34 aa, Artificial Sequence
  Description of Artificial Sequence: Synthetic polypeptide
DEMEIVTTNPVATEQYGTVCSATDGWVEFFEGND

SEQ ID NO: 151467 - protein, 34 aa, Artificial Sequence
  Description of Artificial Sequence: Synthetic polypeptide
DEMEIVTTNPVATEQYGTVCSATDGYHVEFEGND

SEQ ID NO: 151468 - protein, 34 aa, Artificial Sequence
  Description of Artificial Sequence: Synthetic polypeptide
DEMEIVTTNPVATEQYGTVCSATDGYPVEFEGND

SEQ ID NO: 151469 - protein, 34 aa, Artificial Sequence
  Description of Artificial Sequence: Synthetic polypeptide
DEMEIVTTNPVATEQYGTVCSATDGYTVEFEGND

SEQ ID NO: 151470 - protein, 32 aa, Artificial Sequence
  Description of Artificial Sequence: Synthetic polypeptide
DEMEIVTTNPVATEQYGTVCSATDIPEAEEDD

SEQ ID NO: 151471 - protein, 36 aa, Artificial Sequence
  Description of Artificial Sequence: Synthetic polypeptide
DEEEIRTTNPVATEQYGTVDDTMDNSDEGGDGGNEG

SEQ ID NO: 151472 - protein, 33 aa, Artificial Sequence
  Description of Artificial Sequence: Synthetic polypeptide
DEMEIVTTNPVATEQYGTVCSATDIPVEAEEND

SEQ ID NO: 151473 - protein, 34 aa, Artificial Sequence
  Description of Artificial Sequence: Synthetic polypeptide
DEMEIVTTNPVATEQYGTVCSATDIPVEFEGNHD

SEQ ID NO: 151474 - protein, 34 aa, Artificial Sequence
  Description of Artificial Sequence: Synthetic polypeptide
DEMEIVTTNPVATEQYGTVCSATDIPVENFEGND

SEQ ID NO: 151475 - protein, 34 aa, Artificial Sequence
  Description of Artificial Sequence: Synthetic polypeptide
DEMEIVTTNPVATEQYGTVCSATDGRGVEFEGND

SEQ ID NO: 151476 - protein, 34 aa, Artificial Sequence
  Description of Artificial Sequence: Synthetic polypeptide
DEMEIVTTNPVATEQYGTVCSATDGPYEFEGNCD

SEQ ID NO: 151477 - protein, 34 aa, Artificial Sequence
  Description of Artificial Sequence: Synthetic polypeptide
DEMEIVTTNPVATEQYGTVCSATDGPWEFEGSND

SEQ ID NO: 151478 - protein, 34 aa, Artificial Sequence
  Description of Artificial Sequence: Synthetic polypeptide
DEMEIVTTNPVATEQYGTVCSATDGPWEFEGIND

SEQ ID NO: 151479 - protein, 34 aa, Artificial Sequence
  Description of Artificial Sequence: Synthetic polypeptide
DEMEIVTTNPVATEQYGTVCSATDGPVNFEGNDC

SEQ ID NO: 151480 - protein, 33 aa, Artificial Sequence
  Description of Artificial Sequence: Synthetic polypeptide
DEMEIVTTNPVATEQYGTVCSATDGPVNFEIND

SEQ ID NO: 151481 - protein, 38 aa, Artificial Sequence
  Description of Artificial Sequence: Synthetic polypeptide
DEEEIRTTNPVATEQYGVVSTVVNTNQQAGNNQGEEDD

SEQ ID NO: 151482 - protein, 32 aa, Artificial Sequence
  Description of Artificial Sequence: Synthetic polypeptide
DEHEIRTTNPCAYEQWGEVCYNIEEKRDGNDS

SEQ ID NO: 151483 - protein, 34 aa, Artificial Sequence
  Description of Artificial Sequence: Synthetic polypeptide
DEHEIRTTNPCAYEEWGSVAWTWNDGQGGRQGNA

SEQ ID NO: 151484 - protein, 38 aa, Artificial Sequence
  Description of Artificial Sequence: Synthetic polypeptide
DEEEIRTTNPVATEQYGVVSTVVNTNQQAGNQQGNEDE

SEQ ID NO: 151485 - protein, 33 aa, Artificial Sequence
  Description of Artificial Sequence: Synthetic polypeptide
DEHEIRTTNPCAYEEWGSVATDNGNQTGSGNAE

SEQ ID NO: 151486 - protein, 37 aa, Artificial Sequence
  Description of Artificial Sequence: Synthetic polypeptide
DEEEIRTTNPVATEQYGVVSTVVNTNQQQGEEDETED

SEQ ID NO: 151487 - protein, 34 aa, Artificial Sequence
  Description of Artificial Sequence: Synthetic polypeptide
DEMEIVTTNPVATEQYGTVCSATDIPVMNFEGNA

SEQ ID NO: 151488 - protein, 38 aa, Artificial Sequence
  Description of Artificial Sequence: Synthetic polypeptide
DEEEIRTTNPVATEQYGVVSTVVNTNQQQGNNQEDEDE

SEQ ID NO: 151489 - protein, 38 aa, Artificial Sequence
  Description of Artificial Sequence: Synthetic polypeptide
DEEEIRTTNPVATEQYGVVSTVVNTQAGNNDTEENEAT

SEQ ID NO: 151490 - protein, 34 aa, Artificial Sequence
  Description of Artificial Sequence: Synthetic polypeptide
DEMEIVTTNPVATEQYGTVCSATDGPVSFEGNWD

SEQ ID NO: 151491 - protein, 38 aa, Artificial Sequence
  Description of Artificial Sequence: Synthetic polypeptide
DEEEIRTTNPVATEQYGVVSTVVNTQQGNNQQGNNNED

SEQ ID NO: 151492 - protein, 38 aa, Artificial Sequence
  Description of Artificial Sequence: Synthetic polypeptide
DEEEIRTTNPVATEQYGVVSTVVNTQQGNQAGTEEGED

SEQ ID NO: 151493 - protein, 38 aa, Artificial Sequence
  Description of Artificial Sequence: Synthetic polypeptide
DEEEIRTTNPVATEQYGVVSTVVNTQQGNQQGNTTDDD

SEQ ID NO: 151494 - protein, 33 aa, Artificial Sequence
  Description of Artificial Sequence: Synthetic polypeptide
DEMEIVTTNPVATEQYGTVCSATDGPVSFEGQD

SEQ ID NO: 151495 - protein, 34 aa, Artificial Sequence
  Description of Artificial Sequence: Synthetic polypeptide
DEMEIVTTNPVATEQYGTVCSATDGPVYFEGNDK

SEQ ID NO: 151496 - protein, 38 aa, Artificial Sequence
  Description of Artificial Sequence: Synthetic polypeptide
DEEEIRTTNPVATEQYGVVSTVVNTQQGNQQIGTTEDE

SEQ ID NO: 151497 - protein, 38 aa, Artificial Sequence
  Description of Artificial Sequence: Synthetic polypeptide
DEEEIRTTNPVATEQYGVVSTVVNTQAGNNDTEEENEA

SEQ ID NO: 151498 - protein, 34 aa, Artificial Sequence
  Description of Artificial Sequence: Synthetic polypeptide
DEMEIVTTNPVATEQYGTVCSATDGPVMFEGWND

SEQ ID NO: 151499 - protein, 35 aa, Artificial Sequence
  Description of Artificial Sequence: Synthetic polypeptide
DEHEIRTTNPCATECYGVVCYKTNDEGQRNGDNDV

SEQ ID NO: 151500 - protein, 35 aa, Artificial Sequence
  Description of Artificial Sequence: Synthetic polypeptide
DEEEISTTNPVATEQYGCVCSNWGEHNQNFGSNQA

SEQ ID NO: 151501 - protein, 34 aa, Artificial Sequence
  Description of Artificial Sequence: Synthetic polypeptide
DEMEIVTTNPVATEQYGTVCSATFGHPVEFEGND

SEQ ID NO: 151502 - protein, 33 aa, Artificial Sequence
  Description of Artificial Sequence: Synthetic polypeptide
DEMEIVTTNPVATEQYGTVCSATFGPVEFEGCD

SEQ ID NO: 151503 - protein, 38 aa, Artificial Sequence
  Description of Artificial Sequence: Synthetic polypeptide
DEEEIRTTNPVATEQYGTVATVQGNNNLQQGTEEGNND

SEQ ID NO: 151504 - protein, 33 aa, Artificial Sequence
  Description of Artificial Sequence: Synthetic polypeptide
DEHEIRTTNPCATECYGSVATGNTGNAGETDAQ

SEQ ID NO: 151505 - protein, 38 aa, Artificial Sequence
  Description of Artificial Sequence: Synthetic polypeptide
DEEEIRTTNPVATEQYGTVATQNGNNNLQQGTEEGTND

SEQ ID NO: 151506 - protein, 34 aa, Artificial Sequence
  Description of Artificial Sequence: Synthetic polypeptide
DEMEIVTTNPVATEQYGTVCSATKGPVEFEGNED

SEQ ID NO: 151507 - protein, 34 aa, Artificial Sequence
  Description of Artificial Sequence: Synthetic polypeptide
DEMEIVTTNPVATEQYGTVCSATLGCPVEFEGND

SEQ ID NO: 151508 - protein, 34 aa, Artificial Sequence
  Description of Artificial Sequence: Synthetic polypeptide
DEMEIVTTNPVATEQYGTVCSATLGPVEHFEGND

SEQ ID NO: 151509 - protein, 35 aa, Artificial Sequence
  Description of Artificial Sequence: Synthetic polypeptide
DEEEISTTNPVATEQYGCVCSNWNDHQEHFGSEQA

SEQ ID NO: 151510 - protein, 34 aa, Artificial Sequence
  Description of Artificial Sequence: Synthetic polypeptide
DEMEIVTTNPVATEQYGTVCSATLGPVETEGVND

SEQ ID NO: 151511 - protein, 34 aa, Artificial Sequence
  Description of Artificial Sequence: Synthetic polypeptide
DEMEIVTTNPVATEQYGTVCSATMGPVEFEGNFD

SEQ ID NO: 151512 - protein, 33 aa, Artificial Sequence
  Description of Artificial Sequence: Synthetic polypeptide
DEHEIRTTNPCATECYGSVATGNTGNAGEMKGE

SEQ ID NO: 151513 - protein, 34 aa, Artificial Sequence
  Description of Artificial Sequence: Synthetic polypeptide
DEMEIVTTNPVATEQYGTVCSATMGWPVEFEGND

SEQ ID NO: 151514 - protein, 37 aa, Artificial Sequence
  Description of Artificial Sequence: Synthetic polypeptide
DEEEIRTTNPVATEQYGVVSTVVSNNNQNETNNDENQ

SEQ ID NO: 151515 - protein, 33 aa, Artificial Sequence
  Description of Artificial Sequence: Synthetic polypeptide
DEAEIATTNPVAYEQYGSVATAGTQTRNPDEAL

SEQ ID NO: 151516 - protein, 34 aa, Artificial Sequence
  Description of Artificial Sequence: Synthetic polypeptide
DEEEISTTNPVATEQYGCVCSNWPPQENFNSDQL

SEQ ID NO: 151517 - protein, 35 aa, Artificial Sequence
  Description of Artificial Sequence: Synthetic polypeptide
DEEEISTTNPVATEQYGCVCSSEDHQENFGSDNQS

SEQ ID NO: 151518 - protein, 34 aa, Artificial Sequence
  Description of Artificial Sequence: Synthetic polypeptide
DEMEIVTTNPVATEQYGTVCSATDYPVENFEGND

SEQ ID NO: 151519 - protein, 33 aa, Artificial Sequence
  Description of Artificial Sequence: Synthetic polypeptide
DEMEIVTTNPVATEQYGTVCSATDYPVEFEGTD

SEQ ID NO: 151520 - protein, 34 aa, Artificial Sequence
  Description of Artificial Sequence: Synthetic polypeptide
DEMEIVTTNPVATEQYGTVCSATDYPVEFEGNDG

SEQ ID NO: 151521 - protein, 34 aa, Artificial Sequence
  Description of Artificial Sequence: Synthetic polypeptide
DEMEIVTTNPVATEQYGTVCSATDWPVEFEGNDV

SEQ ID NO: 151522 - protein, 38 aa, Artificial Sequence
  Description of Artificial Sequence: Synthetic polypeptide
DEEEIRTTNPVATEQYGVVSTVVSNLQAGISEEGSVED

SEQ ID NO: 151523 - protein, 39 aa, Artificial Sequence
  Description of Artificial Sequence: Synthetic polypeptide
DEEEIRTTNPVATEQYGVVSTVVSNLQQAGNSEEGSVND

SEQ ID NO: 151524 - protein, 38 aa, Artificial Sequence
  Description of Artificial Sequence: Synthetic polypeptide
DEEEIRTTNPVATEQYGVVSTVVSNLQQGTEQGTEEDE

SEQ ID NO: 151525 - protein, 39 aa, Artificial Sequence
  Description of Artificial Sequence: Synthetic polypeptide
DEEEIRTTNPVATEQYGVVSTVVSNNLQQLGNNDEEEED

SEQ ID NO: 151526 - protein, 34 aa, Artificial Sequence
  Description of Artificial Sequence: Synthetic polypeptide
DEMEIVTTNPVATEQYGTVCSATDIPVMNFEGND

SEQ ID NO: 151527 - protein, 34 aa, Artificial Sequence
  Description of Artificial Sequence: Synthetic polypeptide
DEEEISTTNPVATEQYGCVCSNWGEHQHFGSQQG

SEQ ID NO: 151528 - protein, 33 aa, Artificial Sequence
  Description of Artificial Sequence: Synthetic polypeptide
DEMEIVTTNPVATEQYGTVCSATDMPVEFEQND

SEQ ID NO: 151529 - protein, 35 aa, Artificial Sequence
  Description of Artificial Sequence: Synthetic polypeptide
DEEEISTTNPVATEQYGCVCSNWGELNQNFGSDQS

SEQ ID NO: 151530 - protein, 38 aa, Artificial Sequence
  Description of Artificial Sequence: Synthetic polypeptide
DEEEIRTTNPVATEQYGVVSTVVSNGNQQQGTNNTEES

SEQ ID NO: 151531 - protein, 39 aa, Artificial Sequence
  Description of Artificial Sequence: Synthetic polypeptide
DEEEIRTTNPVATEQYGVVSTVVSNNLQQLGNQDETTED

SEQ ID NO: 151532 - protein, 34 aa, Artificial Sequence
  Description of Artificial Sequence: Synthetic polypeptide
DEEEISTTNPVATEQYGCVCSNWGYHQNFNSDQY

SEQ ID NO: 151533 - protein, 34 aa, Artificial Sequence
  Description of Artificial Sequence: Synthetic polypeptide
DEMEIVTTNPVATEQYGTVCSATDPPVEFEGNKD

SEQ ID NO: 151534 - protein, 35 aa, Artificial Sequence
  Description of Artificial Sequence: Synthetic polypeptide
DEMEIVTTNPVATEQYGTVCSATDPPVEQFEGNHD

SEQ ID NO: 151535 - protein, 33 aa, Artificial Sequence
  Description of Artificial Sequence: Synthetic polypeptide
DEMEIVTTNPVATEQYGTVCSATDRPVEFEWND

SEQ ID NO: 151536 - protein, 34 aa, Artificial Sequence
  Description of Artificial Sequence: Synthetic polypeptide
DEMEIVTTNPVATEQYGTVCSATDSPVEFEGQND

SEQ ID NO: 151537 - protein, 33 aa, Artificial Sequence
  Description of Artificial Sequence: Synthetic polypeptide
DEMEIVTTNPVATEQYGTVCSATDSPVEFETND

SEQ ID NO: 151538 - protein, 35 aa, Artificial Sequence
  Description of Artificial Sequence: Synthetic polypeptide
DEEEISTTNPVATEQYGCVCSNWMEDQNFGSENQS

SEQ ID NO: 151539 - protein, 34 aa, Artificial Sequence
  Description of Artificial Sequence: Synthetic polypeptide
DEMEIVTTNPVATEQYGTVCSATDVPVEVFEGND

SEQ ID NO: 151540 - protein, 37 aa, Artificial Sequence
  Description of Artificial Sequence: Synthetic polypeptide
DEEEIRTTNPVATEQYGVVSTVVSNNNDEAGNTEQGS

SEQ ID NO: 151541 - protein, 34 aa, Artificial Sequence
  Description of Artificial Sequence: Synthetic polypeptide
DEMEIVTTNPVATEQYGTVCSATDGPVEFEGWND

SEQ ID NO: 151542 - protein, 33 aa, Artificial Sequence
  Description of Artificial Sequence: Synthetic polypeptide
DEMEIVTTNPVATEQYGTVCSATDGPVKFEIND

SEQ ID NO: 151543 - protein, 33 aa, Artificial Sequence
  Description of Artificial Sequence: Synthetic polypeptide
DEMEIVTTNPVATEQYGTVCSATDGPVKFEGAD

SEQ ID NO: 151544 - protein, 33 aa, Artificial Sequence
  Description of Artificial Sequence: Synthetic polypeptide
DEMEIVTTNPVATEQYGTVCSATDGPVEFFGKD

SEQ ID NO: 151545 - protein, 34 aa, Artificial Sequence
  Description of Artificial Sequence: Synthetic polypeptide
DEEEISTTNPVATEQYGCVCSNWEHNQHFNSQQS

SEQ ID NO: 151546 - protein, 34 aa, Artificial Sequence
  Description of Artificial Sequence: Synthetic polypeptide
DEEEISTTNPVATEQYGCVCSNWEHNQNFGSDQS

SEQ ID NO: 151547 - protein, 34 aa, Artificial Sequence
  Description of Artificial Sequence: Synthetic polypeptide
DEMEIVTTNPVATEQYGTVCSATDGPVEFFGNDN

SEQ ID NO: 151548 - protein, 34 aa, Artificial Sequence
  Description of Artificial Sequence: Synthetic polypeptide
DEEEISTTNPVATEQYGCVCSNWEHNQNFGSQQG

SEQ ID NO: 151549 - protein, 38 aa, Artificial Sequence
  Description of Artificial Sequence: Synthetic polypeptide
DEEEIRTTNPVATEQYGVVSTVVNTNNQLQQGEEEEET

SEQ ID NO: 151550 - protein, 34 aa, Artificial Sequence
  Description of Artificial Sequence: Synthetic polypeptide
DEEEISTTNPVATEQYGCVCSNWEHQENFFSNQG

SEQ ID NO: 151551 - protein, 34 aa, Artificial Sequence
  Description of Artificial Sequence: Synthetic polypeptide
DEEEISTTNPVATEQYGCVCSNWEHQESFGSDQG

SEQ ID NO: 151552 - protein, 34 aa, Artificial Sequence
  Description of Artificial Sequence: Synthetic polypeptide
DEEEISTTNPVATEQYGCVCSNWEHQNFGSDDQN

SEQ ID NO: 151553 - protein, 34 aa, Artificial Sequence
  Description of Artificial Sequence: Synthetic polypeptide
DEMEIVTTNPVATEQYGTVCSATDGPVEFFGNDY

SEQ ID NO: 151554 - protein, 34 aa, Artificial Sequence
  Description of Artificial Sequence: Synthetic polypeptide
DEEEISTTNPVATEQYGCVCSNWEHQNFGSQFQG

SEQ ID NO: 151555 - protein, 34 aa, Artificial Sequence
  Description of Artificial Sequence: Synthetic polypeptide
DEEEISTTNPVATEQYGCVCSNWEPNQNFNSDQS

SEQ ID NO: 151556 - protein, 34 aa, Artificial Sequence
  Description of Artificial Sequence: Synthetic polypeptide
DEMEIVTTNPVATEQYGTVCSATDGPVEFHGNDW

SEQ ID NO: 151557 - protein, 34 aa, Artificial Sequence
  Description of Artificial Sequence: Synthetic polypeptide
DEMEIVTTNPVATEQYGTVCSATDGPVEFIGAND

SEQ ID NO: 151558 - protein, 34 aa, Artificial Sequence
  Description of Artificial Sequence: Synthetic polypeptide
DEMEIVTTNPVATEQYGTVCSATDGPVEFIGNDD

SEQ ID NO: 151559 - protein, 33 aa, Artificial Sequence
  Description of Artificial Sequence: Synthetic polypeptide
DEMEIVTTNPVATEQYGTVCSATDGPVEFKKND

SEQ ID NO: 151560 - protein, 38 aa, Artificial Sequence
  Description of Artificial Sequence: Synthetic polypeptide
DEEEIRTTNPVATEQYGVVSTVVNTNNQQQGTNEQGSE

SEQ ID NO: 151561 - protein, 34 aa, Artificial Sequence
  Description of Artificial Sequence: Synthetic polypeptide
DEMEIVTTNPVATEQYGTVCSATDGPVEFFEGND

SEQ ID NO: 151562 - protein, 33 aa, Artificial Sequence
  Description of Artificial Sequence: Synthetic polypeptide
DEMEIVTTNPVATEQYGTVCSATDGPVEFEYND

SEQ ID NO: 151563 - protein, 33 aa, Artificial Sequence
  Description of Artificial Sequence: Synthetic polypeptide
DEMEIVTTNPVATEQYGTVCSATDGPVEFEWND

SEQ ID NO: 151564 - protein, 33 aa, Artificial Sequence
  Description of Artificial Sequence: Synthetic polypeptide
DEMEIVTTNPVATEQYGTVCSATDGPVEFEVND

SEQ ID NO: 151565 - protein, 33 aa, Artificial Sequence
  Description of Artificial Sequence: Synthetic polypeptide
DEMEIVTTNPVATEQYGTVCSATDGPVEFEGYD

SEQ ID NO: 151566 - protein, 33 aa, Artificial Sequence
  Description of Artificial Sequence: Synthetic polypeptide
DEMEIVTTNPVATEQYGTVCSATDGPVEFEGYL

SEQ ID NO: 151567 - protein, 34 aa, Artificial Sequence
  Description of Artificial Sequence: Synthetic polypeptide
DEMEIVTTNPVATEQYGTVCSATDGPVEFEGYND

SEQ ID NO: 151568 - protein, 33 aa, Artificial Sequence
  Description of Artificial Sequence: Synthetic polypeptide
DEMEIVTTNPVATEQYGTVCSATDGPVEFEHND

SEQ ID NO: 151569 - protein, 33 aa, Artificial Sequence
  Description of Artificial Sequence: Synthetic polypeptide
DEMEIVTTNPVATEQYGTVCSATDGPVEFEIND

SEQ ID NO: 151570 - protein, 33 aa, Artificial Sequence
  Description of Artificial Sequence: Synthetic polypeptide
DEMEIVTTNPVATEQYGTVCSATDGPVEFEKND

SEQ ID NO: 151571 - protein, 33 aa, Artificial Sequence
  Description of Artificial Sequence: Synthetic polypeptide
DEMEIVTTNPVATEQYGTVCSATDGPVEFEKNP

SEQ ID NO: 151572 - protein, 33 aa, Artificial Sequence
  Description of Artificial Sequence: Synthetic polypeptide
DEMEIVTTNPVATEQYGTVCSATDGPVEFELND

SEQ ID NO: 151573 - protein, 33 aa, Artificial Sequence
  Description of Artificial Sequence: Synthetic polypeptide
DEHEIRTTNPCAYEQWGSVPTWENDQANGGGEG

SEQ ID NO: 151574 - protein, 33 aa, Artificial Sequence
  Description of Artificial Sequence: Synthetic polypeptide
DEMEIVTTNPVATEQYGTVCSATDGPVEFEMND

SEQ ID NO: 151575 - protein, 35 aa, Artificial Sequence
  Description of Artificial Sequence: Synthetic polypeptide
DEEEISTTNPVATEQYGCVCSNWEEHNQNFGSNQS

SEQ ID NO: 151576 - protein, 33 aa, Artificial Sequence
  Description of Artificial Sequence: Synthetic polypeptide
DEMEIVTTNPVATEQYGTVCSATDGPVEFEPND

SEQ ID NO: 151577 - protein, 33 aa, Artificial Sequence
  Description of Artificial Sequence: Synthetic polypeptide
DEMEIVTTNPVATEQYGTVCSATDGPVEFEQND

SEQ ID NO: 151578 - protein, 33 aa, Artificial Sequence
  Description of Artificial Sequence: Synthetic polypeptide
DEMEIVTTNPVATEQYGTVCSATDGPVEFEQNS

SEQ ID NO: 151579 - protein, 33 aa, Artificial Sequence
  Description of Artificial Sequence: Synthetic polypeptide
DEMEIVTTNPVATEQYGTVCSATDGPVEFERND

SEQ ID NO: 151580 - protein, 33 aa, Artificial Sequence
  Description of Artificial Sequence: Synthetic polypeptide
DEMEIVTTNPVATEQYGTVCSATDGPVEFESND

SEQ ID NO: 151581 - protein, 34 aa, Artificial Sequence
  Description of Artificial Sequence: Synthetic polypeptide
DEEEISTTNPVATEQYGCVCSNWEHEYFGSDNQP

SEQ ID NO: 151582 - protein, 33 aa, Artificial Sequence
  Description of Artificial Sequence: Synthetic polypeptide
DEMEIVTTNPVATEQYGTVCSATDGPVEFETND

SEQ ID NO: 151583 - protein, 33 aa, Artificial Sequence
  Description of Artificial Sequence: Synthetic polypeptide
DEMEIVTTNPVATEQYGTVCSATDGPVEFENND

SEQ ID NO: 151584 - protein, 34 aa, Artificial Sequence
  Description of Artificial Sequence: Synthetic polypeptide
DEMEIVTTNPVATEQYGTVCSATDGPVKFEGPND

SEQ ID NO: 151585 - protein, 33 aa, Artificial Sequence
  Description of Artificial Sequence: Synthetic polypeptide
DEMEIVTTNPVATEQYGTVCSATDGPVEFTGTD

SEQ ID NO: 151586 - protein, 34 aa, Artificial Sequence
  Description of Artificial Sequence: Synthetic polypeptide
DEMEIVTTNPVATEQYGTVCSATDGPVEGFEGND

SEQ ID NO: 151587 - protein, 34 aa, Artificial Sequence
  Description of Artificial Sequence: Synthetic polypeptide
DEMEIVTTNPVATEQYGTVCSATDGPVEQFEGVD

SEQ ID NO: 151588 - protein, 35 aa, Artificial Sequence
  Description of Artificial Sequence: Synthetic polypeptide
DEMEIVTTNPVATEQYGTVCSATDGPVEQFEGYND

SEQ ID NO: 151589 - protein, 37 aa, Artificial Sequence
  Description of Artificial Sequence: Synthetic polypeptide
DEEEIRTTNPVATEQYGTVQINDNTNLIEQHQVTMNE

SEQ ID NO: 151590 - protein, 35 aa, Artificial Sequence
  Description of Artificial Sequence: Synthetic polypeptide
DEMEIVTTNPVATEQYGTVCSATDGPVERFEGNND

SEQ ID NO: 151591 - protein, 34 aa, Artificial Sequence
  Description of Artificial Sequence: Synthetic polypeptide
DEMEIVTTNPVATEQYGTVCSATDGPVERFEGSD

SEQ ID NO: 151592 - protein, 34 aa, Artificial Sequence
  Description of Artificial Sequence: Synthetic polypeptide
DEMEIVTTNPVATEQYGTVCSATDGPVESFEGND

SEQ ID NO: 151593 - protein, 34 aa, Artificial Sequence
  Description of Artificial Sequence: Synthetic polypeptide
DEMEIVTTNPVATEQYGTVCSATDGPVETFEGND

SEQ ID NO: 151594 - protein, 34 aa, Artificial Sequence
  Description of Artificial Sequence: Synthetic polypeptide
DEMEIVTTNPVATEQYGTVCSATDGPVEVEGVND

SEQ ID NO: 151595 - protein, 34 aa, Artificial Sequence
  Description of Artificial Sequence: Synthetic polypeptide
DEMEIVTTNPVATEQYGTVCSATDGPVEVFEGND

SEQ ID NO: 151596 - protein, 34 aa, Artificial Sequence
  Description of Artificial Sequence: Synthetic polypeptide
DEMEIVTTNPVATEQYGTVCSATDGPVEWFEGND

SEQ ID NO: 151597 - protein, 38 aa, Artificial Sequence
  Description of Artificial Sequence: Synthetic polypeptide
DEEEIRTTNPVATEQYGVVSTVVNTNQNDEQGGNNNQD

SEQ ID NO: 151598 - protein, 33 aa, Artificial Sequence
  Description of Artificial Sequence: Synthetic polypeptide
DEMEIVTTNPVATEQYGTVCSATDGPVEYEFND

SEQ ID NO: 151599 - protein, 34 aa, Artificial Sequence
  Description of Artificial Sequence: Synthetic polypeptide
DEMEIVTTNPVATEQYGTVCSATDGPVEYFEGND

SEQ ID NO: 151600 - protein, 33 aa, Artificial Sequence
  Description of Artificial Sequence: Synthetic polypeptide
DEMEIVTTNPVATEQYGTVCSATDGPVFFEGDD

SEQ ID NO: 151601 - protein, 34 aa, Artificial Sequence
  Description of Artificial Sequence: Synthetic polypeptide
DEMEIVTTNPVATEQYGTVCSATDGPVGFEGNDD

SEQ ID NO: 151602 - protein, 33 aa, Artificial Sequence
  Description of Artificial Sequence: Synthetic polypeptide
DEMEIVTTNPVATEQYGTVCSATDGPVIFEVND

SEQ ID NO: 151603 - protein, 34 aa, Artificial Sequence
  Description of Artificial Sequence: Synthetic polypeptide
DEMEIVTTNPVATEQYGTVCSATDGPVKAFEGND

SEQ ID NO: 151604 - protein, 34 aa, Artificial Sequence
  Description of Artificial Sequence: Synthetic polypeptide
DEEEISTTNPVATEQYGCVCSNWGEDQNFNSEQA

SEQ ID NO: 151605 - protein, 34 aa, Artificial Sequence
  Description of Artificial Sequence: Synthetic polypeptide
DEEEISTTNPVATEQYGCVCSNWGEDQNFGSDQS

SEQ ID NO: 151606 - protein, 35 aa, Artificial Sequence
  Description of Artificial Sequence: Synthetic polypeptide
DEMEIVTTNPVATEQYGTVCSATDGPVEQFEGNYD

SEQ ID NO: 151607 - protein, 35 aa, Artificial Sequence
  Description of Artificial Sequence: Synthetic polypeptide
DEMEIVTTNPVATEQYGTVCSATDGPVEQFEGNDD

SEQ ID NO: 151608 - protein, 33 aa, Artificial Sequence
  Description of Artificial Sequence: Synthetic polypeptide
DEMEIVTTNPVATEQYGTVCSATDGPVEHEGGD

SEQ ID NO: 151609 - protein, 32 aa, Artificial Sequence
  Description of Artificial Sequence: Synthetic polypeptide
DEHEIRTTNPCAYEQWGSVCYNIEEKRDGQDD

SEQ ID NO: 151610 - protein, 34 aa, Artificial Sequence
  Description of Artificial Sequence: Synthetic polypeptide
DEMEIVTTNPVATEQYGTVCSATDGPVEHEGNLD

SEQ ID NO: 151611 - protein, 34 aa, Artificial Sequence
  Description of Artificial Sequence: Synthetic polypeptide
DEMEIVTTNPVATEQYGTVCSATDGPVEHFEGND

SEQ ID NO: 151612 - protein, 34 aa, Artificial Sequence
  Description of Artificial Sequence: Synthetic polypeptide
DEMEIVTTNPVATEQYGTVCSATDGPVEIFEGND

SEQ ID NO: 151613 - protein, 34 aa, Artificial Sequence
  Description of Artificial Sequence: Synthetic polypeptide
DEMEIVTTNPVATEQYGTVCSATDGPVEKEGNYD

SEQ ID NO: 151614 - protein, 34 aa, Artificial Sequence
  Description of Artificial Sequence: Synthetic polypeptide
DEMEIVTTNPVATEQYGTVCSATDGPVEKFEGND

SEQ ID NO: 151615 - protein, 34 aa, Artificial Sequence
  Description of Artificial Sequence: Synthetic polypeptide
DEMEIVTTNPVATEQYGTVCSATDGPVEMFEGND

SEQ ID NO: 151616 - protein, 34 aa, Artificial Sequence
  Description of Artificial Sequence: Synthetic polypeptide
DEMEIVTTNPVATEQYGTVCSATDGPVEFYGNWD

SEQ ID NO: 151617 - protein, 34 aa, Artificial Sequence
  Description of Artificial Sequence: Synthetic polypeptide
DEMEIVTTNPVATEQYGTVCSATDGPVEMLEGND

SEQ ID NO: 151618 - protein, 34 aa, Artificial Sequence
  Description of Artificial Sequence: Synthetic polypeptide
DEMEIVTTNPVATEQYGTVCSATDGPVENFEGND

SEQ ID NO: 151619 - protein, 33 aa, Artificial Sequence
  Description of Artificial Sequence: Synthetic polypeptide
DEMEIVTTNPVATEQYGTVCSATDGPVEPEGPD

SEQ ID NO: 151620 - protein, 33 aa, Artificial Sequence
  Description of Artificial Sequence: Synthetic polypeptide
DEMEIVTTNPVATEQYGTVCSATDGPVEPESND

SEQ ID NO: 151621 - protein, 34 aa, Artificial Sequence
  Description of Artificial Sequence: Synthetic polypeptide
DEMEIVTTNPVATEQYGTVCSATDGPVEPFEGND

SEQ ID NO: 151622 - protein, 34 aa, Artificial Sequence
  Description of Artificial Sequence: Synthetic polypeptide
DEMEIVTTNPVATEQYGTVCSATDGPVEPFIGND

SEQ ID NO: 151623 - protein, 34 aa, Artificial Sequence
  Description of Artificial Sequence: Synthetic polypeptide
DEMEIVTTNPVATEQYGTVCSATDGPVEPFLGND

SEQ ID NO: 151624 - protein, 35 aa, Artificial Sequence
  Description of Artificial Sequence: Synthetic polypeptide
DEEEIRTTNPVATEQYGTVQNITMGEEQPEGEVEI

SEQ ID NO: 151625 - protein, 35 aa, Artificial Sequence
  Description of Artificial Sequence: Synthetic polypeptide
DEMEIVTTNPVATEQYGTVCSATDGPVEQFEGKND

SEQ ID NO: 151626 - protein, 33 aa, Artificial Sequence
  Description of Artificial Sequence: Synthetic polypeptide
DEMEIVTTNPVATEQYGTVCSATDGPVENECND

SEQ ID NO: 151627 - protein, 34 aa, Artificial Sequence
  Description of Artificial Sequence: Synthetic polypeptide
DEMEIVTTNPVATEQYGTVCSATDGIPVEFEGND

SEQ ID NO: 151628 - protein, 33 aa, Artificial Sequence
  Description of Artificial Sequence: Synthetic polypeptide
DEHEIATTNPVAYEQWGSTSTNPNGNGMGGNEN

SEQ ID NO: 151629 - protein, 36 aa, Artificial Sequence
  Description of Artificial Sequence: Synthetic polypeptide
DEEEIRTTNPVAYEQWGSVSGGEPAGPNMQNGNGIV

SEQ ID NO: 151630 - protein, 32 aa, Artificial Sequence
  Description of Artificial Sequence: Synthetic polypeptide
DENEIRTTNPVSTEPYGTISMEDIKQQQNGNH

SEQ ID NO: 151631 - protein, 32 aa, Artificial Sequence
  Description of Artificial Sequence: Synthetic polypeptide
DENEIRTTNPVSTEPYGTISMEDIKQFQNGNH

SEQ ID NO: 151632 - protein, 32 aa, Artificial Sequence
  Description of Artificial Sequence: Synthetic polypeptide
DENEIRTTNPVSTEPYGTISMEDIIQQTNGNT

SEQ ID NO: 151633 - protein, 32 aa, Artificial Sequence
  Description of Artificial Sequence: Synthetic polypeptide
DENEIRTTNPVSTEPYGTISMEDIIQQQNGNH

SEQ ID NO: 151634 - protein, 32 aa, Artificial Sequence
  Description of Artificial Sequence: Synthetic polypeptide
DENEIRTTNPVSTEPYGTISMEDIIQEQTGNH

SEQ ID NO: 151635 - protein, 32 aa, Artificial Sequence
  Description of Artificial Sequence: Synthetic polypeptide
DENEIRTTNPVSTEPYGTISMEDIHQQQNGNH

SEQ ID NO: 151636 - protein, 32 aa, Artificial Sequence
  Description of Artificial Sequence: Synthetic polypeptide
DENEIRTTNPVSTEPYGTISMEDIGQQQNGNH

SEQ ID NO: 151637 - protein, 32 aa, Artificial Sequence
  Description of Artificial Sequence: Synthetic polypeptide
DENEIRTTNPVSTEPYGTISMEDIFQQQNGNH

SEQ ID NO: 151638 - protein, 32 aa, Artificial Sequence
  Description of Artificial Sequence: Synthetic polypeptide
DENEIRTTNPVSTEPYGTISMEDIEQQQNGNQ

SEQ ID NO: 151639 - protein, 32 aa, Artificial Sequence
  Description of Artificial Sequence: Synthetic polypeptide
DENEIRTTNPVSTEPYGTISMEDIEQQQNGNH

SEQ ID NO: 151640 - protein, 32 aa, Artificial Sequence
  Description of Artificial Sequence: Synthetic polypeptide
DENEIRTTNPVSTEPYGTISMEDIDQQQNGNH

SEQ ID NO: 151641 - protein, 32 aa, Artificial Sequence
  Description of Artificial Sequence: Synthetic polypeptide
DENEIRTTNPVSTEPYGTISMEDIDQQQNGND

SEQ ID NO: 151642 - protein, 32 aa, Artificial Sequence
  Description of Artificial Sequence: Synthetic polypeptide
DENEIRTTNPVSTEPYGTISMEDIDQQMNGNH

SEQ ID NO: 151643 - protein, 32 aa, Artificial Sequence
  Description of Artificial Sequence: Synthetic polypeptide
DENEIRTTNPVSTEPYGTISMEDICQQQNGNH

SEQ ID NO: 151644 - protein, 32 aa, Artificial Sequence
  Description of Artificial Sequence: Synthetic polypeptide
DENEIRTTNPVSTEPYGTISMEDIAQQSNGNH

SEQ ID NO: 151645 - protein, 32 aa, Artificial Sequence
  Description of Artificial Sequence: Synthetic polypeptide
DENEIRTTNPVSTEPYGTISMEDIAQQQNGRH

SEQ ID NO: 151646 - protein, 31 aa, Artificial Sequence
  Description of Artificial Sequence: Synthetic polypeptide
DEHCISTTNPVAYEQWGCFSVDNQDFNKGNR

SEQ ID NO: 151647 - protein, 32 aa, Artificial Sequence
  Description of Artificial Sequence: Synthetic polypeptide
DENEIRTTNPVSTEPYGTISMEDIKQQQNGNL

SEQ ID NO: 151648 - protein, 32 aa, Artificial Sequence
  Description of Artificial Sequence: Synthetic polypeptide
DENEIRTTNPVSTEPYGTISMEDIMQQQNGNH

SEQ ID NO: 151649 - protein, 32 aa, Artificial Sequence
  Description of Artificial Sequence: Synthetic polypeptide
DENEIRTTNPVSTEPYGTISMEDIPQQQNGNE

SEQ ID NO: 151650 - protein, 32 aa, Artificial Sequence
  Description of Artificial Sequence: Synthetic polypeptide
DENEIRTTNPVSTEPYGTISMEDIPQQQNGNH

SEQ ID NO: 151651 - protein, 31 aa, Artificial Sequence
  Description of Artificial Sequence: Synthetic polypeptide
DEHEIACTNPVATEQWGCVSEGEMNAAEDNA

SEQ ID NO: 151652 - protein, 32 aa, Artificial Sequence
  Description of Artificial Sequence: Synthetic polypeptide
DENEIRTTNPVSTEPYGTISMEDIQMQNNGNH

SEQ ID NO: 151653 - protein, 36 aa, Artificial Sequence
  Description of Artificial Sequence: Synthetic polypeptide
DEAEIRTTNPVATEQYGSVCSPPIALETGYMEDMND

SEQ ID NO: 151654 - protein, 32 aa, Artificial Sequence
  Description of Artificial Sequence: Synthetic polypeptide
DENEIRTTNPVSTEPYGTISMEDIQKQQNGNH

SEQ ID NO: 151655 - protein, 39 aa, Artificial Sequence
  Description of Artificial Sequence: Synthetic polypeptide
DEEEIRTTNPVATEQYGVVSTVVTNLQGNQEQGNNEQGS

SEQ ID NO: 151656 - protein, 32 aa, Artificial Sequence
  Description of Artificial Sequence: Synthetic polypeptide
DENEIRTTNPVSTEPYGTISMEDIQIQQNGNH

SEQ ID NO: 151657 - protein, 32 aa, Artificial Sequence
  Description of Artificial Sequence: Synthetic polypeptide
DENEIRTTNPVSTEPYGTISMEDIQHQQNGNH

SEQ ID NO: 151658 - protein, 32 aa, Artificial Sequence
  Description of Artificial Sequence: Synthetic polypeptide
DENEIRTTNPVSTEPYGTISMEDIQGVQNGNH

SEQ ID NO: 151659 - protein, 32 aa, Artificial Sequence
  Description of Artificial Sequence: Synthetic polypeptide
DENEIRTTNPVSTEPYGTISMEDIAQQQNGNH

SEQ ID NO: 151660 - protein, 31 aa, Artificial Sequence
  Description of Artificial Sequence: Synthetic polypeptide
DEHCISTTNPVAYEQWGCFSWDNLDKDNGND

SEQ ID NO: 151661 - protein, 32 aa, Artificial Sequence
  Description of Artificial Sequence: Synthetic polypeptide
DENEIRTTNPVSTEPYGTISMEDIQFQQNGNH

SEQ ID NO: 151662 - protein, 32 aa, Artificial Sequence
  Description of Artificial Sequence: Synthetic polypeptide
DENEIRTTNPVSTEPYGTISMEDIQEQQNGNL

SEQ ID NO: 151663 - protein, 32 aa, Artificial Sequence
  Description of Artificial Sequence: Synthetic polypeptide
DENEIRTTNPVSTEPYGTISMEDIQEQQNGNH

SEQ ID NO: 151664 - protein, 32 aa, Artificial Sequence
  Description of Artificial Sequence: Synthetic polypeptide
DENEIRTTNPVSTEPYGTISMEDIQDQQNGNH

SEQ ID NO: 151665 - protein, 32 aa, Artificial Sequence
  Description of Artificial Sequence: Synthetic polypeptide
DENEIRTTNPVSTEPYGTISMEDIQDQQNGNC

SEQ ID NO: 151666 - protein, 32 aa, Artificial Sequence
  Description of Artificial Sequence: Synthetic polypeptide
DENEIRTTNPVSTEPYGTISMEDIQDQQFGNH

SEQ ID NO: 151667 - protein, 32 aa, Artificial Sequence
  Description of Artificial Sequence: Synthetic polypeptide
DENEIRTTNPVSTEPYGTISMEDIQCQQNGNH

SEQ ID NO: 151668 - protein, 32 aa, Artificial Sequence
  Description of Artificial Sequence: Synthetic polypeptide
DENEIRTTNPVSTEPYGTISMEDIQAQQNGNH

SEQ ID NO: 151669 - protein, 32 aa, Artificial Sequence
  Description of Artificial Sequence: Synthetic polypeptide
DENEIRTTNPVSTEPYGTISMEDIQGQQNGNH

SEQ ID NO: 151670 - protein, 39 aa, Artificial Sequence
  Description of Artificial Sequence: Synthetic polypeptide
DEEEIRTTNPVATEQYGVVSTVVTNLQGNNQIGNGNEGE

SEQ ID NO: 151671 - protein, 32 aa, Artificial Sequence
  Description of Artificial Sequence: Synthetic polypeptide
DENEIRTTNPVSTEPYGTISMEDHQQYQIGNQ

SEQ ID NO: 151672 - protein, 35 aa, Artificial Sequence
  Description of Artificial Sequence: Synthetic polypeptide
DEHCIRTTNPVATEQYGKTVATGNVSQPTGTNTAI

SEQ ID NO: 151673 - protein, 32 aa, Artificial Sequence
  Description of Artificial Sequence: Synthetic polypeptide
DENEIRTTNPVSTEPYGTISMEAIQQQQNGNV

SEQ ID NO: 151674 - protein, 30 aa, Artificial Sequence
  Description of Artificial Sequence: Synthetic polypeptide
DENCIRTTNPVATEQWGDVSEIEMNAAEDG

SEQ ID NO: 151675 - protein, 30 aa, Artificial Sequence
  Description of Artificial Sequence: Synthetic polypeptide
DENCIRTTNPVATEQWGDVSWIEMNAAEDA

SEQ ID NO: 151676 - protein, 39 aa, Artificial Sequence
  Description of Artificial Sequence: Synthetic polypeptide
DEEEIRTTNPVATEQYGVVSTVVTNLQGNTEAGNSTEGE

SEQ ID NO: 151677 - protein, 34 aa, Artificial Sequence
  Description of Artificial Sequence: Synthetic polypeptide
DEGVIRYTNPVATEQYGSVSSVPNQNDRGSTSME

SEQ ID NO: 151678 - protein, 38 aa, Artificial Sequence
  Description of Artificial Sequence: Synthetic polypeptide
DEEEIRTTNPVATEQYGVVSTVVTNLQNNNQEQNTEDE

SEQ ID NO: 151679 - protein, 39 aa, Artificial Sequence
  Description of Artificial Sequence: Synthetic polypeptide
DEEEIRTTNPVATEQYGVVSTVVTNLQQGANQQGTEEQT

SEQ ID NO: 151680 - protein, 32 aa, Artificial Sequence
  Description of Artificial Sequence: Synthetic polypeptide
DENEIRTTNPVSTEPYGTISMEAIQQQQNGNH

SEQ ID NO: 151681 - protein, 32 aa, Artificial Sequence
  Description of Artificial Sequence: Synthetic polypeptide
DENEIRTTNPVSTEPYGTISMEAGPQQQNGNH

SEQ ID NO: 151682 - protein, 38 aa, Artificial Sequence
  Description of Artificial Sequence: Synthetic polypeptide
DEAEIRTTNPVATEQYGSVCSPFVDELTQERQGGSENM

SEQ ID NO: 151683 - protein, 32 aa, Artificial Sequence
  Description of Artificial Sequence: Synthetic polypeptide
DENEIRTTNPVSTEPYGTISMDKIQQQQNGNH

SEQ ID NO: 151684 - protein, 31 aa, Artificial Sequence
  Description of Artificial Sequence: Synthetic polypeptide
DENEIRTTNPVSTEPYGTISMDIQQQQNGTH

SEQ ID NO: 151685 - protein, 31 aa, Artificial Sequence
  Description of Artificial Sequence: Synthetic polypeptide
DENEIRTTNPVSTEPYGTISMDIQQQQNGEH

SEQ ID NO: 151686 - protein, 31 aa, Artificial Sequence
  Description of Artificial Sequence: Synthetic polypeptide
DENEIRTTNPVSTEPYGTISMDIQQQQNENH

SEQ ID NO: 151687 - protein, 35 aa, Artificial Sequence
  Description of Artificial Sequence: Synthetic polypeptide
DEAEIRTTNPVATEQYGSVCSPEGCLEGGDEPSED

SEQ ID NO: 151688 - protein, 35 aa, Artificial Sequence
  Description of Artificial Sequence: Synthetic polypeptide
DEAEIRTTNPVATEQYGSVCSPEFCLEGGIEPIQE

SEQ ID NO: 151689 - protein, 32 aa, Artificial Sequence
  Description of Artificial Sequence: Synthetic polypeptide
DENEIRTTNPVSTEPYGTISMDIQEQQNGNDH

SEQ ID NO: 151690 - protein, 31 aa, Artificial Sequence
  Description of Artificial Sequence: Synthetic polypeptide
DENCIRTTNPVATEQWGDVSEIEMNAAEDAF

SEQ ID NO: 151691 - protein, 30 aa, Artificial Sequence
  Description of Artificial Sequence: Synthetic polypeptide
DENCIRTTNPVATEQWGDVSEIEMNAAEDA

SEQ ID NO: 151692 - protein, 30 aa, Artificial Sequence
  Description of Artificial Sequence: Synthetic polypeptide
DENCIRTTNPVATEQWGDVSEIECNAAEDA

SEQ ID NO: 151693 - protein, 32 aa, Artificial Sequence
  Description of Artificial Sequence: Synthetic polypeptide
DENEIRTTNPVSTEPYGTISMEAIYQQQNGNH

SEQ ID NO: 151694 - protein, 32 aa, Artificial Sequence
  Description of Artificial Sequence: Synthetic polypeptide
DENEIRTTNPVSTEPYGTISMEDGQQQQNGNH

SEQ ID NO: 151695 - protein, 32 aa, Artificial Sequence
  Description of Artificial Sequence: Synthetic polypeptide
DENEIRTTNPVSTEPYGTISMEDFQQQQNGNH

SEQ ID NO: 151696 - protein, 32 aa, Artificial Sequence
  Description of Artificial Sequence: Synthetic polypeptide
DENEIRTTNPVSTEPYGTISMEDEQQQQNGNH

SEQ ID NO: 151697 - protein, 31 aa, Artificial Sequence
  Description of Artificial Sequence: Synthetic polypeptide
DENEIRTTNPVSTEPYGTISMEDEMQQNENH

SEQ ID NO: 151698 - protein, 31 aa, Artificial Sequence
  Description of Artificial Sequence: Synthetic polypeptide
DENEIRTTNPVSTEPYGTISMEDEMNQNENH

SEQ ID NO: 151699 - protein, 32 aa, Artificial Sequence
  Description of Artificial Sequence: Synthetic polypeptide
DENEIRTTNPVSTEPYGTISMEDDQQQQNGNL

SEQ ID NO: 151700 - protein, 32 aa, Artificial Sequence
  Description of Artificial Sequence: Synthetic polypeptide
DENEIRTTNPVSTEPYGTISMEDDQQQQNGNH

SEQ ID NO: 151701 - protein, 33 aa, Artificial Sequence
  Description of Artificial Sequence: Synthetic polypeptide
DENEIRTTNPVSTEPYGTISMEDDIQNQQNGNH

SEQ ID NO: 151702 - protein, 32 aa, Artificial Sequence
  Description of Artificial Sequence: Synthetic polypeptide
DENEIRTTNPVSTEPYGTISMEDHQQQQNGNH

SEQ ID NO: 151703 - protein, 32 aa, Artificial Sequence
  Description of Artificial Sequence: Synthetic polypeptide
DENEIRTTNPVSTEPYGTISMEDCQQQTNGNH

SEQ ID NO: 151704 - protein, 32 aa, Artificial Sequence
  Description of Artificial Sequence: Synthetic polypeptide
DENEIRTTNPVSTEPYGTISMEDCQQQQNGNH

SEQ ID NO: 151705 - protein, 32 aa, Artificial Sequence
  Description of Artificial Sequence: Synthetic polypeptide
DENEIRTTNPVSTEPYGTISMEDAQQVQNGNH

SEQ ID NO: 151706 - protein, 32 aa, Artificial Sequence
  Description of Artificial Sequence: Synthetic polypeptide
DENEIRTTNPVSTEPYGTISMEDAQQQQNGNH

SEQ ID NO: 151707 - protein, 32 aa, Artificial Sequence
  Description of Artificial Sequence: Synthetic polypeptide
DENEIRTTNPVSTEPYGTISMECIQQQQNGNH

SEQ ID NO: 151708 - protein, 39 aa, Artificial Sequence
  Description of Artificial Sequence: Synthetic polypeptide
DEEEIRTTNPVATEQYGVVSTVVTNLQGNTEAGNATEDS

SEQ ID NO: 151709 - protein, 31 aa, Artificial Sequence
  Description of Artificial Sequence: Synthetic polypeptide
DENEIRTTNPVSTEPYGTISMECIQQQHENL

SEQ ID NO: 151710 - protein, 36 aa, Artificial Sequence
  Description of Artificial Sequence: Synthetic polypeptide
DEAEIRTTNPVATEQYGSVCSPPCTLETGYMEVMND

SEQ ID NO: 151711 - protein, 33 aa, Artificial Sequence
  Description of Artificial Sequence: Synthetic polypeptide
DENEIRTTNPVSTEPYGTISMEASIQQQQNGNH

SEQ ID NO: 151712 - protein, 32 aa, Artificial Sequence
  Description of Artificial Sequence: Synthetic polypeptide
DENEIRTTNPVSTEPYGTISMEDCQQQQNGNW

SEQ ID NO: 151713 - protein, 32 aa, Artificial Sequence
  Description of Artificial Sequence: Synthetic polypeptide
DENEIRTTNPVSTEPYGTISMDDIVQQFNGNH

SEQ ID NO: 151714 - protein, 32 aa, Artificial Sequence
  Description of Artificial Sequence: Synthetic polypeptide
DENEIRTTNPVSTEPYGTISMEDIQMQQNGNH

SEQ ID NO: 151715 - protein, 39 aa, Artificial Sequence
  Description of Artificial Sequence: Synthetic polypeptide
DEEEIRTTNPVATEQYGVVSTVVTNLQGNNNQGNNEQGQ

SEQ ID NO: 151716 - protein, 32 aa, Artificial Sequence
  Description of Artificial Sequence: Synthetic polypeptide
DENEIRTTNPVSTEPYGTISMEDIQQQQEGNH

SEQ ID NO: 151717 - protein, 32 aa, Artificial Sequence
  Description of Artificial Sequence: Synthetic polypeptide
DENEIRTTNPVSTEPYGTISMEDIQQQQEGNG

SEQ ID NO: 151718 - protein, 32 aa, Artificial Sequence
  Description of Artificial Sequence: Synthetic polypeptide
DENEIRTTNPVSTEPYGTISMEDIQQQQDGNH

SEQ ID NO: 151719 - protein, 32 aa, Artificial Sequence
  Description of Artificial Sequence: Synthetic polypeptide
DENEIRTTNPVSTEPYGTISMEDIQQQQCGNH

SEQ ID NO: 151720 - protein, 32 aa, Artificial Sequence
  Description of Artificial Sequence: Synthetic polypeptide
DENEIRTTNPVSTEPYGTISMEDIQQQQAGNH

SEQ ID NO: 151721 - protein, 32 aa, Artificial Sequence
  Description of Artificial Sequence: Synthetic polypeptide
DENEIRTTNPVSTEPYGTISMEDIQQQQAGND

SEQ ID NO: 151722 - protein, 32 aa, Artificial Sequence
  Description of Artificial Sequence: Synthetic polypeptide
DENEIRTTNPVSTEPYGTISMEDIQQQPNGNH

SEQ ID NO: 151723 - protein, 32 aa, Artificial Sequence
  Description of Artificial Sequence: Synthetic polypeptide
DENEIRTTNPVSTEPYGTISMEDIQQQNNGNH

SEQ ID NO: 151724 - protein, 32 aa, Artificial Sequence
  Description of Artificial Sequence: Synthetic polypeptide
DENEIRTTNPVSTEPYGTISMEDIQQQNGNPH

SEQ ID NO: 151725 - protein, 32 aa, Artificial Sequence
  Description of Artificial Sequence: Synthetic polypeptide
DENEIRTTNPVSTEPYGTISMEDIQQQNGINH

SEQ ID NO: 151726 - protein, 31 aa, Artificial Sequence
  Description of Artificial Sequence: Synthetic polypeptide
DENEIRTTNPVSTEPYGTISMEDIQQQNGGH

SEQ ID NO: 151727 - protein, 31 aa, Artificial Sequence
  Description of Artificial Sequence: Synthetic polypeptide
DENEIRTTNPVSTEPYGTISMEDIQQQNGDH

SEQ ID NO: 151728 - protein, 32 aa, Artificial Sequence
  Description of Artificial Sequence: Synthetic polypeptide
DENEIRTTNPVSTEPYGTISMEDIQQQMNGNH

SEQ ID NO: 151729 - protein, 32 aa, Artificial Sequence
  Description of Artificial Sequence: Synthetic polypeptide
DENEIRTTNPVSTEPYGTISMEDIQQQLNGNH

SEQ ID NO: 151730 - protein, 34 aa, Artificial Sequence
  Description of Artificial Sequence: Synthetic polypeptide
DEEEISTTNPVATEQYGQCVCSNWEDQNFGSEQA

SEQ ID NO: 151731 - protein, 32 aa, Artificial Sequence
  Description of Artificial Sequence: Synthetic polypeptide
DENEIRTTNPVSTEPYGTISMEDIQQQKNGNH

SEQ ID NO: 151732 - protein, 32 aa, Artificial Sequence
  Description of Artificial Sequence: Synthetic polypeptide
DENEIRTTNPVSTEPYGTISMEDIQQQIVGNH

SEQ ID NO: 151733 - protein, 32 aa, Artificial Sequence
  Description of Artificial Sequence: Synthetic polypeptide
DENEIRTTNPVSTEPYGTISMEDIQQQQFGNH

SEQ ID NO: 151734 - protein, 31 aa, Artificial Sequence
  Description of Artificial Sequence: Synthetic polypeptide
DENEIRTTNPVSTEPYGTISMEDIQQQQGDH

SEQ ID NO: 151735 - protein, 31 aa, Artificial Sequence
  Description of Artificial Sequence: Synthetic polypeptide
DENEIRTTNPVSTEPYGTISMEDIQQQQGEL

SEQ ID NO: 151736 - protein, 32 aa, Artificial Sequence
  Description of Artificial Sequence: Synthetic polypeptide
DENEIRTTNPVSTEPYGTISMEDIQQQQGGNH

SEQ ID NO: 151737 - protein, 32 aa, Artificial Sequence
  Description of Artificial Sequence: Synthetic polypeptide
DENEIRTTNPVSTEPYGTISMEDIQQQQNGNF

SEQ ID NO: 151738 - protein, 32 aa, Artificial Sequence
  Description of Artificial Sequence: Synthetic polypeptide
DENEIRTTNPVSTEPYGTISMEDIQQQQNGNE

SEQ ID NO: 151739 - protein, 32 aa, Artificial Sequence
  Description of Artificial Sequence: Synthetic polypeptide
DENEIRTTNPVSTEPYGTISMEDIQQQQNGND

SEQ ID NO: 151740 - protein, 32 aa, Artificial Sequence
  Description of Artificial Sequence: Synthetic polypeptide
DENEIRTTNPVSTEPYGTISMEDIQQQQNGNC

SEQ ID NO: 151741 - protein, 32 aa, Artificial Sequence
  Description of Artificial Sequence: Synthetic polypeptide
DENEIRTTNPVSTEPYGTISMEDIQQQQNGNA

SEQ ID NO: 151742 - protein, 38 aa, Artificial Sequence
  Description of Artificial Sequence: Synthetic polypeptide
DEEEIRTTNPVATEQYGVVSTVVTNLQAGTEAGEETDE

SEQ ID NO: 151743 - protein, 36 aa, Artificial Sequence
  Description of Artificial Sequence: Synthetic polypeptide
DEEEISTTNPVATEQYGQCVCSNTGNHNQNFGSEQA

SEQ ID NO: 151744 - protein, 38 aa, Artificial Sequence
  Description of Artificial Sequence: Synthetic polypeptide
DEEEIRTTNPVATEQYGVVSTVVTNLQAGTEQGTEDSE

SEQ ID NO: 151745 - protein, 32 aa, Artificial Sequence
  Description of Artificial Sequence: Synthetic polypeptide
DENEIRTTNPVSTEPYGTISMEDIQQQINGNH

SEQ ID NO: 151746 - protein, 33 aa, Artificial Sequence
  Description of Artificial Sequence: Synthetic polypeptide
DEHEIATTNPVATAQWGSVAAGNLFTPNNGGPR

SEQ ID NO: 151747 - protein, 39 aa, Artificial Sequence
  Description of Artificial Sequence: Synthetic polypeptide
DEEEIRTTNPVATEQYGVVSTVVTNLQAGTQEQGNDEDD

SEQ ID NO: 151748 - protein, 31 aa, Artificial Sequence
  Description of Artificial Sequence: Synthetic polypeptide
DEHEIATTNPVATAQWGCVATALTADPGDDW

SEQ ID NO: 151749 - protein, 34 aa, Artificial Sequence
  Description of Artificial Sequence: Synthetic polypeptide
DEHEIATTNPVATAAWGSVSSGDNEPQDRGGENG

SEQ ID NO: 151750 - protein, 32 aa, Artificial Sequence
  Description of Artificial Sequence: Synthetic polypeptide
DENEIRTTNPVSTEPYGTISMEDIQQQQMGNH

SEQ ID NO: 151751 - protein, 32 aa, Artificial Sequence
  Description of Artificial Sequence: Synthetic polypeptide
DENEIRTTNPVSTEPYGTISMEDIQQQQLGNH

SEQ ID NO: 151752 - protein, 32 aa, Artificial Sequence
  Description of Artificial Sequence: Synthetic polypeptide
DENEIRTTNPVSTEPYGTISMEDIQQQQKGNH

SEQ ID NO: 151753 - protein, 32 aa, Artificial Sequence
  Description of Artificial Sequence: Synthetic polypeptide
DENEIRTTNPVSTEPYGTISMEDIQQQQIGNH

SEQ ID NO: 151754 - protein, 32 aa, Artificial Sequence
  Description of Artificial Sequence: Synthetic polypeptide
DENEIRTTNPVSTEPYGTISMEDIQQQQHGNH

SEQ ID NO: 151755 - protein, 32 aa, Artificial Sequence
  Description of Artificial Sequence: Synthetic polypeptide
DEHEIATTNPVATAQWGSVAAGNLFTPNNDGN

SEQ ID NO: 151756 - protein, 31 aa, Artificial Sequence
  Description of Artificial Sequence: Synthetic polypeptide
DENEIRTTNPVSTEPYGTISMEDIQNQNGDH

SEQ ID NO: 151757 - protein, 30 aa, Artificial Sequence
  Description of Artificial Sequence: Synthetic polypeptide
DENAIRTTNPVATEQWGDVSEIEMNAAEDA

SEQ ID NO: 151758 - protein, 32 aa, Artificial Sequence
  Description of Artificial Sequence: Synthetic polypeptide
DENEIRTTNPVSTEPYGTISMEDIQQQHNGNI

SEQ ID NO: 151759 - protein, 32 aa, Artificial Sequence
  Description of Artificial Sequence: Synthetic polypeptide
DENEIRTTNPVSTEPYGTISMEDIQQIENGNG

SEQ ID NO: 151760 - protein, 32 aa, Artificial Sequence
  Description of Artificial Sequence: Synthetic polypeptide
DENEIRTTNPVSTEPYGTISMEDIQQHQYGNH

SEQ ID NO: 151761 - protein, 32 aa, Artificial Sequence
  Description of Artificial Sequence: Synthetic polypeptide
DENEIRTTNPVSTEPYGTISMEDIQQHQNGNH

SEQ ID NO: 151762 - protein, 36 aa, Artificial Sequence
  Description of Artificial Sequence: Synthetic polypeptide
DEEEISTTNPVATEQYGQCVCSNWELNQNFGSENQS

SEQ ID NO: 151763 - protein, 32 aa, Artificial Sequence
  Description of Artificial Sequence: Synthetic polypeptide
DENEIRTTNPVSTEPYGTISMEDIQQGQNGNH

SEQ ID NO: 151764 - protein, 35 aa, Artificial Sequence
  Description of Artificial Sequence: Synthetic polypeptide
DEAEIRTTNPVATEQYGSVCSPPKSETGYMEDMND

SEQ ID NO: 151765 - protein, 32 aa, Artificial Sequence
  Description of Artificial Sequence: Synthetic polypeptide
DENEIRTTNPVSTEPYGTISMEDIQQFQNGNH

SEQ ID NO: 151766 - protein, 32 aa, Artificial Sequence
  Description of Artificial Sequence: Synthetic polypeptide
DENEIRTTNPVSTEPYGTISMEDIQQEVNGNH

SEQ ID NO: 151767 - protein, 32 aa, Artificial Sequence
  Description of Artificial Sequence: Synthetic polypeptide
DENEIRTTNPVSTEPYGTISMEDIQQEQNGNH

SEQ ID NO: 151768 - protein, 32 aa, Artificial Sequence
  Description of Artificial Sequence: Synthetic polypeptide
DENEIRTTNPVSTEPYGTISMEDIQQEQDGNH

SEQ ID NO: 151769 - protein, 32 aa, Artificial Sequence
  Description of Artificial Sequence: Synthetic polypeptide
DENEIRTTNPVSTEPYGTISMEDIQQEHMGNH

SEQ ID NO: 151770 - protein, 32 aa, Artificial Sequence
  Description of Artificial Sequence: Synthetic polypeptide
DENEIRTTNPVSTEPYGTISMEDIQQDQNGNH

SEQ ID NO: 151771 - protein, 32 aa, Artificial Sequence
  Description of Artificial Sequence: Synthetic polypeptide
DENEIRTTNPVSTEPYGTISMEDIQQCQNGNH

SEQ ID NO: 151772 - protein, 32 aa, Artificial Sequence
  Description of Artificial Sequence: Synthetic polypeptide
DENEIRTTNPVSTEPYGTISMEDIQQATNGNH

SEQ ID NO: 151773 - protein, 32 aa, Artificial Sequence
  Description of Artificial Sequence: Synthetic polypeptide
DENEIRTTNPVSTEPYGTISMEDIQQAQNGNH

SEQ ID NO: 151774 - protein, 32 aa, Artificial Sequence
  Description of Artificial Sequence: Synthetic polypeptide
DENEIRTTNPVSTEPYGTISMEDIQPQQNGNH

SEQ ID NO: 151775 - protein, 32 aa, Artificial Sequence
  Description of Artificial Sequence: Synthetic polypeptide
DENEIRTTNPVSTEPYGTISMEDIQNQQNCNH

SEQ ID NO: 151776 - protein, 32 aa, Artificial Sequence
  Description of Artificial Sequence: Synthetic polypeptide
DENEIRTTNPVSTEPYGTISMEDIQQIQNGNH

SEQ ID NO: 151777 - protein, 32 aa, Artificial Sequence
  Description of Artificial Sequence: Synthetic polypeptide
DENEIRTTNPVSTEPYGTISMEDIQQKQNGNH

SEQ ID NO: 151778 - protein, 32 aa, Artificial Sequence
  Description of Artificial Sequence: Synthetic polypeptide
DENEIRTTNPVSTEPYGTISMEDIQQMGNGNH

SEQ ID NO: 151779 - protein, 33 aa, Artificial Sequence
  Description of Artificial Sequence: Synthetic polypeptide
DEHEIATTNPCATETYGCVSTGGAGLTNGGNTA

SEQ ID NO: 151780 - protein, 32 aa, Artificial Sequence
  Description of Artificial Sequence: Synthetic polypeptide
DENEIRTTNPVSTEPYGTISMEDIQQQHNGNH

SEQ ID NO: 151781 - protein, 32 aa, Artificial Sequence
  Description of Artificial Sequence: Synthetic polypeptide
DENEIRTTNPVSTEPYGTISMEDIQQQGNGNH

SEQ ID NO: 151782 - protein, 32 aa, Artificial Sequence
  Description of Artificial Sequence: Synthetic polypeptide
DENEIRTTNPVSTEPYGTISMEDIQQQFNGNH

SEQ ID NO: 151783 - protein, 32 aa, Artificial Sequence
  Description of Artificial Sequence: Synthetic polypeptide
DENEIRTTNPVSTEPYGTISMEDIQQQFKGNH

SEQ ID NO: 151784 - protein, 32 aa, Artificial Sequence
  Description of Artificial Sequence: Synthetic polypeptide
DENEIRTTNPVSTEPYGTISMEDIQQQENGNH

SEQ ID NO: 151785 - protein, 32 aa, Artificial Sequence
  Description of Artificial Sequence: Synthetic polypeptide
DENEIRTTNPVSTEPYGTISMEDIQQQEIGNT

SEQ ID NO: 151786 - protein, 32 aa, Artificial Sequence
  Description of Artificial Sequence: Synthetic polypeptide
DENEIRTTNPVSTEPYGTISMEDIQQQDNGNH

SEQ ID NO: 151787 - protein, 32 aa, Artificial Sequence
  Description of Artificial Sequence: Synthetic polypeptide
DENEIRTTNPVSTEPYGTISMEDIQQQDCGNH

SEQ ID NO: 151788 - protein, 32 aa, Artificial Sequence
  Description of Artificial Sequence: Synthetic polypeptide
DENEIRTTNPVSTEPYGTISMEDIQQQHNGNQ

SEQ ID NO: 151789 - protein, 37 aa, Artificial Sequence
  Description of Artificial Sequence: Synthetic polypeptide
DEEEIRTTNPVATEQYGSYVSHCLQPDDDSNEYDEED

SEQ ID NO: 151790 - protein, 32 aa, Artificial Sequence
  Description of Artificial Sequence: Synthetic polypeptide
DENEIRTTNPVSTEPYGTISMEDIQQQANGNH

SEQ ID NO: 151791 - protein, 32 aa, Artificial Sequence
  Description of Artificial Sequence: Synthetic polypeptide
DENEIRTTNPVSTEPYGTISMEDIQQQANGNA

SEQ ID NO: 151792 - protein, 32 aa, Artificial Sequence
  Description of Artificial Sequence: Synthetic polypeptide
DENEIRTTNPVSTEPYGTISMEDIQQQAAGNH

SEQ ID NO: 151793 - protein, 32 aa, Artificial Sequence
  Description of Artificial Sequence: Synthetic polypeptide
DENEIRTTNPVSTEPYGTISMEDIQQPQNGNH

SEQ ID NO: 151794 - protein, 32 aa, Artificial Sequence
  Description of Artificial Sequence: Synthetic polypeptide
DENEIRTTNPVSTEPYGTISMEDIQQNQPGNQ

SEQ ID NO: 151795 - protein, 32 aa, Artificial Sequence
  Description of Artificial Sequence: Synthetic polypeptide
DENEIRTTNPVSTEPYGTISMEDIQQNQNGNH

SEQ ID NO: 151796 - protein, 32 aa, Artificial Sequence
  Description of Artificial Sequence: Synthetic polypeptide
DENEIRTTNPVSTEPYGTISMEDIQQMQNGNH

SEQ ID NO: 151797 - protein, 32 aa, Artificial Sequence
  Description of Artificial Sequence: Synthetic polypeptide
DENAIRTTNPVSTEPYGTISMEDILQQQNGNH

SEQ ID NO: 151798 - protein, 32 aa, Artificial Sequence
  Description of Artificial Sequence: Synthetic polypeptide
DENAIRTTNPVATEQYGVFPTLTLIEGPQISP

SEQ ID NO: 151799 - protein, 32 aa, Artificial Sequence
  Description of Artificial Sequence: Synthetic polypeptide
DENEIRTTNPVSTEPYGTISMEDIQQQQNGNG

SEQ ID NO: 151800 - protein, 32 aa, Artificial Sequence
  Description of Artificial Sequence: Synthetic polypeptide
DENEIRTTNPVSTEPYGTISMDDIQQQQNGNH

SEQ ID NO: 151801 - protein, 31 aa, Artificial Sequence
  Description of Artificial Sequence: Synthetic polypeptide
DENEIRTTNPVSTEPYGTISMCIQQQQNENH

SEQ ID NO: 151802 - protein, 35 aa, Artificial Sequence
  Description of Artificial Sequence: Synthetic polypeptide
DENEAEIRTTNPVAYEQWGSVCYNNDNEEGGDNQR

SEQ ID NO: 151803 - protein, 38 aa, Artificial Sequence
  Description of Artificial Sequence: Synthetic polypeptide
DEEEIRTTNPVATEQYGVVSTVVTNLQQGTEQGSEEGS

SEQ ID NO: 151804 - protein, 33 aa, Artificial Sequence
  Description of Artificial Sequence: Synthetic polypeptide
DENEIRTTNPVSTEPYGTCSMEDIQRQQNGNTH

SEQ ID NO: 151805 - protein, 35 aa, Artificial Sequence
  Description of Artificial Sequence: Synthetic polypeptide
DDEEIRCTNPVATEQYGCVCSTGELQENSGSQTQA

SEQ ID NO: 151806 - protein, 32 aa, Artificial Sequence
  Description of Artificial Sequence: Synthetic polypeptide
DENEIRTTNPVSTEPYGTCSMEDIQQQQNGNH

SEQ ID NO: 151807 - protein, 32 aa, Artificial Sequence
  Description of Artificial Sequence: Synthetic polypeptide
DENEIRTTNPVSTEPYGTCSMEDIQQMQNGNI

SEQ ID NO: 151808 - protein, 32 aa, Artificial Sequence
  Description of Artificial Sequence: Synthetic polypeptide
DENEIRTTNPVSTEPYGTCSMEDIQQMQNGNH

SEQ ID NO: 151809 - protein, 32 aa, Artificial Sequence
  Description of Artificial Sequence: Synthetic polypeptide
DENEIRTTNPVSTEPYGTCSMEDIQQKQTGNH

SEQ ID NO: 151810 - protein, 32 aa, Artificial Sequence
  Description of Artificial Sequence: Synthetic polypeptide
DENEIRTTNPVSTEPYGTCSMEDGQQQHNGNH

SEQ ID NO: 151811 - protein, 32 aa, Artificial Sequence
  Description of Artificial Sequence: Synthetic polypeptide
DENEIRTTNPVSTEPYGTCSMEDDQQQQNGNM

SEQ ID NO: 151812 - protein, 32 aa, Artificial Sequence
  Description of Artificial Sequence: Synthetic polypeptide
DENEIRTTNPVSTEPYGTCSHEDIQQQQQGNH

SEQ ID NO: 151813 - protein, 33 aa, Artificial Sequence
  Description of Artificial Sequence: Synthetic polypeptide
DENEIRTTNPVSTEPYGTCSGMEGNQQQQNGNH

SEQ ID NO: 151814 - protein, 32 aa, Artificial Sequence
  Description of Artificial Sequence: Synthetic polypeptide
DENEIRTTNPVSTEPYGTCSGEDIQQQQNGNK

SEQ ID NO: 151815 - protein, 33 aa, Artificial Sequence
  Description of Artificial Sequence: Synthetic polypeptide
DENEIRTTNPVSTEPYGTCISMEVIQQQQNGNH

SEQ ID NO: 151816 - protein, 32 aa, Artificial Sequence
  Description of Artificial Sequence: Synthetic polypeptide
DENEIRTTNPVSTEPYGTASMEDIQQQQNGNH

SEQ ID NO: 151817 - protein, 31 aa, Artificial Sequence
  Description of Artificial Sequence: Synthetic polypeptide
DENEIRTTNPVSTEPYGTASMEDIQQQNGGH

SEQ ID NO: 151818 - protein, 32 aa, Artificial Sequence
  Description of Artificial Sequence: Synthetic polypeptide
DENEIRTTNPVSTEPYGTASMEDIQQQHNGNH

SEQ ID NO: 151819 - protein, 33 aa, Artificial Sequence
  Description of Artificial Sequence: Synthetic polypeptide
DENEIRTTNPVSTEPYGTCSMVDIQQQQSGVND

SEQ ID NO: 151820 - protein, 32 aa, Artificial Sequence
  Description of Artificial Sequence: Synthetic polypeptide
DENEIRTTNPVSTEPYGTCSMVDIQQVIQGNH

SEQ ID NO: 151821 - protein, 32 aa, Artificial Sequence
  Description of Artificial Sequence: Synthetic polypeptide
DENEIRTTNPVSTEPYGTCSPEDIQQQGNGNH

SEQ ID NO: 151822 - protein, 33 aa, Artificial Sequence
  Description of Artificial Sequence: Synthetic polypeptide
DENEIRTTNPVSTEPYGTCSTMEGIQQQQTGNH

SEQ ID NO: 151823 - protein, 33 aa, Artificial Sequence
  Description of Artificial Sequence: Synthetic polypeptide
DEAEICTTNPVATECWGVVATGGLQGDTGGNES

SEQ ID NO: 151824 - protein, 36 aa, Artificial Sequence
  Description of Artificial Sequence: Synthetic polypeptide
DEEEISTTNPVATEQYGQCVCSTEHNQEHFGSENQA

SEQ ID NO: 151825 - protein, 35 aa, Artificial Sequence
  Description of Artificial Sequence: Synthetic polypeptide
DEEEISTTNPVATEQYGQCVCSTEHNQESFGSDQG

SEQ ID NO: 151826 - protein, 37 aa, Artificial Sequence
  Description of Artificial Sequence: Synthetic polypeptide
DEEEIRTTNPVATEQYGSYVAVIGPPTDNTQFANIMD

SEQ ID NO: 151827 - protein, 36 aa, Artificial Sequence
  Description of Artificial Sequence: Synthetic polypeptide
DEEEIRTTNPVATEQYGSYVAVIGPPLDNTQINNQD

SEQ ID NO: 151828 - protein, 33 aa, Artificial Sequence
  Description of Artificial Sequence: Synthetic polypeptide
DDEEIRCTNPVATEQYGCVCSSEHQENSGSQQA

SEQ ID NO: 151829 - protein, 32 aa, Artificial Sequence
  Description of Artificial Sequence: Synthetic polypeptide
DENEIRTTNPVSTEPYGTICMEVIQQQQNGNH

SEQ ID NO: 151830 - protein, 39 aa, Artificial Sequence
  Description of Artificial Sequence: Synthetic polypeptide
DEEEIRTTNPVATEQYGVVSTVVTNLQQGTEQGNTNQED

SEQ ID NO: 151831 - protein, 32 aa, Artificial Sequence
  Description of Artificial Sequence: Synthetic polypeptide
DENEIRTTNPVSTEPYGTASKEDIQQQQNGNH

SEQ ID NO: 151832 - protein, 32 aa, Artificial Sequence
  Description of Artificial Sequence: Synthetic polypeptide
DENEIRTTNPVSTEPYGTIAMEDIQQQQNGNR

SEQ ID NO: 151833 - protein, 31 aa, Artificial Sequence
  Description of Artificial Sequence: Synthetic polypeptide
DENEIRTTNPVSTEPYGTIAMEDIQQQNGNH

SEQ ID NO: 151834 - protein, 32 aa, Artificial Sequence
  Description of Artificial Sequence: Synthetic polypeptide
DENEIRTTNPVSTEPYGTHSMEDIQQQQNGNH

SEQ ID NO: 151835 - protein, 32 aa, Artificial Sequence
  Description of Artificial Sequence: Synthetic polypeptide
DENEIRTTNPVSTEPYGTHSMEDIDQQQNGNH

SEQ ID NO: 151836 - protein, 32 aa, Artificial Sequence
  Description of Artificial Sequence: Synthetic polypeptide
DENEIRTTNPVSTEPYGTFSMEDIQQQQNGNH

SEQ ID NO: 151837 - protein, 32 aa, Artificial Sequence
  Description of Artificial Sequence: Synthetic polypeptide
DENEIRTTNPVSTEPYGTFSMEDIQQQQNGNA

SEQ ID NO: 151838 - protein, 32 aa, Artificial Sequence
  Description of Artificial Sequence: Synthetic polypeptide
DENEIRTTNPVSTEPYGTFSMEDIQMQQNGNH

SEQ ID NO: 151839 - protein, 32 aa, Artificial Sequence
  Description of Artificial Sequence: Synthetic polypeptide
DENEIRTTNPVSTEPYGTFSMEDIQAQQNGNH

SEQ ID NO: 151840 - protein, 32 aa, Artificial Sequence
  Description of Artificial Sequence: Synthetic polypeptide
DENEIRTTNPVSTEPYGTCSYGDIQQQQNGNH

SEQ ID NO: 151841 - protein, 34 aa, Artificial Sequence
  Description of Artificial Sequence: Synthetic polypeptide
DDEEIRCTNPVATEQYGCVCSTEPNQENSGSQQS

SEQ ID NO: 151842 - protein, 34 aa, Artificial Sequence
  Description of Artificial Sequence: Synthetic polypeptide
DEEEISTTNPVATEQYGQCVCSTEHAEGFGSDQS

SEQ ID NO: 151843 - protein, 31 aa, Artificial Sequence
  Description of Artificial Sequence: Synthetic polypeptide
DENEIRTTNPVSTEPYGTASEDIQQQQNGEK

SEQ ID NO: 151844 - protein, 36 aa, Artificial Sequence
  Description of Artificial Sequence: Synthetic polypeptide
DENEIRTTNPVSTEPYGSVSSTTPAIPNMQNGMNPV

SEQ ID NO: 151845 - protein, 32 aa, Artificial Sequence
  Description of Artificial Sequence: Synthetic polypeptide
DENEIRTTNPVSTEPYGQISAEDIQQQQNGNH

SEQ ID NO: 151846 - protein, 36 aa, Artificial Sequence
  Description of Artificial Sequence: Synthetic polypeptide
DEGTEIATTNPVAYEQWGSVCSTWNDLGEQEGGNDM

SEQ ID NO: 151847 - protein, 32 aa, Artificial Sequence
  Description of Artificial Sequence: Synthetic polypeptide
DENEIRTTNPVSTEPYGNISMEDIQQQQPGNH

SEQ ID NO: 151848 - protein, 32 aa, Artificial Sequence
  Description of Artificial Sequence: Synthetic polypeptide
DENEIRTTNPVSTEPYGNISMEDIQQQQNGNH

SEQ ID NO: 151849 - protein, 34 aa, Artificial Sequence
  Description of Artificial Sequence: Synthetic polypeptide
DEGTEIATTNPVAYECWGSVATNLQGNAGENDTM

SEQ ID NO: 151850 - protein, 34 aa, Artificial Sequence
  Description of Artificial Sequence: Synthetic polypeptide
DEEEISTTNPVATEQYGQCVCSTEHQHFISEFQM

SEQ ID NO: 151851 - protein, 32 aa, Artificial Sequence
  Description of Artificial Sequence: Synthetic polypeptide
DENEIRTTNPVSTEPYGNISMEAIQQQQNGNH

SEQ ID NO: 151852 - protein, 32 aa, Artificial Sequence
  Description of Artificial Sequence: Synthetic polypeptide
DENEIRTTNPVSTEPYGNISANTIQQSQNGQH

SEQ ID NO: 151853 - protein, 38 aa, Artificial Sequence
  Description of Artificial Sequence: Synthetic polypeptide
DEEEIRTTNPVATEQYGVVSTVVTNLQQGTEQGTQEDT

SEQ ID NO: 151854 - protein, 38 aa, Artificial Sequence
  Description of Artificial Sequence: Synthetic polypeptide
DEEEIRTTNPVATEQYGVVSTVVTNLQQGTQQGTEEQT

SEQ ID NO: 151855 - protein, 33 aa, Artificial Sequence
  Description of Artificial Sequence: Synthetic polypeptide
DENEIRTTNPVSTEPYGMIVSMEDIQQQQNGNH

SEQ ID NO: 151856 - protein, 34 aa, Artificial Sequence
  Description of Artificial Sequence: Synthetic polypeptide
DEEEISTTNPVATEQYGQCVCSTEHQNFISQTQS

SEQ ID NO: 151857 - protein, 32 aa, Artificial Sequence
  Description of Artificial Sequence: Synthetic polypeptide
DENEIACTNPIATECYGETSNAENLQEPKGPR

SEQ ID NO: 151858 - protein, 32 aa, Artificial Sequence
  Description of Artificial Sequence: Synthetic polypeptide
DENEIRTTNPVSTEPYGMISMKDIQQQQNGNH

SEQ ID NO: 151859 - protein, 32 aa, Artificial Sequence
  Description of Artificial Sequence: Synthetic polypeptide
DENEIRTTNPVSTEPYGMISMEDIQQQQNGNV

SEQ ID NO: 151860 - protein, 32 aa, Artificial Sequence
  Description of Artificial Sequence: Synthetic polypeptide
DENEIRTTNPVSTEPYGMISMEDIQQQQNGNH

SEQ ID NO: 151861 - protein, 35 aa, Artificial Sequence
  Description of Artificial Sequence: Synthetic polypeptide
DEEEISTTNPVATEQYGQCVCSTETNQNFNSQTQS

SEQ ID NO: 151862 - protein, 32 aa, Artificial Sequence
  Description of Artificial Sequence: Synthetic polypeptide
DENEIRTTNPVSTEPYGQISMEDIQQQQNGNH

SEQ ID NO: 151863 - protein, 33 aa, Artificial Sequence
  Description of Artificial Sequence: Synthetic polypeptide
DENEIRTTNPVSTEPYGQISMEDIQQQQNGNRH

SEQ ID NO: 151864 - protein, 33 aa, Artificial Sequence
  Description of Artificial Sequence: Synthetic polypeptide
DENEIRTTNPVSTEPYGQISMEDNIQQQQNGNH

SEQ ID NO: 151865 - protein, 32 aa, Artificial Sequence
  Description of Artificial Sequence: Synthetic polypeptide
DENEIRTTNPVSTEPYGQISVLDIQQQQNNNH

SEQ ID NO: 151866 - protein, 33 aa, Artificial Sequence
  Description of Artificial Sequence: Synthetic polypeptide
DENEIRTTNPVSTEPYGSVSMEDIQEQQNGEDH

SEQ ID NO: 151867 - protein, 33 aa, Artificial Sequence
  Description of Artificial Sequence: Synthetic polypeptide
DENEIRTTNPVSTEPYGSVSAMDIQEQQEGEDH

SEQ ID NO: 151868 - protein, 33 aa, Artificial Sequence
  Description of Artificial Sequence: Synthetic polypeptide
DENEIRTTNPVSTEPYGSTISMEDIQVQQNGNH

SEQ ID NO: 151869 - protein, 33 aa, Artificial Sequence
  Description of Artificial Sequence: Synthetic polypeptide
DENEIRTTNPVSTEPYGSTISMEDIQQQYNGNH

SEQ ID NO: 151870 - protein, 34 aa, Artificial Sequence
  Description of Artificial Sequence: Synthetic polypeptide
DENEIRTTNPVSTEPYGSTISMEDIQQQQNGNRH

SEQ ID NO: 151871 - protein, 33 aa, Artificial Sequence
  Description of Artificial Sequence: Synthetic polypeptide
DENEIRTTNPVSTEPYGSTISMEDIQQQQNGNH

SEQ ID NO: 151872 - protein, 33 aa, Artificial Sequence
  Description of Artificial Sequence: Synthetic polypeptide
DENEIRTTNPVSTEPYGSTIGMSDIQVQQNGNH

SEQ ID NO: 151873 - protein, 34 aa, Artificial Sequence
  Description of Artificial Sequence: Synthetic polypeptide
DENEIRTTNPVSTEPYGSISMPAIPQQRNGMNPV

SEQ ID NO: 151874 - protein, 39 aa, Artificial Sequence
  Description of Artificial Sequence: Synthetic polypeptide
DEEEIRTTNPVATEQYGVVSTVVTNLQQGTEQGSTNQDT

SEQ ID NO: 151875 - protein, 32 aa, Artificial Sequence
  Description of Artificial Sequence: Synthetic polypeptide
DENEIRTTNPVSTEPYGSISMEDIQQQQNGDH

SEQ ID NO: 151876 - protein, 35 aa, Artificial Sequence
  Description of Artificial Sequence: Synthetic polypeptide
DEAEIRTTNPVATEQYGSVCNTFNCWYGRYESTMD

SEQ ID NO: 151877 - protein, 33 aa, Artificial Sequence
  Description of Artificial Sequence: Synthetic polypeptide
DENEIRTTNPVSTEPYGSISAMEDIQQQQNGNH

SEQ ID NO: 151878 - protein, 33 aa, Artificial Sequence
  Description of Artificial Sequence: Synthetic polypeptide
DENEIRTTNPVSTEPYGSISAMEDIQEQQNGNH

SEQ ID NO: 151879 - protein, 32 aa, Artificial Sequence
  Description of Artificial Sequence: Synthetic polypeptide
DENEIRTTNPVSTEPYGSISAMEDIQDQNGEH

SEQ ID NO: 151880 - protein, 38 aa, Artificial Sequence
  Description of Artificial Sequence: Synthetic polypeptide
DEEEIRTTNPVATEQYGVVSTVVTNLQQGTEQGTEETA

SEQ ID NO: 151881 - protein, 32 aa, Artificial Sequence
  Description of Artificial Sequence: Synthetic polypeptide
DENEIRTTNPVSTEPYGRISMEDIQQQQNGNH

SEQ ID NO: 151882 - protein, 32 aa, Artificial Sequence
  Description of Artificial Sequence: Synthetic polypeptide
DENEIRTTNPVSTEPYGRISMEDIQQQGNGNH

SEQ ID NO: 151883 - protein, 33 aa, Artificial Sequence
  Description of Artificial Sequence: Synthetic polypeptide
DENEIRTTNPVSTEPYGQTISMELIQQQQNGNH

SEQ ID NO: 151884 - protein, 33 aa, Artificial Sequence
  Description of Artificial Sequence: Synthetic polypeptide
DENEIRTTNPVSTEPYGSISMEDIQQQHNGNDH

SEQ ID NO: 151885 - protein, 32 aa, Artificial Sequence
  Description of Artificial Sequence: Synthetic polypeptide
DENEIRTTNPVSTEPYGTISMDDIQQQFNGNH

SEQ ID NO: 151886 - protein, 35 aa, Artificial Sequence
  Description of Artificial Sequence: Synthetic polypeptide
DEEEISTTNPVATEQYGQCVCSTEGHNQGFGSDQS

SEQ ID NO: 151887 - protein, 37 aa, Artificial Sequence
  Description of Artificial Sequence: Synthetic polypeptide
DEEEIRTTNPVATEQYGSYVEPTPIMPQEPGLNVILQ

SEQ ID NO: 151888 - protein, 32 aa, Artificial Sequence
  Description of Artificial Sequence: Synthetic polypeptide
DENEIRTTNPVSTEPYGTISHEDIQQQQNGNH

SEQ ID NO: 151889 - protein, 32 aa, Artificial Sequence
  Description of Artificial Sequence: Synthetic polypeptide
DENEIRTTNPVSTEPYGTISGPAIQQQQNGNH

SEQ ID NO: 151890 - protein, 33 aa, Artificial Sequence
  Description of Artificial Sequence: Synthetic polypeptide
DENEIRTTNPVSTEPYGTISGMEVIQQQQNGNH

SEQ ID NO: 151891 - protein, 35 aa, Artificial Sequence
  Description of Artificial Sequence: Synthetic polypeptide
DEEEIRTTNPVATEQYGSYVSAPSGIQQLMVEEFL

SEQ ID NO: 151892 - protein, 32 aa, Artificial Sequence
  Description of Artificial Sequence: Synthetic polypeptide
DENEIRTTNPVSTEPYGTISGEDIQQQTNGNH

SEQ ID NO: 151893 - protein, 32 aa, Artificial Sequence
  Description of Artificial Sequence: Synthetic polypeptide
DENEIRTTNPVSTEPYGTISGEDIQQQQNGNH

SEQ ID NO: 151894 - protein, 32 aa, Artificial Sequence
  Description of Artificial Sequence: Synthetic polypeptide
DENEIRTTNPVSTEPYGTISGEDIQKQQNGNH

SEQ ID NO: 151895 - protein, 32 aa, Artificial Sequence
  Description of Artificial Sequence: Synthetic polypeptide
DENEIRTTNPVSTEPYGTISGADGQQQANGNH

SEQ ID NO: 151896 - protein, 32 aa, Artificial Sequence
  Description of Artificial Sequence: Synthetic polypeptide
DENEIRTTNPVSTEPYGTISFEDWQQQQNGNH

SEQ ID NO: 151897 - protein, 32 aa, Artificial Sequence
  Description of Artificial Sequence: Synthetic polypeptide
DENEIRTTNPVSTEPYGTISFEDIQQQQNGNH

SEQ ID NO: 151898 - protein, 30 aa, Artificial Sequence
  Description of Artificial Sequence: Synthetic polypeptide
DENDIRTTNPVATEQWGDVSEICMNAAEDA

SEQ ID NO: 151899 - protein, 32 aa, Artificial Sequence
  Description of Artificial Sequence: Synthetic polypeptide
DENEIRTTNPVSTEPYGTISFEDIQDQQNGNV

SEQ ID NO: 151900 - protein, 35 aa, Artificial Sequence
  Description of Artificial Sequence: Synthetic polypeptide
DEAEIRTTNPVATEQYGSVCSPDNLIEDTTEIMSF

SEQ ID NO: 151901 - protein, 31 aa, Artificial Sequence
  Description of Artificial Sequence: Synthetic polypeptide
DENEIRTTNPVSTEPYGTISEEIEMNANGNA

SEQ ID NO: 151902 - protein, 31 aa, Artificial Sequence
  Description of Artificial Sequence: Synthetic polypeptide
DENEIRTTNPVSTEPYGTISEEIEMNAAGNA

SEQ ID NO: 151903 - protein, 32 aa, Artificial Sequence
  Description of Artificial Sequence: Synthetic polypeptide
DENEIRTTNPVSTEPYGTISEEDIQTQQNGNH

SEQ ID NO: 151904 - protein, 32 aa, Artificial Sequence
  Description of Artificial Sequence: Synthetic polypeptide
DENEIRTTNPVSTEPYGTISEEDIQQQQNGNH

SEQ ID NO: 151905 - protein, 34 aa, Artificial Sequence
  Description of Artificial Sequence: Synthetic polypeptide
DEEEISTTNPVATEQYGQCVCSSEHDQGFGSDQS

SEQ ID NO: 151906 - protein, 32 aa, Artificial Sequence
  Description of Artificial Sequence: Synthetic polypeptide
DENEIRTTNPVSTEPYGTISHMDIQQQQNGNH

SEQ ID NO: 151907 - protein, 32 aa, Artificial Sequence
  Description of Artificial Sequence: Synthetic polypeptide
DENEIRTTNPVSTEPYGTISIADIQQQQNGNH

SEQ ID NO: 151908 - protein, 32 aa, Artificial Sequence
  Description of Artificial Sequence: Synthetic polypeptide
DENEIRTTNPVSTEPYGTISIEDIQQQQNGNH

SEQ ID NO: 151909 - protein, 32 aa, Artificial Sequence
  Description of Artificial Sequence: Synthetic polypeptide
DENEIRTTNPVSTEPYGTISMCDIQVAQNGNH

SEQ ID NO: 151910 - protein, 32 aa, Artificial Sequence
  Description of Artificial Sequence: Synthetic polypeptide
DEGVIATVNPVAYEPYGSVSNAGNLEMNGGNN

SEQ ID NO: 151911 - protein, 32 aa, Artificial Sequence
  Description of Artificial Sequence: Synthetic polypeptide
DENEIRTTNPVSTEPYGTISMCDIQQQQNGNQ

SEQ ID NO: 151912 - protein, 32 aa, Artificial Sequence
  Description of Artificial Sequence: Synthetic polypeptide
DENEIRTTNPVSTEPYGTISMCDIQQQQNGNH

SEQ ID NO: 151913 - protein, 32 aa, Artificial Sequence
  Description of Artificial Sequence: Synthetic polypeptide
DENEIRTTNPVSTEPYGTISMCDIQQQQCGNH

SEQ ID NO: 151914 - protein, 32 aa, Artificial Sequence
  Description of Artificial Sequence: Synthetic polypeptide
DENEIRTTNPVSTEPYGTISMADIQQQQNGNH

SEQ ID NO: 151915 - protein, 31 aa, Artificial Sequence
  Description of Artificial Sequence: Synthetic polypeptide
DEGVIATVNPVATEPYGSVSNAGNLEMNAGH

SEQ ID NO: 151916 - protein, 34 aa, Artificial Sequence
  Description of Artificial Sequence: Synthetic polypeptide
DDEEIRATNPVATEQYGSVYGNIGDEGGNQDENI

SEQ ID NO: 151917 - protein, 32 aa, Artificial Sequence
  Description of Artificial Sequence: Synthetic polypeptide
DENEIRTTNPVSTEPYGTISEEDIQQQQEGNH

SEQ ID NO: 151918 - protein, 32 aa, Artificial Sequence
  Description of Artificial Sequence: Synthetic polypeptide
DENEIRTTNPVSTEPYGTISLSDIQVQQNGSH

SEQ ID NO: 151919 - protein, 39 aa, Artificial Sequence
  Description of Artificial Sequence: Synthetic polypeptide
DEEEIRTTNPVATEQYGVVSTVVTNLQQGTEQGGTNNDG

SEQ ID NO: 151920 - protein, 32 aa, Artificial Sequence
  Description of Artificial Sequence: Synthetic polypeptide
DENEIRTTNPVSTEPYGTISLEDIQQQQNGNH

SEQ ID NO: 151921 - protein, 32 aa, Artificial Sequence
  Description of Artificial Sequence: Synthetic polypeptide
DENEIRTTNPVSTEPYGTISLEDEQQQQIGNH

SEQ ID NO: 151922 - protein, 31 aa, Artificial Sequence
  Description of Artificial Sequence: Synthetic polypeptide
DENCISTTNPVAYEQWGCFSWDNLDHGKGNQ

SEQ ID NO: 151923 - protein, 32 aa, Artificial Sequence
  Description of Artificial Sequence: Synthetic polypeptide
DENEIRTTNPVSTEPYGTISKEDIQQQQNGNH

SEQ ID NO: 151924 - protein, 34 aa, Artificial Sequence
  Description of Artificial Sequence: Synthetic polypeptide
DEEEISTTNPVATEQYGQCVCSSEDDQNFNSDQA

SEQ ID NO: 151925 - protein, 32 aa, Artificial Sequence
  Description of Artificial Sequence: Synthetic polypeptide
DENEIRTTNPVSTEPYGTISKEDIQQQFNGNH

SEQ ID NO: 151926 - protein, 32 aa, Artificial Sequence
  Description of Artificial Sequence: Synthetic polypeptide
DENEIRTTNPVSTEPYGTISIEDIYQQQNGNH

SEQ ID NO: 151927 - protein, 34 aa, Artificial Sequence
  Description of Artificial Sequence: Synthetic polypeptide
DDEEIRCTNPVATEQYGCSCSTGEHNQNFGSQQA

SEQ ID NO: 151928 - protein, 35 aa, Artificial Sequence
  Description of Artificial Sequence: Synthetic polypeptide
DEEEISTTNPVATEQYGQCVCSTEELNANFNSNQD

SEQ ID NO: 151929 - protein, 31 aa, Artificial Sequence
  Description of Artificial Sequence: Synthetic polypeptide
DENEIRTTNPVSTEPYGTISEEDIQNQNGDH

SEQ ID NO: 151930 - protein, 32 aa, Artificial Sequence
  Description of Artificial Sequence: Synthetic polypeptide
DENEIRTTNPVSTEPYGTISEEDIIQNQNGNV

SEQ ID NO: 151931 - protein, 33 aa, Artificial Sequence
  Description of Artificial Sequence: Synthetic polypeptide
DENEIRTTNPVSTEPYGTISAMEDLQQQHNGNH

SEQ ID NO: 151932 - protein, 32 aa, Artificial Sequence
  Description of Artificial Sequence: Synthetic polypeptide
DENEIRTTNPVSTEPYGTISAMEDIQQQNGNH

SEQ ID NO: 151933 - protein, 32 aa, Artificial Sequence
  Description of Artificial Sequence: Synthetic polypeptide
DENEIRTTNPVSTEPYGTISAMEDIEQQNGNH

SEQ ID NO: 151934 - protein, 32 aa, Artificial Sequence
  Description of Artificial Sequence: Synthetic polypeptide
DENEIRTTNPVSTEPYGTISAMDIQQQQNGNH

SEQ ID NO: 151935 - protein, 32 aa, Artificial Sequence
  Description of Artificial Sequence: Synthetic polypeptide
DENEIRTTNPVSTEPYGTISAEIIQQQQNGNH

SEQ ID NO: 151936 - protein, 32 aa, Artificial Sequence
  Description of Artificial Sequence: Synthetic polypeptide
DENEIRTTNPVSTEPYGTISAEDIQQQQNGNH

SEQ ID NO: 151937 - protein, 32 aa, Artificial Sequence
  Description of Artificial Sequence: Synthetic polypeptide
DENEIRTTNPVSTEPYGTISAEDIQQQQGGNH

SEQ ID NO: 151938 - protein, 32 aa, Artificial Sequence
  Description of Artificial Sequence: Synthetic polypeptide
DENEIRTTNPVSTEPYGTISAEDIQQEQFGNQ

SEQ ID NO: 151939 - protein, 32 aa, Artificial Sequence
  Description of Artificial Sequence: Synthetic polypeptide
DENEIRTTNPVSTEPYGTISAEDDQQQQNGNH

SEQ ID NO: 151940 - protein, 36 aa, Artificial Sequence
  Description of Artificial Sequence: Synthetic polypeptide
DEEEIRTTNPVATEQYGSYVQVANINEENRALEPLD

SEQ ID NO: 151941 - protein, 33 aa, Artificial Sequence
  Description of Artificial Sequence: Synthetic polypeptide
DENEIRTTNPVSTEPYGTIQSWEDHNQEQFGNQ

SEQ ID NO: 151942 - protein, 31 aa, Artificial Sequence
  Description of Artificial Sequence: Synthetic polypeptide
DENEIRTTNPVSTEPYGTINMEDIQQQNGNH

SEQ ID NO: 151943 - protein, 36 aa, Artificial Sequence
  Description of Artificial Sequence: Synthetic polypeptide
DEAEICTTNPVATECWGAVSTGNGLLQDDRGQNGTN

SEQ ID NO: 151944 - protein, 36 aa, Artificial Sequence
  Description of Artificial Sequence: Synthetic polypeptide
DEAEICTTNPVATECWGEVSTGNGLLQDDRGGNGEN

SEQ ID NO: 151945 - protein, 32 aa, Artificial Sequence
  Description of Artificial Sequence: Synthetic polypeptide
DENEIRTTNPVSTEPYGTIMMTDIQVQQNGNH

SEQ ID NO: 151946 - protein, 34 aa, Artificial Sequence
  Description of Artificial Sequence: Synthetic polypeptide
DEEEISTTNPVATEQYGQCVCSSNHQNFISEFQF

SEQ ID NO: 151947 - protein, 35 aa, Artificial Sequence
  Description of Artificial Sequence: Synthetic polypeptide
DEEEISTTNPVATEQYGQCVCSTEDHQNFGSQTQF

SEQ ID NO: 151948 - protein, 33 aa, Artificial Sequence
  Description of Artificial Sequence: Synthetic polypeptide
DENEIRTTNPVSTEPYGTISAMEDLQQQQNGNH

SEQ ID NO: 151949 - protein, 32 aa, Artificial Sequence
  Description of Artificial Sequence: Synthetic polypeptide
DENEIRTTNPVSTEPYGTISAQDPQQQQNGNH

SEQ ID NO: 151950 - protein, 32 aa, Artificial Sequence
  Description of Artificial Sequence: Synthetic polypeptide
DENEIRTTNPVSTEPYGTISCEDIQQQQIGNQ

SEQ ID NO: 151951 - protein, 32 aa, Artificial Sequence
  Description of Artificial Sequence: Synthetic polypeptide
DENEIRTTNPVSTEPYGTISCEDIQQQQNGNG

SEQ ID NO: 151952 - protein, 31 aa, Artificial Sequence
  Description of Artificial Sequence: Synthetic polypeptide
DENEIRTTNPVSTEPYGTISEEDEMNANGNA

SEQ ID NO: 151953 - protein, 32 aa, Artificial Sequence
  Description of Artificial Sequence: Synthetic polypeptide
DENEIRTTNPVSTEPYGTISEEDAQQQQNGNH

SEQ ID NO: 151954 - protein, 35 aa, Artificial Sequence
  Description of Artificial Sequence: Synthetic polypeptide
DEAEIRTTNPVATEQYGSVCSLLWSEMIGQNEDKE

SEQ ID NO: 151955 - protein, 35 aa, Artificial Sequence
  Description of Artificial Sequence: Synthetic polypeptide
DEAEIRTTNPVATEQYGSVCSLLTQTEIGQEEDHS

SEQ ID NO: 151956 - protein, 33 aa, Artificial Sequence
  Description of Artificial Sequence: Synthetic polypeptide
DENEIRTTNPVSTEPYGTISDMEDIQQQQRGNH

SEQ ID NO: 151957 - protein, 32 aa, Artificial Sequence
  Description of Artificial Sequence: Synthetic polypeptide
DENEIRTTNPVSTEPYGTISDEDIQQSQNGNH

SEQ ID NO: 151958 - protein, 32 aa, Artificial Sequence
  Description of Artificial Sequence: Synthetic polypeptide
DENEIRTTNPVSTEPYGTISDEDIQQQQNGNW

SEQ ID NO: 151959 - protein, 30 aa, Artificial Sequence
  Description of Artificial Sequence: Synthetic polypeptide
DENDIRTTNPVATEQWGDVSEIEMNAAEDA

SEQ ID NO: 151960 - protein, 31 aa, Artificial Sequence
  Description of Artificial Sequence: Synthetic polypeptide
DENEIRTTNPVSTEPYGTISEEDIQNQAGDH

SEQ ID NO: 151961 - protein, 31 aa, Artificial Sequence
  Description of Artificial Sequence: Synthetic polypeptide
DENDIRTTNPVATEQWGDVSEIEMNAAEDVA

SEQ ID NO: 151962 - protein, 32 aa, Artificial Sequence
  Description of Artificial Sequence: Synthetic polypeptide
DENEIRTTNPVSTEPYGTISDEDIQQQQNGNH

SEQ ID NO: 151963 - protein, 32 aa, Artificial Sequence
  Description of Artificial Sequence: Synthetic polypeptide
DENEIRTTNPVSTEPYGTISDEDIQQQQGGNH

SEQ ID NO: 151964 - protein, 32 aa, Artificial Sequence
  Description of Artificial Sequence: Synthetic polypeptide
DENEIRTTNPVSTEPYGTISDEDIEQQQNGNH

SEQ ID NO: 151965 - protein, 33 aa, Artificial Sequence
  Description of Artificial Sequence: Synthetic polypeptide
DENEIRTTNPVSTEPYGTISCVEDINQQQIGEH

SEQ ID NO: 151966 - protein, 31 aa, Artificial Sequence
  Description of Artificial Sequence: Synthetic polypeptide
DENDIRTTNPVSTEPYGTISMEDIQQQNGNH

SEQ ID NO: 151967 - protein, 32 aa, Artificial Sequence
  Description of Artificial Sequence: Synthetic polypeptide
DENEIRTTNPVSTEPYGTISCIDEQQQQNGNG

SEQ ID NO: 151968 - protein, 32 aa, Artificial Sequence
  Description of Artificial Sequence: Synthetic polypeptide
DENEIRTTNPVSTEPYGTISCIDEQQDQNGNG

SEQ ID NO: 151969 - protein, 32 aa, Artificial Sequence
  Description of Artificial Sequence: Synthetic polypeptide
DENEIRTTNPVSTEPYGTISCEDIQQQQNGNH

SEQ ID NO: 151970 - protein, 30 aa, Artificial Sequence
  Description of Artificial Sequence: Synthetic polypeptide
DENDIRTTNPVATEQWGDVSEMEMNAAEDA

SEQ ID NO: 151971 - protein, 33 aa, Artificial Sequence
  Description of Artificial Sequence: Synthetic polypeptide
DENEIRTTNPVSTEPYGTISNMELIQQQQNGNH

SEQ ID NO: 151972 - protein, 36 aa, Artificial Sequence
  Description of Artificial Sequence: Synthetic polypeptide
DEHEIATTNPVATEAYGSVAISNTDTNPDDQTEGNN

SEQ ID NO: 151973 - protein, 32 aa, Artificial Sequence
  Description of Artificial Sequence: Synthetic polypeptide
DENEIRTTNPVSTEPYGTISMEDIQQQQNGNI

SEQ ID NO: 151974 - protein, 32 aa, Artificial Sequence
  Description of Artificial Sequence: Synthetic polypeptide
DENEIRTTNPVSTEPYGTISMIQIQVQQAGNH

SEQ ID NO: 151975 - protein, 32 aa, Artificial Sequence
  Description of Artificial Sequence: Synthetic polypeptide
DENEIRTTNPVSTEPYGTISMIDIQQQQNGNH

SEQ ID NO: 151976 - protein, 32 aa, Artificial Sequence
  Description of Artificial Sequence: Synthetic polypeptide
DENEIRTTNPVSTEPYGTISMIDIQQQQNGNG

SEQ ID NO: 151977 - protein, 32 aa, Artificial Sequence
  Description of Artificial Sequence: Synthetic polypeptide
DENEIRTTNPVSTEPYGTISMIDIQQDQNGNG

SEQ ID NO: 151978 - protein, 30 aa, Artificial Sequence
  Description of Artificial Sequence: Synthetic polypeptide
DDSEIRSTNPVSTEQYGNVANTIMSRAEDA

SEQ ID NO: 151979 - protein, 31 aa, Artificial Sequence
  Description of Artificial Sequence: Synthetic polypeptide
DDSEIRSTNPVSTEQYGNVAANTIMSRAEDR

SEQ ID NO: 151980 - protein, 32 aa, Artificial Sequence
  Description of Artificial Sequence: Synthetic polypeptide
DDSEIRSTNPVSTEPYGTVSMEDIQQQQNGNR

SEQ ID NO: 151981 - protein, 33 aa, Artificial Sequence
  Description of Artificial Sequence: Synthetic polypeptide
DEHEIATTNPVATEQYGTVCAATSGPEEIEGND

SEQ ID NO: 151982 - protein, 31 aa, Artificial Sequence
  Description of Artificial Sequence: Synthetic polypeptide
DDSEIRSTNPVSTEPYGTISMEDIQQQNGNR

SEQ ID NO: 151983 - protein, 33 aa, Artificial Sequence
  Description of Artificial Sequence: Synthetic polypeptide
DEMEIVTTNPVATYQYGTVCSATDGPVEFEGND

SEQ ID NO: 151984 - protein, 33 aa, Artificial Sequence
  Description of Artificial Sequence: Synthetic polypeptide
DEMEIVTTNPVATYQYGTVCSATDGPVEFSGND

SEQ ID NO: 151985 - protein, 33 aa, Artificial Sequence
  Description of Artificial Sequence: Synthetic polypeptide
DEHEIATTNPVATEQYGTVCAATDGPVEMEGND

SEQ ID NO: 151986 - protein, 32 aa, Artificial Sequence
  Description of Artificial Sequence: Synthetic polypeptide
DENEIRTTNPVSTEPYGTISMIDIAQQQNGNH

SEQ ID NO: 151987 - protein, 33 aa, Artificial Sequence
  Description of Artificial Sequence: Synthetic polypeptide
DEMEIVTTNPVATYQYGWVCSATDGPVEFEGND

SEQ ID NO: 151988 - protein, 32 aa, Artificial Sequence
  Description of Artificial Sequence: Synthetic polypeptide
DENEIRTTNPVSTEPYGTISMIDEQQQQNGNG

SEQ ID NO: 151989 - protein, 32 aa, Artificial Sequence
  Description of Artificial Sequence: Synthetic polypeptide
DENEIRTTNPVSTEPYGTISMHDIQQQQNGNH

SEQ ID NO: 151990 - protein, 32 aa, Artificial Sequence
  Description of Artificial Sequence: Synthetic polypeptide
DENEIRTTNPVSTEPYGTISMGDIQSQQNGNH

SEQ ID NO: 151991 - protein, 32 aa, Artificial Sequence
  Description of Artificial Sequence: Synthetic polypeptide
DENEIRTTNPVSTEPYGTISMKDIQQQQNGNH

SEQ ID NO: 151992 - protein, 34 aa, Artificial Sequence
  Description of Artificial Sequence: Synthetic polypeptide
DEHEIATTNPVATEQYGTVCSATDGPVEFEGNDP

SEQ ID NO: 151993 - protein, 32 aa, Artificial Sequence
  Description of Artificial Sequence: Synthetic polypeptide
DENEIRTTNPVSTEPYGTISMLDIQQQQNGNH

SEQ ID NO: 151994 - protein, 32 aa, Artificial Sequence
  Description of Artificial Sequence: Synthetic polypeptide
DENEIRTTNPVSTEPYGTISMLDIQQQQNRNH

SEQ ID NO: 151995 - protein, 33 aa, Artificial Sequence
  Description of Artificial Sequence: Synthetic polypeptide
DENEIRTTNPVSTEPYGTISMVDIQQQQNGANH

SEQ ID NO: 151996 - protein, 32 aa, Artificial Sequence
  Description of Artificial Sequence: Synthetic polypeptide
DENEIRTTNPVSTEPYGTISMSDIQVQVNGQH

SEQ ID NO: 151997 - protein, 32 aa, Artificial Sequence
  Description of Artificial Sequence: Synthetic polypeptide
DENEIRTTNPVSTEPYGTISMSDIQVQQNPNT

SEQ ID NO: 151998 - protein, 32 aa, Artificial Sequence
  Description of Artificial Sequence: Synthetic polypeptide
DENEIRTTNPVSTEPYGTISMSDIQVFQNGLH

SEQ ID NO: 151999 - protein, 32 aa, Artificial Sequence
  Description of Artificial Sequence: Synthetic polypeptide
DENEIRTTNPVSTEPYGTISMRDIQQQQNGNM

SEQ ID NO: 152000 - protein, 35 aa, Artificial Sequence
  Description of Artificial Sequence: Synthetic polypeptide
DEHEIATTNPVATEQYGVVCSTNPQGQPDMDNEDN

SEQ ID NO: 152001 - protein, 32 aa, Artificial Sequence
  Description of Artificial Sequence: Synthetic polypeptide
DENEIRTTNPVSTEPYGTISMRDIQQQQNGNH

SEQ ID NO: 152002 - protein, 32 aa, Artificial Sequence
  Description of Artificial Sequence: Synthetic polypeptide
DENEIRTTNPVSTEPYGTISMQDIQQQQNGNH

SEQ ID NO: 152003 - protein, 33 aa, Artificial Sequence
  Description of Artificial Sequence: Synthetic polypeptide
DEMEIVTTNPVAVEQYGTVCSATDGPKEFEGND

SEQ ID NO: 152004 - protein, 32 aa, Artificial Sequence
  Description of Artificial Sequence: Synthetic polypeptide
DENEIRTTNPVSTEPYGTISMPDIQQQQSGNH

SEQ ID NO: 152005 - protein, 32 aa, Artificial Sequence
  Description of Artificial Sequence: Synthetic polypeptide
DENEIRTTNPVSTEPYGTISMPDIQQQQNGNH

SEQ ID NO: 152006 - protein, 32 aa, Artificial Sequence
  Description of Artificial Sequence: Synthetic polypeptide
DENEIRTTNPVSTEPYGTISMPDIQQNQNGNH

SEQ ID NO: 152007 - protein, 34 aa, Artificial Sequence
  Description of Artificial Sequence: Synthetic polypeptide
DDSEIRTTNPVATECWGSVSANITEPQDREGEQG

SEQ ID NO: 152008 - protein, 34 aa, Artificial Sequence
  Description of Artificial Sequence: Synthetic polypeptide
DDSEIRTTNPVATECWGNVSACINEPQDREGENG

SEQ ID NO: 152009 - protein, 33 aa, Artificial Sequence
  Description of Artificial Sequence: Synthetic polypeptide
DENEIRTTNPVSTEPYGTISMPAGPNQRNGMNV

SEQ ID NO: 152010 - protein, 32 aa, Artificial Sequence
  Description of Artificial Sequence: Synthetic polypeptide
DENEIRTTNPVSTEPYGTISMNDGQQQQNNNH

SEQ ID NO: 152011 - protein, 33 aa, Artificial Sequence
  Description of Artificial Sequence: Synthetic polypeptide
DEMEIVTTNPVATYQYGTVCSATDGPVAFEGND

SEQ ID NO: 152012 - protein, 32 aa, Artificial Sequence
  Description of Artificial Sequence: Synthetic polypeptide
DENEIRTTNPVSTEPYGTISMMDIQQQQNGNH

SEQ ID NO: 152013 - protein, 33 aa, Artificial Sequence
  Description of Artificial Sequence: Synthetic polypeptide
DEMEIVTTNPVATWQYGTVCSATDGPVEFYGND

SEQ ID NO: 152014 - protein, 33 aa, Artificial Sequence
  Description of Artificial Sequence: Synthetic polypeptide
DENEIRTTNPVSTEPYGTISMVDIQQQQNGNTH

SEQ ID NO: 152015 - protein, 33 aa, Artificial Sequence
  Description of Artificial Sequence: Synthetic polypeptide
DEMEIVTTNPVAVEQYGTVCSATDGPVEFEGND

SEQ ID NO: 152016 - protein, 32 aa, Artificial Sequence
  Description of Artificial Sequence: Synthetic polypeptide
DENEIRTTNPVSTEPYGTISMGDIQQQQNGNH

SEQ ID NO: 152017 - protein, 32 aa, Artificial Sequence
  Description of Artificial Sequence: Synthetic polypeptide
DEMEIVTTNPVGTEQYGVVCAASGPVEFEGNI

SEQ ID NO: 152018 - protein, 35 aa, Artificial Sequence
  Description of Artificial Sequence: Synthetic polypeptide
DEEEISTTNPVATEQYGQCVCSDTGELINFGSDQP

SEQ ID NO: 152019 - protein, 36 aa, Artificial Sequence
  Description of Artificial Sequence: Synthetic polypeptide
DEEEISTTNPVATEQYGQCVCSDTGELNQNFGSDQS

SEQ ID NO: 152020 - protein, 38 aa, Artificial Sequence
  Description of Artificial Sequence: Synthetic polypeptide
DEEEIRTTNPVATEQYGVVSTVVTNLNGNNTQGTNEEN

SEQ ID NO: 152021 - protein, 32 aa, Artificial Sequence
  Description of Artificial Sequence: Synthetic polypeptide
DENEIRTTNPVSTEPYGTISMEYIQQQQNGNH

SEQ ID NO: 152022 - protein, 32 aa, Artificial Sequence
  Description of Artificial Sequence: Synthetic polypeptide
DENEIRTTNPVSTEPYGTISMEWIQQQQNGNH

SEQ ID NO: 152023 - protein, 36 aa, Artificial Sequence
  Description of Artificial Sequence: Synthetic polypeptide
DEEEISTTNPVATEQYGQCVCSDTGNDHQNFGSDQP

SEQ ID NO: 152024 - protein, 35 aa, Artificial Sequence
  Description of Artificial Sequence: Synthetic polypeptide
DEEEISTTNPVATEQYGQCVCSDTNHAENFGSDQS

SEQ ID NO: 152025 - protein, 32 aa, Artificial Sequence
  Description of Artificial Sequence: Synthetic polypeptide
DENEIRTTNPVSTEPYGTISMEWIQQQQLGNH

SEQ ID NO: 152026 - protein, 32 aa, Artificial Sequence
  Description of Artificial Sequence: Synthetic polypeptide
DENEIRTTNPVSTEPYGTISMEWIQMQQNGNH

SEQ ID NO: 152027 - protein, 33 aa, Artificial Sequence
  Description of Artificial Sequence: Synthetic polypeptide
DEMEIVTTNPVSTEQYGNVCSATDGIVEFEGQR

SEQ ID NO: 152028 - protein, 32 aa, Artificial Sequence
  Description of Artificial Sequence: Synthetic polypeptide
DENEIRTTNPVSTEPYGTISMETIQQQQNGDH

SEQ ID NO: 152029 - protein, 33 aa, Artificial Sequence
  Description of Artificial Sequence: Synthetic polypeptide
DENEIRTTNPVSTEPYGTISMESQIQQQQNGNH

SEQ ID NO: 152030 - protein, 32 aa, Artificial Sequence
  Description of Artificial Sequence: Synthetic polypeptide
DENEIRTTNPVSTEPYGTISMESIQQQQNDNH

SEQ ID NO: 152031 - protein, 33 aa, Artificial Sequence
  Description of Artificial Sequence: Synthetic polypeptide
DENEIRTTNPVSTEPYGTISMESCIQAQSMGNH

SEQ ID NO: 152032 - protein, 32 aa, Artificial Sequence
  Description of Artificial Sequence: Synthetic polypeptide
DENEIRTTNPVSTEPYGTISMERIQQQQNGNH

SEQ ID NO: 152033 - protein, 33 aa, Artificial Sequence
  Description of Artificial Sequence: Synthetic polypeptide
DEMEIVTTNPVSTEQYGTVCSAMDGIVEQNGNH

SEQ ID NO: 152034 - protein, 32 aa, Artificial Sequence
  Description of Artificial Sequence: Synthetic polypeptide
DEMEIVTTNPVGTEQYGVVCAASGPVEFEGND

SEQ ID NO: 152035 - protein, 33 aa, Artificial Sequence
  Description of Artificial Sequence: Synthetic polypeptide
DEMEIVTTNPVGTEQYGTVCSATDGPVEFEGND

SEQ ID NO: 152036 - protein, 33 aa, Artificial Sequence
  Description of Artificial Sequence: Synthetic polypeptide
DEMEIVTTNPVCTEQYGTVCSATDGPVESEGND

SEQ ID NO: 152037 - protein, 33 aa, Artificial Sequence
  Description of Artificial Sequence: Synthetic polypeptide
DEMEIVTTNPVCTEQYGTVCSATDGPVEFPGND

SEQ ID NO: 152038 - protein, 33 aa, Artificial Sequence
  Description of Artificial Sequence: Synthetic polypeptide
DEHEIATTNPVATEQYGTVCAATDGPEEFGGND

SEQ ID NO: 152039 - protein, 32 aa, Artificial Sequence
  Description of Artificial Sequence: Synthetic polypeptide
DENEIRTTNPVSTEPYGTISMGDIQQQENGNH

SEQ ID NO: 152040 - protein, 32 aa, Artificial Sequence
  Description of Artificial Sequence: Synthetic polypeptide
DENEIRTTNPVSTEPYGTISMFDIQQQQNGNK

SEQ ID NO: 152041 - protein, 33 aa, Artificial Sequence
  Description of Artificial Sequence: Synthetic polypeptide
DENEIRTTNPVSTEPYGTISMFDIQQQQNGNHR

SEQ ID NO: 152042 - protein, 32 aa, Artificial Sequence
  Description of Artificial Sequence: Synthetic polypeptide
DENEIRTTNPVSTEPYGTISMFDIQQQQNGNH

SEQ ID NO: 152043 - protein, 38 aa, Artificial Sequence
  Description of Artificial Sequence: Synthetic polypeptide
DEEEIRTTNPVATEQYGVVSTVVTNLEQGTNNVEQGED

SEQ ID NO: 152044 - protein, 34 aa, Artificial Sequence
  Description of Artificial Sequence: Synthetic polypeptide
DEHEIATTNPVATEQYGSVYCGENDQDHDNKGEH

SEQ ID NO: 152045 - protein, 38 aa, Artificial Sequence
  Description of Artificial Sequence: Synthetic polypeptide
DEEEIRTTNPVATEQYGVVSTVVTNLFGNEQGNTEQGQ

SEQ ID NO: 152046 - protein, 33 aa, Artificial Sequence
  Description of Artificial Sequence: Synthetic polypeptide
DEMEIVTTNPVAWEQYGTVCSATDGPVEFEGND

SEQ ID NO: 152047 - protein, 35 aa, Artificial Sequence
  Description of Artificial Sequence: Synthetic polypeptide
DEHEIATTNPVATEQYGSVVKTDNHNHDQGGGDTN

SEQ ID NO: 152048 - protein, 38 aa, Artificial Sequence
  Description of Artificial Sequence: Synthetic polypeptide
DEEEIRTTNPVATEQYGVVSTVVTNLGQNQNGTEQGSE

SEQ ID NO: 152049 - protein, 33 aa, Artificial Sequence
  Description of Artificial Sequence: Synthetic polypeptide
DEMEIVTTNPVAYEQYGTVCSATDGPVEFEGND

SEQ ID NO: 152050 - protein, 33 aa, Artificial Sequence
  Description of Artificial Sequence: Synthetic polypeptide
DEMEIVTTNPVAYEQYGTVCSATDGPVEKEGND

SEQ ID NO: 152051 - protein, 33 aa, Artificial Sequence
  Description of Artificial Sequence: Synthetic polypeptide
DEMEIVTTNPVAYEQYGTVCSATDGPVEYEGND

SEQ ID NO: 152052 - protein, 33 aa, Artificial Sequence
  Description of Artificial Sequence: Synthetic polypeptide
DEMEIVTTNPVAYEQYGTVCSATDGPVYHEGND

SEQ ID NO: 152053 - protein, 32 aa, Artificial Sequence
  Description of Artificial Sequence: Synthetic polypeptide
DEMEIVTTNPVCTEQYGTVCSADGPVEFEGNQ

SEQ ID NO: 152054 - protein, 33 aa, Artificial Sequence
  Description of Artificial Sequence: Synthetic polypeptide
DEMEIVTTNPVCTEQYGTVCSATDGPVEFEGND

SEQ ID NO: 152055 - protein, 33 aa, Artificial Sequence
  Description of Artificial Sequence: Synthetic polypeptide
DEMEIVTTNPVCTEQYGTVCSATDGPVEFEGNQ

SEQ ID NO: 152056 - protein, 39 aa, Artificial Sequence
  Description of Artificial Sequence: Synthetic polypeptide
DEEEIRTTNPVATEQYGVVSTVVTNLGNLQQGTTDENQD

SEQ ID NO: 152057 - protein, 33 aa, Artificial Sequence
  Description of Artificial Sequence: Synthetic polypeptide
DEMEIVTTNPVSTEQYGTVCSATDDPVEFEGND

SEQ ID NO: 152058 - protein, 32 aa, Artificial Sequence
  Description of Artificial Sequence: Synthetic polypeptide
DENEIRTTNPVSTEPYGTISMVDIQQQQNGQH

SEQ ID NO: 152059 - protein, 35 aa, Artificial Sequence
  Description of Artificial Sequence: Synthetic polypeptide
DDEEIATTNPVSTEQYGNVSSTTPAGQSRNGMNPV

SEQ ID NO: 152060 - protein, 33 aa, Artificial Sequence
  Description of Artificial Sequence: Synthetic polypeptide
DEMEIVTTNPVATLQYGTVCSATDGPVEFEGND

SEQ ID NO: 152061 - protein, 32 aa, Artificial Sequence
  Description of Artificial Sequence: Synthetic polypeptide
DENEIRTTNPVSTEPYGTISNEDIQQQQNGNH

SEQ ID NO: 152062 - protein, 33 aa, Artificial Sequence
  Description of Artificial Sequence: Synthetic polypeptide
DEMEIVTTNPVATMQYGTVCSATDGPVEFEGND

SEQ ID NO: 152063 - protein, 32 aa, Artificial Sequence
  Description of Artificial Sequence: Synthetic polypeptide
DENEIRTTNPVSTEPYGTISNEDIQQQQNGNE

SEQ ID NO: 152064 - protein, 34 aa, Artificial Sequence
  Description of Artificial Sequence: Synthetic polypeptide
DEMEIVTTNPVATMQYGTVCSATDGPVEFEGNRD

SEQ ID NO: 152065 - protein, 33 aa, Artificial Sequence
  Description of Artificial Sequence: Synthetic polypeptide
DEMEIVTTNPVATNQYGTVCSATDGPVEFEGND

SEQ ID NO: 152066 - protein, 33 aa, Artificial Sequence
  Description of Artificial Sequence: Synthetic polypeptide
DEMEIVTTNPVATRQYGTVCSATDGPVEEEGND

SEQ ID NO: 152067 - protein, 35 aa, Artificial Sequence
  Description of Artificial Sequence: Synthetic polypeptide
DEEEISTTNPVATEQYGCVCSWGEHNQGFGSDNQA

SEQ ID NO: 152068 - protein, 34 aa, Artificial Sequence
  Description of Artificial Sequence: Synthetic polypeptide
DEEEISTTNPVATEQYGCVCSWGEHNQHFNSNQS

SEQ ID NO: 152069 - protein, 34 aa, Artificial Sequence
  Description of Artificial Sequence: Synthetic polypeptide
DEEEISTTNPVATEQYGCVCSWGEHNQNFGSDDG

SEQ ID NO: 152070 - protein, 34 aa, Artificial Sequence
  Description of Artificial Sequence: Synthetic polypeptide
DEEEISTTNPVATEQYGCVCSWGEHQENFGSDQP

SEQ ID NO: 152071 - protein, 34 aa, Artificial Sequence
  Description of Artificial Sequence: Synthetic polypeptide
DEEEISTTNPVATEQYGCVCSWGEHQENFNSDQA

SEQ ID NO: 152072 - protein, 30 aa, Artificial Sequence
  Description of Artificial Sequence: Synthetic polypeptide
DEGEIATTNPCASEQYGIVSCNEMNAAEDA

SEQ ID NO: 152073 - protein, 33 aa, Artificial Sequence
  Description of Artificial Sequence: Synthetic polypeptide
DEEEISTTNPVATEQYGCVCSWGEHQYFISEQA

SEQ ID NO: 152074 - protein, 35 aa, Artificial Sequence
  Description of Artificial Sequence: Synthetic polypeptide
DEEEISTTNPVATEQYGCVCSWGELEQENFNSDQS

SEQ ID NO: 152075 - protein, 35 aa, Artificial Sequence
  Description of Artificial Sequence: Synthetic polypeptide
DEEEISTTNPVATEQYGCVCSWGELHNQNFNSDQS

SEQ ID NO: 152076 - protein, 35 aa, Artificial Sequence
  Description of Artificial Sequence: Synthetic polypeptide
DEEEISTTNPVATEQYGCVCSWGELNQENFGSEQS

SEQ ID NO: 152077 - protein, 33 aa, Artificial Sequence
  Description of Artificial Sequence: Synthetic polypeptide
DEMEIVTTNPVATLQYGTVCSATDGKVEFEGND

SEQ ID NO: 152078 - protein, 33 aa, Artificial Sequence
  Description of Artificial Sequence: Synthetic polypeptide
DEMEIVTTNPVATKQYGTVCSATDGPVEFEGND

SEQ ID NO: 152079 - protein, 33 aa, Artificial Sequence
  Description of Artificial Sequence: Synthetic polypeptide
DEMEIVTTNPVATIQYGTVCSATDGPVEFEGND

SEQ ID NO: 152080 - protein, 33 aa, Artificial Sequence
  Description of Artificial Sequence: Synthetic polypeptide
DEMEIVTTNPVATIQYGTVCSATDGPPEFEGND

SEQ ID NO: 152081 - protein, 34 aa, Artificial Sequence
  Description of Artificial Sequence: Synthetic polypeptide
DEEEISTTNPVATEQYGCVCSWGAHQNFGSDTQA

SEQ ID NO: 152082 - protein, 39 aa, Artificial Sequence
  Description of Artificial Sequence: Synthetic polypeptide
DEEEIRTTNPVATEQYGVVSTVVSVTNLQQGTEEGEEED

SEQ ID NO: 152083 - protein, 32 aa, Artificial Sequence
  Description of Artificial Sequence: Synthetic polypeptide
DEHEIATTNPVAYEQWGCVYSNDMQMNGGADR

SEQ ID NO: 152084 - protein, 33 aa, Artificial Sequence
  Description of Artificial Sequence: Synthetic polypeptide
DEMEIVTTNPVATEYYGTVCSATDGPVCFEGND

SEQ ID NO: 152085 - protein, 33 aa, Artificial Sequence
  Description of Artificial Sequence: Synthetic polypeptide
DEMEIVTTNPVATEYYGTVCSATDGPVEFEGND

SEQ ID NO: 152086 - protein, 34 aa, Artificial Sequence
  Description of Artificial Sequence: Synthetic polypeptide
DEEEISTTNPVATEQYGCVCSWGEDHQNFGSDQG

SEQ ID NO: 152087 - protein, 35 aa, Artificial Sequence
  Description of Artificial Sequence: Synthetic polypeptide
DEEEISTTNPVATEQYGCVCSWGEDQEHFGSENQA

SEQ ID NO: 152088 - protein, 33 aa, Artificial Sequence
  Description of Artificial Sequence: Synthetic polypeptide
DEMEIVTTNPVATFQYGTVCSATDGPVEFEGND

SEQ ID NO: 152089 - protein, 35 aa, Artificial Sequence
  Description of Artificial Sequence: Synthetic polypeptide
DEEEISTTNPVATEQYGCVCSWGELQENFNSNPQS

SEQ ID NO: 152090 - protein, 34 aa, Artificial Sequence
  Description of Artificial Sequence: Synthetic polypeptide
DEEEISTTNPVATEQYGCVCSWGEHANFGSDNQG

SEQ ID NO: 152091 - protein, 32 aa, Artificial Sequence
  Description of Artificial Sequence: Synthetic polypeptide
DENEIRTTNPVSTEPYGTISNEDISQQQTGNH

SEQ ID NO: 152092 - protein, 33 aa, Artificial Sequence
  Description of Artificial Sequence: Synthetic polypeptide
DEMEIVTTNPVATFQYGVVCSATDGPVEFEGND

SEQ ID NO: 152093 - protein, 35 aa, Artificial Sequence
  Description of Artificial Sequence: Synthetic polypeptide
DEEEISTTNPVATEQYGCVCSWGEHNENFGSDNQA

SEQ ID NO: 152094 - protein, 34 aa, Artificial Sequence
  Description of Artificial Sequence: Synthetic polypeptide
DEHEIATTNPVAYECWGSVSGDNLNGDRQGDNGK

SEQ ID NO: 152095 - protein, 34 aa, Artificial Sequence
  Description of Artificial Sequence: Synthetic polypeptide
DEHEIATTNPVAYECWGSVSGDNLLGDRQGDNGQ

SEQ ID NO: 152096 - protein, 33 aa, Artificial Sequence
  Description of Artificial Sequence: Synthetic polypeptide
DEMEIVTTNPVATGQYGTVCSATDGPVEFEGND

SEQ ID NO: 152097 - protein, 33 aa, Artificial Sequence
  Description of Artificial Sequence: Synthetic polypeptide
DEMEIVTTNPVATHQYGTVCSATDGPVEFEGND

SEQ ID NO: 152098 - protein, 33 aa, Artificial Sequence
  Description of Artificial Sequence: Synthetic polypeptide
DEMEIVTTNPVATHQYGTVCSATGGPVEFEGND

SEQ ID NO: 152099 - protein, 38 aa, Artificial Sequence
  Description of Artificial Sequence: Synthetic polypeptide
DEEEIRTTNPVATEQYGVVSTVVTNGNQNQAGTNDEED

SEQ ID NO: 152100 - protein, 32 aa, Artificial Sequence
  Description of Artificial Sequence: Synthetic polypeptide
DENEIRTTNPVSTEPYGTISMWDIQQQQAGNH

SEQ ID NO: 152101 - protein, 36 aa, Artificial Sequence
  Description of Artificial Sequence: Synthetic polypeptide
DEEEIRTTNPVAYEQWGSVSGGEPAGPNMQNGMNPG

SEQ ID NO: 152102 - protein, 35 aa, Artificial Sequence
  Description of Artificial Sequence: Synthetic polypeptide
DEEEISTTNPVATEQYGCVCSWGETNQENFGSEQG

SEQ ID NO: 152103 - protein, 33 aa, Artificial Sequence
  Description of Artificial Sequence: Synthetic polypeptide
DEMEIVTTNPVATTQYGTVCSATDGPSEFEGND

SEQ ID NO: 152104 - protein, 31 aa, Artificial Sequence
  Description of Artificial Sequence: Synthetic polypeptide
DDSEIRTTNPVSTEPYGNIAMETIQSRNGQR

SEQ ID NO: 152105 - protein, 32 aa, Artificial Sequence
  Description of Artificial Sequence: Synthetic polypeptide
DDSEIRTTNPVSTEGYGTVAAMEDIQSRVGNH

SEQ ID NO: 152106 - protein, 33 aa, Artificial Sequence
  Description of Artificial Sequence: Synthetic polypeptide
DEEEIRTTNPVAYEQWGSVCVNWEHQEQDMDKF

SEQ ID NO: 152107 - protein, 34 aa, Artificial Sequence
  Description of Artificial Sequence: Synthetic polypeptide
DEEEIRTTNPVAYEQWGSVCVNWEHGEQDNAHQF

SEQ ID NO: 152108 - protein, 33 aa, Artificial Sequence
  Description of Artificial Sequence: Synthetic polypeptide
DEEEIRTTNPVAYEQWGSVCSNWEHQEQDMHTD

SEQ ID NO: 152109 - protein, 32 aa, Artificial Sequence
  Description of Artificial Sequence: Synthetic polypeptide
DDSEIRTTNPVSTEGYGNVAAMEDIQSRVGNH

SEQ ID NO: 152110 - protein, 33 aa, Artificial Sequence
  Description of Artificial Sequence: Synthetic polypeptide
DEMEIVTTNPVATTQYGTVCSATDGPVEFEGND

SEQ ID NO: 152111 - protein, 34 aa, Artificial Sequence
  Description of Artificial Sequence: Synthetic polypeptide
DDSEIRTTNPVATEQYGSVSVIELNQMEMSFEFN

SEQ ID NO: 152112 - protein, 33 aa, Artificial Sequence
  Description of Artificial Sequence: Synthetic polypeptide
DEMEIVTTNPVATVQYGTVCSATDGPVAFEGND

SEQ ID NO: 152113 - protein, 33 aa, Artificial Sequence
  Description of Artificial Sequence: Synthetic polypeptide
DEMEIVTTNPVATVQYGTVCSATDGPVEFEGND

SEQ ID NO: 152114 - protein, 39 aa, Artificial Sequence
  Description of Artificial Sequence: Synthetic polypeptide
DEEEIRTTNPVATEQYGVVSTVVTNLAGNQNIGNTEQGQ

SEQ ID NO: 152115 - protein, 33 aa, Artificial Sequence
  Description of Artificial Sequence: Synthetic polypeptide
DEMEIVTTNPVATVQYGTVCSATDGPVEFLGND

SEQ ID NO: 152116 - protein, 33 aa, Artificial Sequence
  Description of Artificial Sequence: Synthetic polypeptide
DEMEIVTTNPVATWQYGTVCSATDGPVEFEGND

SEQ ID NO: 152117 - protein, 38 aa, Artificial Sequence
  Description of Artificial Sequence: Synthetic polypeptide
DEEEIRTTNPVATEQYGVVSTVVTNLAGNQQGTITEEN

SEQ ID NO: 152118 - protein, 38 aa, Artificial Sequence
  Description of Artificial Sequence: Synthetic polypeptide
DEEEIRTTNPVATEQYGVVSTVVTNLEQGNNNTEQGSD

SEQ ID NO: 152119 - protein, 32 aa, Artificial Sequence
  Description of Artificial Sequence: Synthetic polypeptide
DENEIRTTNPVSTEPYGTISMWDIQQQQNGNH

SEQ ID NO: 152120 - protein, 33 aa, Artificial Sequence
  Description of Artificial Sequence: Synthetic polypeptide
DEMEIVTTNPVATSQYGTVCSATDPPVEFEGND

SEQ ID NO: 152121 - protein, 34 aa, Artificial Sequence
  Description of Artificial Sequence: Synthetic polypeptide
DEMEIVTTNPVATSQYGTVCSATDGPVEFEGNDR

SEQ ID NO: 152122 - protein, 31 aa, Artificial Sequence
  Description of Artificial Sequence: Synthetic polypeptide
DDSEIRTTNPVSTEPYGNISMEDIQSQNGNH

SEQ ID NO: 152123 - protein, 34 aa, Artificial Sequence
  Description of Artificial Sequence: Synthetic polypeptide
DEEEIRTTNPVAYEQWGSVCVNWEHQEQDMHTRD

SEQ ID NO: 152124 - protein, 34 aa, Artificial Sequence
  Description of Artificial Sequence: Synthetic polypeptide
DEEEISTTNPVATEQYGCVCSWGETQENFISDQS

SEQ ID NO: 152125 - protein, 36 aa, Artificial Sequence
  Description of Artificial Sequence: Synthetic polypeptide
DEEEIRTTNPVAYEQWGSVSGGEPAGPNMQNGGNQV

SEQ ID NO: 152126 - protein, 34 aa, Artificial Sequence
  Description of Artificial Sequence: Synthetic polypeptide
DEEEISTTNPVATEQYGCVCSWGPTAENFNSEQA

SEQ ID NO: 152127 - protein, 32 aa, Artificial Sequence
  Description of Artificial Sequence: Synthetic polypeptide
DENEIRTTNPVSTEPYGTISMYDIQQQQNGNN

SEQ ID NO: 152128 - protein, 32 aa, Artificial Sequence
  Description of Artificial Sequence: Synthetic polypeptide
DENEIRTTNPVSTEPYGTISMYDIQQQQNGNH

SEQ ID NO: 152129 - protein, 34 aa, Artificial Sequence
  Description of Artificial Sequence: Synthetic polypeptide
DEEEISTTNPVATEQYGCVCSWMEHNQFFNSDQE

SEQ ID NO: 152130 - protein, 34 aa, Artificial Sequence
  Description of Artificial Sequence: Synthetic polypeptide
DEEEISTTNPVATEQYGCVCSWMNHAEYFGSQQS

SEQ ID NO: 152131 - protein, 36 aa, Artificial Sequence
  Description of Artificial Sequence: Synthetic polypeptide
DEEEIRTTNPVAYEQWGSVSGGEPAGGNMQNGMNNV

SEQ ID NO: 152132 - protein, 32 aa, Artificial Sequence
  Description of Artificial Sequence: Synthetic polypeptide
DENEIRTTNPVSTEPYGTISMYDIQQQQWGNH

SEQ ID NO: 152133 - protein, 36 aa, Artificial Sequence
  Description of Artificial Sequence: Synthetic polypeptide
DEEEIRTTNPVAYEQWGSVSGGENGGGNMRNGMNMV

SEQ ID NO: 152134 - protein, 35 aa, Artificial Sequence
  Description of Artificial Sequence: Synthetic polypeptide
DEEEISTTNPVATEQYGCVCSWPHNQENFGSENQS

SEQ ID NO: 152135 - protein, 33 aa, Artificial Sequence
  Description of Artificial Sequence: Synthetic polypeptide
DEMEIVTTNPVATRQYGTVCSATDGPVEFEGND

SEQ ID NO: 152136 - protein, 30 aa, Artificial Sequence
  Description of Artificial Sequence: Synthetic polypeptide
DDSEIRTTNPVSTEPYGTVANDIQQQVGQH

SEQ ID NO: 152137 - protein, 32 aa, Artificial Sequence
  Description of Artificial Sequence: Synthetic polypeptide
DDSEIRTTNPVSTEPYGTISMEDIQQQQNGNR

SEQ ID NO: 152138 - protein, 32 aa, Artificial Sequence
  Description of Artificial Sequence: Synthetic polypeptide
DDSEIRTTNPVSTEPYGTISAMETIQSQNGNH

SEQ ID NO: 152139 - protein, 36 aa, Artificial Sequence
  Description of Artificial Sequence: Synthetic polypeptide
DEEEIRTTNPVAYEQWGSVPSTTVAGSNYRNGGNPV

SEQ ID NO: 152140 - protein, 33 aa, Artificial Sequence
  Description of Artificial Sequence: Synthetic polypeptide
DEMEIVTTNPVATSQYGTVCSATDGPVEFEGND

SEQ ID NO: 152141 - protein, 33 aa, Artificial Sequence
  Description of Artificial Sequence: Synthetic polypeptide
DEEEIRTTNPVAYEQWGSVCVNWEMGEQDDHQF

SEQ ID NO: 152142 - protein, 35 aa, Artificial Sequence
  Description of Artificial Sequence: Synthetic polypeptide
DEEEISTTNPVATEQYGCVCSWNSTFQENFGSEQS

SEQ ID NO: 152143 - protein, 33 aa, Artificial Sequence
  Description of Artificial Sequence: Synthetic polypeptide
DENEIRTTNPVSTEPYGTISMEDIQQQQNGNHR

SEQ ID NO: 152144 - protein, 32 aa, Artificial Sequence
  Description of Artificial Sequence: Synthetic polypeptide
DENEIRTTNPVSTEPYGTISMEQIQQQQNGNH

SEQ ID NO: 152145 - protein, 33 aa, Artificial Sequence
  Description of Artificial Sequence: Synthetic polypeptide
DEMEIVTTNPVSTEQYGTVCSATDGEGEFEGND

SEQ ID NO: 152146 - protein, 32 aa, Artificial Sequence
  Description of Artificial Sequence: Synthetic polypeptide
DENEIRTTNPVSTEPYGTISMEDIQWQQNGNH

SEQ ID NO: 152147 - protein, 32 aa, Artificial Sequence
  Description of Artificial Sequence: Synthetic polypeptide
DENEIRTTNPVSTEPYGTISMEDIQWQQNGNF

SEQ ID NO: 152148 - protein, 32 aa, Artificial Sequence
  Description of Artificial Sequence: Synthetic polypeptide
DENEIRTTNPVSTEPYGTISMEDIQVQQNGNH

SEQ ID NO: 152149 - protein, 32 aa, Artificial Sequence
  Description of Artificial Sequence: Synthetic polypeptide
DENEIRTTNPVSTEPYGTISMEDIQTYQNGNH

SEQ ID NO: 152150 - protein, 32 aa, Artificial Sequence
  Description of Artificial Sequence: Synthetic polypeptide
DENEIRTTNPVSTEPYGTISMEDIQTQSNGNH

SEQ ID NO: 152151 - protein, 32 aa, Artificial Sequence
  Description of Artificial Sequence: Synthetic polypeptide
DENEIRTTNPVSTEPYGTISMEDIQTQQNGNH

SEQ ID NO: 152152 - protein, 32 aa, Artificial Sequence
  Description of Artificial Sequence: Synthetic polypeptide
DENEIRTTNPVSTEPYGTISMEDIQTEQNGNS

SEQ ID NO: 152153 - protein, 32 aa, Artificial Sequence
  Description of Artificial Sequence: Synthetic polypeptide
DENEIRTTNPVSTEPYGTISMEDIQSQQNGNH

SEQ ID NO: 152154 - protein, 32 aa, Artificial Sequence
  Description of Artificial Sequence: Synthetic polypeptide
DENEIRTTNPVSTEPYGTISMEDIQRQQNGPH

SEQ ID NO: 152155 - protein, 32 aa, Artificial Sequence
  Description of Artificial Sequence: Synthetic polypeptide
DENEIRTTNPVSTEPYGTISMEDIQQYQNGNH

SEQ ID NO: 152156 - protein, 32 aa, Artificial Sequence
  Description of Artificial Sequence: Synthetic polypeptide
DENEIRTTNPVSTEPYGTISMEDIQQWQNGNI

SEQ ID NO: 152157 - protein, 32 aa, Artificial Sequence
  Description of Artificial Sequence: Synthetic polypeptide
DENEIRTTNPVSTEPYGTISMEDIQQWQNGNH

SEQ ID NO: 152158 - protein, 32 aa, Artificial Sequence
  Description of Artificial Sequence: Synthetic polypeptide
DENEIRTTNPVSTEPYGTISMEDIQQVQNGNQ

SEQ ID NO: 152159 - protein, 32 aa, Artificial Sequence
  Description of Artificial Sequence: Synthetic polypeptide
DENEIRTTNPVSTEPYGTISMEDIQQVQNGNH

SEQ ID NO: 152160 - protein, 32 aa, Artificial Sequence
  Description of Artificial Sequence: Synthetic polypeptide
DENEIRTTNPVSTEPYGTISMEDIQQTVNGNH

SEQ ID NO: 152161 - protein, 32 aa, Artificial Sequence
  Description of Artificial Sequence: Synthetic polypeptide
DENEIRTTNPVSTEPYGTISMEDIQQTQNGNH

SEQ ID NO: 152162 - protein, 32 aa, Artificial Sequence
  Description of Artificial Sequence: Synthetic polypeptide
DENEIRTTNPVSTEPYGTISMEDIQQSQNGNH

SEQ ID NO: 152163 - protein, 32 aa, Artificial Sequence
  Description of Artificial Sequence: Synthetic polypeptide
DENEIRTTNPVSTEPYGTISMEDIQYQQNGNH

SEQ ID NO: 152164 - protein, 32 aa, Artificial Sequence
  Description of Artificial Sequence: Synthetic polypeptide
DENEIRTTNPVSTEPYGTISMEDIRQQQNGNH

SEQ ID NO: 152165 - protein, 32 aa, Artificial Sequence
  Description of Artificial Sequence: Synthetic polypeptide
DENEIRTTNPVSTEPYGTISMEDISHQQNGNH

SEQ ID NO: 152166 - protein, 32 aa, Artificial Sequence
  Description of Artificial Sequence: Synthetic polypeptide
DENEIRTTNPVSTEPYGTISMEDISQQQIGNH

SEQ ID NO: 152167 - protein, 36 aa, Artificial Sequence
  Description of Artificial Sequence: Synthetic polypeptide
DEAEIRTTNPVATEQYGSVCSPTSLSMVSEETNIMG

SEQ ID NO: 152168 - protein, 32 aa, Artificial Sequence
  Description of Artificial Sequence: Synthetic polypeptide
DENEIRTTNPVSTEPYGTISMEDLQQQQNGHH

SEQ ID NO: 152169 - protein, 32 aa, Artificial Sequence
  Description of Artificial Sequence: Synthetic polypeptide
DENEIRTTNPVSTEPYGTISMEDLQQQQNGGH

SEQ ID NO: 152170 - protein, 32 aa, Artificial Sequence
  Description of Artificial Sequence: Synthetic polypeptide
DENEIRTTNPVSTEPYGTISMEDLQQQQNENH

SEQ ID NO: 152171 - protein, 33 aa, Artificial Sequence
  Description of Artificial Sequence: Synthetic polypeptide
DEMVIVTTNPVATEQYGTVCSATDGPVEFEGND

SEQ ID NO: 152172 - protein, 33 aa, Artificial Sequence
  Description of Artificial Sequence: Synthetic polypeptide
DENEIRTTNPVSTEPYGTISMEDLIQQQQNGNH

SEQ ID NO: 152173 - protein, 33 aa, Artificial Sequence
  Description of Artificial Sequence: Synthetic polypeptide
DENEIRTTNPVSTEPYGTISMEDLIQQQQNGNA

SEQ ID NO: 152174 - protein, 34 aa, Artificial Sequence
  Description of Artificial Sequence: Synthetic polypeptide
DEHEIATTNPVATEQYGCVCTIEGNQDQGGGEHN

SEQ ID NO: 152175 - protein, 33 aa, Artificial Sequence
  Description of Artificial Sequence: Synthetic polypeptide
DENEIRTTNPVSTEPYGTISMEDIQQRQNGNTH

SEQ ID NO: 152176 - protein, 34 aa, Artificial Sequence
  Description of Artificial Sequence: Synthetic polypeptide
DEHEIATTNPVATEQYGCVAATNPLEAPDNQANN

SEQ ID NO: 152177 - protein, 33 aa, Artificial Sequence
  Description of Artificial Sequence: Synthetic polypeptide
DEMVIVTTNPVATEQYGTVCSFTDGPVEFEGND

SEQ ID NO: 152178 - protein, 32 aa, Artificial Sequence
  Description of Artificial Sequence: Synthetic polypeptide
DENEIRTTNPVSTEPYGTISMEDKQQQQNGNH

SEQ ID NO: 152179 - protein, 35 aa, Artificial Sequence
  Description of Artificial Sequence: Synthetic polypeptide
DEHEIATTNPVATEQWGSVCPTDNNDTDQGGDNNQ

SEQ ID NO: 152180 - protein, 32 aa, Artificial Sequence
  Description of Artificial Sequence: Synthetic polypeptide
DENEIRTTNPVSTEPYGTISMEDIYQQQNGNH

SEQ ID NO: 152181 - protein, 32 aa, Artificial Sequence
  Description of Artificial Sequence: Synthetic polypeptide
DENEIRTTNPVSTEPYGTISMEDIWQQQNGNH

SEQ ID NO: 152182 - protein, 32 aa, Artificial Sequence
  Description of Artificial Sequence: Synthetic polypeptide
DENEIRTTNPVSTEPYGTISMEDIVQQQNGNH

SEQ ID NO: 152183 - protein, 35 aa, Artificial Sequence
  Description of Artificial Sequence: Synthetic polypeptide
DEHEIATTNPVATEQWGSVCPTDNNDQMQGGDNSN

SEQ ID NO: 152184 - protein, 32 aa, Artificial Sequence
  Description of Artificial Sequence: Synthetic polypeptide
DENEIRTTNPVSTEPYGTISMEDISQQQNGNH

SEQ ID NO: 152185 - protein, 34 aa, Artificial Sequence
  Description of Artificial Sequence: Synthetic polypeptide
DEEEISTTNPVATEQYGQCVCSNSEHQHFGSDQD

SEQ ID NO: 152186 - protein, 33 aa, Artificial Sequence
  Description of Artificial Sequence: Synthetic polypeptide
DEMVIVTTNPVATEQYGTVCSATDGPVEEEGND

SEQ ID NO: 152187 - protein, 32 aa, Artificial Sequence
  Description of Artificial Sequence: Synthetic polypeptide
DENEIRTTNPVSTEPYGTISMEDIQQQYNGNH

SEQ ID NO: 152188 - protein, 32 aa, Artificial Sequence
  Description of Artificial Sequence: Synthetic polypeptide
DENEIRTTNPVSTEPYGTISMEDIQQQVNGNH

SEQ ID NO: 152189 - protein, 32 aa, Artificial Sequence
  Description of Artificial Sequence: Synthetic polypeptide
DENEIRTTNPVSTEPYGTISMEDIQQQQNGRH

SEQ ID NO: 152190 - protein, 33 aa, Artificial Sequence
  Description of Artificial Sequence: Synthetic polypeptide
DDEEIKTTNPVATEQYGTVSTVGTGDGGQGEGD

SEQ ID NO: 152191 - protein, 32 aa, Artificial Sequence
  Description of Artificial Sequence: Synthetic polypeptide
DENEIRTTNPVSTEPYGTISMEDIQQQQNGNY

SEQ ID NO: 152192 - protein, 32 aa, Artificial Sequence
  Description of Artificial Sequence: Synthetic polypeptide
DENEIRTTNPVSTEPYGTISMEDIQQQQNGNW

SEQ ID NO: 152193 - protein, 32 aa, Artificial Sequence
  Description of Artificial Sequence: Synthetic polypeptide
DENEIRTTNPVSTEPYGTISMEDIQQQQNGNV

SEQ ID NO: 152194 - protein, 32 aa, Artificial Sequence
  Description of Artificial Sequence: Synthetic polypeptide
DENEIRTTNPVSTEPYGTISMEDIQQQQNGNT

SEQ ID NO: 152195 - protein, 35 aa, Artificial Sequence
  Description of Artificial Sequence: Synthetic polypeptide
DEHEIATTNPVATEHYGSVCQTNDLQDGQQQHGDV

SEQ ID NO: 152196 - protein, 32 aa, Artificial Sequence
  Description of Artificial Sequence: Synthetic polypeptide
DENEIRTTNPVSTEPYGTISMEDIQQQQNGNS

SEQ ID NO: 152197 - protein, 33 aa, Artificial Sequence
  Description of Artificial Sequence: Synthetic polypeptide
DENEIRTTNPVSTEPYGTISMEDIQQQQNGNRH

SEQ ID NO: 152198 - protein, 32 aa, Artificial Sequence
  Description of Artificial Sequence: Synthetic polypeptide
DENEIRTTNPVSTEPYGTISMEDIQQQQNGNQ

SEQ ID NO: 152199 - protein, 32 aa, Artificial Sequence
  Description of Artificial Sequence: Synthetic polypeptide
DENEIRTTNPVSTEPYGTISMEDIQQQQNGNP

SEQ ID NO: 152200 - protein, 32 aa, Artificial Sequence
  Description of Artificial Sequence: Synthetic polypeptide
DENEIRTTNPVSTEPYGTISMEDIQQQQNGNN

SEQ ID NO: 152201 - protein, 32 aa, Artificial Sequence
  Description of Artificial Sequence: Synthetic polypeptide
DENEIRTTNPVSTEPYGTISMEDIQQQQNGNM

SEQ ID NO: 152202 - protein, 32 aa, Artificial Sequence
  Description of Artificial Sequence: Synthetic polypeptide
DENEIRTTNPVSTEPYGTISMEDIQQQQNGNL

SEQ ID NO: 152203 - protein, 34 aa, Artificial Sequence
  Description of Artificial Sequence: Synthetic polypeptide
DEHEIATTNPVATEHYGSVCINIENDQHGQNDHS

SEQ ID NO: 152204 - protein, 32 aa, Artificial Sequence
  Description of Artificial Sequence: Synthetic polypeptide
DENEIRTTNPVSTEPYGTISMEDIQQQQNGNK

SEQ ID NO: 152205 - protein, 35 aa, Artificial Sequence
  Description of Artificial Sequence: Synthetic polypeptide
DDEEIRATNPVATDQYGSVSVDQNEGEQNEGGNGN

SEQ ID NO: 152206 - protein, 33 aa, Artificial Sequence
  Description of Artificial Sequence: Synthetic polypeptide
DENEIRTTNPVSTEPYGTISMEDIQQQQNGRNR

SEQ ID NO: 152207 - protein, 33 aa, Artificial Sequence
  Description of Artificial Sequence: Synthetic polypeptide
DEHEIATTNPVATEPWGSVCSGMNDDQMDLNKA

SEQ ID NO: 152208 - protein, 32 aa, Artificial Sequence
  Description of Artificial Sequence: Synthetic polypeptide
DENEIRTTNPVSTEPYGTISMEDIQQQQNRNH

SEQ ID NO: 152209 - protein, 34 aa, Artificial Sequence
  Description of Artificial Sequence: Synthetic polypeptide
DEHEIATTNPVATEPYGSVAGSGAPGQNHPDDNR

SEQ ID NO: 152210 - protein, 32 aa, Artificial Sequence
  Description of Artificial Sequence: Synthetic polypeptide
DENEIRTTNPVSTEPYGTISMEDIQQQTWGNH

SEQ ID NO: 152211 - protein, 34 aa, Artificial Sequence
  Description of Artificial Sequence: Synthetic polypeptide
DENAEIATTNPVAYESWGSVSGGNLQDHAGGNTQ

SEQ ID NO: 152212 - protein, 32 aa, Artificial Sequence
  Description of Artificial Sequence: Synthetic polypeptide
DENEIRTTNPVSTEPYGTISMEDIQQQTNGNH

SEQ ID NO: 152213 - protein, 32 aa, Artificial Sequence
  Description of Artificial Sequence: Synthetic polypeptide
DENEIRTTNPVSTEPYGTISMEDIQQQSNGNH

SEQ ID NO: 152214 - protein, 32 aa, Artificial Sequence
  Description of Artificial Sequence: Synthetic polypeptide
DENEIRTTNPVSTEPYGTISMEDIQQQRNYNH

SEQ ID NO: 152215 - protein, 33 aa, Artificial Sequence
  Description of Artificial Sequence: Synthetic polypeptide
DENEIRTTNPVSTEPYGTISMEDIQQQRNGENH

SEQ ID NO: 152216 - protein, 34 aa, Artificial Sequence
  Description of Artificial Sequence: Synthetic polypeptide
DENAEICTTNPVAYECWGSVATNLQGNAGENHGH

SEQ ID NO: 152217 - protein, 32 aa, Artificial Sequence
  Description of Artificial Sequence: Synthetic polypeptide
DENEIRTTNPVSTEPYGTISMEDIQQQQYGNQ

SEQ ID NO: 152218 - protein, 32 aa, Artificial Sequence
  Description of Artificial Sequence: Synthetic polypeptide
DENEIRTTNPVSTEPYGTISMEDIQQQWNGNH

SEQ ID NO: 152219 - protein, 32 aa, Artificial Sequence
  Description of Artificial Sequence: Synthetic polypeptide
DENEIRTTNPVSTEPYGTISMEDIQQQQYGNH

SEQ ID NO: 152220 - protein, 32 aa, Artificial Sequence
  Description of Artificial Sequence: Synthetic polypeptide
DENEIRTTNPVSTEPYGTISMEDIQQQQVGNL

SEQ ID NO: 152221 - protein, 32 aa, Artificial Sequence
  Description of Artificial Sequence: Synthetic polypeptide
DENEIRTTNPVSTEPYGTISMEDIQQQQVGNH

SEQ ID NO: 152222 - protein, 32 aa, Artificial Sequence
  Description of Artificial Sequence: Synthetic polypeptide
DENEIRTTNPVSTEPYGTISMEDIQQQQTGNS

SEQ ID NO: 152223 - protein, 32 aa, Artificial Sequence
  Description of Artificial Sequence: Synthetic polypeptide
DENEIRTTNPVSTEPYGTISMEDIQQQQTGNH

SEQ ID NO: 152224 - protein, 32 aa, Artificial Sequence
  Description of Artificial Sequence: Synthetic polypeptide
DENEIRTTNPVSTEPYGTISMEDIQQQQSGNH

SEQ ID NO: 152225 - protein, 33 aa, Artificial Sequence
  Description of Artificial Sequence: Synthetic polypeptide
DENEIRTTNPVSTEPYGTISMEDIQQQQRGNHN

SEQ ID NO: 152226 - protein, 32 aa, Artificial Sequence
  Description of Artificial Sequence: Synthetic polypeptide
DENEIRTTNPVSTEPYGTISMEDIQQQQQGNH

SEQ ID NO: 152227 - protein, 32 aa, Artificial Sequence
  Description of Artificial Sequence: Synthetic polypeptide
DENEIRTTNPVSTEPYGTISMEDIQQQQPGNH

SEQ ID NO: 152228 - protein, 32 aa, Artificial Sequence
  Description of Artificial Sequence: Synthetic polypeptide
DENEIRTTNPVSTEPYGTISMEDIQQQQWGNH

SEQ ID NO: 152229 - protein, 32 aa, Artificial Sequence
  Description of Artificial Sequence: Synthetic polypeptide
DENEIRTTNPVSTEPYGTISMEQIQQQQLGNH

SEQ ID NO: 152230 - protein, 36 aa, Artificial Sequence
  Description of Artificial Sequence: Synthetic polypeptide
DEEEIRTTNPVATEQYGSYVSSVPVEPQMRPLVSIE

SEQ ID NO: 152231 - protein, 36 aa, Artificial Sequence
  Description of Artificial Sequence: Synthetic polypeptide
DDEEIKTTNPVATEQYGSVVSDDQNLQVGEDGGGEQ

SEQ ID NO: 152232 - protein, 33 aa, Artificial Sequence
  Description of Artificial Sequence: Synthetic polypeptide
DEMEIWTTNPVCTEQYGTVCSATDGPVEFEGND

SEQ ID NO: 152233 - protein, 33 aa, Artificial Sequence
  Description of Artificial Sequence: Synthetic polypeptide
DENEIRTTNPVSTEPYGTISMEDWIQNQQNGNH

SEQ ID NO: 152234 - protein, 32 aa, Artificial Sequence
  Description of Artificial Sequence: Synthetic polypeptide
DENEIRTTNPVSTEPYGTISMEDVQWPQSGNH

SEQ ID NO: 152235 - protein, 32 aa, Artificial Sequence
  Description of Artificial Sequence: Synthetic polypeptide
DENEIRTTNPVSTEPYGTISMEDVQQQQNGNH

SEQ ID NO: 152236 - protein, 33 aa, Artificial Sequence
  Description of Artificial Sequence: Synthetic polypeptide
DEMEIYSTNPVATEQYGTVCSATDGPVEFEGND

SEQ ID NO: 152237 - protein, 33 aa, Artificial Sequence
  Description of Artificial Sequence: Synthetic polypeptide
DEMEIYTTNPVATEQYGTVCKATDGPVEFEGND

SEQ ID NO: 152238 - protein, 38 aa, Artificial Sequence
  Description of Artificial Sequence: Synthetic polypeptide
DEEEIRTTNPVATEQYGVVSTVVTNLNGNQNQGTEEEE

SEQ ID NO: 152239 - protein, 34 aa, Artificial Sequence
  Description of Artificial Sequence: Synthetic polypeptide
DDEEIKTTNPVATEQYGAVSTGVGGENDGTGEGQ

SEQ ID NO: 152240 - protein, 30 aa, Artificial Sequence
  Description of Artificial Sequence: Synthetic polypeptide
DEMELRTTNPVATEQWGDVSEMEMNAAEDA

SEQ ID NO: 152241 - protein, 35 aa, Artificial Sequence
  Description of Artificial Sequence: Synthetic polypeptide
DEEEISTTNPVATEQYGQCVCSMTEEDQYFGSDQS

SEQ ID NO: 152242 - protein, 36 aa, Artificial Sequence
  Description of Artificial Sequence: Synthetic polypeptide
DEEEISTTNPVATEQYGQCVCSMTELQENFGSQTQS

SEQ ID NO: 152243 - protein, 33 aa, Artificial Sequence
  Description of Artificial Sequence: Synthetic polypeptide
DEMELVTTNPVATEQYGTVCSATDGPDEFEGND

SEQ ID NO: 152244 - protein, 33 aa, Artificial Sequence
  Description of Artificial Sequence: Synthetic polypeptide
DEMELVTTNPVATEQYGTVCSATDGPVEFEGND

SEQ ID NO: 152245 - protein, 33 aa, Artificial Sequence
  Description of Artificial Sequence: Synthetic polypeptide
DENEIRTTNPVSTEPYGTISMEDVIQQQQNGNH

SEQ ID NO: 152246 - protein, 33 aa, Artificial Sequence
  Description of Artificial Sequence: Synthetic polypeptide
DENEIRTTNPVSTEPYGTISMEDVIQQQQNGNF

SEQ ID NO: 152247 - protein, 33 aa, Artificial Sequence
  Description of Artificial Sequence: Synthetic polypeptide
DENEIRTTNPVSTEPYGTISMEDTQQQQNGSNH

SEQ ID NO: 152248 - protein, 36 aa, Artificial Sequence
  Description of Artificial Sequence: Synthetic polypeptide
DEEEISTTNPVATEQYGQCVCSMTGEHNQNGSDNQS

SEQ ID NO: 152249 - protein, 32 aa, Artificial Sequence
  Description of Artificial Sequence: Synthetic polypeptide
DENEIRTTNPVSTEPYGTISMEDWQQEQNGNH

SEQ ID NO: 152250 - protein, 32 aa, Artificial Sequence
  Description of Artificial Sequence: Synthetic polypeptide
DENEIRTTNPVSTEPYGTISMEDWQQQQNGNH

SEQ ID NO: 152251 - protein, 36 aa, Artificial Sequence
  Description of Artificial Sequence: Synthetic polypeptide
DEEEIRTTNPVATEQYGSYVTHTGEDHNPENGEEQM

SEQ ID NO: 152252 - protein, 39 aa, Artificial Sequence
  Description of Artificial Sequence: Synthetic polypeptide
DEEEIRTTNPVATEQYGVVSTVVTNLNGNQLIGNNEQGQ

SEQ ID NO: 152253 - protein, 32 aa, Artificial Sequence
  Description of Artificial Sequence: Synthetic polypeptide
DENEIRTTNPVSTEPYGTISMEPIQQQQNGNH

SEQ ID NO: 152254 - protein, 32 aa, Artificial Sequence
  Description of Artificial Sequence: Synthetic polypeptide
DENEIRTTNPVSTEPYGTISMEMIQQQQNGNH

SEQ ID NO: 152255 - protein, 32 aa, Artificial Sequence
  Description of Artificial Sequence: Synthetic polypeptide
DENEIRTTNPVSTEPYGTISMEKIQQQQNGNH

SEQ ID NO: 152256 - protein, 32 aa, Artificial Sequence
  Description of Artificial Sequence: Synthetic polypeptide
DENEIRTTNPVSTEPYGTISMEIPQQQQNGNH

SEQ ID NO: 152257 - protein, 32 aa, Artificial Sequence
  Description of Artificial Sequence: Synthetic polypeptide
DENEIRTTNPVSTEPYGTISMEIIQQQQNGNH

SEQ ID NO: 152258 - protein, 32 aa, Artificial Sequence
  Description of Artificial Sequence: Synthetic polypeptide
DENEIRTTNPVSTEPYGTISMEIIQQQQNGNA

SEQ ID NO: 152259 - protein, 32 aa, Artificial Sequence
  Description of Artificial Sequence: Synthetic polypeptide
DENEIRTTNPVSTEPYGTISMEIIQEQQNGNH

SEQ ID NO: 152260 - protein, 32 aa, Artificial Sequence
  Description of Artificial Sequence: Synthetic polypeptide
DENEIRTTNPVSTEPYGTISMEHIQQQQNRNH

SEQ ID NO: 152261 - protein, 38 aa, Artificial Sequence
  Description of Artificial Sequence: Synthetic polypeptide
DEEEIRTTNPVATEQYGVVSTVVTNLNGNQQGTDEEED

SEQ ID NO: 152262 - protein, 32 aa, Artificial Sequence
  Description of Artificial Sequence: Synthetic polypeptide
DENEIRTTNPVSTEPYGTISMEHIQQQQNGNH

SEQ ID NO: 152263 - protein, 32 aa, Artificial Sequence
  Description of Artificial Sequence: Synthetic polypeptide
DENEIRTTNPVSTEPYGTISMEGIQQQQNGNH

SEQ ID NO: 152264 - protein, 32 aa, Artificial Sequence
  Description of Artificial Sequence: Synthetic polypeptide
DENEIRTTNPVSTEPYGTISMEFIQQQQNGNH

SEQ ID NO: 152265 - protein, 32 aa, Artificial Sequence
  Description of Artificial Sequence: Synthetic polypeptide
DENEIRTTNPVSTEPYGTISMEEMQQQQNGNH

SEQ ID NO: 152266 - protein, 32 aa, Artificial Sequence
  Description of Artificial Sequence: Synthetic polypeptide
DENEIRTTNPVSTEPYGTISMEEIQQQQNGNH

SEQ ID NO: 152267 - protein, 33 aa, Artificial Sequence
  Description of Artificial Sequence: Synthetic polypeptide
DEMEIVTTNPVSTEQYGTVCSATDGPVEFEGNL

SEQ ID NO: 152268 - protein, 32 aa, Artificial Sequence
  Description of Artificial Sequence: Synthetic polypeptide
DENEIRTTNPVSTEPYGTISMEEIQQDQFGNQ

SEQ ID NO: 152269 - protein, 32 aa, Artificial Sequence
  Description of Artificial Sequence: Synthetic polypeptide
DENEIRTTNPVSTEPYGTISMEEIIQEQNGNE

SEQ ID NO: 152270 - protein, 32 aa, Artificial Sequence
  Description of Artificial Sequence: Synthetic polypeptide
DENEIRTTNPVSTEPYGTISMEDYQQQQNGNH

SEQ ID NO: 152271 - protein, 33 aa, Artificial Sequence
  Description of Artificial Sequence: Synthetic polypeptide
DEMEIVTTNPVSTEQYGTVCSATDGPVEFEGND

SEQ ID NO: 152272 - protein, 34 aa, Artificial Sequence
  Description of Artificial Sequence: Synthetic polypeptide
DEHEIATTNPVATEQYGCWNAATANPLQAPMENN

SEQ ID NO: 152273 - protein, 33 aa, Artificial Sequence
  Description of Artificial Sequence: Synthetic polypeptide
DENEIRTTNPVSTEPYGTISMEDTISQQQNGNH

SEQ ID NO: 152274 - protein, 33 aa, Artificial Sequence
  Description of Artificial Sequence: Synthetic polypeptide
DENEIRTTNPVSTEPYGTISMEDTIQQQQNGNH

SEQ ID NO: 152275 - protein, 33 aa, Artificial Sequence
  Description of Artificial Sequence: Synthetic polypeptide
DEMQIVTTNPVATEQYGTVCSATDGPVEFEGND

SEQ ID NO: 152276 - protein, 33 aa, Artificial Sequence
  Description of Artificial Sequence: Synthetic polypeptide
DEMSIVTTNPVATEQYGTVCSATDGPVEFEGND

SEQ ID NO: 152277 - protein, 34 aa, Artificial Sequence
  Description of Artificial Sequence: Synthetic polypeptide
DEHEIATTNPVATEQYGSVCAANMGEEQPDDQNS

SEQ ID NO: 152278 - protein, 33 aa, Artificial Sequence
  Description of Artificial Sequence: Synthetic polypeptide
DEMTIVTTNPVATEQYGTVCSATDGPVEFEGND

SEQ ID NO: 152279 - protein, 37 aa, Artificial Sequence
  Description of Artificial Sequence: Synthetic polypeptide
DEEEIRTTNPVATEQYGVVSTVVTNLNGNQQSTTEEN

SEQ ID NO: 152280 - protein, 32 aa, Artificial Sequence
  Description of Artificial Sequence: Synthetic polypeptide
DENEIRTTNPVSTEPYGTISMEDPQQQQPGNH

SEQ ID NO: 152281 - protein, 32 aa, Artificial Sequence
  Description of Artificial Sequence: Synthetic polypeptide
DENEIRTTNPVSTEPYGTISMEDPQQQQNGNH

SEQ ID NO: 152282 - protein, 33 aa, Artificial Sequence
  Description of Artificial Sequence: Synthetic polypeptide
DENEIRTTNPVSTEPYGTISMEDNIQQQQNGNH

SEQ ID NO: 152283 - protein, 33 aa, Artificial Sequence
  Description of Artificial Sequence: Synthetic polypeptide
DENEIRTTNPVSTEPYGTISMEDNIQQQQAGNH

SEQ ID NO: 152284 - protein, 33 aa, Artificial Sequence
  Description of Artificial Sequence: Synthetic polypeptide
DENEIRTTNPVSTEPYGTISMEDNIQQQHNGNH

SEQ ID NO: 152285 - protein, 32 aa, Artificial Sequence
  Description of Artificial Sequence: Synthetic polypeptide
DENEIRTTNPVSTEPYGTISMEDMQQQQNGNH

SEQ ID NO: 152286 - protein, 32 aa, Artificial Sequence
  Description of Artificial Sequence: Synthetic polypeptide
DENEIRTTNPVSTEPYGTISMEDMQQPQSGNE

SEQ ID NO: 152287 - protein, 32 aa, Artificial Sequence
  Description of Artificial Sequence: Synthetic polypeptide
DENEIRTTNPVSTEPYGTISMEDMQQEQNGNH

SEQ ID NO: 152288 - protein, 39 aa, Artificial Sequence
  Description of Artificial Sequence: Synthetic polypeptide
DEEEIRTTNPVATEQYGVVSTVVTNLNGNTQQGNNEQGQ

SEQ ID NO: 152289 - protein, 36 aa, Artificial Sequence
  Description of Artificial Sequence: Synthetic polypeptide
DEHEIATTNPVATEQYGSVAITENDQDDQRQGGDHN

SEQ ID NO: 152290 - protein, 38 aa, Artificial Sequence
  Description of Artificial Sequence: Synthetic polypeptide
DEEEIRTTNPVATEQYGVVSTVVTNLNQLQQGTEEEEE

SEQ ID NO: 152291 - protein, 36 aa, Artificial Sequence
  Description of Artificial Sequence: Synthetic polypeptide
CESEIRTTNPVATEQYGEVVPSYTRSLAQMASGNNA

SEQ ID NO: 152292 - protein, 33 aa, Artificial Sequence
  Description of Artificial Sequence: Synthetic polypeptide
DEMPIVTTNPVATEQYGTVCSATDGPVEFEGND

SEQ ID NO: 152293 - protein, 35 aa, Artificial Sequence
  Description of Artificial Sequence: Synthetic polypeptide
DEHEIATTNPVATEQYGSVCAPENDLEQDDALTGN

SEQ ID NO: 152294 - protein, 39 aa, Artificial Sequence
  Description of Artificial Sequence: Synthetic polypeptide
DEEEIRTTNPVATEQYGVVSTVVTNLNGNQQQGNADEEE

SEQ ID NO: 152295 - protein, 38 aa, Artificial Sequence
  Description of Artificial Sequence: Synthetic polypeptide
DEEEIRTTNPVATEQYGVVSTVVTNLNGNQQGTSTEDN

SEQ ID NO: 152296 - protein, 33 aa, Artificial Sequence
  Description of Artificial Sequence: Synthetic polypeptide
DENEIRTTNPVSTEPYGTISMEDSWQQQQNGNH

SEQ ID NO: 152297 - protein, 38 aa, Artificial Sequence
  Description of Artificial Sequence: Synthetic polypeptide
DEEEIRTTNPVATEQYGVVSTVVTNLNGNQQGTQTEEQ

SEQ ID NO: 152298 - protein, 33 aa, Artificial Sequence
  Description of Artificial Sequence: Synthetic polypeptide
DEMEVVTTNPVATEQYGTVCAATGPVESREGND

SEQ ID NO: 152299 - protein, 33 aa, Artificial Sequence
  Description of Artificial Sequence: Synthetic polypeptide
DEMEVVTTNPVATEQYGTVCSATDGPVEFEGND

SEQ ID NO: 152300 - protein, 33 aa, Artificial Sequence
  Description of Artificial Sequence: Synthetic polypeptide
DENEIRTTNPVSTEPYGTISMEDSSQQQNGNYH

SEQ ID NO: 152301 - protein, 33 aa, Artificial Sequence
  Description of Artificial Sequence: Synthetic polypeptide
DENEIRTTNPVSTEPYGTISMEDSQQQQNGNNH

SEQ ID NO: 152302 - protein, 33 aa, Artificial Sequence
  Description of Artificial Sequence: Synthetic polypeptide
DENEIRTTNPVSTEPYGTISMEDSIQQQQNGNH

SEQ ID NO: 152303 - protein, 33 aa, Artificial Sequence
  Description of Artificial Sequence: Synthetic polypeptide
DEMEVVTTNPVATEQYGTVCSATDGPVEFEGNL

SEQ ID NO: 152304 - protein, 38 aa, Artificial Sequence
  Description of Artificial Sequence: Synthetic polypeptide
DEEEIRTTNPVATEQYGVVSTVVTNLNGNQQGTEDEEE

SEQ ID NO: 152305 - protein, 33 aa, Artificial Sequence
  Description of Artificial Sequence: Synthetic polypeptide
DEMEVVTTNPVATEQYGTVCSATDKPVEFEGNV

SEQ ID NO: 152306 - protein, 32 aa, Artificial Sequence
  Description of Artificial Sequence: Synthetic polypeptide
DENEIRTTNPVSTEPYGTISMEDRQQQQNGNH

SEQ ID NO: 152307 - protein, 33 aa, Artificial Sequence
  Description of Artificial Sequence: Synthetic polypeptide
DEMGIVTTNPVATEQYGTVCSATDGPVEFEGND

SEQ ID NO: 152308 - protein, 32 aa, Artificial Sequence
  Description of Artificial Sequence: Synthetic polypeptide
DENEIRTTNPVSTEPYGTISMEDRQQQQDGNH

SEQ ID NO: 152309 - protein, 33 aa, Artificial Sequence
  Description of Artificial Sequence: Synthetic polypeptide
DEMHIVTTNPVATEQYGTVCSATDGPVEFEGND

SEQ ID NO: 152310 - protein, 33 aa, Artificial Sequence
  Description of Artificial Sequence: Synthetic polypeptide
DEMLIVTTNPVATEQYGTVCSATDGPVEFEGND

SEQ ID NO: 152311 - protein, 33 aa, Artificial Sequence
  Description of Artificial Sequence: Synthetic polypeptide
DEMMIVTTNPVATEQYGTVCSATDGPVEFEGND

SEQ ID NO: 152312 - protein, 32 aa, Artificial Sequence
  Description of Artificial Sequence: Synthetic polypeptide
DENEIRTTNPVSTEPYGTISMEDQQQQQNGNH

SEQ ID NO: 152313 - protein, 34 aa, Artificial Sequence
  Description of Artificial Sequence: Synthetic polypeptide
DEHEIATTNPVATEQYGSVFVWINGEQDRKKVTH

SEQ ID NO: 152314 - protein, 34 aa, Artificial Sequence
  Description of Artificial Sequence: Synthetic polypeptide
DDEEIKTTNPVATEQYGDVSGVDQNNGQGEGGQN

SEQ ID NO: 152315 - protein, 34 aa, Artificial Sequence
  Description of Artificial Sequence: Synthetic polypeptide
DEMEIVTTNPVATEQYGTVCSATDGHVEFEGNDA

SEQ ID NO: 152316 - protein, 34 aa, Artificial Sequence
  Description of Artificial Sequence: Synthetic polypeptide
DEMEIVTTNPVATEQYGTVCSATDGHPVEFEGND

SEQ ID NO: 152317 - protein, 33 aa, Artificial Sequence
  Description of Artificial Sequence: Synthetic polypeptide
DENEIRTTNPVSTEPYGTISWEDDNQEQFGNNQ

SEQ ID NO: 152318 - protein, 33 aa, Artificial Sequence
  Description of Artificial Sequence: Synthetic polypeptide
CEEEIRTTNPVATEQYGCVCSSPEHANFGSEQS

SEQ ID NO: 152319 - protein, 36 aa, Artificial Sequence
  Description of Artificial Sequence: Synthetic polypeptide
CEEEIRTTNPVATEQYGCVCSTEDHNQEGFGSDNQS

SEQ ID NO: 152320 - protein, 34 aa, Artificial Sequence
  Description of Artificial Sequence: Synthetic polypeptide
DEAEIRTTNPVATEQYGSVSFYVDLEVETEEQED

SEQ ID NO: 152321 - protein, 35 aa, Artificial Sequence
  Description of Artificial Sequence: Synthetic polypeptide
CEEEIRTTNPVATEQYGCVCSTEHNQENFNSENQE

SEQ ID NO: 152322 - protein, 36 aa, Artificial Sequence
  Description of Artificial Sequence: Synthetic polypeptide
DEAEIRTTNPVATEQYGSVSFTTASVEHEGNNNDED

SEQ ID NO: 152323 - protein, 35 aa, Artificial Sequence
  Description of Artificial Sequence: Synthetic polypeptide
CEEEIRTTNPVATEQYGCVCSTELNEENFNSDNQE

SEQ ID NO: 152324 - protein, 32 aa, Artificial Sequence
  Description of Artificial Sequence: Synthetic polypeptide
DEMEISTTNPVATQQYGCVCSTEHEYFGSDQA

SEQ ID NO: 152325 - protein, 35 aa, Artificial Sequence
  Description of Artificial Sequence: Synthetic polypeptide
DEPEIKTTNPVATEQYGSVIDTNNNGQGEQGGQQV

SEQ ID NO: 152326 - protein, 34 aa, Artificial Sequence
  Description of Artificial Sequence: Synthetic polypeptide
DEAEIRTTNPVATEQYGSVSDTHSSTDSIDEIQI

SEQ ID NO: 152327 - protein, 36 aa, Artificial Sequence
  Description of Artificial Sequence: Synthetic polypeptide
DEAEIRTTNPVATEQYGSVSDATAEVESQRQQEDTI

SEQ ID NO: 152328 - protein, 36 aa, Artificial Sequence
  Description of Artificial Sequence: Synthetic polypeptide
DEHEIRTTNPVATEQYGLACSSATDLQVTDGDDNQE

SEQ ID NO: 152329 - protein, 35 aa, Artificial Sequence
  Description of Artificial Sequence: Synthetic polypeptide
DEAEIRTTNPVATEQYGSVSAMWGDSQQEGLHEHF

SEQ ID NO: 152330 - protein, 38 aa, Artificial Sequence
  Description of Artificial Sequence: Synthetic polypeptide
DEEEIRTTNPVATEQYGVVSTVVNNQQGNNNNEQNETD

SEQ ID NO: 152331 - protein, 35 aa, Artificial Sequence
  Description of Artificial Sequence: Synthetic polypeptide
DEPEIATTNPVAYEQWGSVCSTENLGDQDIQNGGQ

SEQ ID NO: 152332 - protein, 36 aa, Artificial Sequence
  Description of Artificial Sequence: Synthetic polypeptide
CEEEIRTTNPVATEQYGCVCSTGEDLNQENFNSDQD

SEQ ID NO: 152333 - protein, 34 aa, Artificial Sequence
  Description of Artificial Sequence: Synthetic polypeptide
DEPEIATTNPVATWQYGMVSTAMLEFQQAQSGMN

SEQ ID NO: 152334 - protein, 35 aa, Artificial Sequence
  Description of Artificial Sequence: Synthetic polypeptide
CEEEIRTTNPVATEQYGCVCSTGEHFQEHFGSEQE

SEQ ID NO: 152335 - protein, 35 aa, Artificial Sequence
  Description of Artificial Sequence: Synthetic polypeptide
CEEEIRTTNPVATEQYGCVCSSGNHNQNFNSDNQS

SEQ ID NO: 152336 - protein, 34 aa, Artificial Sequence
  Description of Artificial Sequence: Synthetic polypeptide
DEMEISTTNPVATEQYGTVTSATDGVQVEFQLND

SEQ ID NO: 152337 - protein, 34 aa, Artificial Sequence
  Description of Artificial Sequence: Synthetic polypeptide
DEAEIRTTNPVATEQYGSVSMTDMTDVTIEQESI

SEQ ID NO: 152338 - protein, 35 aa, Artificial Sequence
  Description of Artificial Sequence: Synthetic polypeptide
DEHEIRTTNPVATEQYGSCINVFDDLQTGIEEQQE

SEQ ID NO: 152339 - protein, 32 aa, Artificial Sequence
  Description of Artificial Sequence: Synthetic polypeptide
DEPEIRTTNPVATEQWGDVSVIEQMIAAEDPP

SEQ ID NO: 152340 - protein, 35 aa, Artificial Sequence
  Description of Artificial Sequence: Synthetic polypeptide
DEMEISTTNPVATEQYGTVCSNTMEPNEFEGSNDA

SEQ ID NO: 152341 - protein, 32 aa, Artificial Sequence
  Description of Artificial Sequence: Synthetic polypeptide
DEPEIRTTNPVATEQWGDVSVIEQMIAAEDEE

SEQ ID NO: 152342 - protein, 33 aa, Artificial Sequence
  Description of Artificial Sequence: Synthetic polypeptide
DEPEIRTTNPVATEQWGDVSVIEQMEAAENDTP

SEQ ID NO: 152343 - protein, 31 aa, Artificial Sequence
  Description of Artificial Sequence: Synthetic polypeptide
DEPEIRTTNPVATEQWGDVSVIEMPAAEVAI

SEQ ID NO: 152344 - protein, 31 aa, Artificial Sequence
  Description of Artificial Sequence: Synthetic polypeptide
DEPEIRTTNPVATEQWGDVSVIEMIAAEQDQ

SEQ ID NO: 152345 - protein, 31 aa, Artificial Sequence
  Description of Artificial Sequence: Synthetic polypeptide
DEPEIRTTNPVATEQWGDVSVIEMIAAEDIG

SEQ ID NO: 152346 - protein, 34 aa, Artificial Sequence
  Description of Artificial Sequence: Synthetic polypeptide
DEHEIRTTNPVATEQYGSCINVTHALLTGEEQQE

SEQ ID NO: 152347 - protein, 33 aa, Artificial Sequence
  Description of Artificial Sequence: Synthetic polypeptide
DEPEIATTNPVATEQYGSVSSVINQAEIEFEQI

SEQ ID NO: 152348 - protein, 31 aa, Artificial Sequence
  Description of Artificial Sequence: Synthetic polypeptide
DEPEIRTTNPVATEQWGDVSVIEMIAAEDFE

SEQ ID NO: 152349 - protein, 31 aa, Artificial Sequence
  Description of Artificial Sequence: Synthetic polypeptide
DEPEIRTTNPVATEQWGDVSVIEAMIAAEAV

SEQ ID NO: 152350 - protein, 31 aa, Artificial Sequence
  Description of Artificial Sequence: Synthetic polypeptide
DEPEIRTTNPVATEQWGDVSVIEAMIAAADA

SEQ ID NO: 152351 - protein, 31 aa, Artificial Sequence
  Description of Artificial Sequence: Synthetic polypeptide
DEPEIRTTNPVATEQWGDVSVEEMIAAEVDA

SEQ ID NO: 152352 - protein, 33 aa, Artificial Sequence
  Description of Artificial Sequence: Synthetic polypeptide
DEPEIRTTNPVATEQWGDVSEVIEQMEAAENDT

SEQ ID NO: 152353 - protein, 31 aa, Artificial Sequence
  Description of Artificial Sequence: Synthetic polypeptide
DEPEIRTTNPVATEQWGDVSEVEMIAAEDAP

SEQ ID NO: 152354 - protein, 33 aa, Artificial Sequence
  Description of Artificial Sequence: Synthetic polypeptide
DEPEIRTTNPVATEQWGDVSCVIEQMEAPENDT

SEQ ID NO: 152355 - protein, 32 aa, Artificial Sequence
  Description of Artificial Sequence: Synthetic polypeptide
DEPEIRTTNPVATEQWGDCVSVIEQMIAPTDM

SEQ ID NO: 152356 - protein, 33 aa, Artificial Sequence
  Description of Artificial Sequence: Synthetic polypeptide
DEPEIRTTNPVATEQWGDCVSTVIEQMIAVEDQ

SEQ ID NO: 152357 - protein, 31 aa, Artificial Sequence
  Description of Artificial Sequence: Synthetic polypeptide
DEPEIRTTNPVATEQWGDVSVIEEIAAETGT

SEQ ID NO: 152358 - protein, 32 aa, Artificial Sequence
  Description of Artificial Sequence: Synthetic polypeptide
DEPEIRTTNPVATEQWGDVSVIEQMIAAEFTT

SEQ ID NO: 152359 - protein, 36 aa, Artificial Sequence
  Description of Artificial Sequence: Synthetic polypeptide
DEAEIRTTNPVATEQYGSVPWVTVEMEIGIGNEFRE

SEQ ID NO: 152360 - protein, 35 aa, Artificial Sequence
  Description of Artificial Sequence: Synthetic polypeptide
DEAEIRTTNPVATEQYGSVPTTDLPHEPIIQESDY

SEQ ID NO: 152361 - protein, 30 aa, Artificial Sequence
  Description of Artificial Sequence: Synthetic polypeptide
DENVIRTTNPVATEQWGDVSEIEMNAAEDA

SEQ ID NO: 152362 - protein, 31 aa, Artificial Sequence
  Description of Artificial Sequence: Synthetic polypeptide
DDSEVAPTNPVSTEGYGNVSANNLQSSVGQR

SEQ ID NO: 152363 - protein, 36 aa, Artificial Sequence
  Description of Artificial Sequence: Synthetic polypeptide
DEAEIRTTNPVATEQYGSVNWMLDLEQERSNQNEGN

SEQ ID NO: 152364 - protein, 33 aa, Artificial Sequence
  Description of Artificial Sequence: Synthetic polypeptide
DDCEIRTTNPVATEQYGSVPDTFWPETESQNEV

SEQ ID NO: 152365 - protein, 36 aa, Artificial Sequence
  Description of Artificial Sequence: Synthetic polypeptide
DEAEIRTTNPVATEQYGSVNWCTLDLEQYSDQNEGN

SEQ ID NO: 152366 - protein, 37 aa, Artificial Sequence
  Description of Artificial Sequence: Synthetic polypeptide
DEEEIRTTNPVATEQYGSVSVEDMSLTINVDVHGPDY

SEQ ID NO: 152367 - protein, 35 aa, Artificial Sequence
  Description of Artificial Sequence: Synthetic polypeptide
DEEEIRTTNPVATEQYGSVSVENDDHADAASELEH

SEQ ID NO: 152368 - protein, 38 aa, Artificial Sequence
  Description of Artificial Sequence: Synthetic polypeptide
DEEEIRTTNPVATEQYGVVSTVVNNQQGNNQQNETEEQ

SEQ ID NO: 152369 - protein, 36 aa, Artificial Sequence
  Description of Artificial Sequence: Synthetic polypeptide
CEEEIRTTNPVATEQYGCVCSTTGEHNQNFGSDNQG

SEQ ID NO: 152370 - protein, 31 aa, Artificial Sequence
  Description of Artificial Sequence: Synthetic polypeptide
DENTIRTTNPVATEQWGDVSKIEPMNRAEDA

SEQ ID NO: 152371 - protein, 30 aa, Artificial Sequence
  Description of Artificial Sequence: Synthetic polypeptide
DENTIRTTNPVATEQWGDVSEIEMNAAEDA

SEQ ID NO: 152372 - protein, 36 aa, Artificial Sequence
  Description of Artificial Sequence: Synthetic polypeptide
CEEEIRTTNPVATEQYGCVCSTWEHNQEGFNSDNQE

SEQ ID NO: 152373 - protein, 38 aa, Artificial Sequence
  Description of Artificial Sequence: Synthetic polypeptide
DEEEIRTTNPVATEQYGVVSTVVNNQQGNNQQNTEEDT

SEQ ID NO: 152374 - protein, 38 aa, Artificial Sequence
  Description of Artificial Sequence: Synthetic polypeptide
DEEEIRTTNPVATEQYGVVSTVVNNQQGNQAGNLNEGN

SEQ ID NO: 152375 - protein, 38 aa, Artificial Sequence
  Description of Artificial Sequence: Synthetic polypeptide
DEEEIRTTNPVATEQYGVVSTVVNNQQGNQAGTENNED

SEQ ID NO: 152376 - protein, 38 aa, Artificial Sequence
  Description of Artificial Sequence: Synthetic polypeptide
DEEEIRTTNPVATEQYGVVSTVVNNQQGNQEGENETTD

SEQ ID NO: 152377 - protein, 38 aa, Artificial Sequence
  Description of Artificial Sequence: Synthetic polypeptide
DEEEIRTTNPVATEQYGVVSTVVNNQQGNQENQEETTD

SEQ ID NO: 152378 - protein, 31 aa, Artificial Sequence
  Description of Artificial Sequence: Synthetic polypeptide
DENVIRTTNPVATEQWGDVSEIEMNAAETDA

SEQ ID NO: 152379 - protein, 35 aa, Artificial Sequence
  Description of Artificial Sequence: Synthetic polypeptide
CEEEIRTTNPVATEQYGCVCSTGNHNEENFNSDQA

SEQ ID NO: 152380 - protein, 32 aa, Artificial Sequence
  Description of Artificial Sequence: Synthetic polypeptide
DDCEIRTTNPVATEQYGSVPDTFWPETESQDM

SEQ ID NO: 152381 - protein, 36 aa, Artificial Sequence
  Description of Artificial Sequence: Synthetic polypeptide
DEAEIRTTNPVATEQYGSVNWTLDMLEQLSDQNEGN

SEQ ID NO: 152382 - protein, 34 aa, Artificial Sequence
  Description of Artificial Sequence: Synthetic polypeptide
DEPEIATTNPVATEQYGSVSSNDNQANEVEFEQI

SEQ ID NO: 152383 - protein, 33 aa, Artificial Sequence
  Description of Artificial Sequence: Synthetic polypeptide
DEPEIATTNPVATEQYGSVSSIINQAEVEEEQI

SEQ ID NO: 152384 - protein, 35 aa, Artificial Sequence
  Description of Artificial Sequence: Synthetic polypeptide
DEPEIATTNPVATEQYGSVSSATDGGEDQEGEDGE

SEQ ID NO: 152385 - protein, 35 aa, Artificial Sequence
  Description of Artificial Sequence: Synthetic polypeptide
DEPEIATTNPVATEQYGSVSATGDQEDQEGGGDGG

SEQ ID NO: 152386 - protein, 36 aa, Artificial Sequence
  Description of Artificial Sequence: Synthetic polypeptide
DEPEIATTNPVATEQYGSVIGTNLNGQNGEGGGQEE

SEQ ID NO: 152387 - protein, 34 aa, Artificial Sequence
  Description of Artificial Sequence: Synthetic polypeptide
DEPEIATTNPVATEQYGSVIDLNNGQGEGGGEEE

SEQ ID NO: 152388 - protein, 35 aa, Artificial Sequence
  Description of Artificial Sequence: Synthetic polypeptide
DEPEIATTNPVATEQYGSVIDDTNNGQGEQGGDQQ

SEQ ID NO: 152389 - protein, 36 aa, Artificial Sequence
  Description of Artificial Sequence: Synthetic polypeptide
DEHEIRTTNPVATEQYGKTISTNEFSGVREGGSQRF

SEQ ID NO: 152390 - protein, 35 aa, Artificial Sequence
  Description of Artificial Sequence: Synthetic polypeptide
CEEEIRTTNPVATEQYGCVCSTGEHNAENFGSEQS

SEQ ID NO: 152391 - protein, 35 aa, Artificial Sequence
  Description of Artificial Sequence: Synthetic polypeptide
DEHEIRTTNPVATEQYGKTISANEFSGLKEGGANQ

SEQ ID NO: 152392 - protein, 33 aa, Artificial Sequence
  Description of Artificial Sequence: Synthetic polypeptide
DEPEIATTNPVATDQYGVVNDTGDEGQGGDGNT

SEQ ID NO: 152393 - protein, 31 aa, Artificial Sequence
  Description of Artificial Sequence: Synthetic polypeptide
DDSEVAPTNPVSTEGYGNVSANTLQSSVGQR

SEQ ID NO: 152394 - protein, 36 aa, Artificial Sequence
  Description of Artificial Sequence: Synthetic polypeptide
DEAEIRTTNPVATEQYGSVNWTSDGMTQRSDQNEGN

SEQ ID NO: 152395 - protein, 34 aa, Artificial Sequence
  Description of Artificial Sequence: Synthetic polypeptide
DENVIRYTNPVATEQYGSVSVPNQNDHIGSNSYY

SEQ ID NO: 152396 - protein, 35 aa, Artificial Sequence
  Description of Artificial Sequence: Synthetic polypeptide
DEAEIRTTNPVATEQYGSVNWTLDWTQESDQNEGN

SEQ ID NO: 152397 - protein, 38 aa, Artificial Sequence
  Description of Artificial Sequence: Synthetic polypeptide
DEEEIRTTNPVATEQYGVVSTVVNNQQGNNQQGNEEES

SEQ ID NO: 152398 - protein, 33 aa, Artificial Sequence
  Description of Artificial Sequence: Synthetic polypeptide
DDCEIRATNPVATEQYGSVPDTFWLETESQERQ

SEQ ID NO: 152399 - protein, 35 aa, Artificial Sequence
  Description of Artificial Sequence: Synthetic polypeptide
CEEEIRTTNPVATEQYGCVCSTGETNQNFNSDNQD

SEQ ID NO: 152400 - protein, 36 aa, Artificial Sequence
  Description of Artificial Sequence: Synthetic polypeptide
DEHEIRTTNPVATEQYGKTIPSTNGFSGLREGGSNQ

SEQ ID NO: 152401 - protein, 38 aa, Artificial Sequence
  Description of Artificial Sequence: Synthetic polypeptide
DEEEIRTTNPVATEQYGVVSTVVNNQQGNQQGTNQEAD

SEQ ID NO: 152402 - protein, 32 aa, Artificial Sequence
  Description of Artificial Sequence: Synthetic polypeptide
DEPEIRTTNPVATEQWGDVSVIEQMIAAETPS

SEQ ID NO: 152403 - protein, 31 aa, Artificial Sequence
  Description of Artificial Sequence: Synthetic polypeptide
DEPEIRTTNPVATEQWGDVSVIVEMPAAEAA

SEQ ID NO: 152404 - protein, 38 aa, Artificial Sequence
  Description of Artificial Sequence: Synthetic polypeptide
DEEEIRTTNPVATEQYGVVSTVVNNQNNQQGTNNDEEQ

SEQ ID NO: 152405 - protein, 38 aa, Artificial Sequence
  Description of Artificial Sequence: Synthetic polypeptide
DEEEIRTTNPVATEQYGVVSTVVNNQNQQGTNQETTED

SEQ ID NO: 152406 - protein, 35 aa, Artificial Sequence
  Description of Artificial Sequence: Synthetic polypeptide
DEPEIRTTNPVATEQYGSVTPVTTTQQPPQVGECN

SEQ ID NO: 152407 - protein, 38 aa, Artificial Sequence
  Description of Artificial Sequence: Synthetic polypeptide
DEEEIRTTNPVATEQYGVVSTVVNNQNQQGTTNNDEND

SEQ ID NO: 152408 - protein, 38 aa, Artificial Sequence
  Description of Artificial Sequence: Synthetic polypeptide
DEEEIRTTNPVATEQYGSVSTVVTNQLGGNQSEEEEDE

SEQ ID NO: 152409 - protein, 39 aa, Artificial Sequence
  Description of Artificial Sequence: Synthetic polypeptide
DEEEIRTTNPVATEQYGSVSTVVTNQNGEQGIGNNDEGE

SEQ ID NO: 152410 - protein, 39 aa, Artificial Sequence
  Description of Artificial Sequence: Synthetic polypeptide
DEEEIRTTNPVATEQYGSVSTVVTNQNGNQGIGNNNEEN

SEQ ID NO: 152411 - protein, 37 aa, Artificial Sequence
  Description of Artificial Sequence: Synthetic polypeptide
DEEEIRTTNPVATEQYGSVSTVVTNQNNNNQTEEEDE

SEQ ID NO: 152412 - protein, 39 aa, Artificial Sequence
  Description of Artificial Sequence: Synthetic polypeptide
DEEEIRTTNPVATEQYGSVSTVVTNQNNQQGTEAGTNDE

SEQ ID NO: 152413 - protein, 38 aa, Artificial Sequence
  Description of Artificial Sequence: Synthetic polypeptide
DEEEIRTTNPVATEQYGVVSTVVNNQNQQQGNNNNNNE

SEQ ID NO: 152414 - protein, 33 aa, Artificial Sequence
  Description of Artificial Sequence: Synthetic polypeptide
DEMEISTTNPVATEQYGCVCSTGEHINFGSDQS

SEQ ID NO: 152415 - protein, 35 aa, Artificial Sequence
  Description of Artificial Sequence: Synthetic polypeptide
CEEEIRTTNPVATEQYGAVGQVGDLGQRFNINEQD

SEQ ID NO: 152416 - protein, 35 aa, Artificial Sequence
  Description of Artificial Sequence: Synthetic polypeptide
DEEEISTTNPCATEQYGCVCPWGNLQENFGSNNQS

SEQ ID NO: 152417 - protein, 38 aa, Artificial Sequence
  Description of Artificial Sequence: Synthetic polypeptide
DEEEIRTTNPVATEQYGSVSTVVTTNNNQNQGTEEGTQ

SEQ ID NO: 152418 - protein, 35 aa, Artificial Sequence
  Description of Artificial Sequence: Synthetic polypeptide
CEEEIRTTNPVATEQYGAVVDDTVGQNGQENDDGD

SEQ ID NO: 152419 - protein, 37 aa, Artificial Sequence
  Description of Artificial Sequence: Synthetic polypeptide
DEHEIRTTNPVATEQYGSVESTPLQWAEEIMGDEPQN

SEQ ID NO: 152420 - protein, 34 aa, Artificial Sequence
  Description of Artificial Sequence: Synthetic polypeptide
CEEEIRTTNPVATEQYGCVCPNTGEHQNFGSDQE

SEQ ID NO: 152421 - protein, 38 aa, Artificial Sequence
  Description of Artificial Sequence: Synthetic polypeptide
DEEEIRTTNPVATEQYGVVSTVVNNQNNQQGTNNDEEN

SEQ ID NO: 152422 - protein, 38 aa, Artificial Sequence
  Description of Artificial Sequence: Synthetic polypeptide
DEEEIRTTNPVATEQYGSVSTVVTNNQGNQQEATTNNE

SEQ ID NO: 152423 - protein, 35 aa, Artificial Sequence
  Description of Artificial Sequence: Synthetic polypeptide
DEHEIRTTNPVATEQYGSVITVTHDLETGPEEQYE

SEQ ID NO: 152424 - protein, 35 aa, Artificial Sequence
  Description of Artificial Sequence: Synthetic polypeptide
DEPEIRTTNPVATESWGSVSCWNPISQTTGGNNPF

SEQ ID NO: 152425 - protein, 37 aa, Artificial Sequence
  Description of Artificial Sequence: Synthetic polypeptide
DEEEIRTTNPVATEQYGVVSTVVNNQNNNEQEAEEED

SEQ ID NO: 152426 - protein, 33 aa, Artificial Sequence
  Description of Artificial Sequence: Synthetic polypeptide
DEQAIRTTNPVATEQYGSFSDLTLTIEGGQISP

SEQ ID NO: 152427 - protein, 34 aa, Artificial Sequence
  Description of Artificial Sequence: Synthetic polypeptide
DEQAIRTTNPVATEQYGSFISTLTLGIEGGQISP

SEQ ID NO: 152428 - protein, 33 aa, Artificial Sequence
  Description of Artificial Sequence: Synthetic polypeptide
DEQAIATTNPVATEQYGSWSHTDLEDHEGEDLN

SEQ ID NO: 152429 - protein, 30 aa, Artificial Sequence
  Description of Artificial Sequence: Synthetic polypeptide
DEPEIYTTNPVATEQWGDVSEIEMNAAEDA

SEQ ID NO: 152430 - protein, 33 aa, Artificial Sequence
  Description of Artificial Sequence: Synthetic polypeptide
DEPEIVTTNPVATEQYGTVCSATDGPVEFEGGD

SEQ ID NO: 152431 - protein, 34 aa, Artificial Sequence
  Description of Artificial Sequence: Synthetic polypeptide
DEPEIVTTNPVATEQYGTVCSATDGPPVEFEGND

SEQ ID NO: 152432 - protein, 39 aa, Artificial Sequence
  Description of Artificial Sequence: Synthetic polypeptide
DEEEIRTTNPVATEQYGSVSTVVTNLQNNQQGTTTDEQE

SEQ ID NO: 152433 - protein, 39 aa, Artificial Sequence
  Description of Artificial Sequence: Synthetic polypeptide
DEEEIRTTNPVATEQYGSVSTVVTTNNNQQGTEQGTNVE

SEQ ID NO: 152434 - protein, 34 aa, Artificial Sequence
  Description of Artificial Sequence: Synthetic polypeptide
DEPEITTTNPVATEQYGTVCSATLGPVEFQGAND

SEQ ID NO: 152435 - protein, 34 aa, Artificial Sequence
  Description of Artificial Sequence: Synthetic polypeptide
DEMEISTTNPVATEQYGCVCSNTGEPNEFEGDDA

SEQ ID NO: 152436 - protein, 35 aa, Artificial Sequence
  Description of Artificial Sequence: Synthetic polypeptide
DEMEISTTNPVATEQYGCVCSNTGNHQENFGSEQS

SEQ ID NO: 152437 - protein, 32 aa, Artificial Sequence
  Description of Artificial Sequence: Synthetic polypeptide
DEPEIRTTNPVSTEPYGWISMEDIQQQQNGNH

SEQ ID NO: 152438 - protein, 32 aa, Artificial Sequence
  Description of Artificial Sequence: Synthetic polypeptide
DEPEIRTTNPVSTEPYGTISSEDIQQQQNGNH

SEQ ID NO: 152439 - protein, 32 aa, Artificial Sequence
  Description of Artificial Sequence: Synthetic polypeptide
DEPEIRTTNPVSTEPYGTISMEDIQQQQNGNH

SEQ ID NO: 152440 - protein, 37 aa, Artificial Sequence
  Description of Artificial Sequence: Synthetic polypeptide
DEHEIRTTNPVATEQYGSVMSVDADLEQTGGSQEPNI

SEQ ID NO: 152441 - protein, 36 aa, Artificial Sequence
  Description of Artificial Sequence: Synthetic polypeptide
CEEEIRTTNPVATEFYGATTVSTGNGEGQNEGGNAE

SEQ ID NO: 152442 - protein, 36 aa, Artificial Sequence
  Description of Artificial Sequence: Synthetic polypeptide
DEHEIRTTNPVATEQYGSVMPTTLLHVIEGSNEDVT

SEQ ID NO: 152443 - protein, 36 aa, Artificial Sequence
  Description of Artificial Sequence: Synthetic polypeptide
DEHEIRTTNPVATEQYGSVMTNDVTEEPFMLQDHPI

SEQ ID NO: 152444 - protein, 31 aa, Artificial Sequence
  Description of Artificial Sequence: Synthetic polypeptide
DEPEIRTTNPVATEQWGDVSVIGEMPTAEVT

SEQ ID NO: 152445 - protein, 38 aa, Artificial Sequence
  Description of Artificial Sequence: Synthetic polypeptide
DEEEIRTTNPVATEQYGVVSTVVNNQNQQQGNNNTEED

SEQ ID NO: 152446 - protein, 38 aa, Artificial Sequence
  Description of Artificial Sequence: Synthetic polypeptide
DEEEIRTTNPVATEQYGVVSTVVNNQNQQQGTNNATEQ

SEQ ID NO: 152447 - protein, 36 aa, Artificial Sequence
  Description of Artificial Sequence: Synthetic polypeptide
CEEEIRTTNPVATEQYGCVCSNTMEHQENFGSDNQA

SEQ ID NO: 152448 - protein, 36 aa, Artificial Sequence
  Description of Artificial Sequence: Synthetic polypeptide
DEAEIRTTNPVATEQYGSVSSDWNELEVERQSDVQQ

SEQ ID NO: 152449 - protein, 35 aa, Artificial Sequence
  Description of Artificial Sequence: Synthetic polypeptide
DEAEIRTTNPVATEQYGSVSPVQQSITTEGTEWSM

SEQ ID NO: 152450 - protein, 35 aa, Artificial Sequence
  Description of Artificial Sequence: Synthetic polypeptide
CEEEIRTTNPVATEQYGCVCSNTPEDQENFGSEQS

SEQ ID NO: 152451 - protein, 33 aa, Artificial Sequence
  Description of Artificial Sequence: Synthetic polypeptide
DEHEIRTTNPVATEQYGSFYTWLNESESIEDQC

SEQ ID NO: 152452 - protein, 37 aa, Artificial Sequence
  Description of Artificial Sequence: Synthetic polypeptide
DEEEIRTTNPVATEQYGVVSTVVNNQQGETAEEEEED

SEQ ID NO: 152453 - protein, 34 aa, Artificial Sequence
  Description of Artificial Sequence: Synthetic polypeptide
DEPEIRTTNPVATEQYGSSHVGTSQQPETSEETN

SEQ ID NO: 152454 - protein, 35 aa, Artificial Sequence
  Description of Artificial Sequence: Synthetic polypeptide
DEPEIRTTNPVATEQYGSSHVGLTSIQHEGSEEQN

SEQ ID NO: 152455 - protein, 34 aa, Artificial Sequence
  Description of Artificial Sequence: Synthetic polypeptide
DEMEISTTNPVATEQYGTTVCSATSGPVEFIGND

SEQ ID NO: 152456 - protein, 34 aa, Artificial Sequence
  Description of Artificial Sequence: Synthetic polypeptide
DEMEISTTNPVATEQYGTVCSATDGPVETFEGND

SEQ ID NO: 152457 - protein, 34 aa, Artificial Sequence
  Description of Artificial Sequence: Synthetic polypeptide
DEMEISTTNPVATEQYGTVCSATPGNPVEFQLND

SEQ ID NO: 152458 - protein, 33 aa, Artificial Sequence
  Description of Artificial Sequence: Synthetic polypeptide
DEMEISTTNPVATEQYGTVCSATSGPVEFEGVF

SEQ ID NO: 152459 - protein, 34 aa, Artificial Sequence
  Description of Artificial Sequence: Synthetic polypeptide
DEMEISTTNPVATEQYGTVCSCTDGPSEPEGGND

SEQ ID NO: 152460 - protein, 36 aa, Artificial Sequence
  Description of Artificial Sequence: Synthetic polypeptide
DEPEIRTTNPVATEQYGCVSSTTPAGPNMRNGMNPV

SEQ ID NO: 152461 - protein, 37 aa, Artificial Sequence
  Description of Artificial Sequence: Synthetic polypeptide
DEPEIRTTNPVATEQWGYSNVSATEELQHQRPGQGYG

SEQ ID NO: 152462 - protein, 31 aa, Artificial Sequence
  Description of Artificial Sequence: Synthetic polypeptide
DEPEIRTTNPVATEQWGYAVSVIEMPAAEFA

SEQ ID NO: 152463 - protein, 31 aa, Artificial Sequence
  Description of Artificial Sequence: Synthetic polypeptide
DEPEIRTTNPVATEQWGMVSCIIEANAAEDA

SEQ ID NO: 152464 - protein, 36 aa, Artificial Sequence
  Description of Artificial Sequence: Synthetic polypeptide
DEAEIRTTNPVATEQYGSVSSMDTLLDTGSSKDTEY

SEQ ID NO: 152465 - protein, 37 aa, Artificial Sequence
  Description of Artificial Sequence: Synthetic polypeptide
DEAEIRTTNPVATEQYGSVSSTDTGLDDTGSSNDLES

SEQ ID NO: 152466 - protein, 37 aa, Artificial Sequence
  Description of Artificial Sequence: Synthetic polypeptide
DEPEIRTTNPVATEQYGSVMSPADNLEIEPGNVNTVI

SEQ ID NO: 152467 - protein, 36 aa, Artificial Sequence
  Description of Artificial Sequence: Synthetic polypeptide
DEPEIRTTNPVATEQYGSVNIVTNDLNEPETQTEEN

SEQ ID NO: 152468 - protein, 38 aa, Artificial Sequence
  Description of Artificial Sequence: Synthetic polypeptide
DEEEIRTTNPVATEQYGVVSTVVNNQNQQQGTTNAEEN

SEQ ID NO: 152469 - protein, 36 aa, Artificial Sequence
  Description of Artificial Sequence: Synthetic polypeptide
DEHEIRTTNPVATEQYGSNVSPLDELQWAEGGDEEL

SEQ ID NO: 152470 - protein, 37 aa, Artificial Sequence
  Description of Artificial Sequence: Synthetic polypeptide
DEPEIRTTNPVATEQYGSVSTCVYMLEPPGPNAGQEM

SEQ ID NO: 152471 - protein, 37 aa, Artificial Sequence
  Description of Artificial Sequence: Synthetic polypeptide
DEEEIRTTNPVATEQYGVVSTVVNNQNQQTNEETETD

SEQ ID NO: 152472 - protein, 35 aa, Artificial Sequence
  Description of Artificial Sequence: Synthetic polypeptide
CEEEIRTTNPVATEQYGCVCSMTEHQEGFGSDTQS

SEQ ID NO: 152473 - protein, 35 aa, Artificial Sequence
  Description of Artificial Sequence: Synthetic polypeptide
CEEEIRTTNPVATEQYGCVCSMTGEDHQGFGSDQS

SEQ ID NO: 152474 - protein, 37 aa, Artificial Sequence
  Description of Artificial Sequence: Synthetic polypeptide
DEPEIRTTNPVATEQYGSVSPAVNLDIEPGDNVNTVI

SEQ ID NO: 152475 - protein, 36 aa, Artificial Sequence
  Description of Artificial Sequence: Synthetic polypeptide
DEPEIRTTNPVATEQYGSVSPAVNIEIENGNVNTVI

SEQ ID NO: 152476 - protein, 35 aa, Artificial Sequence
  Description of Artificial Sequence: Synthetic polypeptide
CEEEIRTTNPVATEQYGCVCSMTEHMQENFNSDQS

SEQ ID NO: 152477 - protein, 36 aa, Artificial Sequence
  Description of Artificial Sequence: Synthetic polypeptide
DEPEIRTTNPVATEQYGSVSPAVFLEIEPGNVNTVI

SEQ ID NO: 152478 - protein, 36 aa, Artificial Sequence
  Description of Artificial Sequence: Synthetic polypeptide
DEPEIRTTNPVATEQYGSVSPALNNEIEVGNVNTVI

SEQ ID NO: 152479 - protein, 36 aa, Artificial Sequence
  Description of Artificial Sequence: Synthetic polypeptide
DEAEIRTTNPVATEQYGSVSTHTNWEETDNGQEDDN

SEQ ID NO: 152480 - protein, 35 aa, Artificial Sequence
  Description of Artificial Sequence: Synthetic polypeptide
DEAEIRTTNPVATEQYGSVSSVDTPMWDTGSSDEY

SEQ ID NO: 152481 - protein, 35 aa, Artificial Sequence
  Description of Artificial Sequence: Synthetic polypeptide
CEEEIRTTNPVATEQYGCVCSNTEEHQENFGSDQS

SEQ ID NO: 152482 - protein, 35 aa, Artificial Sequence
  Description of Artificial Sequence: Synthetic polypeptide
DEAEIRTTNPVATEQYGSVSSVDTLADTGSSMQEN

SEQ ID NO: 152483 - protein, 35 aa, Artificial Sequence
  Description of Artificial Sequence: Synthetic polypeptide
CEEEIRTTNPVATEQYGCVCSNTEHQENFNSQTQA

SEQ ID NO: 152484 - protein, 36 aa, Artificial Sequence
  Description of Artificial Sequence: Synthetic polypeptide
DEAEIRTTNPVATEQYGSVSSVDTDLGDTGSSQMEY

SEQ ID NO: 152485 - protein, 36 aa, Artificial Sequence
  Description of Artificial Sequence: Synthetic polypeptide
DEPEIRTTNPVATEQYGSVSAENYEQVQIEPVNNSE

SEQ ID NO: 152486 - protein, 36 aa, Artificial Sequence
  Description of Artificial Sequence: Synthetic polypeptide
DEPEIRTTNPVATEQYGSVSPASNNEIEPGIVNTVI

SEQ ID NO: 152487 - protein, 32 aa, Artificial Sequence
  Description of Artificial Sequence: Synthetic polypeptide
DEQCIATTNPVATEQYGSDSATDMEDHEGEDL

SEQ ID NO: 152488 - protein, 32 aa, Artificial Sequence
  Description of Artificial Sequence: Synthetic polypeptide
DENSIRTTNPVSTEPYGTISMENIQQQQNGNH

SEQ ID NO: 152489 - protein, 38 aa, Artificial Sequence
  Description of Artificial Sequence: Synthetic polypeptide
DEEEIRTTNPVATEQYGVVSTVVNNQQGNQQNTNNNVD

SEQ ID NO: 152490 - protein, 32 aa, Artificial Sequence
  Description of Artificial Sequence: Synthetic polypeptide
DENEIYTTNPVSTEPYGTISMEDTQQQQNGNH

SEQ ID NO: 152491 - protein, 33 aa, Artificial Sequence
  Description of Artificial Sequence: Synthetic polypeptide
DEAEIATTNPVAYEQWGSVCQTNDHDHPMGDHR

SEQ ID NO: 152492 - protein, 36 aa, Artificial Sequence
  Description of Artificial Sequence: Synthetic polypeptide
DEAEIATTNPVAYEQWGSVCSTDNGGNTGQQGNGRN

SEQ ID NO: 152493 - protein, 35 aa, Artificial Sequence
  Description of Artificial Sequence: Synthetic polypeptide
DEAEIATTNPVAYEQWGSVCSTNDAGEHQRDNHEG

SEQ ID NO: 152494 - protein, 33 aa, Artificial Sequence
  Description of Artificial Sequence: Synthetic polypeptide
DEAEIATTNPVAYEQWGSVCSTNDHDHPNGQES

SEQ ID NO: 152495 - protein, 30 aa, Artificial Sequence
  Description of Artificial Sequence: Synthetic polypeptide
DENEIYTTNPVATEQWGDVSEIEMNAAEDA

SEQ ID NO: 152496 - protein, 33 aa, Artificial Sequence
  Description of Artificial Sequence: Synthetic polypeptide
DEMEIVSTNPVATEQYGTVCAATDTLVEHEGNI

SEQ ID NO: 152497 - protein, 33 aa, Artificial Sequence
  Description of Artificial Sequence: Synthetic polypeptide
DEMEIVSTNPVATEQYGTVCSATDGIVEFEGND

SEQ ID NO: 152498 - protein, 35 aa, Artificial Sequence
  Description of Artificial Sequence: Synthetic polypeptide
DEAEIATTNPVAYEQWGSVCSTQDNMDERQGGNHK

SEQ ID NO: 152499 - protein, 36 aa, Artificial Sequence
  Description of Artificial Sequence: Synthetic polypeptide
DEEEIRTTNPVAYEQYGKTVSCTNAFITRTMDNELN

SEQ ID NO: 152500 - protein, 33 aa, Artificial Sequence
  Description of Artificial Sequence: Synthetic polypeptide
DEMEIVSTNPVATEQYGTVCSATDGPVEFEGND

SEQ ID NO: 152501 - protein, 35 aa, Artificial Sequence
  Description of Artificial Sequence: Synthetic polypeptide
DEEEIRTTNPVAYEQYGKTVSCTFAFDTRTMDNEL

SEQ ID NO: 152502 - protein, 31 aa, Artificial Sequence
  Description of Artificial Sequence: Synthetic polypeptide
DDSEVACTNPVSTEQYGNVAAETIQSRVGNR

SEQ ID NO: 152503 - protein, 33 aa, Artificial Sequence
  Description of Artificial Sequence: Synthetic polypeptide
DEAEIATTNPVAYEQWGSVCSTTDQGDTQNGGA

SEQ ID NO: 152504 - protein, 30 aa, Artificial Sequence
  Description of Artificial Sequence: Synthetic polypeptide
DENEIYTTNPVATEQWGDVSEIEMNAAADA

SEQ ID NO: 152505 - protein, 31 aa, Artificial Sequence
  Description of Artificial Sequence: Synthetic polypeptide
DENEIYTTNPVATEQWGDVSCITEMNAAEDA

SEQ ID NO: 152506 - protein, 30 aa, Artificial Sequence
  Description of Artificial Sequence: Synthetic polypeptide
DENEIWTTNPVATEQWGEVSEIEMNAAEDA

SEQ ID NO: 152507 - protein, 32 aa, Artificial Sequence
  Description of Artificial Sequence: Synthetic polypeptide
DENEIYTTNPVSTEPYGTISMSDIQQQQNGNH

SEQ ID NO: 152508 - protein, 33 aa, Artificial Sequence
  Description of Artificial Sequence: Synthetic polypeptide
DEMEIVGTNPVATEQYGTVCSATDGPVGFEGND

SEQ ID NO: 152509 - protein, 30 aa, Artificial Sequence
  Description of Artificial Sequence: Synthetic polypeptide
DENELRTTNPVATEQWGDVSEIEMNAAEDA

SEQ ID NO: 152510 - protein, 30 aa, Artificial Sequence
  Description of Artificial Sequence: Synthetic polypeptide
DENELRTTNPVATEQWGDVSEIEMNAAEDC

SEQ ID NO: 152511 - protein, 36 aa, Artificial Sequence
  Description of Artificial Sequence: Synthetic polypeptide
DEHEIRTTNPVATEMWGSVCSTMNNDHHERNGGQNH

SEQ ID NO: 152512 - protein, 30 aa, Artificial Sequence
  Description of Artificial Sequence: Synthetic polypeptide
DENEVASTNPVSTEGYGEAAAENIQRVGQR

SEQ ID NO: 152513 - protein, 36 aa, Artificial Sequence
  Description of Artificial Sequence: Synthetic polypeptide
DEAEIRTTNPVATEQYGSVNSQWNSLEFGEFEQQVA

SEQ ID NO: 152514 - protein, 31 aa, Artificial Sequence
  Description of Artificial Sequence: Synthetic polypeptide
DENEVASTNPVATECYGDVSAECIQSRVEQR

SEQ ID NO: 152515 - protein, 37 aa, Artificial Sequence
  Description of Artificial Sequence: Synthetic polypeptide
DEAEIRTTNPVATEQYGSVNSGWNSLQEFGEFEQQVL

SEQ ID NO: 152516 - protein, 38 aa, Artificial Sequence
  Description of Artificial Sequence: Synthetic polypeptide
DEEEIRTTNPVATEQYGVVSTVVNQNGGNQQGNNNQDD

SEQ ID NO: 152517 - protein, 30 aa, Artificial Sequence
  Description of Artificial Sequence: Synthetic polypeptide
DENETRTTNPVATEQWGRVSEIEGNAAEDA

SEQ ID NO: 152518 - protein, 33 aa, Artificial Sequence
  Description of Artificial Sequence: Synthetic polypeptide
DENENCTTNPVAYEHWGSVSTGQLGDTQGGGQR

SEQ ID NO: 152519 - protein, 31 aa, Artificial Sequence
  Description of Artificial Sequence: Synthetic polypeptide
DENEIWTTNPVATEQWGDVSEIEMNAAEVDA

SEQ ID NO: 152520 - protein, 33 aa, Artificial Sequence
  Description of Artificial Sequence: Synthetic polypeptide
DDECIRTTNPVATEGYGCVCSTEHNQNFNSDLS

SEQ ID NO: 152521 - protein, 33 aa, Artificial Sequence
  Description of Artificial Sequence: Synthetic polypeptide
DEMEIVCTNPVATEQYGTVCSAEDGPVMFEGNR

SEQ ID NO: 152522 - protein, 33 aa, Artificial Sequence
  Description of Artificial Sequence: Synthetic polypeptide
DEMEIVCTNPVATEQYGTVCSATDGPVEFEGND

SEQ ID NO: 152523 - protein, 33 aa, Artificial Sequence
  Description of Artificial Sequence: Synthetic polypeptide
DEMEIVCTNPVATEQYGTVCSATDGPVMFEGND

SEQ ID NO: 152524 - protein, 32 aa, Artificial Sequence
  Description of Artificial Sequence: Synthetic polypeptide
DEMEIVCTNPVATEQYGTVSAEDGPVEFEGND

SEQ ID NO: 152525 - protein, 34 aa, Artificial Sequence
  Description of Artificial Sequence: Synthetic polypeptide
DEAEIATTNPVAYEQWGSVCNTFNRDEGRGDTDR

SEQ ID NO: 152526 - protein, 33 aa, Artificial Sequence
  Description of Artificial Sequence: Synthetic polypeptide
DEMEIVGTNPVATEQYGTVCSATDGPVEFEGND

SEQ ID NO: 152527 - protein, 32 aa, Artificial Sequence
  Description of Artificial Sequence: Synthetic polypeptide
DENELRTTNPVSTEPYGSISMEDIQQQQNGNH

SEQ ID NO: 152528 - protein, 30 aa, Artificial Sequence
  Description of Artificial Sequence: Synthetic polypeptide
DENELRTTNPVATEQWGDVSEIEMNAAESA

SEQ ID NO: 152529 - protein, 33 aa, Artificial Sequence
  Description of Artificial Sequence: Synthetic polypeptide
DEMEIVCTNPVATEQYGTVCSAEDGPVEFEGNR

SEQ ID NO: 152530 - protein, 38 aa, Artificial Sequence
  Description of Artificial Sequence: Synthetic polypeptide
DEEEIRTTNPVATEQYGVVSTVVNQLQQGTEQGTTDTN

SEQ ID NO: 152531 - protein, 30 aa, Artificial Sequence
  Description of Artificial Sequence: Synthetic polypeptide
DENEIWTTNPVATEQWGDVSEIEMNAAEDA

SEQ ID NO: 152532 - protein, 30 aa, Artificial Sequence
  Description of Artificial Sequence: Synthetic polypeptide
DENEIWTTNPVATEQWGDVSEIEMMAAEDA

SEQ ID NO: 152533 - protein, 33 aa, Artificial Sequence
  Description of Artificial Sequence: Synthetic polypeptide
DEMEIVTTNPCATEQYGTVCSATDGPVEFEGND

SEQ ID NO: 152534 - protein, 33 aa, Artificial Sequence
  Description of Artificial Sequence: Synthetic polypeptide
DEMEIVTTNPCATEQYGTVCSATDGPVEFEGNV

SEQ ID NO: 152535 - protein, 32 aa, Artificial Sequence
  Description of Artificial Sequence: Synthetic polypeptide
DENEIVTTNPVSTEPYGTICSTEDPQQFEGNH

SEQ ID NO: 152536 - protein, 32 aa, Artificial Sequence
  Description of Artificial Sequence: Synthetic polypeptide
DENEIVTTNPVSTEPYGTICSTDDPQQFEGNH

SEQ ID NO: 152537 - protein, 32 aa, Artificial Sequence
  Description of Artificial Sequence: Synthetic polypeptide
DENEIVTTNPVSTEPYGTICSTDDPQEFEGNH

SEQ ID NO: 152538 - protein, 32 aa, Artificial Sequence
  Description of Artificial Sequence: Synthetic polypeptide
DENEIVTTNPVSTEPYGTICSTDDPQEFEGND

SEQ ID NO: 152539 - protein, 36 aa, Artificial Sequence
  Description of Artificial Sequence: Synthetic polypeptide
DEAEIRTTNPVATEQYGSVNNTIEPLVEGGMNEVSL

SEQ ID NO: 152540 - protein, 38 aa, Artificial Sequence
  Description of Artificial Sequence: Synthetic polypeptide
DEEEIRTTNPVATEQYGVVSTVVNQNNNNQQGTNQDED

SEQ ID NO: 152541 - protein, 33 aa, Artificial Sequence
  Description of Artificial Sequence: Synthetic polypeptide
DDECIRTTNPVATEQYGCVCSTEHNQSFVSDQA

SEQ ID NO: 152542 - protein, 35 aa, Artificial Sequence
  Description of Artificial Sequence: Synthetic polypeptide
DEAEIRTTNPVATEQYGSVNNIETEWEGGNSEISG

SEQ ID NO: 152543 - protein, 35 aa, Artificial Sequence
  Description of Artificial Sequence: Synthetic polypeptide
DEAEIRTTNPVATEQYGSVNNIEPLWEGGSSEESR

SEQ ID NO: 152544 - protein, 34 aa, Artificial Sequence
  Description of Artificial Sequence: Synthetic polypeptide
DEAEIRTTNPVATEQYGSVNNIEPLVEMGGEVQL

SEQ ID NO: 152545 - protein, 33 aa, Artificial Sequence
  Description of Artificial Sequence: Synthetic polypeptide
DENEIVTTNPVATEQYGTVCSATLGPVEFEHND

SEQ ID NO: 152546 - protein, 34 aa, Artificial Sequence
  Description of Artificial Sequence: Synthetic polypeptide
DENEIVTTNPVATEQYGTVCSATDIEVENFAGND

SEQ ID NO: 152547 - protein, 34 aa, Artificial Sequence
  Description of Artificial Sequence: Synthetic polypeptide
DENEIVTTNPVATEQYGTVCSATDIEVENFAGNA

SEQ ID NO: 152548 - protein, 34 aa, Artificial Sequence
  Description of Artificial Sequence: Synthetic polypeptide
DEAEIRTTNPVATEQYGSVNNIEPLIEGGSEVSG

SEQ ID NO: 152549 - protein, 34 aa, Artificial Sequence
  Description of Artificial Sequence: Synthetic polypeptide
DEEEISTTNPVATEEYGCVCSTEEHNQNFGSDQA

SEQ ID NO: 152550 - protein, 32 aa, Artificial Sequence
  Description of Artificial Sequence: Synthetic polypeptide
DENEIVTTNPVSTEPYGTVSMDDIQQQQNGNH

SEQ ID NO: 152551 - protein, 32 aa, Artificial Sequence
  Description of Artificial Sequence: Synthetic polypeptide
DENEIVTTNPVSTEQYGTISMDDIQQQFNGND

SEQ ID NO: 152552 - protein, 38 aa, Artificial Sequence
  Description of Artificial Sequence: Synthetic polypeptide
DEEEIRTTNPVATEQYGTVSTVQGNNQLQQGTEEGSTD

SEQ ID NO: 152553 - protein, 32 aa, Artificial Sequence
  Description of Artificial Sequence: Synthetic polypeptide
DENEIVTTNPVSTEQYGTISMDDIQQQFNGNH

SEQ ID NO: 152554 - protein, 30 aa, Artificial Sequence
  Description of Artificial Sequence: Synthetic polypeptide
DENEIWTTNPVATEQWGDVSEIEMEAAEDA

SEQ ID NO: 152555 - protein, 36 aa, Artificial Sequence
  Description of Artificial Sequence: Synthetic polypeptide
DEAEIRTTNPVATEQYGSVNRNEVELEVLGNDETQD

SEQ ID NO: 152556 - protein, 37 aa, Artificial Sequence
  Description of Artificial Sequence: Synthetic polypeptide
DEEEIRTTNPVATEQYGSVSVMNESLPTQNEVSELLN

SEQ ID NO: 152557 - protein, 38 aa, Artificial Sequence
  Description of Artificial Sequence: Synthetic polypeptide
DEEEIRTTNPVATEQYGVVSTVVNQNLQQGTTEETTED

SEQ ID NO: 152558 - protein, 37 aa, Artificial Sequence
  Description of Artificial Sequence: Synthetic polypeptide
DEEEIRTTNPVATEQYGSVSVMNLGLSQAQPMVVQVA

SEQ ID NO: 152559 - protein, 35 aa, Artificial Sequence
  Description of Artificial Sequence: Synthetic polypeptide
DEAEIRTTNPVATEQYGSVNNYTNAEQPSSFEDQF

SEQ ID NO: 152560 - protein, 36 aa, Artificial Sequence
  Description of Artificial Sequence: Synthetic polypeptide
DEEEIRTTNPVATEQYGSVSVMNLSLPEFEVSELKN

SEQ ID NO: 152561 - protein, 33 aa, Artificial Sequence
  Description of Artificial Sequence: Synthetic polypeptide
DEMEIVSTNPVATEQYGVVCSADDGPVQFEGNQ

SEQ ID NO: 152562 - protein, 31 aa, Artificial Sequence
  Description of Artificial Sequence: Synthetic polypeptide
DENEIWTTNPVATEQWGDVSEIEMNAAEADA

SEQ ID NO: 152563 - protein, 33 aa, Artificial Sequence
  Description of Artificial Sequence: Synthetic polypeptide
DEMEIVSTNPVATEQYGVVCSATDGPVEFEGNQ

SEQ ID NO: 152564 - protein, 33 aa, Artificial Sequence
  Description of Artificial Sequence: Synthetic polypeptide
DENEIVTTNPVSTEQYGTVSAMDDIQQQQEGND

SEQ ID NO: 152565 - protein, 33 aa, Artificial Sequence
  Description of Artificial Sequence: Synthetic polypeptide
DENEIVTTNPVSTEQYGTVSAMDDIQEQQEGND

SEQ ID NO: 152566 - protein, 33 aa, Artificial Sequence
  Description of Artificial Sequence: Synthetic polypeptide
DENEIVTTNPVSTEQYGTVCSMEDIQQQQNGNH

SEQ ID NO: 152567 - protein, 33 aa, Artificial Sequence
  Description of Artificial Sequence: Synthetic polypeptide
DENEIVTTNPVSTEQYGTVCSMEDIQQQFNGNH

SEQ ID NO: 152568 - protein, 34 aa, Artificial Sequence
  Description of Artificial Sequence: Synthetic polypeptide
DENEIVTTNPVSTEQYGTVCSATEDIQQQFNGNH

SEQ ID NO: 152569 - protein, 32 aa, Artificial Sequence
  Description of Artificial Sequence: Synthetic polypeptide
DENEIVTTNPVSTEQYGTISMEDIQQQQNGND

SEQ ID NO: 152570 - protein, 32 aa, Artificial Sequence
  Description of Artificial Sequence: Synthetic polypeptide
DENEIVTTNPVSTEQYGTISMDDIQQQQNGND

SEQ ID NO: 152571 - protein, 33 aa, Artificial Sequence
  Description of Artificial Sequence: Synthetic polypeptide
DEMEIVTTNPCASEQYGTVCSATDNPVESEGND

SEQ ID NO: 152572 - protein, 33 aa, Artificial Sequence
  Description of Artificial Sequence: Synthetic polypeptide
DENEIVTTNPVSTEQYGTVSAMDDIQQQQEGNH

SEQ ID NO: 152573 - protein, 38 aa, Artificial Sequence
  Description of Artificial Sequence: Synthetic polypeptide
DEEEIRTTNPVATEQYGVVSTVVNNQQGNQQNETQEDE

SEQ ID NO: 152574 - protein, 30 aa, Artificial Sequence
  Description of Artificial Sequence: Synthetic polypeptide
DENEVASTNPVSTEPYGNIAMTIQQRVGNH

SEQ ID NO: 152575 - protein, 35 aa, Artificial Sequence
  Description of Artificial Sequence: Synthetic polypeptide
DEAEIATTNPVAYEQWGSVAKTNDLQEQRGGQIDK

SEQ ID NO: 152576 - protein, 32 aa, Artificial Sequence
  Description of Artificial Sequence: Synthetic polypeptide
DEHEIRTTNPVATEQWGAVYSIEIEMNQAEDA

SEQ ID NO: 152577 - protein, 37 aa, Artificial Sequence
  Description of Artificial Sequence: Synthetic polypeptide
DEEEIRTTNPVATEQYGVVSTVVNNQQQGTDEEEEED

SEQ ID NO: 152578 - protein, 30 aa, Artificial Sequence
  Description of Artificial Sequence: Synthetic polypeptide
DENNIRTTNPVATEQWGDVSEIEMNADEDA

SEQ ID NO: 152579 - protein, 38 aa, Artificial Sequence
  Description of Artificial Sequence: Synthetic polypeptide
DEEEIRTTNPVATEQYGVVSTVVNNQQQIGTNVTEEND

SEQ ID NO: 152580 - protein, 30 aa, Artificial Sequence
  Description of Artificial Sequence: Synthetic polypeptide
DENNIRTTNPVATEQWGDVSEIEMNAAEDA

SEQ ID NO: 152581 - protein, 35 aa, Artificial Sequence
  Description of Artificial Sequence: Synthetic polypeptide
DEHEIRTTNPVATEPYGSVCFTNEDHTDQGGDQHQ

SEQ ID NO: 152582 - protein, 38 aa, Artificial Sequence
  Description of Artificial Sequence: Synthetic polypeptide
DEEEIRTTNPVATEQYGVVSTVVNNTNQLQQGEEEEEE

SEQ ID NO: 152583 - protein, 31 aa, Artificial Sequence
  Description of Artificial Sequence: Synthetic polypeptide
DENMIRTTNPVATEQWGDVSEIEMNAAEDGA

SEQ ID NO: 152584 - protein, 38 aa, Artificial Sequence
  Description of Artificial Sequence: Synthetic polypeptide
DEEEIRTTNPVATEQYGVVSTVVNQEQNGNQQGTNQDE

SEQ ID NO: 152585 - protein, 33 aa, Artificial Sequence
  Description of Artificial Sequence: Synthetic polypeptide
DEEEISTTNPEATEQYGCVCPTEHNAYFGSEQA

SEQ ID NO: 152586 - protein, 36 aa, Artificial Sequence
  Description of Artificial Sequence: Synthetic polypeptide
DEEEISTTNPVAHEQYGSVSSTTPAGPNMRSGMNPV

SEQ ID NO: 152587 - protein, 31 aa, Artificial Sequence
  Description of Artificial Sequence: Synthetic polypeptide
DENMIRTTNPVATEQWGDVSEIEMNAAEDAT

SEQ ID NO: 152588 - protein, 30 aa, Artificial Sequence
  Description of Artificial Sequence: Synthetic polypeptide
DENMIRTTNPVATEQWGDVSEIEMNAAEDA

SEQ ID NO: 152589 - protein, 33 aa, Artificial Sequence
  Description of Artificial Sequence: Synthetic polypeptide
DDECIRCTNPVATEQYGCQVCSTEHQNFGSDQA

SEQ ID NO: 152590 - protein, 33 aa, Artificial Sequence
  Description of Artificial Sequence: Synthetic polypeptide
DEMEISTVNPVATEQYGCVCSTEDFNFGSDNQS

SEQ ID NO: 152591 - protein, 34 aa, Artificial Sequence
  Description of Artificial Sequence: Synthetic polypeptide
DEMEISTVNPVATEQYGCVCSTEHNAHFGSNNQS

SEQ ID NO: 152592 - protein, 30 aa, Artificial Sequence
  Description of Artificial Sequence: Synthetic polypeptide
DENLIRTTNPVATEQWGDVSMIEMNAVQDA

SEQ ID NO: 152593 - protein, 38 aa, Artificial Sequence
  Description of Artificial Sequence: Synthetic polypeptide
DEEEIRTTNPVATEQYGVVSTVVNNQQQAGTTTNVATE

SEQ ID NO: 152594 - protein, 32 aa, Artificial Sequence
  Description of Artificial Sequence: Synthetic polypeptide
DENPIATTNPVAYDPWGMVPSCTAEHSQRGNR

SEQ ID NO: 152595 - protein, 30 aa, Artificial Sequence
  Description of Artificial Sequence: Synthetic polypeptide
DENPIRTTNPVATEQWGDVSEFEMNAAEDA

SEQ ID NO: 152596 - protein, 30 aa, Artificial Sequence
  Description of Artificial Sequence: Synthetic polypeptide
DENPIRTTNPVATEQWGDVSEIEMNAAEDA

SEQ ID NO: 152597 - protein, 30 aa, Artificial Sequence
  Description of Artificial Sequence: Synthetic polypeptide
DENSIRTTNPVATEQWGDVSEIEMNWAEDA

SEQ ID NO: 152598 - protein, 30 aa, Artificial Sequence
  Description of Artificial Sequence: Synthetic polypeptide
DENSIRTTNPVATEQWGDVSEIEMNNAEDA

SEQ ID NO: 152599 - protein, 30 aa, Artificial Sequence
  Description of Artificial Sequence: Synthetic polypeptide
DENSIRTTNPVATEQWGDVSEIEMNAATDA

SEQ ID NO: 152600 - protein, 30 aa, Artificial Sequence
  Description of Artificial Sequence: Synthetic polypeptide
DENSIRTTNPVATEQWGDVSEIEMNAAEDA

SEQ ID NO: 152601 - protein, 35 aa, Artificial Sequence
  Description of Artificial Sequence: Synthetic polypeptide
DEAEIRTTNPVATEQYGSVNTMWGDSQQEGGLEEH

SEQ ID NO: 152602 - protein, 34 aa, Artificial Sequence
  Description of Artificial Sequence: Synthetic polypeptide
DENSEICTTNPVAYEHWGSVSTGQLGDHQGGGQR

SEQ ID NO: 152603 - protein, 38 aa, Artificial Sequence
  Description of Artificial Sequence: Synthetic polypeptide
DEEEIRTTNPVATEQYGVVSTVVNNQQGNQQTGTNNDE

SEQ ID NO: 152604 - protein, 32 aa, Artificial Sequence
  Description of Artificial Sequence: Synthetic polypeptide
DDDEIRATNPVATEPYGVVSSYCELQRVPMDC

SEQ ID NO: 152605 - protein, 31 aa, Artificial Sequence
  Description of Artificial Sequence: Synthetic polypeptide
DENLIRTTNPVATEQWGDVSEIEMNAAEDAC

SEQ ID NO: 152606 - protein, 37 aa, Artificial Sequence
  Description of Artificial Sequence: Synthetic polypeptide
DEEEIRTTNPVATEQYGVVSTVVNNQQGTDEEEEEED

SEQ ID NO: 152607 - protein, 31 aa, Artificial Sequence
  Description of Artificial Sequence: Synthetic polypeptide
DENQIRTTNPVATEQWGDVSEIEMNAAETDA

SEQ ID NO: 152608 - protein, 38 aa, Artificial Sequence
  Description of Artificial Sequence: Synthetic polypeptide
DEEEIRTTNPVATEQYGVVSTVVNNQQGTEDNEQEEED

SEQ ID NO: 152609 - protein, 30 aa, Artificial Sequence
  Description of Artificial Sequence: Synthetic polypeptide
DENQIRTTNPVATEQWGDVSEIEMNAAEDA

SEQ ID NO: 152610 - protein, 37 aa, Artificial Sequence
  Description of Artificial Sequence: Synthetic polypeptide
DEEEIRTTNPVATEQYGVVSTVVNNQQGTEEGEEEED

SEQ ID NO: 152611 - protein, 37 aa, Artificial Sequence
  Description of Artificial Sequence: Synthetic polypeptide
DEEEIRTTNPVATEQYGVVSTVVNNQQGTTEEEEDET

SEQ ID NO: 152612 - protein, 39 aa, Artificial Sequence
  Description of Artificial Sequence: Synthetic polypeptide
DEEEIRTTNPVATEQYGVVSTVVNNQQLQQGTNTEEAED

SEQ ID NO: 152613 - protein, 37 aa, Artificial Sequence
  Description of Artificial Sequence: Synthetic polypeptide
DEEEIRTTNPVATEQYGVVSTVVNNQQNQQGTTEEED

SEQ ID NO: 152614 - protein, 32 aa, Artificial Sequence
  Description of Artificial Sequence: Synthetic polypeptide
DENPIRTTNPVSTEPYGTISMEDIQQQRNGNH

SEQ ID NO: 152615 - protein, 34 aa, Artificial Sequence
  Description of Artificial Sequence: Synthetic polypeptide
DEHEIRTTNPVATEQWGVVSCWGISQTTGGNNPT

SEQ ID NO: 152616 - protein, 31 aa, Artificial Sequence
  Description of Artificial Sequence: Synthetic polypeptide
DENEVASTNPVSTEPYGNISMTIQQQRVGNH

SEQ ID NO: 152617 - protein, 30 aa, Artificial Sequence
  Description of Artificial Sequence: Synthetic polypeptide
DENLIRTTNPVATEQWGDVSEIEMNAAEDA

SEQ ID NO: 152618 - protein, 33 aa, Artificial Sequence
  Description of Artificial Sequence: Synthetic polypeptide
DEMEISTVNPVATEQYGCVCSTETAYFGSNNQS

SEQ ID NO: 152619 - protein, 30 aa, Artificial Sequence
  Description of Artificial Sequence: Synthetic polypeptide
DENEVRTTNPVATEQWGDVSEIPMNAAEDA

SEQ ID NO: 152620 - protein, 31 aa, Artificial Sequence
  Description of Artificial Sequence: Synthetic polypeptide
DENEVRTTNPVATEQWGDVSEIEMNAAELDA

SEQ ID NO: 152621 - protein, 30 aa, Artificial Sequence
  Description of Artificial Sequence: Synthetic polypeptide
DENEVRTTNPVATEQWGDVSEIEMNAAEDA

SEQ ID NO: 152622 - protein, 34 aa, Artificial Sequence
  Description of Artificial Sequence: Synthetic polypeptide
DEHEIRTTNPVATENYGCVATTPGMQQDRQGDAP

SEQ ID NO: 152623 - protein, 30 aa, Artificial Sequence
  Description of Artificial Sequence: Synthetic polypeptide
DENEVRSTNPVSTEQWGDVSNIIQNAAEDR

SEQ ID NO: 152624 - protein, 32 aa, Artificial Sequence
  Description of Artificial Sequence: Synthetic polypeptide
DENEVRSTNPVSTEPYGNISANDIQQQRNGQR

SEQ ID NO: 152625 - protein, 35 aa, Artificial Sequence
  Description of Artificial Sequence: Synthetic polypeptide
DEMEITTTNPVATEQYGTVCSATSGPVELFIGPND

SEQ ID NO: 152626 - protein, 31 aa, Artificial Sequence
  Description of Artificial Sequence: Synthetic polypeptide
DENEVASTNPVSTEQYGDVAANTIQNRVEQR

SEQ ID NO: 152627 - protein, 31 aa, Artificial Sequence
  Description of Artificial Sequence: Synthetic polypeptide
DENEVASTNPVSTEQYGDVAANIIQNRVEQR

SEQ ID NO: 152628 - protein, 33 aa, Artificial Sequence
  Description of Artificial Sequence: Synthetic polypeptide
DEMEIVATNPVATEQYGTVCSATDGPVEFEGND

SEQ ID NO: 152629 - protein, 34 aa, Artificial Sequence
  Description of Artificial Sequence: Synthetic polypeptide
DEHEIRTTNPVATENYGCVATTPGMQQDRGGDPH

SEQ ID NO: 152630 - protein, 39 aa, Artificial Sequence
  Description of Artificial Sequence: Synthetic polypeptide
DEEEIRTTNPVATEQYGTVTNLQSGTIGTNLQNQEAGNV

SEQ ID NO: 152631 - protein, 34 aa, Artificial Sequence
  Description of Artificial Sequence: Synthetic polypeptide
DEAEIATTNPVAYEQWGSVAKTNDLQEQDLGQVG

SEQ ID NO: 152632 - protein, 34 aa, Artificial Sequence
  Description of Artificial Sequence: Synthetic polypeptide
DEHEIRTTNPVATENYGCVATTPGMQQDREGDTP

SEQ ID NO: 152633 - protein, 38 aa, Artificial Sequence
  Description of Artificial Sequence: Synthetic polypeptide
DEEEIRTTNPVATEQYGVVSTVVNQLQQGTEEGTTDDE

SEQ ID NO: 152634 - protein, 34 aa, Artificial Sequence
  Description of Artificial Sequence: Synthetic polypeptide
DEHEIRTTNPVATENYGCVATTGGMQQQDRGGDP

SEQ ID NO: 152635 - protein, 33 aa, Artificial Sequence
  Description of Artificial Sequence: Synthetic polypeptide
DEMEIVCTNPVATEQYGEVCSATDGPVEFEGND

SEQ ID NO: 152636 - protein, 33 aa, Artificial Sequence
  Description of Artificial Sequence: Synthetic polypeptide
DENEVRTTNPVSTEPYGNISANEDIQQQRNGQR

SEQ ID NO: 152637 - protein, 32 aa, Artificial Sequence
  Description of Artificial Sequence: Synthetic polypeptide
DENEVRTTNPVSTEPYGTISMEDIQQQRNGNH

SEQ ID NO: 152638 - protein, 34 aa, Artificial Sequence
  Description of Artificial Sequence: Synthetic polypeptide
DEMEITTTNPVATEQYGTVCSATSGPQEFQHEND

SEQ ID NO: 152639 - protein, 32 aa, Artificial Sequence
  Description of Artificial Sequence: Synthetic polypeptide
DENEVRTTNPVSTEPYGTISMETIQQQQNGNH

SEQ ID NO: 152640 - protein, 34 aa, Artificial Sequence
  Description of Artificial Sequence: Synthetic polypeptide
DEMEISTVNPVATEQYGCVCSTGELFYFGSNNQS

SEQ ID NO: 152641 - protein, 30 aa, Artificial Sequence
  Description of Artificial Sequence: Synthetic polypeptide
DENKIRTTNPVATEQWGDVSEIEMNAAEDI

SEQ ID NO: 152642 - protein, 30 aa, Artificial Sequence
  Description of Artificial Sequence: Synthetic polypeptide
DENKIRTTNPVATEQWGDVSEIEMNAAEDA

SEQ ID NO: 152643 - protein, 30 aa, Artificial Sequence
  Description of Artificial Sequence: Synthetic polypeptide
DENIIRTTNPVATEQWGDVSEIEMNAAEDA

SEQ ID NO: 152644 - protein, 34 aa, Artificial Sequence
  Description of Artificial Sequence: Synthetic polypeptide
DEHEIRTTNPVATENYGCVATTPGMQQDRSGGDH

SEQ ID NO: 152645 - protein, 30 aa, Artificial Sequence
  Description of Artificial Sequence: Synthetic polypeptide
DENHIRTTNPVATEQWGQVSEIEMNAAEDA

SEQ ID NO: 152646 - protein, 30 aa, Artificial Sequence
  Description of Artificial Sequence: Synthetic polypeptide
DENHIRTTNPVATEQWGDVSMIEMNAAEDA

SEQ ID NO: 152647 - protein, 30 aa, Artificial Sequence
  Description of Artificial Sequence: Synthetic polypeptide
DENHIRTTNPVATEQWGDVSEIEMNAPEDA

SEQ ID NO: 152648 - protein, 30 aa, Artificial Sequence
  Description of Artificial Sequence: Synthetic polypeptide
DENLIRTTNPVATEQWGDVSEIEFNAAEDA

SEQ ID NO: 152649 - protein, 33 aa, Artificial Sequence
  Description of Artificial Sequence: Synthetic polypeptide
DEMEITCTNPVATEQYGTVCSATDGPVEFEGND

SEQ ID NO: 152650 - protein, 30 aa, Artificial Sequence
  Description of Artificial Sequence: Synthetic polypeptide
DENHIRTTNPVATEQWGDVSEIEMNAAEDA

SEQ ID NO: 152651 - protein, 32 aa, Artificial Sequence
  Description of Artificial Sequence: Synthetic polypeptide
DENGIRTTNPVSTEPYGTISMESIQQQQNGNH

SEQ ID NO: 152652 - protein, 32 aa, Artificial Sequence
  Description of Artificial Sequence: Synthetic polypeptide
DENGIRTTNPVSTEPYGTISMEDIQQQQNGNR

SEQ ID NO: 152653 - protein, 34 aa, Artificial Sequence
  Description of Artificial Sequence: Synthetic polypeptide
CEEEIRTTNPVATEQYGCVCSWEEHQNFNSNPQS

SEQ ID NO: 152654 - protein, 33 aa, Artificial Sequence
  Description of Artificial Sequence: Synthetic polypeptide
CEEEIRTTNPVATEQYGCVCSWEHEENFNSNQE

SEQ ID NO: 152655 - protein, 33 aa, Artificial Sequence
  Description of Artificial Sequence: Synthetic polypeptide
DEMEITTTNPVATEQYGTVCSATDGPVEFEMND

SEQ ID NO: 152656 - protein, 30 aa, Artificial Sequence
  Description of Artificial Sequence: Synthetic polypeptide
DENGIRTTNPVATEQWGDVSEIEMNAAEDA

SEQ ID NO: 152657 - protein, 32 aa, Artificial Sequence
  Description of Artificial Sequence: Synthetic polypeptide
DENEVRTTNPVSTEPYGTISNEDIQQQQNGNR

SEQ ID NO: 152658 - protein, 30 aa, Artificial Sequence
  Description of Artificial Sequence: Synthetic polypeptide
DENHIRTTNPVATEQWGDVSEIEMNAAEDD

SEQ ID NO: 152659 - protein, 34 aa, Artificial Sequence
  Description of Artificial Sequence: Synthetic polypeptide
DDECIRTTNPVATEQYGCVCSTGEHNQNFNSDQS

SEQ ID NO: 152660 - protein, 35 aa, Artificial Sequence
  Description of Artificial Sequence: Synthetic polypeptide
DEEEISTTNPCATEQYGCVCPTGNHQEYFGSDNQS

SEQ ID NO: 152661 - protein, 36 aa, Artificial Sequence
  Description of Artificial Sequence: Synthetic polypeptide
DEHEIRTTNPVATEQYGSVSCNDGDEEIFMLQDHPF

SEQ ID NO: 152662 - protein, 32 aa, Artificial Sequence
  Description of Artificial Sequence: Synthetic polypeptide
DDSEVASTNPVATEQYGNVAANAIPQSRVGQR

SEQ ID NO: 152663 - protein, 34 aa, Artificial Sequence
  Description of Artificial Sequence: Synthetic polypeptide
DEQEIATTNPVATEQWGSVSANGDLEADTEGEDA

SEQ ID NO: 152664 - protein, 36 aa, Artificial Sequence
  Description of Artificial Sequence: Synthetic polypeptide
DEMEIRTTNPVATEQYGSVSVPSKLTELEITQESRF

SEQ ID NO: 152665 - protein, 36 aa, Artificial Sequence
  Description of Artificial Sequence: Synthetic polypeptide
DEMEIRTTNPVATEQYGSVSVPSNLTEEEIVQEDVF

SEQ ID NO: 152666 - protein, 36 aa, Artificial Sequence
  Description of Artificial Sequence: Synthetic polypeptide
DEMEIRTTNPVATEQYGSVSVPSNLTEEEIWNESDF

SEQ ID NO: 152667 - protein, 31 aa, Artificial Sequence
  Description of Artificial Sequence: Synthetic polypeptide
DDSEVASTNPVATEGYGSVAATTIEDRVGQR

SEQ ID NO: 152668 - protein, 33 aa, Artificial Sequence
  Description of Artificial Sequence: Synthetic polypeptide
DEAEIATTNPVAYEGWGTVCSTNDQGDVGDNSS

SEQ ID NO: 152669 - protein, 31 aa, Artificial Sequence
  Description of Artificial Sequence: Synthetic polypeptide
DDSEVASTNPVATEGYGNVSCTIQSRVGEQR

SEQ ID NO: 152670 - protein, 31 aa, Artificial Sequence
  Description of Artificial Sequence: Synthetic polypeptide
DDSEVASTNPVATEGYGNVSANTLESHVGQR

SEQ ID NO: 152671 - protein, 35 aa, Artificial Sequence
  Description of Artificial Sequence: Synthetic polypeptide
CTGEIRTTNPVATEQYGSVSNTQNNGNQLEGEGFT

SEQ ID NO: 152672 - protein, 32 aa, Artificial Sequence
  Description of Artificial Sequence: Synthetic polypeptide
DDSEVASTNPVATEGYGNVSANTEPQSRVGQR

SEQ ID NO: 152673 - protein, 31 aa, Artificial Sequence
  Description of Artificial Sequence: Synthetic polypeptide
DDSEVASTNPVATEGYGNVSAETIQSRVGGR

SEQ ID NO: 152674 - protein, 35 aa, Artificial Sequence
  Description of Artificial Sequence: Synthetic polypeptide
CTGEIRTTNPVATEQYGSVDTTQNNGQEEGNGGGT

SEQ ID NO: 152675 - protein, 35 aa, Artificial Sequence
  Description of Artificial Sequence: Synthetic polypeptide
DEAEIATTNPVAYEKWGVVCSTDNGNQERDGDNRQ

SEQ ID NO: 152676 - protein, 35 aa, Artificial Sequence
  Description of Artificial Sequence: Synthetic polypeptide
DEAEIATTNPVAYEPQWGQSVAANDLLQTRGITRQ

SEQ ID NO: 152677 - protein, 30 aa, Artificial Sequence
  Description of Artificial Sequence: Synthetic polypeptide
DEQEIATTNPVATEQWGDVSEIEMDAAEDA

SEQ ID NO: 152678 - protein, 32 aa, Artificial Sequence
  Description of Artificial Sequence: Synthetic polypeptide
DEQEIATTNPVATEQWGDVSATDLEDHEEDDA

SEQ ID NO: 152679 - protein, 37 aa, Artificial Sequence
  Description of Artificial Sequence: Synthetic polypeptide
DEEEIRTTNPVATEQYGVVATTNLQLQAGTEQGSTDS

SEQ ID NO: 152680 - protein, 37 aa, Artificial Sequence
  Description of Artificial Sequence: Synthetic polypeptide
DEEEIRTTNPVATEQYGVVATTNNNLQAGTEQGTTET

SEQ ID NO: 152681 - protein, 37 aa, Artificial Sequence
  Description of Artificial Sequence: Synthetic polypeptide
DEEEIRTTNPVATEQYGVVATTNNQLQAGTEEGTTEQ

SEQ ID NO: 152682 - protein, 31 aa, Artificial Sequence
  Description of Artificial Sequence: Synthetic polypeptide
DDSEVASTNPVATEQYGNVAANTIQSHVGQR

SEQ ID NO: 152683 - protein, 34 aa, Artificial Sequence
  Description of Artificial Sequence: Synthetic polypeptide
DEQEIATTNPVATEQWGSVSATGDLEDHEGEDAP

SEQ ID NO: 152684 - protein, 35 aa, Artificial Sequence
  Description of Artificial Sequence: Synthetic polypeptide
DEQEIATTNPVATEQWGSVSATGDLDEDHQGGEVH

SEQ ID NO: 152685 - protein, 36 aa, Artificial Sequence
  Description of Artificial Sequence: Synthetic polypeptide
DEQEIATTNPVATEQWGSVSATGDLDEDHQGGEDNH

SEQ ID NO: 152686 - protein, 34 aa, Artificial Sequence
  Description of Artificial Sequence: Synthetic polypeptide
DEQEIATTNPVATEQWGSVSATGDLDEDHQGEDA

SEQ ID NO: 152687 - protein, 33 aa, Artificial Sequence
  Description of Artificial Sequence: Synthetic polypeptide
DEQEIATTNPVATEQWGSVSATGDEADTEGEDA

SEQ ID NO: 152688 - protein, 34 aa, Artificial Sequence
  Description of Artificial Sequence: Synthetic polypeptide
DEQEIATTNPVATEQWGSVSATDPLNDHGGDEDN

SEQ ID NO: 152689 - protein, 34 aa, Artificial Sequence
  Description of Artificial Sequence: Synthetic polypeptide
DEQEIATTNPVATEQWGSVSATDPLEDHHGGEDL

SEQ ID NO: 152690 - protein, 37 aa, Artificial Sequence
  Description of Artificial Sequence: Synthetic polypeptide
DEEEIRTTNPVATEQYGVVATVNQQLQAGTEEGSTEQ

SEQ ID NO: 152691 - protein, 36 aa, Artificial Sequence
  Description of Artificial Sequence: Synthetic polypeptide
DEEEIRTTNPVATEQYGVNSSTTPAGPNMRNGMNPV

SEQ ID NO: 152692 - protein, 32 aa, Artificial Sequence
  Description of Artificial Sequence: Synthetic polypeptide
DEQEIATTNPVATEQWGSVSATDEMDHAEEDL

SEQ ID NO: 152693 - protein, 35 aa, Artificial Sequence
  Description of Artificial Sequence: Synthetic polypeptide
DEMEIRTTNPVATEQYGSVSVMEDVDLDRFESIME

SEQ ID NO: 152694 - protein, 35 aa, Artificial Sequence
  Description of Artificial Sequence: Synthetic polypeptide
DEMEIRTTNPVATEQYGSVSVMLAEELDRFESIME

SEQ ID NO: 152695 - protein, 36 aa, Artificial Sequence
  Description of Artificial Sequence: Synthetic polypeptide
DEMEIRTTNPVATEQYGSVSVMLEVECDRFDGSISE

SEQ ID NO: 152696 - protein, 36 aa, Artificial Sequence
  Description of Artificial Sequence: Synthetic polypeptide
DEMEIRTTNPVATEQYGSVSVMPVVELDRFDGSIME

SEQ ID NO: 152697 - protein, 34 aa, Artificial Sequence
  Description of Artificial Sequence: Synthetic polypeptide
DEMEIRTTNPVATEQYGSVSVMYETEQDKFFSIE

SEQ ID NO: 152698 - protein, 36 aa, Artificial Sequence
  Description of Artificial Sequence: Synthetic polypeptide
DEMEIRTTNPVATEQYGSVSVMYEVEQDKFGNSIED

SEQ ID NO: 152699 - protein, 35 aa, Artificial Sequence
  Description of Artificial Sequence: Synthetic polypeptide
CTGEIRTTNPVATEQYGSVSTQNNGDQQDEGEMGQ

SEQ ID NO: 152700 - protein, 35 aa, Artificial Sequence
  Description of Artificial Sequence: Synthetic polypeptide
CTGEIRTTNPVATEQYGSVSTQNNGDQLEGEMEGM

SEQ ID NO: 152701 - protein, 37 aa, Artificial Sequence
  Description of Artificial Sequence: Synthetic polypeptide
DEEEIRTTNPVATEQYGVVATTNQQLQAGTEQGTTDE

SEQ ID NO: 152702 - protein, 34 aa, Artificial Sequence
  Description of Artificial Sequence: Synthetic polypeptide
DEQEIATTNPVATEQWGSVSATGDLEDHLGEDLH

SEQ ID NO: 152703 - protein, 34 aa, Artificial Sequence
  Description of Artificial Sequence: Synthetic polypeptide
DEEEIRTTNPVATEQYGVIYHTYLEDHNDEGDEQ

SEQ ID NO: 152704 - protein, 35 aa, Artificial Sequence
  Description of Artificial Sequence: Synthetic polypeptide
DEEEIRTTNPVATEQYGVISDDGDNGQNGGGDEDN

SEQ ID NO: 152705 - protein, 33 aa, Artificial Sequence
  Description of Artificial Sequence: Synthetic polypeptide
DEQEIATTNPVATEPYGSISATEDLEDHEGEDL

SEQ ID NO: 152706 - protein, 31 aa, Artificial Sequence
  Description of Artificial Sequence: Synthetic polypeptide
DDSEVASTNPVATEGYGNAAANTLQSRVGQR

SEQ ID NO: 152707 - protein, 33 aa, Artificial Sequence
  Description of Artificial Sequence: Synthetic polypeptide
DEQEIATTNPVATEKYGSVYSATDLEDHETEDL

SEQ ID NO: 152708 - protein, 39 aa, Artificial Sequence
  Description of Artificial Sequence: Synthetic polypeptide
DEEEIRTTNPVATEQYGSVSTVNNQNLLQGNNQEEENES

SEQ ID NO: 152709 - protein, 39 aa, Artificial Sequence
  Description of Artificial Sequence: Synthetic polypeptide
DEEEIRTTNPVATEQYGSVSTVNNQNLLQGNNQEETTEQ

SEQ ID NO: 152710 - protein, 39 aa, Artificial Sequence
  Description of Artificial Sequence: Synthetic polypeptide
DEEEIRTTNPVATEQYGSVSTVNNQQLQQGTEQGTVVTD

SEQ ID NO: 152711 - protein, 36 aa, Artificial Sequence
  Description of Artificial Sequence: Synthetic polypeptide
DEQEIATTNPVATEIYGSVCSNWNDGQDRQGGGTER

SEQ ID NO: 152712 - protein, 31 aa, Artificial Sequence
  Description of Artificial Sequence: Synthetic polypeptide
DDSEVASTNPVATEGYGEVSAETIQSRVGQR

SEQ ID NO: 152713 - protein, 34 aa, Artificial Sequence
  Description of Artificial Sequence: Synthetic polypeptide
CEEEIRCTNPVATEQYGCVCSTGEHQNFNSDNQS

SEQ ID NO: 152714 - protein, 32 aa, Artificial Sequence
  Description of Artificial Sequence: Synthetic polypeptide
DEQEIATTNPVATEHWGSCSATDNNDHEGEDL

SEQ ID NO: 152715 - protein, 31 aa, Artificial Sequence
  Description of Artificial Sequence: Synthetic polypeptide
DDSEVASTNPVATEGYGEVSAETIQSRVGGR

SEQ ID NO: 152716 - protein, 38 aa, Artificial Sequence
  Description of Artificial Sequence: Synthetic polypeptide
DEEEIRTTNPVATEQYGSVSTVNQNNNVNQNATTNATE

SEQ ID NO: 152717 - protein, 30 aa, Artificial Sequence
  Description of Artificial Sequence: Synthetic polypeptide
DDSEVASTNPVATEGYGEVANTIQSRVGQR

SEQ ID NO: 152718 - protein, 30 aa, Artificial Sequence
  Description of Artificial Sequence: Synthetic polypeptide
DDSEVASTNPVATEGYGEVAETIQSRVGQR

SEQ ID NO: 152719 - protein, 31 aa, Artificial Sequence
  Description of Artificial Sequence: Synthetic polypeptide
DDSEVASTNPVATEGYGEVAANTIQSRVGQR

SEQ ID NO: 152720 - protein, 40 aa, Artificial Sequence
  Description of Artificial Sequence: Synthetic polypeptide
DEEEIRTTNPVATEQYGSVSTVNQNQLQAGTEQYGTVVNE

SEQ ID NO: 152721 - protein, 39 aa, Artificial Sequence
  Description of Artificial Sequence: Synthetic polypeptide
DEEEIRTTNPVATEQYGSVSTVNQNQLQEATEQGTVVEM

SEQ ID NO: 152722 - protein, 31 aa, Artificial Sequence
  Description of Artificial Sequence: Synthetic polypeptide
DDSEVASTNPVATEGYGNVAANDIQSRVGQR

SEQ ID NO: 152723 - protein, 35 aa, Artificial Sequence
  Description of Artificial Sequence: Synthetic polypeptide
DEMEIRTTNPVATEQYGSVTPTNSDQETLPEDDIE

SEQ ID NO: 152724 - protein, 33 aa, Artificial Sequence
  Description of Artificial Sequence: Synthetic polypeptide
DEMEIRTTNPVATEQYGSVTFMPDLNDIESSQS

SEQ ID NO: 152725 - protein, 34 aa, Artificial Sequence
  Description of Artificial Sequence: Synthetic polypeptide
DEQEIATTNPVATEPYGSVCFTNEDHTDRGGDHV

SEQ ID NO: 152726 - protein, 30 aa, Artificial Sequence
  Description of Artificial Sequence: Synthetic polypeptide
DDSEVASTNPVATEGYGNVANTIQSRVGQR

SEQ ID NO: 152727 - protein, 34 aa, Artificial Sequence
  Description of Artificial Sequence: Synthetic polypeptide
DEMEIRTTNPVATEQYGSVSWHDEVESLYDNIES

SEQ ID NO: 152728 - protein, 35 aa, Artificial Sequence
  Description of Artificial Sequence: Synthetic polypeptide
DEMEIRTTNPVATEQYGSVSWMHEVELDRFESIME

SEQ ID NO: 152729 - protein, 34 aa, Artificial Sequence
  Description of Artificial Sequence: Synthetic polypeptide
DEEEIRTTNPVATEQYGVCVYPSPVIMNNVDMFE

SEQ ID NO: 152730 - protein, 33 aa, Artificial Sequence
  Description of Artificial Sequence: Synthetic polypeptide
DEQEIATTNPVATEQWGCVAAANHLTAQAEDRE

SEQ ID NO: 152731 - protein, 34 aa, Artificial Sequence
  Description of Artificial Sequence: Synthetic polypeptide
DEMEIRTTNPVATEQYGSVSWPVHEDFEPEIDNF

SEQ ID NO: 152732 - protein, 31 aa, Artificial Sequence
  Description of Artificial Sequence: Synthetic polypeptide
DDSEVASTNPVATEGYGNVAANTIQSRVGQR

SEQ ID NO: 152733 - protein, 31 aa, Artificial Sequence
  Description of Artificial Sequence: Synthetic polypeptide
DDSEVASTNPVATEGYGNVAANTIQSREGQR

SEQ ID NO: 152734 - protein, 35 aa, Artificial Sequence
  Description of Artificial Sequence: Synthetic polypeptide
DEMEIRTTNPVATEQYGSVSWCDEDQSLYDDNIEG

SEQ ID NO: 152735 - protein, 30 aa, Artificial Sequence
  Description of Artificial Sequence: Synthetic polypeptide
DDSEVASTNPVATEGYGNVAANTIQRVEQR

SEQ ID NO: 152736 - protein, 32 aa, Artificial Sequence
  Description of Artificial Sequence: Synthetic polypeptide
DEQEIATTNPVATEQWGAVSAADLEEHKGPYI

SEQ ID NO: 152737 - protein, 32 aa, Artificial Sequence
  Description of Artificial Sequence: Synthetic polypeptide
DEQEIATTNPVATEQWGAVSAADLEEHKGEYL

SEQ ID NO: 152738 - protein, 32 aa, Artificial Sequence
  Description of Artificial Sequence: Synthetic polypeptide
DEQEIATTNPVATEQWGAVSAADLEEHKGEYI

SEQ ID NO: 152739 - protein, 32 aa, Artificial Sequence
  Description of Artificial Sequence: Synthetic polypeptide
DEQEIATTNPVATEQWGAVSAADLEDHEGEYL

SEQ ID NO: 152740 - protein, 35 aa, Artificial Sequence
  Description of Artificial Sequence: Synthetic polypeptide
DEMEIRTTNPVATEQYGSVTDTYVDDLERDPAQME

SEQ ID NO: 152741 - protein, 34 aa, Artificial Sequence
  Description of Artificial Sequence: Synthetic polypeptide
DEQEIATTNPVATEPYGVVSWNNDEGEQNGSNDE

SEQ ID NO: 152742 - protein, 33 aa, Artificial Sequence
  Description of Artificial Sequence: Synthetic polypeptide
DEQEIATTNPVATEPYGTISATEDLQDHEGEDL

SEQ ID NO: 152743 - protein, 33 aa, Artificial Sequence
  Description of Artificial Sequence: Synthetic polypeptide
DEQEIATTNPVATEPYGSVSATEDIEDHEGEDL

SEQ ID NO: 152744 - protein, 31 aa, Artificial Sequence
  Description of Artificial Sequence: Synthetic polypeptide
DDSEVASTNPVATEGYGNVAANTIQQRVGQR

SEQ ID NO: 152745 - protein, 39 aa, Artificial Sequence
  Description of Artificial Sequence: Synthetic polypeptide
DEEEIRTTNPVATEQYGSVSTVNQNQLQQGTEQGTVVEQ

SEQ ID NO: 152746 - protein, 34 aa, Artificial Sequence
  Description of Artificial Sequence: Synthetic polypeptide
DEQEIATTNPVATEQWGSVSATGDLEDHQGDIDN

SEQ ID NO: 152747 - protein, 34 aa, Artificial Sequence
  Description of Artificial Sequence: Synthetic polypeptide
DEQEIATTNPVATEQWGSVSATGDLPDDHEGEDN

SEQ ID NO: 152748 - protein, 34 aa, Artificial Sequence
  Description of Artificial Sequence: Synthetic polypeptide
DEEEIRTTNPVATEQYGVVMGDNPEMGGGEGGTG

SEQ ID NO: 152749 - protein, 35 aa, Artificial Sequence
  Description of Artificial Sequence: Synthetic polypeptide
DEEEIRTTNPVATEQYGVVMGDLFNGQEGGGDEGG

SEQ ID NO: 152750 - protein, 33 aa, Artificial Sequence
  Description of Artificial Sequence: Synthetic polypeptide
DCMEIVTTNPVATEQYGTVCSGTDGPVEFEGND

SEQ ID NO: 152751 - protein, 33 aa, Artificial Sequence
  Description of Artificial Sequence: Synthetic polypeptide
DEQEIATTNPVATEQWGSVWAATDLEEHEGPDI

SEQ ID NO: 152752 - protein, 37 aa, Artificial Sequence
  Description of Artificial Sequence: Synthetic polypeptide
DEMEIRTTNPVATEQYGSVSSTPPAGPNMENGMNDIQ

SEQ ID NO: 152753 - protein, 37 aa, Artificial Sequence
  Description of Artificial Sequence: Synthetic polypeptide
DEMEIRTTNPVATEQYGSVSSTPPAGPNMENGMNPVN

SEQ ID NO: 152754 - protein, 33 aa, Artificial Sequence
  Description of Artificial Sequence: Synthetic polypeptide
DEAEIATTNPVATEQYGTVASATDGPVPAEGGD

SEQ ID NO: 152755 - protein, 36 aa, Artificial Sequence
  Description of Artificial Sequence: Synthetic polypeptide
DEMEIRTTNPVATEQYGSVSSTTPAGPNMRNGMEVV

SEQ ID NO: 152756 - protein, 37 aa, Artificial Sequence
  Description of Artificial Sequence: Synthetic polypeptide
DEMEIRTTNPVATEQYGSVSSTTPAGPNMRNGMNVEQ

SEQ ID NO: 152757 - protein, 36 aa, Artificial Sequence
  Description of Artificial Sequence: Synthetic polypeptide
DEMEIRTTNPVATEQYGSVSSTTPAMPNMENGMDPV

SEQ ID NO: 152758 - protein, 37 aa, Artificial Sequence
  Description of Artificial Sequence: Synthetic polypeptide
DEMEIRTTNPVATEQYGSVSSTTPAMPNMRNGMNVLN

SEQ ID NO: 152759 - protein, 40 aa, Artificial Sequence
  Description of Artificial Sequence: Synthetic polypeptide
DEEEIRTTNPVATEQYGSVSTVNNNLLQAGTEQYGTNVED

SEQ ID NO: 152760 - protein, 39 aa, Artificial Sequence
  Description of Artificial Sequence: Synthetic polypeptide
DEEEIRTTNPVATEQYGSVSTVNNNNLLQGNNQDEEEEQ

SEQ ID NO: 152761 - protein, 33 aa, Artificial Sequence
  Description of Artificial Sequence: Synthetic polypeptide
DEAEIATTNPVATEQYGTVCAANDGPTADDGND

SEQ ID NO: 152762 - protein, 35 aa, Artificial Sequence
  Description of Artificial Sequence: Synthetic polypeptide
DEQEIATTNPVATEQWGSVSGQGVGLQDSDGNGGN

SEQ ID NO: 152763 - protein, 35 aa, Artificial Sequence
  Description of Artificial Sequence: Synthetic polypeptide
DEEEIRTTNPVATEQYGVVGGMGDNVGQGEGMEGT

SEQ ID NO: 152764 - protein, 36 aa, Artificial Sequence
  Description of Artificial Sequence: Synthetic polypeptide
DEEEIRTVNPVATEQYGSVSPMLLLDSVRFNAQVDK

SEQ ID NO: 152765 - protein, 35 aa, Artificial Sequence
  Description of Artificial Sequence: Synthetic polypeptide
DEEEIRTTNPVATEQYGVVMGDTGSGGQNNINGQP

SEQ ID NO: 152766 - protein, 33 aa, Artificial Sequence
  Description of Artificial Sequence: Synthetic polypeptide
DEQEIATTNPVATEQWGSVWSATDWEDHEGEDL

SEQ ID NO: 152767 - protein, 33 aa, Artificial Sequence
  Description of Artificial Sequence: Synthetic polypeptide
DCMEIVTTNPVATEQYGTVCSATDGPVEFEGNI

SEQ ID NO: 152768 - protein, 36 aa, Artificial Sequence
  Description of Artificial Sequence: Synthetic polypeptide
DEMEIRTTNPVATEQYGSVSSPNNCNALEILQESMI

SEQ ID NO: 152769 - protein, 35 aa, Artificial Sequence
  Description of Artificial Sequence: Synthetic polypeptide
DEQEIATTNPVATEQYGATVSCTGLSEAHEGGENL

SEQ ID NO: 152770 - protein, 36 aa, Artificial Sequence
  Description of Artificial Sequence: Synthetic polypeptide
DEEEIRTTNPVATEQYGVVMSTGFQGGDGEIDGSTE

SEQ ID NO: 152771 - protein, 36 aa, Artificial Sequence
  Description of Artificial Sequence: Synthetic polypeptide
DEEEIRTTNPVATEQYGVVMSDETNGGEFTNDDGEQ

SEQ ID NO: 152772 - protein, 35 aa, Artificial Sequence
  Description of Artificial Sequence: Synthetic polypeptide
DEEEIRTTNPVATEQYGVVMGVTDNIEGQGIIEGI

SEQ ID NO: 152773 - protein, 39 aa, Artificial Sequence
  Description of Artificial Sequence: Synthetic polypeptide
DEEEIRTTNPVATEQYGSVSTVNLQQLQEGTEQGTVVQD

SEQ ID NO: 152774 - protein, 35 aa, Artificial Sequence
  Description of Artificial Sequence: Synthetic polypeptide
DEMEIRTTNPVATEQYGSVSPTVYGPEQSFEQFES

SEQ ID NO: 152775 - protein, 36 aa, Artificial Sequence
  Description of Artificial Sequence: Synthetic polypeptide
DEAEIRTTNPVATEQYGSVSVDAANTQTGQGEEVES

SEQ ID NO: 152776 - protein, 36 aa, Artificial Sequence
  Description of Artificial Sequence: Synthetic polypeptide
DEAEIRTTNPVATEQYGSVSVAAANTNTGQVEESES

SEQ ID NO: 152777 - protein, 33 aa, Artificial Sequence
  Description of Artificial Sequence: Synthetic polypeptide
DEQEIATTNPVATEQWGSVSGEGNPDNDLVGAE

SEQ ID NO: 152778 - protein, 36 aa, Artificial Sequence
  Description of Artificial Sequence: Synthetic polypeptide
DEEEIRTTNPVATEQYGVVMGNDENVEQTDGGNGET

SEQ ID NO: 152779 - protein, 36 aa, Artificial Sequence
  Description of Artificial Sequence: Synthetic polypeptide
DEEEIRTTNPVATEQYGVVMGNDENNVQEDGGNGGT

SEQ ID NO: 152780 - protein, 33 aa, Artificial Sequence
  Description of Artificial Sequence: Synthetic polypeptide
DCMEIVTTNPVATEQYGTVCSATDGPVEFEGND

SEQ ID NO: 152781 - protein, 36 aa, Artificial Sequence
  Description of Artificial Sequence: Synthetic polypeptide
DEEEIRTTNPVATEQYGVVMGNDENDEQTQGGNGGT

SEQ ID NO: 152782 - protein, 35 aa, Artificial Sequence
  Description of Artificial Sequence: Synthetic polypeptide
DEEEIRTTNPVATEQYGVVMGINDNQEGGDDEEIL

SEQ ID NO: 152783 - protein, 34 aa, Artificial Sequence
  Description of Artificial Sequence: Synthetic polypeptide
DEEEIRTTNPVATEQYGVVMGINDNEGGDDEEDT

SEQ ID NO: 152784 - protein, 34 aa, Artificial Sequence
  Description of Artificial Sequence: Synthetic polypeptide
DEEEIRTTNPVATEQYGVVMGINDNEGGDDEDEV

SEQ ID NO: 152785 - protein, 32 aa, Artificial Sequence
  Description of Artificial Sequence: Synthetic polypeptide
DEQEIATTNPVATEQWGTCSATDNNDHEGEDS

SEQ ID NO: 152786 - protein, 33 aa, Artificial Sequence
  Description of Artificial Sequence: Synthetic polypeptide
DEQEIATTNPVATEQWGSVWSATDWEDHEGPDL

SEQ ID NO: 152787 - protein, 36 aa, Artificial Sequence
  Description of Artificial Sequence: Synthetic polypeptide
DCKEIRTTNPVATEQYGSVSSTTPAGPNMRNGMNPV

SEQ ID NO: 152788 - protein, 33 aa, Artificial Sequence
  Description of Artificial Sequence: Synthetic polypeptide
DEQEIATTNPVATEQWGSVSATGDLNNHEMEDL

SEQ ID NO: 152789 - protein, 35 aa, Artificial Sequence
  Description of Artificial Sequence: Synthetic polypeptide
DEEEIRTTNPVATEQYGVVGGMGDNGNQGEGMELN

SEQ ID NO: 152790 - protein, 36 aa, Artificial Sequence
  Description of Artificial Sequence: Synthetic polypeptide
DEMEIRTTNPVATEQYGSVSSVPLHDNIEWQEENNM

SEQ ID NO: 152791 - protein, 30 aa, Artificial Sequence
  Description of Artificial Sequence: Synthetic polypeptide
DDSEVASTNPVSTECYGNVAANTIQSRGQR

SEQ ID NO: 152792 - protein, 34 aa, Artificial Sequence
  Description of Artificial Sequence: Synthetic polypeptide
DEAEIATTNPVATEVWGSVCYTNENQDKGGGNAM

SEQ ID NO: 152793 - protein, 30 aa, Artificial Sequence
  Description of Artificial Sequence: Synthetic polypeptide
DDSEVASTNPVSTECYGNVAANTIQRVGQR

SEQ ID NO: 152794 - protein, 29 aa, Artificial Sequence
  Description of Artificial Sequence: Synthetic peptide
DDSEVASTNPVSTECYGDVANTIQSRGQR

SEQ ID NO: 152795 - protein, 34 aa, Artificial Sequence
  Description of Artificial Sequence: Synthetic polypeptide
DEAEIATTNPVATEWWGSVYITDNHQQDHAGGDR

SEQ ID NO: 152796 - protein, 34 aa, Artificial Sequence
  Description of Artificial Sequence: Synthetic polypeptide
DEAEIATTNPVAWEQYGSVSCTGQAQVKTVANNE

SEQ ID NO: 152797 - protein, 34 aa, Artificial Sequence
  Description of Artificial Sequence: Synthetic polypeptide
DEAEIATTNPVAYECWGCVASNDNLGEERGENSR

SEQ ID NO: 152798 - protein, 33 aa, Artificial Sequence
  Description of Artificial Sequence: Synthetic polypeptide
DAAEIACTNPVATEQWGGCSATGNGQTRDGNNQ

SEQ ID NO: 152799 - protein, 35 aa, Artificial Sequence
  Description of Artificial Sequence: Synthetic polypeptide
DEMEIRTTNPVATEQYGSVSTPNNATYEEIVQESS

SEQ ID NO: 152800 - protein, 30 aa, Artificial Sequence
  Description of Artificial Sequence: Synthetic polypeptide
DDSEVASTNPVGTEGYGVVANTLQSRVGQR

SEQ ID NO: 152801 - protein, 30 aa, Artificial Sequence
  Description of Artificial Sequence: Synthetic polypeptide
DDSEVASTNPVGTEGYGNVASTIQSRVGDR

SEQ ID NO: 152802 - protein, 33 aa, Artificial Sequence
  Description of Artificial Sequence: Synthetic polypeptide
DEAEIATTNPVAYECWGSVSCANFSDDREGGNV

SEQ ID NO: 152803 - protein, 29 aa, Artificial Sequence
  Description of Artificial Sequence: Synthetic peptide
DDSEVASTNPVGTEGYGNVASTIQSRGDI

SEQ ID NO: 152804 - protein, 29 aa, Artificial Sequence
  Description of Artificial Sequence: Synthetic peptide
DDSEVASTNPVGTEGYGNVASTIQSHGDR

SEQ ID NO: 152805 - protein, 34 aa, Artificial Sequence
  Description of Artificial Sequence: Synthetic polypeptide
DEAEIATTNPVAYECWGSVYWTDNLQDDMNNGNN

SEQ ID NO: 152806 - protein, 35 aa, Artificial Sequence
  Description of Artificial Sequence: Synthetic polypeptide
DEEEIRTTNPVATEQYGVVCSNWGEHQENFGSEQS

SEQ ID NO: 152807 - protein, 36 aa, Artificial Sequence
  Description of Artificial Sequence: Synthetic polypeptide
DEEEIRTTNPVATEQYGVVCSNTEEHNQENFGSDQA

SEQ ID NO: 152808 - protein, 29 aa, Artificial Sequence
  Description of Artificial Sequence: Synthetic peptide
DDSEVASTNPVSTECYGNVANTIQSRGQR

SEQ ID NO: 152809 - protein, 34 aa, Artificial Sequence
  Description of Artificial Sequence: Synthetic polypeptide
DEAEIATTNPVATEVWGSVCYTNDLQDEHGGESH

SEQ ID NO: 152810 - protein, 33 aa, Artificial Sequence
  Description of Artificial Sequence: Synthetic polypeptide
DCSEIVTTNPVATEQYGTVCSATDGPVEFEGND

SEQ ID NO: 152811 - protein, 34 aa, Artificial Sequence
  Description of Artificial Sequence: Synthetic polypeptide
DCSEIRTTNPVATEVYGETTSCTNGAHSQRGGDS

SEQ ID NO: 152812 - protein, 36 aa, Artificial Sequence
  Description of Artificial Sequence: Synthetic polypeptide
DEMEIRTTNPVATEQYGSVSSVPLHLNGEWSEENNM

SEQ ID NO: 152813 - protein, 35 aa, Artificial Sequence
  Description of Artificial Sequence: Synthetic polypeptide
DEQEIATTNPVATEQWGSVSATHPLEDHGNDEDLD

SEQ ID NO: 152814 - protein, 34 aa, Artificial Sequence
  Description of Artificial Sequence: Synthetic polypeptide
DEQEIATTNPVATEQWGSVSATGLIDHQGDEDAH

SEQ ID NO: 152815 - protein, 38 aa, Artificial Sequence
  Description of Artificial Sequence: Synthetic polypeptide
DEEEIRTTNPVATEQYGSVSTVNNNNQQGTEQGTEGQD

SEQ ID NO: 152816 - protein, 30 aa, Artificial Sequence
  Description of Artificial Sequence: Synthetic polypeptide
DCNEIRTTNPVATEQWGDVSEIEMNAAEDA

SEQ ID NO: 152817 - protein, 35 aa, Artificial Sequence
  Description of Artificial Sequence: Synthetic polypeptide
DCNEIRTTNPVAVEQYGSVSTNKHSSETPMGSDRN

SEQ ID NO: 152818 - protein, 34 aa, Artificial Sequence
  Description of Artificial Sequence: Synthetic polypeptide
DEQEIATTNPVATEQWGSVSATGDPLDNHQGEDL

SEQ ID NO: 152819 - protein, 35 aa, Artificial Sequence
  Description of Artificial Sequence: Synthetic polypeptide
DEMEIRTTNPVATEQYGSVSTEPYTQHESTQDTAG

SEQ ID NO: 152820 - protein, 35 aa, Artificial Sequence
  Description of Artificial Sequence: Synthetic polypeptide
DEEEIRTTNPVATEQYGVVFGSFEDDEGGNFENIQ

SEQ ID NO: 152821 - protein, 34 aa, Artificial Sequence
  Description of Artificial Sequence: Synthetic polypeptide
DEAEIATTNPVATEQYGTVCSATDGGVEPEGDND

SEQ ID NO: 152822 - protein, 36 aa, Artificial Sequence
  Description of Artificial Sequence: Synthetic polypeptide
DEEEIRTTNPVATEQYGVVDIMTNITGQEDGEGQET

SEQ ID NO: 152823 - protein, 38 aa, Artificial Sequence
  Description of Artificial Sequence: Synthetic polypeptide
DEEEIRTTNPVATEQYGVVSTVVNNNNNQQGTNEDEED

SEQ ID NO: 152824 - protein, 34 aa, Artificial Sequence
  Description of Artificial Sequence: Synthetic polypeptide
DEAEIATTNPVATEQYGVVAWTDNQQDTQQNSDS

SEQ ID NO: 152825 - protein, 35 aa, Artificial Sequence
  Description of Artificial Sequence: Synthetic polypeptide
DEEEIRTTNPVATEQYGVVCSWGEHNQENFNSEQS

SEQ ID NO: 152826 - protein, 35 aa, Artificial Sequence
  Description of Artificial Sequence: Synthetic polypeptide
DEAEIATTNPVATESYGSVCQTNDQQQMDGQGQNE

SEQ ID NO: 152827 - protein, 34 aa, Artificial Sequence
  Description of Artificial Sequence: Synthetic polypeptide
DEAEIATTNPVATETYGCVSTGGAGLTGGDNTSS

SEQ ID NO: 152828 - protein, 34 aa, Artificial Sequence
  Description of Artificial Sequence: Synthetic polypeptide
DEAEIATTNPVATETYGSVCCTENNQDDQQDNQQ

SEQ ID NO: 152829 - protein, 34 aa, Artificial Sequence
  Description of Artificial Sequence: Synthetic polypeptide
DEAEIATTNPVATEVWGSVCFTNENQDQGGGNHH

SEQ ID NO: 152830 - protein, 35 aa, Artificial Sequence
  Description of Artificial Sequence: Synthetic polypeptide
DEEEIRTTNPVATEQYGVVDQDTNMTVEGGGQQEE

SEQ ID NO: 152831 - protein, 35 aa, Artificial Sequence
  Description of Artificial Sequence: Synthetic polypeptide
DEEEISTTNPCATEQYGCVCPTGELQENFGSDNQA

SEQ ID NO: 152832 - protein, 31 aa, Artificial Sequence
  Description of Artificial Sequence: Synthetic polypeptide
DDSEVASTNPISTEQYGSVAANNIQSRVGQR

SEQ ID NO: 152833 - protein, 33 aa, Artificial Sequence
  Description of Artificial Sequence: Synthetic polypeptide
DEQEIATTNPVATECYGSVWANTDLEDHEGEDL

SEQ ID NO: 152834 - protein, 35 aa, Artificial Sequence
  Description of Artificial Sequence: Synthetic polypeptide
DDAEIRTTNPVATEQYGSVSDTHSLDTDRIDEIQI

SEQ ID NO: 152835 - protein, 38 aa, Artificial Sequence
  Description of Artificial Sequence: Synthetic polypeptide
DEEEIRTTNPVATEQYGVVSTVVNNQEGNQQGTEEGED

SEQ ID NO: 152836 - protein, 31 aa, Artificial Sequence
  Description of Artificial Sequence: Synthetic polypeptide
DEQEIASTNPVSTEGYGNVAANDIQDRVGQL

SEQ ID NO: 152837 - protein, 38 aa, Artificial Sequence
  Description of Artificial Sequence: Synthetic polypeptide
DEEEIRTTNPVATEQYGVVSTVVNNQENQQGTNAEEED

SEQ ID NO: 152838 - protein, 34 aa, Artificial Sequence
  Description of Artificial Sequence: Synthetic polypeptide
DDAEIRTTNPVATEQYGSVSVTYNSTYFSDPDQE

SEQ ID NO: 152839 - protein, 35 aa, Artificial Sequence
  Description of Artificial Sequence: Synthetic polypeptide
DDAEIRTTNPVATEQYGSVYVTYNSQTEFFDNDQE

SEQ ID NO: 152840 - protein, 38 aa, Artificial Sequence
  Description of Artificial Sequence: Synthetic polypeptide
DEEEIRTTNPVATEQYGSVSTVVNNNNNDEGNGTEEQD

SEQ ID NO: 152841 - protein, 38 aa, Artificial Sequence
  Description of Artificial Sequence: Synthetic polypeptide
DEEEIRTTNPVATEQYGSVSTVVNNNNNDEQQGTEEED

SEQ ID NO: 152842 - protein, 38 aa, Artificial Sequence
  Description of Artificial Sequence: Synthetic polypeptide
DEEEIRTTNPVATEQYGSVSTVVNNNNNQNNNDEDETE

SEQ ID NO: 152843 - protein, 32 aa, Artificial Sequence
  Description of Artificial Sequence: Synthetic polypeptide
DEQEIASTNPVATEQYGSVAASDLEDHEGEDI

SEQ ID NO: 152844 - protein, 33 aa, Artificial Sequence
  Description of Artificial Sequence: Synthetic polypeptide
DEQEIASTNPVATEQYGRSVSAEDLEDHEGEDL

SEQ ID NO: 152845 - protein, 32 aa, Artificial Sequence
  Description of Artificial Sequence: Synthetic polypeptide
DEQEIASTNPVATEQYGNVSANDIESHEGEDL

SEQ ID NO: 152846 - protein, 38 aa, Artificial Sequence
  Description of Artificial Sequence: Synthetic polypeptide
DEEEIRTTNPVATEQYGSVSTVVNNQNNLQQNEEEETE

SEQ ID NO: 152847 - protein, 32 aa, Artificial Sequence
  Description of Artificial Sequence: Synthetic polypeptide
DEEEISSTNPCATEPYGDVASMELCYVDGENV

SEQ ID NO: 152848 - protein, 33 aa, Artificial Sequence
  Description of Artificial Sequence: Synthetic polypeptide
DEQEIACTNPVATEQYGSWVSWTLLEDHEKEDL

SEQ ID NO: 152849 - protein, 36 aa, Artificial Sequence
  Description of Artificial Sequence: Synthetic polypeptide
CEEEIRTTNPMATEQYGSTVVACTNANSQTQGGNYA

SEQ ID NO: 152850 - protein, 36 aa, Artificial Sequence
  Description of Artificial Sequence: Synthetic polypeptide
CEEEIRTTNPMAYEQYGSVVACTLNALSQTQGGNYA

SEQ ID NO: 152851 - protein, 34 aa, Artificial Sequence
  Description of Artificial Sequence: Synthetic polypeptide
DDAEIRTTNPVATEQYGSVIVQYANLESFQENQF

SEQ ID NO: 152852 - protein, 39 aa, Artificial Sequence
  Description of Artificial Sequence: Synthetic polypeptide
DEEEIRTTNPVATEQYGSVSTVVNENQAGNQQGTTQNNE

SEQ ID NO: 152853 - protein, 32 aa, Artificial Sequence
  Description of Artificial Sequence: Synthetic polypeptide
DEMEIRTTNPVSTERYGTISMEDIQQQQNGNH

SEQ ID NO: 152854 - protein, 34 aa, Artificial Sequence
  Description of Artificial Sequence: Synthetic polypeptide
DEMEIRTTNPVSTEQYGTVCSAMDDIQEQQNGNH

SEQ ID NO: 152855 - protein, 34 aa, Artificial Sequence
  Description of Artificial Sequence: Synthetic polypeptide
DEAEIATTNPVAYEQWGSTSTNNQQGDANGGNTY

SEQ ID NO: 152856 - protein, 37 aa, Artificial Sequence
  Description of Artificial Sequence: Synthetic polypeptide
DEEEIRTTNPVATEQYGVVSTVVNNNQQQGEEEEEGE

SEQ ID NO: 152857 - protein, 35 aa, Artificial Sequence
  Description of Artificial Sequence: Synthetic polypeptide
DDAEIRTTNPVATEQYGCVCSTNDHQESFGSDTQA

SEQ ID NO: 152858 - protein, 39 aa, Artificial Sequence
  Description of Artificial Sequence: Synthetic polypeptide
DEEEIRTTNPVATEQYGTVTTNQSVTISTNTQMQEVGNT

SEQ ID NO: 152859 - protein, 32 aa, Artificial Sequence
  Description of Artificial Sequence: Synthetic polypeptide
DEAEIATTNPVAYEQWGSVAGEGPGQNAGNSS

SEQ ID NO: 152860 - protein, 32 aa, Artificial Sequence
  Description of Artificial Sequence: Synthetic polypeptide
DEMEIRTTNPVATQQYGTVSTIAGEVEVHEGC

SEQ ID NO: 152861 - protein, 35 aa, Artificial Sequence
  Description of Artificial Sequence: Synthetic polypeptide
DDAEIRTTNPVATEQYGCVCSWGNDHQSFGSDNQA

SEQ ID NO: 152862 - protein, 34 aa, Artificial Sequence
  Description of Artificial Sequence: Synthetic polypeptide
DDAEIRTTNPVATEQYGCVCSWNDHNQSFNSDTQ

SEQ ID NO: 152863 - protein, 33 aa, Artificial Sequence
  Description of Artificial Sequence: Synthetic polypeptide
DEEEISTTNPCATEEYGCVCGTGEHNGRFGSNA

SEQ ID NO: 152864 - protein, 35 aa, Artificial Sequence
  Description of Artificial Sequence: Synthetic polypeptide
DDAEIRTTNPVATEQYGCVSTLDATQFNGLQDWEF

SEQ ID NO: 152865 - protein, 35 aa, Artificial Sequence
  Description of Artificial Sequence: Synthetic polypeptide
DDAEIRTTNPVATEQYGQCVCSNTEELQGFGSEQS

SEQ ID NO: 152866 - protein, 38 aa, Artificial Sequence
  Description of Artificial Sequence: Synthetic polypeptide
DEEEIRTTNPVATEQYGVVSTVVNNQAGNQQGTNEQGQ

SEQ ID NO: 152867 - protein, 37 aa, Artificial Sequence
  Description of Artificial Sequence: Synthetic polypeptide
DEEEIRTTNPVATEQYGVVSTVVNNQAGTEDEEEEED

SEQ ID NO: 152868 - protein, 38 aa, Artificial Sequence
  Description of Artificial Sequence: Synthetic polypeptide
DEEEIRTTNPVATEQYGSVSTVVNANNNTEQGTNQQED

SEQ ID NO: 152869 - protein, 32 aa, Artificial Sequence
  Description of Artificial Sequence: Synthetic polypeptide
DEMEIRTTNPVSTEPYGTISMEDIQEQQNGNH

SEQ ID NO: 152870 - protein, 32 aa, Artificial Sequence
  Description of Artificial Sequence: Synthetic polypeptide
DEMEIRTTNPVSTEPYGTISMEDIQQQQNGNH

SEQ ID NO: 152871 - protein, 33 aa, Artificial Sequence
  Description of Artificial Sequence: Synthetic polypeptide
DEMEIRTTNPVSTEQYGTICSMDDIQEQQNGNH

SEQ ID NO: 152872 - protein, 33 aa, Artificial Sequence
  Description of Artificial Sequence: Synthetic polypeptide
DEAEIATTNPVAYEQWGSVAHTDDGQDRNGGAD

SEQ ID NO: 152873 - protein, 35 aa, Artificial Sequence
  Description of Artificial Sequence: Synthetic polypeptide
DDAEIRTTNPVATEQYGCVSTLLATQFNGLQQQEF

SEQ ID NO: 152874 - protein, 34 aa, Artificial Sequence
  Description of Artificial Sequence: Synthetic polypeptide
DEMEIRTTNPVATQQYGCVCSTGNHEENFGSDQS

SEQ ID NO: 152875 - protein, 38 aa, Artificial Sequence
  Description of Artificial Sequence: Synthetic polypeptide
DEEEIRTTNPVATEQYGVVSTVVNNQGGNQAGTNEEED

SEQ ID NO: 152876 - protein, 38 aa, Artificial Sequence
  Description of Artificial Sequence: Synthetic polypeptide
DEEEIRTTNPVATEQYGSVSTVVNQQQSATEAGTEQGS

SEQ ID NO: 152877 - protein, 35 aa, Artificial Sequence
  Description of Artificial Sequence: Synthetic polypeptide
DEQCIRTTNPVATEQYGKTVCSTGNHSIPGGNTFE

SEQ ID NO: 152878 - protein, 35 aa, Artificial Sequence
  Description of Artificial Sequence: Synthetic polypeptide
DEQCIRTTNPVATEQYGKTVATQNVSQPTGTNTAV

SEQ ID NO: 152879 - protein, 35 aa, Artificial Sequence
  Description of Artificial Sequence: Synthetic polypeptide
DEQCIRTTNPVATEQYGKTVATGNNSQPTGTNTAL

SEQ ID NO: 152880 - protein, 35 aa, Artificial Sequence
  Description of Artificial Sequence: Synthetic polypeptide
DEQCIRTTNPVATEQYGKTVATGNISQPTGTNADI

SEQ ID NO: 152881 - protein, 34 aa, Artificial Sequence
  Description of Artificial Sequence: Synthetic polypeptide
DEQCIRTTNPVATEPYGKTVSCVGNISQHGNTFI

SEQ ID NO: 152882 - protein, 34 aa, Artificial Sequence
  Description of Artificial Sequence: Synthetic polypeptide
DEQCIRTTNPVATEPYGKTVSCTGDISQPGNQFI

SEQ ID NO: 152883 - protein, 34 aa, Artificial Sequence
  Description of Artificial Sequence: Synthetic polypeptide
DEQCINTTNPVATEAYGKTVSTGNISQPGGNTFI

SEQ ID NO: 152884 - protein, 34 aa, Artificial Sequence
  Description of Artificial Sequence: Synthetic polypeptide
DEQCICTTNPVAYEQYGKTVPSTGNAIQPGNTVI

SEQ ID NO: 152885 - protein, 38 aa, Artificial Sequence
  Description of Artificial Sequence: Synthetic polypeptide
DEEEIRTTNPVATEQYGVVSTVVNNQNGNQGQGNDEEE

SEQ ID NO: 152886 - protein, 35 aa, Artificial Sequence
  Description of Artificial Sequence: Synthetic polypeptide
DEEEISTTNPCATEQYGCVCPNTELQENFGSNNQA

SEQ ID NO: 152887 - protein, 38 aa, Artificial Sequence
  Description of Artificial Sequence: Synthetic polypeptide
DEEEIRTTNPVATEQYGVVSTVVNNQNGNQQETNNNTD

SEQ ID NO: 152888 - protein, 37 aa, Artificial Sequence
  Description of Artificial Sequence: Synthetic polypeptide
DEHEIRTTNPVATEQYGSVSFTNDVDEEIFMLQDHPA

SEQ ID NO: 152889 - protein, 34 aa, Artificial Sequence
  Description of Artificial Sequence: Synthetic polypeptide
DEEEISTTNPCATEQYGCVCPSELQENFGSNTQA

SEQ ID NO: 152890 - protein, 34 aa, Artificial Sequence
  Description of Artificial Sequence: Synthetic polypeptide
DEEEISTTNPCATEQYGCVCPTEDQENFGSNNQS

SEQ ID NO: 152891 - protein, 33 aa, Artificial Sequence
  Description of Artificial Sequence: Synthetic polypeptide
DEMEISTTNPVATEQYGAVCGATDGPVEFEGNY

SEQ ID NO: 152892 - protein, 34 aa, Artificial Sequence
  Description of Artificial Sequence: Synthetic polypeptide
DEEEISTTNPCATEQYGCVCPTELQEYFNSDTQS

SEQ ID NO: 152893 - protein, 34 aa, Artificial Sequence
  Description of Artificial Sequence: Synthetic polypeptide
DEMEISTTNPVATEQYGAVCSATDGPVEPFEGNE

SEQ ID NO: 152894 - protein, 35 aa, Artificial Sequence
  Description of Artificial Sequence: Synthetic polypeptide
DEQCIRTTNPVATEQYGKTVNTGNISQDTGTNTAI

SEQ ID NO: 152895 - protein, 35 aa, Artificial Sequence
  Description of Artificial Sequence: Synthetic polypeptide
DEQCIRTTNPVATEQYGKTVSTGNVSQPTETNTAI

SEQ ID NO: 152896 - protein, 35 aa, Artificial Sequence
  Description of Artificial Sequence: Synthetic polypeptide
DEQCIRTTNPVATEQYGKTVSTGPISQPTGTNTAA

SEQ ID NO: 152897 - protein, 34 aa, Artificial Sequence
  Description of Artificial Sequence: Synthetic polypeptide
DEQCIRTTNPVAYEQYGKVSVGNMISQPGTNNFI

SEQ ID NO: 152898 - protein, 38 aa, Artificial Sequence
  Description of Artificial Sequence: Synthetic polypeptide
DEEEIRTTNPVATEQYGSVSTVVNTNATEQGTTEQGSE

SEQ ID NO: 152899 - protein, 38 aa, Artificial Sequence
  Description of Artificial Sequence: Synthetic polypeptide
DEEEIRTTNPVATEQYGSVSTVVNTNNDEQGTTEQGSQ

SEQ ID NO: 152900 - protein, 37 aa, Artificial Sequence
  Description of Artificial Sequence: Synthetic polypeptide
DEEEIRTTNPVATEQYGVVSTVVNNQGNTEDETEEED

SEQ ID NO: 152901 - protein, 38 aa, Artificial Sequence
  Description of Artificial Sequence: Synthetic polypeptide
DEEEIRTTNPVATEQYGSVSTVVNTQQSTTEQGTEQGS

SEQ ID NO: 152902 - protein, 37 aa, Artificial Sequence
  Description of Artificial Sequence: Synthetic polypeptide
DEEEIRTTNPVATEQYGVVSTVVNNQNGEEDETEEED

SEQ ID NO: 152903 - protein, 36 aa, Artificial Sequence
  Description of Artificial Sequence: Synthetic polypeptide
CEEEIRTTNPVATEAYGSTASYTANGLSQTDTGGTL

SEQ ID NO: 152904 - protein, 38 aa, Artificial Sequence
  Description of Artificial Sequence: Synthetic polypeptide
DEEEIRTTNPVATEQYGVVSTVVNNQNGNEDEEEEEED

SEQ ID NO: 152905 - protein, 31 aa, Artificial Sequence
  Description of Artificial Sequence: Synthetic polypeptide
DEQEEATTNPVAYEAWGCTSTNNQGNDNDGR

SEQ ID NO: 152906 - protein, 34 aa, Artificial Sequence
  Description of Artificial Sequence: Synthetic polypeptide
CEEEIRTTNPVATDQYGDVVSVGDTGQGNQGNED

SEQ ID NO: 152907 - protein, 35 aa, Artificial Sequence
  Description of Artificial Sequence: Synthetic polypeptide
DEQEAEIRTTNPVAYEQWGSVCYNNDNDGGQDNQR

SEQ ID NO: 152908 - protein, 34 aa, Artificial Sequence
  Description of Artificial Sequence: Synthetic polypeptide
DEQEAEIATTNPVAYEQWGSVSGGNGNHGEGNTQ

SEQ ID NO: 152909 - protein, 37 aa, Artificial Sequence
  Description of Artificial Sequence: Synthetic polypeptide
DEEEIRTTNPVATEQYGSVSTVVSNNNNTEQGTEEED

SEQ ID NO: 152910 - protein, 33 aa, Artificial Sequence
  Description of Artificial Sequence: Synthetic polypeptide
DEAAEIATTNPVAYEQWGTVCSTENDEHDGNEK

SEQ ID NO: 152911 - protein, 37 aa, Artificial Sequence
  Description of Artificial Sequence: Synthetic polypeptide
DEEEIRTTNPVATEQYGSVSTVVSNQNNNEENNDENA

SEQ ID NO: 152912 - protein, 39 aa, Artificial Sequence
  Description of Artificial Sequence: Synthetic polypeptide
DEEEIRTTNPVATEQYGSVSTVVSTNNGQQGTEAGTNDE

SEQ ID NO: 152913 - protein, 33 aa, Artificial Sequence
  Description of Artificial Sequence: Synthetic polypeptide
DEQDEIATTNPVAYEGWGSVATNLQGDAGQGQE

SEQ ID NO: 152914 - protein, 34 aa, Artificial Sequence
  Description of Artificial Sequence: Synthetic polypeptide
DEQDEIATTNPVAYEGWGSVATNLQGDAGNNGQE

SEQ ID NO: 152915 - protein, 38 aa, Artificial Sequence
  Description of Artificial Sequence: Synthetic polypeptide
DEEEIRTTNPVATEQYGVVSTVVNNQNGNQAGTEEGEE

SEQ ID NO: 152916 - protein, 33 aa, Artificial Sequence
  Description of Artificial Sequence: Synthetic polypeptide
DEAAEIATTNPVAYEQWGTVCSTENDEHDGNEH

SEQ ID NO: 152917 - protein, 34 aa, Artificial Sequence
  Description of Artificial Sequence: Synthetic polypeptide
DEQEIATTNPVATECYGSVWSNTEDLEEHEGEYI

SEQ ID NO: 152918 - protein, 33 aa, Artificial Sequence
  Description of Artificial Sequence: Synthetic polypeptide
DEQEIATTNPAVATVQYGSRSATDLEMHEGEDL

SEQ ID NO: 152919 - protein, 38 aa, Artificial Sequence
  Description of Artificial Sequence: Synthetic polypeptide
DEEEIRTTNPVATEQYGVVSTVVNNNQQLGNQTEETED

SEQ ID NO: 152920 - protein, 34 aa, Artificial Sequence
  Description of Artificial Sequence: Synthetic polypeptide
DEMEIRTTNPVATEQYGSVVVTYNDHEFIDVSQQ

SEQ ID NO: 152921 - protein, 38 aa, Artificial Sequence
  Description of Artificial Sequence: Synthetic polypeptide
DEEEIRTTNPVATEQYGSVSTVTNNNTEQGNNDTNDTE

SEQ ID NO: 152922 - protein, 32 aa, Artificial Sequence
  Description of Artificial Sequence: Synthetic polypeptide
DEQEIATTNPIATEQYGSVAATDWAEHEGEYL

SEQ ID NO: 152923 - protein, 32 aa, Artificial Sequence
  Description of Artificial Sequence: Synthetic polypeptide
DEQEIATTNPIATEQYGATSATDLEEHKGEDL

SEQ ID NO: 152924 - protein, 32 aa, Artificial Sequence
  Description of Artificial Sequence: Synthetic polypeptide
DEQEIATTNPIATEQYGATSATDLEEHEGEDL

SEQ ID NO: 152925 - protein, 32 aa, Artificial Sequence
  Description of Artificial Sequence: Synthetic polypeptide
DEQEIATTNPIATEQYGATSATDLEDHEGEDL

SEQ ID NO: 152926 - protein, 35 aa, Artificial Sequence
  Description of Artificial Sequence: Synthetic polypeptide
DEMEIRTTNPVATEQYGSVWPMMNSAEGRENEELM

SEQ ID NO: 152927 - protein, 33 aa, Artificial Sequence
  Description of Artificial Sequence: Synthetic polypeptide
DEQEIATTNPIATEQWGSVWSATDLEDHEGPDL

SEQ ID NO: 152928 - protein, 34 aa, Artificial Sequence
  Description of Artificial Sequence: Synthetic polypeptide
DEEEIRTTNPVATEQYGVCVFPSPVNMPNVDMEE

SEQ ID NO: 152929 - protein, 34 aa, Artificial Sequence
  Description of Artificial Sequence: Synthetic polypeptide
DEEEIRTTNPVATEQYGVCTYPSPQNEPNVDMFE

SEQ ID NO: 152930 - protein, 34 aa, Artificial Sequence
  Description of Artificial Sequence: Synthetic polypeptide
DEMEIRTTNPVATEQYGSVWVQYEVEQDGFGSIE

SEQ ID NO: 152931 - protein, 35 aa, Artificial Sequence
  Description of Artificial Sequence: Synthetic polypeptide
DEMEIRTTNPVATEQYGSVWVSPNDHESFDQSFIS

SEQ ID NO: 152932 - protein, 35 aa, Artificial Sequence
  Description of Artificial Sequence: Synthetic polypeptide
DEMEIRTTNPVATEQYGSVWVTDWIDTRPASDGTM

SEQ ID NO: 152933 - protein, 35 aa, Artificial Sequence
  Description of Artificial Sequence: Synthetic polypeptide
DEMEIRTTNPVATEQYGSVWVTPNHIETFNGTVME

SEQ ID NO: 152934 - protein, 38 aa, Artificial Sequence
  Description of Artificial Sequence: Synthetic polypeptide
DEEEIRTTNPVATEQYGVVSTVVNNNNQQGNEETTEDE

SEQ ID NO: 152935 - protein, 38 aa, Artificial Sequence
  Description of Artificial Sequence: Synthetic polypeptide
DEEEIRTTNPVATEQYGVVSTVVNNNNQQGTTNEDETD

SEQ ID NO: 152936 - protein, 32 aa, Artificial Sequence
  Description of Artificial Sequence: Synthetic polypeptide
DEQEIATTNPIATECYGAVSATDLEDPKGEDL

SEQ ID NO: 152937 - protein, 38 aa, Artificial Sequence
  Description of Artificial Sequence: Synthetic polypeptide
DEEEIRTTNPVATEQYGSVSTVTNNNQQGTEQGTEEED

SEQ ID NO: 152938 - protein, 38 aa, Artificial Sequence
  Description of Artificial Sequence: Synthetic polypeptide
DEEEIRTTNPVATEQYGSVSTVTNNNNQNNNQAGTEDE

SEQ ID NO: 152939 - protein, 33 aa, Artificial Sequence
  Description of Artificial Sequence: Synthetic polypeptide
DEQEIATTNPVAAEQYGSVSSASLLEDHEGEDL

SEQ ID NO: 152940 - protein, 34 aa, Artificial Sequence
  Description of Artificial Sequence: Synthetic polypeptide
DEQEIATTNPVAHEQYGSVASATLDLEDHEGEDL

SEQ ID NO: 152941 - protein, 33 aa, Artificial Sequence
  Description of Artificial Sequence: Synthetic polypeptide
DEQEIATTNPVATECYGSVWANTDLADHEGPDL

SEQ ID NO: 152942 - protein, 33 aa, Artificial Sequence
  Description of Artificial Sequence: Synthetic polypeptide
DEQEIATTNPVATECYGSVWANTDLADHEGEDL

SEQ ID NO: 152943 - protein, 36 aa, Artificial Sequence
  Description of Artificial Sequence: Synthetic polypeptide
CEEEIRCTNPVATEQYGSVSSTTPAGPNMRNGMNPV

SEQ ID NO: 152944 - protein, 33 aa, Artificial Sequence
  Description of Artificial Sequence: Synthetic polypeptide
DEQEIATTNPVATECYGSVSACIDLEDHEGEDG

SEQ ID NO: 152945 - protein, 35 aa, Artificial Sequence
  Description of Artificial Sequence: Synthetic polypeptide
DEMEIRTTNPVATEQYGSVTTYVDLQELEDDDQMG

SEQ ID NO: 152946 - protein, 35 aa, Artificial Sequence
  Description of Artificial Sequence: Synthetic polypeptide
DEMEIRTTNPVATEQYGSVTVNGLLELSFESDQRS

SEQ ID NO: 152947 - protein, 35 aa, Artificial Sequence
  Description of Artificial Sequence: Synthetic polypeptide
DEMEIRTTNPVATEQYGSVTVTDIEDTRPNSDGTM

SEQ ID NO: 152948 - protein, 35 aa, Artificial Sequence
  Description of Artificial Sequence: Synthetic polypeptide
DEMEIRTTNPVATEQYGSVTVTMDIDTRPISDGTM

SEQ ID NO: 152949 - protein, 34 aa, Artificial Sequence
  Description of Artificial Sequence: Synthetic polypeptide
DEAAEIATTNPVAYEQWGSVAWNPDDQGQGDDNR

SEQ ID NO: 152950 - protein, 35 aa, Artificial Sequence
  Description of Artificial Sequence: Synthetic polypeptide
DEMEIRTTNPVATEQYGSVTVTWDIDTRPGSDGTA

SEQ ID NO: 152951 - protein, 32 aa, Artificial Sequence
  Description of Artificial Sequence: Synthetic polypeptide
DEQEIATTNPVATAQWGSVAAGNLFTPNPMGV

SEQ ID NO: 152952 - protein, 36 aa, Artificial Sequence
  Description of Artificial Sequence: Synthetic polypeptide
DEAEIRTTNPVATEQYGSVSTMWGDSQQEGPEFEHD

SEQ ID NO: 152953 - protein, 32 aa, Artificial Sequence
  Description of Artificial Sequence: Synthetic polypeptide
DEQEIATTNPVATAQWGCVAGTGGLEPRDQNP

SEQ ID NO: 152954 - protein, 33 aa, Artificial Sequence
  Description of Artificial Sequence: Synthetic polypeptide
DEQEIATTNPVATAAWGSVSGNNEPLDNGGENG

SEQ ID NO: 152955 - protein, 36 aa, Artificial Sequence
  Description of Artificial Sequence: Synthetic polypeptide
DEAEIRTTNPVATEQYGSVSTMWGCSQQEGGEFEHS

SEQ ID NO: 152956 - protein, 32 aa, Artificial Sequence
  Description of Artificial Sequence: Synthetic polypeptide
DEQEIATTNPVASEQYGIVSACDLEDHEGEDL

SEQ ID NO: 152957 - protein, 39 aa, Artificial Sequence
  Description of Artificial Sequence: Synthetic polypeptide
DEEEIRTTNPVATEQYGSVSTVSNNQQNNQQGTTTNVAE

SEQ ID NO: 152958 - protein, 39 aa, Artificial Sequence
  Description of Artificial Sequence: Synthetic polypeptide
DEEEIRTTNPVATEQYGSVSTVSTNNQQGNQNGTEQGSE

SEQ ID NO: 152959 - protein, 34 aa, Artificial Sequence
  Description of Artificial Sequence: Synthetic polypeptide
DEQEIATTNPVATAQWGSVSATGAGGQAEMGNGF

SEQ ID NO: 152960 - protein, 37 aa, Artificial Sequence
  Description of Artificial Sequence: Synthetic polypeptide
DEEEIRTTNPVATEQYGTVTTVSVTNISTEQYGSTTE

SEQ ID NO: 152961 - protein, 35 aa, Artificial Sequence
  Description of Artificial Sequence: Synthetic polypeptide
DEMEIRTTNPVATEQYGSYFCSVTDWNDEFLVDNS

SEQ ID NO: 152962 - protein, 36 aa, Artificial Sequence
  Description of Artificial Sequence: Synthetic polypeptide
DEMEIRTTNPVATEQYGSYFCYVTDWNDERLGDNTS

SEQ ID NO: 152963 - protein, 33 aa, Artificial Sequence
  Description of Artificial Sequence: Synthetic polypeptide
DEMEIRTTNPVATEQYGTVSAEDGEVMNFAGDD

SEQ ID NO: 152964 - protein, 34 aa, Artificial Sequence
  Description of Artificial Sequence: Synthetic polypeptide
DEMEIRTTNPVATEQYGTVSAENDHTQEQFEDGD

SEQ ID NO: 152965 - protein, 38 aa, Artificial Sequence
  Description of Artificial Sequence: Synthetic polypeptide
DEEEIRTTNPVATEQYGTVTVVVTNNNLQQGTEETNNN

SEQ ID NO: 152966 - protein, 38 aa, Artificial Sequence
  Description of Artificial Sequence: Synthetic polypeptide
DEEEIRTTNPVATEQYGTVTVVVTNNNLQQGEEEGQNG

SEQ ID NO: 152967 - protein, 38 aa, Artificial Sequence
  Description of Artificial Sequence: Synthetic polypeptide
DEEEIRTTNPVATEQYGTVTVVTTNNNLQQGTTETNND

SEQ ID NO: 152968 - protein, 36 aa, Artificial Sequence
  Description of Artificial Sequence: Synthetic polypeptide
DEAEIRTTNPVATEQYGSVSTMAGDSQQEGGEFEGT

SEQ ID NO: 152969 - protein, 32 aa, Artificial Sequence
  Description of Artificial Sequence: Synthetic polypeptide
DEQEIATTNPCATEQWGSCSATDNNDHEGEDM

SEQ ID NO: 152970 - protein, 34 aa, Artificial Sequence
  Description of Artificial Sequence: Synthetic polypeptide
DEMEIRTTNPVATEQYGTVWSNAEGPVAEFEGNI

SEQ ID NO: 152971 - protein, 34 aa, Artificial Sequence
  Description of Artificial Sequence: Synthetic polypeptide
DEMEIRTTNPVATEQYGTVWSNAEGPVAEPEGNI

SEQ ID NO: 152972 - protein, 33 aa, Artificial Sequence
  Description of Artificial Sequence: Synthetic polypeptide
DEEEISCTNPVATEQYGCVCSWGNHDHGSDTQS

SEQ ID NO: 152973 - protein, 30 aa, Artificial Sequence
  Description of Artificial Sequence: Synthetic polypeptide
DDSEVASTNPISTEGYGSVAANTIQRVGQR

SEQ ID NO: 152974 - protein, 38 aa, Artificial Sequence
  Description of Artificial Sequence: Synthetic polypeptide
DEEEIRTTNPVATEQYGVVSTVVNNNQQGNQQGTEQGQ

SEQ ID NO: 152975 - protein, 35 aa, Artificial Sequence
  Description of Artificial Sequence: Synthetic polypeptide
DDAEIRTTNPVATEQYGCVCSTGEDLQESFGSDQA

SEQ ID NO: 152976 - protein, 36 aa, Artificial Sequence
  Description of Artificial Sequence: Synthetic polypeptide
DEMEIRTTNPVATEQYGVVSTTLTVLEFNGGDNQGL

SEQ ID NO: 152977 - protein, 37 aa, Artificial Sequence
  Description of Artificial Sequence: Synthetic polypeptide
DEMEIRTTNPVATEQYGVVSVTLTNLMEFNGGDNQDL

SEQ ID NO: 152978 - protein, 36 aa, Artificial Sequence
  Description of Artificial Sequence: Synthetic polypeptide
DEMEIRTTNPVATEQYGVVSVTYTNLEFNGGDEQGL

SEQ ID NO: 152979 - protein, 34 aa, Artificial Sequence
  Description of Artificial Sequence: Synthetic polypeptide
DDAEIRTTNPVATEQYGCVCSTGNDHQSFISDQA

SEQ ID NO: 152980 - protein, 33 aa, Artificial Sequence
  Description of Artificial Sequence: Synthetic polypeptide
DEMEIRTTNPVATEQYGTVSAEDGEVMNFAGDA

SEQ ID NO: 152981 - protein, 33 aa, Artificial Sequence
  Description of Artificial Sequence: Synthetic polypeptide
CSEEISTTNPVAYTQWGISTVSTTNPSMHGGNR

SEQ ID NO: 152982 - protein, 34 aa, Artificial Sequence
  Description of Artificial Sequence: Synthetic polypeptide
DEAEIATTNPVAYEQWGEVVPTDNGDQHDGNRGN

SEQ ID NO: 152983 - protein, 38 aa, Artificial Sequence
  Description of Artificial Sequence: Synthetic polypeptide
DEEEIRTTNPVATEQYGVVSTVVNNNNTQQGNNNEQNG

SEQ ID NO: 152984 - protein, 36 aa, Artificial Sequence
  Description of Artificial Sequence: Synthetic polypeptide
DEMEIRTTNPVATEQYGSYSSTTPAGPNMRNGMNPV

SEQ ID NO: 152985 - protein, 35 aa, Artificial Sequence
  Description of Artificial Sequence: Synthetic polypeptide
DEMEIRTTNPVATEQYGSYTTYVDDLESRDNTQME

SEQ ID NO: 152986 - protein, 32 aa, Artificial Sequence
  Description of Artificial Sequence: Synthetic polypeptide
DEQEIATTNPIATECYGAVSATDLEDHKGEDL

SEQ ID NO: 152987 - protein, 32 aa, Artificial Sequence
  Description of Artificial Sequence: Synthetic polypeptide
DEQEIATTNPIATECYGAVSATDLEDHEGEDL

SEQ ID NO: 152988 - protein, 34 aa, Artificial Sequence
  Description of Artificial Sequence: Synthetic polypeptide
DEAEIATTNPVAYEQWGCVSGDNEGMGQRGGNTN

SEQ ID NO: 152989 - protein, 34 aa, Artificial Sequence
  Description of Artificial Sequence: Synthetic polypeptide
DEAEIATTNPVAYEQWGCVYSTNNDLGEPGGNHD

SEQ ID NO: 152990 - protein, 34 aa, Artificial Sequence
  Description of Artificial Sequence: Synthetic polypeptide
DEMEIRTTNPVATEQYGTTCSATDGPVEFEGNYI

SEQ ID NO: 152991 - protein, 35 aa, Artificial Sequence
  Description of Artificial Sequence: Synthetic polypeptide
DDAEIRTTNPVATEQYGCVCSMTNDHNQSFGSDQA

SEQ ID NO: 152992 - protein, 37 aa, Artificial Sequence
  Description of Artificial Sequence: Synthetic polypeptide
DEMEIRTTNPVATEQYGSYFCSVTDWNDERLGSDNSP

SEQ ID NO: 152993 - protein, 38 aa, Artificial Sequence
  Description of Artificial Sequence: Synthetic polypeptide
DEEEIRTTNPVATEQYGVVSTVVNNNNQQQGNNNNEEE

SEQ ID NO: 152994 - protein, 33 aa, Artificial Sequence
  Description of Artificial Sequence: Synthetic polypeptide
DDAEIRTTNPVATEQYGCVCSTEDHASFGSDQA

SEQ ID NO: 152995 - protein, 34 aa, Artificial Sequence
  Description of Artificial Sequence: Synthetic polypeptide
DEMEIRTTNPVATEQYGTVCSATDGEVENFAGDD

SEQ ID NO: 152996 - protein, 34 aa, Artificial Sequence
  Description of Artificial Sequence: Synthetic polypeptide
DEMEIRTTNPVATEQYGTVCSATDGEVMNFAGDD

SEQ ID NO: 152997 - protein, 36 aa, Artificial Sequence
  Description of Artificial Sequence: Synthetic polypeptide
DEHEIRTTNPVATEQYGSVSTMDVTEEIFMLQEHPI

SEQ ID NO: 152998 - protein, 31 aa, Artificial Sequence
  Description of Artificial Sequence: Synthetic polypeptide
DEAEIATTNPVAYEQWGEVSGGGNHGAQNGM

SEQ ID NO: 152999 - protein, 33 aa, Artificial Sequence
  Description of Artificial Sequence: Synthetic polypeptide
DEAEIATTNPVAYEQWGEVSGGNAQNGNENGDH

SEQ ID NO: 153000 - protein, 33 aa, Artificial Sequence
  Description of Artificial Sequence: Synthetic polypeptide
DEAEIATTNPVAYEQWGEVSGPNGNQGGMNGSD

SEQ ID NO: 153001 - protein, 38 aa, Artificial Sequence
  Description of Artificial Sequence: Synthetic polypeptide
DEEEIRTTNPVATEQYGVVSTVVNNNNQQQGTNNEEEN

SEQ ID NO: 153002 - protein, 38 aa, Artificial Sequence
  Description of Artificial Sequence: Synthetic polypeptide
DEEEIRTTNPVATEQYGVVSTVVNNNNQQQGTNNDEES

SEQ ID NO: 153003 - protein, 34 aa, Artificial Sequence
  Description of Artificial Sequence: Synthetic polypeptide
DENEIVTTNPVATEQYGTVCSATDGPVEFEGIND

SEQ ID NO: 153004 - protein, 33 aa, Artificial Sequence
  Description of Artificial Sequence: Synthetic polypeptide
DENEIVTTNPVATEQYGTVCSATDGPVEFEGGD

SEQ ID NO: 153005 - protein, 36 aa, Artificial Sequence
  Description of Artificial Sequence: Synthetic polypeptide
DEAEIRTTNPVATEQYGSVNMTETEDQVYGNIIAED

SEQ ID NO: 153006 - protein, 33 aa, Artificial Sequence
  Description of Artificial Sequence: Synthetic polypeptide
DEMEIVTTNPVATEQYGTVCGATDGPVEFEGND

SEQ ID NO: 153007 - protein, 34 aa, Artificial Sequence
  Description of Artificial Sequence: Synthetic polypeptide
DEAEIRTTNPVATEQYGSVHDIQLNTVEGDDEQN

SEQ ID NO: 153008 - protein, 35 aa, Artificial Sequence
  Description of Artificial Sequence: Synthetic polypeptide
DEAEIRTTNPVATEQYGSVGREDLDFTGFNENDED

SEQ ID NO: 153009 - protein, 36 aa, Artificial Sequence
  Description of Artificial Sequence: Synthetic polypeptide
DEAEIRTTNPVATEQYGSVGMENDLDLTGFNENDED

SEQ ID NO: 153010 - protein, 32 aa, Artificial Sequence
  Description of Artificial Sequence: Synthetic polypeptide
DENEIRTTNPVSTEQYGTISMEDIQQQQNINH

SEQ ID NO: 153011 - protein, 33 aa, Artificial Sequence
  Description of Artificial Sequence: Synthetic polypeptide
DENEIRTTNPVSTEQYGTISMEDIQQMQNGMNH

SEQ ID NO: 153012 - protein, 35 aa, Artificial Sequence
  Description of Artificial Sequence: Synthetic polypeptide
DEEEISTTNPVATEQYGCVCSNTEHNQSFGSETQA

SEQ ID NO: 153013 - protein, 33 aa, Artificial Sequence
  Description of Artificial Sequence: Synthetic polypeptide
DENEIRTTNPVSTEQYGTISMEDIPQQQNGMNH

SEQ ID NO: 153014 - protein, 33 aa, Artificial Sequence
  Description of Artificial Sequence: Synthetic polypeptide
DENEIRTTNPVSTEQYGTISMEDGQQQQNGMNH

SEQ ID NO: 153015 - protein, 32 aa, Artificial Sequence
  Description of Artificial Sequence: Synthetic polypeptide
DENEIRTTNPVSTEQYGTISMEDEQQQQAENA

SEQ ID NO: 153016 - protein, 34 aa, Artificial Sequence
  Description of Artificial Sequence: Synthetic polypeptide
DEAEIRTTNPVATEQYGSVGEVTDFTGFNENDED

SEQ ID NO: 153017 - protein, 31 aa, Artificial Sequence
  Description of Artificial Sequence: Synthetic polypeptide
DENEIRTTNPVSTEQYGTISEEIEMNAAGDA

SEQ ID NO: 153018 - protein, 34 aa, Artificial Sequence
  Description of Artificial Sequence: Synthetic polypeptide
DEMEIVTTNPVATEQYGTVCGATDGPVELFEGND

SEQ ID NO: 153019 - protein, 35 aa, Artificial Sequence
  Description of Artificial Sequence: Synthetic polypeptide
DEAEIRTTNPVATEQYGSVGENMIDFTGFNEMVID

SEQ ID NO: 153020 - protein, 32 aa, Artificial Sequence
  Description of Artificial Sequence: Synthetic polypeptide
DENEIRTTNPVSTEQYGTIPMEDIQQQQNGNH

SEQ ID NO: 153021 - protein, 36 aa, Artificial Sequence
  Description of Artificial Sequence: Synthetic polypeptide
DEAEIRTTNPVATEQYGSVFVWINGEQDRQMNKGDA

SEQ ID NO: 153022 - protein, 32 aa, Artificial Sequence
  Description of Artificial Sequence: Synthetic polypeptide
DENEIRTTNPVSTEQYGTASMEDIQQQQNENH

SEQ ID NO: 153023 - protein, 34 aa, Artificial Sequence
  Description of Artificial Sequence: Synthetic polypeptide
DENEIRTTNPVSTEQYGTISTMEDIPQQQNGMNH

SEQ ID NO: 153024 - protein, 34 aa, Artificial Sequence
  Description of Artificial Sequence: Synthetic polypeptide
DENEIRTTNPVSTEQYGTISTMPAIPQQQNGMNH

SEQ ID NO: 153025 - protein, 34 aa, Artificial Sequence
  Description of Artificial Sequence: Synthetic polypeptide
DENEIRTTNPVSTEQYGTISTMPDIPQQQNGMNH

SEQ ID NO: 153026 - protein, 33 aa, Artificial Sequence
  Description of Artificial Sequence: Synthetic polypeptide
DEAEIRTTNPVATEQYGSVHEIQDNTVETEEQN

SEQ ID NO: 153027 - protein, 32 aa, Artificial Sequence
  Description of Artificial Sequence: Synthetic polypeptide
DENEIRTTNPVSTEVYGTISMEDIQQQVNGNH

SEQ ID NO: 153028 - protein, 33 aa, Artificial Sequence
  Description of Artificial Sequence: Synthetic polypeptide
DEMEIVTTNPVATEQYGTVCDATDGPVEFEGND

SEQ ID NO: 153029 - protein, 33 aa, Artificial Sequence
  Description of Artificial Sequence: Synthetic polypeptide
DEMEIVTTNPVATEQYGTVCDATDGPVEFEGNG

SEQ ID NO: 153030 - protein, 33 aa, Artificial Sequence
  Description of Artificial Sequence: Synthetic polypeptide
DEMEIVTTNPVATEQYGTVCDATDGTVEFEGND

SEQ ID NO: 153031 - protein, 33 aa, Artificial Sequence
  Description of Artificial Sequence: Synthetic polypeptide
DENEIRTTNPVSTEVYGTISMEDIQQQQNGNRH

SEQ ID NO: 153032 - protein, 32 aa, Artificial Sequence
  Description of Artificial Sequence: Synthetic polypeptide
DENEIRTTNPVSTEVYGTISMEDIQQQQNGNH

SEQ ID NO: 153033 - protein, 32 aa, Artificial Sequence
  Description of Artificial Sequence: Synthetic polypeptide
DENEIRTTNPVSTETYGTISMEDIQQQQNGNH

SEQ ID NO: 153034 - protein, 35 aa, Artificial Sequence
  Description of Artificial Sequence: Synthetic polypeptide
DEEEISTTNPVATEQYGCVCSNTEHNQFFISDNQT

SEQ ID NO: 153035 - protein, 31 aa, Artificial Sequence
  Description of Artificial Sequence: Synthetic polypeptide
DENEIRTTNPVSTEQYGTAPMEDIQQQQENH

SEQ ID NO: 153036 - protein, 33 aa, Artificial Sequence
  Description of Artificial Sequence: Synthetic polypeptide
DEMEIVTTNPVATEQYGTVCEATDGPVEFEGND

SEQ ID NO: 153037 - protein, 32 aa, Artificial Sequence
  Description of Artificial Sequence: Synthetic polypeptide
DENEIRTTNPVSTESYGTISMEDIQQQQNGNH

SEQ ID NO: 153038 - protein, 32 aa, Artificial Sequence
  Description of Artificial Sequence: Synthetic polypeptide
DENEIRTTNPVSTESYGTISMEDIQQIQNGNN

SEQ ID NO: 153039 - protein, 32 aa, Artificial Sequence
  Description of Artificial Sequence: Synthetic polypeptide
DENEIRTTNPVSTESYGTISEEDGQQQQNGNH

SEQ ID NO: 153040 - protein, 33 aa, Artificial Sequence
  Description of Artificial Sequence: Synthetic polypeptide
DEMEIVTTNPVATEQYGTVCFATDGPVEKEGND

SEQ ID NO: 153041 - protein, 32 aa, Artificial Sequence
  Description of Artificial Sequence: Synthetic polypeptide
DENEIRTTNPVSTESYGFISMEDIQQQQNGNH

SEQ ID NO: 153042 - protein, 32 aa, Artificial Sequence
  Description of Artificial Sequence: Synthetic polypeptide
DENEIRTTNPVSTERYGVISMEDIQQQQNGNH

SEQ ID NO: 153043 - protein, 33 aa, Artificial Sequence
  Description of Artificial Sequence: Synthetic polypeptide
DEMEIVTTNPVATEQYGTVCGATDGPVEEEGND

SEQ ID NO: 153044 - protein, 32 aa, Artificial Sequence
  Description of Artificial Sequence: Synthetic polypeptide
DENEIRTTNPVSTERYGTISMEDIQQQQNGNH

SEQ ID NO: 153045 - protein, 33 aa, Artificial Sequence
  Description of Artificial Sequence: Synthetic polypeptide
DEMEIVTTNPVATEQYGTVCFATDGPVEFEGND

SEQ ID NO: 153046 - protein, 32 aa, Artificial Sequence
  Description of Artificial Sequence: Synthetic polypeptide
DENEIRTTNPVSTEVYGTISMEDISQQQNGNH

SEQ ID NO: 153047 - protein, 33 aa, Artificial Sequence
  Description of Artificial Sequence: Synthetic polypeptide
DEMEIVTTNPVATEQYGTVCGATDGPVNFEGND

SEQ ID NO: 153048 - protein, 33 aa, Artificial Sequence
  Description of Artificial Sequence: Synthetic polypeptide
DEMEIVTTNPVATEQYGTVCGATDGWVEFEGND

SEQ ID NO: 153049 - protein, 33 aa, Artificial Sequence
  Description of Artificial Sequence: Synthetic polypeptide
DEMEIVTTNPVATEQYGTVCMATDGPVEFEGND

SEQ ID NO: 153050 - protein, 33 aa, Artificial Sequence
  Description of Artificial Sequence: Synthetic polypeptide
DENEIRTTNPVSTEPYGYTYSMSDIQQQQNGNH

SEQ ID NO: 153051 - protein, 33 aa, Artificial Sequence
  Description of Artificial Sequence: Synthetic polypeptide
DEMEIVTTNPVATEQYGTVCMATDGPVWFEGND

SEQ ID NO: 153052 - protein, 33 aa, Artificial Sequence
  Description of Artificial Sequence: Synthetic polypeptide
DEMEIVTTNPVATEQYGTVCNATDGPVEFEGND

SEQ ID NO: 153053 - protein, 33 aa, Artificial Sequence
  Description of Artificial Sequence: Synthetic polypeptide
DEMEIVTTNPVATEQYGTVCNATDGPVEFHGND

SEQ ID NO: 153054 - protein, 32 aa, Artificial Sequence
  Description of Artificial Sequence: Synthetic polypeptide
DENEIRTTNPVSTEPYGYISMEIIQQQQNGNH

SEQ ID NO: 153055 - protein, 31 aa, Artificial Sequence
  Description of Artificial Sequence: Synthetic polypeptide
DEMEIVTTNPVATEQYGTVCPAEDGPEFENK

SEQ ID NO: 153056 - protein, 35 aa, Artificial Sequence
  Description of Artificial Sequence: Synthetic polypeptide
DEEEISTTNPVATEQYGCVCSNTGEDNQHFGSEQG

SEQ ID NO: 153057 - protein, 32 aa, Artificial Sequence
  Description of Artificial Sequence: Synthetic polypeptide
DENEIRTTNPVSTEPYGYISMEDIQQQQNGNH

SEQ ID NO: 153058 - protein, 32 aa, Artificial Sequence
  Description of Artificial Sequence: Synthetic polypeptide
DENEIRTTNPVSTEPYGWISVEDIQQPQSGEH

SEQ ID NO: 153059 - protein, 32 aa, Artificial Sequence
  Description of Artificial Sequence: Synthetic polypeptide
DENEIRTTNPVSTEPYGWISMEDIQQQQTGNH

SEQ ID NO: 153060 - protein, 32 aa, Artificial Sequence
  Description of Artificial Sequence: Synthetic polypeptide
DENEIRTTNPVSTEPYGWISMEDIQQQQNGNH

SEQ ID NO: 153061 - protein, 32 aa, Artificial Sequence
  Description of Artificial Sequence: Synthetic polypeptide
DENEIRTTNPVSTEPYGWISMEDIQQQFNGNH

SEQ ID NO: 153062 - protein, 32 aa, Artificial Sequence
  Description of Artificial Sequence: Synthetic polypeptide
DENEIRTTNPVSTEPYGWISMEDIQQQENGNH

SEQ ID NO: 153063 - protein, 32 aa, Artificial Sequence
  Description of Artificial Sequence: Synthetic polypeptide
DENEIRTTNPVSTEPYGWISMEAMQQPQSGNH

SEQ ID NO: 153064 - protein, 33 aa, Artificial Sequence
  Description of Artificial Sequence: Synthetic polypeptide
DEMEIVTTNPVATEQYGTVCPATDGPGEFEGND

SEQ ID NO: 153065 - protein, 32 aa, Artificial Sequence
  Description of Artificial Sequence: Synthetic polypeptide
DENEIRTTNPVSTEPYGVYSMEDICQQQNGNH

SEQ ID NO: 153066 - protein, 33 aa, Artificial Sequence
  Description of Artificial Sequence: Synthetic polypeptide
DEMEIVTTNPVATEQYGTVCLATDGPVIFEGND

SEQ ID NO: 153067 - protein, 35 aa, Artificial Sequence
  Description of Artificial Sequence: Synthetic polypeptide
DEEEISTTNPVATEQYGCVCSNTETQEGFGSEFQG

SEQ ID NO: 153068 - protein, 32 aa, Artificial Sequence
  Description of Artificial Sequence: Synthetic polypeptide
DENEIRTTNPVSTEPYMTISMENIQQQQNGNH

SEQ ID NO: 153069 - protein, 33 aa, Artificial Sequence
  Description of Artificial Sequence: Synthetic polypeptide
DEMEIVTTNPVATEQYGTVCLATDGPVEFEGND

SEQ ID NO: 153070 - protein, 33 aa, Artificial Sequence
  Description of Artificial Sequence: Synthetic polypeptide
DEMEIVTTNPVATEQYGTVCHATDGPVEFEGND

SEQ ID NO: 153071 - protein, 33 aa, Artificial Sequence
  Description of Artificial Sequence: Synthetic polypeptide
DEMEIVTTNPVATEQYGTVCIATDGPVEFEGND

SEQ ID NO: 153072 - protein, 35 aa, Artificial Sequence
  Description of Artificial Sequence: Synthetic polypeptide
DEAEIRTTNPVATEQYGSVFSIDVPHWGEGNNEHL

SEQ ID NO: 153073 - protein, 30 aa, Artificial Sequence
  Description of Artificial Sequence: Synthetic polypeptide
DENEIRTTNPVSTEQWGIVSEIEMNAAEDA

SEQ ID NO: 153074 - protein, 36 aa, Artificial Sequence
  Description of Artificial Sequence: Synthetic polypeptide
DEAEIRTTNPVATEQYGSVFDTDNNDTHRSGQEDIG

SEQ ID NO: 153075 - protein, 30 aa, Artificial Sequence
  Description of Artificial Sequence: Synthetic polypeptide
DENEIRTTNPVSTEQWGDVSNIEMNAAEDA

SEQ ID NO: 153076 - protein, 33 aa, Artificial Sequence
  Description of Artificial Sequence: Synthetic polypeptide
DEMEIVTTNPVATEQYGTVCKATDGPVEFEGND

SEQ ID NO: 153077 - protein, 35 aa, Artificial Sequence
  Description of Artificial Sequence: Synthetic polypeptide
DEAEIRTTNPVATEQYGSVEWIDELDPQIAENNFQ

SEQ ID NO: 153078 - protein, 35 aa, Artificial Sequence
  Description of Artificial Sequence: Synthetic polypeptide
DEAEIRTTNPVATEQYGSVFTMWGDSQQEGGEEEG

SEQ ID NO: 153079 - protein, 30 aa, Artificial Sequence
  Description of Artificial Sequence: Synthetic polypeptide
DENEIRTTNPVSTEQWGDVSEIEMNAAETA

SEQ ID NO: 153080 - protein, 36 aa, Artificial Sequence
  Description of Artificial Sequence: Synthetic polypeptide
DEEEISTTNPVATEQYGCVCSNTELNAENFGSENQS

SEQ ID NO: 153081 - protein, 31 aa, Artificial Sequence
  Description of Artificial Sequence: Synthetic polypeptide
DENEIRTTNPVSTEQWGDVSEIEMNAAEDIA

SEQ ID NO: 153082 - protein, 30 aa, Artificial Sequence
  Description of Artificial Sequence: Synthetic polypeptide
DENEIRTTNPVSTEQWGDVSEIEMNAAEDG

SEQ ID NO: 153083 - protein, 30 aa, Artificial Sequence
  Description of Artificial Sequence: Synthetic polypeptide
DENEIRTTNPVSTEQWGDVSEIEMNAAEDA

SEQ ID NO: 153084 - protein, 35 aa, Artificial Sequence
  Description of Artificial Sequence: Synthetic polypeptide
DEAEIRTTNPVATEQYGSVEWDVSQHIGNGIQEFM

SEQ ID NO: 153085 - protein, 30 aa, Artificial Sequence
  Description of Artificial Sequence: Synthetic polypeptide
DENEIRTTNPVSTEQWGDVANTIMSAAEDA

SEQ ID NO: 153086 - protein, 30 aa, Artificial Sequence
  Description of Artificial Sequence: Synthetic polypeptide
DENEIRTTNPVSTEQWGDVANIEMNRAEDA

SEQ ID NO: 153087 - protein, 31 aa, Artificial Sequence
  Description of Artificial Sequence: Synthetic polypeptide
DENEIRTTNPVSTEQWGDISMDEQQQQNGDH

SEQ ID NO: 153088 - protein, 33 aa, Artificial Sequence
  Description of Artificial Sequence: Synthetic polypeptide
DEMEIVTTNPVATEQYGTVCKATDGPYEFEGND

SEQ ID NO: 153089 - protein, 33 aa, Artificial Sequence
  Description of Artificial Sequence: Synthetic polypeptide
DEAEIRTTNPVATEQYGSVEVPEDSHDGGFSEA

SEQ ID NO: 153090 - protein, 33 aa, Artificial Sequence
  Description of Artificial Sequence: Synthetic polypeptide
DEMEIVTTNPVATEQYGTVCCATDGPVEFEGND

SEQ ID NO: 153091 - protein, 34 aa, Artificial Sequence
  Description of Artificial Sequence: Synthetic polypeptide
DEMEIVTTNPVATEQYGTVCAATDGPVESREGND

SEQ ID NO: 153092 - protein, 36 aa, Artificial Sequence
  Description of Artificial Sequence: Synthetic polypeptide
DEEEISTTNPVATEQYGCVCSNTEDLNQENFGSDQG

SEQ ID NO: 153093 - protein, 36 aa, Artificial Sequence
  Description of Artificial Sequence: Synthetic polypeptide
DEEEISTTNPVATEQYGCVCSNTEDLNQNFGSETQA

SEQ ID NO: 153094 - protein, 37 aa, Artificial Sequence
  Description of Artificial Sequence: Synthetic polypeptide
DEEEIRTTNPVAYEQYGESVNSPSVNNELFRVGEPVD

SEQ ID NO: 153095 - protein, 35 aa, Artificial Sequence
  Description of Artificial Sequence: Synthetic polypeptide
DEEEISTTNPVATEQYGCVCSNTEDLQENFISDQD

SEQ ID NO: 153096 - protein, 33 aa, Artificial Sequence
  Description of Artificial Sequence: Synthetic polypeptide
DEMEIVTTNPVATEQYGTMCSATDGPVIFEGND

SEQ ID NO: 153097 - protein, 35 aa, Artificial Sequence
  Description of Artificial Sequence: Synthetic polypeptide
DEEEISTTNPVATEQYGCVCSNTEDNQEFFGSDQS

SEQ ID NO: 153098 - protein, 35 aa, Artificial Sequence
  Description of Artificial Sequence: Synthetic polypeptide
DEEEISTTNPVATEQYGCVCSNTEDNQNFNSDFQA

SEQ ID NO: 153099 - protein, 33 aa, Artificial Sequence
  Description of Artificial Sequence: Synthetic polypeptide
DEMEIVTTNPVATEQYGTMCSATRGPVEFEGND

SEQ ID NO: 153100 - protein, 36 aa, Artificial Sequence
  Description of Artificial Sequence: Synthetic polypeptide
DEEEISTTNPVATEQYGCVCSNTEEDLQEHFGSDQD

SEQ ID NO: 153101 - protein, 36 aa, Artificial Sequence
  Description of Artificial Sequence: Synthetic polypeptide
DEEEISTTNPVATEQYGCVCSNTEEDNQEGFNSDQF

SEQ ID NO: 153102 - protein, 36 aa, Artificial Sequence
  Description of Artificial Sequence: Synthetic polypeptide
DEEEISTTNPVATEQYGCVCSNTEEDNQNFGSQNQS

SEQ ID NO: 153103 - protein, 34 aa, Artificial Sequence
  Description of Artificial Sequence: Synthetic polypeptide
DEMEIVTTNPVATEQYGTMVCSATDGPVEFEGND

SEQ ID NO: 153104 - protein, 38 aa, Artificial Sequence
  Description of Artificial Sequence: Synthetic polypeptide
DEEEIRTTNPVATEQYGVVSTVVNSTNNNLAGNTEQGS

SEQ ID NO: 153105 - protein, 35 aa, Artificial Sequence
  Description of Artificial Sequence: Synthetic polypeptide
DEEEISTTNPVATEQYGCVCSNTEEHNANFNSNQD

SEQ ID NO: 153106 - protein, 32 aa, Artificial Sequence
  Description of Artificial Sequence: Synthetic polypeptide
DENEIRTTNPVSYEAYGTISWEDINQEQFGNQ

SEQ ID NO: 153107 - protein, 36 aa, Artificial Sequence
  Description of Artificial Sequence: Synthetic polypeptide
DEEEISTTNPVATEQYGCVCSNTEEHNESFGSDNQA

SEQ ID NO: 153108 - protein, 32 aa, Artificial Sequence
  Description of Artificial Sequence: Synthetic polypeptide
DENEIRTTNPVSTYPYGTISMELIQQQQNGNH

SEQ ID NO: 153109 - protein, 35 aa, Artificial Sequence
  Description of Artificial Sequence: Synthetic polypeptide
DEEEISTTNPVATEQYGCVCSNTEDLANFGSEFQG

SEQ ID NO: 153110 - protein, 35 aa, Artificial Sequence
  Description of Artificial Sequence: Synthetic polypeptide
DEEEISTTNPVATEQYGCVCSNTEAHQNFGSEFQG

SEQ ID NO: 153111 - protein, 37 aa, Artificial Sequence
  Description of Artificial Sequence: Synthetic polypeptide
DEEEIRTTNPVAYEQYGESVSPSLNDELFVRVGEPVD

SEQ ID NO: 153112 - protein, 36 aa, Artificial Sequence
  Description of Artificial Sequence: Synthetic polypeptide
DEEEISTTNPVATEQYGCVCSNTAHNQENFGSENQS

SEQ ID NO: 153113 - protein, 33 aa, Artificial Sequence
  Description of Artificial Sequence: Synthetic polypeptide
DEMEIVTTNPVATEQYGTICSAMDGIVQFEGND

SEQ ID NO: 153114 - protein, 33 aa, Artificial Sequence
  Description of Artificial Sequence: Synthetic polypeptide
DEMEIVTTNPVATEQYGTICSATDGPVEFEGND

SEQ ID NO: 153115 - protein, 33 aa, Artificial Sequence
  Description of Artificial Sequence: Synthetic polypeptide
DEMEIVTTNPVATEQYGTISAMDGIVQQFNGND

SEQ ID NO: 153116 - protein, 33 aa, Artificial Sequence
  Description of Artificial Sequence: Synthetic polypeptide
DEAEIATTNPVAYEQWGTVCSTENDEHDGNGQM

SEQ ID NO: 153117 - protein, 34 aa, Artificial Sequence
  Description of Artificial Sequence: Synthetic polypeptide
DEMEIVTTNPVATEQYGTIVCSATDGPVEFEGND

SEQ ID NO: 153118 - protein, 33 aa, Artificial Sequence
  Description of Artificial Sequence: Synthetic polypeptide
DEMEIVTTNPVATEQYGTLCSATDGPVEFEGND

SEQ ID NO: 153119 - protein, 34 aa, Artificial Sequence
  Description of Artificial Sequence: Synthetic polypeptide
DEMEIVTTNPVATEQYGTLVCSATDGPVEFEGND

SEQ ID NO: 153120 - protein, 31 aa, Artificial Sequence
  Description of Artificial Sequence: Synthetic polypeptide
DEMEIVTTNPVATEQYGTMCAATDGPEFGDD

SEQ ID NO: 153121 - protein, 35 aa, Artificial Sequence
  Description of Artificial Sequence: Synthetic polypeptide
DEEEISTTNPVATEQYGCVCSNTEEHQEGFGSDQF

SEQ ID NO: 153122 - protein, 31 aa, Artificial Sequence
  Description of Artificial Sequence: Synthetic polypeptide
DEMEIVTTNPVATEQYGTMCAATDTPEFGDD

SEQ ID NO: 153123 - protein, 35 aa, Artificial Sequence
  Description of Artificial Sequence: Synthetic polypeptide
DEEEISTTNPVATEQYGCVCSNSGELNQNFGSDQP

SEQ ID NO: 153124 - protein, 35 aa, Artificial Sequence
  Description of Artificial Sequence: Synthetic polypeptide
DEEEISTTNPVATEQYGCVCSNSGETNQNFGSEQA

SEQ ID NO: 153125 - protein, 36 aa, Artificial Sequence
  Description of Artificial Sequence: Synthetic polypeptide
DEEEISTTNPVATEQYGCVCSNSGNHNQNFGSENQA

SEQ ID NO: 153126 - protein, 35 aa, Artificial Sequence
  Description of Artificial Sequence: Synthetic polypeptide
DEEEISTTNPVATEQYGCVCSNSGPLQENFGSDQL

SEQ ID NO: 153127 - protein, 33 aa, Artificial Sequence
  Description of Artificial Sequence: Synthetic polypeptide
DEMEIVTTNPVATEQYGTMCSATDGPVEFEGND

SEQ ID NO: 153128 - protein, 35 aa, Artificial Sequence
  Description of Artificial Sequence: Synthetic polypeptide
DEEEISTTNPVATEQYGCVCSNSMEHQEFFGSNQD

SEQ ID NO: 153129 - protein, 34 aa, Artificial Sequence
  Description of Artificial Sequence: Synthetic polypeptide
DEEEISTTNPVATEQYGCVCSNSMPHQNFGSDQL

SEQ ID NO: 153130 - protein, 36 aa, Artificial Sequence
  Description of Artificial Sequence: Synthetic polypeptide
DEEEIRTTNPVAYEQYGESVSPSQNDELFRVIEPVD

SEQ ID NO: 153131 - protein, 33 aa, Artificial Sequence
  Description of Artificial Sequence: Synthetic polypeptide
DEMEIVTTNPVATEQYGTMCSATDGPFEFEGND

SEQ ID NO: 153132 - protein, 33 aa, Artificial Sequence
  Description of Artificial Sequence: Synthetic polypeptide
DEMEIVTTNPVATEQYGTVCCATDGPGEFEGND

SEQ ID NO: 153133 - protein, 35 aa, Artificial Sequence
  Description of Artificial Sequence: Synthetic polypeptide
DEEEISTTNPVATEQYGCVCSNTEEHQEYFNSEAE

SEQ ID NO: 153134 - protein, 33 aa, Artificial Sequence
  Description of Artificial Sequence: Synthetic polypeptide
DEMEIVTTNPVATEQYGTNCSATDGPVEFEGNG

SEQ ID NO: 153135 - protein, 34 aa, Artificial Sequence
  Description of Artificial Sequence: Synthetic polypeptide
DEMEIVTTNPVATEQYGTTVHSATDGPVEFEGND

SEQ ID NO: 153136 - protein, 33 aa, Artificial Sequence
  Description of Artificial Sequence: Synthetic polypeptide
DEMEIVTTNPVATEQYGTVAQATDGPVEFEGND

SEQ ID NO: 153137 - protein, 33 aa, Artificial Sequence
  Description of Artificial Sequence: Synthetic polypeptide
DEMEIVTTNPVATEQYGTVASALDGPVEFEGND

SEQ ID NO: 153138 - protein, 33 aa, Artificial Sequence
  Description of Artificial Sequence: Synthetic polypeptide
DEMEIVTTNPVATEQYGTVASATDGPVEFEGHD

SEQ ID NO: 153139 - protein, 33 aa, Artificial Sequence
  Description of Artificial Sequence: Synthetic polypeptide
DEAEIATTNPVAYEQWGTVCSTENDEHDGNSDE

SEQ ID NO: 153140 - protein, 33 aa, Artificial Sequence
  Description of Artificial Sequence: Synthetic polypeptide
DEMEIVTTNPVATEQYGTVCAASDGPVEFEGND

SEQ ID NO: 153141 - protein, 33 aa, Artificial Sequence
  Description of Artificial Sequence: Synthetic polypeptide
DEMEIVTTNPVATEQYGTVCAATDGEFEFEGND

SEQ ID NO: 153142 - protein, 33 aa, Artificial Sequence
  Description of Artificial Sequence: Synthetic polypeptide
DEMEIVTTNPVATEQYGTVCAATDGHVEFEGND

SEQ ID NO: 153143 - protein, 33 aa, Artificial Sequence
  Description of Artificial Sequence: Synthetic polypeptide
DEMEIVTTNPVATEQYGTVCAATDGPVAFEGND

SEQ ID NO: 153144 - protein, 35 aa, Artificial Sequence
  Description of Artificial Sequence: Synthetic polypeptide
DEEEISTTNPVATEQYGCVCSNTEHNQENFGSEQF

SEQ ID NO: 153145 - protein, 33 aa, Artificial Sequence
  Description of Artificial Sequence: Synthetic polypeptide
DEMEIVTTNPVATEQYGTVCAATDGPVEFEGND

SEQ ID NO: 153146 - protein, 32 aa, Artificial Sequence
  Description of Artificial Sequence: Synthetic polypeptide
DENEIRTTNPVSTEWYGTISMEDIQQCQNGNH

SEQ ID NO: 153147 - protein, 32 aa, Artificial Sequence
  Description of Artificial Sequence: Synthetic polypeptide
DENEIRTTNPVSTEWYGTISMEDIHQQQNGNH

SEQ ID NO: 153148 - protein, 32 aa, Artificial Sequence
  Description of Artificial Sequence: Synthetic polypeptide
DENEIRTTNPVSTEWYGTCSMEDIQQQQNGNH

SEQ ID NO: 153149 - protein, 33 aa, Artificial Sequence
  Description of Artificial Sequence: Synthetic polypeptide
DEMEIVTTNPVATEQYGTVCAATDGPVEFGGND

SEQ ID NO: 153150 - protein, 33 aa, Artificial Sequence
  Description of Artificial Sequence: Synthetic polypeptide
DEMEIVTTNPVATEQYGTVCAATDGPVEFKGND

SEQ ID NO: 153151 - protein, 33 aa, Artificial Sequence
  Description of Artificial Sequence: Synthetic polypeptide
DEMEIVTTNPVATEQYGTVCAATDGPVEHEGND

SEQ ID NO: 153152 - protein, 34 aa, Artificial Sequence
  Description of Artificial Sequence: Synthetic polypeptide
DEMEIVTTNPVATEQYGTTVCSLTDGPVEFEGND

SEQ ID NO: 153153 - protein, 34 aa, Artificial Sequence
  Description of Artificial Sequence: Synthetic polypeptide
DEMEIVTTNPVATEQYGTTVCSATDGPVEPEGND

SEQ ID NO: 153154 - protein, 34 aa, Artificial Sequence
  Description of Artificial Sequence: Synthetic polypeptide
DEMEIVTTNPVATEQYGTTVCSATDGPVEFWGND

SEQ ID NO: 153155 - protein, 34 aa, Artificial Sequence
  Description of Artificial Sequence: Synthetic polypeptide
DEMEIVTTNPVATEQYGTTVCSATDGPVEFEGND

SEQ ID NO: 153156 - protein, 35 aa, Artificial Sequence
  Description of Artificial Sequence: Synthetic polypeptide
DEEEISTTNPVATEQYGCVCSNTEELNENFGSDQS

SEQ ID NO: 153157 - protein, 35 aa, Artificial Sequence
  Description of Artificial Sequence: Synthetic polypeptide
DEEEISTTNPVATEQYGCVCSNTEHDQNFGSETQP

SEQ ID NO: 153158 - protein, 32 aa, Artificial Sequence
  Description of Artificial Sequence: Synthetic polypeptide
DENEIRTTNPVSTRPYGTISMEDLQQQQNGNH

SEQ ID NO: 153159 - protein, 35 aa, Artificial Sequence
  Description of Artificial Sequence: Synthetic polypeptide
DEEEISTTNPVATEQYGCVCSNTEHNANFGSDFQP

SEQ ID NO: 153160 - protein, 34 aa, Artificial Sequence
  Description of Artificial Sequence: Synthetic polypeptide
DEMEIVTTNPVATEQYGTQVCSATDGPVEFEGND

SEQ ID NO: 153161 - protein, 34 aa, Artificial Sequence
  Description of Artificial Sequence: Synthetic polypeptide
DEMEIVTTNPVATEQYGTQVCSATDGPVEFEGNH

SEQ ID NO: 153162 - protein, 34 aa, Artificial Sequence
  Description of Artificial Sequence: Synthetic polypeptide
DEMEIVTTNPVATEQYGTQVCSATDGSVEFEGND

SEQ ID NO: 153163 - protein, 34 aa, Artificial Sequence
  Description of Artificial Sequence: Synthetic polypeptide
DEMEIVTTNPVATEQYGTSCSATDGPVEDFEGND

SEQ ID NO: 153164 - protein, 34 aa, Artificial Sequence
  Description of Artificial Sequence: Synthetic polypeptide
DEMEIVTTNPVATEQYGTMVCSATDGPVYFEGND

SEQ ID NO: 153165 - protein, 33 aa, Artificial Sequence
  Description of Artificial Sequence: Synthetic polypeptide
DEMEIVTTNPVATEQYGTSCSATDGPVEFEDND

SEQ ID NO: 153166 - protein, 38 aa, Artificial Sequence
  Description of Artificial Sequence: Synthetic polypeptide
DEEEIRTTNPVATEQYGVVSTVVNTNLQNNNQGGTTDD

SEQ ID NO: 153167 - protein, 31 aa, Artificial Sequence
  Description of Artificial Sequence: Synthetic polypeptide
DENEIRTTNPVSTMPYGTISMEDIQQQNGNH

SEQ ID NO: 153168 - protein, 33 aa, Artificial Sequence
  Description of Artificial Sequence: Synthetic polypeptide
DEMEIVTTNPVATEQYGTTCSATDGPVEFEGND

SEQ ID NO: 153169 - protein, 33 aa, Artificial Sequence
  Description of Artificial Sequence: Synthetic polypeptide
DEMEIVTTNPVATEQYGTTCSATDRPVEFEGND

SEQ ID NO: 153170 - protein, 36 aa, Artificial Sequence
  Description of Artificial Sequence: Synthetic polypeptide
DEEEISTTNPVATEQYGCVCSNTEHNQEHFGSDNQA

SEQ ID NO: 153171 - protein, 32 aa, Artificial Sequence
  Description of Artificial Sequence: Synthetic polypeptide
DENEIRTTNPVSTEYYGTISWEEINQEQFGDQ

SEQ ID NO: 153172 - protein, 32 aa, Artificial Sequence
  Description of Artificial Sequence: Synthetic polypeptide
DENEIRTTNPVSTEYYGTISMEDIQQQQNGNH

SEQ ID NO: 153173 - protein, 32 aa, Artificial Sequence
  Description of Artificial Sequence: Synthetic polypeptide
DENEIRTTNPVSTEWYGTISMEDIQQQQNGNH

SEQ ID NO: 153174 - protein, 34 aa, Artificial Sequence
  Description of Artificial Sequence: Synthetic polypeptide
DEMEIVTTNPVATEQYGTSCSATDGPVEFEGNTD

SEQ ID NO: 153175 - protein, 34 aa, Artificial Sequence
  Description of Artificial Sequence: Synthetic polypeptide
DEMEIVTTNPVATEQYGTHVCSATDGPVEPEGND

SEQ ID NO: 153176 - protein, 33 aa, Artificial Sequence
  Description of Artificial Sequence: Synthetic polypeptide
DEAEIRTTNPVATEQYGSVEVPEDHDLGFSVQE

SEQ ID NO: 153177 - protein, 33 aa, Artificial Sequence
  Description of Artificial Sequence: Synthetic polypeptide
DENEIRTTNPVSTEPYGVISVLDIQQPQNGFNH

SEQ ID NO: 153178 - protein, 33 aa, Artificial Sequence
  Description of Artificial Sequence: Synthetic polypeptide
DENEIRTTNPVSTEPYGTSISMEDIQQQQNGNH

SEQ ID NO: 153179 - protein, 32 aa, Artificial Sequence
  Description of Artificial Sequence: Synthetic polypeptide
DENEIRTTNPVSTEPYGTSAMEDIQQQQNGNH

SEQ ID NO: 153180 - protein, 32 aa, Artificial Sequence
  Description of Artificial Sequence: Synthetic polypeptide
DENEIRTTNPVSTEPYGTQSMPDIEIQQGGNH

SEQ ID NO: 153181 - protein, 32 aa, Artificial Sequence
  Description of Artificial Sequence: Synthetic polypeptide
DENEIRTTNPVSTEPYGTQSMEDRQQQQNGNH

SEQ ID NO: 153182 - protein, 32 aa, Artificial Sequence
  Description of Artificial Sequence: Synthetic polypeptide
DENEIRTTNPVSTEPYGTQSMEDIQQQPNGNH

SEQ ID NO: 153183 - protein, 33 aa, Artificial Sequence
  Description of Artificial Sequence: Synthetic polypeptide
DEMEIVTTNPVATEQYGTVCSAQDGPVEFEGND

SEQ ID NO: 153184 - protein, 34 aa, Artificial Sequence
  Description of Artificial Sequence: Synthetic polypeptide
DEMEIVTTNPVATEQYGTVCSAQDGPVEQFEGND

SEQ ID NO: 153185 - protein, 33 aa, Artificial Sequence
  Description of Artificial Sequence: Synthetic polypeptide
DEMEIVTTNPVATEQYGTVCSAQDGPVVFEGND

SEQ ID NO: 153186 - protein, 33 aa, Artificial Sequence
  Description of Artificial Sequence: Synthetic polypeptide
DEMEIVTTNPVATEQYGTVCSARDGPVEFEGND

SEQ ID NO: 153187 - protein, 33 aa, Artificial Sequence
  Description of Artificial Sequence: Synthetic polypeptide
DEMEIVTTNPVATEQYGTVCSASDGPVEFEGND

SEQ ID NO: 153188 - protein, 32 aa, Artificial Sequence
  Description of Artificial Sequence: Synthetic polypeptide
DENEIRTTNPVSTEPYGTMSQEDIQQQQNGNH

SEQ ID NO: 153189 - protein, 32 aa, Artificial Sequence
  Description of Artificial Sequence: Synthetic polypeptide
DENEIRTTNPVSTEPYGTMSMEDIQQQQNGNH

SEQ ID NO: 153190 - protein, 34 aa, Artificial Sequence
  Description of Artificial Sequence: Synthetic polypeptide
DEMEIVTTNPVATEQYGTVCSATDCPVEFEGNDC

SEQ ID NO: 153191 - protein, 32 aa, Artificial Sequence
  Description of Artificial Sequence: Synthetic polypeptide
DENEIRTTNPVSTEPYGTMSLEDIQQQQNGNH

SEQ ID NO: 153192 - protein, 34 aa, Artificial Sequence
  Description of Artificial Sequence: Synthetic polypeptide
DEMEIVTTNPVATEQYGTVCSATDDPVEDFEGND

SEQ ID NO: 153193 - protein, 33 aa, Artificial Sequence
  Description of Artificial Sequence: Synthetic polypeptide
DENEIRTTNPVSTEPYGTMISMNDIQQQQNGNH

SEQ ID NO: 153194 - protein, 34 aa, Artificial Sequence
  Description of Artificial Sequence: Synthetic polypeptide
DEMEIVTTNPVATEQYGTVCSATDDPVEFEGNDA

SEQ ID NO: 153195 - protein, 34 aa, Artificial Sequence
  Description of Artificial Sequence: Synthetic polypeptide
DENEIRTTNPVSTEPYGTSISMEDIQQQQNGNRH

SEQ ID NO: 153196 - protein, 33 aa, Artificial Sequence
  Description of Artificial Sequence: Synthetic polypeptide
DEMEIVTTNPVATEQYGTVCSAPDGPVEFEGND

SEQ ID NO: 153197 - protein, 32 aa, Artificial Sequence
  Description of Artificial Sequence: Synthetic polypeptide
DENEIRTTNPVSTEPYGTSSMEDIQQQQNGNH

SEQ ID NO: 153198 - protein, 33 aa, Artificial Sequence
  Description of Artificial Sequence: Synthetic polypeptide
DEMEIVTTNPVATEQYGTVCSAPDGPVEEEGNP

SEQ ID NO: 153199 - protein, 32 aa, Artificial Sequence
  Description of Artificial Sequence: Synthetic polypeptide
DENEIRTTNPVSTEPYGTTSGEDIQQQQDGNH

SEQ ID NO: 153200 - protein, 33 aa, Artificial Sequence
  Description of Artificial Sequence: Synthetic polypeptide
DENEIRTTNPVSTEPYGTTSAEDWNQQQQNGNH

SEQ ID NO: 153201 - protein, 33 aa, Artificial Sequence
  Description of Artificial Sequence: Synthetic polypeptide
DEMEIVTTNPVATEQYGTVCSALDGPVEFIGND

SEQ ID NO: 153202 - protein, 33 aa, Artificial Sequence
  Description of Artificial Sequence: Synthetic polypeptide
DEMEIVTTNPVATEQYGTVCSALDGPVEFKGND

SEQ ID NO: 153203 - protein, 33 aa, Artificial Sequence
  Description of Artificial Sequence: Synthetic polypeptide
DEMEIVTTNPVATEQYGTVCSALDGPVEIEGND

SEQ ID NO: 153204 - protein, 33 aa, Artificial Sequence
  Description of Artificial Sequence: Synthetic polypeptide
DEMEIVTTNPVATEQYGTVCSAMDGIVEFNGNH

SEQ ID NO: 153205 - protein, 33 aa, Artificial Sequence
  Description of Artificial Sequence: Synthetic polypeptide
DENEIRTTNPVSTEPYGTTISMEDISQNQNGNH

SEQ ID NO: 153206 - protein, 33 aa, Artificial Sequence
  Description of Artificial Sequence: Synthetic polypeptide
DEMEIVTTNPVATEQYGTVCSAMDGPVEFEGND

SEQ ID NO: 153207 - protein, 33 aa, Artificial Sequence
  Description of Artificial Sequence: Synthetic polypeptide
DEAEIATTNPVAYEQWGVVSGDNMQLNDQHGDF

SEQ ID NO: 153208 - protein, 34 aa, Artificial Sequence
  Description of Artificial Sequence: Synthetic polypeptide
DEMEIVTTNPVATEQYGTVCSAMDGPVEQFNGND

SEQ ID NO: 153209 - protein, 34 aa, Artificial Sequence
  Description of Artificial Sequence: Synthetic polypeptide
DEMEIVTTNPVATEQYGTVCSAMDGPVEQFNGNH

SEQ ID NO: 153210 - protein, 34 aa, Artificial Sequence
  Description of Artificial Sequence: Synthetic polypeptide
DEMEIVTTNPVATEQYGTVCSAMEDPVEQFNGNH

SEQ ID NO: 153211 - protein, 34 aa, Artificial Sequence
  Description of Artificial Sequence: Synthetic polypeptide
DEMEIVTTNPVATEQYGTVCSAMEGPVEQFNGNH

SEQ ID NO: 153212 - protein, 32 aa, Artificial Sequence
  Description of Artificial Sequence: Synthetic polypeptide
DENEIRTTNPVSTEPYGTTISAEDIQQQNGNH

SEQ ID NO: 153213 - protein, 32 aa, Artificial Sequence
  Description of Artificial Sequence: Synthetic polypeptide
DENEIRTTNPVSTEPYGTTISAEDIQQPNGNH

SEQ ID NO: 153214 - protein, 33 aa, Artificial Sequence
  Description of Artificial Sequence: Synthetic polypeptide
DENEIRTTNPVSTEPYGTSSMEDSIQQQQNGNH

SEQ ID NO: 153215 - protein, 32 aa, Artificial Sequence
  Description of Artificial Sequence: Synthetic polypeptide
DENEIRTTNPVSTEPYGTSSMEDIQQQYNGNH

SEQ ID NO: 153216 - protein, 33 aa, Artificial Sequence
  Description of Artificial Sequence: Synthetic polypeptide
DEAEIATTNPVAYEQWGTVCSTENDEHGDGNEQ

SEQ ID NO: 153217 - protein, 32 aa, Artificial Sequence
  Description of Artificial Sequence: Synthetic polypeptide
DENEIRTTNPVSTEPYGTTISMEDIQQQNGNH

SEQ ID NO: 153218 - protein, 32 aa, Artificial Sequence
  Description of Artificial Sequence: Synthetic polypeptide
DENEIRTTNPVSTEPYGTTSGEDMGQQQNGNH

SEQ ID NO: 153219 - protein, 33 aa, Artificial Sequence
  Description of Artificial Sequence: Synthetic polypeptide
DEMEIVTTNPVATEQYGTVCSATDEPVEFEGED

SEQ ID NO: 153220 - protein, 34 aa, Artificial Sequence
  Description of Artificial Sequence: Synthetic polypeptide
DEMEIVTTNPVATEQYGTVCSATDFPVEFEGNLD

SEQ ID NO: 153221 - protein, 34 aa, Artificial Sequence
  Description of Artificial Sequence: Synthetic polypeptide
DEMEIVTTNPVATEQYGTVCSATDGEVEFFEGND

SEQ ID NO: 153222 - protein, 33 aa, Artificial Sequence
  Description of Artificial Sequence: Synthetic polypeptide
DENEIRTTNPVSTEPYGTITSVEDINQQQNGEH

SEQ ID NO: 153223 - protein, 33 aa, Artificial Sequence
  Description of Artificial Sequence: Synthetic polypeptide
DENEIRTTNPVSTEPYGTISYEDTIQQQQNGNH

SEQ ID NO: 153224 - protein, 32 aa, Artificial Sequence
  Description of Artificial Sequence: Synthetic polypeptide
DENEIRTTNPVSTEPYGTISYEDIQQYQFGNH

SEQ ID NO: 153225 - protein, 32 aa, Artificial Sequence
  Description of Artificial Sequence: Synthetic polypeptide
DENEIRTTNPVSTEPYGTISYEDIQQQQNGNH

SEQ ID NO: 153226 - protein, 32 aa, Artificial Sequence
  Description of Artificial Sequence: Synthetic polypeptide
DENEIRTTNPVSTEPYGTISYEDIQQFQNGNH

SEQ ID NO: 153227 - protein, 34 aa, Artificial Sequence
  Description of Artificial Sequence: Synthetic polypeptide
DEMEIVTTNPVATEQYGTVCSATDGFPVEFEGND

SEQ ID NO: 153228 - protein, 34 aa, Artificial Sequence
  Description of Artificial Sequence: Synthetic polypeptide
DEMEIVTTNPVATEQYGTVCSATDGFPVEFEGNI

SEQ ID NO: 153229 - protein, 34 aa, Artificial Sequence
  Description of Artificial Sequence: Synthetic polypeptide
DEMEIVTTNPVATEQYGTVCSATDGFPVEFEGNS

SEQ ID NO: 153230 - protein, 33 aa, Artificial Sequence
  Description of Artificial Sequence: Synthetic polypeptide
DENEIRTTNPVSTEPYGTISWEEDNQEQFGNQS

SEQ ID NO: 153231 - protein, 34 aa, Artificial Sequence
  Description of Artificial Sequence: Synthetic polypeptide
DEMEIVTTNPVATEQYGTVCSATDGFVEFEGNDE

SEQ ID NO: 153232 - protein, 32 aa, Artificial Sequence
  Description of Artificial Sequence: Synthetic polypeptide
DENEIRTTNPVSTEPYGTISWEDIQQQQNGNH

SEQ ID NO: 153233 - protein, 36 aa, Artificial Sequence
  Description of Artificial Sequence: Synthetic polypeptide
DEEEISTTNPVATEQYGCVCSNTGEHNQYFGSNNQS

SEQ ID NO: 153234 - protein, 34 aa, Artificial Sequence
  Description of Artificial Sequence: Synthetic polypeptide
DEMEIVTTNPVATEQYGTVCSATDGGPVEFEGND

SEQ ID NO: 153235 - protein, 32 aa, Artificial Sequence
  Description of Artificial Sequence: Synthetic polypeptide
DENEIRTTNPVSTEPYGTISWEDDQQDQSGNH

SEQ ID NO: 153236 - protein, 34 aa, Artificial Sequence
  Description of Artificial Sequence: Synthetic polypeptide
DEMEIVTTNPVATEQYGTVCSATDGGVEFEGDND

SEQ ID NO: 153237 - protein, 33 aa, Artificial Sequence
  Description of Artificial Sequence: Synthetic polypeptide
DEAEIATTNPVAYEQWGVVSGGELQEHERNNDA

SEQ ID NO: 153238 - protein, 34 aa, Artificial Sequence
  Description of Artificial Sequence: Synthetic polypeptide
DEMEIVTTNPVATEQYGTVCSATDGEVEFEGNCD

SEQ ID NO: 153239 - protein, 32 aa, Artificial Sequence
  Description of Artificial Sequence: Synthetic polypeptide
DENEIRTTNPVSTEPYGTIVMEDIQQQQNGNH

SEQ ID NO: 153240 - protein, 32 aa, Artificial Sequence
  Description of Artificial Sequence: Synthetic polypeptide
DENEIRTTNPVSTEPYGTIVMEHIQQQQNGNH

SEQ ID NO: 153241 - protein, 33 aa, Artificial Sequence
  Description of Artificial Sequence: Synthetic polypeptide
DENEIRTTNPVSTEPYGTIVSMEDIQQQKNGNH

SEQ ID NO: 153242 - protein, 33 aa, Artificial Sequence
  Description of Artificial Sequence: Synthetic polypeptide
DENEIRTTNPVSTEPYGTLSVEDVIQQQVIGNH

SEQ ID NO: 153243 - protein, 34 aa, Artificial Sequence
  Description of Artificial Sequence: Synthetic polypeptide
DEMEIVTTNPVATEQYGTVCSATDGAPVEFEGND

SEQ ID NO: 153244 - protein, 34 aa, Artificial Sequence
  Description of Artificial Sequence: Synthetic polypeptide
DEMEIVTTNPVATEQYGTVCSATDGAPVEPEGND

SEQ ID NO: 153245 - protein, 34 aa, Artificial Sequence
  Description of Artificial Sequence: Synthetic polypeptide
DEMEIVTTNPVATEQYGTVCSATDGAPWEFEGND

SEQ ID NO: 153246 - protein, 34 aa, Artificial Sequence
  Description of Artificial Sequence: Synthetic polypeptide
DEMEIVTTNPVATEQYGTVCSATDGAVEFEGAND

SEQ ID NO: 153247 - protein, 34 aa, Artificial Sequence
  Description of Artificial Sequence: Synthetic polypeptide
DEMEIVTTNPVATEQYGTVCSATDGAVVEFEGND

SEQ ID NO: 153248 - protein, 34 aa, Artificial Sequence
  Description of Artificial Sequence: Synthetic polypeptide
DEMEIVTTNPVATEQYGTVCSATDGCPVEFEGND

SEQ ID NO: 153249 - protein, 33 aa, Artificial Sequence
  Description of Artificial Sequence: Synthetic polypeptide
DEMEIVTTNPVATEQYGTVCSATDGCVEFEGED

SEQ ID NO: 153250 - protein, 34 aa, Artificial Sequence
  Description of Artificial Sequence: Synthetic polypeptide
DEMEIVTTNPVATEQYGTVCSATDEPVEFEGNDC

SEQ ID NO: 153251 - protein, 34 aa, Artificial Sequence
  Description of Artificial Sequence: Synthetic polypeptide
DEMEIVTTNPVATEQYGTVCSATDGCVEFEGQND

SEQ ID NO: 153252 - protein, 34 aa, Artificial Sequence
  Description of Artificial Sequence: Synthetic polypeptide
DEMEIVTTNPVATEQYGTVCSATDGDPVEFEGND

SEQ ID NO: 153253 - protein, 34 aa, Artificial Sequence
  Description of Artificial Sequence: Synthetic polypeptide
DEMEIVTTNPVATEQYGTVCSATDGDVEFEGNAD

SEQ ID NO: 153254 - protein, 34 aa, Artificial Sequence
  Description of Artificial Sequence: Synthetic polypeptide
DEMEIVTTNPVATEQYGTVCSATDGDVEFEGNND

SEQ ID NO: 153255 - protein, 34 aa, Artificial Sequence
  Description of Artificial Sequence: Synthetic polypeptide
DEMEIVTTNPVATEQYGTVCSATDGEPVEFEGND

SEQ ID NO: 153256 - protein, 34 aa, Artificial Sequence
  Description of Artificial Sequence: Synthetic polypeptide
DEMEIVTTNPVATEQYGTVCSATDGEPVETEGND

SEQ ID NO: 153257 - protein, 33 aa, Artificial Sequence
  Description of Artificial Sequence: Synthetic polypeptide
DENEIRTTNPVSTEPYGTIVSMEMIQQQQNGNH

SEQ ID NO: 153258 - protein, 33 aa, Artificial Sequence
  Description of Artificial Sequence: Synthetic polypeptide
DEMEIVTTNPVATEQYGTVCSATDGEVEFAGDD

SEQ ID NO: 153259 - protein, 33 aa, Artificial Sequence
  Description of Artificial Sequence: Synthetic polypeptide
DENEIRTTNPVSTEPYGTIVSMEDIQQQQNGNH

SEQ ID NO: 153260 - protein, 32 aa, Artificial Sequence
  Description of Artificial Sequence: Synthetic polypeptide
DENEIRTTNPVSTEPYGTLSMEDIQQQQNGNH

SEQ ID NO: 153261 - protein, 33 aa, Artificial Sequence
  Description of Artificial Sequence: Synthetic polypeptide
DEMEIVTTNPVATEQYGTVCPATDGPVEFEGND

SEQ ID NO: 153262 - protein, 32 aa, Artificial Sequence
  Description of Artificial Sequence: Synthetic polypeptide
DENEIRTTNPVSTEPYGTTSGEGGQAQPNGNH

SEQ ID NO: 153263 - protein, 33 aa, Artificial Sequence
  Description of Artificial Sequence: Synthetic polypeptide
DEMEIVTTNPVATEQYGTVCSALDGPVEFEGND

SEQ ID NO: 153264 - protein, 32 aa, Artificial Sequence
  Description of Artificial Sequence: Synthetic polypeptide
DENEIRTTNPVSTEPYGTYSMEDIQQQQNGNH

SEQ ID NO: 153265 - protein, 33 aa, Artificial Sequence
  Description of Artificial Sequence: Synthetic polypeptide
DEMEIVTTNPVATEQYGTVCSAADGPVVFEGND

SEQ ID NO: 153266 - protein, 32 aa, Artificial Sequence
  Description of Artificial Sequence: Synthetic polypeptide
DENEIRTTNPVSTEPYGTYSMDDIQQQQIGNH

SEQ ID NO: 153267 - protein, 32 aa, Artificial Sequence
  Description of Artificial Sequence: Synthetic polypeptide
DENEIRTTNPVSTEPYGTWSMHDIQQQQNGNH

SEQ ID NO: 153268 - protein, 32 aa, Artificial Sequence
  Description of Artificial Sequence: Synthetic polypeptide
DENEIRTTNPVSTEPYGTWSMEDIQQQQNGNH

SEQ ID NO: 153269 - protein, 36 aa, Artificial Sequence
  Description of Artificial Sequence: Synthetic polypeptide
DEAEIRTTNPVATEQYGSVDVTTLGNVTREGSQQEY

SEQ ID NO: 153270 - protein, 34 aa, Artificial Sequence
  Description of Artificial Sequence: Synthetic polypeptide
DEAEIRTTNPVATEQYGSVCWWVDTTERLENNQE

SEQ ID NO: 153271 - protein, 35 aa, Artificial Sequence
  Description of Artificial Sequence: Synthetic polypeptide
DEAEIRTTNPVATEQYGSVCTPPCNETGMMEDMND

SEQ ID NO: 153272 - protein, 35 aa, Artificial Sequence
  Description of Artificial Sequence: Synthetic polypeptide
DEEEIRTTNPVATEQYGSVSVSPWICAQFEESIQD

SEQ ID NO: 153273 - protein, 32 aa, Artificial Sequence
  Description of Artificial Sequence: Synthetic polypeptide
DENEIRTTNPVSTEPYGTVSMEIIQQQQNENH

SEQ ID NO: 153274 - protein, 32 aa, Artificial Sequence
  Description of Artificial Sequence: Synthetic polypeptide
DENEIRTTNPVSTEPYGTVSMEIIQQQQNENA

SEQ ID NO: 153275 - protein, 32 aa, Artificial Sequence
  Description of Artificial Sequence: Synthetic polypeptide
DENEIRTTNPVSTEPYGTVSMEDIQQQQNNNH

SEQ ID NO: 153276 - protein, 33 aa, Artificial Sequence
  Description of Artificial Sequence: Synthetic polypeptide
DENEIRTTNPVSTEPYGTVSMEDIQQQQNGMNH

SEQ ID NO: 153277 - protein, 32 aa, Artificial Sequence
  Description of Artificial Sequence: Synthetic polypeptide
DENEIRTTNPVSTEPYGTVSMEDIQQQQNGDH

SEQ ID NO: 153278 - protein, 33 aa, Artificial Sequence
  Description of Artificial Sequence: Synthetic polypeptide
DEMEIVTTNPVATEQYGTVCSACDFPVEFEGND

SEQ ID NO: 153279 - protein, 32 aa, Artificial Sequence
  Description of Artificial Sequence: Synthetic polypeptide
DENEIRTTNPVSTEPYGTVSMEDIQQQQAGDH

SEQ ID NO: 153280 - protein, 33 aa, Artificial Sequence
  Description of Artificial Sequence: Synthetic polypeptide
DEMEIVTTNPVATEQYGTVCSACDGPPEFEGND

SEQ ID NO: 153281 - protein, 32 aa, Artificial Sequence
  Description of Artificial Sequence: Synthetic polypeptide
DENEIRTTNPVSTEPYGVIAMETLQQQQNGNH

SEQ ID NO: 153282 - protein, 33 aa, Artificial Sequence
  Description of Artificial Sequence: Synthetic polypeptide
DEMEIVTTNPVATEQYGTVCSAADGPVEFKGND

SEQ ID NO: 153283 - protein, 33 aa, Artificial Sequence
  Description of Artificial Sequence: Synthetic polypeptide
DEMEIVTTNPVATEQYGTVCSAADGPVEFEGNI

SEQ ID NO: 153284 - protein, 35 aa, Artificial Sequence
  Description of Artificial Sequence: Synthetic polypeptide
DEEEISTTNPVATEQYGCVCSNTGEDQYFNSDNQS

SEQ ID NO: 153285 - protein, 33 aa, Artificial Sequence
  Description of Artificial Sequence: Synthetic polypeptide
DEMEIVTTNPVATEQYGTVCQATDGKVEFEGND

SEQ ID NO: 153286 - protein, 33 aa, Artificial Sequence
  Description of Artificial Sequence: Synthetic polypeptide
DEMEIVTTNPVATEQYGTVCQATDGPVEFEGND

SEQ ID NO: 153287 - protein, 35 aa, Artificial Sequence
  Description of Artificial Sequence: Synthetic polypeptide
DEAEIRTTNPVATEQYGSVESNDVLLDTGSSDQEY

SEQ ID NO: 153288 - protein, 35 aa, Artificial Sequence
  Description of Artificial Sequence: Synthetic polypeptide
DEAEIRTTNPVATEQYGSVESGPNDSVGGIIEEGQ

SEQ ID NO: 153289 - protein, 32 aa, Artificial Sequence
  Description of Artificial Sequence: Synthetic polypeptide
DENEIRTTNPVSTEPYGVISMEDIQQQSNGNH

SEQ ID NO: 153290 - protein, 33 aa, Artificial Sequence
  Description of Artificial Sequence: Synthetic polypeptide
DEMEIVTTNPVATEQYGTVCQATDGPVKFEGND

SEQ ID NO: 153291 - protein, 35 aa, Artificial Sequence
  Description of Artificial Sequence: Synthetic polypeptide
DEEEISTTNPVATEQYGCVCSNTGEDPQHFGSDQD

SEQ ID NO: 153292 - protein, 33 aa, Artificial Sequence
  Description of Artificial Sequence: Synthetic polypeptide
DEMEIVTTNPVATEQYGTVCQATDGPVYFEGND

SEQ ID NO: 153293 - protein, 36 aa, Artificial Sequence
  Description of Artificial Sequence: Synthetic polypeptide
DEAEIRTTNPVATEQYGSVCTPPCLGETGYNEDMND

SEQ ID NO: 153294 - protein, 33 aa, Artificial Sequence
  Description of Artificial Sequence: Synthetic polypeptide
DEMEIVTTNPVATEQYGTVCQATSGPVEFYGND

SEQ ID NO: 153295 - protein, 32 aa, Artificial Sequence
  Description of Artificial Sequence: Synthetic polypeptide
DENEIRTTNPVSTEPYGVISMEDIQQQNNGNH

SEQ ID NO: 153296 - protein, 32 aa, Artificial Sequence
  Description of Artificial Sequence: Synthetic polypeptide
DENEIRTTNPVSTEPYGVISMEDEQQQQNGNH

SEQ ID NO: 153297 - protein, 33 aa, Artificial Sequence
  Description of Artificial Sequence: Synthetic polypeptide
DEMEIVTTNPVATEQYGTVCRATDGPVEFEGND

SEQ ID NO: 153298 - protein, 33 aa, Artificial Sequence
  Description of Artificial Sequence: Synthetic polypeptide
DEMEIVTTNPVATEQYGTVCRATDGPVESEGND

SEQ ID NO: 153299 - protein, 32 aa, Artificial Sequence
  Description of Artificial Sequence: Synthetic polypeptide
DENEIRTTNPVSTEPYGVISDEDIQQQSNGNH

SEQ ID NO: 153300 - protein, 34 aa, Artificial Sequence
  Description of Artificial Sequence: Synthetic polypeptide
DEAEIRTTNPVATEQYGSVEDTVSSTDRIDEIQN

SEQ ID NO: 153301 - protein, 33 aa, Artificial Sequence
  Description of Artificial Sequence: Synthetic polypeptide
DEMEIVTTNPVATEQYGTVCSAADGPEFEGNYD

SEQ ID NO: 153302 - protein, 33 aa, Artificial Sequence
  Description of Artificial Sequence: Synthetic polypeptide
DEMEIVTTNPVATEQYGTVCSAADGPVEFEGND

SEQ ID NO: 153303 - protein, 32 aa, Artificial Sequence
  Description of Artificial Sequence: Synthetic polypeptide
DENEIRTTNPVSTEPYGVISMEDIQQQQNGNH

SEQ ID NO: 153304 - protein, 32 aa, Artificial Sequence
  Description of Artificial Sequence: Synthetic polypeptide
DENEIRTTNPVSTEPYGTTSGEGGQQVQNGNH

SEQ ID NO: 153305 - protein, 35 aa, Artificial Sequence
  Description of Artificial Sequence: Synthetic polypeptide
DEAEIRTTNPVATEQYGSVCTPPCEETGYQEDMND

SEQ ID NO: 153306 - protein, 34 aa, Artificial Sequence
  Description of Artificial Sequence: Synthetic polypeptide
DEAEIRTTNPVATEQYGSVCTMDMTDVTIEQNSI

SEQ ID NO: 153307 - protein, 33 aa, Artificial Sequence
  Description of Artificial Sequence: Synthetic polypeptide
DEMEIVTTNPVATEQYGTVCSAFDGPVEFEGND

SEQ ID NO: 153308 - protein, 34 aa, Artificial Sequence
  Description of Artificial Sequence: Synthetic polypeptide
DEMEIVTTNPVATEQYGTVCSAFDGQPVEFEGND

SEQ ID NO: 153309 - protein, 33 aa, Artificial Sequence
  Description of Artificial Sequence: Synthetic polypeptide
DEMEIVTTNPVATEQYGTVCSAGDGHVEFEGND

SEQ ID NO: 153310 - protein, 32 aa, Artificial Sequence
  Description of Artificial Sequence: Synthetic polypeptide
DENEIRTTNPVSTEPYGTTSMEDPQQPQSGNH

SEQ ID NO: 153311 - protein, 33 aa, Artificial Sequence
  Description of Artificial Sequence: Synthetic polypeptide
DEMEIVTTNPVATEQYGTVCSAGDGPVEFEGND

SEQ ID NO: 153312 - protein, 32 aa, Artificial Sequence
  Description of Artificial Sequence: Synthetic polypeptide
DENEIRTTNPVSTEPYGTTSMEDIQQQQNGNH

SEQ ID NO: 153313 - protein, 32 aa, Artificial Sequence
  Description of Artificial Sequence: Synthetic polypeptide
DENEIRTTNPVSTEPYGTTSMEDIQQQQKGNH

SEQ ID NO: 153314 - protein, 32 aa, Artificial Sequence
  Description of Artificial Sequence: Synthetic polypeptide
DENEIRTTNPVSTEPYGTTSMEDIQQEQNGNS

SEQ ID NO: 153315 - protein, 32 aa, Artificial Sequence
  Description of Artificial Sequence: Synthetic polypeptide
DENEIRTTNPVSTEPYGTTSMEDIQQEQNGNH

SEQ ID NO: 153316 - protein, 32 aa, Artificial Sequence
  Description of Artificial Sequence: Synthetic polypeptide
DENEIRTTNPVSTEPYGTTSMEDIQQEPNGNH

SEQ ID NO: 153317 - protein, 33 aa, Artificial Sequence
  Description of Artificial Sequence: Synthetic polypeptide
DEMEIVTTNPVATEQYGTVCSAHDGPVEFEGND

SEQ ID NO: 153318 - protein, 32 aa, Artificial Sequence
  Description of Artificial Sequence: Synthetic polypeptide
DENEIRTTNPVSTEPYGTTSMEDIQAEPKGNH

SEQ ID NO: 153319 - protein, 33 aa, Artificial Sequence
  Description of Artificial Sequence: Synthetic polypeptide
DEMEIVTTNPVATEQYGTVCSAHDGPVEMEGND

SEQ ID NO: 153320 - protein, 32 aa, Artificial Sequence
  Description of Artificial Sequence: Synthetic polypeptide
DENEIRTTNPVSTEPYGTTSMEDGQQDQNGNH

SEQ ID NO: 153321 - protein, 33 aa, Artificial Sequence
  Description of Artificial Sequence: Synthetic polypeptide
DEMEIVTTNPVATEQYGTVCSAIDGPVEFEGND

SEQ ID NO: 153322 - protein, 33 aa, Artificial Sequence
  Description of Artificial Sequence: Synthetic polypeptide
DEMEIVTTNPVATEQYGTVCSAKDGPVEFEGND

SEQ ID NO: 153323 - protein, 32 aa, Artificial Sequence
  Description of Artificial Sequence: Synthetic polypeptide
DENEIRTTNPVSTEPYGTTSMEDGGQQTNGNH

SEQ ID NO: 153324 - protein, 33 aa, Artificial Sequence
  Description of Artificial Sequence: Synthetic polypeptide
DEMEIVTTNPVATEQYGTVCSAEDGPVQFEGED

SEQ ID NO: 153325 - protein, 32 aa, Artificial Sequence
  Description of Artificial Sequence: Synthetic polypeptide
DENEIRTTNPVSTEPYGTTSMEFIQQQQNGNH

SEQ ID NO: 153326 - protein, 33 aa, Artificial Sequence
  Description of Artificial Sequence: Synthetic polypeptide
DENEIRTTNPVSTEPYGTTSTMEDIQQQQNGNH

SEQ ID NO: 153327 - protein, 33 aa, Artificial Sequence
  Description of Artificial Sequence: Synthetic polypeptide
DENEIRTTNPVSTEPYGTTTSGEDNQQQQNGNH

SEQ ID NO: 153328 - protein, 32 aa, Artificial Sequence
  Description of Artificial Sequence: Synthetic polypeptide
DENEIRTTNPVSTEPYGTVSEEDIQQQQAGDH

SEQ ID NO: 153329 - protein, 36 aa, Artificial Sequence
  Description of Artificial Sequence: Synthetic polypeptide
DEAEIRTTNPVATEQYGSVCSVTWPILEDRFSHEGG

SEQ ID NO: 153330 - protein, 33 aa, Artificial Sequence
  Description of Artificial Sequence: Synthetic polypeptide
DEMEIVTTNPVATEQYGTVCSACDGPVEFEGND

SEQ ID NO: 153331 - protein, 33 aa, Artificial Sequence
  Description of Artificial Sequence: Synthetic polypeptide
DEAEIATTNPVAYEQWGTVCSTENDEHDGPNEQ

SEQ ID NO: 153332 - protein, 33 aa, Artificial Sequence
  Description of Artificial Sequence: Synthetic polypeptide
DENEIRTTNPVSTEPYGTVISMQDIQQQQNGNH

SEQ ID NO: 153333 - protein, 33 aa, Artificial Sequence
  Description of Artificial Sequence: Synthetic polypeptide
DENEIRTTNPVSTEPYGTVISMEDIQQQQNGNH

SEQ ID NO: 153334 - protein, 33 aa, Artificial Sequence
  Description of Artificial Sequence: Synthetic polypeptide
DENEIRTTNPVSTEPYGTVISMEDIQQAQNGNH

SEQ ID NO: 153335 - protein, 33 aa, Artificial Sequence
  Description of Artificial Sequence: Synthetic polypeptide
DENEIRTTNPVSTEPYGTVISMEDINQPQSGEH

SEQ ID NO: 153336 - protein, 35 aa, Artificial Sequence
  Description of Artificial Sequence: Synthetic polypeptide
DEAEIRTTNPVATEQYGSVCTPACHETGYMEDMND

SEQ ID NO: 153337 - protein, 33 aa, Artificial Sequence
  Description of Artificial Sequence: Synthetic polypeptide
DEMEIVTTNPVATEQYGTVCSADDGPVEFEGND

SEQ ID NO: 153338 - protein, 33 aa, Artificial Sequence
  Description of Artificial Sequence: Synthetic polypeptide
DEMEIVTTNPVATEQYGTVCSAEDCPVQFEGED

SEQ ID NO: 153339 - protein, 32 aa, Artificial Sequence
  Description of Artificial Sequence: Synthetic polypeptide
DENEIRTTNPVSTEPYGTVFMEDIQQQQNGNH

SEQ ID NO: 153340 - protein, 33 aa, Artificial Sequence
  Description of Artificial Sequence: Synthetic polypeptide
DENEIRTTNPVSTEPYGTVCSMWDVQQQQMGNH

SEQ ID NO: 153341 - protein, 33 aa, Artificial Sequence
  Description of Artificial Sequence: Synthetic polypeptide
DENEIRTTNPVSTEPYGTVCSMWDIQQQQNGNS

SEQ ID NO: 153342 - protein, 33 aa, Artificial Sequence
  Description of Artificial Sequence: Synthetic polypeptide
DENEIRTTNPVSTEPYGTVCSMEDIQQQQNGNH

SEQ ID NO: 153343 - protein, 33 aa, Artificial Sequence
  Description of Artificial Sequence: Synthetic polypeptide
DENEIRTTNPVSTEPYGTVCSGEDIQHQQNGNH

SEQ ID NO: 153344 - protein, 33 aa, Artificial Sequence
  Description of Artificial Sequence: Synthetic polypeptide
DEMEIVTTNPVATEQYGTVCSAEDGPVEFEGND

SEQ ID NO: 153345 - protein, 33 aa, Artificial Sequence
  Description of Artificial Sequence: Synthetic polypeptide
DEMEIVTTNPVATEQYGTVCSAEDGPVEFWGND

SEQ ID NO: 153346 - protein, 33 aa, Artificial Sequence
  Description of Artificial Sequence: Synthetic polypeptide
DEMEIVTTNPVATEQYGTVCSADDGPVEFMGND

SEQ ID NO: 153347 - protein, 34 aa, Artificial Sequence
  Description of Artificial Sequence: Synthetic polypeptide
DEMEIVTTNPVATEQYGTHVCSATDGPVEFEGNK

SEQ ID NO: 153348 - protein, 34 aa, Artificial Sequence
  Description of Artificial Sequence: Synthetic polypeptide
DEMEIVTTNPVATEQYGTHVCSATDGPVEFEGND

SEQ ID NO: 153349 - protein, 33 aa, Artificial Sequence
  Description of Artificial Sequence: Synthetic polypeptide
DEMEIVTTNPVATEQYGTHCSATDGPVEFEGNQ

SEQ ID NO: 153350 - protein, 33 aa, Artificial Sequence
  Description of Artificial Sequence: Synthetic polypeptide
DEMEIVTTNPVATECYGTVCSATDGPVEPEGND

SEQ ID NO: 153351 - protein, 33 aa, Artificial Sequence
  Description of Artificial Sequence: Synthetic polypeptide
DEMEIVTTNPVATECYGTVCSATQGPVEFEGND

SEQ ID NO: 153352 - protein, 33 aa, Artificial Sequence
  Description of Artificial Sequence: Synthetic polypeptide
DEMEIVTTNPVATECYGTVCSATSGPVEFEGND

SEQ ID NO: 153353 - protein, 36 aa, Artificial Sequence
  Description of Artificial Sequence: Synthetic polypeptide
DEAEIRTTNPVATEQYGSVIEPTWIWGQDEGEEHNM

SEQ ID NO: 153354 - protein, 35 aa, Artificial Sequence
  Description of Artificial Sequence: Synthetic polypeptide
DENEISTTNPVATEQYGSVSATGQGEDQEGEGDGD

SEQ ID NO: 153355 - protein, 33 aa, Artificial Sequence
  Description of Artificial Sequence: Synthetic polypeptide
DEMEIVTTNPVATEEYGTVCSATDGPVEFEGND

SEQ ID NO: 153356 - protein, 33 aa, Artificial Sequence
  Description of Artificial Sequence: Synthetic polypeptide
DEMEIVTTNPVATEEYGTVCSATDGPVEFEGNV

SEQ ID NO: 153357 - protein, 33 aa, Artificial Sequence
  Description of Artificial Sequence: Synthetic polypeptide
DEMEIVTTNPVATEEYGTVCSWTDGPVEFEGND

SEQ ID NO: 153358 - protein, 33 aa, Artificial Sequence
  Description of Artificial Sequence: Synthetic polypeptide
DEMEIVTTNPVATEFYGTVCSATDGPVEFEGND

SEQ ID NO: 153359 - protein, 34 aa, Artificial Sequence
  Description of Artificial Sequence: Synthetic polypeptide
DEEEISTTNPVATEGYGCVCSWGEHQHFGSENQS

SEQ ID NO: 153360 - protein, 33 aa, Artificial Sequence
  Description of Artificial Sequence: Synthetic polypeptide
DEMEIVTTNPVATEFYGTVCSATPGPVEFEGND

SEQ ID NO: 153361 - protein, 39 aa, Artificial Sequence
  Description of Artificial Sequence: Synthetic polypeptide
DEEEIRTTNPVATEQYGTVSTVNLQQNATEQGTNQETTE

SEQ ID NO: 153362 - protein, 39 aa, Artificial Sequence
  Description of Artificial Sequence: Synthetic polypeptide
DEEEIRTTNPVATEQYGTVSTVNLQQNATEQGTNNQTQE

SEQ ID NO: 153363 - protein, 38 aa, Artificial Sequence
  Description of Artificial Sequence: Synthetic polypeptide
DEEEIRTTNPVATEQYGVVSTVVNQQNGNQQGGNNEDE

SEQ ID NO: 153364 - protein, 37 aa, Artificial Sequence
  Description of Artificial Sequence: Synthetic polypeptide
DEEEIRTTNPVATEQYGVVSTVVNQQNNQNDEEEEED

SEQ ID NO: 153365 - protein, 30 aa, Artificial Sequence
  Description of Artificial Sequence: Synthetic polypeptide
DEMEIVTTNPVATEGYGTMCATDTPEFGDD

SEQ ID NO: 153366 - protein, 39 aa, Artificial Sequence
  Description of Artificial Sequence: Synthetic polypeptide
DEEEIRTTNPVATEQYGTVSTVNLQQGATEQGTNNATTE

SEQ ID NO: 153367 - protein, 34 aa, Artificial Sequence
  Description of Artificial Sequence: Synthetic polypeptide
DEMEIVTTNPVATECYGTVCSATDGPVEFEGNRF

SEQ ID NO: 153368 - protein, 33 aa, Artificial Sequence
  Description of Artificial Sequence: Synthetic polypeptide
DEMEIVTTNPVATECYGTVCSATDGPVEFEGNG

SEQ ID NO: 153369 - protein, 33 aa, Artificial Sequence
  Description of Artificial Sequence: Synthetic polypeptide
DEMEIVTTNPVATECYGTVCSATDGPVEFEGND

SEQ ID NO: 153370 - protein, 33 aa, Artificial Sequence
  Description of Artificial Sequence: Synthetic polypeptide
DEEEISTTNPVATEGYGCVCSTPHAENFNSEQS

SEQ ID NO: 153371 - protein, 33 aa, Artificial Sequence
  Description of Artificial Sequence: Synthetic polypeptide
DEMEIVTTNPVATEAYGTVCSATDGPDEFEGND

SEQ ID NO: 153372 - protein, 33 aa, Artificial Sequence
  Description of Artificial Sequence: Synthetic polypeptide
DEMEIVTTNPVATEAYGTVCSATDGPVEFAGND

SEQ ID NO: 153373 - protein, 33 aa, Artificial Sequence
  Description of Artificial Sequence: Synthetic polypeptide
DEMEIVTTNPVATEAYGTVCSATDGPVEFEGND

SEQ ID NO: 153374 - protein, 33 aa, Artificial Sequence
  Description of Artificial Sequence: Synthetic polypeptide
DEMEIVTTNPVATECWGSVSCDNEPEDFEGENG

SEQ ID NO: 153375 - protein, 37 aa, Artificial Sequence
  Description of Artificial Sequence: Synthetic polypeptide
DEEEIRTTNPVATEQYGVVSTVVNQQGNQNATNVATE

SEQ ID NO: 153376 - protein, 34 aa, Artificial Sequence
  Description of Artificial Sequence: Synthetic polypeptide
DEMEIVTTNPVATECWGTVCSATINPVQFEGENG

SEQ ID NO: 153377 - protein, 33 aa, Artificial Sequence
  Description of Artificial Sequence: Synthetic polypeptide
DEMEIVTTNPVATECWGTVCSCINEPQFEGENG

SEQ ID NO: 153378 - protein, 33 aa, Artificial Sequence
  Description of Artificial Sequence: Synthetic polypeptide
DEMEIVTTNPVATECWGTVCSCINPPQFEGENG

SEQ ID NO: 153379 - protein, 34 aa, Artificial Sequence
  Description of Artificial Sequence: Synthetic polypeptide
DEEEISTTNPVATEIYGCVCSTEEHNQNFGSDQS

SEQ ID NO: 153380 - protein, 33 aa, Artificial Sequence
  Description of Artificial Sequence: Synthetic polypeptide
DEMEIVTTNPVATECWGTVSACINPVQFEGENG

SEQ ID NO: 153381 - protein, 32 aa, Artificial Sequence
  Description of Artificial Sequence: Synthetic polypeptide
DEMEIVTTNPVATECYGDVCSATDCPVEFGED

SEQ ID NO: 153382 - protein, 33 aa, Artificial Sequence
  Description of Artificial Sequence: Synthetic polypeptide
DEMEIVTTNPVATECYGDVCSATDGPVEFEGND

SEQ ID NO: 153383 - protein, 35 aa, Artificial Sequence
  Description of Artificial Sequence: Synthetic polypeptide
DEEEISTTNPVATEGYGCVCSTEDLFQENFGSEFS

SEQ ID NO: 153384 - protein, 37 aa, Artificial Sequence
  Description of Artificial Sequence: Synthetic polypeptide
DEEEIRTTNPVAYEQYGKTVCSCTNMFTTRTGDNELF

SEQ ID NO: 153385 - protein, 35 aa, Artificial Sequence
  Description of Artificial Sequence: Synthetic polypeptide
DEEEIRTTNPVAYEQYGKTMSCTNAFTNTGDNELC

SEQ ID NO: 153386 - protein, 33 aa, Artificial Sequence
  Description of Artificial Sequence: Synthetic polypeptide
DEMEIVTTNPVATECYGTVCSAEDGPVQFEGND

SEQ ID NO: 153387 - protein, 33 aa, Artificial Sequence
  Description of Artificial Sequence: Synthetic polypeptide
DEMEIVTTNPVATECYGTVCSATDDPVEFEGND

SEQ ID NO: 153388 - protein, 33 aa, Artificial Sequence
  Description of Artificial Sequence: Synthetic polypeptide
DEMEIVTTNPVATECYGTVCSATDDPVEFKGND

SEQ ID NO: 153389 - protein, 32 aa, Artificial Sequence
  Description of Artificial Sequence: Synthetic polypeptide
DEMEIVTTNPVATECYGDVCSAEDGPVQHENL

SEQ ID NO: 153390 - protein, 33 aa, Artificial Sequence
  Description of Artificial Sequence: Synthetic polypeptide
DEMEIVTTNPVATDQYGTVCSATDGPVENEGND

SEQ ID NO: 153391 - protein, 33 aa, Artificial Sequence
  Description of Artificial Sequence: Synthetic polypeptide
DEMEIVTTNPVATEGYGTVCSATDGPVEFDGND

SEQ ID NO: 153392 - protein, 34 aa, Artificial Sequence
  Description of Artificial Sequence: Synthetic polypeptide
DEEEIRTTNPVAYEQYGITTPSTAGHSNWGGNNM

SEQ ID NO: 153393 - protein, 34 aa, Artificial Sequence
  Description of Artificial Sequence: Synthetic polypeptide
DEEEISTTNPVATEQYGCIVCSTMEHTNFNSEQS

SEQ ID NO: 153394 - protein, 34 aa, Artificial Sequence
  Description of Artificial Sequence: Synthetic polypeptide
DEMEIVTTNPVATEPYGTVCSATDDPVEQFEGND

SEQ ID NO: 153395 - protein, 34 aa, Artificial Sequence
  Description of Artificial Sequence: Synthetic polypeptide
DEMEIVTTNPVATEPYGTVCSATDDPVEQQEGND

SEQ ID NO: 153396 - protein, 33 aa, Artificial Sequence
  Description of Artificial Sequence: Synthetic polypeptide
DEMEIVTTNPVATEPYGTVCSATDGPVEFEGND

SEQ ID NO: 153397 - protein, 36 aa, Artificial Sequence
  Description of Artificial Sequence: Synthetic polypeptide
DEEEISTTNPVATEQYGCQVCSNTGELQENFGSEQS

SEQ ID NO: 153398 - protein, 34 aa, Artificial Sequence
  Description of Artificial Sequence: Synthetic polypeptide
DEMEIVTTNPVATEPYGTVCSATDGPVEQFEGND

SEQ ID NO: 153399 - protein, 35 aa, Artificial Sequence
  Description of Artificial Sequence: Synthetic polypeptide
DEEEISTTNPVATEQYGCQVCSSGEHQENFGSNQS

SEQ ID NO: 153400 - protein, 34 aa, Artificial Sequence
  Description of Artificial Sequence: Synthetic polypeptide
DEMEIVTTNPVATEPYGTVCSATEDIVEQQNGND

SEQ ID NO: 153401 - protein, 34 aa, Artificial Sequence
  Description of Artificial Sequence: Synthetic polypeptide
DEMEIVTTNPVATEPYGTVCSATEDPVEQQEGND

SEQ ID NO: 153402 - protein, 34 aa, Artificial Sequence
  Description of Artificial Sequence: Synthetic polypeptide
DEMEIVTTNPVATEPYGTVCSATEDPVEQQNGND

SEQ ID NO: 153403 - protein, 30 aa, Artificial Sequence
  Description of Artificial Sequence: Synthetic polypeptide
DENEISTTNPVATEQWGDVSEVEANAAEDA

SEQ ID NO: 153404 - protein, 33 aa, Artificial Sequence
  Description of Artificial Sequence: Synthetic polypeptide
DEMEIVTTNPVATEQFGTVCSATDGPVEFEGND

SEQ ID NO: 153405 - protein, 31 aa, Artificial Sequence
  Description of Artificial Sequence: Synthetic polypeptide
DENEISTTNPVATEQWGDVSEIEMNAAEDAG

SEQ ID NO: 153406 - protein, 30 aa, Artificial Sequence
  Description of Artificial Sequence: Synthetic polypeptide
DENEISTTNPVATEQWGDVSEIEMNAAEDA

SEQ ID NO: 153407 - protein, 33 aa, Artificial Sequence
  Description of Artificial Sequence: Synthetic polypeptide
DEMEIVTTNPVATEQFGWVCSATDGPVEFEGND

SEQ ID NO: 153408 - protein, 30 aa, Artificial Sequence
  Description of Artificial Sequence: Synthetic polypeptide
DEMEIVTTNPVATEQWGDVSEIEMNAAEDA

SEQ ID NO: 153409 - protein, 34 aa, Artificial Sequence
  Description of Artificial Sequence: Synthetic polypeptide
DEMEIVTTNPVATEQWGSVCSCIGPVQDFEGENG

SEQ ID NO: 153410 - protein, 34 aa, Artificial Sequence
  Description of Artificial Sequence: Synthetic polypeptide
DEEEISTTNPVATEQYGCIVCSTGAHTNFNSEQA

SEQ ID NO: 153411 - protein, 34 aa, Artificial Sequence
  Description of Artificial Sequence: Synthetic polypeptide
DEEEISTTNPVATEQYGCIVCSTEHTEHFNSEQA

SEQ ID NO: 153412 - protein, 32 aa, Artificial Sequence
  Description of Artificial Sequence: Synthetic polypeptide
DEMEIVTTNPVATEPYGTISMEDIQQQQNGNH

SEQ ID NO: 153413 - protein, 32 aa, Artificial Sequence
  Description of Artificial Sequence: Synthetic polypeptide
DEMEIVTTNPVATEPYGTISMEDIQQQQEGNH

SEQ ID NO: 153414 - protein, 33 aa, Artificial Sequence
  Description of Artificial Sequence: Synthetic polypeptide
DEMEIVTTNPVATEGYGTVCSATDGPVHFEGND

SEQ ID NO: 153415 - protein, 34 aa, Artificial Sequence
  Description of Artificial Sequence: Synthetic polypeptide
DEMEIVTTNPVATEGYGTVCSTTGEPNEFFGSND

SEQ ID NO: 153416 - protein, 33 aa, Artificial Sequence
  Description of Artificial Sequence: Synthetic polypeptide
DEMEIVTTNPVATEHYGTVCSATAGPVEFEGND

SEQ ID NO: 153417 - protein, 33 aa, Artificial Sequence
  Description of Artificial Sequence: Synthetic polypeptide
DEMEIVTTNPVATEHYGTVCSATDGPVEFEGND

SEQ ID NO: 153418 - protein, 33 aa, Artificial Sequence
  Description of Artificial Sequence: Synthetic polypeptide
DEMEIVTTNPVATEIYGTVCSATDGPVEFEGND

SEQ ID NO: 153419 - protein, 33 aa, Artificial Sequence
  Description of Artificial Sequence: Synthetic polypeptide
DEMEIVTTNPVATEIYGTVCSATDGPVEFKGND

SEQ ID NO: 153420 - protein, 33 aa, Artificial Sequence
  Description of Artificial Sequence: Synthetic polypeptide
DEMEIVTTNPVATEIYGTVCSATDGPVEMEGND

SEQ ID NO: 153421 - protein, 33 aa, Artificial Sequence
  Description of Artificial Sequence: Synthetic polypeptide
DEMEIVTTNPVATEIYGTVCSATDGPWEFEGND

SEQ ID NO: 153422 - protein, 33 aa, Artificial Sequence
  Description of Artificial Sequence: Synthetic polypeptide
DEMEIVTTNPVATEGYGTVCSATDGPVEFEGND

SEQ ID NO: 153423 - protein, 33 aa, Artificial Sequence
  Description of Artificial Sequence: Synthetic polypeptide
DEMEIVTTNPVATEKYGTVCSATDGPVEFEGND

SEQ ID NO: 153424 - protein, 33 aa, Artificial Sequence
  Description of Artificial Sequence: Synthetic polypeptide
DEMEIVTTNPVATELYGTVCSATDGPVEFEGND

SEQ ID NO: 153425 - protein, 33 aa, Artificial Sequence
  Description of Artificial Sequence: Synthetic polypeptide
DEMEIVTTNPVATELYGTVCSATDGPVEFEGNP

SEQ ID NO: 153426 - protein, 35 aa, Artificial Sequence
  Description of Artificial Sequence: Synthetic polypeptide
DEEEISTTNPVATEQYGCAVCSTWGEHQNFGSDQS

SEQ ID NO: 153427 - protein, 33 aa, Artificial Sequence
  Description of Artificial Sequence: Synthetic polypeptide
DEMEIVTTNPVATEMYGTVCSATDGPVEFEGND

SEQ ID NO: 153428 - protein, 33 aa, Artificial Sequence
  Description of Artificial Sequence: Synthetic polypeptide
DEMEIVTTNPVATEMYGTVCSGTDGPVEFEGND

SEQ ID NO: 153429 - protein, 33 aa, Artificial Sequence
  Description of Artificial Sequence: Synthetic polypeptide
DEMEIVTTNPVATENYGTVCSATDGPVEFEGND

SEQ ID NO: 153430 - protein, 33 aa, Artificial Sequence
  Description of Artificial Sequence: Synthetic polypeptide
DEMEIVTTNPVATENYGTVCSATDGPVEIEGND

SEQ ID NO: 153431 - protein, 33 aa, Artificial Sequence
  Description of Artificial Sequence: Synthetic polypeptide
DEMEIVTTNPVATENYGTVCSATDGPVWFEGND

SEQ ID NO: 153432 - protein, 33 aa, Artificial Sequence
  Description of Artificial Sequence: Synthetic polypeptide
DEMEIVTTNPVATEKYGTVCSATDGWVEFEGND

SEQ ID NO: 153433 - protein, 31 aa, Artificial Sequence
  Description of Artificial Sequence: Synthetic polypeptide
DENEISTTNPVATEQWGCVSSAEMNAFNSDA

SEQ ID NO: 153434 - protein, 36 aa, Artificial Sequence
  Description of Artificial Sequence: Synthetic polypeptide
DEEEIRTTNPVAYEQYGKTVSCCANMFTRTGANELF

SEQ ID NO: 153435 - protein, 33 aa, Artificial Sequence
  Description of Artificial Sequence: Synthetic polypeptide
DEMEIVTTNPVATDQYGTVCSATDGPVEFEGND

SEQ ID NO: 153436 - protein, 33 aa, Artificial Sequence
  Description of Artificial Sequence: Synthetic polypeptide
DEMEIVTTNPIATEQYGTVCSATDGPVEFEGND

SEQ ID NO: 153437 - protein, 33 aa, Artificial Sequence
  Description of Artificial Sequence: Synthetic polypeptide
DEMEIVTTNPIATEQYGTVCSATDGPVEFVGND

SEQ ID NO: 153438 - protein, 30 aa, Artificial Sequence
  Description of Artificial Sequence: Synthetic polypeptide
DENEIVTTNPVATEQWGDVSEIEWNAAEDA

SEQ ID NO: 153439 - protein, 30 aa, Artificial Sequence
  Description of Artificial Sequence: Synthetic polypeptide
DENEIVTTNPVATEQWGDVSEIEMNAAEDA

SEQ ID NO: 153440 - protein, 30 aa, Artificial Sequence
  Description of Artificial Sequence: Synthetic polypeptide
DENEIVTTNPVATEQWGDVSEGEVMAAEDA

SEQ ID NO: 153441 - protein, 32 aa, Artificial Sequence
  Description of Artificial Sequence: Synthetic polypeptide
DENEIVTTNPVATEQWGDVCSEDGPVMFAGND

SEQ ID NO: 153442 - protein, 33 aa, Artificial Sequence
  Description of Artificial Sequence: Synthetic polypeptide
DEMEIVTTNPIATEQYGTVCSATPGPVEFEGND

SEQ ID NO: 153443 - protein, 37 aa, Artificial Sequence
  Description of Artificial Sequence: Synthetic polypeptide
DEEEIRTTNPVATEQYGSVSVNVATEQYGSTQQQQQD

SEQ ID NO: 153444 - protein, 32 aa, Artificial Sequence
  Description of Artificial Sequence: Synthetic polypeptide
DENEIVTTNPVATEPYGTISMEDIQQQQNGNH

SEQ ID NO: 153445 - protein, 36 aa, Artificial Sequence
  Description of Artificial Sequence: Synthetic polypeptide
DEAEIRTTNPVATEQYGSVISGWNSLEFGEFEQQVP

SEQ ID NO: 153446 - protein, 39 aa, Artificial Sequence
  Description of Artificial Sequence: Synthetic polypeptide
DEEEIRTTNPVATEQYGTVSTVNLQQSATETGTNNQTEE

SEQ ID NO: 153447 - protein, 31 aa, Artificial Sequence
  Description of Artificial Sequence: Synthetic polypeptide
DDSEVACTNPVSTEGYGNVSANTIQSRVGQR

SEQ ID NO: 153448 - protein, 33 aa, Artificial Sequence
  Description of Artificial Sequence: Synthetic polypeptide
DDECIRTTNPVATEQYGCVCSWEEHQNFGSDQS

SEQ ID NO: 153449 - protein, 39 aa, Artificial Sequence
  Description of Artificial Sequence: Synthetic polypeptide
DEEEIRTTNPVATEQYGTVSTVNLQQSATEQGTTNQQTE

SEQ ID NO: 153450 - protein, 32 aa, Artificial Sequence
  Description of Artificial Sequence: Synthetic polypeptide
DENEIVTTNPVATECYGTVCSAEDCPVQFGED

SEQ ID NO: 153451 - protein, 35 aa, Artificial Sequence
  Description of Artificial Sequence: Synthetic polypeptide
DEAEIRTTNPVATEQYGSVISDWWDLLEISNQIQE

SEQ ID NO: 153452 - protein, 39 aa, Artificial Sequence
  Description of Artificial Sequence: Synthetic polypeptide
DEEEIRTTNPVATEQYGTVSTVNLQQSATEEGTNEETTE

SEQ ID NO: 153453 - protein, 33 aa, Artificial Sequence
  Description of Artificial Sequence: Synthetic polypeptide
DEMEIVTTNPIATEQYGTVCSATDGPTEFEGND

SEQ ID NO: 153454 - protein, 33 aa, Artificial Sequence
  Description of Artificial Sequence: Synthetic polypeptide
DEMEIVTTNPIATEQYGTVCSATDGPAEFEGND

SEQ ID NO: 153455 - protein, 36 aa, Artificial Sequence
  Description of Artificial Sequence: Synthetic polypeptide
DEHEIRTTNPVATEGYGSVSSTTPAGPNMRNGMNPV

SEQ ID NO: 153456 - protein, 38 aa, Artificial Sequence
  Description of Artificial Sequence: Synthetic polypeptide
DEEEIRTTNPVATEQYGVVSTVVNQQAGNQAATNVATE

SEQ ID NO: 153457 - protein, 34 aa, Artificial Sequence
  Description of Artificial Sequence: Synthetic polypeptide
DENEIVTTNPVATEQYGTVCSATDGEVENFAGND

SEQ ID NO: 153458 - protein, 36 aa, Artificial Sequence
  Description of Artificial Sequence: Synthetic polypeptide
DEAEIRTTNPVATEQYGSVNEDNMLDFTGFNEGTID

SEQ ID NO: 153459 - protein, 34 aa, Artificial Sequence
  Description of Artificial Sequence: Synthetic polypeptide
DENEIVTTNPVATEQYGTVCSAMDDPQEQFEGND

SEQ ID NO: 153460 - protein, 36 aa, Artificial Sequence
  Description of Artificial Sequence: Synthetic polypeptide
DEEEIRTTNPVAYEQYGKTVSCQNMFETRTGDNELF

SEQ ID NO: 153461 - protein, 38 aa, Artificial Sequence
  Description of Artificial Sequence: Synthetic polypeptide
DEEEIRTTNPVATEQYGVVSTVVNQNNQQGTNQEDEDE

SEQ ID NO: 153462 - protein, 36 aa, Artificial Sequence
  Description of Artificial Sequence: Synthetic polypeptide
DEAEIRTTNPVATEQYGSVMVTAANQDTGYSEEIER

SEQ ID NO: 153463 - protein, 35 aa, Artificial Sequence
  Description of Artificial Sequence: Synthetic polypeptide
DEAEIRTTNPVATEQYGSVMDTTGMMAENGEGNQE

SEQ ID NO: 153464 - protein, 35 aa, Artificial Sequence
  Description of Artificial Sequence: Synthetic polypeptide
DEAEIRTTNPVATEQYGSVLVVTAEVESRQQEDRI

SEQ ID NO: 153465 - protein, 33 aa, Artificial Sequence
  Description of Artificial Sequence: Synthetic polypeptide
DEMEIVTTNPLATEQYGTVCSATDGPVEFHGND

SEQ ID NO: 153466 - protein, 35 aa, Artificial Sequence
  Description of Artificial Sequence: Synthetic polypeptide
DEAEIRTTNPVATEQYGSVLDWTAEVESRPQEDRI

SEQ ID NO: 153467 - protein, 35 aa, Artificial Sequence
  Description of Artificial Sequence: Synthetic polypeptide
DEAEIRTTNPVATEQYGSVLDQTAEVESIQQEDRI

SEQ ID NO: 153468 - protein, 33 aa, Artificial Sequence
  Description of Artificial Sequence: Synthetic polypeptide
DENEIVTTNPVATEQYGDVCSATIPVMNAEEND

SEQ ID NO: 153469 - protein, 33 aa, Artificial Sequence
  Description of Artificial Sequence: Synthetic polypeptide
DENEIVTTNPVATEQYGDVCSATDGPVEFEEND

SEQ ID NO: 153470 - protein, 33 aa, Artificial Sequence
  Description of Artificial Sequence: Synthetic polypeptide
DENEIVTTNPVATEQYGDVCSAEDGPVEFAGND

SEQ ID NO: 153471 - protein, 34 aa, Artificial Sequence
  Description of Artificial Sequence: Synthetic polypeptide
DEAEIRTTNPVATEQYGSVIWPWQVEQGFGSIIE

SEQ ID NO: 153472 - protein, 37 aa, Artificial Sequence
  Description of Artificial Sequence: Synthetic polypeptide
DEEEIRTTNPVATEQYGVVSTVVNQNQQQGEEEEEEQ

SEQ ID NO: 153473 - protein, 38 aa, Artificial Sequence
  Description of Artificial Sequence: Synthetic polypeptide
DEEEIRTTNPVATEQYGVVSTVVNQNQQQGTTEQGNTE

SEQ ID NO: 153474 - protein, 35 aa, Artificial Sequence
  Description of Artificial Sequence: Synthetic polypeptide
DEAEIRTTNPVATEQYGSVISVSCSNEFGFESNQH

SEQ ID NO: 153475 - protein, 34 aa, Artificial Sequence
  Description of Artificial Sequence: Synthetic polypeptide
DEAEIRTTNPVATEQYGSVLDTAEVESRQQEDPQ

SEQ ID NO: 153476 - protein, 33 aa, Artificial Sequence
  Description of Artificial Sequence: Synthetic polypeptide
DEEEISTTNPVATEGYGCVCSNTGEHQNNSDQI

SEQ ID NO: 153477 - protein, 34 aa, Artificial Sequence
  Description of Artificial Sequence: Synthetic polypeptide
CEEEIRTTNPVATEQYGCVCSWGEHQNFNSDPDS

SEQ ID NO: 153478 - protein, 36 aa, Artificial Sequence
  Description of Artificial Sequence: Synthetic polypeptide
DEAEIRTTNPVATEQYGSVISDTYLVLEMGVQQDEY

SEQ ID NO: 153479 - protein, 33 aa, Artificial Sequence
  Description of Artificial Sequence: Synthetic polypeptide
DEMEIVTTNPVAIEQYGTVCSATDGPVEFEGND

SEQ ID NO: 153480 - protein, 33 aa, Artificial Sequence
  Description of Artificial Sequence: Synthetic polypeptide
DEMEIVTTNPVALEQYGTVCSATDGPVEFEGND

SEQ ID NO: 153481 - protein, 31 aa, Artificial Sequence
  Description of Artificial Sequence: Synthetic polypeptide
DENEISTTNPVAYEQWGTVSKEIETNQAEDA

SEQ ID NO: 153482 - protein, 33 aa, Artificial Sequence
  Description of Artificial Sequence: Synthetic polypeptide
DEMEIVTTNPVAMEQYGTVCSATDGPVEFEGND

SEQ ID NO: 153483 - protein, 33 aa, Artificial Sequence
  Description of Artificial Sequence: Synthetic polypeptide
DEMEIVTTNPVAMEQYGTVCSATDGPVEFEGNM

SEQ ID NO: 153484 - protein, 33 aa, Artificial Sequence
  Description of Artificial Sequence: Synthetic polypeptide
DEMEIVTTNPVASEQYGTVCSATDGPTEFEGND

SEQ ID NO: 153485 - protein, 33 aa, Artificial Sequence
  Description of Artificial Sequence: Synthetic polypeptide
DEMEIVTTNPVASEQYGTVCSATDGPVEFEGND

SEQ ID NO: 153486 - protein, 32 aa, Artificial Sequence
  Description of Artificial Sequence: Synthetic polypeptide
DDECIRTTNPVATEQYGCVCSWEHQNFISDLS

SEQ ID NO: 153487 - protein, 33 aa, Artificial Sequence
  Description of Artificial Sequence: Synthetic polypeptide
DEMEIVTTNPVASEQYGTVCSATDGPVESEGND

SEQ ID NO: 153488 - protein, 39 aa, Artificial Sequence
  Description of Artificial Sequence: Synthetic polypeptide
DEEEIRTTNPVATEQYGTVSTVNLQQNATETGTNNTTTE

SEQ ID NO: 153489 - protein, 33 aa, Artificial Sequence
  Description of Artificial Sequence: Synthetic polypeptide
DEMEIVTTNPVATAQYGTVCSATDGHVEFEGND

SEQ ID NO: 153490 - protein, 33 aa, Artificial Sequence
  Description of Artificial Sequence: Synthetic polypeptide
DEMEIVTTNPVATAQYGTVCSATDGPVEFEGND

SEQ ID NO: 153491 - protein, 33 aa, Artificial Sequence
  Description of Artificial Sequence: Synthetic polypeptide
DEEEISTTNPVATEGYGCVCSNTEHINFGSDQI

SEQ ID NO: 153492 - protein, 33 aa, Artificial Sequence
  Description of Artificial Sequence: Synthetic polypeptide
DEMEIVTTNPVATAQYGTVCSLTDGPVEFEGND

SEQ ID NO: 153493 - protein, 35 aa, Artificial Sequence
  Description of Artificial Sequence: Synthetic polypeptide
DEEEIRTTNPVAYEQYGKTVSCCNMFTKTGDNQLF

SEQ ID NO: 153494 - protein, 36 aa, Artificial Sequence
  Description of Artificial Sequence: Synthetic polypeptide
DEEEIRTTNPVAYEQYGKTVSCCNMFTIRTGDNQSF

SEQ ID NO: 153495 - protein, 33 aa, Artificial Sequence
  Description of Artificial Sequence: Synthetic polypeptide
DEMEIVTTNPVATCQYGTVCSATDGPVEFEGND

SEQ ID NO: 153496 - protein, 36 aa, Artificial Sequence
  Description of Artificial Sequence: Synthetic polypeptide
DEEEIRTTNPVAYEQYGKTVSCCNMPAIRTGDNNLF

SEQ ID NO: 153497 - protein, 33 aa, Artificial Sequence
  Description of Artificial Sequence: Synthetic polypeptide
DEMEIVTTNPVAHEQYGTVCSATDGPVEFEGND

SEQ ID NO: 153498 - protein, 33 aa, Artificial Sequence
  Description of Artificial Sequence: Synthetic polypeptide
DEMEIVTTNPVAGEQYGTVCSATDPPVEFEGND

SEQ ID NO: 153499 - protein, 33 aa, Artificial Sequence
  Description of Artificial Sequence: Synthetic polypeptide
DEMEIVTTNPVAGEQYGTVCSATDGPVTFEGND

SEQ ID NO: 153500 - protein, 35 aa, Artificial Sequence
  Description of Artificial Sequence: Synthetic polypeptide
DEAEIRTTNPVATEQYGSVIHSTINWNTVADEEQN

SEQ ID NO: 153501 - protein, 32 aa, Artificial Sequence
  Description of Artificial Sequence: Synthetic polypeptide
DENEITTTNPVSTEPYGTISMSDIQVQMNGNH

SEQ ID NO: 153502 - protein, 33 aa, Artificial Sequence
  Description of Artificial Sequence: Synthetic polypeptide
DEMEIVTTNPTATEQYGTVCSATDGPVEFEGND

SEQ ID NO: 153503 - protein, 30 aa, Artificial Sequence
  Description of Artificial Sequence: Synthetic polypeptide
DENEITTTNPVATEQWGDVSNIEMNAAEDA

SEQ ID NO: 153504 - protein, 30 aa, Artificial Sequence
  Description of Artificial Sequence: Synthetic polypeptide
DENEITTTNPVATEQWGDVSEIEMNAAEDA

SEQ ID NO: 153505 - protein, 33 aa, Artificial Sequence
  Description of Artificial Sequence: Synthetic polypeptide
DEMEIVTTNPTATEQYGTVNSATDGPVEFEGND

SEQ ID NO: 153506 - protein, 33 aa, Artificial Sequence
  Description of Artificial Sequence: Synthetic polypeptide
DEMEIVTTNPVACEQYGTVCSATDGPVEFEGND

SEQ ID NO: 153507 - protein, 33 aa, Artificial Sequence
  Description of Artificial Sequence: Synthetic polypeptide
DEMEIVTTNPVACEQYGTVCSATDRPVEFEGND

SEQ ID NO: 153508 - protein, 34 aa, Artificial Sequence
  Description of Artificial Sequence: Synthetic polypeptide
CEEEIRTTNPVATEQYGCVCSWGEHQSFQSDNQS

SEQ ID NO: 153509 - protein, 33 aa, Artificial Sequence
  Description of Artificial Sequence: Synthetic polypeptide
DEMEIVTTNPVACEQYGTVCSATGGPVEFEGND

SEQ ID NO: 153510 - protein, 38 aa, Artificial Sequence
  Description of Artificial Sequence: Synthetic polypeptide
DEEEIRTTNPVATEQYGVVSTVVNQQAGTEQGTNQQQD

SEQ ID NO: 153511 - protein, 32 aa, Artificial Sequence
  Description of Artificial Sequence: Synthetic polypeptide
DENEISTTNPVSTEPYGTISTEDIQQQQNGNH

SEQ ID NO: 153512 - protein, 37 aa, Artificial Sequence
  Description of Artificial Sequence: Synthetic polypeptide
DEEEIRTTNPVATEQYGVVSTVVNQQGNLQQNTEQGS

SEQ ID NO: 153513 - protein, 33 aa, Artificial Sequence
  Description of Artificial Sequence: Synthetic polypeptide
DEMEIVTTNPVAFEQYGTVCSATDGPVEFEGND

SEQ ID NO: 153514 - protein, 33 aa, Artificial Sequence
  Description of Artificial Sequence: Synthetic polypeptide
DEMEIVTTNPVAFEQYGTVQSATDVPVEFEGND

SEQ ID NO: 153515 - protein, 34 aa, Artificial Sequence
  Description of Artificial Sequence: Synthetic polypeptide
DEMEIVTTNPVAGEQYGTVCSATDGNPVEFEGND

SEQ ID NO: 153516 - protein, 33 aa, Artificial Sequence
  Description of Artificial Sequence: Synthetic polypeptide
DEMEIVTTNPVAGEQYGTVCSATDGPVECEGND

SEQ ID NO: 153517 - protein, 33 aa, Artificial Sequence
  Description of Artificial Sequence: Synthetic polypeptide
DEMEIVTTNPVAGEQYGTVCSATDGPVEFEGND

SEQ ID NO: 153518 - protein, 33 aa, Artificial Sequence
  Description of Artificial Sequence: Synthetic polypeptide
DEMEIVTTNPVACEQYGTVCSHTDGPVEFEGND

SEQ ID NO: 153519 - protein, 33 aa, Artificial Sequence
  Description of Artificial Sequence: Synthetic polypeptide
DEMEIVTTNPVATEQWGTVCSATDGPVEFCGND

SEQ ID NO: 153520 - protein, 33 aa, Artificial Sequence
  Description of Artificial Sequence: Synthetic polypeptide
DEMEIVTTNPVATEQWGTVCSATDGPVEFEGND

SEQ ID NO: 153521 - protein, 33 aa, Artificial Sequence
  Description of Artificial Sequence: Synthetic polypeptide
DEMEIVTTNPVATEQWGTVCSATDGPVEVEGND

SEQ ID NO: 153522 - protein, 33 aa, Artificial Sequence
  Description of Artificial Sequence: Synthetic polypeptide
DEMEIVTTNPVATEQYGNVCSATDGPVEFEGQD

SEQ ID NO: 153523 - protein, 33 aa, Artificial Sequence
  Description of Artificial Sequence: Synthetic polypeptide
DEMEIVTTNPVATEQYGNVCSATDGPVWFEAND

SEQ ID NO: 153524 - protein, 33 aa, Artificial Sequence
  Description of Artificial Sequence: Synthetic polypeptide
DEAEIATTNPVAYEQWGSVSGPGGNHQGEGGLE

SEQ ID NO: 153525 - protein, 35 aa, Artificial Sequence
  Description of Artificial Sequence: Synthetic polypeptide
DEHEIRTTNPVATEAYGSVCFTTEDHTDQGGDNHS

SEQ ID NO: 153526 - protein, 34 aa, Artificial Sequence
  Description of Artificial Sequence: Synthetic polypeptide
DEMEIVTTNPVATEQYGQTVCSATDGPVEFEGND

SEQ ID NO: 153527 - protein, 33 aa, Artificial Sequence
  Description of Artificial Sequence: Synthetic polypeptide
DEMEIVTTNPVATEQYGQVCSATDGPVEFEGKD

SEQ ID NO: 153528 - protein, 34 aa, Artificial Sequence
  Description of Artificial Sequence: Synthetic polypeptide
DEMEIVTTNPVATEQYGRTVCSATDGPVEFEGND

SEQ ID NO: 153529 - protein, 34 aa, Artificial Sequence
  Description of Artificial Sequence: Synthetic polypeptide
DEAEIATTNPVAYEQWGSVSHTMNDRGNDGNNGP

SEQ ID NO: 153530 - protein, 39 aa, Artificial Sequence
  Description of Artificial Sequence: Synthetic polypeptide
DEEEIRTTNPVATEQYGTVSTQNLQQSATEEGTNNNQTE

SEQ ID NO: 153531 - protein, 34 aa, Artificial Sequence
  Description of Artificial Sequence: Synthetic polypeptide
DEEEISTTNPVATEQYGCVCSNSEEHQNFGSEQS

SEQ ID NO: 153532 - protein, 35 aa, Artificial Sequence
  Description of Artificial Sequence: Synthetic polypeptide
DEEEISTTNPVATEQYGCVCSNSEEHQYFGSDNQQ

SEQ ID NO: 153533 - protein, 35 aa, Artificial Sequence
  Description of Artificial Sequence: Synthetic polypeptide
DEEEISTTNPVATEQYGCVCSNSEELQENFSSNQS

SEQ ID NO: 153534 - protein, 37 aa, Artificial Sequence
  Description of Artificial Sequence: Synthetic polypeptide
DEEEIRTTNPVATEQYGTVSTNVATEQYGSTTQQQDD

SEQ ID NO: 153535 - protein, 38 aa, Artificial Sequence
  Description of Artificial Sequence: Synthetic polypeptide
DEEEIRTTNPVATEQYGVVSTVVNQQQQIGTNVTEDED

SEQ ID NO: 153536 - protein, 38 aa, Artificial Sequence
  Description of Artificial Sequence: Synthetic polypeptide
DEEEIRTTNPVATEQYGVVSTVVNQQQQIGTTNDEDED

SEQ ID NO: 153537 - protein, 39 aa, Artificial Sequence
  Description of Artificial Sequence: Synthetic polypeptide
DEEEIRTTNPVATEQYGTVSTNLQSGTNTQAGTNQQGNE

SEQ ID NO: 153538 - protein, 34 aa, Artificial Sequence
  Description of Artificial Sequence: Synthetic polypeptide
DEEEISTTNPVATEQYGCVCSNSETANFGSEFQG

SEQ ID NO: 153539 - protein, 33 aa, Artificial Sequence
  Description of Artificial Sequence: Synthetic polypeptide
DEMEIVTTNPVATEQYGNVCSATDGIVEFEGQD

SEQ ID NO: 153540 - protein, 33 aa, Artificial Sequence
  Description of Artificial Sequence: Synthetic polypeptide
DEMEIVTTNPVATEQYGNVCEATDGPVEFEGND

SEQ ID NO: 153541 - protein, 34 aa, Artificial Sequence
  Description of Artificial Sequence: Synthetic polypeptide
DEMEIVTTNPVATEQYGNTVCSATDGPVEFEGND

SEQ ID NO: 153542 - protein, 34 aa, Artificial Sequence
  Description of Artificial Sequence: Synthetic polypeptide
DEMEIVTTNPVATEQYGNTVCSATDGPVEFAGND

SEQ ID NO: 153543 - protein, 34 aa, Artificial Sequence
  Description of Artificial Sequence: Synthetic polypeptide
DEMEIVTTNPVATEQYGHTVCSATDGPVEFEGNI

SEQ ID NO: 153544 - protein, 34 aa, Artificial Sequence
  Description of Artificial Sequence: Synthetic polypeptide
DEMEIVTTNPVATEQYGHVCSATDGPVEFFEGND

SEQ ID NO: 153545 - protein, 34 aa, Artificial Sequence
  Description of Artificial Sequence: Synthetic polypeptide
DEMEIVTTNPVATEQYGITVCSATDGPVEFEGND

SEQ ID NO: 153546 - protein, 39 aa, Artificial Sequence
  Description of Artificial Sequence: Synthetic polypeptide
DEEEIRTTNPVATEQYGTVSTTNLQAGNNENGNNNEQNT

SEQ ID NO: 153547 - protein, 34 aa, Artificial Sequence
  Description of Artificial Sequence: Synthetic polypeptide
DEMEIVTTNPVATEQYGIVCSATDGPVEFEGNDQ

SEQ ID NO: 153548 - protein, 34 aa, Artificial Sequence
  Description of Artificial Sequence: Synthetic polypeptide
DEMEIVTTNPVATEQYGIVCSATDGPVETFEGND

SEQ ID NO: 153549 - protein, 34 aa, Artificial Sequence
  Description of Artificial Sequence: Synthetic polypeptide
DEMEIVTTNPVATEQYGKTVCSATDDPVEFEGND

SEQ ID NO: 153550 - protein, 34 aa, Artificial Sequence
  Description of Artificial Sequence: Synthetic polypeptide
DEMEIVTTNPVATEQYGKTVCSATDGPVEFEGND

SEQ ID NO: 153551 - protein, 39 aa, Artificial Sequence
  Description of Artificial Sequence: Synthetic polypeptide
DEEEIRTTNPVATEQYGTVSTNLQSGNNNQAGTNQQGND

SEQ ID NO: 153552 - protein, 33 aa, Artificial Sequence
  Description of Artificial Sequence: Synthetic polypeptide
DEMEIVTTNPVATEQYGKVHSVTDGPVEFEGFD

SEQ ID NO: 153553 - protein, 33 aa, Artificial Sequence
  Description of Artificial Sequence: Synthetic polypeptide
DEMEIVTTNPVATEQYGLVCSALDGPVEFEGND

SEQ ID NO: 153554 - protein, 34 aa, Artificial Sequence
  Description of Artificial Sequence: Synthetic polypeptide
DEMEIVTTNPVATEQYGLVTSATDGYPVENEGNV

SEQ ID NO: 153555 - protein, 34 aa, Artificial Sequence
  Description of Artificial Sequence: Synthetic polypeptide
DEMEIVTTNPVATEQYGMTVCSATDGPVEFEGND

SEQ ID NO: 153556 - protein, 35 aa, Artificial Sequence
  Description of Artificial Sequence: Synthetic polypeptide
DEMEIVTTNPVATEQYGMTVCSATDGPVEQFEGND

SEQ ID NO: 153557 - protein, 34 aa, Artificial Sequence
  Description of Artificial Sequence: Synthetic polypeptide
DEMEIVTTNPVATEQYGMTVVSATDGPVEKEGND

SEQ ID NO: 153558 - protein, 34 aa, Artificial Sequence
  Description of Artificial Sequence: Synthetic polypeptide
DEMEIVTTNPVATEQYGMVCSATDGPVEFEGNDN

SEQ ID NO: 153559 - protein, 34 aa, Artificial Sequence
  Description of Artificial Sequence: Synthetic polypeptide
DEMEIVTTNPVATEQYGMVCSATDGPVEFEGQND

SEQ ID NO: 153560 - protein, 33 aa, Artificial Sequence
  Description of Artificial Sequence: Synthetic polypeptide
DEMEIVTTNPVATEQYGMVCVATDGPVEFEGND

SEQ ID NO: 153561 - protein, 33 aa, Artificial Sequence
  Description of Artificial Sequence: Synthetic polypeptide
DEMEIVTTNPVATEQYGLVCIATDGPVEFEGND

SEQ ID NO: 153562 - protein, 34 aa, Artificial Sequence
  Description of Artificial Sequence: Synthetic polypeptide
DEMEIVTTNPVATEQYGHTVCSATDGPVEFEGND

SEQ ID NO: 153563 - protein, 39 aa, Artificial Sequence
  Description of Artificial Sequence: Synthetic polypeptide
DEEEIRTTNPVATEQYGTVSTNLQSGNNNQAGTNEQGSE

SEQ ID NO: 153564 - protein, 34 aa, Artificial Sequence
  Description of Artificial Sequence: Synthetic polypeptide
DEAEIATTNPVAYEQWGSVSWGDNLQHGDGTGDH

SEQ ID NO: 153565 - protein, 32 aa, Artificial Sequence
  Description of Artificial Sequence: Synthetic polypeptide
DENEIRTTNPVSYEPYGTISMENIQQQQNGNH

SEQ ID NO: 153566 - protein, 32 aa, Artificial Sequence
  Description of Artificial Sequence: Synthetic polypeptide
DEMEIVTTNPVATEQYGTAPATDGPVQFEEND

SEQ ID NO: 153567 - protein, 32 aa, Artificial Sequence
  Description of Artificial Sequence: Synthetic polypeptide
DEHEIRTTNPVATDSYGSVNMQLQNDSIQIPK

SEQ ID NO: 153568 - protein, 34 aa, Artificial Sequence
  Description of Artificial Sequence: Synthetic polypeptide
DEMEIVTTNPVATEQYGTAVCSATDGPVEFEGND

SEQ ID NO: 153569 - protein, 33 aa, Artificial Sequence
  Description of Artificial Sequence: Synthetic polypeptide
DEMEIVTTNPVATEQYGTCCSATDGPVEFEGND

SEQ ID NO: 153570 - protein, 33 aa, Artificial Sequence
  Description of Artificial Sequence: Synthetic polypeptide
DEMEIVTTNPVATEQYGTCSATDGKPDEFEGNN

SEQ ID NO: 153571 - protein, 34 aa, Artificial Sequence
  Description of Artificial Sequence: Synthetic polypeptide
DEMEIVTTNPVATEQYGTCVCSATDGPVEFEGND

SEQ ID NO: 153572 - protein, 34 aa, Artificial Sequence
  Description of Artificial Sequence: Synthetic polypeptide
DEMEIVTTNPVATEQYGTCVCSATDGPVGFEGND

SEQ ID NO: 153573 - protein, 34 aa, Artificial Sequence
  Description of Artificial Sequence: Synthetic polypeptide
DEMEIVTTNPVATEQYGTCVCSATDYPVEFEGND

SEQ ID NO: 153574 - protein, 33 aa, Artificial Sequence
  Description of Artificial Sequence: Synthetic polypeptide
DEMEIVTTNPVATEQYGTFCSATDGDVEFEGND

SEQ ID NO: 153575 - protein, 33 aa, Artificial Sequence
  Description of Artificial Sequence: Synthetic polypeptide
DEMEIVTTNPVATEQYGTFCSATDGPVEFEGND

SEQ ID NO: 153576 - protein, 33 aa, Artificial Sequence
  Description of Artificial Sequence: Synthetic polypeptide
DEMEIVTTNPVATEQYGTFCSATDGPVELEGND

SEQ ID NO: 153577 - protein, 34 aa, Artificial Sequence
  Description of Artificial Sequence: Synthetic polypeptide
DEMEIVTTNPVATEQYGTFVCSATDGPVEFEGND

SEQ ID NO: 153578 - protein, 34 aa, Artificial Sequence
  Description of Artificial Sequence: Synthetic polypeptide
DEMEIVTTNPVATEQYGTFVCSATDGPVEFEGNF

SEQ ID NO: 153579 - protein, 38 aa, Artificial Sequence
  Description of Artificial Sequence: Synthetic polypeptide
DEEEIRTTNPVATEQYGVVSTVVNQQQQQQGTNNNNEE

SEQ ID NO: 153580 - protein, 34 aa, Artificial Sequence
  Description of Artificial Sequence: Synthetic polypeptide
DEMEIVTTNPVATEQYGTGVCSATDGPVEFEGND

SEQ ID NO: 153581 - protein, 33 aa, Artificial Sequence
  Description of Artificial Sequence: Synthetic polypeptide
DEMEIVTTNPVATEQYGTHCSATDGPVEFEGND

SEQ ID NO: 153582 - protein, 32 aa, Artificial Sequence
  Description of Artificial Sequence: Synthetic polypeptide
DENEIRTTNPVSYEPYGTISVEDISQQQNGNH

SEQ ID NO: 153583 - protein, 33 aa, Artificial Sequence
  Description of Artificial Sequence: Synthetic polypeptide
DEAEIATTNPVAYEQWGSVYWTDQQDDHNGMND

SEQ ID NO: 153584 - protein, 32 aa, Artificial Sequence
  Description of Artificial Sequence: Synthetic polypeptide
DEMEIVTTNPVATEQYGTACSATVPVEFEGED

SEQ ID NO: 153585 - protein, 36 aa, Artificial Sequence
  Description of Artificial Sequence: Synthetic polypeptide
DEHEIRTTNPVATEAWGISVRTWNDDQDDRRQGEER

SEQ ID NO: 153586 - protein, 34 aa, Artificial Sequence
  Description of Artificial Sequence: Synthetic polypeptide
DEMEIVTTNPVATEQYGSVSATDGPVEDHEGEDL

SEQ ID NO: 153587 - protein, 31 aa, Artificial Sequence
  Description of Artificial Sequence: Synthetic polypeptide
DENEIRYTNPVATEQWGDVSEILEMNAAEDA

SEQ ID NO: 153588 - protein, 31 aa, Artificial Sequence
  Description of Artificial Sequence: Synthetic polypeptide
DENEIRYTNPVATEQWGDVSEIEMNAAEDAP

SEQ ID NO: 153589 - protein, 30 aa, Artificial Sequence
  Description of Artificial Sequence: Synthetic polypeptide
DENEIRYTNPVATEQWGDVSEIEMNAAEDA

SEQ ID NO: 153590 - protein, 31 aa, Artificial Sequence
  Description of Artificial Sequence: Synthetic polypeptide
DENEIRTVNPVSTEPYGTISMEDIQQQNGNH

SEQ ID NO: 153591 - protein, 36 aa, Artificial Sequence
  Description of Artificial Sequence: Synthetic polypeptide
DEAEIATTNPVAYEQWGSVVSTMNTLGEERDGQNNG

SEQ ID NO: 153592 - protein, 31 aa, Artificial Sequence
  Description of Artificial Sequence: Synthetic polypeptide
DENEIRTVNPVCTEPYGTISDEDIQQSNGNH

SEQ ID NO: 153593 - protein, 37 aa, Artificial Sequence
  Description of Artificial Sequence: Synthetic polypeptide
DEEEIRTTNPVATEQYGSVSVRQTGEEEARQLQMVTP

SEQ ID NO: 153594 - protein, 34 aa, Artificial Sequence
  Description of Artificial Sequence: Synthetic polypeptide
DEAEIATTNPVAYEQWGSVSTTNGNDEHQGDDER

SEQ ID NO: 153595 - protein, 33 aa, Artificial Sequence
  Description of Artificial Sequence: Synthetic polypeptide
DEMEIVTTNPVATEQYGTACSAEDNPVEFEGGR

SEQ ID NO: 153596 - protein, 33 aa, Artificial Sequence
  Description of Artificial Sequence: Synthetic polypeptide
DEMEIVTTNPVATEQYGTACSATDGPVEFEGGR

SEQ ID NO: 153597 - protein, 33 aa, Artificial Sequence
  Description of Artificial Sequence: Synthetic polypeptide
DEMEIVTTNPVATEQYGTACSATDGPVEFEGND

SEQ ID NO: 153598 - protein, 33 aa, Artificial Sequence
  Description of Artificial Sequence: Synthetic polypeptide
DEMEIVTTNPVATEQYGTACSATDGPVQFEEND

SEQ ID NO: 153599 - protein, 30 aa, Artificial Sequence
  Description of Artificial Sequence: Synthetic polypeptide
DENEIRTVNPVATEQWGDVSEIEMNAAEDA

SEQ ID NO: 153600 - protein, 30 aa, Artificial Sequence
  Description of Artificial Sequence: Synthetic polypeptide
DENEIRTTNVVATEQWGEVSEIEMNAAEDA

SEQ ID NO: 153601 - protein, 32 aa, Artificial Sequence
  Description of Artificial Sequence: Synthetic polypeptide
DENEIRTTNPVVTERYGTISMEDIQQQQNGNH

SEQ ID NO: 153602 - protein, 32 aa, Artificial Sequence
  Description of Artificial Sequence: Synthetic polypeptide
DENEIRTTNPVTTEPYGTISMMDIQQQQNGNH

SEQ ID NO: 153603 - protein, 33 aa, Artificial Sequence
  Description of Artificial Sequence: Synthetic polypeptide
DEMEIVTTNPVATEQYGTACSATDVPVEFEGND

SEQ ID NO: 153604 - protein, 34 aa, Artificial Sequence
  Description of Artificial Sequence: Synthetic polypeptide
DEAEIRTTNPVATEQYGSVHYTIDPYVEGEEDDQ

SEQ ID NO: 153605 - protein, 34 aa, Artificial Sequence
  Description of Artificial Sequence: Synthetic polypeptide
DEMEIVTTNPVATEQYGGVCSATDGRPVEFEGND

SEQ ID NO: 153606 - protein, 32 aa, Artificial Sequence
  Description of Artificial Sequence: Synthetic polypeptide
DEMEIVTTNPVATEQYGEVPATDGPVEHEENK

SEQ ID NO: 153607 - protein, 32 aa, Artificial Sequence
  Description of Artificial Sequence: Synthetic polypeptide
DEMEIVTTNPVATEQYGEVPATDGPVEHEEND

SEQ ID NO: 153608 - protein, 34 aa, Artificial Sequence
  Description of Artificial Sequence: Synthetic polypeptide
DEMEIVTTNPVATEQYGAVCSATQGSPVEFEGNE

SEQ ID NO: 153609 - protein, 38 aa, Artificial Sequence
  Description of Artificial Sequence: Synthetic polypeptide
DEEEIRTTNPVATEQYGVVSTVVNQQNQQQGTNDETED

SEQ ID NO: 153610 - protein, 33 aa, Artificial Sequence
  Description of Artificial Sequence: Synthetic polypeptide
DEMEIVTTNPVATEQYGAVWAATDGPVEFKGND

SEQ ID NO: 153611 - protein, 33 aa, Artificial Sequence
  Description of Artificial Sequence: Synthetic polypeptide
DEEEISTTNPVATEQYGCVCPWEHNQNFNSNQS

SEQ ID NO: 153612 - protein, 33 aa, Artificial Sequence
  Description of Artificial Sequence: Synthetic polypeptide
DEMEIVTTNPVATEQYGAVWAATDGWVEFKGND

SEQ ID NO: 153613 - protein, 33 aa, Artificial Sequence
  Description of Artificial Sequence: Synthetic polypeptide
DEMEIVTTNPVATEQYGCICSATDGPVEFEGND

SEQ ID NO: 153614 - protein, 34 aa, Artificial Sequence
  Description of Artificial Sequence: Synthetic polypeptide
DEMEIVTTNPVATEQYGCTVCSATDGPVEFEGND

SEQ ID NO: 153615 - protein, 33 aa, Artificial Sequence
  Description of Artificial Sequence: Synthetic polypeptide
DEMEIVTTNPVATEQYGCVCRATDGPVEFEGND

SEQ ID NO: 153616 - protein, 34 aa, Artificial Sequence
  Description of Artificial Sequence: Synthetic polypeptide
DEMEIVTTNPVATEQYGCVCSATDGPVEFEGIND

SEQ ID NO: 153617 - protein, 34 aa, Artificial Sequence
  Description of Artificial Sequence: Synthetic polypeptide
DEMEIVTTNPVATEQYGCVCSATDGPVEFEGNDQ

SEQ ID NO: 153618 - protein, 34 aa, Artificial Sequence
  Description of Artificial Sequence: Synthetic polypeptide
DEEEISTTNPVATEQYGCVCQTEHNQNFNSDTQS

SEQ ID NO: 153619 - protein, 36 aa, Artificial Sequence
  Description of Artificial Sequence: Synthetic polypeptide
DEEEIRTTNPVAYEQYGHTVQACIGHLSQPRLSGVR

SEQ ID NO: 153620 - protein, 34 aa, Artificial Sequence
  Description of Artificial Sequence: Synthetic polypeptide
DEMEIVTTNPVATEQYGCVCSATDGPVEFEGYND

SEQ ID NO: 153621 - protein, 34 aa, Artificial Sequence
  Description of Artificial Sequence: Synthetic polypeptide
DEEEISTTNPVATEQYGCVCQWGEHQENFGSNQS

SEQ ID NO: 153622 - protein, 33 aa, Artificial Sequence
  Description of Artificial Sequence: Synthetic polypeptide
DEEEISTTNPVATEQYGCVCQWGEHQYFNSEQP

SEQ ID NO: 153623 - protein, 33 aa, Artificial Sequence
  Description of Artificial Sequence: Synthetic polypeptide
DEEEISTTNPVATEQYGCVCSDSEDENFGSEQA

SEQ ID NO: 153624 - protein, 33 aa, Artificial Sequence
  Description of Artificial Sequence: Synthetic polypeptide
DEMEIVTTNPVATEQYGCVCSATDGPVEFEMND

SEQ ID NO: 153625 - protein, 34 aa, Artificial Sequence
  Description of Artificial Sequence: Synthetic polypeptide
DEMEIVTTNPVATEQYGAVCSATDIPVEFEGEND

SEQ ID NO: 153626 - protein, 33 aa, Artificial Sequence
  Description of Artificial Sequence: Synthetic polypeptide
DEMEIVTTNPVATEQYGAVCSATDGPVEFEMNP

SEQ ID NO: 153627 - protein, 38 aa, Artificial Sequence
  Description of Artificial Sequence: Synthetic polypeptide
DEEEIRTTNPVATEQYGVVSTVVNQQNQQNGNNQEEED

SEQ ID NO: 153628 - protein, 33 aa, Artificial Sequence
  Description of Artificial Sequence: Synthetic polypeptide
DEMEIVTTNPVATEQYGAVCSATDGPVEFEGPD

SEQ ID NO: 153629 - protein, 34 aa, Artificial Sequence
  Description of Artificial Sequence: Synthetic polypeptide
DEMEIVTTNPVATEQWGTVCSCDGPPQDREGEND

SEQ ID NO: 153630 - protein, 35 aa, Artificial Sequence
  Description of Artificial Sequence: Synthetic polypeptide
DEAEIRTTNPVATEQYGSVIEPTWIDQDEEFEHNI

SEQ ID NO: 153631 - protein, 33 aa, Artificial Sequence
  Description of Artificial Sequence: Synthetic polypeptide
DENEISTTNPVATEIYGCVCSWGELNQNFGSDQ

SEQ ID NO: 153632 - protein, 34 aa, Artificial Sequence
  Description of Artificial Sequence: Synthetic polypeptide
DEMEIVTTNPVATEQWGTVCSCDGPVQDREGEND

SEQ ID NO: 153633 - protein, 33 aa, Artificial Sequence
  Description of Artificial Sequence: Synthetic polypeptide
DEMEIVTTNPVATEQWGTVCSTDGPVEFEGENG

SEQ ID NO: 153634 - protein, 38 aa, Artificial Sequence
  Description of Artificial Sequence: Synthetic polypeptide
DEEEIRTTNPVATEQYGTVSTTVTNTNLQQGTEEGSTD

SEQ ID NO: 153635 - protein, 33 aa, Artificial Sequence
  Description of Artificial Sequence: Synthetic polypeptide
DEMEIVTTNPVATEQWGTVCSVTDGPVEFEGND

SEQ ID NO: 153636 - protein, 33 aa, Artificial Sequence
  Description of Artificial Sequence: Synthetic polypeptide
DEMEIVTTNPVATEQWGTVKSATDGPVEFEGND

SEQ ID NO: 153637 - protein, 33 aa, Artificial Sequence
  Description of Artificial Sequence: Synthetic polypeptide
DEEEISTTNPVATEQYGCVCSDSEHANFGSEQS

SEQ ID NO: 153638 - protein, 37 aa, Artificial Sequence
  Description of Artificial Sequence: Synthetic polypeptide
DEEEIRTTNPVATEQYGVVSTVVNQQNNQNGETEEED

SEQ ID NO: 153639 - protein, 39 aa, Artificial Sequence
  Description of Artificial Sequence: Synthetic polypeptide
DEEEIRTTNPVATEQYGTVSTTNLQYGNNQNGNNNNQED

SEQ ID NO: 153640 - protein, 35 aa, Artificial Sequence
  Description of Artificial Sequence: Synthetic polypeptide
DEEEISTTNPVATEQYGCVCGNWGELNQNFNSEQP

SEQ ID NO: 153641 - protein, 34 aa, Artificial Sequence
  Description of Artificial Sequence: Synthetic polypeptide
DEMEIVTTNPVATEQYGATVCSATDGPVEFEGND

SEQ ID NO: 153642 - protein, 35 aa, Artificial Sequence
  Description of Artificial Sequence: Synthetic polypeptide
DEEEISTTNPVATEQYGCVCGTGEHNQNFGSQNQD

SEQ ID NO: 153643 - protein, 34 aa, Artificial Sequence
  Description of Artificial Sequence: Synthetic polypeptide
DEMEIVTTNPVATEQYGATVCSATSGPVEFEGND

SEQ ID NO: 153644 - protein, 38 aa, Artificial Sequence
  Description of Artificial Sequence: Synthetic polypeptide
DEEEIRTTNPVATEQYGVVSTVVNQQNQQGTNNNDEED

SEQ ID NO: 153645 - protein, 33 aa, Artificial Sequence
  Description of Artificial Sequence: Synthetic polypeptide
DEMEIVTTNPVATEQYGAVCSATDDPEFEGPYD

SEQ ID NO: 153646 - protein, 33 aa, Artificial Sequence
  Description of Artificial Sequence: Synthetic polypeptide
DEMEIVTTNPVATEQYGAVCSATDGPEFEGPYD

SEQ ID NO: 153647 - protein, 38 aa, Artificial Sequence
  Description of Artificial Sequence: Synthetic polypeptide
DEEEIRTTNPVATEQYGTVSTTNQAGGNNNQQGTNNDE

SEQ ID NO: 153648 - protein, 33 aa, Artificial Sequence
  Description of Artificial Sequence: Synthetic polypeptide
DEEEISTTNPVATEQYGCVCSDSEHANFNSNQA

SEQ ID NO: 153649 - protein, 34 aa, Artificial Sequence
  Description of Artificial Sequence: Synthetic polypeptide
DEEEISTTNPVATEQYGCVCSDSEHNQGFGSEQS

SEQ ID NO: 153650 - protein, 35 aa, Artificial Sequence
  Description of Artificial Sequence: Synthetic polypeptide
DEEEISTTNPVATEQYGCVCSDTEDHAENFGSNQS

SEQ ID NO: 153651 - protein, 34 aa, Artificial Sequence
  Description of Artificial Sequence: Synthetic polypeptide
DEMEIVTTNPVATEQYGCVVCSATDGPVEFKGND

SEQ ID NO: 153652 - protein, 37 aa, Artificial Sequence
  Description of Artificial Sequence: Synthetic polypeptide
DEEEIRTTNPVAYEQYGESVSPSVNQELFERVGEPVD

SEQ ID NO: 153653 - protein, 33 aa, Artificial Sequence
  Description of Artificial Sequence: Synthetic polypeptide
DEMEIVTTNPVATEQYGDVCMATDGPVEFEGND

SEQ ID NO: 153654 - protein, 32 aa, Artificial Sequence
  Description of Artificial Sequence: Synthetic polypeptide
DEMEIVTTNPVATEQYGDVCSAEIEMNAEENA

SEQ ID NO: 153655 - protein, 39 aa, Artificial Sequence
  Description of Artificial Sequence: Synthetic polypeptide
DEEEIRTTNPVATEQYGTVSTTNLQQSATEQGTNNQTTE

SEQ ID NO: 153656 - protein, 35 aa, Artificial Sequence
  Description of Artificial Sequence: Synthetic polypeptide
DEEEISTTNPVATEQYGCVCSMTMEDHQENFGSDQ

SEQ ID NO: 153657 - protein, 39 aa, Artificial Sequence
  Description of Artificial Sequence: Synthetic polypeptide
DEEEIRTTNPVATEQYGTVSTTNLQQGNNQAGNNNNQND

SEQ ID NO: 153658 - protein, 32 aa, Artificial Sequence
  Description of Artificial Sequence: Synthetic polypeptide
DEMEIVTTNPVATEQYGDVSAEDGPVEAAENA

SEQ ID NO: 153659 - protein, 36 aa, Artificial Sequence
  Description of Artificial Sequence: Synthetic polypeptide
DEEEISTTNPVATEQYGCVCSMTGNHQENFGSDTQG

SEQ ID NO: 153660 - protein, 36 aa, Artificial Sequence
  Description of Artificial Sequence: Synthetic polypeptide
DEEEISTTNPVATEQYGCVCSMTMEHNQGFGSNNQS

SEQ ID NO: 153661 - protein, 31 aa, Artificial Sequence
  Description of Artificial Sequence: Synthetic polypeptide
DDSEVACTNPVSTEGYGNVAANTIQSRVGNR

SEQ ID NO: 153662 - protein, 33 aa, Artificial Sequence
  Description of Artificial Sequence: Synthetic polypeptide
DEAEIATTNPVAYEQWGSVSGIGNGNSGEGNTS

SEQ ID NO: 153663 - protein, 30 aa, Artificial Sequence
  Description of Artificial Sequence: Synthetic polypeptide
DEMEIVTTNPVATEQYGEACPEVPVEHGEK

SEQ ID NO: 153664 - protein, 31 aa, Artificial Sequence
  Description of Artificial Sequence: Synthetic polypeptide
DEMEIVTTNPVATEQYGEACSEVPVEHEGEK

SEQ ID NO: 153665 - protein, 34 aa, Artificial Sequence
  Description of Artificial Sequence: Synthetic polypeptide
DEMEIVTTNPVATEQYGETVCSATDGPVEFEGND

SEQ ID NO: 153666 - protein, 39 aa, Artificial Sequence
  Description of Artificial Sequence: Synthetic polypeptide
DEEEIRTTNPVATEQYGTVSTTNLQAGNTEQGTNQETTE

SEQ ID NO: 153667 - protein, 30 aa, Artificial Sequence
  Description of Artificial Sequence: Synthetic polypeptide
DEMEIVTTNPVATEQYGEVPAEDVPEHEED

SEQ ID NO: 153668 - protein, 30 aa, Artificial Sequence
  Description of Artificial Sequence: Synthetic polypeptide
DEMEIVTTNPVATEQYGEVPAEDVPEHEEK

SEQ ID NO: 153669 - protein, 37 aa, Artificial Sequence
  Description of Artificial Sequence: Synthetic polypeptide
DEEEIRTTNPVAYEQYGESVSPSVNDEPQFRVGEPVD

SEQ ID NO: 153670 - protein, 35 aa, Artificial Sequence
  Description of Artificial Sequence: Synthetic polypeptide
DEEEISTTNPVATEQYGQCVCSTGAPNQNFNSEQS

SEQ ID NO: 153671 - protein, 36 aa, Artificial Sequence
  Description of Artificial Sequence: Synthetic polypeptide
DEEEISTTNPVATEQYGCVCSMTGNHNQNFNSDNQM

SEQ ID NO: 153672 - protein, 35 aa, Artificial Sequence
  Description of Artificial Sequence: Synthetic polypeptide
DEEEISTTNPVATEQYGCVCSMTGEHQNFNSDTQM

SEQ ID NO: 153673 - protein, 34 aa, Artificial Sequence
  Description of Artificial Sequence: Synthetic polypeptide
DEEEISTTNPVATEQYGCVCSDTEEHANFGSDQS

SEQ ID NO: 153674 - protein, 37 aa, Artificial Sequence
  Description of Artificial Sequence: Synthetic polypeptide
DEEEIRTTNPVAYEQYGGSVSSTTPAGPNMRNGMNPV

SEQ ID NO: 153675 - protein, 33 aa, Artificial Sequence
  Description of Artificial Sequence: Synthetic polypeptide
DEMEIVTTNPVATEQYGCVCSNSDEPVEFFGND

SEQ ID NO: 153676 - protein, 34 aa, Artificial Sequence
  Description of Artificial Sequence: Synthetic polypeptide
DEEEISTTNPVATEQYGCVCSETEHQENFPSEQP

SEQ ID NO: 153677 - protein, 34 aa, Artificial Sequence
  Description of Artificial Sequence: Synthetic polypeptide
DEMEIVTTNPVATEQYGCVCSNTGEPNAFFGDDA

SEQ ID NO: 153678 - protein, 34 aa, Artificial Sequence
  Description of Artificial Sequence: Synthetic polypeptide
DEMEIVTTNPVATEQYGCVCSNTGEPNAFFGSQQ

SEQ ID NO: 153679 - protein, 38 aa, Artificial Sequence
  Description of Artificial Sequence: Synthetic polypeptide
DEEEIRTTNPVATEQYGVVSTVVNQQNQQQGTNNAEEE

SEQ ID NO: 153680 - protein, 34 aa, Artificial Sequence
  Description of Artificial Sequence: Synthetic polypeptide
DEMEIVTTNPVATEQYGCVCSNTGEPNEFFGQQS

SEQ ID NO: 153681 - protein, 33 aa, Artificial Sequence
  Description of Artificial Sequence: Synthetic polypeptide
DEMEIVTTNPVATEQYGCVCTACDGPVEFEGNE

SEQ ID NO: 153682 - protein, 35 aa, Artificial Sequence
  Description of Artificial Sequence: Synthetic polypeptide
DEEEISTTNPVATEQYGCVCSMTEHNQENFGSDLS

SEQ ID NO: 153683 - protein, 35 aa, Artificial Sequence
  Description of Artificial Sequence: Synthetic polypeptide
DEEEISTTNPVATEQYGCVCSMTEHNQNFGSDTQM

SEQ ID NO: 153684 - protein, 34 aa, Artificial Sequence
  Description of Artificial Sequence: Synthetic polypeptide
DEAAIRTTNPVATEQYGCFCSTEHNIIFGSNNQA

SEQ ID NO: 153685 - protein, 33 aa, Artificial Sequence
  Description of Artificial Sequence: Synthetic polypeptide
DEAAIRTTNPVATEQYGCFCSTELNINFGSDQF

SEQ ID NO: 153686 - protein, 35 aa, Artificial Sequence
  Description of Artificial Sequence: Synthetic polypeptide
DEEEISTTNPVATEQYGCVCSMTGEHDQGFISNQS

SEQ ID NO: 153687 - protein, 34 aa, Artificial Sequence
  Description of Artificial Sequence: Synthetic polypeptide
DEMEIVTTNPVATEQYGCVCSNTGEPVEFEGNQS

SEQ ID NO: 153688 - protein, 36 aa, Artificial Sequence
  Description of Artificial Sequence: Synthetic polypeptide
DEEEISTTNPVATEQYGCVCSMTGEHNINFGSDNQM

SEQ ID NO: 153689 - protein, 34 aa, Artificial Sequence
  Description of Artificial Sequence: Synthetic polypeptide
DEMEIVTTNPVATEQYGCVCSNWGEPNEFFGNDA

SEQ ID NO: 153690 - protein, 39 aa, Artificial Sequence
  Description of Artificial Sequence: Synthetic polypeptide
DEEEIRTTNPVATEQYGTVSTTNLQSGNNQAGNNNQQNQ

SEQ ID NO: 153691 - protein, 35 aa, Artificial Sequence
  Description of Artificial Sequence: Synthetic polypeptide
DEEEISTTNPVATEQYGCVCSMTEHNQENFSSNQS

SEQ ID NO: 153692 - protein, 32 aa, Artificial Sequence
  Description of Artificial Sequence: Synthetic polypeptide
DENEIRTTNPVSTEPYGMISMDDIQQQQNGNH

SEQ ID NO: 153693 - protein, 33 aa, Artificial Sequence
  Description of Artificial Sequence: Synthetic polypeptide
DENEIRTTNPVSTEPYGLTISMESIQQQQNGNA

SEQ ID NO: 153694 - protein, 32 aa, Artificial Sequence
  Description of Artificial Sequence: Synthetic polypeptide
DENEIRTTNPVSTEPYGLISMEDIQQQQNGNT

SEQ ID NO: 153695 - protein, 32 aa, Artificial Sequence
  Description of Artificial Sequence: Synthetic polypeptide
DENEIATTNPVAYEQYGSCATNLADDPLDEAH

SEQ ID NO: 153696 - protein, 34 aa, Artificial Sequence
  Description of Artificial Sequence: Synthetic polypeptide
DEESIRTTNPSAYEQWGSTVNTTGNGSQQRSNNE

SEQ ID NO: 153697 - protein, 38 aa, Artificial Sequence
  Description of Artificial Sequence: Synthetic polypeptide
DEEEIRTTNPVATEQYGVVSVVVSNLQAGNSEEGSVAE

SEQ ID NO: 153698 - protein, 38 aa, Artificial Sequence
  Description of Artificial Sequence: Synthetic polypeptide
DEEEIRTTNPVATEQYGVVSVVVSNLQAGNSELGTVNQ

SEQ ID NO: 153699 - protein, 31 aa, Artificial Sequence
  Description of Artificial Sequence: Synthetic polypeptide
DENEIRTTNPVATEQWGDCVSHIEMNAAEDA

SEQ ID NO: 153700 - protein, 31 aa, Artificial Sequence
  Description of Artificial Sequence: Synthetic polypeptide
DENEIRTTNPVATEQWGDCVSEKEMNAAEDA

SEQ ID NO: 153701 - protein, 31 aa, Artificial Sequence
  Description of Artificial Sequence: Synthetic polypeptide
DENEIRTTNPVATEQWGDCVSEIEMNAAEDA

SEQ ID NO: 153702 - protein, 36 aa, Artificial Sequence
  Description of Artificial Sequence: Synthetic polypeptide
DEESIRTTNPVATEQYGSLSEQTPAGPNMRNGMNPV

SEQ ID NO: 153703 - protein, 35 aa, Artificial Sequence
  Description of Artificial Sequence: Synthetic polypeptide
DEEEIRTTNPVATNQYGSVSCYVDLNIPNSQIDEQ

SEQ ID NO: 153704 - protein, 38 aa, Artificial Sequence
  Description of Artificial Sequence: Synthetic polypeptide
DEEEIRTTNPVATEQYGVVSVVVSNLQAGNSEYGSVQD

SEQ ID NO: 153705 - protein, 38 aa, Artificial Sequence
  Description of Artificial Sequence: Synthetic polypeptide
DEEEIRTTNPVATEQYGVVSVVVSNLQAGNTEGGNVNE

SEQ ID NO: 153706 - protein, 35 aa, Artificial Sequence
  Description of Artificial Sequence: Synthetic polypeptide
DENEIATTNPVAYEQYGSVAAITNNEEAPGNQERD

SEQ ID NO: 153707 - protein, 31 aa, Artificial Sequence
  Description of Artificial Sequence: Synthetic polypeptide
CEGEIAPTNPCSYESYGKVSCNLSQSGGDNR

SEQ ID NO: 153708 - protein, 30 aa, Artificial Sequence
  Description of Artificial Sequence: Synthetic polypeptide
DENEIRTTNPVATEQWGDCSKIEMNAAEDA

SEQ ID NO: 153709 - protein, 30 aa, Artificial Sequence
  Description of Artificial Sequence: Synthetic polypeptide
DENEIRTTNPVATEQWGDCSFIEMNAAQDA

SEQ ID NO: 153710 - protein, 30 aa, Artificial Sequence
  Description of Artificial Sequence: Synthetic polypeptide
DENEIRTTNPVATEQWGDCSEIEYNAAEDA

SEQ ID NO: 153711 - protein, 30 aa, Artificial Sequence
  Description of Artificial Sequence: Synthetic polypeptide
DENEIRTTNPVATEQWGDCSEIEMNKAEDA

SEQ ID NO: 153712 - protein, 33 aa, Artificial Sequence
  Description of Artificial Sequence: Synthetic polypeptide
DENEIATTNPVAYEQYGSCATNHTQTRNPDEAL

SEQ ID NO: 153713 - protein, 38 aa, Artificial Sequence
  Description of Artificial Sequence: Synthetic polypeptide
DEEEIRTTNPVATEQYGVVSVVVSNLQAGNSEAGNNNQ

SEQ ID NO: 153714 - protein, 36 aa, Artificial Sequence
  Description of Artificial Sequence: Synthetic polypeptide
DEGEIATTNPVAYEQYGSVATVANDLQTAMGPNEET

SEQ ID NO: 153715 - protein, 33 aa, Artificial Sequence
  Description of Artificial Sequence: Synthetic polypeptide
DDEEISTTNPVATEQWGCVTSTEHNQNFGSDAS

SEQ ID NO: 153716 - protein, 30 aa, Artificial Sequence
  Description of Artificial Sequence: Synthetic polypeptide
DENEIRTTNPVATEQWGDISEIEMNAAEDA

SEQ ID NO: 153717 - protein, 31 aa, Artificial Sequence
  Description of Artificial Sequence: Synthetic polypeptide
DENEIRTTNPVATEQWGDISEIEMNAAECDA

SEQ ID NO: 153718 - protein, 31 aa, Artificial Sequence
  Description of Artificial Sequence: Synthetic polypeptide
DENEIRTTNPVATEQWGDISEEIEMNAAGDA

SEQ ID NO: 153719 - protein, 31 aa, Artificial Sequence
  Description of Artificial Sequence: Synthetic polypeptide
DENEIRTTNPVATEQWGDHVSEIEMNAAEDA

SEQ ID NO: 153720 - protein, 30 aa, Artificial Sequence
  Description of Artificial Sequence: Synthetic polypeptide
DENEIRTTNPVATEQWGDHSEIEMNAAEDA

SEQ ID NO: 153721 - protein, 31 aa, Artificial Sequence
  Description of Artificial Sequence: Synthetic polypeptide
DENEIRTTNPVATEQWGDGVSEIEMNAHEDA

SEQ ID NO: 153722 - protein, 31 aa, Artificial Sequence
  Description of Artificial Sequence: Synthetic polypeptide
DENEIRTTNPVATEQWGDGVSEIEMNAAEDF

SEQ ID NO: 153723 - protein, 31 aa, Artificial Sequence
  Description of Artificial Sequence: Synthetic polypeptide
DENEIRTTNPVATEQWGDGVSEIEMNAAEDA

SEQ ID NO: 153724 - protein, 30 aa, Artificial Sequence
  Description of Artificial Sequence: Synthetic polypeptide
DENEIRTTNPVATEQWGDCSEIEMNAAEDA

SEQ ID NO: 153725 - protein, 32 aa, Artificial Sequence
  Description of Artificial Sequence: Synthetic polypeptide
DENEIRTTNPVATEQWGDGVSEIEMLAAEDTA

SEQ ID NO: 153726 - protein, 31 aa, Artificial Sequence
  Description of Artificial Sequence: Synthetic polypeptide
DENEIRTTNPVATEQWGDFVSEIEMNAAESA

SEQ ID NO: 153727 - protein, 31 aa, Artificial Sequence
  Description of Artificial Sequence: Synthetic polypeptide
DENEIRTTNPVATEQWGDFVSEIEMNAAEDK

SEQ ID NO: 153728 - protein, 31 aa, Artificial Sequence
  Description of Artificial Sequence: Synthetic polypeptide
DENEIRTTNPVATEQWGDFVSEIEMNAAEDA

SEQ ID NO: 153729 - protein, 31 aa, Artificial Sequence
  Description of Artificial Sequence: Synthetic polypeptide
DENEIRTTNPVATEQWGDFVSEIEHNAAEDA

SEQ ID NO: 153730 - protein, 31 aa, Artificial Sequence
  Description of Artificial Sequence: Synthetic polypeptide
DENEIRTTNPVATEQWGDFVSEIEDNAAEDA

SEQ ID NO: 153731 - protein, 33 aa, Artificial Sequence
  Description of Artificial Sequence: Synthetic polypeptide
DEGEIATTNPVAYEQYGSVCAAMNPLNDMDGGN

SEQ ID NO: 153732 - protein, 30 aa, Artificial Sequence
  Description of Artificial Sequence: Synthetic polypeptide
DENEIRTTNPVATEQWGDFSEIEMNAAEDA

SEQ ID NO: 153733 - protein, 31 aa, Artificial Sequence
  Description of Artificial Sequence: Synthetic polypeptide
DEGEIATTNPVAYEQYGSVCAAGPEDNMMNN

SEQ ID NO: 153734 - protein, 31 aa, Artificial Sequence
  Description of Artificial Sequence: Synthetic polypeptide
DENEIRTTNPVATEQWGDFVSEIEMNAAQEA

SEQ ID NO: 153735 - protein, 31 aa, Artificial Sequence
  Description of Artificial Sequence: Synthetic polypeptide
DENEIRTTNPVATEQWGDISMEIEMNAAENA

SEQ ID NO: 153736 - protein, 31 aa, Artificial Sequence
  Description of Artificial Sequence: Synthetic polypeptide
DENEIRTTNPVATEQWGDCSEIEENTAEDEA

SEQ ID NO: 153737 - protein, 33 aa, Artificial Sequence
  Description of Artificial Sequence: Synthetic polypeptide
DENEIATTNPVAYEQYGSVAGSNDANDNPGAQP

SEQ ID NO: 153738 - protein, 34 aa, Artificial Sequence
  Description of Artificial Sequence: Synthetic polypeptide
DEESIRTTNPVAYEQYGKTVNTTGNGSVHRSNNE

SEQ ID NO: 153739 - protein, 36 aa, Artificial Sequence
  Description of Artificial Sequence: Synthetic polypeptide
DEESIRTTNPVAYEQYGQSWTSNTNDMLQPRSIEKH

SEQ ID NO: 153740 - protein, 35 aa, Artificial Sequence
  Description of Artificial Sequence: Synthetic polypeptide
DEESIRTTNPVAYEQYGSTVNTTGNGSQQNSTNNE

SEQ ID NO: 153741 - protein, 34 aa, Artificial Sequence
  Description of Artificial Sequence: Synthetic polypeptide
DEESIRTTNPVAYEQYGSTVNTTGNGSTYASNNE

SEQ ID NO: 153742 - protein, 35 aa, Artificial Sequence
  Description of Artificial Sequence: Synthetic polypeptide
DEESIRTTNPVAYEQYGWTVNTTGNGSQQRSNNEM

SEQ ID NO: 153743 - protein, 39 aa, Artificial Sequence
  Description of Artificial Sequence: Synthetic polypeptide
DEEEIRTTNPVATEQYGVVSVVVSTNNLLEQGNNTEEGE

SEQ ID NO: 153744 - protein, 31 aa, Artificial Sequence
  Description of Artificial Sequence: Synthetic polypeptide
DENEIRTTNPVATEQWGCVTSSPEANAFIDA

SEQ ID NO: 153745 - protein, 39 aa, Artificial Sequence
  Description of Artificial Sequence: Synthetic polypeptide
DEEEIRTTNPVATEQYGVVSVVVSTNNLLEQGTNNEETE

SEQ ID NO: 153746 - protein, 38 aa, Artificial Sequence
  Description of Artificial Sequence: Synthetic polypeptide
DEEEIRTTNPVATEQYGVVSVVVSTNNNDEQGSTQNDD

SEQ ID NO: 153747 - protein, 33 aa, Artificial Sequence
  Description of Artificial Sequence: Synthetic polypeptide
DEGEIATTNPVAYEQYGSVATNGVTTAENPNEN

SEQ ID NO: 153748 - protein, 39 aa, Artificial Sequence
  Description of Artificial Sequence: Synthetic polypeptide
DEEEIRTTNPVATEQYGVVSVVVSTNNQAGNTEQYGNVE

SEQ ID NO: 153749 - protein, 33 aa, Artificial Sequence
  Description of Artificial Sequence: Synthetic polypeptide
DEGEIATTNPVAYEQYGSVATAHIGENPGDNAE

SEQ ID NO: 153750 - protein, 35 aa, Artificial Sequence
  Description of Artificial Sequence: Synthetic polypeptide
DEETEIATTNPVAYERWGSVYYTDNIDQRGNGDLS

SEQ ID NO: 153751 - protein, 33 aa, Artificial Sequence
  Description of Artificial Sequence: Synthetic polypeptide
DEGEIATTNPVAYEQYGSVATAGTQTANGPDEH

SEQ ID NO: 153752 - protein, 34 aa, Artificial Sequence
  Description of Artificial Sequence: Synthetic polypeptide
DEETIATTNPVATEFYGQSVDIMNGQQGGDNQDG

SEQ ID NO: 153753 - protein, 35 aa, Artificial Sequence
  Description of Artificial Sequence: Synthetic polypeptide
DEETIATTNPVAYETYGSVPTDLSLFTQRSGNEEF

SEQ ID NO: 153754 - protein, 38 aa, Artificial Sequence
  Description of Artificial Sequence: Synthetic polypeptide
DEEEIRTTNPVATEQYGVVSVVVSTNQQGNQQGTEEGS

SEQ ID NO: 153755 - protein, 32 aa, Artificial Sequence
  Description of Artificial Sequence: Synthetic polypeptide
DENEIRTTNPVATEQWGCVVSEINEENTIEDA

SEQ ID NO: 153756 - protein, 31 aa, Artificial Sequence
  Description of Artificial Sequence: Synthetic polypeptide
DENEIRTTNPVATEQWGDASEEIEMNAANDA

SEQ ID NO: 153757 - protein, 30 aa, Artificial Sequence
  Description of Artificial Sequence: Synthetic polypeptide
DENEIRTTNPVATEQWGDASEICMNHAEDA

SEQ ID NO: 153758 - protein, 30 aa, Artificial Sequence
  Description of Artificial Sequence: Synthetic polypeptide
DENEIRTTNPVATEQWGDASEIEMNAAEDA

SEQ ID NO: 153759 - protein, 33 aa, Artificial Sequence
  Description of Artificial Sequence: Synthetic polypeptide
DENEIATTNPVAYEQYGSVAGTGLADTPGDEAH

SEQ ID NO: 153760 - protein, 34 aa, Artificial Sequence
  Description of Artificial Sequence: Synthetic polypeptide
DEESIRTTNPVAYDQYGSTVNTTGNGSGYRSNNE

SEQ ID NO: 153761 - protein, 34 aa, Artificial Sequence
  Description of Artificial Sequence: Synthetic polypeptide
DEESIRTTNPVAYEAYGTTPSTAEHSQNRAGGNE

SEQ ID NO: 153762 - protein, 38 aa, Artificial Sequence
  Description of Artificial Sequence: Synthetic polypeptide
DEEEIRTTNPVATEQYGVVSVVVSNLTQAGSEYGSVNE

SEQ ID NO: 153763 - protein, 34 aa, Artificial Sequence
  Description of Artificial Sequence: Synthetic polypeptide
DEESIRTTNPVAYEGYGQTVATTGNGSQQRSNNE

SEQ ID NO: 153764 - protein, 34 aa, Artificial Sequence
  Description of Artificial Sequence: Synthetic polypeptide
DENEIATTNPVAYEQYGSVAITHDEQTGEQNENQ

SEQ ID NO: 153765 - protein, 31 aa, Artificial Sequence
  Description of Artificial Sequence: Synthetic polypeptide
DENEIRTTNPVATEQWGDAVSEIEMYAAEDA

SEQ ID NO: 153766 - protein, 31 aa, Artificial Sequence
  Description of Artificial Sequence: Synthetic polypeptide
DENEIRTTNPVATEQWGDAVSEIEMNFAEDA

SEQ ID NO: 153767 - protein, 38 aa, Artificial Sequence
  Description of Artificial Sequence: Synthetic polypeptide
DEEEIRTTNPVATEQYGVVSVVVSNLQQGNSEGGSVSE

SEQ ID NO: 153768 - protein, 34 aa, Artificial Sequence
  Description of Artificial Sequence: Synthetic polypeptide
DEESIRTTNPVAYEGYGSTVNDTGNGSQQPVNNE

SEQ ID NO: 153769 - protein, 31 aa, Artificial Sequence
  Description of Artificial Sequence: Synthetic polypeptide
DENEIRTTNPVATEQWGDAVSEIEMNAAEDK

SEQ ID NO: 153770 - protein, 31 aa, Artificial Sequence
  Description of Artificial Sequence: Synthetic polypeptide
DENEIRTTNPVATEQWGDAVSEIEMNAAEDA

SEQ ID NO: 153771 - protein, 31 aa, Artificial Sequence
  Description of Artificial Sequence: Synthetic polypeptide
DENEIRTTNPVATEQWGDAVSEIEENAAEDW

SEQ ID NO: 153772 - protein, 35 aa, Artificial Sequence
  Description of Artificial Sequence: Synthetic polypeptide
DEESIRTTNPVAYEGYGSTVNTTGNGGSQQRSNNS

SEQ ID NO: 153773 - protein, 31 aa, Artificial Sequence
  Description of Artificial Sequence: Synthetic polypeptide
DENEIRTTNPVATEQWGDASEIESMNAAEDA

SEQ ID NO: 153774 - protein, 34 aa, Artificial Sequence
  Description of Artificial Sequence: Synthetic polypeptide
DEESIRTTNPVAYEGYGSTVNTTGNGSQDDSNNE

SEQ ID NO: 153775 - protein, 38 aa, Artificial Sequence
  Description of Artificial Sequence: Synthetic polypeptide
DEEEIRTTNPVATEQYGVVSVVVSNNQQAGNSEQGNAE

SEQ ID NO: 153776 - protein, 30 aa, Artificial Sequence
  Description of Artificial Sequence: Synthetic polypeptide
DENEIRTTNPVATEQWGDASEIEMNAAEEK

SEQ ID NO: 153777 - protein, 32 aa, Artificial Sequence
  Description of Artificial Sequence: Synthetic polypeptide
DENEIRTTNPVATEQWGDAVSEIEMNAAEHDA

SEQ ID NO: 153778 - protein, 35 aa, Artificial Sequence
  Description of Artificial Sequence: Synthetic polypeptide
DEETICTTNPVATEAYGSVATVNNDQQGTEENETD

SEQ ID NO: 153779 - protein, 32 aa, Artificial Sequence
  Description of Artificial Sequence: Synthetic polypeptide
DENEIRTTNPVATEQWGDISMEIEQMQAAENA

SEQ ID NO: 153780 - protein, 32 aa, Artificial Sequence
  Description of Artificial Sequence: Synthetic polypeptide
DENEIRTTNPVATEQWGDIVSEITEMNAPEDA

SEQ ID NO: 153781 - protein, 35 aa, Artificial Sequence
  Description of Artificial Sequence: Synthetic polypeptide
DEESICTTNPVATEAYGSVATTVNNQQGQGTNQDT

SEQ ID NO: 153782 - protein, 34 aa, Artificial Sequence
  Description of Artificial Sequence: Synthetic polypeptide
DEESICTTNPVATEAYGSVATVNNDDQGTEENEM

SEQ ID NO: 153783 - protein, 30 aa, Artificial Sequence
  Description of Artificial Sequence: Synthetic polypeptide
DENEIRTTNPVATEQWGDVFEIEMNAAEDV

SEQ ID NO: 153784 - protein, 30 aa, Artificial Sequence
  Description of Artificial Sequence: Synthetic polypeptide
DENEIRTTNPVATEQWGDVFEIEMNAAEDA

SEQ ID NO: 153785 - protein, 33 aa, Artificial Sequence
  Description of Artificial Sequence: Synthetic polypeptide
DENEIRTTNPVATEQWGDVDSNIGENNGQEEDA

SEQ ID NO: 153786 - protein, 32 aa, Artificial Sequence
  Description of Artificial Sequence: Synthetic polypeptide
DENEIRTTNPVATEQWGDVCSELEMNIAEDYA

SEQ ID NO: 153787 - protein, 32 aa, Artificial Sequence
  Description of Artificial Sequence: Synthetic polypeptide
DENEIRTTNPVATEQWGDVCSEIEVENAAENA

SEQ ID NO: 153788 - protein, 31 aa, Artificial Sequence
  Description of Artificial Sequence: Synthetic polypeptide
DENEIRTTNPVATEQWGDVCSEIEMNWAEDA

SEQ ID NO: 153789 - protein, 31 aa, Artificial Sequence
  Description of Artificial Sequence: Synthetic polypeptide
DENEIRTTNPVATEQWGDVCSEIEMNAEEDD

SEQ ID NO: 153790 - protein, 32 aa, Artificial Sequence
  Description of Artificial Sequence: Synthetic polypeptide
DENEIRTTNPVATEQWGDVCSEIEMNAAEDLA

SEQ ID NO: 153791 - protein, 31 aa, Artificial Sequence
  Description of Artificial Sequence: Synthetic polypeptide
DENEIRTTNPVATEQWGDVCSEIEMNAAEDD

SEQ ID NO: 153792 - protein, 31 aa, Artificial Sequence
  Description of Artificial Sequence: Synthetic polypeptide
DENEIRTTNPVATEQWGDVCSEIEMNAAEDC

SEQ ID NO: 153793 - protein, 31 aa, Artificial Sequence
  Description of Artificial Sequence: Synthetic polypeptide
DENEIRTTNPVATEQWGDVCSEIEMNAAEDA

SEQ ID NO: 153794 - protein, 31 aa, Artificial Sequence
  Description of Artificial Sequence: Synthetic polypeptide
DENEIRTTNPVATEQWGDVCSEDGEMAEEDD

SEQ ID NO: 153795 - protein, 30 aa, Artificial Sequence
  Description of Artificial Sequence: Synthetic polypeptide
DENEIRTTNPVATEQWGDVCEIEMNAAEDA

SEQ ID NO: 153796 - protein, 30 aa, Artificial Sequence
  Description of Artificial Sequence: Synthetic polypeptide
DENEIRTTNPVATEQWGDVCEGEMNAAEDA

SEQ ID NO: 153797 - protein, 34 aa, Artificial Sequence
  Description of Artificial Sequence: Synthetic polypeptide
DEESICTTNPVATEAYGSVNTVNTDQGTEENESN

SEQ ID NO: 153798 - protein, 32 aa, Artificial Sequence
  Description of Artificial Sequence: Synthetic polypeptide
DENEIATTNPVAYEQWGGVYSTEIEMTQREDA

SEQ ID NO: 153799 - protein, 34 aa, Artificial Sequence
  Description of Artificial Sequence: Synthetic polypeptide
DEAEIACTNPVATEQYGSVAATNEEADRHQAGQA

SEQ ID NO: 153800 - protein, 31 aa, Artificial Sequence
  Description of Artificial Sequence: Synthetic polypeptide
DENEIRTTNPVATEQWGDVFSEIEMNAAADA

SEQ ID NO: 153801 - protein, 33 aa, Artificial Sequence
  Description of Artificial Sequence: Synthetic polypeptide
DEESIATVNPVATEPYGSVSNAGNLEMNASNEN

SEQ ID NO: 153802 - protein, 31 aa, Artificial Sequence
  Description of Artificial Sequence: Synthetic polypeptide
DENEIRTTNPVATEQWGDVISEIEMNAAEDA

SEQ ID NO: 153803 - protein, 31 aa, Artificial Sequence
  Description of Artificial Sequence: Synthetic polypeptide
DENEIRTTNPVATEQWGDVIENIEMNAAEDA

SEQ ID NO: 153804 - protein, 35 aa, Artificial Sequence
  Description of Artificial Sequence: Synthetic polypeptide
DEGEIATTNPVAYEQYGSVCSPTNNNGQTHAGITE

SEQ ID NO: 153805 - protein, 30 aa, Artificial Sequence
  Description of Artificial Sequence: Synthetic polypeptide
DENEIRTTNPVATEQWGDVIEIEMNAAEDA

SEQ ID NO: 153806 - protein, 32 aa, Artificial Sequence
  Description of Artificial Sequence: Synthetic polypeptide
DENEIRTTNPVATEQWGDVHSEIEMNAAEDAF

SEQ ID NO: 153807 - protein, 37 aa, Artificial Sequence
  Description of Artificial Sequence: Synthetic polypeptide
DEEEIRTTNPVATWQYGSVSSTTPAIGPNMRNGMNPV

SEQ ID NO: 153808 - protein, 33 aa, Artificial Sequence
  Description of Artificial Sequence: Synthetic polypeptide
DEGEIATTNPVAYEQYGSVCSPPGGAEAEGNEN

SEQ ID NO: 153809 - protein, 31 aa, Artificial Sequence
  Description of Artificial Sequence: Synthetic polypeptide
DENEIRTTNPVATEQWGDVHSEIEMNAAEDA

SEQ ID NO: 153810 - protein, 31 aa, Artificial Sequence
  Description of Artificial Sequence: Synthetic polypeptide
DENEIRTTNPVATEQWGDVASEIEMNWAEDA

SEQ ID NO: 153811 - protein, 31 aa, Artificial Sequence
  Description of Artificial Sequence: Synthetic polypeptide
DENEIRTTNPVATEQWGDVHEILEMNAAEDA

SEQ ID NO: 153812 - protein, 30 aa, Artificial Sequence
  Description of Artificial Sequence: Synthetic polypeptide
DENEIRTTNPVATEQWGDVHEIEMNAAEDA

SEQ ID NO: 153813 - protein, 31 aa, Artificial Sequence
  Description of Artificial Sequence: Synthetic polypeptide
DENEIRTTNPVATEQWGDVGSEIEMNAAEKA

SEQ ID NO: 153814 - protein, 32 aa, Artificial Sequence
  Description of Artificial Sequence: Synthetic polypeptide
DENEIRTTNPVATEQWGDVGSEIEMNAAEDTA

SEQ ID NO: 153815 - protein, 31 aa, Artificial Sequence
  Description of Artificial Sequence: Synthetic polypeptide
DENEIRTTNPVATEQWGDVGSEIEMNAAEDA

SEQ ID NO: 153816 - protein, 30 aa, Artificial Sequence
  Description of Artificial Sequence: Synthetic polypeptide
DENEIRTTNPVATEQWGDVGEIEMNAAEDA

SEQ ID NO: 153817 - protein, 31 aa, Artificial Sequence
  Description of Artificial Sequence: Synthetic polypeptide
DENEIRTTNPVATEQWGDVFSEIEMNAIEDA

SEQ ID NO: 153818 - protein, 32 aa, Artificial Sequence
  Description of Artificial Sequence: Synthetic polypeptide
DENEIRTTNPVATEQWGDVFSEIEMNAAEDQA

SEQ ID NO: 153819 - protein, 31 aa, Artificial Sequence
  Description of Artificial Sequence: Synthetic polypeptide
DENEIRTTNPVATEQWGDVFSEIEMNAAEDA

SEQ ID NO: 153820 - protein, 30 aa, Artificial Sequence
  Description of Artificial Sequence: Synthetic polypeptide
DENEIRTTNPVATEQWGDVHEIEMYAAEDA

SEQ ID NO: 153821 - protein, 31 aa, Artificial Sequence
  Description of Artificial Sequence: Synthetic polypeptide
DENEIRTTNPVATEQWGDIVSEIEMNAAEDA

SEQ ID NO: 153822 - protein, 38 aa, Artificial Sequence
  Description of Artificial Sequence: Synthetic polypeptide
DEEEIRTTNPVATEQYGVVSVVVNTNNNNLQQGTDEEE

SEQ ID NO: 153823 - protein, 37 aa, Artificial Sequence
  Description of Artificial Sequence: Synthetic polypeptide
DEEEIRTTNPVATTQYGSVSSTTPAGPNMRNGMNPVA

SEQ ID NO: 153824 - protein, 30 aa, Artificial Sequence
  Description of Artificial Sequence: Synthetic polypeptide
DENEIRTTNPVATEQWGDQSWIEMNAAEDA

SEQ ID NO: 153825 - protein, 37 aa, Artificial Sequence
  Description of Artificial Sequence: Synthetic polypeptide
DEEEIRTTNPVATSQYGQSVSSTTPAGPNMRNGMNPV

SEQ ID NO: 153826 - protein, 31 aa, Artificial Sequence
  Description of Artificial Sequence: Synthetic polypeptide
DENEIRTTNPVATEQWGDMVSEIEMNAMEDA

SEQ ID NO: 153827 - protein, 33 aa, Artificial Sequence
  Description of Artificial Sequence: Synthetic polypeptide
DEESIGSTNPVATEIYGSVSPVGLDDGGPGQIR

SEQ ID NO: 153828 - protein, 31 aa, Artificial Sequence
  Description of Artificial Sequence: Synthetic polypeptide
DENEIRTTNPVATEQWGDMVSEIEMNAAEDA

SEQ ID NO: 153829 - protein, 32 aa, Artificial Sequence
  Description of Artificial Sequence: Synthetic polypeptide
DENEIRTTNPVATEQWGDMSVRIQEMNAAEDA

SEQ ID NO: 153830 - protein, 30 aa, Artificial Sequence
  Description of Artificial Sequence: Synthetic polypeptide
DENEIRTTNPVATEQWGDMSEIPMNAAEDA

SEQ ID NO: 153831 - protein, 30 aa, Artificial Sequence
  Description of Artificial Sequence: Synthetic polypeptide
DENEIRTTNPVATEQWGDMSEIEMNAAEDA

SEQ ID NO: 153832 - protein, 32 aa, Artificial Sequence
  Description of Artificial Sequence: Synthetic polypeptide
DENEIRTTNPVATEQWGDLVSENIEMNAAEDA

SEQ ID NO: 153833 - protein, 31 aa, Artificial Sequence
  Description of Artificial Sequence: Synthetic polypeptide
DENEIRTTNPVATEQWGDLVSEIEMNAAQDA

SEQ ID NO: 153834 - protein, 31 aa, Artificial Sequence
  Description of Artificial Sequence: Synthetic polypeptide
DENEIRTTNPVATEQWGDLVSEIEMNAAEDA

SEQ ID NO: 153835 - protein, 30 aa, Artificial Sequence
  Description of Artificial Sequence: Synthetic polypeptide
DENEIRTTNPVATEQWGDLSEIEMNAAEDA

SEQ ID NO: 153836 - protein, 30 aa, Artificial Sequence
  Description of Artificial Sequence: Synthetic polypeptide
DENEIRTTNPVATEQWGDLSEIEINAAEDA

SEQ ID NO: 153837 - protein, 31 aa, Artificial Sequence
  Description of Artificial Sequence: Synthetic polypeptide
DENEIRTTNPVATEQWGDKVSEIEMNAAVDA

SEQ ID NO: 153838 - protein, 31 aa, Artificial Sequence
  Description of Artificial Sequence: Synthetic polypeptide
DENEIRTTNPVATEQWGDKVSEIEMNAAEDF

SEQ ID NO: 153839 - protein, 31 aa, Artificial Sequence
  Description of Artificial Sequence: Synthetic polypeptide
DENEIRTTNPVATEQWGDKVSEIEMNAAEDA

SEQ ID NO: 153840 - protein, 31 aa, Artificial Sequence
  Description of Artificial Sequence: Synthetic polypeptide
DENEIRTTNPVATEQWGDKVSEIEMHAAEDA

SEQ ID NO: 153841 - protein, 31 aa, Artificial Sequence
  Description of Artificial Sequence: Synthetic polypeptide
DENEIRTTNPVATEQWGDQVSEIEMNAAEDA

SEQ ID NO: 153842 - protein, 30 aa, Artificial Sequence
  Description of Artificial Sequence: Synthetic polypeptide
DENEIRTTNPVATEQWGDRSEIEMNDAEDA

SEQ ID NO: 153843 - protein, 30 aa, Artificial Sequence
  Description of Artificial Sequence: Synthetic polypeptide
DENEIRTTNPVATEQWGDRSEIGMNAAEDA

SEQ ID NO: 153844 - protein, 30 aa, Artificial Sequence
  Description of Artificial Sequence: Synthetic polypeptide
DENEIRTTNPVATEQWGDRSEIWMNAAEDA

SEQ ID NO: 153845 - protein, 32 aa, Artificial Sequence
  Description of Artificial Sequence: Synthetic polypeptide
DENEIRTTNPVATEQWGDVASEIEMNAAEDAA

SEQ ID NO: 153846 - protein, 31 aa, Artificial Sequence
  Description of Artificial Sequence: Synthetic polypeptide
DENEIRTTNPVATEQWGDVASEIEMNAAEDA

SEQ ID NO: 153847 - protein, 31 aa, Artificial Sequence
  Description of Artificial Sequence: Synthetic polypeptide
DENEIRTTNPVATEQWGDVASEHEMNAAEDA

SEQ ID NO: 153848 - protein, 30 aa, Artificial Sequence
  Description of Artificial Sequence: Synthetic polypeptide
DENEIRTTNPVATEQWGDVANIIMSAAEDA

SEQ ID NO: 153849 - protein, 34 aa, Artificial Sequence
  Description of Artificial Sequence: Synthetic polypeptide
DEESICTTNPVATEAYGSVTTVNTDQGTEENEMD

SEQ ID NO: 153850 - protein, 30 aa, Artificial Sequence
  Description of Artificial Sequence: Synthetic polypeptide
DENEIRTTNPVATEQWGDVAEIEMNAAEDA

SEQ ID NO: 153851 - protein, 31 aa, Artificial Sequence
  Description of Artificial Sequence: Synthetic polypeptide
DENEIRTTNPVATEQWGDTVSEIEMNPAEDI

SEQ ID NO: 153852 - protein, 31 aa, Artificial Sequence
  Description of Artificial Sequence: Synthetic polypeptide
DENEIRTTNPVATEQWGDTVSEIEMNFAEDA

SEQ ID NO: 153853 - protein, 32 aa, Artificial Sequence
  Description of Artificial Sequence: Synthetic polypeptide
DEAEIACTNPVATEQYGSVANMNDETAGIGEA

SEQ ID NO: 153854 - protein, 32 aa, Artificial Sequence
  Description of Artificial Sequence: Synthetic polypeptide
DENEIRTTNPVATEQWGDTVSEIEMNAKEDYI

SEQ ID NO: 153855 - protein, 32 aa, Artificial Sequence
  Description of Artificial Sequence: Synthetic polypeptide
DENEIRTTNPVATEQWGDTVSEIEMNAAERDA

SEQ ID NO: 153856 - protein, 31 aa, Artificial Sequence
  Description of Artificial Sequence: Synthetic polypeptide
DENEIRTTNPVATEQWGDTVSEIEMNAAEDA

SEQ ID NO: 153857 - protein, 32 aa, Artificial Sequence
  Description of Artificial Sequence: Synthetic polypeptide
DENEIRTTNPVATEQWGDTVSEIEFIAAEDNA

SEQ ID NO: 153858 - protein, 32 aa, Artificial Sequence
  Description of Artificial Sequence: Synthetic polypeptide
DENEIRTTNPVATEQWGDTVSAIEMNAKEDYI

SEQ ID NO: 153859 - protein, 35 aa, Artificial Sequence
  Description of Artificial Sequence: Synthetic polypeptide
DEGEIATTNPVAYEQYGSVCAATNPLNQGSEDNDS

SEQ ID NO: 153860 - protein, 31 aa, Artificial Sequence
  Description of Artificial Sequence: Synthetic polypeptide
DENEIATTNPVAYEQWGIVSKEIENRQAEDA

SEQ ID NO: 153861 - protein, 38 aa, Artificial Sequence
  Description of Artificial Sequence: Synthetic polypeptide
DEEEIRTTNPVATEQYGVVSVVVSNLGQAGSEGGTTNQ

SEQ ID NO: 153862 - protein, 31 aa, Artificial Sequence
  Description of Artificial Sequence: Synthetic polypeptide
DENEIRTTNPVATEQWGDRVSEIEMNAAEDA

SEQ ID NO: 153863 - protein, 31 aa, Artificial Sequence
  Description of Artificial Sequence: Synthetic polypeptide
DENEIRTTNPVATEQWGDTVSEIEMNACEDA

SEQ ID NO: 153864 - protein, 32 aa, Artificial Sequence
  Description of Artificial Sequence: Synthetic polypeptide
DENEIRTTNPVATEQWGDVISEIEMNAAEDQA

SEQ ID NO: 153865 - protein, 33 aa, Artificial Sequence
  Description of Artificial Sequence: Synthetic polypeptide
DENEIRTTNPVATEQWGCVTSFEVEMNILEDEN

SEQ ID NO: 153866 - protein, 35 aa, Artificial Sequence
  Description of Artificial Sequence: Synthetic polypeptide
DEGEIATTNPVAYEQYGSVAPTGNPLPDSMGPNDN

SEQ ID NO: 153867 - protein, 32 aa, Artificial Sequence
  Description of Artificial Sequence: Synthetic polypeptide
DEGEIATTNPVAYEQWGSCQTWDHIREMNNMR

SEQ ID NO: 153868 - protein, 35 aa, Artificial Sequence
  Description of Artificial Sequence: Synthetic polypeptide
DEEEIRTTNPVATGQYGSVSIYPDYQADANIDSEG

SEQ ID NO: 153869 - protein, 33 aa, Artificial Sequence
  Description of Artificial Sequence: Synthetic polypeptide
DENEIRTTNPVATEPYGTISSMEDIQQQQNGNH

SEQ ID NO: 153870 - protein, 32 aa, Artificial Sequence
  Description of Artificial Sequence: Synthetic polypeptide
DENEIRTTNPVATEPYGTISMEIIQQQQNGDH

SEQ ID NO: 153871 - protein, 32 aa, Artificial Sequence
  Description of Artificial Sequence: Synthetic polypeptide
DENEIRTTNPVATEPYGTISMEIIQQQANENH

SEQ ID NO: 153872 - protein, 32 aa, Artificial Sequence
  Description of Artificial Sequence: Synthetic polypeptide
DENEIRTTNPVATEPYGTISMEIIQQNQNGDA

SEQ ID NO: 153873 - protein, 32 aa, Artificial Sequence
  Description of Artificial Sequence: Synthetic polypeptide
DENEIRTTNPVATEPYGTISMEIIQMNQNGDA

SEQ ID NO: 153874 - protein, 32 aa, Artificial Sequence
  Description of Artificial Sequence: Synthetic polypeptide
DENEIRTTNPVATEPYGTISMEIIQMNQNEDA

SEQ ID NO: 153875 - protein, 33 aa, Artificial Sequence
  Description of Artificial Sequence: Synthetic polypeptide
DENEIRTTNPVATEPYGTISMEDRIQQQQNGNH

SEQ ID NO: 153876 - protein, 33 aa, Artificial Sequence
  Description of Artificial Sequence: Synthetic polypeptide
DEAEIACTNPVAYEQYGSVATNHTQTRNPDEAL

SEQ ID NO: 153877 - protein, 32 aa, Artificial Sequence
  Description of Artificial Sequence: Synthetic polypeptide
DEGEIATTNPVAYEPYGSVAGNGDQNSDGSVH

SEQ ID NO: 153878 - protein, 34 aa, Artificial Sequence
  Description of Artificial Sequence: Synthetic polypeptide
DEGEIATTNPVAYEPYGSTVCAGNNLTDAGGNER

SEQ ID NO: 153879 - protein, 32 aa, Artificial Sequence
  Description of Artificial Sequence: Synthetic polypeptide
DENEIRTTNPVATEPYGTISMEDIQQQQNGGH

SEQ ID NO: 153880 - protein, 32 aa, Artificial Sequence
  Description of Artificial Sequence: Synthetic polypeptide
DENEIRTTNPVATEPYGTISMEDIQQQQNGEL

SEQ ID NO: 153881 - protein, 32 aa, Artificial Sequence
  Description of Artificial Sequence: Synthetic polypeptide
DENEIRTTNPVATEPYGTISMEDIQQQQNGEH

SEQ ID NO: 153882 - protein, 32 aa, Artificial Sequence
  Description of Artificial Sequence: Synthetic polypeptide
DENEIRTTNPVATEPYGTISMEDIQQQQNGDH

SEQ ID NO: 153883 - protein, 33 aa, Artificial Sequence
  Description of Artificial Sequence: Synthetic polypeptide
DENEIRTTNPVATEPYGTISMEDIQQQQEGNDH

SEQ ID NO: 153884 - protein, 32 aa, Artificial Sequence
  Description of Artificial Sequence: Synthetic polypeptide
DEGEIATTNPVAYEQWGSCWTDLIDREMNNSM

SEQ ID NO: 153885 - protein, 34 aa, Artificial Sequence
  Description of Artificial Sequence: Synthetic polypeptide
DDEEISTTNPVATCQYGCVCSNTGNPINFGSNQA

SEQ ID NO: 153886 - protein, 33 aa, Artificial Sequence
  Description of Artificial Sequence: Synthetic polypeptide
DENEIRTTNPVATEPYGTTWSAEDIQQQQKGNH

SEQ ID NO: 153887 - protein, 38 aa, Artificial Sequence
  Description of Artificial Sequence: Synthetic polypeptide
DEEEIRTTNPVATEQYGVVSVVVTTNNLEQGNNNEEEE

SEQ ID NO: 153888 - protein, 32 aa, Artificial Sequence
  Description of Artificial Sequence: Synthetic polypeptide
DENEIRTTNPVATEQWGAVPSEVEMNIAEDEA

SEQ ID NO: 153889 - protein, 31 aa, Artificial Sequence
  Description of Artificial Sequence: Synthetic polypeptide
DENEIRTTNPVATEQWGAVGSEIEMNAAEDA

SEQ ID NO: 153890 - protein, 35 aa, Artificial Sequence
  Description of Artificial Sequence: Synthetic polypeptide
DEEEIRTTNPVATEQYGSVVNINATEHLVGEEVEY

SEQ ID NO: 153891 - protein, 31 aa, Artificial Sequence
  Description of Artificial Sequence: Synthetic polypeptide
DENEIRTTNPVATEQWGATSNEIWANAKGPI

SEQ ID NO: 153892 - protein, 32 aa, Artificial Sequence
  Description of Artificial Sequence: Synthetic polypeptide
DEAEIRTTNPVATEQWGCVSEGVEMNAAEDAQ

SEQ ID NO: 153893 - protein, 33 aa, Artificial Sequence
  Description of Artificial Sequence: Synthetic polypeptide
DDEEISTTNPVATCQYGCVCSTEPIENFGSNQA

SEQ ID NO: 153894 - protein, 33 aa, Artificial Sequence
  Description of Artificial Sequence: Synthetic polypeptide
DENEIRTTNPVATEQWGACVTSEVEMNILQDEA

SEQ ID NO: 153895 - protein, 32 aa, Artificial Sequence
  Description of Artificial Sequence: Synthetic polypeptide
DENEIRTTNPVATEQWGACVSEVEENIAEDFA

SEQ ID NO: 153896 - protein, 32 aa, Artificial Sequence
  Description of Artificial Sequence: Synthetic polypeptide
DEGEIATTNPVAYEPYGSTAANGLTGAPGNPE

SEQ ID NO: 153897 - protein, 35 aa, Artificial Sequence
  Description of Artificial Sequence: Synthetic polypeptide
DEETIRTTNPCATEQYGSVPEIANLQATTAPVGQN

SEQ ID NO: 153898 - protein, 35 aa, Artificial Sequence
  Description of Artificial Sequence: Synthetic polypeptide
DEEEIRTTNPVATEQYGSVVNVGFGQENNQDEDGT

SEQ ID NO: 153899 - protein, 36 aa, Artificial Sequence
  Description of Artificial Sequence: Synthetic polypeptide
DEEEIRTTNPVATEQYGSVVPDDDEDEQNVGGENGG

SEQ ID NO: 153900 - protein, 36 aa, Artificial Sequence
  Description of Artificial Sequence: Synthetic polypeptide
DEEEIRTTNPVATEQYGSVVPDFDENEQNVGGEQGG

SEQ ID NO: 153901 - protein, 35 aa, Artificial Sequence
  Description of Artificial Sequence: Synthetic polypeptide
DEEEIRTTNPVATEQYGSVVPGDFLEMRQVLSEWN

SEQ ID NO: 153902 - protein, 36 aa, Artificial Sequence
  Description of Artificial Sequence: Synthetic polypeptide
DEEEIRTTNPVATEQYGSVVPGENLEEHGVMEEDEL

SEQ ID NO: 153903 - protein, 37 aa, Artificial Sequence
  Description of Artificial Sequence: Synthetic polypeptide
DEEEIRTTNPVATEQYGSVVPGENYLQEHIVEENDEL

SEQ ID NO: 153904 - protein, 36 aa, Artificial Sequence
  Description of Artificial Sequence: Synthetic polypeptide
DEEEIRTTNPVATEQYGSVVPLENLPEHFVMENDMI

SEQ ID NO: 153905 - protein, 37 aa, Artificial Sequence
  Description of Artificial Sequence: Synthetic polypeptide
DEEEIRTTNPVATEQYGSVVPMEGYLQEHRVEENDEL

SEQ ID NO: 153906 - protein, 36 aa, Artificial Sequence
  Description of Artificial Sequence: Synthetic polypeptide
CEEEISTTNPVATEQYGCVCSNTGELDQNFGSNTQS

SEQ ID NO: 153907 - protein, 30 aa, Artificial Sequence
  Description of Artificial Sequence: Synthetic polypeptide
DENEIRTTNPVATEQWGAVQEIEMNAEEDD

SEQ ID NO: 153908 - protein, 35 aa, Artificial Sequence
  Description of Artificial Sequence: Synthetic polypeptide
DEEEIRTTNPVATEYYGTVVDEGGNLDGNQGNFGI

SEQ ID NO: 153909 - protein, 32 aa, Artificial Sequence
  Description of Artificial Sequence: Synthetic polypeptide
DENEIRTTNPVATEPYGTISMEDIQMQQNENA

SEQ ID NO: 153910 - protein, 36 aa, Artificial Sequence
  Description of Artificial Sequence: Synthetic polypeptide
DEEEIRTTNPVATEQYGSVVQVMSWGEVQHGTQEQP

SEQ ID NO: 153911 - protein, 35 aa, Artificial Sequence
  Description of Artificial Sequence: Synthetic polypeptide
DEAEIRTTNPVATEQFGCVCSSTLYMVLRGGQNDS

SEQ ID NO: 153912 - protein, 36 aa, Artificial Sequence
  Description of Artificial Sequence: Synthetic polypeptide
DENEIRTTNPVATEPYGSVSSTTPAGPNMRNGMNPV

SEQ ID NO: 153913 - protein, 34 aa, Artificial Sequence
  Description of Artificial Sequence: Synthetic polypeptide
CEEEISTTNPVATEQYGCVCSNTGNHANFGSEQT

SEQ ID NO: 153914 - protein, 34 aa, Artificial Sequence
  Description of Artificial Sequence: Synthetic polypeptide
DDEEIRTTNPVATEQWGCVTSNTEDNQNFNSQQS

SEQ ID NO: 153915 - protein, 35 aa, Artificial Sequence
  Description of Artificial Sequence: Synthetic polypeptide
DEETIRTTNPVATEQWGVVATVNNNNQQLGNQNDE

SEQ ID NO: 153916 - protein, 34 aa, Artificial Sequence
  Description of Artificial Sequence: Synthetic polypeptide
DEAEIRTTNPVATEPYGISVWSWVVEADTIKNRS

SEQ ID NO: 153917 - protein, 34 aa, Artificial Sequence
  Description of Artificial Sequence: Synthetic polypeptide
DEAEIRTTNPVATEPYGISVSWVVLGADTIKNGS

SEQ ID NO: 153918 - protein, 36 aa, Artificial Sequence
  Description of Artificial Sequence: Synthetic polypeptide
DENEIRTTNPVATEPYGSISSTTPAGPNQRNGMNPV

SEQ ID NO: 153919 - protein, 31 aa, Artificial Sequence
  Description of Artificial Sequence: Synthetic polypeptide
CEGEIAPTNPCSYEQYGKVSCNVSQSGGMNR

SEQ ID NO: 153920 - protein, 36 aa, Artificial Sequence
  Description of Artificial Sequence: Synthetic polypeptide
DENEIRTTNPVATEPYGSISSTTEDIQQMRNGMNPH

SEQ ID NO: 153921 - protein, 36 aa, Artificial Sequence
  Description of Artificial Sequence: Synthetic polypeptide
DENEIRTTNPVATEPYGSISSTTEDIPQMRNGMNPH

SEQ ID NO: 153922 - protein, 35 aa, Artificial Sequence
  Description of Artificial Sequence: Synthetic polypeptide
DENEIRTTNPVATEPYGSISSTEDIQQMQNGMNPH

SEQ ID NO: 153923 - protein, 32 aa, Artificial Sequence
  Description of Artificial Sequence: Synthetic polypeptide
CEGEIAPTNPCSYEQYGKVSCNSLSQSGGVNR

SEQ ID NO: 153924 - protein, 36 aa, Artificial Sequence
  Description of Artificial Sequence: Synthetic polypeptide
DEEEIRTTNPVATEYYGMVSSTTPAGPNMRNGMNPV

SEQ ID NO: 153925 - protein, 33 aa, Artificial Sequence
  Description of Artificial Sequence: Synthetic polypeptide
DENEIRTTNPVATEPYGETISMEDIQQQQNGNH

SEQ ID NO: 153926 - protein, 37 aa, Artificial Sequence
  Description of Artificial Sequence: Synthetic polypeptide
DEEEIRTTNPVATEQYGSVVSGGMPDEGQEDEGNTQG

SEQ ID NO: 153927 - protein, 36 aa, Artificial Sequence
  Description of Artificial Sequence: Synthetic polypeptide
DEEEIRTTNPVATEQYGSVVQPTVMLQPSMDEAEEN

SEQ ID NO: 153928 - protein, 36 aa, Artificial Sequence
  Description of Artificial Sequence: Synthetic polypeptide
DEEEIRTTNPVATEQYGSVVQPHMEGWQQGQAQNQI

SEQ ID NO: 153929 - protein, 36 aa, Artificial Sequence
  Description of Artificial Sequence: Synthetic polypeptide
DEEEIRTTNPVATEQYGSVVQNGFNTTGDIEGEGNE

SEQ ID NO: 153930 - protein, 33 aa, Artificial Sequence
  Description of Artificial Sequence: Synthetic polypeptide
DENEIRTTNPVATEPYGTISATEDIQQQQEGEH

SEQ ID NO: 153931 - protein, 38 aa, Artificial Sequence
  Description of Artificial Sequence: Synthetic polypeptide
DEEEIRTTNPVATEQYGSVVPSTTPAEGPNERTGGNPV

SEQ ID NO: 153932 - protein, 33 aa, Artificial Sequence
  Description of Artificial Sequence: Synthetic polypeptide
DEGEIATTNPVATEQYGTVCSAADGPGEPEGND

SEQ ID NO: 153933 - protein, 35 aa, Artificial Sequence
  Description of Artificial Sequence: Synthetic polypeptide
DEGEIATTNPVATEQYGSVTSATDTLEPHEGMEDG

SEQ ID NO: 153934 - protein, 38 aa, Artificial Sequence
  Description of Artificial Sequence: Synthetic polypeptide
DEEEIRTTNPVATEQYGVVSVVVVNNNLQQGNNNEQND

SEQ ID NO: 153935 - protein, 33 aa, Artificial Sequence
  Description of Artificial Sequence: Synthetic polypeptide
DEAEIASTNPVAYEQYGSVTSAANQLDSNNPPP

SEQ ID NO: 153936 - protein, 36 aa, Artificial Sequence
  Description of Artificial Sequence: Synthetic polypeptide
DENEIATTNPVAYEQYGSVCSVDNGPQDSMIGNERW

SEQ ID NO: 153937 - protein, 36 aa, Artificial Sequence
  Description of Artificial Sequence: Synthetic polypeptide
DENEIATTNPVAYEQYGSVCSVDNLPQDSMDGMNMW

SEQ ID NO: 153938 - protein, 32 aa, Artificial Sequence
  Description of Artificial Sequence: Synthetic polypeptide
DENEIRTTNPVATEPYGTISEEIIQQQANENH

SEQ ID NO: 153939 - protein, 32 aa, Artificial Sequence
  Description of Artificial Sequence: Synthetic polypeptide
DENEIRTTNPVATEPYGTISMEDIQMQQNENH

SEQ ID NO: 153940 - protein, 36 aa, Artificial Sequence
  Description of Artificial Sequence: Synthetic polypeptide
DEEEIRTTNPVATEYYGSVSSTTPAGPNMRNGMQPV

SEQ ID NO: 153941 - protein, 36 aa, Artificial Sequence
  Description of Artificial Sequence: Synthetic polypeptide
DEETIRTTNPVATEQWGSVATTNNNNQQLGGNDEDE

SEQ ID NO: 153942 - protein, 36 aa, Artificial Sequence
  Description of Artificial Sequence: Synthetic polypeptide
DEETIRTTNPVATEQWGSVATVNNNNQQLGGNNNNE

SEQ ID NO: 153943 - protein, 36 aa, Artificial Sequence
  Description of Artificial Sequence: Synthetic polypeptide
DEETIRTTNPVATEQWGSVATVNNNNQQLGGNNTTT

SEQ ID NO: 153944 - protein, 36 aa, Artificial Sequence
  Description of Artificial Sequence: Synthetic polypeptide
DEETIRTTNPVATEQWGSVATVNNNNQQQNGNNTDE

SEQ ID NO: 153945 - protein, 37 aa, Artificial Sequence
  Description of Artificial Sequence: Synthetic polypeptide
DEEEIRTTNPVATEQYGSVVPTMGANEFAADQLENDD

SEQ ID NO: 153946 - protein, 32 aa, Artificial Sequence
  Description of Artificial Sequence: Synthetic polypeptide
DENEIRTTNPVATEPYGTISEEDIQQQAAGDH

SEQ ID NO: 153947 - protein, 37 aa, Artificial Sequence
  Description of Artificial Sequence: Synthetic polypeptide
DEEEIRTTNPVATEQYGSVVPTTPDGPNMGNGENDGT

SEQ ID NO: 153948 - protein, 36 aa, Artificial Sequence
  Description of Artificial Sequence: Synthetic polypeptide
DEEEIRTTNPVATEQYGSVVQNGFNTTDTGDGEGNE

SEQ ID NO: 153949 - protein, 36 aa, Artificial Sequence
  Description of Artificial Sequence: Synthetic polypeptide
DEETIRTTNPVATEQWGSVATTNNNNNQQQGNNTDE

SEQ ID NO: 153950 - protein, 32 aa, Artificial Sequence
  Description of Artificial Sequence: Synthetic polypeptide
DEAEIRTTNGVAYCQYGCVCSTELQHFISDQA

SEQ ID NO: 153951 - protein, 33 aa, Artificial Sequence
  Description of Artificial Sequence: Synthetic polypeptide
DDEEISTTNPVATCQYGCVCSTGEPNANFGSEQ

SEQ ID NO: 153952 - protein, 33 aa, Artificial Sequence
  Description of Artificial Sequence: Synthetic polypeptide
DEGEIATTNPVAYEQYGCVAANGLTGAPGNMEM

SEQ ID NO: 153953 - protein, 30 aa, Artificial Sequence
  Description of Artificial Sequence: Synthetic polypeptide
DEAEIRTTNPVATEQWGDCSEIEENAAEDA

SEQ ID NO: 153954 - protein, 32 aa, Artificial Sequence
  Description of Artificial Sequence: Synthetic polypeptide
DEAEIRTTNPVATEQWGCVSGEGVEMNAAEGA

SEQ ID NO: 153955 - protein, 31 aa, Artificial Sequence
  Description of Artificial Sequence: Synthetic polypeptide
DENEIRTTNPVATEQWGCVSEMWEENTIEDI

SEQ ID NO: 153956 - protein, 32 aa, Artificial Sequence
  Description of Artificial Sequence: Synthetic polypeptide
DENEIRTTNPVATEQWGCVSEIWEENTPEDAE

SEQ ID NO: 153957 - protein, 31 aa, Artificial Sequence
  Description of Artificial Sequence: Synthetic polypeptide
DENEIRTTNPVATEQWGCVSEIMHMNAAEDA

SEQ ID NO: 153958 - protein, 37 aa, Artificial Sequence
  Description of Artificial Sequence: Synthetic polypeptide
DEEEIRTTNPVATEQYGSVVMTQNEFNDQDDEEGGGG

SEQ ID NO: 153959 - protein, 32 aa, Artificial Sequence
  Description of Artificial Sequence: Synthetic polypeptide
DENEIRTTNPVATEQWGCVSEGEMNAAEDEAQ

SEQ ID NO: 153960 - protein, 31 aa, Artificial Sequence
  Description of Artificial Sequence: Synthetic polypeptide
DENEIRTTNPVATEQWGCVSDEIEMNAAEDA

SEQ ID NO: 153961 - protein, 32 aa, Artificial Sequence
  Description of Artificial Sequence: Synthetic polypeptide
DENEIRTTNPVATEQWGCVSCEIESMNAAVDA

SEQ ID NO: 153962 - protein, 38 aa, Artificial Sequence
  Description of Artificial Sequence: Synthetic polypeptide
DEEEIRTTNPVATEQYGVVSVVVTNLQAGTEQGTEEEE

SEQ ID NO: 153963 - protein, 32 aa, Artificial Sequence
  Description of Artificial Sequence: Synthetic polypeptide
DENEIRTTNPVATEQWGCVCSWEEMNALNDAA

SEQ ID NO: 153964 - protein, 34 aa, Artificial Sequence
  Description of Artificial Sequence: Synthetic polypeptide
DEAEIRTTNGVAYCQYGCVCSTNDLQESFGSDQS

SEQ ID NO: 153965 - protein, 39 aa, Artificial Sequence
  Description of Artificial Sequence: Synthetic polypeptide
DEEEIRTTNPVATEQYGVVSVVVTNLQAGTEQGTTNQEQ

SEQ ID NO: 153966 - protein, 32 aa, Artificial Sequence
  Description of Artificial Sequence: Synthetic polypeptide
DEGEIATTNPVAYEQYGSVAAPNGTAENPNDQ

SEQ ID NO: 153967 - protein, 33 aa, Artificial Sequence
  Description of Artificial Sequence: Synthetic polypeptide
DEGEIATTNPVAYEQYGSVAAAHLDDSGGNTHK

SEQ ID NO: 153968 - protein, 35 aa, Artificial Sequence
  Description of Artificial Sequence: Synthetic polypeptide
DEGEIATTNPVAYEQYGSTVCAANNLQDADGNFMD

SEQ ID NO: 153969 - protein, 35 aa, Artificial Sequence
  Description of Artificial Sequence: Synthetic polypeptide
DEGEIATTNPVAYEQYGSTVCAANDLQDSDGNEHA

SEQ ID NO: 153970 - protein, 31 aa, Artificial Sequence
  Description of Artificial Sequence: Synthetic polypeptide
DEAEIRTTNPVATEQWGDCSFIEMNTEEDAD

SEQ ID NO: 153971 - protein, 30 aa, Artificial Sequence
  Description of Artificial Sequence: Synthetic polypeptide
DEAEIRTTNPVATEQWGDFSEIEMNAAEDA

SEQ ID NO: 153972 - protein, 32 aa, Artificial Sequence
  Description of Artificial Sequence: Synthetic polypeptide
DENEIRTTNPVATEQWGCVSNSPEANAFSSDA

SEQ ID NO: 153973 - protein, 32 aa, Artificial Sequence
  Description of Artificial Sequence: Synthetic polypeptide
DENEIRTTNPVATEQWGCVSSADMNAFESDAF

SEQ ID NO: 153974 - protein, 32 aa, Artificial Sequence
  Description of Artificial Sequence: Synthetic polypeptide
DENEIRTTNPVATEQWGCVTSEINEENTAEDF

SEQ ID NO: 153975 - protein, 33 aa, Artificial Sequence
  Description of Artificial Sequence: Synthetic polypeptide
DEETICTTNPVATEFYGSVNNDNTGEEDEGGNE

SEQ ID NO: 153976 - protein, 35 aa, Artificial Sequence
  Description of Artificial Sequence: Synthetic polypeptide
DEETICTTNPVATEFYGSVNNTDNTGEQGENGGNI

SEQ ID NO: 153977 - protein, 38 aa, Artificial Sequence
  Description of Artificial Sequence: Synthetic polypeptide
DEEEIRTTNPVATEQYGVVSVVVSTQAGNQQGTNNTTD

SEQ ID NO: 153978 - protein, 32 aa, Artificial Sequence
  Description of Artificial Sequence: Synthetic polypeptide
DENEIRTTNPVATEQWGCVSSPEMNAFNSDAA

SEQ ID NO: 153979 - protein, 32 aa, Artificial Sequence
  Description of Artificial Sequence: Synthetic polypeptide
DENEIATTNPVAYEQYGSVASNPANPNPNAQP

SEQ ID NO: 153980 - protein, 33 aa, Artificial Sequence
  Description of Artificial Sequence: Synthetic polypeptide
DENEIATTNPVAYEQYGSVATHGTPDQGMGAEE

SEQ ID NO: 153981 - protein, 35 aa, Artificial Sequence
  Description of Artificial Sequence: Synthetic polypeptide
DEETICTTNPVATEFYGSVVDITDNTGEQDEGGNI

SEQ ID NO: 153982 - protein, 33 aa, Artificial Sequence
  Description of Artificial Sequence: Synthetic polypeptide
DENEIRTTNPVATEQWGCVCSTSPEMNAFNSDA

SEQ ID NO: 153983 - protein, 35 aa, Artificial Sequence
  Description of Artificial Sequence: Synthetic polypeptide
DEETICTTNPVATEFYGSVVDTDNTGEQDEFGGNI

SEQ ID NO: 153984 - protein, 31 aa, Artificial Sequence
  Description of Artificial Sequence: Synthetic polypeptide
DENEIRTTNPVATEQWGCVSSPEMEAFSSDA

SEQ ID NO: 153985 - protein, 32 aa, Artificial Sequence
  Description of Artificial Sequence: Synthetic polypeptide
DENEIRTTNPVATEQWGCVSSPEANAFISDAM

SEQ ID NO: 153986 - protein, 32 aa, Artificial Sequence
  Description of Artificial Sequence: Synthetic polypeptide
DENEIRTTNPVATEQWGCVSSMPEANAFNSDA

SEQ ID NO: 153987 - protein, 32 aa, Artificial Sequence
  Description of Artificial Sequence: Synthetic polypeptide
DENEIRTTNPVATEQWGCVSSEENANNSESDA

SEQ ID NO: 153988 - protein, 32 aa, Artificial Sequence
  Description of Artificial Sequence: Synthetic polypeptide
DENEIRTTNPVATEQWGCVSSAEMNAFSSDAN

SEQ ID NO: 153989 - protein, 32 aa, Artificial Sequence
  Description of Artificial Sequence: Synthetic polypeptide
DENEIRTTNPVATEQWGCVSSAEINAFNSDTA

SEQ ID NO: 153990 - protein, 32 aa, Artificial Sequence
  Description of Artificial Sequence: Synthetic polypeptide
DENEIRTTNPVATEQWGCVSSAEDNAFISDAA

SEQ ID NO: 153991 - protein, 33 aa, Artificial Sequence
  Description of Artificial Sequence: Synthetic polypeptide
DENEIRTTNPVATEQWGCVSSAEANAFNSDNAS

SEQ ID NO: 153992 - protein, 31 aa, Artificial Sequence
  Description of Artificial Sequence: Synthetic polypeptide
DEAEIRTTNPVATEQWGDVSVEIEMNAAEDV

SEQ ID NO: 153993 - protein, 34 aa, Artificial Sequence
  Description of Artificial Sequence: Synthetic polypeptide
DDEEISTTNPVATCQYGCVCSTGNDPTNFGSNQA

SEQ ID NO: 153994 - protein, 33 aa, Artificial Sequence
  Description of Artificial Sequence: Synthetic polypeptide
DEGEIATTNPVAYEQYGSTAATAGLTGAPGNPE

SEQ ID NO: 153995 - protein, 32 aa, Artificial Sequence
  Description of Artificial Sequence: Synthetic polypeptide
DEGEIATTNPVAYEQYGSASAPPANDNPGGQP

SEQ ID NO: 153996 - protein, 37 aa, Artificial Sequence
  Description of Artificial Sequence: Synthetic polypeptide
DEETIRATNPVATEQYGVVSTVTNLQQGQNNGNNQDD

SEQ ID NO: 153997 - protein, 35 aa, Artificial Sequence
  Description of Artificial Sequence: Synthetic polypeptide
DENEIATTNPVAYEQYGSVCMSNPLPQDHGDDNEA

SEQ ID NO: 153998 - protein, 35 aa, Artificial Sequence
  Description of Artificial Sequence: Synthetic polypeptide
DEETIRATNPVATEQYGVVSTVTNQQQQNQNNQDT

SEQ ID NO: 153999 - protein, 36 aa, Artificial Sequence
  Description of Artificial Sequence: Synthetic polypeptide
DEETIRATNPVATEQYGVVSTVVNNQQQQNGNNQGE

SEQ ID NO: 154000 - protein, 36 aa, Artificial Sequence
  Description of Artificial Sequence: Synthetic polypeptide
DEETIRATNPVATEQYGVVSTVVTNQQQQNGNNQED

SEQ ID NO: 154001 - protein, 31 aa, Artificial Sequence
  Description of Artificial Sequence: Synthetic polypeptide
DENEIRTTNPVATEQWGCVCSEPEMNISEDA

SEQ ID NO: 154002 - protein, 32 aa, Artificial Sequence
  Description of Artificial Sequence: Synthetic polypeptide
DENEIRTTNPVATEQWGCVAEGVEMNAAEDNA

SEQ ID NO: 154003 - protein, 32 aa, Artificial Sequence
  Description of Artificial Sequence: Synthetic polypeptide
DENEIRTTNPVATEQWGCFTSEVEMNILEDEA

SEQ ID NO: 154004 - protein, 31 aa, Artificial Sequence
  Description of Artificial Sequence: Synthetic polypeptide
DENEIRTTNPVATEQWGCDVSEISMNAAEDA

SEQ ID NO: 154005 - protein, 31 aa, Artificial Sequence
  Description of Artificial Sequence: Synthetic polypeptide
DENEIRTTNPVATEQWGCDVSEIQMHAAEDA

SEQ ID NO: 154006 - protein, 32 aa, Artificial Sequence
  Description of Artificial Sequence: Synthetic polypeptide
DENEIRTTNPVATEQWGCDVSEIEMNAAEDDA

SEQ ID NO: 154007 - protein, 31 aa, Artificial Sequence
  Description of Artificial Sequence: Synthetic polypeptide
DENEIRTTNPVATEQWGCDVSEIEMNAAEDA

SEQ ID NO: 154008 - protein, 32 aa, Artificial Sequence
  Description of Artificial Sequence: Synthetic polypeptide
DEGEIATTNPVAYEQYGCVAANTNLATPADPE

SEQ ID NO: 154009 - protein, 31 aa, Artificial Sequence
  Description of Artificial Sequence: Synthetic polypeptide
DENEIRTTNPVATEQWGCCVSEWEENTIEDA

SEQ ID NO: 154010 - protein, 31 aa, Artificial Sequence
  Description of Artificial Sequence: Synthetic polypeptide
DENEIRTTNPVATEQWGCCVSEVEENTHEDT

SEQ ID NO: 154011 - protein, 32 aa, Artificial Sequence
  Description of Artificial Sequence: Synthetic polypeptide
DENEIRTTNPVATEQWGCATSEVEENILEDEI

SEQ ID NO: 154012 - protein, 34 aa, Artificial Sequence
  Description of Artificial Sequence: Synthetic polypeptide
DDEEISTTNPVATCQYGCVCSTGNPTNFGSNTQS

SEQ ID NO: 154013 - protein, 36 aa, Artificial Sequence
  Description of Artificial Sequence: Synthetic polypeptide
DEETIRATNPVATEQYGVVSTVNQQQQQGNGNNQDD

SEQ ID NO: 154014 - protein, 36 aa, Artificial Sequence
  Description of Artificial Sequence: Synthetic polypeptide
DEETIRATNPVATEQYGVVSTVNNQQQQQNGNNQED

SEQ ID NO: 154015 - protein, 36 aa, Artificial Sequence
  Description of Artificial Sequence: Synthetic polypeptide
DEETIRATNPVATEQYGVVSTVNNNQQQQNGNNDDD

SEQ ID NO: 154016 - protein, 34 aa, Artificial Sequence
  Description of Artificial Sequence: Synthetic polypeptide
DEGEIATTNPVAYEQYGCVAGTGLDNQAGEMLRW

SEQ ID NO: 154017 - protein, 31 aa, Artificial Sequence
  Description of Artificial Sequence: Synthetic polypeptide
DENEIRTTNPVATEQWGCVCSSPEMNAFQDA

SEQ ID NO: 154018 - protein, 34 aa, Artificial Sequence
  Description of Artificial Sequence: Synthetic polypeptide
DEAEIRTTNGVAYCQYGCVCSTNHQENFGSDNQA

SEQ ID NO: 154019 - protein, 32 aa, Artificial Sequence
  Description of Artificial Sequence: Synthetic polypeptide
DENEIRTTNPVATEQWGCVCSSPEANHFESDA

SEQ ID NO: 154020 - protein, 32 aa, Artificial Sequence
  Description of Artificial Sequence: Synthetic polypeptide
DENEIRTTNPVATEQWGCVCSSPDANAFNSDA

SEQ ID NO: 154021 - protein, 33 aa, Artificial Sequence
  Description of Artificial Sequence: Synthetic polypeptide
DENEIRTTNPVATEQWGCVCSSMPETNAFESDA

SEQ ID NO: 154022 - protein, 36 aa, Artificial Sequence
  Description of Artificial Sequence: Synthetic polypeptide
DEEEIRTTNPVATEQYGSVYDQTVNFNAFEDDGGED

SEQ ID NO: 154023 - protein, 35 aa, Artificial Sequence
  Description of Artificial Sequence: Synthetic polypeptide
DEGEIATTNPVAYEQYGSACSPANALQEAEIGNND

SEQ ID NO: 154024 - protein, 34 aa, Artificial Sequence
  Description of Artificial Sequence: Synthetic polypeptide
DEGEIATTNPVAYEQYGSACSATNNNQTAGGDIT

SEQ ID NO: 154025 - protein, 38 aa, Artificial Sequence
  Description of Artificial Sequence: Synthetic polypeptide
DEEEIRTTNPVATEQYGVVSVVVTNNNNQAGNNDEEEE

SEQ ID NO: 154026 - protein, 33 aa, Artificial Sequence
  Description of Artificial Sequence: Synthetic polypeptide
DEGEIATTNPVAYEQYGSACATNPLADDPGGDI

SEQ ID NO: 154027 - protein, 33 aa, Artificial Sequence
  Description of Artificial Sequence: Synthetic polypeptide
DEAEIACTNPVATEQYGSVCATNLAGTLAEDAD

SEQ ID NO: 154028 - protein, 34 aa, Artificial Sequence
  Description of Artificial Sequence: Synthetic polypeptide
DEGEIATTNPVAYEQYGSACAATNPLNQTEDNDS

SEQ ID NO: 154029 - protein, 33 aa, Artificial Sequence
  Description of Artificial Sequence: Synthetic polypeptide
DEAEIACTNPVATEQYGSVCAVTALTQADEDDD

SEQ ID NO: 154030 - protein, 33 aa, Artificial Sequence
  Description of Artificial Sequence: Synthetic polypeptide
DEGEIATTNPVAYEQYGSACAATNNNQTAGGMT

SEQ ID NO: 154031 - protein, 35 aa, Artificial Sequence
  Description of Artificial Sequence: Synthetic polypeptide
DEAEIACTNPVATEQYGSVCSTNDQQEHQDGTAQK

SEQ ID NO: 154032 - protein, 38 aa, Artificial Sequence
  Description of Artificial Sequence: Synthetic polypeptide
DEEEIRTTNPVATEQYGVVSVVVTTNLNEQGNNNEETE

SEQ ID NO: 154033 - protein, 39 aa, Artificial Sequence
  Description of Artificial Sequence: Synthetic polypeptide
DEEEIRTTNPVATEQYGVVSVVVTTNLQAGNSEQGGVAE

SEQ ID NO: 154034 - protein, 36 aa, Artificial Sequence
  Description of Artificial Sequence: Synthetic polypeptide
DEETIRATNPVATEQYGVVSTVNNNQQQQNGNEQGD

SEQ ID NO: 154035 - protein, 35 aa, Artificial Sequence
  Description of Artificial Sequence: Synthetic polypeptide
DEAEIACTNPVATEQYGSVCAMANPAEDQDRGLNH

SEQ ID NO: 154036 - protein, 35 aa, Artificial Sequence
  Description of Artificial Sequence: Synthetic polypeptide
DEAEIRTTNPVATEPWGSVCPTDNDNNDQGGDNTM

SEQ ID NO: 154037 - protein, 38 aa, Artificial Sequence
  Description of Artificial Sequence: Synthetic polypeptide
DEEEIRTTNPVATEQYGVVSVVVNTNNLEQGNNTEETE

SEQ ID NO: 154038 - protein, 33 aa, Artificial Sequence
  Description of Artificial Sequence: Synthetic polypeptide
DEESIATTNPVAYECWGVVYNWTNDNQREGNMQ

SEQ ID NO: 154039 - protein, 32 aa, Artificial Sequence
  Description of Artificial Sequence: Synthetic polypeptide
DENEIATTNPVATESYGCVANNNLNIDAGAGH

SEQ ID NO: 154040 - protein, 31 aa, Artificial Sequence
  Description of Artificial Sequence: Synthetic polypeptide
DEESIACTNPVATEQWGCVAGTNDAMGDESL

SEQ ID NO: 154041 - protein, 37 aa, Artificial Sequence
  Description of Artificial Sequence: Synthetic polypeptide
DDEEIRTTNPVATEFYGSVSTMNQNVGDQTGGGNEEE

SEQ ID NO: 154042 - protein, 36 aa, Artificial Sequence
  Description of Artificial Sequence: Synthetic polypeptide
DEEEIRTTNPVATEQYGSVYGNFEDDEGGNDQENIV

SEQ ID NO: 154043 - protein, 39 aa, Artificial Sequence
  Description of Artificial Sequence: Synthetic polypeptide
DEEEIRTTNPVATEQYGVVSVTVVNTNLQQGNNQEDEDD

SEQ ID NO: 154044 - protein, 34 aa, Artificial Sequence
  Description of Artificial Sequence: Synthetic polypeptide
DEESIACTNPVATEQWGGCTVAGMNNLQEAGHNR

SEQ ID NO: 154045 - protein, 33 aa, Artificial Sequence
  Description of Artificial Sequence: Synthetic polypeptide
DEGEIRPTNPCSTEQYGIVSTTNLNMSNGMTPV

SEQ ID NO: 154046 - protein, 30 aa, Artificial Sequence
  Description of Artificial Sequence: Synthetic polypeptide
DEGEIRPTNPCSSEPYGTISMENIQQQGNH

SEQ ID NO: 154047 - protein, 30 aa, Artificial Sequence
  Description of Artificial Sequence: Synthetic polypeptide
DEGEIRPTNPCSSEPYGTISCENIQQQGNH

SEQ ID NO: 154048 - protein, 32 aa, Artificial Sequence
  Description of Artificial Sequence: Synthetic polypeptide
DENEIATTNPVATTQWGMVRTWDQGQQGQNEE

SEQ ID NO: 154049 - protein, 35 aa, Artificial Sequence
  Description of Artificial Sequence: Synthetic polypeptide
DEGEIRCTNPVATEQYGSVSTAENDHTQELFEDGD

SEQ ID NO: 154050 - protein, 33 aa, Artificial Sequence
  Description of Artificial Sequence: Synthetic polypeptide
DEGEIRATNPVAYEQWGEVTGWNDHQGMRGDRP

SEQ ID NO: 154051 - protein, 30 aa, Artificial Sequence
  Description of Artificial Sequence: Synthetic polypeptide
DEGEIRATNPVATEQWGCVSEGEMNAAEDA

SEQ ID NO: 154052 - protein, 33 aa, Artificial Sequence
  Description of Artificial Sequence: Synthetic polypeptide
DEGEIKTTNPVAYEQYGTVCSCTDGPSEFEGND

SEQ ID NO: 154053 - protein, 31 aa, Artificial Sequence
  Description of Artificial Sequence: Synthetic polypeptide
DENEIRTTNPVATEQWGDVSEIIEMNAAEDA

SEQ ID NO: 154054 - protein, 31 aa, Artificial Sequence
  Description of Artificial Sequence: Synthetic polypeptide
DENEIRTTNPVATEQWGDVSEIIEMNAADDA

SEQ ID NO: 154055 - protein, 31 aa, Artificial Sequence
  Description of Artificial Sequence: Synthetic polypeptide
DENEIRTTNPVATEQWGDVSEIIEMDAEEDG

SEQ ID NO: 154056 - protein, 32 aa, Artificial Sequence
  Description of Artificial Sequence: Synthetic polypeptide
DENEIRTTNPVATEQWGDVSEIIEMNAAEDAD

SEQ ID NO: 154057 - protein, 32 aa, Artificial Sequence
  Description of Artificial Sequence: Synthetic polypeptide
DENEIRTTNPVATEQWGDVSEIIEMNAEGEDG

SEQ ID NO: 154058 - protein, 31 aa, Artificial Sequence
  Description of Artificial Sequence: Synthetic polypeptide
DENEIRTTNPVATEQWGDVSEIIEMNEAEDA

SEQ ID NO: 154059 - protein, 31 aa, Artificial Sequence
  Description of Artificial Sequence: Synthetic polypeptide
DENEIRTTNPVATEQWGDVSEIIEMNPAEDA

SEQ ID NO: 154060 - protein, 33 aa, Artificial Sequence
  Description of Artificial Sequence: Synthetic polypeptide
DEAEIRTTNPVATEQYGCTCSSEHNQHFGSDQS

SEQ ID NO: 154061 - protein, 32 aa, Artificial Sequence
  Description of Artificial Sequence: Synthetic polypeptide
DENEIRTTNPVATEQWGDVSEINEMNAAEYDA

SEQ ID NO: 154062 - protein, 31 aa, Artificial Sequence
  Description of Artificial Sequence: Synthetic polypeptide
DENEIRTTNPVATEQWGDVSEIMEMNPAEDA

SEQ ID NO: 154063 - protein, 31 aa, Artificial Sequence
  Description of Artificial Sequence: Synthetic polypeptide
DENEIRTTNPVATEQWGDVSEIMEMNAAEDA

SEQ ID NO: 154064 - protein, 36 aa, Artificial Sequence
  Description of Artificial Sequence: Synthetic polypeptide
DEGEIRSTNPVATEPYGSVCIWVQNDQDQRKGDNTR

SEQ ID NO: 154065 - protein, 34 aa, Artificial Sequence
  Description of Artificial Sequence: Synthetic polypeptide
DEAEIRTTNPVATEQYGCTCSNTEDNQHFGSDQS

SEQ ID NO: 154066 - protein, 34 aa, Artificial Sequence
  Description of Artificial Sequence: Synthetic polypeptide
DEAEIRTTNPVATEQYGCTCSMTEEHNQSIGSDQ

SEQ ID NO: 154067 - protein, 34 aa, Artificial Sequence
  Description of Artificial Sequence: Synthetic polypeptide
DEEEIRTTNPVATEQYGSVTVMMDVPFRQEEPEG

SEQ ID NO: 154068 - protein, 31 aa, Artificial Sequence
  Description of Artificial Sequence: Synthetic polypeptide
DENEIRTTNPVATEQWGDVSEIIEMDAEEDA

SEQ ID NO: 154069 - protein, 36 aa, Artificial Sequence
  Description of Artificial Sequence: Synthetic polypeptide
DEEEIRTTNPVATEQYGSVYGQDTADLIEQGPEFVD

SEQ ID NO: 154070 - protein, 37 aa, Artificial Sequence
  Description of Artificial Sequence: Synthetic polypeptide
DEEEIRTTNPVATEQYGVVSVTVVNQQGNNQEEEETE

SEQ ID NO: 154071 - protein, 33 aa, Artificial Sequence
  Description of Artificial Sequence: Synthetic polypeptide
DENEIRTTNPVATEQWGDVSEILERMMAAEDAV

SEQ ID NO: 154072 - protein, 35 aa, Artificial Sequence
  Description of Artificial Sequence: Synthetic polypeptide
DEAEIRTTNPVATEQYGCSCSWGELNQENFGSDQS

SEQ ID NO: 154073 - protein, 32 aa, Artificial Sequence
  Description of Artificial Sequence: Synthetic polypeptide
DENEIRTTNPVATEQWGDVSEILEMNAAEPDA

SEQ ID NO: 154074 - protein, 31 aa, Artificial Sequence
  Description of Artificial Sequence: Synthetic polypeptide
DENEIRTTNPVATEQWGDVSEIKEMTAAEDA

SEQ ID NO: 154075 - protein, 37 aa, Artificial Sequence
  Description of Artificial Sequence: Synthetic polypeptide
DEEEIRTTNPVATEQYGVVSVTVVNQQGNTDEEEEEE

SEQ ID NO: 154076 - protein, 31 aa, Artificial Sequence
  Description of Artificial Sequence: Synthetic polypeptide
DENEIRTTNPVATEQWGDVSEIKEMNAAEDA

SEQ ID NO: 154077 - protein, 32 aa, Artificial Sequence
  Description of Artificial Sequence: Synthetic polypeptide
DENEIATTNPVATESYGCIANNNLQDDAAGHH

SEQ ID NO: 154078 - protein, 38 aa, Artificial Sequence
  Description of Artificial Sequence: Synthetic polypeptide
DEEEIRTTNPVATEQYGVVSVTVVNQQAGNQAGNQQDE

SEQ ID NO: 154079 - protein, 31 aa, Artificial Sequence
  Description of Artificial Sequence: Synthetic polypeptide
DENEIRTTNPVATEQWGDVSEIPEMNAAEDA

SEQ ID NO: 154080 - protein, 31 aa, Artificial Sequence
  Description of Artificial Sequence: Synthetic polypeptide
DENEIRTTNPVATEQWGDVSEIHEMNAAEDA

SEQ ID NO: 154081 - protein, 32 aa, Artificial Sequence
  Description of Artificial Sequence: Synthetic polypeptide
DENEIRTTNPVATEQWGDVSEIGEMNAAEDQA

SEQ ID NO: 154082 - protein, 32 aa, Artificial Sequence
  Description of Artificial Sequence: Synthetic polypeptide
DENEIRTTNPVATEQWGDVSEIEQMNAAEDEA

SEQ ID NO: 154083 - protein, 32 aa, Artificial Sequence
  Description of Artificial Sequence: Synthetic polypeptide
DENEIRTTNPVATEQWGDVSEIEPMNALEQDA

SEQ ID NO: 154084 - protein, 31 aa, Artificial Sequence
  Description of Artificial Sequence: Synthetic polypeptide
DENEIRTTNPVATEQWGDVSEIEPMNAAQDA

SEQ ID NO: 154085 - protein, 32 aa, Artificial Sequence
  Description of Artificial Sequence: Synthetic polypeptide
DENEIRTTNPVATEQWGDVSEIEPMNAAEEDA

SEQ ID NO: 154086 - protein, 31 aa, Artificial Sequence
  Description of Artificial Sequence: Synthetic polypeptide
DENEIRTTNPVATEQWGDVSEIEPMNAAEDW

SEQ ID NO: 154087 - protein, 32 aa, Artificial Sequence
  Description of Artificial Sequence: Synthetic polypeptide
DENEIRTTNPVATEQWGDVSEIEPMNAAEDDA

SEQ ID NO: 154088 - protein, 31 aa, Artificial Sequence
  Description of Artificial Sequence: Synthetic polypeptide
DENEIRTTNPVATEQWGDVSEIEPMNAAEDA

SEQ ID NO: 154089 - protein, 31 aa, Artificial Sequence
  Description of Artificial Sequence: Synthetic polypeptide
DENEIRTTNPVATEQWGDVSEIEPMDAAEDA

SEQ ID NO: 154090 - protein, 34 aa, Artificial Sequence
  Description of Artificial Sequence: Synthetic polypeptide
DEAEIRTTNPVATEQYGAYWSLDNMLEAESNQTD

SEQ ID NO: 154091 - protein, 38 aa, Artificial Sequence
  Description of Artificial Sequence: Synthetic polypeptide
DEAEIRTTNPVATEQYGASVVSTNIMLEELPNGNEEVF

SEQ ID NO: 154092 - protein, 31 aa, Artificial Sequence
  Description of Artificial Sequence: Synthetic polypeptide
DENEIRTTNPVATEQWGDVSEIEMPAAEDVA

SEQ ID NO: 154093 - protein, 36 aa, Artificial Sequence
  Description of Artificial Sequence: Synthetic polypeptide
DEEEIRTTNPVATEQYGSVVCMPAMPQNVAGVNDVF

SEQ ID NO: 154094 - protein, 35 aa, Artificial Sequence
  Description of Artificial Sequence: Synthetic polypeptide
DEAEIRTTNPVATEQYGAANSMVNDFDGNHEDERG

SEQ ID NO: 154095 - protein, 36 aa, Artificial Sequence
  Description of Artificial Sequence: Synthetic polypeptide
DEEEIRTTNPVATEQYGSVVCVPHIGQQVAGVNDEF

SEQ ID NO: 154096 - protein, 35 aa, Artificial Sequence
  Description of Artificial Sequence: Synthetic polypeptide
DEEEIRTTNPVATEQYGSVVDGMMDEETGGGNGEI

SEQ ID NO: 154097 - protein, 35 aa, Artificial Sequence
  Description of Artificial Sequence: Synthetic polypeptide
DEEEIRTTNPVATEQYGSVVDGMMNEEEEGEDGEF

SEQ ID NO: 154098 - protein, 33 aa, Artificial Sequence
  Description of Artificial Sequence: Synthetic polypeptide
DEGEIATVNPVATEQYGCVAGTGLQSNANNQEE

SEQ ID NO: 154099 - protein, 35 aa, Artificial Sequence
  Description of Artificial Sequence: Synthetic polypeptide
DEEEIRTTNPVATEQYGSVTWVMMGLPNPNFNQET

SEQ ID NO: 154100 - protein, 34 aa, Artificial Sequence
  Description of Artificial Sequence: Synthetic polypeptide
DEEEIRTTNPVATEQYGSVTWPGDMEYPGSQFHH

SEQ ID NO: 154101 - protein, 35 aa, Artificial Sequence
  Description of Artificial Sequence: Synthetic polypeptide
DEEEIRTTNPVATEQYGSVTWDYDPMDLQSMEDFY

SEQ ID NO: 154102 - protein, 36 aa, Artificial Sequence
  Description of Artificial Sequence: Synthetic polypeptide
DEEEIRTTNPVATEQYGSVTVVVTTTNNNDTEENTG

SEQ ID NO: 154103 - protein, 31 aa, Artificial Sequence
  Description of Artificial Sequence: Synthetic polypeptide
DENEIRTTNPVATEQWGDVSEIGEMNAAEDA

SEQ ID NO: 154104 - protein, 32 aa, Artificial Sequence
  Description of Artificial Sequence: Synthetic polypeptide
DENEIRTTNPVATEQWGDVSEIGEMNAAEAAA

SEQ ID NO: 154105 - protein, 31 aa, Artificial Sequence
  Description of Artificial Sequence: Synthetic polypeptide
DENEIRTTNPVATEQWGDVSEIGEDNAAEDA

SEQ ID NO: 154106 - protein, 31 aa, Artificial Sequence
  Description of Artificial Sequence: Synthetic polypeptide
DENEIRTTNPVATEQWGDVSEIFEMNAAEDV

SEQ ID NO: 154107 - protein, 32 aa, Artificial Sequence
  Description of Artificial Sequence: Synthetic polypeptide
DENEIRTTNPVATEQWGDVSEIFEMNAAEDQA

SEQ ID NO: 154108 - protein, 31 aa, Artificial Sequence
  Description of Artificial Sequence: Synthetic polypeptide
DENEIRTTNPVATEQWGDVSEIFEMNAAEDA

SEQ ID NO: 154109 - protein, 31 aa, Artificial Sequence
  Description of Artificial Sequence: Synthetic polypeptide
DENEIRTTNPVATEQWGDVSEIEYMNAAEYA

SEQ ID NO: 154110 - protein, 31 aa, Artificial Sequence
  Description of Artificial Sequence: Synthetic polypeptide
DENEIRTTNPVATEQWGDVSEIEYMNAAEDA

SEQ ID NO: 154111 - protein, 31 aa, Artificial Sequence
  Description of Artificial Sequence: Synthetic polypeptide
DENEIRTTNPVATEQWGDVSEIGEMNADEDA

SEQ ID NO: 154112 - protein, 31 aa, Artificial Sequence
  Description of Artificial Sequence: Synthetic polypeptide
DENEIRTTNPVATEQWGDVSEIEWMNAAEDA

SEQ ID NO: 154113 - protein, 31 aa, Artificial Sequence
  Description of Artificial Sequence: Synthetic polypeptide
DENEIRTTNPVATEQWGDVSEIEVMNAAEVA

SEQ ID NO: 154114 - protein, 32 aa, Artificial Sequence
  Description of Artificial Sequence: Synthetic polypeptide
DENEIRTTNPVATEQWGDVSEIEVMNAAEDAK

SEQ ID NO: 154115 - protein, 31 aa, Artificial Sequence
  Description of Artificial Sequence: Synthetic polypeptide
DENEIRTTNPVATEQWGDVSEIEVMNAAEDA

SEQ ID NO: 154116 - protein, 31 aa, Artificial Sequence
  Description of Artificial Sequence: Synthetic polypeptide
DENEIRTTNPVATEQWGDVSEIESMNAVEDA

SEQ ID NO: 154117 - protein, 32 aa, Artificial Sequence
  Description of Artificial Sequence: Synthetic polypeptide
DENEIRTTNPVATEQWGDVSEIESMNAAEDAS

SEQ ID NO: 154118 - protein, 32 aa, Artificial Sequence
  Description of Artificial Sequence: Synthetic polypeptide
DENEIRTTNPVATEQWGDVSEIESMNAAEDAG

SEQ ID NO: 154119 - protein, 31 aa, Artificial Sequence
  Description of Artificial Sequence: Synthetic polypeptide
DENEIRTTNPVATEQWGDVSEIESMNAAEDA

SEQ ID NO: 154120 - protein, 36 aa, Artificial Sequence
  Description of Artificial Sequence: Synthetic polypeptide
DEEEIRTTNPVATEQYGSVTVVVTNTNNNDTEEENG

SEQ ID NO: 154121 - protein, 31 aa, Artificial Sequence
  Description of Artificial Sequence: Synthetic polypeptide
DENEIRTTNPVATEQWGDVSEIEVMNAEEDA

SEQ ID NO: 154122 - protein, 35 aa, Artificial Sequence
  Description of Artificial Sequence: Synthetic polypeptide
DEEEIRTTNPVATEQYGSVVDGMMNEETGGEDGEI

SEQ ID NO: 154123 - protein, 35 aa, Artificial Sequence
  Description of Artificial Sequence: Synthetic polypeptide
DEEEIRTTNPVATEQYGSVYGQQTDDENQGPEFDT

SEQ ID NO: 154124 - protein, 39 aa, Artificial Sequence
  Description of Artificial Sequence: Synthetic polypeptide
DEEEIRTTNPVATEQYGVVSVTVTTVNLQQGTNQEGEDE

SEQ ID NO: 154125 - protein, 32 aa, Artificial Sequence
  Description of Artificial Sequence: Synthetic polypeptide
DENEIRTTNPVATEQWGDVSESIEMNAAESDA

SEQ ID NO: 154126 - protein, 32 aa, Artificial Sequence
  Description of Artificial Sequence: Synthetic polypeptide
DENEIRTTNPVATEQWGDVSESIEMNAAEDIA

SEQ ID NO: 154127 - protein, 31 aa, Artificial Sequence
  Description of Artificial Sequence: Synthetic polypeptide
DENEIRTTNPVATEQWGDVSESIEMNAAEDA

SEQ ID NO: 154128 - protein, 31 aa, Artificial Sequence
  Description of Artificial Sequence: Synthetic polypeptide
DENEIRTTNPVATEQWGDVSERIEMNAAEDA

SEQ ID NO: 154129 - protein, 31 aa, Artificial Sequence
  Description of Artificial Sequence: Synthetic polypeptide
DENEIRTTNPVATEQWGDVSERIEMMAAEDA

SEQ ID NO: 154130 - protein, 31 aa, Artificial Sequence
  Description of Artificial Sequence: Synthetic polypeptide
DENEIRTTNPVATEQWGDVSEQIWMNAAEDA

SEQ ID NO: 154131 - protein, 31 aa, Artificial Sequence
  Description of Artificial Sequence: Synthetic polypeptide
DENEIRTTNPVATEQWGDVSEQIEMNAAEDA

SEQ ID NO: 154132 - protein, 31 aa, Artificial Sequence
  Description of Artificial Sequence: Synthetic polypeptide
DENEIRTTNPVATEQWGDVSEPIEMNAAEDA

SEQ ID NO: 154133 - protein, 31 aa, Artificial Sequence
  Description of Artificial Sequence: Synthetic polypeptide
DENEIRTTNPVATEQWGDVSEPEPMNAAEDA

SEQ ID NO: 154134 - protein, 33 aa, Artificial Sequence
  Description of Artificial Sequence: Synthetic polypeptide
DENEIRTTNPVATEQWGDVSEPAEPMNANGMNV

SEQ ID NO: 154135 - protein, 30 aa, Artificial Sequence
  Description of Artificial Sequence: Synthetic polypeptide
DEESIACTNPVATASWGCVATNELADNSNS

SEQ ID NO: 154136 - protein, 31 aa, Artificial Sequence
  Description of Artificial Sequence: Synthetic polypeptide
DENEIATTNPVATEQYGTAPMEDIQQQNGEH

SEQ ID NO: 154137 - protein, 32 aa, Artificial Sequence
  Description of Artificial Sequence: Synthetic polypeptide
DEESIACTNPVATASWGCVATNELQDDSNGNM

SEQ ID NO: 154138 - protein, 31 aa, Artificial Sequence
  Description of Artificial Sequence: Synthetic polypeptide
DEESIACTNPVATASWGCVATNELQDNSNNP

SEQ ID NO: 154139 - protein, 33 aa, Artificial Sequence
  Description of Artificial Sequence: Synthetic polypeptide
DENEIRTTNPVATEQWGDVSEPAEPMNANGMNA

SEQ ID NO: 154140 - protein, 32 aa, Artificial Sequence
  Description of Artificial Sequence: Synthetic polypeptide
DENEIRTTNPVATEQWGDVSEPAEPMNANENA

SEQ ID NO: 154141 - protein, 32 aa, Artificial Sequence
  Description of Artificial Sequence: Synthetic polypeptide
DENEIRTTNPVATEQWGDVSEPAEPMNAAENA

SEQ ID NO: 154142 - protein, 31 aa, Artificial Sequence
  Description of Artificial Sequence: Synthetic polypeptide
DENEIRTTNPVATEQWGDVSESIESNAALDA

SEQ ID NO: 154143 - protein, 38 aa, Artificial Sequence
  Description of Artificial Sequence: Synthetic polypeptide
DEEEIRTTNPVATEQYGSVTTNEQVELEEVLGNPETQD

SEQ ID NO: 154144 - protein, 31 aa, Artificial Sequence
  Description of Artificial Sequence: Synthetic polypeptide
DENEIRTTNPVATEQWGDVSEVIEMNAAEDA

SEQ ID NO: 154145 - protein, 31 aa, Artificial Sequence
  Description of Artificial Sequence: Synthetic polypeptide
DENEIRTTNPVATEQWGDVSEWIEMNAAEDA

SEQ ID NO: 154146 - protein, 31 aa, Artificial Sequence
  Description of Artificial Sequence: Synthetic polypeptide
DENEIRTTNPVATEQWGDVSKEIEMNAAEDA

SEQ ID NO: 154147 - protein, 32 aa, Artificial Sequence
  Description of Artificial Sequence: Synthetic polypeptide
DENEIRTTNPVATEQWGDVSIIEMNAAETDFA

SEQ ID NO: 154148 - protein, 31 aa, Artificial Sequence
  Description of Artificial Sequence: Synthetic polypeptide
DENEIRTTNPVATEQWGDVSIEIEMNAAEDA

SEQ ID NO: 154149 - protein, 31 aa, Artificial Sequence
  Description of Artificial Sequence: Synthetic polypeptide
DENEIRTTNPVATEQWGDVSHESEMNAAEDA

SEQ ID NO: 154150 - protein, 31 aa, Artificial Sequence
  Description of Artificial Sequence: Synthetic polypeptide
DENEIRTTNPVATEQWGDVSHEIEMNAAEDA

SEQ ID NO: 154151 - protein, 31 aa, Artificial Sequence
  Description of Artificial Sequence: Synthetic polypeptide
DENEIRTTNPVATEQWGDVSHEIEHNAAEDA

SEQ ID NO: 154152 - protein, 38 aa, Artificial Sequence
  Description of Artificial Sequence: Synthetic polypeptide
DEEEIRTTNPVATEQYGVVSVTVNTNLQQQATNVATES

SEQ ID NO: 154153 - protein, 32 aa, Artificial Sequence
  Description of Artificial Sequence: Synthetic polypeptide
DENEIRTTNPVATEQWGDVSGEIMEMNAAEDA

SEQ ID NO: 154154 - protein, 31 aa, Artificial Sequence
  Description of Artificial Sequence: Synthetic polypeptide
DEESIACTNPVATASWGCVATNELQDSNGMA

SEQ ID NO: 154155 - protein, 31 aa, Artificial Sequence
  Description of Artificial Sequence: Synthetic polypeptide
DENEIRTTNPVATEQWGDVSGEIEMNAAEDA

SEQ ID NO: 154156 - protein, 31 aa, Artificial Sequence
  Description of Artificial Sequence: Synthetic polypeptide
DENEIRTTNPVATEQWGDVSGDIEMNAAEDA

SEQ ID NO: 154157 - protein, 31 aa, Artificial Sequence
  Description of Artificial Sequence: Synthetic polypeptide
DENEIRTTNPVATEQWGDVSFIAEMNAAEDA

SEQ ID NO: 154158 - protein, 32 aa, Artificial Sequence
  Description of Artificial Sequence: Synthetic polypeptide
DENEIRTTNPVATEQWGDVSFEIEMNAAEDKA

SEQ ID NO: 154159 - protein, 31 aa, Artificial Sequence
  Description of Artificial Sequence: Synthetic polypeptide
DENEIRTTNPVATEQWGDVSFEIEMNAAEDA

SEQ ID NO: 154160 - protein, 31 aa, Artificial Sequence
  Description of Artificial Sequence: Synthetic polypeptide
DENEIRTTNPVATEQWGDVSFEIEENAAEDA

SEQ ID NO: 154161 - protein, 31 aa, Artificial Sequence
  Description of Artificial Sequence: Synthetic polypeptide
DENEIRTTNPVATEQWGDVSEYIEMNAHEDA

SEQ ID NO: 154162 - protein, 31 aa, Artificial Sequence
  Description of Artificial Sequence: Synthetic polypeptide
DENEIRTTNPVATEQWGDVSEYIEMNAAEDA

SEQ ID NO: 154163 - protein, 31 aa, Artificial Sequence
  Description of Artificial Sequence: Synthetic polypeptide
DENEIRTTNPVATEQWGDVSEWIEMNAAEMA

SEQ ID NO: 154164 - protein, 31 aa, Artificial Sequence
  Description of Artificial Sequence: Synthetic polypeptide
DENEIRTTNPVATEQWGDVSGEFEMNAAEDA

SEQ ID NO: 154165 - protein, 39 aa, Artificial Sequence
  Description of Artificial Sequence: Synthetic polypeptide
DEEEIRTTNPVATEQYGVVSVTVVNLQAGNTEQGVVTTQ

SEQ ID NO: 154166 - protein, 31 aa, Artificial Sequence
  Description of Artificial Sequence: Synthetic polypeptide
DEESIACTNPVATASYGCVATEGLQNPMGGM

SEQ ID NO: 154167 - protein, 32 aa, Artificial Sequence
  Description of Artificial Sequence: Synthetic polypeptide
DENEIRTTNPVATEQWGDVSEPAEPMNAAEDA

SEQ ID NO: 154168 - protein, 32 aa, Artificial Sequence
  Description of Artificial Sequence: Synthetic polypeptide
DENEIRTTNPVATEQWGDVSEIVEMNAAEDAG

SEQ ID NO: 154169 - protein, 31 aa, Artificial Sequence
  Description of Artificial Sequence: Synthetic polypeptide
DENEIRTTNPVATEQWGDVSEIVEMNAAEDA

SEQ ID NO: 154170 - protein, 31 aa, Artificial Sequence
  Description of Artificial Sequence: Synthetic polypeptide
DENEIRTTNPVATEQWGDVSEIVCMNAAEDA

SEQ ID NO: 154171 - protein, 38 aa, Artificial Sequence
  Description of Artificial Sequence: Synthetic polypeptide
DEEEIRTTNPVATEQYGVVSVTVTNQQQGNQNGNQTDE

SEQ ID NO: 154172 - protein, 31 aa, Artificial Sequence
  Description of Artificial Sequence: Synthetic polypeptide
DENEIRTTNPVATEQWGDVSEISVMNAAEDA

SEQ ID NO: 154173 - protein, 34 aa, Artificial Sequence
  Description of Artificial Sequence: Synthetic polypeptide
DEAEIRTTNPVATEQYGCTCSTGEPNQHFGSDQA

SEQ ID NO: 154174 - protein, 31 aa, Artificial Sequence
  Description of Artificial Sequence: Synthetic polypeptide
DENEIRTTNPVATEQWGDVSEISEMNAAEDA

SEQ ID NO: 154175 - protein, 31 aa, Artificial Sequence
  Description of Artificial Sequence: Synthetic polypeptide
DENEIRTTNPVATEQWGDVSEIRESNAAEDA

SEQ ID NO: 154176 - protein, 32 aa, Artificial Sequence
  Description of Artificial Sequence: Synthetic polypeptide
DENEIRTTNPVATEQWGDVSEIREMNAAEDAG

SEQ ID NO: 154177 - protein, 31 aa, Artificial Sequence
  Description of Artificial Sequence: Synthetic polypeptide
DENEIRTTNPVATEQWGDVSEIREMNAAEDA

SEQ ID NO: 154178 - protein, 31 aa, Artificial Sequence
  Description of Artificial Sequence: Synthetic polypeptide
DEGEIRTTNPCSSEPYGTISMENIQQQQGNH

SEQ ID NO: 154179 - protein, 34 aa, Artificial Sequence
  Description of Artificial Sequence: Synthetic polypeptide
DEAEIRTTNPVATEQYGCTCSTGEHNQYFNSDQA

SEQ ID NO: 154180 - protein, 33 aa, Artificial Sequence
  Description of Artificial Sequence: Synthetic polypeptide
DDEEISTTNPVATEQYGCVCSTEHDQGFISDQS

SEQ ID NO: 154181 - protein, 34 aa, Artificial Sequence
  Description of Artificial Sequence: Synthetic polypeptide
DEGEIRTTNPCAYEQWGSVYCTDNDQHRDGHDVA

SEQ ID NO: 154182 - protein, 35 aa, Artificial Sequence
  Description of Artificial Sequence: Synthetic polypeptide
DEEEIRTTNPVATEQYGSVYGQTTDDMNQGPEFVT

SEQ ID NO: 154183 - protein, 36 aa, Artificial Sequence
  Description of Artificial Sequence: Synthetic polypeptide
DEEEIRTTNPVATEQYGSVYGQTTDDLGQGEETEED

SEQ ID NO: 154184 - protein, 35 aa, Artificial Sequence
  Description of Artificial Sequence: Synthetic polypeptide
DEEEIRTTNPVATEQYGSVYGQTTADVNQGPEFGV

SEQ ID NO: 154185 - protein, 31 aa, Artificial Sequence
  Description of Artificial Sequence: Synthetic polypeptide
DENEIRTTNPVATEQWGDVSEIWEMNAAEDA

SEQ ID NO: 154186 - protein, 31 aa, Artificial Sequence
  Description of Artificial Sequence: Synthetic polypeptide
DENEIRTTNPVATEQWGDVSEIWEMNIAEDA

SEQ ID NO: 154187 - protein, 33 aa, Artificial Sequence
  Description of Artificial Sequence: Synthetic polypeptide
DEAEIRTTNGVAYCQYGCVCSSNHQERFGSDQS

SEQ ID NO: 154188 - protein, 31 aa, Artificial Sequence
  Description of Artificial Sequence: Synthetic polypeptide
DENEIRTTNPVATEQWGDVSEIYEMNAAEDA

SEQ ID NO: 154189 - protein, 37 aa, Artificial Sequence
  Description of Artificial Sequence: Synthetic polypeptide
DEEEIRTTNPVATEQYGSVYGVDDNTLQDTGGEDGEG

SEQ ID NO: 154190 - protein, 33 aa, Artificial Sequence
  Description of Artificial Sequence: Synthetic polypeptide
DEAEIRTTNPVATEQYGCVCQTWAHINFMSDQS

SEQ ID NO: 154191 - protein, 38 aa, Artificial Sequence
  Description of Artificial Sequence: Synthetic polypeptide
DEEEIRTTNPVATEQYGVVSVTVTNQQAGNQAGNQTDD

SEQ ID NO: 154192 - protein, 32 aa, Artificial Sequence
  Description of Artificial Sequence: Synthetic polypeptide
DEAEIRTTNGVAYCQYGCVCSSNHQENGSDQA

SEQ ID NO: 154193 - protein, 33 aa, Artificial Sequence
  Description of Artificial Sequence: Synthetic polypeptide
DEAEIRTTNPVATEQYGCVCQTAHIEYFMSNQA

SEQ ID NO: 154194 - protein, 32 aa, Artificial Sequence
  Description of Artificial Sequence: Synthetic polypeptide
DENEIRTTNPVATEQWGDVSENEPMNAAEEDA

SEQ ID NO: 154195 - protein, 34 aa, Artificial Sequence
  Description of Artificial Sequence: Synthetic polypeptide
DENEIATTNPVATEQYGTVCSATDGPVEAEGMND

SEQ ID NO: 154196 - protein, 34 aa, Artificial Sequence
  Description of Artificial Sequence: Synthetic polypeptide
DENEIATTNPVATEQYGTVCSATDGPVEFGGNAD

SEQ ID NO: 154197 - protein, 32 aa, Artificial Sequence
  Description of Artificial Sequence: Synthetic polypeptide
DEESIACTNPVATASYGCVATNELQDDSPGMW

SEQ ID NO: 154198 - protein, 38 aa, Artificial Sequence
  Description of Artificial Sequence: Synthetic polypeptide
DEEEIRTTNPVATEQYGVVSVTVTNQQNGNQAGNQQGN

SEQ ID NO: 154199 - protein, 33 aa, Artificial Sequence
  Description of Artificial Sequence: Synthetic polypeptide
DEAEIRTTNPVATEQYGCVCQSGAHINFMSNQS

SEQ ID NO: 154200 - protein, 32 aa, Artificial Sequence
  Description of Artificial Sequence: Synthetic polypeptide
DENEIRTTNPVATEQWGDVSEMIEYMNAAEDA

SEQ ID NO: 154201 - protein, 31 aa, Artificial Sequence
  Description of Artificial Sequence: Synthetic polypeptide
DENEIRTTNPVATEQWGDVSEMIEMNAAEDW

SEQ ID NO: 154202 - protein, 32 aa, Artificial Sequence
  Description of Artificial Sequence: Synthetic polypeptide
DENEIRTTNPVATEQWGDVSEMIEMNAAEDMA

SEQ ID NO: 154203 - protein, 31 aa, Artificial Sequence
  Description of Artificial Sequence: Synthetic polypeptide
DENEIRTTNPVATEQWGDVSEMIEMNAAEDA

SEQ ID NO: 154204 - protein, 31 aa, Artificial Sequence
  Description of Artificial Sequence: Synthetic polypeptide
DENEIRTTNPVATEQWGDVSEMCEMNAAEDI

SEQ ID NO: 154205 - protein, 31 aa, Artificial Sequence
  Description of Artificial Sequence: Synthetic polypeptide
DENEIRTTNPVATEQWGDVSEKIEMNAAEDA

SEQ ID NO: 154206 - protein, 31 aa, Artificial Sequence
  Description of Artificial Sequence: Synthetic polypeptide
DENEIRTTNPVATEQWGDVSEKCEMNAAEDA

SEQ ID NO: 154207 - protein, 34 aa, Artificial Sequence
  Description of Artificial Sequence: Synthetic polypeptide
CEEEISTTNPVATEQYGCVCSNTETQGFGSDTQS

SEQ ID NO: 154208 - protein, 36 aa, Artificial Sequence
  Description of Artificial Sequence: Synthetic polypeptide
DEGEIATTNPVAYEQYGSVCSVDNLPQDSMGGNEEE

SEQ ID NO: 154209 - protein, 35 aa, Artificial Sequence
  Description of Artificial Sequence: Synthetic polypeptide
DEEEIRTTNPVATEQYGSVVDGMMNNEETGEDGEF

SEQ ID NO: 154210 - protein, 35 aa, Artificial Sequence
  Description of Artificial Sequence: Synthetic polypeptide
DEEEIRTTNPVATEQYGSVVDNGEEMTMEGGTQGD

SEQ ID NO: 154211 - protein, 31 aa, Artificial Sequence
  Description of Artificial Sequence: Synthetic polypeptide
DENEIRTTNPVATEQWGDVREIQEMNAAEDA

SEQ ID NO: 154212 - protein, 30 aa, Artificial Sequence
  Description of Artificial Sequence: Synthetic polypeptide
DENEIRTTNPVATEQWGDVREIMMNAAEDA

SEQ ID NO: 154213 - protein, 30 aa, Artificial Sequence
  Description of Artificial Sequence: Synthetic polypeptide
DENEIRTTNPVATEQWGDVREIEMNAAKDA

SEQ ID NO: 154214 - protein, 31 aa, Artificial Sequence
  Description of Artificial Sequence: Synthetic polypeptide
DENEIRTTNPVATEQWGDVREIEMNAAEPDA

SEQ ID NO: 154215 - protein, 30 aa, Artificial Sequence
  Description of Artificial Sequence: Synthetic polypeptide
DENEIRTTNPVATEQWGDVREIEMNAAEDA

SEQ ID NO: 154216 - protein, 30 aa, Artificial Sequence
  Description of Artificial Sequence: Synthetic polypeptide
DENEIRTTNPVATEQWGDVREIEMAAAEDA

SEQ ID NO: 154217 - protein, 31 aa, Artificial Sequence
  Description of Artificial Sequence: Synthetic polypeptide
DENEIRTTNPVATEQWGDVQSEIEMNAAEFA

SEQ ID NO: 154218 - protein, 31 aa, Artificial Sequence
  Description of Artificial Sequence: Synthetic polypeptide
DENEIRTTNPVATEQWGDVQSEIEMNAAEDA

SEQ ID NO: 154219 - protein, 30 aa, Artificial Sequence
  Description of Artificial Sequence: Synthetic polypeptide
DENEIRTTNPVATEQWGDVQEVEMNDAEDA

SEQ ID NO: 154220 - protein, 31 aa, Artificial Sequence
  Description of Artificial Sequence: Synthetic polypeptide
DENEIRTTNPVATEQWGDVQEISEMNAAEDA

SEQ ID NO: 154221 - protein, 30 aa, Artificial Sequence
  Description of Artificial Sequence: Synthetic polypeptide
DENEIRTTNPVATEQWGDVQEIEMNAAEDA

SEQ ID NO: 154222 - protein, 30 aa, Artificial Sequence
  Description of Artificial Sequence: Synthetic polypeptide
DENEIRTTNPVATEQWGDVQEIEFNAAEDA

SEQ ID NO: 154223 - protein, 32 aa, Artificial Sequence
  Description of Artificial Sequence: Synthetic polypeptide
DENEIRTTNPVATEQWGDVPSEIEMNAAEDIA

SEQ ID NO: 154224 - protein, 31 aa, Artificial Sequence
  Description of Artificial Sequence: Synthetic polypeptide
DENEIRTTNPVATEQWGDVPSEIEMNAAEDA

SEQ ID NO: 154225 - protein, 31 aa, Artificial Sequence
  Description of Artificial Sequence: Synthetic polypeptide
DENEIRTTNPVATEQWGDVPSEGEMNAAEDA

SEQ ID NO: 154226 - protein, 31 aa, Artificial Sequence
  Description of Artificial Sequence: Synthetic polypeptide
DENEIRTTNPVATEQWGDVPSEEEMNAAEDA

SEQ ID NO: 154227 - protein, 31 aa, Artificial Sequence
  Description of Artificial Sequence: Synthetic polypeptide
DENEIRTTNPVATEQWGDVPEIEMNAAEDIA

SEQ ID NO: 154228 - protein, 31 aa, Artificial Sequence
  Description of Artificial Sequence: Synthetic polypeptide
DENEIRTTNPVATEQWGDVRSEIEMNAAEDA

SEQ ID NO: 154229 - protein, 31 aa, Artificial Sequence
  Description of Artificial Sequence: Synthetic polypeptide
DENEIRTTNPVATEQWGDVRSEIMMNAAEDA

SEQ ID NO: 154230 - protein, 31 aa, Artificial Sequence
  Description of Artificial Sequence: Synthetic polypeptide
DENEIRTTNPVATEQWGDVRSEIPMNAAEDA

SEQ ID NO: 154231 - protein, 32 aa, Artificial Sequence
  Description of Artificial Sequence: Synthetic polypeptide
DENEIRTTNPVATEQWGDVSAEDIEMNAAEDA

SEQ ID NO: 154232 - protein, 37 aa, Artificial Sequence
  Description of Artificial Sequence: Synthetic polypeptide
DEEEIRTTNPVATEQYGSVVIGGMGNVGQEDEGNTEE

SEQ ID NO: 154233 - protein, 32 aa, Artificial Sequence
  Description of Artificial Sequence: Synthetic polypeptide
DENEIRTTNPVATEQWGDVSCIEPMNRAEEDA

SEQ ID NO: 154234 - protein, 31 aa, Artificial Sequence
  Description of Artificial Sequence: Synthetic polypeptide
DEAEIRTTNPVATEQWGHVVSEGEMNAALDA

SEQ ID NO: 154235 - protein, 36 aa, Artificial Sequence
  Description of Artificial Sequence: Synthetic polypeptide
DEEEIRTTNPVATEQYGSVVLDGFGQENDQGEDGTA

SEQ ID NO: 154236 - protein, 31 aa, Artificial Sequence
  Description of Artificial Sequence: Synthetic polypeptide
DENEIRTTNPVATEQWGDVSCEVEMNAAEDA

SEQ ID NO: 154237 - protein, 32 aa, Artificial Sequence
  Description of Artificial Sequence: Synthetic polypeptide
DENEIRTTNPVATEQWGDVSCEQIEMNAAEDA

SEQ ID NO: 154238 - protein, 32 aa, Artificial Sequence
  Description of Artificial Sequence: Synthetic polypeptide
DENEIRTTNPVATEQWGDVSCEITEMNAAEDA

SEQ ID NO: 154239 - protein, 32 aa, Artificial Sequence
  Description of Artificial Sequence: Synthetic polypeptide
DENEIRTTNPVATEQWGDVSCEIEMNAAEDVA

SEQ ID NO: 154240 - protein, 31 aa, Artificial Sequence
  Description of Artificial Sequence: Synthetic polypeptide
DENEIRTTNPVATEQWGDVPEIEMNAAEDCE

SEQ ID NO: 154241 - protein, 32 aa, Artificial Sequence
  Description of Artificial Sequence: Synthetic polypeptide
DENEIRTTNPVATEQWGDVSCEIEMNAAEDAE

SEQ ID NO: 154242 - protein, 35 aa, Artificial Sequence
  Description of Artificial Sequence: Synthetic polypeptide
DEEEIRTTNPVATEQYGSVVLDGMGQENDQDEDGT

SEQ ID NO: 154243 - protein, 32 aa, Artificial Sequence
  Description of Artificial Sequence: Synthetic polypeptide
DENEIRTTNPVATEQWGDVSATIEVMNFEEDA

SEQ ID NO: 154244 - protein, 32 aa, Artificial Sequence
  Description of Artificial Sequence: Synthetic polypeptide
DENEIRTTNPVATEQWGDVSATIEVMNAEEDA

SEQ ID NO: 154245 - protein, 32 aa, Artificial Sequence
  Description of Artificial Sequence: Synthetic polypeptide
DENEIRTTNPVATEQWGDVSATIEVMNAAEDA

SEQ ID NO: 154246 - protein, 32 aa, Artificial Sequence
  Description of Artificial Sequence: Synthetic polypeptide
DENEIRTTNPVATEQWGDVSAEIEVMNAAEDA

SEQ ID NO: 154247 - protein, 38 aa, Artificial Sequence
  Description of Artificial Sequence: Synthetic polypeptide
DEEEIRTTNPVATEQYGSVVLVQITDNGGQTQDQGNGD

SEQ ID NO: 154248 - protein, 31 aa, Artificial Sequence
  Description of Artificial Sequence: Synthetic polypeptide
DENEIRTTNPVATEQWGDVSAEIEMNAAEDA

SEQ ID NO: 154249 - protein, 32 aa, Artificial Sequence
  Description of Artificial Sequence: Synthetic polypeptide
DENEIRTTNPVATEQWGDVSAEGEVMNFAGDD

SEQ ID NO: 154250 - protein, 31 aa, Artificial Sequence
  Description of Artificial Sequence: Synthetic polypeptide
DENEIRTTNPVATEQWGDVSCEIEMNAAEDA

SEQ ID NO: 154251 - protein, 31 aa, Artificial Sequence
  Description of Artificial Sequence: Synthetic polypeptide
DENEIRTTNPVATEQWGDVSCIESMNAAEDA

SEQ ID NO: 154252 - protein, 30 aa, Artificial Sequence
  Description of Artificial Sequence: Synthetic polypeptide
DENEIRTTNPVATEQWGDVPEIEMNAAEDA

SEQ ID NO: 154253 - protein, 32 aa, Artificial Sequence
  Description of Artificial Sequence: Synthetic polypeptide
DENEIRTTNPVATEQWGDVNSNIMEMNAGEDA

SEQ ID NO: 154254 - protein, 31 aa, Artificial Sequence
  Description of Artificial Sequence: Synthetic polypeptide
DENEIRTTNPVATEQWGDVKSEIEMNALEDA

SEQ ID NO: 154255 - protein, 35 aa, Artificial Sequence
  Description of Artificial Sequence: Synthetic polypeptide
DEESIATTNPVATEQYGSVCAAMNPLNDMDGGENA

SEQ ID NO: 154256 - protein, 32 aa, Artificial Sequence
  Description of Artificial Sequence: Synthetic polypeptide
DENEIRTTNPVATEQWGDVKSEIEMNAAEDAQ

SEQ ID NO: 154257 - protein, 31 aa, Artificial Sequence
  Description of Artificial Sequence: Synthetic polypeptide
DENEIRTTNPVATEQWGDVKSEIEMNAAEDA

SEQ ID NO: 154258 - protein, 31 aa, Artificial Sequence
  Description of Artificial Sequence: Synthetic polypeptide
DENEIRTTNPVATEQWGDVKSEIEMNAAADA

SEQ ID NO: 154259 - protein, 30 aa, Artificial Sequence
  Description of Artificial Sequence: Synthetic polypeptide
DENEIRTTNPVATEQWGDVKEIEMNAAEDS

SEQ ID NO: 154260 - protein, 30 aa, Artificial Sequence
  Description of Artificial Sequence: Synthetic polypeptide
DENEIRTTNPVATEQWGDVKEIEMNAAEDA

SEQ ID NO: 154261 - protein, 36 aa, Artificial Sequence
  Description of Artificial Sequence: Synthetic polypeptide
DEEEIRTTNPVATYQYGSVSSTTPAGPNMRNEMNPV

SEQ ID NO: 154262 - protein, 34 aa, Artificial Sequence
  Description of Artificial Sequence: Synthetic polypeptide
DEGEIATTNPVAYEQYGSVSVANGATERGDQTAQ

SEQ ID NO: 154263 - protein, 32 aa, Artificial Sequence
  Description of Artificial Sequence: Synthetic polypeptide
DEESIATTNPVAYECWGSVYNWGNDHQREGDW

SEQ ID NO: 154264 - protein, 33 aa, Artificial Sequence
  Description of Artificial Sequence: Synthetic polypeptide
DEESIATTNPVAYECWGSVYNWTNDHQRDQNMA

SEQ ID NO: 154265 - protein, 33 aa, Artificial Sequence
  Description of Artificial Sequence: Synthetic polypeptide
DEESIATTNPVAYECWGSVYNWTNDTHQREGQM

SEQ ID NO: 154266 - protein, 30 aa, Artificial Sequence
  Description of Artificial Sequence: Synthetic polypeptide
DENEIRTTNPVATEQWGDVKEHEMNAAEDA

SEQ ID NO: 154267 - protein, 31 aa, Artificial Sequence
  Description of Artificial Sequence: Synthetic polypeptide
DENEIRTTNPVATEQWGDVISEIYMNAAEDA

SEQ ID NO: 154268 - protein, 31 aa, Artificial Sequence
  Description of Artificial Sequence: Synthetic polypeptide
DENEIRTTNPVATEQWGDVISEIEMNPAEDA

SEQ ID NO: 154269 - protein, 33 aa, Artificial Sequence
  Description of Artificial Sequence: Synthetic polypeptide
DEGEIATTNPVAYEQYGSVSANNSDEDAGGAED

SEQ ID NO: 154270 - protein, 31 aa, Artificial Sequence
  Description of Artificial Sequence: Synthetic polypeptide
DENEIRTTNPVATEQWGDVISEIEMNAAKDA

SEQ ID NO: 154271 - protein, 32 aa, Artificial Sequence
  Description of Artificial Sequence: Synthetic polypeptide
DEAEIACTNPVATEQYGSCATGNPANGDPDPQ

SEQ ID NO: 154272 - protein, 30 aa, Artificial Sequence
  Description of Artificial Sequence: Synthetic polypeptide
DENEIRTTNPVATEQWGDVLEIEMNAAEDA

SEQ ID NO: 154273 - protein, 31 aa, Artificial Sequence
  Description of Artificial Sequence: Synthetic polypeptide
DENEIRTTNPVATEQWGDVLEIEMNAAEDAA

SEQ ID NO: 154274 - protein, 31 aa, Artificial Sequence
  Description of Artificial Sequence: Synthetic polypeptide
DENEIRTTNPVATEQWGDVLHIEMNAAEDRA

SEQ ID NO: 154275 - protein, 32 aa, Artificial Sequence
  Description of Artificial Sequence: Synthetic polypeptide
DENEIRTTNPVATEQWGDVNSEIEQENAAEDA

SEQ ID NO: 154276 - protein, 36 aa, Artificial Sequence
  Description of Artificial Sequence: Synthetic polypeptide
DEEEIRTTNPVAVEQYGSVSTMNKHSSETPMGSDLN

SEQ ID NO: 154277 - protein, 31 aa, Artificial Sequence
  Description of Artificial Sequence: Synthetic polypeptide
DENEIRTTNPVATEQWGDVNSEIEMNAAEDA

SEQ ID NO: 154278 - protein, 31 aa, Artificial Sequence
  Description of Artificial Sequence: Synthetic polypeptide
DENEIRTTNPVATEQWGDVNSEIEMCAAEDA

SEQ ID NO: 154279 - protein, 31 aa, Artificial Sequence
  Description of Artificial Sequence: Synthetic polypeptide
DENEIRTTNPVATEQWGDVNEILEMNAAEDA

SEQ ID NO: 154280 - protein, 30 aa, Artificial Sequence
  Description of Artificial Sequence: Synthetic polypeptide
DENEIRTTNPVATEQWGDVNEIEMNAAEDA

SEQ ID NO: 154281 - protein, 31 aa, Artificial Sequence
  Description of Artificial Sequence: Synthetic polypeptide
DENEIRTTNPVATEQWGDVMSEIEMNAAEDE

SEQ ID NO: 154282 - protein, 31 aa, Artificial Sequence
  Description of Artificial Sequence: Synthetic polypeptide
DENEIRTTNPVATEQWGDVMSEIEMNAAEDA

SEQ ID NO: 154283 - protein, 32 aa, Artificial Sequence
  Description of Artificial Sequence: Synthetic polypeptide
DEESIATTNPVATASWGCVAGTANELGDSGNM

SEQ ID NO: 154284 - protein, 30 aa, Artificial Sequence
  Description of Artificial Sequence: Synthetic polypeptide
DENEIRTTNPVATEQWGDVMMIEMNAAEDA

SEQ ID NO: 154285 - protein, 30 aa, Artificial Sequence
  Description of Artificial Sequence: Synthetic polypeptide
DENEIRTTNPVATEQWGDVMEIEMNAAIDA

SEQ ID NO: 154286 - protein, 30 aa, Artificial Sequence
  Description of Artificial Sequence: Synthetic polypeptide
DENEIRTTNPVATEQWGDVMEIEMNAAEMA

SEQ ID NO: 154287 - protein, 31 aa, Artificial Sequence
  Description of Artificial Sequence: Synthetic polypeptide
DENEIRTTNPVATEQWGDVMEIEMNAAEKDA

SEQ ID NO: 154288 - protein, 31 aa, Artificial Sequence
  Description of Artificial Sequence: Synthetic polypeptide
DENEIRTTNPVATEQWGDVMEIEMNAAEDVA

SEQ ID NO: 154289 - protein, 30 aa, Artificial Sequence
  Description of Artificial Sequence: Synthetic polypeptide
DENEIRTTNPVATEQWGDVMEIEMNAAEDA

SEQ ID NO: 154290 - protein, 31 aa, Artificial Sequence
  Description of Artificial Sequence: Synthetic polypeptide
DENEIRTTNPVATEQWGDVLSEIEMNAAEDA

SEQ ID NO: 154291 - protein, 36 aa, Artificial Sequence
  Description of Artificial Sequence: Synthetic polypeptide
DEEEIRTTNPVAVEQYGSVCSTNKHSSETPMGSDDN

SEQ ID NO: 154292 - protein, 31 aa, Artificial Sequence
  Description of Artificial Sequence: Synthetic polypeptide
DENEIRTTNPVATEQWGDVLSEFEMNAAEDA

SEQ ID NO: 154293 - protein, 36 aa, Artificial Sequence
  Description of Artificial Sequence: Synthetic polypeptide
DEEEIRTTNPVAVEQYGSVSSTTPAGPNMRNHMNPV

SEQ ID NO: 154294 - protein, 36 aa, Artificial Sequence
  Description of Artificial Sequence: Synthetic polypeptide
DEEEIRTTNPVATEQYGSVVDLMVNNDQTEDGEEGD

SEQ ID NO: 154295 - protein, 31 aa, Artificial Sequence
  Description of Artificial Sequence: Synthetic polypeptide
DENEIRTTNPVATEQWGDVSCIIEMNAAEDA

SEQ ID NO: 154296 - protein, 31 aa, Artificial Sequence
  Description of Artificial Sequence: Synthetic polypeptide
DEGEIATTNPVSSEQYGIVSACDLEDHEGEL

SEQ ID NO: 154297 - protein, 32 aa, Artificial Sequence
  Description of Artificial Sequence: Synthetic polypeptide
DENEIRTTNPVATEQWGDVSEIELMNAAELDA

SEQ ID NO: 154298 - protein, 31 aa, Artificial Sequence
  Description of Artificial Sequence: Synthetic polypeptide
DENEIRTTNPVATEQWGDVSEIEKMNAAEDA

SEQ ID NO: 154299 - protein, 31 aa, Artificial Sequence
  Description of Artificial Sequence: Synthetic polypeptide
DENEIRTTNPVATEQWGDVSEIEIMNAAEDA

SEQ ID NO: 154300 - protein, 31 aa, Artificial Sequence
  Description of Artificial Sequence: Synthetic polypeptide
DENEIRTTNPVATEQWGDVSEIEIMFAAEDA

SEQ ID NO: 154301 - protein, 31 aa, Artificial Sequence
  Description of Artificial Sequence: Synthetic polypeptide
DENEIRTTNPVATEQWGDVSEIEHMNAAEDA

SEQ ID NO: 154302 - protein, 31 aa, Artificial Sequence
  Description of Artificial Sequence: Synthetic polypeptide
DENEIRTTNPVATEQWGDVSEIEGMNVAEDA

SEQ ID NO: 154303 - protein, 31 aa, Artificial Sequence
  Description of Artificial Sequence: Synthetic polypeptide
DENEIRTTNPVATEQWGDVSEIEGMNAAEDA

SEQ ID NO: 154304 - protein, 31 aa, Artificial Sequence
  Description of Artificial Sequence: Synthetic polypeptide
DENEIRTTNPVATEQWGDVSEIEFMNAAEDA

SEQ ID NO: 154305 - protein, 37 aa, Artificial Sequence
  Description of Artificial Sequence: Synthetic polypeptide
DEEEIRTTNPVATEQYGSVVGSGQDQEEQDGEGQGNG

SEQ ID NO: 154306 - protein, 31 aa, Artificial Sequence
  Description of Artificial Sequence: Synthetic polypeptide
DENEIRTTNPVATEQWGDVSEIEEMNWAEDA

SEQ ID NO: 154307 - protein, 31 aa, Artificial Sequence
  Description of Artificial Sequence: Synthetic polypeptide
DENEIRTTNPVATEQWGDVSEIEEMNAAEHA

SEQ ID NO: 154308 - protein, 31 aa, Artificial Sequence
  Description of Artificial Sequence: Synthetic polypeptide
DENEIRTTNPVATEQWGDVSEIEEMNAAEDA

SEQ ID NO: 154309 - protein, 31 aa, Artificial Sequence
  Description of Artificial Sequence: Synthetic polypeptide
DENEIRTTNPVATEQWGDVSEIEDMNAAVDI

SEQ ID NO: 154310 - protein, 31 aa, Artificial Sequence
  Description of Artificial Sequence: Synthetic polypeptide
DENEIRTTNPVATEQWGDVSEIEDMNAAEDA

SEQ ID NO: 154311 - protein, 31 aa, Artificial Sequence
  Description of Artificial Sequence: Synthetic polypeptide
DENEIRTTNPVATEQWGDVSEIECMNAAEDA

SEQ ID NO: 154312 - protein, 39 aa, Artificial Sequence
  Description of Artificial Sequence: Synthetic polypeptide
DEEEIRTTNPVATEQYGVVSVTVVTTNLQQGNNDEDEDE

SEQ ID NO: 154313 - protein, 31 aa, Artificial Sequence
  Description of Artificial Sequence: Synthetic polypeptide
DENEIRTTNPVATEQWGDVSEIEAMNAAEDA

SEQ ID NO: 154314 - protein, 37 aa, Artificial Sequence
  Description of Artificial Sequence: Synthetic polypeptide
DEEEIRTTNPVATEQYGSVVGMGQNDEEQDPEFGNNI

SEQ ID NO: 154315 - protein, 36 aa, Artificial Sequence
  Description of Artificial Sequence: Synthetic polypeptide
DEEEIRTTNPVATEQYGSVVGMGQDDEEQDGEGNNE

SEQ ID NO: 154316 - protein, 31 aa, Artificial Sequence
  Description of Artificial Sequence: Synthetic polypeptide
DEAEIRTTNPVATEQWGVDVSEIEMNAAEDA

SEQ ID NO: 154317 - protein, 31 aa, Artificial Sequence
  Description of Artificial Sequence: Synthetic polypeptide
DENEIRTTNPVATEQWGDVSEIEMDAAEDAS

SEQ ID NO: 154318 - protein, 36 aa, Artificial Sequence
  Description of Artificial Sequence: Synthetic polypeptide
DEEEIRTTNPVATEQYGSVVDPTIGAITQIQVNEQN

SEQ ID NO: 154319 - protein, 36 aa, Artificial Sequence
  Description of Artificial Sequence: Synthetic polypeptide
DEEEIRTTNPVATEQYGSVVDPTIGVTTQIGVAEQN

SEQ ID NO: 154320 - protein, 37 aa, Artificial Sequence
  Description of Artificial Sequence: Synthetic polypeptide
DEEEIRTTNPVATEQYGSVVDTTNNMIALDGNGEGGT

SEQ ID NO: 154321 - protein, 35 aa, Artificial Sequence
  Description of Artificial Sequence: Synthetic polypeptide
DEEEIRTTNPVATEQYGSVVENNQLAMMAEEEIQD

SEQ ID NO: 154322 - protein, 33 aa, Artificial Sequence
  Description of Artificial Sequence: Synthetic polypeptide
DEGEIATVNPVATEQWGCVAGTGLQTRANQMEN

SEQ ID NO: 154323 - protein, 38 aa, Artificial Sequence
  Description of Artificial Sequence: Synthetic polypeptide
DEEEIRTTNPVATEQYGVVSVTVVTNLQQGTDEEEETD

SEQ ID NO: 154324 - protein, 32 aa, Artificial Sequence
  Description of Artificial Sequence: Synthetic polypeptide
DENEIRTTNPVATEQWGDVSEIEMNAAEHDAL

SEQ ID NO: 154325 - protein, 37 aa, Artificial Sequence
  Description of Artificial Sequence: Synthetic polypeptide
DEEEIRTTNPVATEQYGSVVFTTIDNMETQGEGGGGT

SEQ ID NO: 154326 - protein, 31 aa, Artificial Sequence
  Description of Artificial Sequence: Synthetic polypeptide
DENEIRTTNPVATEQWGDVSEIDEMNIAEDA

SEQ ID NO: 154327 - protein, 36 aa, Artificial Sequence
  Description of Artificial Sequence: Synthetic polypeptide
DEEEIRTTNPVATEQYGSVVGDFNNNNEFTQGTNIQ

SEQ ID NO: 154328 - protein, 32 aa, Artificial Sequence
  Description of Artificial Sequence: Synthetic polypeptide
DENEIRTTNPVATEQWGDVSEIEMNAAEDTAW

SEQ ID NO: 154329 - protein, 32 aa, Artificial Sequence
  Description of Artificial Sequence: Synthetic polypeptide
DENEIRTTNPVATEQWGDVSEIEMNAAEDQAA

SEQ ID NO: 154330 - protein, 31 aa, Artificial Sequence
  Description of Artificial Sequence: Synthetic polypeptide
DENEIRTTNPVATEQWGDVSEIEMMNAAEDA

SEQ ID NO: 154331 - protein, 31 aa, Artificial Sequence
  Description of Artificial Sequence: Synthetic polypeptide
DENEIRTTNPVATEQWGDVSEIEMGAAEDMA

SEQ ID NO: 154332 - protein, 34 aa, Artificial Sequence
  Description of Artificial Sequence: Synthetic polypeptide
DEGEIATTNPVSTEQYGSVCAANNNLLDSDGNQN

SEQ ID NO: 154333 - protein, 31 aa, Artificial Sequence
  Description of Artificial Sequence: Synthetic polypeptide
DENEIRTTNPVATEQWGDVSEIEMFAAEDEA

SEQ ID NO: 154334 - protein, 31 aa, Artificial Sequence
  Description of Artificial Sequence: Synthetic polypeptide
DENEIRTTNPVATEQWGDVSEIEMEAAEHDA

SEQ ID NO: 154335 - protein, 31 aa, Artificial Sequence
  Description of Artificial Sequence: Synthetic polypeptide
DENEIRTTNPVATEQWGDVSEIEMDAAESDA

SEQ ID NO: 154336 - protein, 32 aa, Artificial Sequence
  Description of Artificial Sequence: Synthetic polypeptide
DENEIRTTNPVATEQWGDVSEIEMNAAEFDTA

SEQ ID NO: 154337 - protein, 33 aa, Artificial Sequence
  Description of Artificial Sequence: Synthetic polypeptide
DENEIRTTNPVATEQWGDVSCIIEPMNRAEEDA

SEQ ID NO: 154338 - protein, 31 aa, Artificial Sequence
  Description of Artificial Sequence: Synthetic polypeptide
DENEIRTTNPVATEQWGDVSEIDEMNAAEDY

SEQ ID NO: 154339 - protein, 31 aa, Artificial Sequence
  Description of Artificial Sequence: Synthetic polypeptide
DENEIRTTNPVATEQWGDVSEIDEMNAAEDA

SEQ ID NO: 154340 - protein, 32 aa, Artificial Sequence
  Description of Artificial Sequence: Synthetic polypeptide
DENEIRTTNPVATEQWGDVSEEIEKMNAAEDA

SEQ ID NO: 154341 - protein, 31 aa, Artificial Sequence
  Description of Artificial Sequence: Synthetic polypeptide
DENEIRTTNPVATEQWGDVSEEDEMNAKEDA

SEQ ID NO: 154342 - protein, 35 aa, Artificial Sequence
  Description of Artificial Sequence: Synthetic polypeptide
DEAEIATTNPVATEQYGSVANTGNGEYGAEGTGRD

SEQ ID NO: 154343 - protein, 31 aa, Artificial Sequence
  Description of Artificial Sequence: Synthetic polypeptide
DENEIRTTNPVATEQWGDVSEEDEANAKEDA

SEQ ID NO: 154344 - protein, 32 aa, Artificial Sequence
  Description of Artificial Sequence: Synthetic polypeptide
DENEIRTTNPVATEQWGDVSEDINEMNAAEDA

SEQ ID NO: 154345 - protein, 31 aa, Artificial Sequence
  Description of Artificial Sequence: Synthetic polypeptide
DENEIRTTNPVATEQWGDVSEDIEMNPAEDA

SEQ ID NO: 154346 - protein, 31 aa, Artificial Sequence
  Description of Artificial Sequence: Synthetic polypeptide
DENEIRTTNPVATEQWGDVSEDIEMNAEEDD

SEQ ID NO: 154347 - protein, 31 aa, Artificial Sequence
  Description of Artificial Sequence: Synthetic polypeptide
DENEIRTTNPVATEQWGDVSEDIEMNAAHDA

SEQ ID NO: 154348 - protein, 32 aa, Artificial Sequence
  Description of Artificial Sequence: Synthetic polypeptide
DENEIRTTNPVATEQWGDVSEDIEMNAAEYDA

SEQ ID NO: 154349 - protein, 31 aa, Artificial Sequence
  Description of Artificial Sequence: Synthetic polypeptide
DENEIRTTNPVATEQWGDVSEDIEMNAAEDA

SEQ ID NO: 154350 - protein, 31 aa, Artificial Sequence
  Description of Artificial Sequence: Synthetic polypeptide
DENEIRTTNPVATEQWGDVSECIEMNAAPDA

SEQ ID NO: 154351 - protein, 31 aa, Artificial Sequence
  Description of Artificial Sequence: Synthetic polypeptide
DENEIRTTNPVATEQWGDVSECIEMNAAEDA

SEQ ID NO: 154352 - protein, 31 aa, Artificial Sequence
  Description of Artificial Sequence: Synthetic polypeptide
DENEIRTTNPVATEQWGDVSEAIEMNAAEDA

SEQ ID NO: 154353 - protein, 31 aa, Artificial Sequence
  Description of Artificial Sequence: Synthetic polypeptide
DENEIRTTNPVATEQWGDVSDPIEMNAAEDA

SEQ ID NO: 154354 - protein, 31 aa, Artificial Sequence
  Description of Artificial Sequence: Synthetic polypeptide
DENEIRTTNPVATEQWGDVSDIMEMNAAEDA

SEQ ID NO: 154355 - protein, 31 aa, Artificial Sequence
  Description of Artificial Sequence: Synthetic polypeptide
DENEIRTTNPVATEQWGDVSDEIEMNAAEDA

SEQ ID NO: 154356 - protein, 35 aa, Artificial Sequence
  Description of Artificial Sequence: Synthetic polypeptide
DEESIACTNPVATEQYGSVCATNNPMQQGNQTQGT

SEQ ID NO: 154357 - protein, 31 aa, Artificial Sequence
  Description of Artificial Sequence: Synthetic polypeptide
DENEIRTTNPVATEQWGDVSEEIEMNAAEDA

SEQ ID NO: 154358 - protein, 31 aa, Artificial Sequence
  Description of Artificial Sequence: Synthetic polypeptide
DENEIRTTNPVATEQWGDVSEEIEMNAAEHA

SEQ ID NO: 154359 - protein, 31 aa, Artificial Sequence
  Description of Artificial Sequence: Synthetic polypeptide
DENEIRTTNPVATEQWGDVSEEIEMNAKEDA

SEQ ID NO: 154360 - protein, 31 aa, Artificial Sequence
  Description of Artificial Sequence: Synthetic polypeptide
DENEIRTTNPVATEQWGDVSEEIEVNAAEDL

SEQ ID NO: 154361 - protein, 31 aa, Artificial Sequence
  Description of Artificial Sequence: Synthetic polypeptide
DENEIRTTNPVATEQWGDVSEICEMNAAEDA

SEQ ID NO: 154362 - protein, 31 aa, Artificial Sequence
  Description of Artificial Sequence: Synthetic polypeptide
DENEIRTTNPVATEQWGDVSEIAYMNAAEDA

SEQ ID NO: 154363 - protein, 32 aa, Artificial Sequence
  Description of Artificial Sequence: Synthetic polypeptide
DENEIRTTNPVATEQWGDVSEIAEMNAAERDA

SEQ ID NO: 154364 - protein, 31 aa, Artificial Sequence
  Description of Artificial Sequence: Synthetic polypeptide
DENEIRTTNPVATEQWGDVSEIAEMNAAEIA

SEQ ID NO: 154365 - protein, 32 aa, Artificial Sequence
  Description of Artificial Sequence: Synthetic polypeptide
DENEIRTTNPVATEQWGDVSEIAEMNAAEDFA

SEQ ID NO: 154366 - protein, 31 aa, Artificial Sequence
  Description of Artificial Sequence: Synthetic polypeptide
DENEIRTTNPVATEQWGDVSEIAEMNAAEDA

SEQ ID NO: 154367 - protein, 31 aa, Artificial Sequence
  Description of Artificial Sequence: Synthetic polypeptide
DENEIRTTNPVATEQWGDVSEHKEMNAAEDA

SEQ ID NO: 154368 - protein, 32 aa, Artificial Sequence
  Description of Artificial Sequence: Synthetic polypeptide
DENEIRTTNPVATEQWGDVSEHILEMNAAEDA

SEQ ID NO: 154369 - protein, 32 aa, Artificial Sequence
  Description of Artificial Sequence: Synthetic polypeptide
DENEIRTTNPVATEQWGDVSEIDEMNAAEDQA

SEQ ID NO: 154370 - protein, 32 aa, Artificial Sequence
  Description of Artificial Sequence: Synthetic polypeptide
DENEIRTTNPVATEQWGDVSEHIHEMNAAEDA

SEQ ID NO: 154371 - protein, 31 aa, Artificial Sequence
  Description of Artificial Sequence: Synthetic polypeptide
DENEIRTTNPVATEQWGDVSEHEHMNAAEDA

SEQ ID NO: 154372 - protein, 31 aa, Artificial Sequence
  Description of Artificial Sequence: Synthetic polypeptide
DENEIRTTNPVATEQWGDVSEGSEMNAAEDA

SEQ ID NO: 154373 - protein, 31 aa, Artificial Sequence
  Description of Artificial Sequence: Synthetic polypeptide
DENEIRTTNPVATEQWGDVSEGIEMNAAEDA

SEQ ID NO: 154374 - protein, 31 aa, Artificial Sequence
  Description of Artificial Sequence: Synthetic polypeptide
DENEIRTTNPVATEQWGDVSEGEVMNAAEDA

SEQ ID NO: 154375 - protein, 38 aa, Artificial Sequence
  Description of Artificial Sequence: Synthetic polypeptide
DEEEIRTTNPVATEQYGSVVGSGQNDEEQNGEGENNQG

SEQ ID NO: 154376 - protein, 31 aa, Artificial Sequence
  Description of Artificial Sequence: Synthetic polypeptide
DENEIRTTNPVATEQWGDVSEFIEMNAAEDV

SEQ ID NO: 154377 - protein, 31 aa, Artificial Sequence
  Description of Artificial Sequence: Synthetic polypeptide
DENEIRTTNPVATEQWGDVSEFIEMNAAEDA

SEQ ID NO: 154378 - protein, 32 aa, Artificial Sequence
  Description of Artificial Sequence: Synthetic polypeptide
DENEIRTTNPVATEQWGDVSEEISEMNAAEDA

SEQ ID NO: 154379 - protein, 31 aa, Artificial Sequence
  Description of Artificial Sequence: Synthetic polypeptide
DENEIRTTNPVATEQWGDVSEHIEMNAAEDA

SEQ ID NO: 154380 - protein, 37 aa, Artificial Sequence
  Description of Artificial Sequence: Synthetic polypeptide
DEEEIRTTNPVATEQYGSVVSNGMQDEGQEDEGNTDE

SEQ ID NO: 154381 - protein, 32 aa, Artificial Sequence
  Description of Artificial Sequence: Synthetic polypeptide
DENEIRTTNPVATEPYGDISMEIIQMNQNEDA

SEQ ID NO: 154382 - protein, 32 aa, Artificial Sequence
  Description of Artificial Sequence: Synthetic polypeptide
DENEIRTTNPVATEPYGDISEEDIQQQAAGDH

SEQ ID NO: 154383 - protein, 34 aa, Artificial Sequence
  Description of Artificial Sequence: Synthetic polypeptide
DEGEIATTNPVATEQWGHSNIAATNGLEARPGEF

SEQ ID NO: 154384 - protein, 35 aa, Artificial Sequence
  Description of Artificial Sequence: Synthetic polypeptide
DEEEIRTTNPVATESYGSVMGGLDFGQEGGGDEGG

SEQ ID NO: 154385 - protein, 33 aa, Artificial Sequence
  Description of Artificial Sequence: Synthetic polypeptide
DEFEIRTTNPVATEQWGSDVSEIQEMMGMELEA

SEQ ID NO: 154386 - protein, 34 aa, Artificial Sequence
  Description of Artificial Sequence: Synthetic polypeptide
DEFEIRTTNPVATEQWGSDVSEIQETMNGMEDEA

SEQ ID NO: 154387 - protein, 34 aa, Artificial Sequence
  Description of Artificial Sequence: Synthetic polypeptide
DEFEIRTTNPVATEQWGSDVSEMIQEMNGMEEAN

SEQ ID NO: 154388 - protein, 34 aa, Artificial Sequence
  Description of Artificial Sequence: Synthetic polypeptide
DEFEIRTTNPVATEQWGSLVSEWIQEMNGMEEAA

SEQ ID NO: 154389 - protein, 34 aa, Artificial Sequence
  Description of Artificial Sequence: Synthetic polypeptide
DEFEIRTTNPVATEQWGSVVSEIQETMNGMEEAL

SEQ ID NO: 154390 - protein, 35 aa, Artificial Sequence
  Description of Artificial Sequence: Synthetic polypeptide
DEEEIRTTNPVATEQYGSVWAYPDPMQQMGSQEEE

SEQ ID NO: 154391 - protein, 34 aa, Artificial Sequence
  Description of Artificial Sequence: Synthetic polypeptide
DENEIRCTNPVATEQYGCVSWAFALETRIQENEQ

SEQ ID NO: 154392 - protein, 30 aa, Artificial Sequence
  Description of Artificial Sequence: Synthetic polypeptide
DENEIRTTNPTATEQWGNVSEIEMVAAEDA

SEQ ID NO: 154393 - protein, 35 aa, Artificial Sequence
  Description of Artificial Sequence: Synthetic polypeptide
DEEEIRTTNPVATEQYGSVWAVVDPMNQLGSLEET

SEQ ID NO: 154394 - protein, 30 aa, Artificial Sequence
  Description of Artificial Sequence: Synthetic polypeptide
DENEIRTTNPTATEQWGDVSVIEMNAAEDA

SEQ ID NO: 154395 - protein, 30 aa, Artificial Sequence
  Description of Artificial Sequence: Synthetic polypeptide
DENEIRTTNPTATEQWGDVSEIEMNAAEDA

SEQ ID NO: 154396 - protein, 34 aa, Artificial Sequence
  Description of Artificial Sequence: Synthetic polypeptide
DDEEIRTTNPVATEQYGDVVQGTDLGEGEDEQGQ

SEQ ID NO: 154397 - protein, 32 aa, Artificial Sequence
  Description of Artificial Sequence: Synthetic polypeptide
DEFEIRTTNPVSTEPYGKISMEDIQQQQNGNH

SEQ ID NO: 154398 - protein, 32 aa, Artificial Sequence
  Description of Artificial Sequence: Synthetic polypeptide
DEFEIRTTNPVSTEPYGTISMEDIQMQQNGNH

SEQ ID NO: 154399 - protein, 32 aa, Artificial Sequence
  Description of Artificial Sequence: Synthetic polypeptide
DEFEIRTTNPVSTEPYGTISMEDIQQQQNGNH

SEQ ID NO: 154400 - protein, 35 aa, Artificial Sequence
  Description of Artificial Sequence: Synthetic polypeptide
DEAEIATTNPVATEQYGSVAITNIDNDERNGMQGQ

SEQ ID NO: 154401 - protein, 37 aa, Artificial Sequence
  Description of Artificial Sequence: Synthetic polypeptide
DEEEIRTTNPVATEQYGWSVSSTTPAGPNMRNGMTPV

SEQ ID NO: 154402 - protein, 32 aa, Artificial Sequence
  Description of Artificial Sequence: Synthetic polypeptide
DENEIRTTNPTSTEPYGTISMEDIQRQQNGNH

SEQ ID NO: 154403 - protein, 36 aa, Artificial Sequence
  Description of Artificial Sequence: Synthetic polypeptide
DEEEIRTTNPVATEQYGSVWCPTPLLSESQIMVLEE

SEQ ID NO: 154404 - protein, 30 aa, Artificial Sequence
  Description of Artificial Sequence: Synthetic polypeptide
DENEIRTTNPVAFEQWGDVSEIEMNAAEDA

SEQ ID NO: 154405 - protein, 35 aa, Artificial Sequence
  Description of Artificial Sequence: Synthetic polypeptide
DEEEIRTTNPVATESYGSVSDGFGGGEGQGENQDI

SEQ ID NO: 154406 - protein, 30 aa, Artificial Sequence
  Description of Artificial Sequence: Synthetic polypeptide
DENEIRTTNPVACEQWGDVSEIEMNAAEDA

SEQ ID NO: 154407 - protein, 30 aa, Artificial Sequence
  Description of Artificial Sequence: Synthetic polypeptide
DENEIRTTNPVACEQWGDVSEIEANAAEDA

SEQ ID NO: 154408 - protein, 32 aa, Artificial Sequence
  Description of Artificial Sequence: Synthetic polypeptide
DEAEIRTTNPCAYEQWGVVSGGNMQDTGGGKD

SEQ ID NO: 154409 - protein, 33 aa, Artificial Sequence
  Description of Artificial Sequence: Synthetic polypeptide
DEAEIRTTNPCAYEQWGVVSGGNMQQDTGGGAR

SEQ ID NO: 154410 - protein, 34 aa, Artificial Sequence
  Description of Artificial Sequence: Synthetic polypeptide
DEEEIRTTNPVATESYGSVSDGFGGGEGEGEQSE

SEQ ID NO: 154411 - protein, 36 aa, Artificial Sequence
  Description of Artificial Sequence: Synthetic polypeptide
DEEEIRTTNPVATEQYGSVWDAVPDPMLQLGSLEET

SEQ ID NO: 154412 - protein, 32 aa, Artificial Sequence
  Description of Artificial Sequence: Synthetic polypeptide
DEFEIRTTNPVSTEPYGTISMEDIWQQQNGNH

SEQ ID NO: 154413 - protein, 34 aa, Artificial Sequence
  Description of Artificial Sequence: Synthetic polypeptide
DDEEIRTTNPVATEQYGQCVCSWEEHQAFGSEQA

SEQ ID NO: 154414 - protein, 35 aa, Artificial Sequence
  Description of Artificial Sequence: Synthetic polypeptide
DEEEIRTTNPVATEQYGSVWCVLDDLNQPNSQIEQ

SEQ ID NO: 154415 - protein, 30 aa, Artificial Sequence
  Description of Artificial Sequence: Synthetic polypeptide
DENEIRTTNPVACEQWGDVSAIEMNAAEDA

SEQ ID NO: 154416 - protein, 35 aa, Artificial Sequence
  Description of Artificial Sequence: Synthetic polypeptide
DEEEIRTTNPVATEQYGWIYHTALEDHNGEGDENQ

SEQ ID NO: 154417 - protein, 33 aa, Artificial Sequence
  Description of Artificial Sequence: Synthetic polypeptide
DENEIRCTNPVATEQYGCSAWAYLTERIQENEQ

SEQ ID NO: 154418 - protein, 34 aa, Artificial Sequence
  Description of Artificial Sequence: Synthetic polypeptide
DEFEICTVNPVAYEAYGISVSCTNELSTEPGGNH

SEQ ID NO: 154419 - protein, 35 aa, Artificial Sequence
  Description of Artificial Sequence: Synthetic polypeptide
DEEEIRTTNPVATEQYGWIYHTILEDHNDEGDENE

SEQ ID NO: 154420 - protein, 36 aa, Artificial Sequence
  Description of Artificial Sequence: Synthetic polypeptide
DDEEIRTTNPVATEQYGNVSSTTPAGPNMRNGMNPV

SEQ ID NO: 154421 - protein, 33 aa, Artificial Sequence
  Description of Artificial Sequence: Synthetic polypeptide
DEFEIRTTNPCAYEEYGSTVAYENEHSGRGGNA

SEQ ID NO: 154422 - protein, 36 aa, Artificial Sequence
  Description of Artificial Sequence: Synthetic polypeptide
DEEEIRTTNPVATEQYGSVWCWTPNVNQTQMVQEAD

SEQ ID NO: 154423 - protein, 31 aa, Artificial Sequence
  Description of Artificial Sequence: Synthetic polypeptide
DENEIRTTNPVAFEQWGDVSEIEMNAAEDPA

SEQ ID NO: 154424 - protein, 36 aa, Artificial Sequence
  Description of Artificial Sequence: Synthetic polypeptide
DEAEIATTNPVATEQWGSVTSAAANLGQEAAGGNNL

SEQ ID NO: 154425 - protein, 33 aa, Artificial Sequence
  Description of Artificial Sequence: Synthetic polypeptide
DEFEIVTTNPVATEQYGTVCVATDGPVEFEGND

SEQ ID NO: 154426 - protein, 32 aa, Artificial Sequence
  Description of Artificial Sequence: Synthetic polypeptide
DEGEIATTNPVATEQWGCVSEGEMNAAEDNAD

SEQ ID NO: 154427 - protein, 36 aa, Artificial Sequence
  Description of Artificial Sequence: Synthetic polypeptide
DEFQIRTTNPVATEQYGSVSSTTPAGPNMRNGMNPV

SEQ ID NO: 154428 - protein, 36 aa, Artificial Sequence
  Description of Artificial Sequence: Synthetic polypeptide
DEAEIATTNPVATEQYGSVAITNIDHGERQGQGNTD

SEQ ID NO: 154429 - protein, 35 aa, Artificial Sequence
  Description of Artificial Sequence: Synthetic polypeptide
DEAEIATTNPVATEQYGSVAITNHDEQTGEGGGTH

SEQ ID NO: 154430 - protein, 34 aa, Artificial Sequence
  Description of Artificial Sequence: Synthetic polypeptide
DEGEIATTNPVATEQWGCVAMTNLNPDDGMGDRM

SEQ ID NO: 154431 - protein, 35 aa, Artificial Sequence
  Description of Artificial Sequence: Synthetic polypeptide
DEEEIRTTNPVATESYGKVNNSFNKLYGREIITAD

SEQ ID NO: 154432 - protein, 33 aa, Artificial Sequence
  Description of Artificial Sequence: Synthetic polypeptide
DEFVICTTNPVATEQYGCVETDDWPTQTFGNQF

SEQ ID NO: 154433 - protein, 33 aa, Artificial Sequence
  Description of Artificial Sequence: Synthetic polypeptide
DEGEIATTNPVATEQWGCVAGTGELAQNNHQNH

SEQ ID NO: 154434 - protein, 33 aa, Artificial Sequence
  Description of Artificial Sequence: Synthetic polypeptide
DEAEIATTNPVATEQWGTVCSATDGEVEAEGND

SEQ ID NO: 154435 - protein, 35 aa, Artificial Sequence
  Description of Artificial Sequence: Synthetic polypeptide
DDEEIRTTNPVATEQYGCVCSYNDNLDEETFENQV

SEQ ID NO: 154436 - protein, 34 aa, Artificial Sequence
  Description of Artificial Sequence: Synthetic polypeptide
DDEEIRTTNPVATEQYGCVCSWMEHQEFFGSEQA

SEQ ID NO: 154437 - protein, 34 aa, Artificial Sequence
  Description of Artificial Sequence: Synthetic polypeptide
DDEEIRTTNPVATEQYGCVCSWGEHNQNFNSDQS

SEQ ID NO: 154438 - protein, 31 aa, Artificial Sequence
  Description of Artificial Sequence: Synthetic polypeptide
DENEIRTTNPIATEQWGDVSNEIEMNAAEDI

SEQ ID NO: 154439 - protein, 31 aa, Artificial Sequence
  Description of Artificial Sequence: Synthetic polypeptide
DENEIRTTNPIATEQWGDVSEIEMNAAEDSA

SEQ ID NO: 154440 - protein, 30 aa, Artificial Sequence
  Description of Artificial Sequence: Synthetic polypeptide
DENEIRTTNPIATEQWGDVSEIEMNAAEDL

SEQ ID NO: 154441 - protein, 30 aa, Artificial Sequence
  Description of Artificial Sequence: Synthetic polypeptide
DENEIRTTNPIATEQWGDVSEIEMNAAEDA

SEQ ID NO: 154442 - protein, 31 aa, Artificial Sequence
  Description of Artificial Sequence: Synthetic polypeptide
DENEIRTTNPIATEQWGDVSEEDWMNAAGDA

SEQ ID NO: 154443 - protein, 32 aa, Artificial Sequence
  Description of Artificial Sequence: Synthetic polypeptide
DEFETCTVNPVATEQYGSVSWNEDDFEGGGDH

SEQ ID NO: 154444 - protein, 35 aa, Artificial Sequence
  Description of Artificial Sequence: Synthetic polypeptide
DEEEIRTTNPVATEQYGSVVVDGFGQENDLPEDGT

SEQ ID NO: 154445 - protein, 32 aa, Artificial Sequence
  Description of Artificial Sequence: Synthetic polypeptide
DENEIRTTNPISTEPYGTISEEDLQQQQNGNH

SEQ ID NO: 154446 - protein, 32 aa, Artificial Sequence
  Description of Artificial Sequence: Synthetic polypeptide
DENEIRTTNPISTEPYGTISMEDLQQQQNGNH

SEQ ID NO: 154447 - protein, 33 aa, Artificial Sequence
  Description of Artificial Sequence: Synthetic polypeptide
DEFEIVTVNPVATEQYGTVCSATDGPVEFEGND

SEQ ID NO: 154448 - protein, 34 aa, Artificial Sequence
  Description of Artificial Sequence: Synthetic polypeptide
DDEEIRTTNPVATEQYGDVSGDQNINGDGGEGEQ

SEQ ID NO: 154449 - protein, 34 aa, Artificial Sequence
  Description of Artificial Sequence: Synthetic polypeptide
DENEIRCTNPVATEQYGCVSWPFLDTFRIQENEQ

SEQ ID NO: 154450 - protein, 34 aa, Artificial Sequence
  Description of Artificial Sequence: Synthetic polypeptide
DENEIRCTNPVATEQYGCVSWPFLLTRIQENEQF

SEQ ID NO: 154451 - protein, 32 aa, Artificial Sequence
  Description of Artificial Sequence: Synthetic polypeptide
DENEIRTTNPLSTEPYGTISNSDIQVQQNGNH

SEQ ID NO: 154452 - protein, 34 aa, Artificial Sequence
  Description of Artificial Sequence: Synthetic polypeptide
DEFELCTVNPVATEQYGSVSWTENDLDEKGGGDH

SEQ ID NO: 154453 - protein, 30 aa, Artificial Sequence
  Description of Artificial Sequence: Synthetic polypeptide
DENEIRTTNPLATEQWGNVSEIEMNAAEDA

SEQ ID NO: 154454 - protein, 30 aa, Artificial Sequence
  Description of Artificial Sequence: Synthetic polypeptide
DENEIRTTNPLATEQWGDVSEIEMNAAEDA

SEQ ID NO: 154455 - protein, 32 aa, Artificial Sequence
  Description of Artificial Sequence: Synthetic polypeptide
DENEIRTTNPTATEPYGTISMEDIQQQQNGNH

SEQ ID NO: 154456 - protein, 30 aa, Artificial Sequence
  Description of Artificial Sequence: Synthetic polypeptide
DENEIRTTNPLATEQWGDVSEIEENAAEDA

SEQ ID NO: 154457 - protein, 37 aa, Artificial Sequence
  Description of Artificial Sequence: Synthetic polypeptide
DEEEIRTTNPVATEQYGSVVYSGMFGQEGEQEEDDRG

SEQ ID NO: 154458 - protein, 37 aa, Artificial Sequence
  Description of Artificial Sequence: Synthetic polypeptide
DEEEIRTTNPVATEQYGSVVYPTVNPHGEISQGEDRP

SEQ ID NO: 154459 - protein, 36 aa, Artificial Sequence
  Description of Artificial Sequence: Synthetic polypeptide
DEAEIRTTNPEATEQYGSVSSTTPAGPNMRNGMNPV

SEQ ID NO: 154460 - protein, 33 aa, Artificial Sequence
  Description of Artificial Sequence: Synthetic polypeptide
DENEIRCTNPVATEQYGEASSEPAGPQMRGGPV

SEQ ID NO: 154461 - protein, 35 aa, Artificial Sequence
  Description of Artificial Sequence: Synthetic polypeptide
DEFELCTVNPVATEQYGSVSWTENDQHDQKGGNEH

SEQ ID NO: 154462 - protein, 34 aa, Artificial Sequence
  Description of Artificial Sequence: Synthetic polypeptide
DEFELCTVNPVATEQYGSVSWTENDQHDQKGGTH

SEQ ID NO: 154463 - protein, 35 aa, Artificial Sequence
  Description of Artificial Sequence: Synthetic polypeptide
DEFELCTVNPVATEQYGSVSWTENDQHNQKGDNDH

SEQ ID NO: 154464 - protein, 34 aa, Artificial Sequence
  Description of Artificial Sequence: Synthetic polypeptide
DEEEIRTTNPVATEQYGSVVYENAPEETPFQAEA

SEQ ID NO: 154465 - protein, 32 aa, Artificial Sequence
  Description of Artificial Sequence: Synthetic polypeptide
DENEIRTTNPISTEQYGTISMEDIQQQQNGNH

SEQ ID NO: 154466 - protein, 31 aa, Artificial Sequence
  Description of Artificial Sequence: Synthetic polypeptide
DENEIRTTNPIATEQWGDTVSEIEANAAGDA

SEQ ID NO: 154467 - protein, 35 aa, Artificial Sequence
  Description of Artificial Sequence: Synthetic polypeptide
DDEEIRTTNPVATEQYGQCVCSWGEHQNFGSENQA

SEQ ID NO: 154468 - protein, 30 aa, Artificial Sequence
  Description of Artificial Sequence: Synthetic polypeptide
DENEIRCTNPVATEQWGDVSEIEMNAAEMA

SEQ ID NO: 154469 - protein, 35 aa, Artificial Sequence
  Description of Artificial Sequence: Synthetic polypeptide
DEEEIRTTNPVATEQYGVVVNGGQIGEGGGANTSD

SEQ ID NO: 154470 - protein, 30 aa, Artificial Sequence
  Description of Artificial Sequence: Synthetic polypeptide
DENEIRTTNPVATEAWGDVSEIEMNAAMDA

SEQ ID NO: 154471 - protein, 30 aa, Artificial Sequence
  Description of Artificial Sequence: Synthetic polypeptide
DENEIRTTNPVATEAWGDVSEIEMNAAEDA

SEQ ID NO: 154472 - protein, 32 aa, Artificial Sequence
  Description of Artificial Sequence: Synthetic polypeptide
DENEIRCTNPISTEPYGTVSEEDLQQQQNGNH

SEQ ID NO: 154473 - protein, 34 aa, Artificial Sequence
  Description of Artificial Sequence: Synthetic polypeptide
DENEIRTTNPVATDQYGSVNVTGAEHPRQATNDQ

SEQ ID NO: 154474 - protein, 34 aa, Artificial Sequence
  Description of Artificial Sequence: Synthetic polypeptide
DENEIRTTNPVATDQYGSVNVTGAEHPAQAQNDA

SEQ ID NO: 154475 - protein, 32 aa, Artificial Sequence
  Description of Artificial Sequence: Synthetic polypeptide
DEEVISTTNPDATEGYGSCSDPLARYGDEYDG

SEQ ID NO: 154476 - protein, 35 aa, Artificial Sequence
  Description of Artificial Sequence: Synthetic polypeptide
DEEEIRTTNPVATEQYGVVVSITGMGESNDDEFED

SEQ ID NO: 154477 - protein, 32 aa, Artificial Sequence
  Description of Artificial Sequence: Synthetic polypeptide
DENEIRCTNPISTEQYGTISMENIQQQQNGNH

SEQ ID NO: 154478 - protein, 39 aa, Artificial Sequence
  Description of Artificial Sequence: Synthetic polypeptide
DEEEIRTTNPVATESYGTVTNDQSGTVSTNTQNQEVGNR

SEQ ID NO: 154479 - protein, 35 aa, Artificial Sequence
  Description of Artificial Sequence: Synthetic polypeptide
DEGEIATTNPVATEQYGCVAATNPTPADPGDNNRM

SEQ ID NO: 154480 - protein, 34 aa, Artificial Sequence
  Description of Artificial Sequence: Synthetic polypeptide
DEGEIATTNPVATEQYGCVAATNPLEAPDNQNNV

SEQ ID NO: 154481 - protein, 36 aa, Artificial Sequence
  Description of Artificial Sequence: Synthetic polypeptide
DEEEIRTTNPVATEQYGVVVSIVTGMGQGNDDETED

SEQ ID NO: 154482 - protein, 34 aa, Artificial Sequence
  Description of Artificial Sequence: Synthetic polypeptide
DENEIRTTNPVATDQYGSVNTPGLEHPRQAQAGD

SEQ ID NO: 154483 - protein, 37 aa, Artificial Sequence
  Description of Artificial Sequence: Synthetic polypeptide
DEEEIRTTNPVATEQYGVVVVVVSNNNLQQGTEEGQD

SEQ ID NO: 154484 - protein, 36 aa, Artificial Sequence
  Description of Artificial Sequence: Synthetic polypeptide
DEEEIRTTNPVATEQYGSVVVDDFGDENDQEEDNGE

SEQ ID NO: 154485 - protein, 34 aa, Artificial Sequence
  Description of Artificial Sequence: Synthetic polypeptide
DEEEIRTTNPVATEQYGSVWHIIDGVGGMQEPEQ

SEQ ID NO: 154486 - protein, 30 aa, Artificial Sequence
  Description of Artificial Sequence: Synthetic polypeptide
DENEIRTTNPVATEAWGDVSEIEMNAVKDA

SEQ ID NO: 154487 - protein, 36 aa, Artificial Sequence
  Description of Artificial Sequence: Synthetic polypeptide
DEEEIRTTNPVATEQYGSVWPENNPLDEVMGEKEEN

SEQ ID NO: 154488 - protein, 30 aa, Artificial Sequence
  Description of Artificial Sequence: Synthetic polypeptide
DENEIRTTNPVATEAWGQVSEHEMNAAEDA

SEQ ID NO: 154489 - protein, 35 aa, Artificial Sequence
  Description of Artificial Sequence: Synthetic polypeptide
DENEIRTTNPVATEAWGSVSTVVNNNNQGDEGEEG

SEQ ID NO: 154490 - protein, 30 aa, Artificial Sequence
  Description of Artificial Sequence: Synthetic polypeptide
DENEIRTTNPVATECWGAVSADWMNAKEDA

SEQ ID NO: 154491 - protein, 38 aa, Artificial Sequence
  Description of Artificial Sequence: Synthetic polypeptide
DEEEIRTTNPVATEQYGVVTVVVTNNNLQQGEDETNNA

SEQ ID NO: 154492 - protein, 34 aa, Artificial Sequence
  Description of Artificial Sequence: Synthetic polypeptide
DDEEIRTTNPVATEQYGSVMGNNNNNMTEGGQGG

SEQ ID NO: 154493 - protein, 34 aa, Artificial Sequence
  Description of Artificial Sequence: Synthetic polypeptide
DDEEIRTTNPVATEQYGSVMGNNNNMDEGGEEGE

SEQ ID NO: 154494 - protein, 35 aa, Artificial Sequence
  Description of Artificial Sequence: Synthetic polypeptide
DENEIRATNPVATEQYGSVTNQGDEGQGEGQGEIR

SEQ ID NO: 154495 - protein, 33 aa, Artificial Sequence
  Description of Artificial Sequence: Synthetic polypeptide
DEGEIATTNPVATEQYGCWNANINPLQAPMENN

SEQ ID NO: 154496 - protein, 34 aa, Artificial Sequence
  Description of Artificial Sequence: Synthetic polypeptide
DDEEIRTTNPVATEQYGSVMGNGNNMDEGGEGGA

SEQ ID NO: 154497 - protein, 35 aa, Artificial Sequence
  Description of Artificial Sequence: Synthetic polypeptide
DENEIRTTNPVATEAYGVVSNDTNMDGQDGGGEGT

SEQ ID NO: 154498 - protein, 35 aa, Artificial Sequence
  Description of Artificial Sequence: Synthetic polypeptide
DENEIRTTNPVATDQYGSVNNTQLEHPRQAQNLDA

SEQ ID NO: 154499 - protein, 37 aa, Artificial Sequence
  Description of Artificial Sequence: Synthetic polypeptide
DEEEIRTTNPVATEQYGSVVTTPGMNNETGEDGGNET

SEQ ID NO: 154500 - protein, 36 aa, Artificial Sequence
  Description of Artificial Sequence: Synthetic polypeptide
DENEIRTTNPVATEAYGSVMSDQNDLDQTGGQGGQT

SEQ ID NO: 154501 - protein, 36 aa, Artificial Sequence
  Description of Artificial Sequence: Synthetic polypeptide
DEEEIRTTNPVATEQYGVVVDSGINDNEQQDEGQEI

SEQ ID NO: 154502 - protein, 32 aa, Artificial Sequence
  Description of Artificial Sequence: Synthetic polypeptide
DENEIRATNPVSTEPYGTISMELIQQQQNGNH

SEQ ID NO: 154503 - protein, 32 aa, Artificial Sequence
  Description of Artificial Sequence: Synthetic polypeptide
DENEIRATNPVSTEPYGTISMNDIQQQQNGNH

SEQ ID NO: 154504 - protein, 37 aa, Artificial Sequence
  Description of Artificial Sequence: Synthetic polypeptide
DDEEIRTTNPVATEQYGSVGVTNLQSGEEDEGGDIED

SEQ ID NO: 154505 - protein, 34 aa, Artificial Sequence
  Description of Artificial Sequence: Synthetic polypeptide
DENEIRTTNPVATEAWGSVSVVNNNNNDEGENGT

SEQ ID NO: 154506 - protein, 34 aa, Artificial Sequence
  Description of Artificial Sequence: Synthetic polypeptide
DEGEIATTNPVATEQYGCVATGLTNPDDQGENNV

SEQ ID NO: 154507 - protein, 39 aa, Artificial Sequence
  Description of Artificial Sequence: Synthetic polypeptide
DEEEIRTTNPVATEQYGSVVTVVTNLQGNQNIGNNNEGT

SEQ ID NO: 154508 - protein, 33 aa, Artificial Sequence
  Description of Artificial Sequence: Synthetic polypeptide
DEEVIRTTNPVAYEPWGSTVHCTNISHNSGGRA

SEQ ID NO: 154509 - protein, 30 aa, Artificial Sequence
  Description of Artificial Sequence: Synthetic polypeptide
DENEIRTTNPVAFEQWGDVSEIEMNHAEDA

SEQ ID NO: 154510 - protein, 34 aa, Artificial Sequence
  Description of Artificial Sequence: Synthetic polypeptide
DENEIRTTNPVATDQYGSVNALEAEHQRQAVNDA

SEQ ID NO: 154511 - protein, 35 aa, Artificial Sequence
  Description of Artificial Sequence: Synthetic polypeptide
DEGEIATTNPVATEQYGCVAATHLPQASMSGNDTM

SEQ ID NO: 154512 - protein, 32 aa, Artificial Sequence
  Description of Artificial Sequence: Synthetic polypeptide
DENEIRCTNPVATEPYGTISMEDIQQQQNGNH

SEQ ID NO: 154513 - protein, 32 aa, Artificial Sequence
  Description of Artificial Sequence: Synthetic polypeptide
DEAEIATTNPVATEQWGSVAGEGDQNTDDNNY

SEQ ID NO: 154514 - protein, 35 aa, Artificial Sequence
  Description of Artificial Sequence: Synthetic polypeptide
DEEEIRTTNPVATEQYGSVVVDGFGDENDQEEDGV

SEQ ID NO: 154515 - protein, 30 aa, Artificial Sequence
  Description of Artificial Sequence: Synthetic polypeptide
DENEIRTTNPVASEQWGDVSEIEMNAAEDA

SEQ ID NO: 154516 - protein, 32 aa, Artificial Sequence
  Description of Artificial Sequence: Synthetic polypeptide
CEEVIACTNPVATEQWGCVAGTNLATMPGERM

SEQ ID NO: 154517 - protein, 30 aa, Artificial Sequence
  Description of Artificial Sequence: Synthetic polypeptide
DENEIRTTNPVAIEQWGDVSEPEMNAAEDA

SEQ ID NO: 154518 - protein, 30 aa, Artificial Sequence
  Description of Artificial Sequence: Synthetic polypeptide
DENEIRTTNPVAIEQWGDVSEIEMNAAEDA

SEQ ID NO: 154519 - protein, 35 aa, Artificial Sequence
  Description of Artificial Sequence: Synthetic polypeptide
DEAEIATTNPVATEQWGSVAITNPEQMHQGDNSDA

SEQ ID NO: 154520 - protein, 33 aa, Artificial Sequence
  Description of Artificial Sequence: Synthetic polypeptide
DEGEIATTNPVATEQWGSVSVPNITNNDGTDQN

SEQ ID NO: 154521 - protein, 34 aa, Artificial Sequence
  Description of Artificial Sequence: Synthetic polypeptide
DEGEIATTNPVATEQWGSVSVPNITNNDGEENDW

SEQ ID NO: 154522 - protein, 34 aa, Artificial Sequence
  Description of Artificial Sequence: Synthetic polypeptide
DEGEIATTNPVATEQWGSVSVPAITNNDDQENDN

SEQ ID NO: 154523 - protein, 34 aa, Artificial Sequence
  Description of Artificial Sequence: Synthetic polypeptide
DDEEIRTTNPVATEQYGSVAESPTTEVPTAPPDV

SEQ ID NO: 154524 - protein, 37 aa, Artificial Sequence
  Description of Artificial Sequence: Synthetic polypeptide
DEEEIRTTNPVATESYGSVSSTTPAWGPNMRNGMNPV

SEQ ID NO: 154525 - protein, 30 aa, Artificial Sequence
  Description of Artificial Sequence: Synthetic polypeptide
DENEIRCTNPVATEQWGDASENEMNAAEDA

SEQ ID NO: 154526 - protein, 33 aa, Artificial Sequence
  Description of Artificial Sequence: Synthetic polypeptide
DEAEIRTTNPCAYEQWGSVCYNIEERDQRGTDS

SEQ ID NO: 154527 - protein, 30 aa, Artificial Sequence
  Description of Artificial Sequence: Synthetic polypeptide
DENEIRCTNPVATEQWGDVSEIEMNAAEDA

SEQ ID NO: 154528 - protein, 31 aa, Artificial Sequence
  Description of Artificial Sequence: Synthetic polypeptide
DENEIRCTNPVATEQWGDVSEIEMNAAEDAL

SEQ ID NO: 154529 - protein, 30 aa, Artificial Sequence
  Description of Artificial Sequence: Synthetic polypeptide
DENEIRTTNPVASEQWGMVSEIEMNAAEDA

SEQ ID NO: 154530 - protein, 33 aa, Artificial Sequence
  Description of Artificial Sequence: Synthetic polypeptide
CEEVIACTNPVATEQWGCVAGTNLATMNQNENR

SEQ ID NO: 154531 - protein, 31 aa, Artificial Sequence
  Description of Artificial Sequence: Synthetic polypeptide
DEFEIATTNPVAYEQWGEISKTLEDRQSGEH

SEQ ID NO: 154532 - protein, 30 aa, Artificial Sequence
  Description of Artificial Sequence: Synthetic polypeptide
DENEIRTTNPVATAQWGDVSEIEMNAAEDA

SEQ ID NO: 154533 - protein, 35 aa, Artificial Sequence
  Description of Artificial Sequence: Synthetic polypeptide
DEGEIATTNPVATEQYGCVAATHHLDQIDENANRN

SEQ ID NO: 154534 - protein, 33 aa, Artificial Sequence
  Description of Artificial Sequence: Synthetic polypeptide
DEGEIATTNPVATEQYGCVAATGLTATMNNDTH

SEQ ID NO: 154535 - protein, 33 aa, Artificial Sequence
  Description of Artificial Sequence: Synthetic polypeptide
DEGEIATTNPVATEQYGCVAATGDTATMNNDRN

SEQ ID NO: 154536 - protein, 33 aa, Artificial Sequence
  Description of Artificial Sequence: Synthetic polypeptide
DENEIRTTNPVATDQYGSTNTQTEHPRQAQNDA

SEQ ID NO: 154537 - protein, 37 aa, Artificial Sequence
  Description of Artificial Sequence: Synthetic polypeptide
DDEEIRTTNPVATEQYGSVDVTNLQSGEEAEGGDGED

SEQ ID NO: 154538 - protein, 34 aa, Artificial Sequence
  Description of Artificial Sequence: Synthetic polypeptide
DEGEIATTNPVATEQYGCVAATAGLTATMNGNED

SEQ ID NO: 154539 - protein, 35 aa, Artificial Sequence
  Description of Artificial Sequence: Synthetic polypeptide
DEGEIATTNPVATEQYGCVAATAGLTATMNGNDRE

SEQ ID NO: 154540 - protein, 34 aa, Artificial Sequence
  Description of Artificial Sequence: Synthetic polypeptide
DEGEIATTNPVATEQYGCVAATAGLTATATNDRS

SEQ ID NO: 154541 - protein, 33 aa, Artificial Sequence
  Description of Artificial Sequence: Synthetic polypeptide
DEGEIATTNPVATEQYGCVAATNDATPNPMENF

SEQ ID NO: 154542 - protein, 35 aa, Artificial Sequence
  Description of Artificial Sequence: Synthetic polypeptide
DDEEIRTTNPVATEQYGSVDTQTMDGGGDNGGETT

SEQ ID NO: 154543 - protein, 33 aa, Artificial Sequence
  Description of Artificial Sequence: Synthetic polypeptide
DEGEIATTNPVATEQYGCVAANTNLADNPPSPM

SEQ ID NO: 154544 - protein, 30 aa, Artificial Sequence
  Description of Artificial Sequence: Synthetic polypeptide
DENEIRTTNPVATDQWGDVSEIEMNAAEDA

SEQ ID NO: 154545 - protein, 36 aa, Artificial Sequence
  Description of Artificial Sequence: Synthetic polypeptide
DDEEIRTTNPVATEQYGSVDSGVQEGQQGGGNGNGD

SEQ ID NO: 154546 - protein, 36 aa, Artificial Sequence
  Description of Artificial Sequence: Synthetic polypeptide
DDEEIRTTNPVATEQYGSVDSGVQEGEQNGGNGNGN

SEQ ID NO: 154547 - protein, 35 aa, Artificial Sequence
  Description of Artificial Sequence: Synthetic polypeptide
DEGEIATTNPVATEQYGCVAANPGLADAPGGDNRE

SEQ ID NO: 154548 - protein, 35 aa, Artificial Sequence
  Description of Artificial Sequence: Synthetic polypeptide
DENEIRTTNPVATDAYGSVDQTNNGLGQRFDEIAQ

SEQ ID NO: 154549 - protein, 30 aa, Artificial Sequence
  Description of Artificial Sequence: Synthetic polypeptide
DENEIRTTNPVATCQWGDVSHIEMNAAEDA

SEQ ID NO: 154550 - protein, 35 aa, Artificial Sequence
  Description of Artificial Sequence: Synthetic polypeptide
DEFEIATTNPVATEQYGCVYVWEINGIQKTGDNRP

SEQ ID NO: 154551 - protein, 30 aa, Artificial Sequence
  Description of Artificial Sequence: Synthetic polypeptide
DENEIRTTNPVATDQWGDVSEIEMNPAEDA

SEQ ID NO: 154552 - protein, 30 aa, Artificial Sequence
  Description of Artificial Sequence: Synthetic polypeptide
DENEIRTTNPVATECWGAVSADWMNPKEDA

SEQ ID NO: 154553 - protein, 34 aa, Artificial Sequence
  Description of Artificial Sequence: Synthetic polypeptide
DEGEIATTNPVATEQWGCVADTWELAQDNAGNHQ

SEQ ID NO: 154554 - protein, 32 aa, Artificial Sequence
  Description of Artificial Sequence: Synthetic polypeptide
DEAEIATTNPVATEQYGCTAATENLTADIAGD

SEQ ID NO: 154555 - protein, 30 aa, Artificial Sequence
  Description of Artificial Sequence: Synthetic polypeptide
DENEIRSTNPVATEQWGDVSEIIMNAAEDA

SEQ ID NO: 154556 - protein, 30 aa, Artificial Sequence
  Description of Artificial Sequence: Synthetic polypeptide
DENEIRSTNPVATEQWGDVSEIEMNAAEDA

SEQ ID NO: 154557 - protein, 30 aa, Artificial Sequence
  Description of Artificial Sequence: Synthetic polypeptide
DENEIRSTNPVATEQWGDVANTEQNAAEDA

SEQ ID NO: 154558 - protein, 30 aa, Artificial Sequence
  Description of Artificial Sequence: Synthetic polypeptide
DEGEIAPTNPCASEQYGIVACENWQEPGPI

SEQ ID NO: 154559 - protein, 30 aa, Artificial Sequence
  Description of Artificial Sequence: Synthetic polypeptide
DENEIRSTNPVATEQWGDVANTEMNAAEDA

SEQ ID NO: 154560 - protein, 34 aa, Artificial Sequence
  Description of Artificial Sequence: Synthetic polypeptide
DEAEIATTNPVATEQYGSTCAMIEHLEATRDGDR

SEQ ID NO: 154561 - protein, 30 aa, Artificial Sequence
  Description of Artificial Sequence: Synthetic polypeptide
DEGEIAPTNPCATECYGAVWACDLQPGPYI

SEQ ID NO: 154562 - protein, 31 aa, Artificial Sequence
  Description of Artificial Sequence: Synthetic polypeptide
DENEIRSTNPVATEGYGDVAAEIIQSAAGDA

SEQ ID NO: 154563 - protein, 30 aa, Artificial Sequence
  Description of Artificial Sequence: Synthetic polypeptide
DENEIRSTNPVATEGWGDVSEIEQNAAEDA

SEQ ID NO: 154564 - protein, 30 aa, Artificial Sequence
  Description of Artificial Sequence: Synthetic polypeptide
DENEIRSTNPVATEGWGDVANTIMNAAGDA

SEQ ID NO: 154565 - protein, 29 aa, Artificial Sequence
  Description of Artificial Sequence: Synthetic peptide
DENEIRSTNPVATEGWGDVAEIEQAAEDA

SEQ ID NO: 154566 - protein, 32 aa, Artificial Sequence
  Description of Artificial Sequence: Synthetic polypeptide
DEGEIATTNPIATECWGSCSKNEDDQGGGNTS

SEQ ID NO: 154567 - protein, 31 aa, Artificial Sequence
  Description of Artificial Sequence: Synthetic polypeptide
DENEIRSTNPVATEGWGDVAANTIQSAAGDA

SEQ ID NO: 154568 - protein, 32 aa, Artificial Sequence
  Description of Artificial Sequence: Synthetic polypeptide
DEGEIATTNPIATECWGSCSKNEDDQGGGNTI

SEQ ID NO: 154569 - protein, 37 aa, Artificial Sequence
  Description of Artificial Sequence: Synthetic polypeptide
DEEEIRTTNPVATEQYGYVSSTTPAGPNMRNGMNPVP

SEQ ID NO: 154570 - protein, 35 aa, Artificial Sequence
  Description of Artificial Sequence: Synthetic polypeptide
DEAEIATTNPVATEQYGSTVSCTLVSEDFEGGENL

SEQ ID NO: 154571 - protein, 37 aa, Artificial Sequence
  Description of Artificial Sequence: Synthetic polypeptide
DEEEIRTTNPVATEQYGYVNMSNMNLEMEFEGQEGGQ

SEQ ID NO: 154572 - protein, 30 aa, Artificial Sequence
  Description of Artificial Sequence: Synthetic polypeptide
DENEIRSTNPVATEQWGDVSEIIMNAAEQA

SEQ ID NO: 154573 - protein, 30 aa, Artificial Sequence
  Description of Artificial Sequence: Synthetic polypeptide
DENEIRSTNPVATEQWGVVSDIEMNAAEDA

SEQ ID NO: 154574 - protein, 36 aa, Artificial Sequence
  Description of Artificial Sequence: Synthetic polypeptide
DEEEIRTTNPVATEQYGSVVVTGFGQENDQDEDTGV

SEQ ID NO: 154575 - protein, 35 aa, Artificial Sequence
  Description of Artificial Sequence: Synthetic polypeptide
DENEIRSTNPVATEQYGSVITDNNGNDEGEGGNGL

SEQ ID NO: 154576 - protein, 29 aa, Artificial Sequence
  Description of Artificial Sequence: Synthetic peptide
DENEIRSTNPVSTEPYGTMASDIQHNGDI

SEQ ID NO: 154577 - protein, 35 aa, Artificial Sequence
  Description of Artificial Sequence: Synthetic polypeptide
DEAEIATTNPVATEQYGCVSTTDLNEDHFGSENLA

SEQ ID NO: 154578 - protein, 31 aa, Artificial Sequence
  Description of Artificial Sequence: Synthetic polypeptide
DENEIRSTNPVSTEPYGTISMEDIQQQNGNI

SEQ ID NO: 154579 - protein, 35 aa, Artificial Sequence
  Description of Artificial Sequence: Synthetic polypeptide
DENEIRGTNPVATEQYGSVMSDTINGGQEDDDIIG

SEQ ID NO: 154580 - protein, 35 aa, Artificial Sequence
  Description of Artificial Sequence: Synthetic polypeptide
DENEIRGTNPVATEQYGSVMSNPDNIFQGEMNEGG

SEQ ID NO: 154581 - protein, 36 aa, Artificial Sequence
  Description of Artificial Sequence: Synthetic polypeptide
DEAEIATTNPVATEQYGISTVSCTLLSEDFEGGENF

SEQ ID NO: 154582 - protein, 35 aa, Artificial Sequence
  Description of Artificial Sequence: Synthetic polypeptide
DDEEIRTTNPVATEQYGCVCSNTGEHNQNFGSDQS

SEQ ID NO: 154583 - protein, 35 aa, Artificial Sequence
  Description of Artificial Sequence: Synthetic polypeptide
DENEIRGTNPVATEQYGSVMSNPQNIFQEEMGEGE

SEQ ID NO: 154584 - protein, 30 aa, Artificial Sequence
  Description of Artificial Sequence: Synthetic polypeptide
DENEIRQTNPVATEQWGDVSEIEMNATEDA

SEQ ID NO: 154585 - protein, 35 aa, Artificial Sequence
  Description of Artificial Sequence: Synthetic polypeptide
DENEIRGTNPVATEQYGSVMSNPTNIFQEEDEEGG

SEQ ID NO: 154586 - protein, 35 aa, Artificial Sequence
  Description of Artificial Sequence: Synthetic polypeptide
DEAEIATTNPVATEQYGSACSANPLAEAEMGNGQF

SEQ ID NO: 154587 - protein, 32 aa, Artificial Sequence
  Description of Artificial Sequence: Synthetic polypeptide
DEGEIATTNPVATAQWGCVATAALTADGGNDM

SEQ ID NO: 154588 - protein, 33 aa, Artificial Sequence
  Description of Artificial Sequence: Synthetic polypeptide
DEGEIATTNPVATAQWGCVAISNALTQDGNGDM

SEQ ID NO: 154589 - protein, 32 aa, Artificial Sequence
  Description of Artificial Sequence: Synthetic polypeptide
DENEIRSTNPVSTEGYGTISMETIQQQQNGNH

SEQ ID NO: 154590 - protein, 35 aa, Artificial Sequence
  Description of Artificial Sequence: Synthetic polypeptide
DEGEIACTNPVATEQYGSVCATNLDTGTWEVNTED

SEQ ID NO: 154591 - protein, 29 aa, Artificial Sequence
  Description of Artificial Sequence: Synthetic peptide
DENEIRSTNPVGTEGWGDVAETLQAAEDA

SEQ ID NO: 154592 - protein, 38 aa, Artificial Sequence
  Description of Artificial Sequence: Synthetic polypeptide
DEEEIRTTNPVATEQYGSVVVSVSTNQQAGTEQGSTTE

SEQ ID NO: 154593 - protein, 37 aa, Artificial Sequence
  Description of Artificial Sequence: Synthetic polypeptide
DEEEIRTTNPVATEQYGSVVVTGFGQENDQDEDGATV

SEQ ID NO: 154594 - protein, 31 aa, Artificial Sequence
  Description of Artificial Sequence: Synthetic polypeptide
DENEIRSTNPVSTEPYGNIAANTIQSQVGQR

SEQ ID NO: 154595 - protein, 32 aa, Artificial Sequence
  Description of Artificial Sequence: Synthetic polypeptide
DENEIRSTNPVSTEPYGVVSMEDIQQQQNGNH

SEQ ID NO: 154596 - protein, 30 aa, Artificial Sequence
  Description of Artificial Sequence: Synthetic polypeptide
DENEIRQTNPVATEQWGDVSEIEMNAAEDA

SEQ ID NO: 154597 - protein, 32 aa, Artificial Sequence
  Description of Artificial Sequence: Synthetic polypeptide
DEGEIATTNPIATEAWGSCSKNEDDQGGGGNM

SEQ ID NO: 154598 - protein, 33 aa, Artificial Sequence
  Description of Artificial Sequence: Synthetic polypeptide
DEGEIATTNPCSSEQYGTVCSATDGLVQSEGTR

SEQ ID NO: 154599 - protein, 33 aa, Artificial Sequence
  Description of Artificial Sequence: Synthetic polypeptide
DEGEIATTNPCSSEQYGTVCSATDGLVQFEGTR

SEQ ID NO: 154600 - protein, 30 aa, Artificial Sequence
  Description of Artificial Sequence: Synthetic polypeptide
DENEIRPTNPVATEQWGLVSEIEMNAAEDA

SEQ ID NO: 154601 - protein, 33 aa, Artificial Sequence
  Description of Artificial Sequence: Synthetic polypeptide
DEGEIATTNPCSSEQYGTVCSATDGLVEFEGNR

SEQ ID NO: 154602 - protein, 35 aa, Artificial Sequence
  Description of Artificial Sequence: Synthetic polypeptide
DDEEIRTTNPVATEQYGAVVSVTDEGQDEGQGGEG

SEQ ID NO: 154603 - protein, 30 aa, Artificial Sequence
  Description of Artificial Sequence: Synthetic polypeptide
DENEIRPTNPVATEQWGDVSEIEMNNAEDA

SEQ ID NO: 154604 - protein, 31 aa, Artificial Sequence
  Description of Artificial Sequence: Synthetic polypeptide
DENEIRPTNPVATEQWGDVSEIEMNAAEDAL

SEQ ID NO: 154605 - protein, 30 aa, Artificial Sequence
  Description of Artificial Sequence: Synthetic polypeptide
DENEIRPTNPVATEQWGDVSEIEMNAAEDA

SEQ ID NO: 154606 - protein, 38 aa, Artificial Sequence
  Description of Artificial Sequence: Synthetic polypeptide
DEEEIRTTNPVATEQYGSVVVVVTTNNNDEQIGTNQEE

SEQ ID NO: 154607 - protein, 32 aa, Artificial Sequence
  Description of Artificial Sequence: Synthetic polypeptide
CEEVIACTNPVATEQYGCVAGTGLPDNTEGNH

SEQ ID NO: 154608 - protein, 30 aa, Artificial Sequence
  Description of Artificial Sequence: Synthetic polypeptide
DENEIRMTNPVATEQWGDVSEIEMNAAEDA

SEQ ID NO: 154609 - protein, 31 aa, Artificial Sequence
  Description of Artificial Sequence: Synthetic polypeptide
DENEIRMTNPVATEQWGAVSEIEPNAAEDWA

SEQ ID NO: 154610 - protein, 35 aa, Artificial Sequence
  Description of Artificial Sequence: Synthetic polypeptide
DDEEIRTTNPVATEQYGCSCSTGEPHNQYFNSDQS

SEQ ID NO: 154611 - protein, 37 aa, Artificial Sequence
  Description of Artificial Sequence: Synthetic polypeptide
DEEEIRTTNPVATEQYGYSYSSTTPAGPNMRNGMNPV

SEQ ID NO: 154612 - protein, 38 aa, Artificial Sequence
  Description of Artificial Sequence: Synthetic polypeptide
DEEEIRTTNPVATEQYGYSVSSTTPAGPNMRNGMNPVW

SEQ ID NO: 154613 - protein, 38 aa, Artificial Sequence
  Description of Artificial Sequence: Synthetic polypeptide
DEEEIRTTNPVATEQYGYSVSSTTPAGPNMRNGMNPVT

SEQ ID NO: 154614 - protein, 38 aa, Artificial Sequence
  Description of Artificial Sequence: Synthetic polypeptide
DEEEIRTTNPVATEQYGYSVSSTTPAGPNMRNGMNPVD

SEQ ID NO: 154615 - protein, 30 aa, Artificial Sequence
  Description of Artificial Sequence: Synthetic polypeptide
DENEIRPTNPVSSEPYGTISMDIQQQQGTR

SEQ ID NO: 154616 - protein, 31 aa, Artificial Sequence
  Description of Artificial Sequence: Synthetic polypeptide
DENEIRPTNPVSTEPYGTISMEVFQQQQGNH

SEQ ID NO: 154617 - protein, 32 aa, Artificial Sequence
  Description of Artificial Sequence: Synthetic polypeptide
DENEIRPTNPVSTEPYGTISVEDIQQQQNGNH

SEQ ID NO: 154618 - protein, 30 aa, Artificial Sequence
  Description of Artificial Sequence: Synthetic polypeptide
DENEIRPTNPVSTEQYGDVSCIEMNAAETA

SEQ ID NO: 154619 - protein, 29 aa, Artificial Sequence
  Description of Artificial Sequence: Synthetic peptide
DEGEIAPTNPCSSEQYGIVACNWQEPGPI

SEQ ID NO: 154620 - protein, 30 aa, Artificial Sequence
  Description of Artificial Sequence: Synthetic polypeptide
DENEIRQTNPVATEQWGDVSEIEMIAAEDA

SEQ ID NO: 154621 - protein, 37 aa, Artificial Sequence
  Description of Artificial Sequence: Synthetic polypeptide
DEEEIRTTNPVATEQYGSVVYDGLFGQEGDQEEDNGI

SEQ ID NO: 154622 - protein, 34 aa, Artificial Sequence
  Description of Artificial Sequence: Synthetic polypeptide
DDEEIRTTNPVATEQYGCVCSNTEHQENFMSDQY

SEQ ID NO: 154623 - protein, 35 aa, Artificial Sequence
  Description of Artificial Sequence: Synthetic polypeptide
DDEEIRTTNPVATEQYGCVCSNTEHNQEFFGSDQE

SEQ ID NO: 154624 - protein, 36 aa, Artificial Sequence
  Description of Artificial Sequence: Synthetic polypeptide
DDEEIRTTNPVATEQYGCVCSNTEEHNQENFGSNQN

SEQ ID NO: 154625 - protein, 34 aa, Artificial Sequence
  Description of Artificial Sequence: Synthetic polypeptide
DEAEIATTNPVATEQYGSVAATPHEQANPGVDQV

SEQ ID NO: 154626 - protein, 36 aa, Artificial Sequence
  Description of Artificial Sequence: Synthetic polypeptide
DEEEIRTTNPVATEQYGSVVYDGFGQEGDQEENNGQ

SEQ ID NO: 154627 - protein, 30 aa, Artificial Sequence
  Description of Artificial Sequence: Synthetic polypeptide
DEGEIAPTNPCSSEPYGTVSCENLQQQGTH

SEQ ID NO: 154628 - protein, 30 aa, Artificial Sequence
  Description of Artificial Sequence: Synthetic polypeptide
DEGEIAPTNPIASECYGAVSCDLASKGPYR

SEQ ID NO: 154629 - protein, 36 aa, Artificial Sequence
  Description of Artificial Sequence: Synthetic polypeptide
DEEEIRTTNPVATEQYGSVVYDGFGQEGDQEEEING

SEQ ID NO: 154630 - protein, 36 aa, Artificial Sequence
  Description of Artificial Sequence: Synthetic polypeptide
DEEEIRTTNPVATEQYGSVVYDGFGQEGDQEEDGNG

SEQ ID NO: 154631 - protein, 35 aa, Artificial Sequence
  Description of Artificial Sequence: Synthetic polypeptide
DDEEIRTTNPVATEQYGCVCSNSGEHQHFGSDNQS

SEQ ID NO: 154632 - protein, 32 aa, Artificial Sequence
  Description of Artificial Sequence: Synthetic polypeptide
DENEIRPTNPVSTEQYGTISCEDLQQQQNGTH

SEQ ID NO: 154633 - protein, 37 aa, Artificial Sequence
  Description of Artificial Sequence: Synthetic polypeptide
DDEEIRTTNPVATEQYGAVVSTGGQIINGQGGDNQGN

SEQ ID NO: 154634 - protein, 36 aa, Artificial Sequence
  Description of Artificial Sequence: Synthetic polypeptide
DDEEIRTTNPVATEQYGAVVSTGGQIITGQGGDNIQ

SEQ ID NO: 154635 - protein, 31 aa, Artificial Sequence
  Description of Artificial Sequence: Synthetic polypeptide
DEGEIAPTNPVSSEQYGNVAANTIQSSVGTR

SEQ ID NO: 154636 - protein, 36 aa, Artificial Sequence
  Description of Artificial Sequence: Synthetic polypeptide
DDEEIRTTNPVATEQYGAVVSTGNVDETGEGGNQGE

SEQ ID NO: 154637 - protein, 35 aa, Artificial Sequence
  Description of Artificial Sequence: Synthetic polypeptide
DEEEIRTTNPVATEQYGSVVYDGFGQEGDQEEMEG

SEQ ID NO: 154638 - protein, 32 aa, Artificial Sequence
  Description of Artificial Sequence: Synthetic polypeptide
DENEIRCTNPVSTEPYGSISEEDIQMQQNGNH

SEQ ID NO: 154639 - protein, 30 aa, Artificial Sequence
  Description of Artificial Sequence: Synthetic polypeptide
DENEIRSTNPVSTEQWGNVSNIEMSAAEDR

SEQ ID NO: 154640 - protein, 30 aa, Artificial Sequence
  Description of Artificial Sequence: Synthetic polypeptide
DENEIRSVNPVSTEPYGVISDDIQQQQGNH

SEQ ID NO: 154641 - protein, 32 aa, Artificial Sequence
  Description of Artificial Sequence: Synthetic polypeptide
DENEIRCTNPVSTEPYGTISMSDPQQQQNGNH

SEQ ID NO: 154642 - protein, 34 aa, Artificial Sequence
  Description of Artificial Sequence: Synthetic polypeptide
DEAEIATTNPVATEQYGCVAATANEQANPGVDQM

SEQ ID NO: 154643 - protein, 35 aa, Artificial Sequence
  Description of Artificial Sequence: Synthetic polypeptide
DEEEIRTTNPVATEQYGSVVVDGFGQENDQEEDEM

SEQ ID NO: 154644 - protein, 30 aa, Artificial Sequence
  Description of Artificial Sequence: Synthetic polypeptide
DENEIRFTNPVATEQWGDVSIIEMNAAEYA

SEQ ID NO: 154645 - protein, 37 aa, Artificial Sequence
  Description of Artificial Sequence: Synthetic polypeptide
DEEEIRTTNPVATERYGSSVSQTTPAGPNMRNGMNPV

SEQ ID NO: 154646 - protein, 37 aa, Artificial Sequence
  Description of Artificial Sequence: Synthetic polypeptide
DEEEIRTTNPVATERYGESVSSTTPAGPNMRNGMNPV

SEQ ID NO: 154647 - protein, 37 aa, Artificial Sequence
  Description of Artificial Sequence: Synthetic polypeptide
DEEEIRTTNPVATERWGSVVSTGNEDATPRTGGQNHG

SEQ ID NO: 154648 - protein, 34 aa, Artificial Sequence
  Description of Artificial Sequence: Synthetic polypeptide
DEAEIATTNPVATEQYGCVAATNQEQANPGVDTM

SEQ ID NO: 154649 - protein, 35 aa, Artificial Sequence
  Description of Artificial Sequence: Synthetic polypeptide
DEAEIATTNPVATEQYGCVAATQGLPPAGEPNHRH

SEQ ID NO: 154650 - protein, 34 aa, Artificial Sequence
  Description of Artificial Sequence: Synthetic polypeptide
DEGAIRTTNPVATEQYGSCCSPTNSDIELYEDSE

SEQ ID NO: 154651 - protein, 35 aa, Artificial Sequence
  Description of Artificial Sequence: Synthetic polypeptide
DDEEIRTTNPVATEQYGCVCSTEEHNQENGGSEQS

SEQ ID NO: 154652 - protein, 32 aa, Artificial Sequence
  Description of Artificial Sequence: Synthetic polypeptide
DEAEIATTNPVATEQYGCVAATTDTNIMSEHQ

SEQ ID NO: 154653 - protein, 33 aa, Artificial Sequence
  Description of Artificial Sequence: Synthetic polypeptide
DEAEIATTNPVATEQYGCVCSNTDPEDHEGEDQ

SEQ ID NO: 154654 - protein, 34 aa, Artificial Sequence
  Description of Artificial Sequence: Synthetic polypeptide
DDEEIRTTNPVATEQYGCVCSNWGEHQNFGSEQA

SEQ ID NO: 154655 - protein, 36 aa, Artificial Sequence
  Description of Artificial Sequence: Synthetic polypeptide
DEAEIATTNPVATEQYGSVAITENDQDDQRRGGDDS

SEQ ID NO: 154656 - protein, 36 aa, Artificial Sequence
  Description of Artificial Sequence: Synthetic polypeptide
DEAEIATTNPVATEQYGSVAITENDQDDQRQGGGHA

SEQ ID NO: 154657 - protein, 34 aa, Artificial Sequence
  Description of Artificial Sequence: Synthetic polypeptide
DDEEIRTTNPVATEQYGAISGDVTDEGQGGQEGT

SEQ ID NO: 154658 - protein, 33 aa, Artificial Sequence
  Description of Artificial Sequence: Synthetic polypeptide
DEAEIATTNPVATEQYGCVAATAGLTAMMNNDE

SEQ ID NO: 154659 - protein, 33 aa, Artificial Sequence
  Description of Artificial Sequence: Synthetic polypeptide
DEAEIATTNPVATEQYGCVAANNNVTTDDGNEQ

SEQ ID NO: 154660 - protein, 31 aa, Artificial Sequence
  Description of Artificial Sequence: Synthetic polypeptide
DENEIRTTNPIATECYGAVANAECWQHKGEL

SEQ ID NO: 154661 - protein, 31 aa, Artificial Sequence
  Description of Artificial Sequence: Synthetic polypeptide
DENEIRCTNPVSTEPYGTISMEDIQQQQGNH

SEQ ID NO: 154662 - protein, 32 aa, Artificial Sequence
  Description of Artificial Sequence: Synthetic polypeptide
DENEIRCTNPVSTEPYGSISMEDIQQQQNGNH

SEQ ID NO: 154663 - protein, 34 aa, Artificial Sequence
  Description of Artificial Sequence: Synthetic polypeptide
DDEEIRTTNPVATEQYGCVCSWEHNQENFNSEQG

SEQ ID NO: 154664 - protein, 31 aa, Artificial Sequence
  Description of Artificial Sequence: Synthetic polypeptide
DENEIRCTNPVSTEPYGTASEEDIQQQQGNH

SEQ ID NO: 154665 - protein, 31 aa, Artificial Sequence
  Description of Artificial Sequence: Synthetic polypeptide
DENEIRCTNPVSTEPYGTASMEDIQQQQGNH

SEQ ID NO: 154666 - protein, 31 aa, Artificial Sequence
  Description of Artificial Sequence: Synthetic polypeptide
DENEIRCTNPVSTEPYGTISEEDIQQQQGNH

SEQ ID NO: 154667 - protein, 31 aa, Artificial Sequence
  Description of Artificial Sequence: Synthetic polypeptide
DEGEIATTNPVATEQWGCVAATGDTATNNDF

SEQ ID NO: 154668 - protein, 33 aa, Artificial Sequence
  Description of Artificial Sequence: Synthetic polypeptide
DEAEIATTNPVATEQYGCVAANGDATMPPGERH

SEQ ID NO: 154669 - protein, 34 aa, Artificial Sequence
  Description of Artificial Sequence: Synthetic polypeptide
DEFVIRTTNPVATEQYGCVETDWPQTTFGDNQFV

SEQ ID NO: 154670 - protein, 34 aa, Artificial Sequence
  Description of Artificial Sequence: Synthetic polypeptide
DEGEIATTNPVATEMWGSVAATANLENNASNSRS

SEQ ID NO: 154671 - protein, 33 aa, Artificial Sequence
  Description of Artificial Sequence: Synthetic polypeptide
DEAEIATTNPVATEQYGCVAANNDATMNPGENH

SEQ ID NO: 154672 - protein, 32 aa, Artificial Sequence
  Description of Artificial Sequence: Synthetic polypeptide
DENEIRTTNPIATEPYGATISAEDWQQQNGNI

SEQ ID NO: 154673 - protein, 35 aa, Artificial Sequence
  Description of Artificial Sequence: Synthetic polypeptide
DDEEIRTTNPVATEQYGCVCSTGEHNQENFISNQS

SEQ ID NO: 154674 - protein, 36 aa, Artificial Sequence
  Description of Artificial Sequence: Synthetic polypeptide
DDEEIRTTNPVATEQYGCVCSTGEHNQENFGSDNQE

SEQ ID NO: 154675 - protein, 33 aa, Artificial Sequence
  Description of Artificial Sequence: Synthetic polypeptide
DEFVVRTTNPVATEQYGCVETDWDGQTFGNQFG

SEQ ID NO: 154676 - protein, 31 aa, Artificial Sequence
  Description of Artificial Sequence: Synthetic polypeptide
DENEIRCTNPVSTEPYGTISEEDIQQRNGGH

SEQ ID NO: 154677 - protein, 31 aa, Artificial Sequence
  Description of Artificial Sequence: Synthetic polypeptide
DENEIRTTNPIATECYGAVANAEDWQPKGEI

SEQ ID NO: 154678 - protein, 31 aa, Artificial Sequence
  Description of Artificial Sequence: Synthetic polypeptide
DENEIRTTNPIATECYGAVANAECWQPKGEL

SEQ ID NO: 154679 - protein, 31 aa, Artificial Sequence
  Description of Artificial Sequence: Synthetic polypeptide
DENEIRTTNPIATECYGAVANAECWQPKGEI

SEQ ID NO: 154680 - protein, 34 aa, Artificial Sequence
  Description of Artificial Sequence: Synthetic polypeptide
DDEEIRTTNPVATEQYGCVCSTGEHNQNFISDQS

SEQ ID NO: 154681 - protein, 30 aa, Artificial Sequence
  Description of Artificial Sequence: Synthetic polypeptide
DENEIRSTNPVSTEQYGNVANTIMSAAEDA

SEQ ID NO: 154682 - protein, 36 aa, Artificial Sequence
  Description of Artificial Sequence: Synthetic polypeptide
DDEEIRTTNPVATEQYGAVNSDDLNEQGEGQGGNNT

SEQ ID NO: 154683 - protein, 33 aa, Artificial Sequence
  Description of Artificial Sequence: Synthetic polypeptide
DEGAIRTTNPVAYEAYGSIPSTNEFIDGGNNDY

SEQ ID NO: 154684 - protein, 32 aa, Artificial Sequence
  Description of Artificial Sequence: Synthetic polypeptide
DENEIRTTNPCAYEQWGMVPTWENDQNKAGEQ

SEQ ID NO: 154685 - protein, 33 aa, Artificial Sequence
  Description of Artificial Sequence: Synthetic polypeptide
CEEVIACTNPVATEQWGSVASNNNQTAGGPNSN

SEQ ID NO: 154686 - protein, 36 aa, Artificial Sequence
  Description of Artificial Sequence: Synthetic polypeptide
DEEEIRTTNPVATEQYGSVVVDGFGQENDQEENDND

SEQ ID NO: 154687 - protein, 36 aa, Artificial Sequence
  Description of Artificial Sequence: Synthetic polypeptide
DEEEIRTTNPVATEQYGSVVVDGFGQGNDQDEDGTF

SEQ ID NO: 154688 - protein, 33 aa, Artificial Sequence
  Description of Artificial Sequence: Synthetic polypeptide
DEGEIATTNPVATAQWGGCCATALQVQMGNMRN

SEQ ID NO: 154689 - protein, 31 aa, Artificial Sequence
  Description of Artificial Sequence: Synthetic polypeptide
DEGEIACTNPVATEQWGCVAGTALIDNMGGM

SEQ ID NO: 154690 - protein, 30 aa, Artificial Sequence
  Description of Artificial Sequence: Synthetic polypeptide
DENEIRTTNPCATEQWGDVSEIEMNAAEWA

SEQ ID NO: 154691 - protein, 30 aa, Artificial Sequence
  Description of Artificial Sequence: Synthetic polypeptide
DENEIRTTNPCATEQWGDVSEIEMNAAEMA

SEQ ID NO: 154692 - protein, 31 aa, Artificial Sequence
  Description of Artificial Sequence: Synthetic polypeptide
DENEIRTTNPCATEQWGDVSEIEMNAAEDAQ

SEQ ID NO: 154693 - protein, 30 aa, Artificial Sequence
  Description of Artificial Sequence: Synthetic polypeptide
DENEIRTTNPCATEQWGDVSEIEMNAAEDA

SEQ ID NO: 154694 - protein, 31 aa, Artificial Sequence
  Description of Artificial Sequence: Synthetic polypeptide
DEGEIACTNPVATEQWGCVAGTGLAAMEGML

SEQ ID NO: 154695 - protein, 34 aa, Artificial Sequence
  Description of Artificial Sequence: Synthetic polypeptide
DEAEIATTNPVATEQYGCVCSTWDLNEEHFGEDL

SEQ ID NO: 154696 - protein, 32 aa, Artificial Sequence
  Description of Artificial Sequence: Synthetic polypeptide
DENEIRTCNPVSTEPYGTISMESIQQQQNGNH

SEQ ID NO: 154697 - protein, 34 aa, Artificial Sequence
  Description of Artificial Sequence: Synthetic polypeptide
DEAEIATTNPVATEQYGCVCTIEGNQDQGGKEQD

SEQ ID NO: 154698 - protein, 32 aa, Artificial Sequence
  Description of Artificial Sequence: Synthetic polypeptide
DENEIRSVNPVSTEPYGVVSDENIQQQSNGNH

SEQ ID NO: 154699 - protein, 34 aa, Artificial Sequence
  Description of Artificial Sequence: Synthetic polypeptide
DEAEIATTNPVATEQYGCVSNTDPNEDHFGSEDL

SEQ ID NO: 154700 - protein, 32 aa, Artificial Sequence
  Description of Artificial Sequence: Synthetic polypeptide
DEAEIATTNPVATEQYGCVSNWDPEDHFGEDL

SEQ ID NO: 154701 - protein, 35 aa, Artificial Sequence
  Description of Artificial Sequence: Synthetic polypeptide
DDEEIRTTNPVATEQYGCVCSNTMEHNQNFNSDQD

SEQ ID NO: 154702 - protein, 30 aa, Artificial Sequence
  Description of Artificial Sequence: Synthetic polypeptide
DENEIRGTNPVATEQWGDVSEIEMNAAEDA

SEQ ID NO: 154703 - protein, 32 aa, Artificial Sequence
  Description of Artificial Sequence: Synthetic polypeptide
DENEIRTTNPCSSEQYGTISMENIQQQQNGNH

SEQ ID NO: 154704 - protein, 31 aa, Artificial Sequence
  Description of Artificial Sequence: Synthetic polypeptide
DENEIRTTNPCSTEPYGIISCDIQQQQNGNH

SEQ ID NO: 154705 - protein, 36 aa, Artificial Sequence
  Description of Artificial Sequence: Synthetic polypeptide
DEGAIRTTNPVAYEAYGSVIPSTGNELVDIGGNNRI

SEQ ID NO: 154706 - protein, 34 aa, Artificial Sequence
  Description of Artificial Sequence: Synthetic polypeptide
DEGAIRTTNPVAYEAYGSVIPSTNEHVIIGGENK

SEQ ID NO: 154707 - protein, 35 aa, Artificial Sequence
  Description of Artificial Sequence: Synthetic polypeptide
DDEEIRTTNPVATEQYGCVCSNWEEHQGFGSENQA

SEQ ID NO: 154708 - protein, 31 aa, Artificial Sequence
  Description of Artificial Sequence: Synthetic polypeptide
DENEIRTTNPIATECWGATVSNACLAPGEYI

SEQ ID NO: 154709 - protein, 32 aa, Artificial Sequence
  Description of Artificial Sequence: Synthetic polypeptide
DEGAISTTNPVAYEQWGCSYSTNHPEDIDGNH

SEQ ID NO: 154710 - protein, 36 aa, Artificial Sequence
  Description of Artificial Sequence: Synthetic polypeptide
DEEEIRTTNPVATEQYGYAVAPTMEDVQEFQQNGNS

SEQ ID NO: 154711 - protein, 37 aa, Artificial Sequence
  Description of Artificial Sequence: Synthetic polypeptide
DEEEIRTTNPVATEQYGYAVEWPTMLDVQEAQQNGNS

SEQ ID NO: 154712 - protein, 33 aa, Artificial Sequence
  Description of Artificial Sequence: Synthetic polypeptide
DEGCIATTNPVAYECYGSVAATENEISQSGGNM

SEQ ID NO: 154713 - protein, 35 aa, Artificial Sequence
  Description of Artificial Sequence: Synthetic polypeptide
DEAEIATTNPVATEQYGSVAITDNQDDQQQGGDDH

SEQ ID NO: 154714 - protein, 29 aa, Artificial Sequence
  Description of Artificial Sequence: Synthetic peptide
DEGEIATTNPVATASWGCIATTAEQNDNF

SEQ ID NO: 154715 - protein, 33 aa, Artificial Sequence
  Description of Artificial Sequence: Synthetic polypeptide
DEGCIRTTNPVAYEAYGKVSTGDISQPTGNTFI

SEQ ID NO: 154716 - protein, 33 aa, Artificial Sequence
  Description of Artificial Sequence: Synthetic polypeptide
DEGEIATTNPVATAQWGSVAAGNLFDNNMGPRF

SEQ ID NO: 154717 - protein, 32 aa, Artificial Sequence
  Description of Artificial Sequence: Synthetic polypeptide
DEGCISTTNPVAYEQWGCFSWDNLGDFDTGNR

SEQ ID NO: 154718 - protein, 34 aa, Artificial Sequence
  Description of Artificial Sequence: Synthetic polypeptide
DEGDEIATTNPVAYECWGSVATNLQGNAGENDGS

SEQ ID NO: 154719 - protein, 36 aa, Artificial Sequence
  Description of Artificial Sequence: Synthetic polypeptide
DDEEIRTTNPVATEQYGCVCSNTNEHNQNFGSETQS

SEQ ID NO: 154720 - protein, 34 aa, Artificial Sequence
  Description of Artificial Sequence: Synthetic polypeptide
DEAEIATTNPVATEQYGCVCSTTELNEEHEGEDL

SEQ ID NO: 154721 - protein, 32 aa, Artificial Sequence
  Description of Artificial Sequence: Synthetic polypeptide
DENEIRTTNPCSTEQYGTISMEDIQQQQNGNH

SEQ ID NO: 154722 - protein, 31 aa, Artificial Sequence
  Description of Artificial Sequence: Synthetic polypeptide
DENEIRTTNPCSTEQYGTISCDIQQQQNGTH

SEQ ID NO: 154723 - protein, 33 aa, Artificial Sequence
  Description of Artificial Sequence: Synthetic polypeptide
DEGEIATTNPVATAQWGSVSMSGNGGQPPPQNN

SEQ ID NO: 154724 - protein, 30 aa, Artificial Sequence
  Description of Artificial Sequence: Synthetic polypeptide
DENEIRTTNPVATECWGAVSAIWMNAKEDA

SEQ ID NO: 154725 - protein, 35 aa, Artificial Sequence
  Description of Artificial Sequence: Synthetic polypeptide
DEGEIATTNPVATEQYGSACATNPLQDDPPEEGRN

SEQ ID NO: 154726 - protein, 30 aa, Artificial Sequence
  Description of Artificial Sequence: Synthetic polypeptide
DENEIRTTNPVATECWGAVSEIWMEAAEDA

SEQ ID NO: 154727 - protein, 31 aa, Artificial Sequence
  Description of Artificial Sequence: Synthetic polypeptide
DENEIATTNPVSTEPYGTISMEVCQQQNGNH

SEQ ID NO: 154728 - protein, 36 aa, Artificial Sequence
  Description of Artificial Sequence: Synthetic polypeptide
DDEEIRTTNPVATEQYGSVVSAGTDQNDGEGEGQEG

SEQ ID NO: 154729 - protein, 36 aa, Artificial Sequence
  Description of Artificial Sequence: Synthetic polypeptide
DEAEIATTNPVATEAYGSVCFTNDQNQDEGGQNGRN

SEQ ID NO: 154730 - protein, 32 aa, Artificial Sequence
  Description of Artificial Sequence: Synthetic polypeptide
DENEIATTNPVSTEPYGTISMEVCQQQQNGNH

SEQ ID NO: 154731 - protein, 32 aa, Artificial Sequence
  Description of Artificial Sequence: Synthetic polypeptide
DENEIATTNPVSTEPYGTISMEVIQQQQNGNK

SEQ ID NO: 154732 - protein, 31 aa, Artificial Sequence
  Description of Artificial Sequence: Synthetic polypeptide
DENEIATTNPVSTEPYGTISTDIQEQQNGEL

SEQ ID NO: 154733 - protein, 32 aa, Artificial Sequence
  Description of Artificial Sequence: Synthetic polypeptide
DENEIATTNPVSTEPYGTISTEDIQQQQNGNH

SEQ ID NO: 154734 - protein, 36 aa, Artificial Sequence
  Description of Artificial Sequence: Synthetic polypeptide
DEETIRTTNPVATEQYGVVSTTNQQQQQNNNNDEED

SEQ ID NO: 154735 - protein, 37 aa, Artificial Sequence
  Description of Artificial Sequence: Synthetic polypeptide
DEETIRTTNPVATEQYGVVSTTTNQQLLLQGQNDEED

SEQ ID NO: 154736 - protein, 37 aa, Artificial Sequence
  Description of Artificial Sequence: Synthetic polypeptide
DEETIRTTNPVATEQYGVVSTVNNLQQGQEQGTEESE

SEQ ID NO: 154737 - protein, 32 aa, Artificial Sequence
  Description of Artificial Sequence: Synthetic polypeptide
DENEIATTNPVSTEPYGTTSGEGNQQQQNGNH

SEQ ID NO: 154738 - protein, 33 aa, Artificial Sequence
  Description of Artificial Sequence: Synthetic polypeptide
DENEIATTNPVSTEPYGTVSATDIQEDQEGNDL

SEQ ID NO: 154739 - protein, 33 aa, Artificial Sequence
  Description of Artificial Sequence: Synthetic polypeptide
DENEIATTNPVSTEPYGTVSATDIQEDQNGNDL

SEQ ID NO: 154740 - protein, 37 aa, Artificial Sequence
  Description of Artificial Sequence: Synthetic polypeptide
DEETIRTTNPVATEQYGVVSTVTNNDQSGNNQQDEDE

SEQ ID NO: 154741 - protein, 32 aa, Artificial Sequence
  Description of Artificial Sequence: Synthetic polypeptide
DENEIATTNPVSTEPYGTVSMEDIQQDQNGNH

SEQ ID NO: 154742 - protein, 32 aa, Artificial Sequence
  Description of Artificial Sequence: Synthetic polypeptide
DENEIATTNPVSTEPYGTVSMEDIQQQHNGNH

SEQ ID NO: 154743 - protein, 32 aa, Artificial Sequence
  Description of Artificial Sequence: Synthetic polypeptide
DENEIATTNPVSTEPYGTVSMEDLQQQQNENH

SEQ ID NO: 154744 - protein, 33 aa, Artificial Sequence
  Description of Artificial Sequence: Synthetic polypeptide
DEAEIATTNPVATEAWGSVAWNDDGQQDIGDTR

SEQ ID NO: 154745 - protein, 32 aa, Artificial Sequence
  Description of Artificial Sequence: Synthetic polypeptide
DENEIATTNPVSTEPYGTISMETLQQQQNGNH

SEQ ID NO: 154746 - protein, 32 aa, Artificial Sequence
  Description of Artificial Sequence: Synthetic polypeptide
DENEIATTNPVSTEPYGTISMENIQQQQNGNH

SEQ ID NO: 154747 - protein, 32 aa, Artificial Sequence
  Description of Artificial Sequence: Synthetic polypeptide
DENEIATTNPVSTEPYGTISMEDLQQQSNGNH

SEQ ID NO: 154748 - protein, 31 aa, Artificial Sequence
  Description of Artificial Sequence: Synthetic polypeptide
DENEIATTNPVSTEPYGTISMDIQQQQNGNL

SEQ ID NO: 154749 - protein, 31 aa, Artificial Sequence
  Description of Artificial Sequence: Synthetic polypeptide
DENEIATTNPVSTEPYGTISMDIQQQQVGNH

SEQ ID NO: 154750 - protein, 31 aa, Artificial Sequence
  Description of Artificial Sequence: Synthetic polypeptide
DENEIATTNPVSTEPYGTISMECIQQQNGNH

SEQ ID NO: 154751 - protein, 37 aa, Artificial Sequence
  Description of Artificial Sequence: Synthetic polypeptide
DDEEIRTTNPVATEQYGSVVSTTSGNMDQEDQEGGQG

SEQ ID NO: 154752 - protein, 30 aa, Artificial Sequence
  Description of Artificial Sequence: Synthetic polypeptide
DENEIATTNPVSTEPYGTISMEDIQQQGDH

SEQ ID NO: 154753 - protein, 37 aa, Artificial Sequence
  Description of Artificial Sequence: Synthetic polypeptide
DDEEIRTTNPVATEQYGSVVSTTSGNMDQDEGGGGQG

SEQ ID NO: 154754 - protein, 36 aa, Artificial Sequence
  Description of Artificial Sequence: Synthetic polypeptide
DDEEIRTTNPVATEQYGSVVSTMDIDQNGGGGEEEQ

SEQ ID NO: 154755 - protein, 36 aa, Artificial Sequence
  Description of Artificial Sequence: Synthetic polypeptide
DDEEIRTTNPVATEQYGSVVSIVGEGENAGGNGNGD

SEQ ID NO: 154756 - protein, 32 aa, Artificial Sequence
  Description of Artificial Sequence: Synthetic polypeptide
DENEIATTNPVSTEPYGTVSTEDIQQDHNGEL

SEQ ID NO: 154757 - protein, 36 aa, Artificial Sequence
  Description of Artificial Sequence: Synthetic polypeptide
DDEEIRTTNPVATEQYGSVVSGVQEGDQGGNAGNGD

SEQ ID NO: 154758 - protein, 38 aa, Artificial Sequence
  Description of Artificial Sequence: Synthetic polypeptide
DEETIRTTNPVATEQYGTVVTVVSTNNQLQNIGTNQEQ

SEQ ID NO: 154759 - protein, 37 aa, Artificial Sequence
  Description of Artificial Sequence: Synthetic polypeptide
DEETIRTTNPVATEQYGTVVTVVSTNQQQQIGTNTEE

SEQ ID NO: 154760 - protein, 38 aa, Artificial Sequence
  Description of Artificial Sequence: Synthetic polypeptide
DEETIRTTNPVATEQYGTVVTVVSTTNQLQQIGTNAEE

SEQ ID NO: 154761 - protein, 37 aa, Artificial Sequence
  Description of Artificial Sequence: Synthetic polypeptide
DEETIRTTNPVATEQYGTVVTVVSTTQLQQIGTNNEE

SEQ ID NO: 154762 - protein, 37 aa, Artificial Sequence
  Description of Artificial Sequence: Synthetic polypeptide
DEEEIRTTNPVATEVYGSVNSDGMGENLGNDGGENGQ

SEQ ID NO: 154763 - protein, 35 aa, Artificial Sequence
  Description of Artificial Sequence: Synthetic polypeptide
DDEEIRTTNPVATEQYGSVVSGGQAGESGEQEGQG

SEQ ID NO: 154764 - protein, 34 aa, Artificial Sequence
  Description of Artificial Sequence: Synthetic polypeptide
DEAEIRTTNPVATEGWGCVCSWMNENQDNEGSNQ

SEQ ID NO: 154765 - protein, 32 aa, Artificial Sequence
  Description of Artificial Sequence: Synthetic polypeptide
DENEIATTNPVSTEPYGTISMEDIQQQRNGNH

SEQ ID NO: 154766 - protein, 34 aa, Artificial Sequence
  Description of Artificial Sequence: Synthetic polypeptide
DEAEIATTNPVATCQYGCVCSWGALQNFGSDNQS

SEQ ID NO: 154767 - protein, 31 aa, Artificial Sequence
  Description of Artificial Sequence: Synthetic polypeptide
DENEIATTNPVSTEPYGTISMDIQQQQNGNH

SEQ ID NO: 154768 - protein, 32 aa, Artificial Sequence
  Description of Artificial Sequence: Synthetic polypeptide
DENEIATTNPVSTEPYGTVSTEDIQQQHNGEH

SEQ ID NO: 154769 - protein, 34 aa, Artificial Sequence
  Description of Artificial Sequence: Synthetic polypeptide
DEGEIATTNPVATEQYGSVCAMHGQDSLGDNAQM

SEQ ID NO: 154770 - protein, 31 aa, Artificial Sequence
  Description of Artificial Sequence: Synthetic polypeptide
CEGEIAPTNPCSYEQYGKVSCNLSGTGGTNR

SEQ ID NO: 154771 - protein, 35 aa, Artificial Sequence
  Description of Artificial Sequence: Synthetic polypeptide
DDEEIRTTNPVATEQYGSVVQTDPEMVQEQGGFET

SEQ ID NO: 154772 - protein, 36 aa, Artificial Sequence
  Description of Artificial Sequence: Synthetic polypeptide
DDEEIRTTNPVATEQYGSVVQNLGSGENDEFGDIDD

SEQ ID NO: 154773 - protein, 37 aa, Artificial Sequence
  Description of Artificial Sequence: Synthetic polypeptide
DEETIRTTNPVATEQYGVVSVTVTQQLQAGENEEEED

SEQ ID NO: 154774 - protein, 32 aa, Artificial Sequence
  Description of Artificial Sequence: Synthetic polypeptide
CEGEIAPTNPCSYEQYGKTVSCNELSQSGTNR

SEQ ID NO: 154775 - protein, 37 aa, Artificial Sequence
  Description of Artificial Sequence: Synthetic polypeptide
DEETIRTTNPVATEQYGVVSVVVTQQLQAGSNNEEED

SEQ ID NO: 154776 - protein, 34 aa, Artificial Sequence
  Description of Artificial Sequence: Synthetic polypeptide
DEAEIATTNPVATEMWGSVYITDNHEQQHGDGDR

SEQ ID NO: 154777 - protein, 34 aa, Artificial Sequence
  Description of Artificial Sequence: Synthetic polypeptide
DENEIRTTNPVATEIYGQCVCSWELNQNFGSDQA

SEQ ID NO: 154778 - protein, 28 aa, Artificial Sequence
  Description of Artificial Sequence: Synthetic peptide
CEGEIACTNPVGTEGWGVSASMLQHGDQ

SEQ ID NO: 154779 - protein, 36 aa, Artificial Sequence
  Description of Artificial Sequence: Synthetic polypeptide
DEETIRTTNPVATEWYGSVSSTTPAGPNMRNGMNPV

SEQ ID NO: 154780 - protein, 36 aa, Artificial Sequence
  Description of Artificial Sequence: Synthetic polypeptide
DDEEIRTTNPVATEQYGSVVGNSNGLNQNIGQGGGD

SEQ ID NO: 154781 - protein, 36 aa, Artificial Sequence
  Description of Artificial Sequence: Synthetic polypeptide
DDEEIRTTNPVATEQYGSVVGGDTMNGDEGGETNQD

SEQ ID NO: 154782 - protein, 36 aa, Artificial Sequence
  Description of Artificial Sequence: Synthetic polypeptide
DEGEIATTNPVATEQYGSVCAATNNLEETEDGNENQ

SEQ ID NO: 154783 - protein, 31 aa, Artificial Sequence
  Description of Artificial Sequence: Synthetic polypeptide
CEEVIATTNPDATEGYGSCSTPLARYHEYDG

SEQ ID NO: 154784 - protein, 38 aa, Artificial Sequence
  Description of Artificial Sequence: Synthetic polypeptide
DEEEIRTTNPVATEQYGVVSVVVVTNNLEQGNNDEEED

SEQ ID NO: 154785 - protein, 34 aa, Artificial Sequence
  Description of Artificial Sequence: Synthetic polypeptide
DEGEIATTNPVATEQYGSVCAATNGEEAEAEMNN

SEQ ID NO: 154786 - protein, 35 aa, Artificial Sequence
  Description of Artificial Sequence: Synthetic polypeptide
DEGEIATTNPVATEQYGSVCAATNGDEETEDGNNQ

SEQ ID NO: 154787 - protein, 32 aa, Artificial Sequence
  Description of Artificial Sequence: Synthetic polypeptide
CEGEIAPTNPCSYEQYGKVSCNLSQSGGTNRA

SEQ ID NO: 154788 - protein, 29 aa, Artificial Sequence
  Description of Artificial Sequence: Synthetic peptide
DENEIATVNPVATEQWGDVSEIEMNAEDA

SEQ ID NO: 154789 - protein, 36 aa, Artificial Sequence
  Description of Artificial Sequence: Synthetic polypeptide
DEEEIRTTNPVATEQYGSVWSPSYGPLEELDFEVRG

SEQ ID NO: 154790 - protein, 33 aa, Artificial Sequence
  Description of Artificial Sequence: Synthetic polypeptide
DENEIATTNPVSTEQYGTVSATDIQEQHNGEDH

SEQ ID NO: 154791 - protein, 37 aa, Artificial Sequence
  Description of Artificial Sequence: Synthetic polypeptide
DEETIRTTNPVATEQYGVVSTVVNLQQNNQQGTEESE

SEQ ID NO: 154792 - protein, 38 aa, Artificial Sequence
  Description of Artificial Sequence: Synthetic polypeptide
DEETIRTTNPVATEQYGVVSTVVNNLQQLQGNNDEEEE

SEQ ID NO: 154793 - protein, 38 aa, Artificial Sequence
  Description of Artificial Sequence: Synthetic polypeptide
DEETIRTTNPVATEQYGVVSTVVNNLQQLQQGNDEEEE

SEQ ID NO: 154794 - protein, 34 aa, Artificial Sequence
  Description of Artificial Sequence: Synthetic polypeptide
DEGEIATTNPVATEQYGSVCAGTDPPTDDQNGDP

SEQ ID NO: 154795 - protein, 34 aa, Artificial Sequence
  Description of Artificial Sequence: Synthetic polypeptide
DEAEIATTNPVATEHWGAVCSTDNGDERDGDIRN

SEQ ID NO: 154796 - protein, 33 aa, Artificial Sequence
  Description of Artificial Sequence: Synthetic polypeptide
DEAEIATTNPVATEHWGSVCYNNDDQDHGDVDR

SEQ ID NO: 154797 - protein, 32 aa, Artificial Sequence
  Description of Artificial Sequence: Synthetic polypeptide
DENEIATTNPVSTEPYGVISMETIQQQQNGNH

SEQ ID NO: 154798 - protein, 36 aa, Artificial Sequence
  Description of Artificial Sequence: Synthetic polypeptide
DEAEIATTNPVATEHWGVVCSTDNGEQERDGQDNRT

SEQ ID NO: 154799 - protein, 33 aa, Artificial Sequence
  Description of Artificial Sequence: Synthetic polypeptide
DEGEIATTNPVATEQYGSVCAMHGQDSPGQDKH

SEQ ID NO: 154800 - protein, 38 aa, Artificial Sequence
  Description of Artificial Sequence: Synthetic polypeptide
DEETIRTTNPVATEQYGVVSTVVSTNNNLQNEGDEEDE

SEQ ID NO: 154801 - protein, 29 aa, Artificial Sequence
  Description of Artificial Sequence: Synthetic peptide
DENEIATTNPVSTEQWGDVSEIEMNAEDA

SEQ ID NO: 154802 - protein, 32 aa, Artificial Sequence
  Description of Artificial Sequence: Synthetic polypeptide
DENEIATTNPVSTEQYGEASMEDIQQQQNGNH

SEQ ID NO: 154803 - protein, 32 aa, Artificial Sequence
  Description of Artificial Sequence: Synthetic polypeptide
DENEIATTNPVSTEQYGEISMEDIQQQQNGNH

SEQ ID NO: 154804 - protein, 37 aa, Artificial Sequence
  Description of Artificial Sequence: Synthetic polypeptide
DEETIRTTNPVATEQYGVVSTVVTNDQAGNNQQDEQE

SEQ ID NO: 154805 - protein, 32 aa, Artificial Sequence
  Description of Artificial Sequence: Synthetic polypeptide
CEGEIAPTNPCSYEQYGKVSCNLSQSPGGQNR

SEQ ID NO: 154806 - protein, 34 aa, Artificial Sequence
  Description of Artificial Sequence: Synthetic polypeptide
DEGEIATTNPVATEQYGSVCADHNNLNIDPPENH

SEQ ID NO: 154807 - protein, 33 aa, Artificial Sequence
  Description of Artificial Sequence: Synthetic polypeptide
DENEIATTNPVSTEQYGTVSAMEDLQQDHNGEH

SEQ ID NO: 154808 - protein, 37 aa, Artificial Sequence
  Description of Artificial Sequence: Synthetic polypeptide
DEETIRTTNPVATEQYGVVSTVVTTNNNLQQGQEEDE

SEQ ID NO: 154809 - protein, 38 aa, Artificial Sequence
  Description of Artificial Sequence: Synthetic polypeptide
DEETIRTTNPVATEQYGVVSTVVSTNNNNLQQGDEEAE

SEQ ID NO: 154810 - protein, 36 aa, Artificial Sequence
  Description of Artificial Sequence: Synthetic polypeptide
DDEEIRTTNPVATEQYGSVVDIMNAGGQTNNTGANT

SEQ ID NO: 154811 - protein, 31 aa, Artificial Sequence
  Description of Artificial Sequence: Synthetic polypeptide
DENEIATTNPVSTEPYGTISEEVCQQQNGNH

SEQ ID NO: 154812 - protein, 37 aa, Artificial Sequence
  Description of Artificial Sequence: Synthetic polypeptide
DEEEIRTTNPVATEVYGSVSTDGMGENLTNDGGEAGQ

SEQ ID NO: 154813 - protein, 31 aa, Artificial Sequence
  Description of Artificial Sequence: Synthetic polypeptide
DENEIRTTNPVATEPWGDVSEEDIMNAAGDH

SEQ ID NO: 154814 - protein, 30 aa, Artificial Sequence
  Description of Artificial Sequence: Synthetic polypeptide
DENEIRTTNPVATEPWGDISMIEMNQNEDA

SEQ ID NO: 154815 - protein, 30 aa, Artificial Sequence
  Description of Artificial Sequence: Synthetic polypeptide
DENEIRTTNPVATEPWGDISEIEMNQNEDA

SEQ ID NO: 154816 - protein, 37 aa, Artificial Sequence
  Description of Artificial Sequence: Synthetic polypeptide
DEEEIRTTNPVATEQYGVVSVVVVTNDEQGNNEEETE

SEQ ID NO: 154817 - protein, 37 aa, Artificial Sequence
  Description of Artificial Sequence: Synthetic polypeptide
DEEEIRTTNPVATEQYGVVSVVVVTNDEQGSNTEDEE

SEQ ID NO: 154818 - protein, 30 aa, Artificial Sequence
  Description of Artificial Sequence: Synthetic polypeptide
DENEIRTTNPVATENWGDVSEIEMNNAEDA

SEQ ID NO: 154819 - protein, 30 aa, Artificial Sequence
  Description of Artificial Sequence: Synthetic polypeptide
DENEIRTTNPVATENWGDVSEIEMNAAEDL

SEQ ID NO: 154820 - protein, 30 aa, Artificial Sequence
  Description of Artificial Sequence: Synthetic polypeptide
DENEIRTTNPVATENWGDVSEIEMNAAEDA

SEQ ID NO: 154821 - protein, 33 aa, Artificial Sequence
  Description of Artificial Sequence: Synthetic polypeptide
DEAEIATTNPEATDQYGQVCCCDQDQKREGNTR

SEQ ID NO: 154822 - protein, 30 aa, Artificial Sequence
  Description of Artificial Sequence: Synthetic polypeptide
DENEIRTTNPVATEMWGDVSEIIMNAAEDA

SEQ ID NO: 154823 - protein, 30 aa, Artificial Sequence
  Description of Artificial Sequence: Synthetic polypeptide
DENEIRTTNPVATEMWGDVSEIEMNAAESA

SEQ ID NO: 154824 - protein, 30 aa, Artificial Sequence
  Description of Artificial Sequence: Synthetic polypeptide
DENEIRTTNPVATEMWGDVSEIEMNAAEDA

SEQ ID NO: 154825 - protein, 31 aa, Artificial Sequence
  Description of Artificial Sequence: Synthetic polypeptide
DENEIATTNPVGTEPYGTISSETIQQQHGDH

SEQ ID NO: 154826 - protein, 31 aa, Artificial Sequence
  Description of Artificial Sequence: Synthetic polypeptide
DENEIATTNPVGTEPYGTISSETIQQQHGDI

SEQ ID NO: 154827 - protein, 30 aa, Artificial Sequence
  Description of Artificial Sequence: Synthetic polypeptide
DENEIRTTNPVATEKWGDVSWIEMNAAEDA

SEQ ID NO: 154828 - protein, 30 aa, Artificial Sequence
  Description of Artificial Sequence: Synthetic polypeptide
DENEIRTTNPVATEKWGDVSEIEMNAAEDA

SEQ ID NO: 154829 - protein, 30 aa, Artificial Sequence
  Description of Artificial Sequence: Synthetic polypeptide
DENEIRTTNPVATEKWGDVSEIEMAAAEDA

SEQ ID NO: 154830 - protein, 31 aa, Artificial Sequence
  Description of Artificial Sequence: Synthetic polypeptide
DENEIRTTNPVATEPWGDVSEEIIMNAAGDH

SEQ ID NO: 154831 - protein, 30 aa, Artificial Sequence
  Description of Artificial Sequence: Synthetic polypeptide
DENEIRTTNPVATEPWGDVSEIEINAAEDA

SEQ ID NO: 154832 - protein, 30 aa, Artificial Sequence
  Description of Artificial Sequence: Synthetic polypeptide
DENEIRTTNPVATEPWGDVSEIEMNAAEDA

SEQ ID NO: 154833 - protein, 36 aa, Artificial Sequence
  Description of Artificial Sequence: Synthetic polypeptide
DEAEIRTTNPVATEGYGSVCATNMLWDPNSGENQDN

SEQ ID NO: 154834 - protein, 33 aa, Artificial Sequence
  Description of Artificial Sequence: Synthetic polypeptide
DENEIRTTNPVATEPYGAISNMEDIQQQQNGNI

SEQ ID NO: 154835 - protein, 32 aa, Artificial Sequence
  Description of Artificial Sequence: Synthetic polypeptide
DENEIRTTNPVATEPYGAIAMEDIQEQNGNYH

SEQ ID NO: 154836 - protein, 32 aa, Artificial Sequence
  Description of Artificial Sequence: Synthetic polypeptide
DENEIRTTNPVATEPYGAIAMEDIQEQKGNYH

SEQ ID NO: 154837 - protein, 36 aa, Artificial Sequence
  Description of Artificial Sequence: Synthetic polypeptide
DEEEIRTTNPVATEQYGSVVSPSSVGNDRQGEEETT

SEQ ID NO: 154838 - protein, 34 aa, Artificial Sequence
  Description of Artificial Sequence: Synthetic polypeptide
DEAEIRTTNPVATEMYGSTCFTQMLLTVRGGQGE

SEQ ID NO: 154839 - protein, 33 aa, Artificial Sequence
  Description of Artificial Sequence: Synthetic polypeptide
DEAEIRTTNPVATEIYGCVCSWGEHNQNFGSDQ

SEQ ID NO: 154840 - protein, 33 aa, Artificial Sequence
  Description of Artificial Sequence: Synthetic polypeptide
DDEEIRTTNPVAYEQYGCVCSWEEHQGFGSEQA

SEQ ID NO: 154841 - protein, 36 aa, Artificial Sequence
  Description of Artificial Sequence: Synthetic polypeptide
DEGEIATTNPVATEQYGSVSATNPAITNMGNGMEPV

SEQ ID NO: 154842 - protein, 38 aa, Artificial Sequence
  Description of Artificial Sequence: Synthetic polypeptide
DEEEIRTTNPVATEQYGVVSVVVVTNLDEQGNNEEEED

SEQ ID NO: 154843 - protein, 31 aa, Artificial Sequence
  Description of Artificial Sequence: Synthetic polypeptide
DENEIATTNPVGTEGYGTIASETIQQQHGDI

SEQ ID NO: 154844 - protein, 31 aa, Artificial Sequence
  Description of Artificial Sequence: Synthetic polypeptide
DENEIRTTNPVATEPWGTISMIIQQQQNGDH

SEQ ID NO: 154845 - protein, 33 aa, Artificial Sequence
  Description of Artificial Sequence: Synthetic polypeptide
DENEIRTTNPVATEPWGTISMENIPQQQEGENH

SEQ ID NO: 154846 - protein, 32 aa, Artificial Sequence
  Description of Artificial Sequence: Synthetic polypeptide
DENEIRTTNPVATEPWGTISMEIIQQQQNGNH

SEQ ID NO: 154847 - protein, 32 aa, Artificial Sequence
  Description of Artificial Sequence: Synthetic polypeptide
DENEIRTTNPVATEPWGTISMEIEQQQQNGNH

SEQ ID NO: 154848 - protein, 32 aa, Artificial Sequence
  Description of Artificial Sequence: Synthetic polypeptide
DENEIRTTNPVATEPWGTISMEIEQQQANGNA

SEQ ID NO: 154849 - protein, 32 aa, Artificial Sequence
  Description of Artificial Sequence: Synthetic polypeptide
DENEIRTTNPVATEPWGTISMEDIQQQQEGNH

SEQ ID NO: 154850 - protein, 33 aa, Artificial Sequence
  Description of Artificial Sequence: Synthetic polypeptide
DENEIRTTNPVATEPWGTISCENIPQQQEGENH

SEQ ID NO: 154851 - protein, 34 aa, Artificial Sequence
  Description of Artificial Sequence: Synthetic polypeptide
DEAEIRTTNPVATEIWGSVSRCINEPQVRDDEVE

SEQ ID NO: 154852 - protein, 31 aa, Artificial Sequence
  Description of Artificial Sequence: Synthetic polypeptide
DENEIATTNPVGTEPYGTIASETIQQQHGDI

SEQ ID NO: 154853 - protein, 33 aa, Artificial Sequence
  Description of Artificial Sequence: Synthetic polypeptide
DEAEIATTNPVATCQYGCVCSWATNQNFGSEQS

SEQ ID NO: 154854 - protein, 34 aa, Artificial Sequence
  Description of Artificial Sequence: Synthetic polypeptide
DDEEIRTTNPVATEQWGCVTSSGELQENFGSDQQ

SEQ ID NO: 154855 - protein, 35 aa, Artificial Sequence
  Description of Artificial Sequence: Synthetic polypeptide
DEGEIATTNPVATEQYGSVPCWDNHGQQRQGGEDA

SEQ ID NO: 154856 - protein, 31 aa, Artificial Sequence
  Description of Artificial Sequence: Synthetic polypeptide
DENEIATTNPVSTEPYGTASMDIQQQQNGNH

SEQ ID NO: 154857 - protein, 33 aa, Artificial Sequence
  Description of Artificial Sequence: Synthetic polypeptide
CEEEISTTNPVATEQYGCVCSTEHANFGSETQS

SEQ ID NO: 154858 - protein, 34 aa, Artificial Sequence
  Description of Artificial Sequence: Synthetic polypeptide
CEEEISTTNPVATEQYGCVCSTEHDQENFGSDQF

SEQ ID NO: 154859 - protein, 35 aa, Artificial Sequence
  Description of Artificial Sequence: Synthetic polypeptide
CEEEISTTNPVATEQYGCVCSTEHNAEGFGSENQT

SEQ ID NO: 154860 - protein, 33 aa, Artificial Sequence
  Description of Artificial Sequence: Synthetic polypeptide
CEEEISTTNPVATEQYGCVCSTEHQEYFFSDQA

SEQ ID NO: 154861 - protein, 33 aa, Artificial Sequence
  Description of Artificial Sequence: Synthetic polypeptide
DEAEIATTNPVATCQYGCVCSTEADQNFGSDQS

SEQ ID NO: 154862 - protein, 31 aa, Artificial Sequence
  Description of Artificial Sequence: Synthetic polypeptide
DENEIATTNPVSTEPYGTASMEDIQQQNGNH

SEQ ID NO: 154863 - protein, 34 aa, Artificial Sequence
  Description of Artificial Sequence: Synthetic polypeptide
CEEEISTTNPVATEQYGCVCSTGELANFNSETQT

SEQ ID NO: 154864 - protein, 35 aa, Artificial Sequence
  Description of Artificial Sequence: Synthetic polypeptide
CEEEISTTNPVATEQYGCVCSTGELNQNFNSDTQD

SEQ ID NO: 154865 - protein, 34 aa, Artificial Sequence
  Description of Artificial Sequence: Synthetic polypeptide
CEEEISTTNPVATEQYGCVCSTGNHANFGSETQA

SEQ ID NO: 154866 - protein, 36 aa, Artificial Sequence
  Description of Artificial Sequence: Synthetic polypeptide
DEGEIATTNPVATEQYGSVCATNPMTQEHQDGNQHN

SEQ ID NO: 154867 - protein, 38 aa, Artificial Sequence
  Description of Artificial Sequence: Synthetic polypeptide
DEEEIRTTNPVATEQYGVVSVVVVTNLQAGTTEQGEAE

SEQ ID NO: 154868 - protein, 34 aa, Artificial Sequence
  Description of Artificial Sequence: Synthetic polypeptide
DDEEIRTTNPVATEQWGCVTSTEDNQENFNSDAS

SEQ ID NO: 154869 - protein, 34 aa, Artificial Sequence
  Description of Artificial Sequence: Synthetic polypeptide
DEGEIATTNPVATEQYGSVCATDGLTQPDQEEAM

SEQ ID NO: 154870 - protein, 31 aa, Artificial Sequence
  Description of Artificial Sequence: Synthetic polypeptide
DENEIATTNPVSTEPYGTASMNIQQQQNGGH

SEQ ID NO: 154871 - protein, 33 aa, Artificial Sequence
  Description of Artificial Sequence: Synthetic polypeptide
DEGEIATTNPVATEQYGSVCAPNPEEADNQENH

SEQ ID NO: 154872 - protein, 32 aa, Artificial Sequence
  Description of Artificial Sequence: Synthetic polypeptide
DENEIATTNPVSTEPYGTISCEDLQQQSNGNH

SEQ ID NO: 154873 - protein, 31 aa, Artificial Sequence
  Description of Artificial Sequence: Synthetic polypeptide
DENEIATTNPVSTEPYGTASMDIQQQHNGNH

SEQ ID NO: 154874 - protein, 35 aa, Artificial Sequence
  Description of Artificial Sequence: Synthetic polypeptide
DEAEIATTNPVATCQYGCVCSNTALNQENFGSNQS

SEQ ID NO: 154875 - protein, 35 aa, Artificial Sequence
  Description of Artificial Sequence: Synthetic polypeptide
DDEEIRTTNPVATEQYGSVYGQGTDDLGQGEEFTG

SEQ ID NO: 154876 - protein, 31 aa, Artificial Sequence
  Description of Artificial Sequence: Synthetic polypeptide
DENEIATTNPVSTEPYGNISMDIQQQQVGNH

SEQ ID NO: 154877 - protein, 35 aa, Artificial Sequence
  Description of Artificial Sequence: Synthetic polypeptide
DDEEIRTTNPVATEQYGVVVGDTMNGDEGGETNID

SEQ ID NO: 154878 - protein, 34 aa, Artificial Sequence
  Description of Artificial Sequence: Synthetic polypeptide
DEGEIATTNPVATEQYGSVFFATDTLEPHEGEDI

SEQ ID NO: 154879 - protein, 36 aa, Artificial Sequence
  Description of Artificial Sequence: Synthetic polypeptide
DDEEIRTTNPVATEQYGVVSILNGQEDEGQGGNNTN

SEQ ID NO: 154880 - protein, 36 aa, Artificial Sequence
  Description of Artificial Sequence: Synthetic polypeptide
DDEEIRTTNPVATEQYGVVSGGNDQNDGEGEGNGEF

SEQ ID NO: 154881 - protein, 34 aa, Artificial Sequence
  Description of Artificial Sequence: Synthetic polypeptide
DDEEIRTTNPVATEQYGVVSGDDEIDGQGGEGEQ

SEQ ID NO: 154882 - protein, 36 aa, Artificial Sequence
  Description of Artificial Sequence: Synthetic polypeptide
DDEEIRTTNPVATEQYGVVSAGTDQNDGEGEGNGNG

SEQ ID NO: 154883 - protein, 32 aa, Artificial Sequence
  Description of Artificial Sequence: Synthetic polypeptide
DENEIATTNPVSTEGYGTISMEDIQQQQNGNR

SEQ ID NO: 154884 - protein, 32 aa, Artificial Sequence
  Description of Artificial Sequence: Synthetic polypeptide
DENEIATTNPVSTEGYGTISNEDIQQQQNGNR

SEQ ID NO: 154885 - protein, 38 aa, Artificial Sequence
  Description of Artificial Sequence: Synthetic polypeptide
DEEEIRTTNPVATEQYGVVSVVVVTNLDEQGNNTDETE

SEQ ID NO: 154886 - protein, 37 aa, Artificial Sequence
  Description of Artificial Sequence: Synthetic polypeptide
DEGEIATTNPVATEQYGSVCSMTNDLPQDHQDDNDNN

SEQ ID NO: 154887 - protein, 34 aa, Artificial Sequence
  Description of Artificial Sequence: Synthetic polypeptide
DDEEIRTTNPVATEQYGVVDQTTGQGGGETTFGE

SEQ ID NO: 154888 - protein, 35 aa, Artificial Sequence
  Description of Artificial Sequence: Synthetic polypeptide
DDEEIRTTNPVATEQYGVVDGTTTGQGGGNTTGGD

SEQ ID NO: 154889 - protein, 34 aa, Artificial Sequence
  Description of Artificial Sequence: Synthetic polypeptide
DEAEIATTNPIATEQWGSIVPTNWDQHEGGQEDR

SEQ ID NO: 154890 - protein, 32 aa, Artificial Sequence
  Description of Artificial Sequence: Synthetic polypeptide
DENEIATTNPVSTEPYGEISMENIQQQQNGNH

SEQ ID NO: 154891 - protein, 37 aa, Artificial Sequence
  Description of Artificial Sequence: Synthetic polypeptide
DEEEIRTTNPVATEVYGYSVSSTTPAGPNMRNGMNPV

SEQ ID NO: 154892 - protein, 32 aa, Artificial Sequence
  Description of Artificial Sequence: Synthetic polypeptide
DENEIATTNPVSTEPYGIISMENIQQQSNGNH

SEQ ID NO: 154893 - protein, 36 aa, Artificial Sequence
  Description of Artificial Sequence: Synthetic polypeptide
DEGEIATTNPVATEQYGSVCSAPALGQDHQDGNDNQ

SEQ ID NO: 154894 - protein, 36 aa, Artificial Sequence
  Description of Artificial Sequence: Synthetic polypeptide
DDEEIRTTNPVATEQYGSVYGQTGDLEVGNGGNNTT

SEQ ID NO: 154895 - protein, 31 aa, Artificial Sequence
  Description of Artificial Sequence: Synthetic polypeptide
DENEIATTNPVSTEPYGDISMDIQQQQNGNL

SEQ ID NO: 154896 - protein, 30 aa, Artificial Sequence
  Description of Artificial Sequence: Synthetic polypeptide
DENEICTTNPVATEQWGDVSEIEMNAAEDA

SEQ ID NO: 154897 - protein, 31 aa, Artificial Sequence
  Description of Artificial Sequence: Synthetic polypeptide
DENEICTTNPVATEQWGDVSEIEMNAAEDAW

SEQ ID NO: 154898 - protein, 30 aa, Artificial Sequence
  Description of Artificial Sequence: Synthetic polypeptide
DENEICTTNPVATEQWGDVSEIEMNAAMDA

SEQ ID NO: 154899 - protein, 35 aa, Artificial Sequence
  Description of Artificial Sequence: Synthetic polypeptide
DEAEIRTTNPVATEAWGSVCSTMNNDHERNGDSTM

SEQ ID NO: 154900 - protein, 39 aa, Artificial Sequence
  Description of Artificial Sequence: Synthetic polypeptide
DEEEIRTTNPVATESYGTVTTGQQSTISTNLQMQEVGNR

SEQ ID NO: 154901 - protein, 30 aa, Artificial Sequence
  Description of Artificial Sequence: Synthetic polypeptide
DEAEIRTTNPVATEAWGDVSEIEMNAAEDA

SEQ ID NO: 154902 - protein, 37 aa, Artificial Sequence
  Description of Artificial Sequence: Synthetic polypeptide
DEEEIRTTNPVATEQYGVVTVVNSNNLQAGTTTEEED

SEQ ID NO: 154903 - protein, 34 aa, Artificial Sequence
  Description of Artificial Sequence: Synthetic polypeptide
DEGEIATTNPVATEQYGSVANGGNGEYGAEGTGR

SEQ ID NO: 154904 - protein, 38 aa, Artificial Sequence
  Description of Artificial Sequence: Synthetic polypeptide
DEEEIRTTNPVATEQYGVVTVVVTENNLQQGIGTNGTD

SEQ ID NO: 154905 - protein, 38 aa, Artificial Sequence
  Description of Artificial Sequence: Synthetic polypeptide
DEEEIRTTNPVATEQYGVVTVVVTNLQGNQQAGNNEEQ

SEQ ID NO: 154906 - protein, 35 aa, Artificial Sequence
  Description of Artificial Sequence: Synthetic polypeptide
DEAEIRTTNPVATDCWGSVSRCINLEPQVTDGENG

SEQ ID NO: 154907 - protein, 31 aa, Artificial Sequence
  Description of Artificial Sequence: Synthetic polypeptide
DENEIRTTNPVATECWGSVSCIIEMNAAEDA

SEQ ID NO: 154908 - protein, 36 aa, Artificial Sequence
  Description of Artificial Sequence: Synthetic polypeptide
DEEVIRTTNPVATEQYGCVVVVSTNAHSDNTGQNNP

SEQ ID NO: 154909 - protein, 37 aa, Artificial Sequence
  Description of Artificial Sequence: Synthetic polypeptide
DEEEIRTTNPVATEQYGVVTVVVTNLQLNQQGTTEES

SEQ ID NO: 154910 - protein, 36 aa, Artificial Sequence
  Description of Artificial Sequence: Synthetic polypeptide
DEEEIRTTNPVATEQYGSVVTMLNLELVAPIDILDD

SEQ ID NO: 154911 - protein, 37 aa, Artificial Sequence
  Description of Artificial Sequence: Synthetic polypeptide
DDEEIRTTNPVATEQYGSVSSTTPDGPNMGNGENDVT

SEQ ID NO: 154912 - protein, 35 aa, Artificial Sequence
  Description of Artificial Sequence: Synthetic polypeptide
DEEVIRTTNPVATEQYGQCVCSTGEHNDNFGSQQS

SEQ ID NO: 154913 - protein, 32 aa, Artificial Sequence
  Description of Artificial Sequence: Synthetic polypeptide
DENEIRTTNPVATECWGETTANENLAEPKGPR

SEQ ID NO: 154914 - protein, 39 aa, Artificial Sequence
  Description of Artificial Sequence: Synthetic polypeptide
DEEEIRTTNPVATESYGTVTNLQSGVISTNLQNQENGNV

SEQ ID NO: 154915 - protein, 32 aa, Artificial Sequence
  Description of Artificial Sequence: Synthetic polypeptide
DENEIRTTNPVATECWGETTANEDLAEPKGPR

SEQ ID NO: 154916 - protein, 36 aa, Artificial Sequence
  Description of Artificial Sequence: Synthetic polypeptide
DEEEIRTTNPVATEQYGSVVSWTPGVQPTQMVQVPD

SEQ ID NO: 154917 - protein, 32 aa, Artificial Sequence
  Description of Artificial Sequence: Synthetic polypeptide
DENEIRTTNPVATECWGSVSEIIEPMNAAENA

SEQ ID NO: 154918 - protein, 32 aa, Artificial Sequence
  Description of Artificial Sequence: Synthetic polypeptide
DENEIITTNPVSTEPYGIISMEDITQQQNGNH

SEQ ID NO: 154919 - protein, 33 aa, Artificial Sequence
  Description of Artificial Sequence: Synthetic polypeptide
DDEEIRTTNPVATEQWGCVTSWGEHQNFGSEQN

SEQ ID NO: 154920 - protein, 36 aa, Artificial Sequence
  Description of Artificial Sequence: Synthetic polypeptide
DDEEIRTTNPVATEQYGSVSTMDIENGEGGGEEETG

SEQ ID NO: 154921 - protein, 36 aa, Artificial Sequence
  Description of Artificial Sequence: Synthetic polypeptide
DDEEIRTTNPVATEQYGSVSTMDIANGEGGGEEEQF

SEQ ID NO: 154922 - protein, 35 aa, Artificial Sequence
  Description of Artificial Sequence: Synthetic polypeptide
DEGEIATTNPVATEQYGSVATNNDLDQLHQDDTEN

SEQ ID NO: 154923 - protein, 37 aa, Artificial Sequence
  Description of Artificial Sequence: Synthetic polypeptide
DEEEIRTTNPVATEQYGVVSVVVVTTTQAGNTEQGAE

SEQ ID NO: 154924 - protein, 34 aa, Artificial Sequence
  Description of Artificial Sequence: Synthetic polypeptide
DDEEIRTTNPVATEQWGCVTSTGEHNQNSGSDAS

SEQ ID NO: 154925 - protein, 36 aa, Artificial Sequence
  Description of Artificial Sequence: Synthetic polypeptide
DEEEIRTTNPVATEQYGVVTDNDNMDQGGGGETNNG

SEQ ID NO: 154926 - protein, 37 aa, Artificial Sequence
  Description of Artificial Sequence: Synthetic polypeptide
DEEEIRTTNPVATEQYGVVTDSTDNGMEGQGEGQEGE

SEQ ID NO: 154927 - protein, 34 aa, Artificial Sequence
  Description of Artificial Sequence: Synthetic polypeptide
DEAEIRTTNPVATECWGSFSVCINEQDVSDGENE

SEQ ID NO: 154928 - protein, 37 aa, Artificial Sequence
  Description of Artificial Sequence: Synthetic polypeptide
DEEEIRTTNPVATEQYGVVTVVVTNLQLQQGTTTEES

SEQ ID NO: 154929 - protein, 30 aa, Artificial Sequence
  Description of Artificial Sequence: Synthetic polypeptide
DENEIITTNPVATEQWGDVSEIEMNAAEDA

SEQ ID NO: 154930 - protein, 34 aa, Artificial Sequence
  Description of Artificial Sequence: Synthetic polypeptide
CEEEISTTNPVAYEQYGCVCSNTMELQNFGSDQS

SEQ ID NO: 154931 - protein, 35 aa, Artificial Sequence
  Description of Artificial Sequence: Synthetic polypeptide
DEEVIRTTNPVATEQYGCVCSNTGELNDNFGSDQS

SEQ ID NO: 154932 - protein, 30 aa, Artificial Sequence
  Description of Artificial Sequence: Synthetic polypeptide
DENEIITTNPVATEQWGDVSRIEMNAAEDA

SEQ ID NO: 154933 - protein, 34 aa, Artificial Sequence
  Description of Artificial Sequence: Synthetic polypeptide
DEAEIRTTNPVATECWGSFSCINEQQVSDGENEE

SEQ ID NO: 154934 - protein, 30 aa, Artificial Sequence
  Description of Artificial Sequence: Synthetic polypeptide
DENEIITTNPVATEQWGNVSEIEMNAAEDA

SEQ ID NO: 154935 - protein, 33 aa, Artificial Sequence
  Description of Artificial Sequence: Synthetic polypeptide
DEAEIRTTNPVATEAYGSVSWSEHFRIEDIQST

SEQ ID NO: 154936 - protein, 35 aa, Artificial Sequence
  Description of Artificial Sequence: Synthetic polypeptide
DEEVIRTTNPVATEQYGCVCSTGEDNDENFNSDQS

SEQ ID NO: 154937 - protein, 35 aa, Artificial Sequence
  Description of Artificial Sequence: Synthetic polypeptide
DEEVIRTTNPVATEQYGCVCSTGEDNINFGSDTQS

SEQ ID NO: 154938 - protein, 30 aa, Artificial Sequence
  Description of Artificial Sequence: Synthetic polypeptide
DENEIITTNPVATEQWGDVSEIEMYAAEDA

SEQ ID NO: 154939 - protein, 36 aa, Artificial Sequence
  Description of Artificial Sequence: Synthetic polypeptide
DENEIRTTNPVATECYGSVSSTEPALPQMRNEMEPV

SEQ ID NO: 154940 - protein, 37 aa, Artificial Sequence
  Description of Artificial Sequence: Synthetic polypeptide
DEEVIRTTNPVATEQYGSVSSTTPAGPNMRNGMNPVE

SEQ ID NO: 154941 - protein, 36 aa, Artificial Sequence
  Description of Artificial Sequence: Synthetic polypeptide
DDEEIRTTNPVATEQYGSVSISNGFDQNINEGGQGE

SEQ ID NO: 154942 - protein, 37 aa, Artificial Sequence
  Description of Artificial Sequence: Synthetic polypeptide
DEEEIRTTNPVATEQYGSVVTNVATEQYGSTQQQTDE

SEQ ID NO: 154943 - protein, 30 aa, Artificial Sequence
  Description of Artificial Sequence: Synthetic polypeptide
DENEIMTTNPVATEQWGDVSEIEMNAAEDA

SEQ ID NO: 154944 - protein, 37 aa, Artificial Sequence
  Description of Artificial Sequence: Synthetic polypeptide
DEEEIRTTNPVATEQYGSVVTNVATEQYGSTTQQEQE

SEQ ID NO: 154945 - protein, 30 aa, Artificial Sequence
  Description of Artificial Sequence: Synthetic polypeptide
DENEIRTTNPVATECWGDVSECEMNAAEEL

SEQ ID NO: 154946 - protein, 30 aa, Artificial Sequence
  Description of Artificial Sequence: Synthetic polypeptide
DENEIRTTNPVATECWGDVSECEMNAAEDL

SEQ ID NO: 154947 - protein, 37 aa, Artificial Sequence
  Description of Artificial Sequence: Synthetic polypeptide
DEEEIRTTNPVATEQYGSVVTNVATEQYGSVTQQLQM

SEQ ID NO: 154948 - protein, 36 aa, Artificial Sequence
  Description of Artificial Sequence: Synthetic polypeptide
DEEEIRTTNPVATEQYGSVVTTDGMNEEFGEDGGEF

SEQ ID NO: 154949 - protein, 36 aa, Artificial Sequence
  Description of Artificial Sequence: Synthetic polypeptide
DEEEIRTTNPVATEQYGSVVTTDGMNNETGEFGGEG

SEQ ID NO: 154950 - protein, 36 aa, Artificial Sequence
  Description of Artificial Sequence: Synthetic polypeptide
DEEEIRTTNPVATEQYGSVVTTGDNDETGEDGGGET

SEQ ID NO: 154951 - protein, 30 aa, Artificial Sequence
  Description of Artificial Sequence: Synthetic polypeptide
DENEINTTNPVATEQWGDVSEIEMNAAEDA

SEQ ID NO: 154952 - protein, 31 aa, Artificial Sequence
  Description of Artificial Sequence: Synthetic polypeptide
DENEINTTNPVATEQWGDVSEIEMNAAEDEA

SEQ ID NO: 154953 - protein, 32 aa, Artificial Sequence
  Description of Artificial Sequence: Synthetic polypeptide
DENEINTTNPVSTEPYGTISMMDLIQQQNGNH

SEQ ID NO: 154954 - protein, 30 aa, Artificial Sequence
  Description of Artificial Sequence: Synthetic polypeptide
DENEIQTTNPVATEQWGDVSEIEMNAAEDA

SEQ ID NO: 154955 - protein, 35 aa, Artificial Sequence
  Description of Artificial Sequence: Synthetic polypeptide
DDEEIRTTNPVATEQYGSVMGTNNNDNMDEGGQGI

SEQ ID NO: 154956 - protein, 31 aa, Artificial Sequence
  Description of Artificial Sequence: Synthetic polypeptide
DENEIRTTNPVATECWGAVSNADWMNPKEDA

SEQ ID NO: 154957 - protein, 30 aa, Artificial Sequence
  Description of Artificial Sequence: Synthetic polypeptide
DENEIRATNPVATEQWGDVSEIEMNAAEDA

SEQ ID NO: 154958 - protein, 30 aa, Artificial Sequence
  Description of Artificial Sequence: Synthetic polypeptide
DENEIRTTNPVATECWGAVSEIWMEAKEDA

SEQ ID NO: 154959 - protein, 34 aa, Artificial Sequence
  Description of Artificial Sequence: Synthetic polypeptide
DEAEIRTTNPTATECYGCVATTNGNDPREGGNTQ

SEQ ID NO: 154960 - protein, 30 aa, Artificial Sequence
  Description of Artificial Sequence: Synthetic polypeptide
DENEILTTNPVATEQWGDVSEREMNAAEDA

SEQ ID NO: 154961 - protein, 30 aa, Artificial Sequence
  Description of Artificial Sequence: Synthetic polypeptide
DENEILTTNPVATEQWGDVSEIESNAAEDA

SEQ ID NO: 154962 - protein, 31 aa, Artificial Sequence
  Description of Artificial Sequence: Synthetic polypeptide
DENEILTTNPVATEQWGDVSEIEMNAAEDAG

SEQ ID NO: 154963 - protein, 30 aa, Artificial Sequence
  Description of Artificial Sequence: Synthetic polypeptide
DENEIKTTNPVATEQWGDVSEIEMNAAEDA

SEQ ID NO: 154964 - protein, 30 aa, Artificial Sequence
  Description of Artificial Sequence: Synthetic polypeptide
DENEIKTTNPVATEQWGDVSEIEMNAAEDL

SEQ ID NO: 154965 - protein, 30 aa, Artificial Sequence
  Description of Artificial Sequence: Synthetic polypeptide
DENEIKTTNPVATEQWGIVSEIEMNAAEDA

SEQ ID NO: 154966 - protein, 35 aa, Artificial Sequence
  Description of Artificial Sequence: Synthetic polypeptide
DENEIKTTNPVATEQYGDVSILNGEDEQTEEGGNG

SEQ ID NO: 154967 - protein, 32 aa, Artificial Sequence
  Description of Artificial Sequence: Synthetic polypeptide
DENEIRTTNPVATECWGDVSEIIEQNRAEEDG

SEQ ID NO: 154968 - protein, 32 aa, Artificial Sequence
  Description of Artificial Sequence: Synthetic polypeptide
DENEIRTTNPVATECWGDVSEIIEQNRAEEDA

SEQ ID NO: 154969 - protein, 31 aa, Artificial Sequence
  Description of Artificial Sequence: Synthetic polypeptide
DENEIRTTNPVATECWGDVSEIIEMNRAEDA

SEQ ID NO: 154970 - protein, 31 aa, Artificial Sequence
  Description of Artificial Sequence: Synthetic polypeptide
DENEIRTTNPVATECWGDVSEIEPQDAAEDG

SEQ ID NO: 154971 - protein, 35 aa, Artificial Sequence
  Description of Artificial Sequence: Synthetic polypeptide
DEGEIATTNPVATEQYGSSFSATDTLEPHEGQDTR

SEQ ID NO: 154972 - protein, 31 aa, Artificial Sequence
  Description of Artificial Sequence: Synthetic polypeptide
DENEIRTTNPVATECWGDVSEIEPQDAAEDA

SEQ ID NO: 154973 - protein, 31 aa, Artificial Sequence
  Description of Artificial Sequence: Synthetic polypeptide
DENEIRTTNPVATECWGDVSEIEMNAAEPYA

SEQ ID NO: 154974 - protein, 30 aa, Artificial Sequence
  Description of Artificial Sequence: Synthetic polypeptide
DENEIRTTNPVATECWGDVSEIEMNAAEPA

SEQ ID NO: 154975 - protein, 30 aa, Artificial Sequence
  Description of Artificial Sequence: Synthetic polypeptide
DENEIRTTNPVATECWGDVSEIEMNAAEEA

SEQ ID NO: 154976 - protein, 30 aa, Artificial Sequence
  Description of Artificial Sequence: Synthetic polypeptide
DENEIRTTNPVATECWGDVSEIEMNAAEDL

SEQ ID NO: 154977 - protein, 30 aa, Artificial Sequence
  Description of Artificial Sequence: Synthetic polypeptide
DENEIRTTNPVATECWGDVSEIEMNAAEDI

SEQ ID NO: 154978 - protein, 30 aa, Artificial Sequence
  Description of Artificial Sequence: Synthetic polypeptide
DENEIRTTNPVATECWGDVSEIEMNAAEDA

SEQ ID NO: 154979 - protein, 30 aa, Artificial Sequence
  Description of Artificial Sequence: Synthetic polypeptide
DENEIRTTNPVATECWGDVSEHEMNAAEDA

SEQ ID NO: 154980 - protein, 30 aa, Artificial Sequence
  Description of Artificial Sequence: Synthetic polypeptide
DENEILTTNPVATEQWGDVSEIEMNAAEDA

SEQ ID NO: 154981 - protein, 31 aa, Artificial Sequence
  Description of Artificial Sequence: Synthetic polypeptide
DENEIRTTNPVATECWGDVSEIEMNPAEPYA

SEQ ID NO: 154982 - protein, 36 aa, Artificial Sequence
  Description of Artificial Sequence: Synthetic polypeptide
DENEIRTTNPVATECYGSVSSTTPALPQMRNEMEPV

SEQ ID NO: 154983 - protein, 34 aa, Artificial Sequence
  Description of Artificial Sequence: Synthetic polypeptide
DEAEIRTTNPVATECWGSVSCIEEPQDGEGENTS

SEQ ID NO: 154984 - protein, 34 aa, Artificial Sequence
  Description of Artificial Sequence: Synthetic polypeptide
DEAEIRTTNPVATECWGSVSCIEEPQDREGEEHS

SEQ ID NO: 154985 - protein, 32 aa, Artificial Sequence
  Description of Artificial Sequence: Synthetic polypeptide
DEEVIATTNPDATEGYGSCSTPLGARSYEYDG

SEQ ID NO: 154986 - protein, 30 aa, Artificial Sequence
  Description of Artificial Sequence: Synthetic polypeptide
DENEIRTTNPVATEIWGDVSEIEMNAAEDA

SEQ ID NO: 154987 - protein, 35 aa, Artificial Sequence
  Description of Artificial Sequence: Synthetic polypeptide
DENEICTTNPVATEQYGSVFTWTYNPQTQQDVNIM

SEQ ID NO: 154988 - protein, 30 aa, Artificial Sequence
  Description of Artificial Sequence: Synthetic polypeptide
DENEIRTTNPVATEHWGKVSEIEMNAAEDA

SEQ ID NO: 154989 - protein, 35 aa, Artificial Sequence
  Description of Artificial Sequence: Synthetic polypeptide
DEGEIATTNPVATEQYGSVCAANPQQEHQDGNQHQ

SEQ ID NO: 154990 - protein, 30 aa, Artificial Sequence
  Description of Artificial Sequence: Synthetic polypeptide
DENEIRTTNPVATEHWGDVSEIEPNAAEDA

SEQ ID NO: 154991 - protein, 30 aa, Artificial Sequence
  Description of Artificial Sequence: Synthetic polypeptide
DENEIRTTNPVATEHWGDVSEIEMNMAEDA

SEQ ID NO: 154992 - protein, 38 aa, Artificial Sequence
  Description of Artificial Sequence: Synthetic polypeptide
DEEEIRTTNPVATEQYGVVSVVVVTNNQQGNTEQGTTE

SEQ ID NO: 154993 - protein, 30 aa, Artificial Sequence
  Description of Artificial Sequence: Synthetic polypeptide
DENEIRTTNPVATEHWGDVSEIEMNAAEDA

SEQ ID NO: 154994 - protein, 35 aa, Artificial Sequence
  Description of Artificial Sequence: Synthetic polypeptide
DEGEIATTNPVATEQYGSVCAANNGVLPEDGGNDV

SEQ ID NO: 154995 - protein, 36 aa, Artificial Sequence
  Description of Artificial Sequence: Synthetic polypeptide
DDEEIRTTNPVATEQYGSVTDTDDQLIGENTGGQIG

SEQ ID NO: 154996 - protein, 39 aa, Artificial Sequence
  Description of Artificial Sequence: Synthetic polypeptide
DEEEIRTTNPVATESYGTVTTVQSVTISTNLQMQEVGNP

SEQ ID NO: 154997 - protein, 35 aa, Artificial Sequence
  Description of Artificial Sequence: Synthetic polypeptide
DENEIRTTNPVATEGYGSVVNNGLDQQTGGQTGQG

SEQ ID NO: 154998 - protein, 36 aa, Artificial Sequence
  Description of Artificial Sequence: Synthetic polypeptide
DENEIRTTNPVATEGYGSVMSDLNDLDQTGGQTGQT

SEQ ID NO: 154999 - protein, 32 aa, Artificial Sequence
  Description of Artificial Sequence: Synthetic polypeptide
DENEIETTNPVSTEPYGTISMENIQQSQNGNH

SEQ ID NO: 155000 - protein, 34 aa, Artificial Sequence
  Description of Artificial Sequence: Synthetic polypeptide
CEEEISTTNPVATEQYGQCVCSTNHANFGSETQT

SEQ ID NO: 155001 - protein, 34 aa, Artificial Sequence
  Description of Artificial Sequence: Synthetic polypeptide
DEAEIRTTNPVATECWGSVSCINYETQHTGSEYM

SEQ ID NO: 155002 - protein, 35 aa, Artificial Sequence
  Description of Artificial Sequence: Synthetic polypeptide
DENEICTTNPVATEQYGSVFTWTYNIQTQQDNQIM

SEQ ID NO: 155003 - protein, 30 aa, Artificial Sequence
  Description of Artificial Sequence: Synthetic polypeptide
DENEIRTTNPVATEIWGDVSEIRMNAAEDA

SEQ ID NO: 155004 - protein, 33 aa, Artificial Sequence
  Description of Artificial Sequence: Synthetic polypeptide
DENEIRTTNPVATEIYGCVCSNWEHQNFGSDQS

SEQ ID NO: 155005 - protein, 33 aa, Artificial Sequence
  Description of Artificial Sequence: Synthetic polypeptide
DEEVIATTNPDATEGYGSCSTPLGAARYNEYDG

SEQ ID NO: 155006 - protein, 33 aa, Artificial Sequence
  Description of Artificial Sequence: Synthetic polypeptide
DEEVIACTNPVATAQWGSVSTHGPLGAPGGNDT

SEQ ID NO: 155007 - protein, 35 aa, Artificial Sequence
  Description of Artificial Sequence: Synthetic polypeptide
DEAEIRTTNPVATECYGSVCYTTENDGQQQQNGDA

SEQ ID NO: 155008 - protein, 31 aa, Artificial Sequence
  Description of Artificial Sequence: Synthetic polypeptide
DEEVIACTNPVATASWGCVATNELQDDSNGA

SEQ ID NO: 155009 - protein, 38 aa, Artificial Sequence
  Description of Artificial Sequence: Synthetic polypeptide
DEEEIRTTNPVATEQYGVVSVVVVTNNLQAGTDEEEED

SEQ ID NO: 155010 - protein, 33 aa, Artificial Sequence
  Description of Artificial Sequence: Synthetic polypeptide
DEEVIACTNPVATEQYGCVAGTNLPDNTEQNNT

SEQ ID NO: 155011 - protein, 34 aa, Artificial Sequence
  Description of Artificial Sequence: Synthetic polypeptide
DEAEIRTTNPVATECYGSVCNTFNCWYGRYESDD

SEQ ID NO: 155012 - protein, 34 aa, Artificial Sequence
  Description of Artificial Sequence: Synthetic polypeptide
DEAEIRTTNPVATECWGSVWCINETQHRGSEYMP

SEQ ID NO: 155013 - protein, 35 aa, Artificial Sequence
  Description of Artificial Sequence: Synthetic polypeptide
DENEICTTNPVATEQYGSCISVTHDLQTGMEDQQY

SEQ ID NO: 155014 - protein, 31 aa, Artificial Sequence
  Description of Artificial Sequence: Synthetic polypeptide
DENEIRTTNPVATEGYGDVAAEIIQSAAEDA

SEQ ID NO: 155015 - protein, 33 aa, Artificial Sequence
  Description of Artificial Sequence: Synthetic polypeptide
DEGEIATTNPVATEQYGSVCAATHEEADSENMD

SEQ ID NO: 155016 - protein, 35 aa, Artificial Sequence
  Description of Artificial Sequence: Synthetic polypeptide
DEAEIRTTNPVATECWGSVSVCINEPQHRGGEDMF

SEQ ID NO: 155017 - protein, 34 aa, Artificial Sequence
  Description of Artificial Sequence: Synthetic polypeptide
DEGEIATTNPVATEQYGSVCAATGVLPEDNDNDQ

SEQ ID NO: 155018 - protein, 33 aa, Artificial Sequence
  Description of Artificial Sequence: Synthetic polypeptide
DEGEIATTNPVATEQYGSVCAATGEEATDSMNN

SEQ ID NO: 155019 - protein, 36 aa, Artificial Sequence
  Description of Artificial Sequence: Synthetic polypeptide
DEEEIRTTNPVATETYGQVSSTTPAGPNMRNGMNPV

SEQ ID NO: 155020 - protein, 38 aa, Artificial Sequence
  Description of Artificial Sequence: Synthetic polypeptide
DEEEIRTTNPVATEQYGVVSVVVVTNNNQEQGNTEQGS

SEQ ID NO: 155021 - protein, 34 aa, Artificial Sequence
  Description of Artificial Sequence: Synthetic polypeptide
DENEIRTTNPVATEIYGCVCSWEHNTNFGSDNQA

SEQ ID NO: 155022 - protein, 38 aa, Artificial Sequence
  Description of Artificial Sequence: Synthetic polypeptide
DEEEIRTTNPVATEQYGVVSVVVVTNNQAGNSEQGTAE

SEQ ID NO: 155023 - protein, 35 aa, Artificial Sequence
  Description of Artificial Sequence: Synthetic polypeptide
DENEICTTNPVATEQYGSVFAWTYNPQTQQSNQIM

SEQ ID NO: 155024 - protein, 34 aa, Artificial Sequence
  Description of Artificial Sequence: Synthetic polypeptide
DEAEIRTTNPVATECWGSVSWCIDEPTYRGGENE

SEQ ID NO: 155025 - protein, 32 aa, Artificial Sequence
  Description of Artificial Sequence: Synthetic polypeptide
DENEIFTTNPVSTEPYGTISMVDIQQQQNGNH

SEQ ID NO: 155026 - protein, 35 aa, Artificial Sequence
  Description of Artificial Sequence: Synthetic polypeptide
DENEIRTTNPVATEGYGCVCSWGELNQNFGSDNQS

SEQ ID NO: 155027 - protein, 35 aa, Artificial Sequence
  Description of Artificial Sequence: Synthetic polypeptide
DEGEIATTNPVATEQYGSVCAANGVLPEDGENQDQ

SEQ ID NO: 155028 - protein, 36 aa, Artificial Sequence
  Description of Artificial Sequence: Synthetic polypeptide
DENEIRTTNPVATEFYGSVMSDQNDLDQTGGQTGFT

SEQ ID NO: 155029 - protein, 30 aa, Artificial Sequence
  Description of Artificial Sequence: Synthetic polypeptide
DENEIHTTNPVATEQWGDVSEIEMNAAEDA

SEQ ID NO: 155030 - protein, 31 aa, Artificial Sequence
  Description of Artificial Sequence: Synthetic polypeptide
DENEIHTTNPVATEQWGDVSEIEMNAAEHDA

SEQ ID NO: 155031 - protein, 36 aa, Artificial Sequence
  Description of Artificial Sequence: Synthetic polypeptide
DEEVIRTTNPVAEEQYGCVVVVSTNAHSDNTGGNNR

SEQ ID NO: 155032 - protein, 36 aa, Artificial Sequence
  Description of Artificial Sequence: Synthetic polypeptide
DDEEIRTTNPVATEQYGSVSTMDIVNGEGGGEEEGS

SEQ ID NO: 155033 - protein, 34 aa, Artificial Sequence
  Description of Artificial Sequence: Synthetic polypeptide
DEGEIATTNPVATEQYGSVCAADNHGQDSDINHH

SEQ ID NO: 155034 - protein, 35 aa, Artificial Sequence
  Description of Artificial Sequence: Synthetic polypeptide
DEEVIRTTNPVATECYGKHHSTWNSELQPPSNEMF

SEQ ID NO: 155035 - protein, 34 aa, Artificial Sequence
  Description of Artificial Sequence: Synthetic polypeptide
DEEVIRTTNPVATECYGKHSSTWTSELQPPSNEF

SEQ ID NO: 155036 - protein, 36 aa, Artificial Sequence
  Description of Artificial Sequence: Synthetic polypeptide
DENEIRTTNPVATEFYGSVNSDTNMVNEGGNFEGGD

SEQ ID NO: 155037 - protein, 36 aa, Artificial Sequence
  Description of Artificial Sequence: Synthetic polypeptide
DEEVIRTTNPVATECYGSVSSTTPAGPNMRNGMNPV

SEQ ID NO: 155038 - protein, 37 aa, Artificial Sequence
  Description of Artificial Sequence: Synthetic polypeptide
DEEEIRTTNPVATEQYGVVSVVVVTNTEQGNNQEEED

SEQ ID NO: 155039 - protein, 30 aa, Artificial Sequence
  Description of Artificial Sequence: Synthetic polypeptide
DENEIRTTNPVATEEWGDVSEMEMNAAEDA

SEQ ID NO: 155040 - protein, 30 aa, Artificial Sequence
  Description of Artificial Sequence: Synthetic polypeptide
DENEIRTTNPVATEEWGDVSEIEMNAAEDA

SEQ ID NO: 155041 - protein, 36 aa, Artificial Sequence
  Description of Artificial Sequence: Synthetic polypeptide
DDEEIRTTNPVATEQYGSVSTMDIQNGIDGGEEEGG

SEQ ID NO: 155042 - protein, 34 aa, Artificial Sequence
  Description of Artificial Sequence: Synthetic polypeptide
DEAEIRTTNPVATECWGSVSCINEPEVRDGEKIE

SEQ ID NO: 155043 - protein, 34 aa, Artificial Sequence
  Description of Artificial Sequence: Synthetic polypeptide
DEAEIRTTNPVATECWGSVSCIEEPQDREGESTG

SEQ ID NO: 155044 - protein, 38 aa, Artificial Sequence
  Description of Artificial Sequence: Synthetic polypeptide
DEEEIRTTNPVATEQYGVVSVVVVTNTQAGNDEQGEAE

SEQ ID NO: 155045 - protein, 34 aa, Artificial Sequence
  Description of Artificial Sequence: Synthetic polypeptide
DDEEIRTTNPVATEQWGCVTSTEHNIENFGSDAS

SEQ ID NO: 155046 - protein, 31 aa, Artificial Sequence
  Description of Artificial Sequence: Synthetic polypeptide
DENEIRTTNPVATEFWGDVSNDIEMNAAEDA

SEQ ID NO: 155047 - protein, 31 aa, Artificial Sequence
  Description of Artificial Sequence: Synthetic polypeptide
DENEIRTTNPVATEQWGDVSKRIEMNAAEDA

SEQ ID NO: 155048 - protein, 34 aa, Artificial Sequence
  Description of Artificial Sequence: Synthetic polypeptide
DEGEIATTNPVATEQYGSVCAAMHGQDSDGNDTW

SEQ ID NO: 155049 - protein, 30 aa, Artificial Sequence
  Description of Artificial Sequence: Synthetic polypeptide
DENEIHTTNPVATEQWGDVSEHEMNAAEDA

SEQ ID NO: 155050 - protein, 35 aa, Artificial Sequence
  Description of Artificial Sequence: Synthetic polypeptide
DEGEIATTNPVATEQYGSVCAANANDQDMPGENAN

SEQ ID NO: 155051 - protein, 36 aa, Artificial Sequence
  Description of Artificial Sequence: Synthetic polypeptide
DEEVINTTNPVATEQYGIKVVPSTNLSDPRVGSPEF

SEQ ID NO: 155052 - protein, 30 aa, Artificial Sequence
  Description of Artificial Sequence: Synthetic polypeptide
DENEIGTTNPVATEQWGDVSEIEMDAAEDA

SEQ ID NO: 155053 - protein, 30 aa, Artificial Sequence
  Description of Artificial Sequence: Synthetic polypeptide
DENEIGTTNPVATEQWGDVSEIEMNAAEDA

SEQ ID NO: 155054 - protein, 31 aa, Artificial Sequence
  Description of Artificial Sequence: Synthetic polypeptide
DENEIRTTNPVATEGWGDVSEIEMNAAEDAS

SEQ ID NO: 155055 - protein, 30 aa, Artificial Sequence
  Description of Artificial Sequence: Synthetic polypeptide
DENEIRTTNPVATEGWGDVSEIEMNAAEDA

SEQ ID NO: 155056 - protein, 31 aa, Artificial Sequence
  Description of Artificial Sequence: Synthetic polypeptide
DENEIGTTNPVATEQWGDVSEIEMNAAEDAW

SEQ ID NO: 155057 - protein, 35 aa, Artificial Sequence
  Description of Artificial Sequence: Synthetic polypeptide
DEAEIRTTNPVATECWGSVSCINEQQVSDGENIEP

SEQ ID NO: 155058 - protein, 30 aa, Artificial Sequence
  Description of Artificial Sequence: Synthetic polypeptide
DENEIHTTNPVATEQWGDVSEIEINAAEDA

SEQ ID NO: 155059 - protein, 30 aa, Artificial Sequence
  Description of Artificial Sequence: Synthetic polypeptide
DENEIRTTNPVATEGWGDVAEIIQSAAEDA

SEQ ID NO: 155060 - protein, 33 aa, Artificial Sequence
  Description of Artificial Sequence: Synthetic polypeptide
DEGEIATTNPVATEQYGSVCAAMHGTDSGENDH

SEQ ID NO: 155061 - protein, 34 aa, Artificial Sequence
  Description of Artificial Sequence: Synthetic polypeptide
DEEVIRATNPVATDQYGFVSMTVLFQTGGGEDES

SEQ ID NO: 155062 - protein, 34 aa, Artificial Sequence
  Description of Artificial Sequence: Synthetic polypeptide
DEGEIATTNPVATEQYGSVCAAMHGQDSNGNDAH

SEQ ID NO: 155063 - protein, 36 aa, Artificial Sequence
  Description of Artificial Sequence: Synthetic polypeptide
DDEEIRTTNPVATEQYGSVSTMWGDVQQIGGDQEKT

SEQ ID NO: 155064 - protein, 32 aa, Artificial Sequence
  Description of Artificial Sequence: Synthetic polypeptide
DENEIGTTNPVSTEPYGTISMEDLQQQQNGNH

SEQ ID NO: 155065 - protein, 34 aa, Artificial Sequence
  Description of Artificial Sequence: Synthetic polypeptide
DEGEIATTNPVATEQYGSVCAAMHGQDSDGNGEH

SEQ ID NO: 155066 - protein, 33 aa, Artificial Sequence
  Description of Artificial Sequence: Synthetic polypeptide
DEEVIRCTNPVATEQYGASHSWRNSFEMGGKFI

SEQ ID NO: 155067 - protein, 32 aa, Artificial Sequence
  Description of Artificial Sequence: Synthetic polypeptide
DENEIGTTNPVSTEPYGTISMSDGQVQQNGNH

SEQ ID NO: 155068 - protein, 34 aa, Artificial Sequence
  Description of Artificial Sequence: Synthetic polypeptide
DEAEIRTTNPCATEYWGSVSGGNADDERNGNGNS

SEQ ID NO: 155069 - protein, 37 aa, Artificial Sequence
  Description of Artificial Sequence: Synthetic polypeptide
DEEEIRTTNPVATEQYGVVMSTGFQGGDGELDGNTEQ

SEQ ID NO: 155070 - protein, 31 aa, Artificial Sequence
  Description of Artificial Sequence: Synthetic polypeptide
DENEIRTTNPVATEQWGDVSLEIEMNAAEDA

SEQ ID NO: 155071 - protein, 31 aa, Artificial Sequence
  Description of Artificial Sequence: Synthetic polypeptide
DENEIRTTNPVATEQWGDVSMEIEMNAAECA

SEQ ID NO: 155072 - protein, 31 aa, Artificial Sequence
  Description of Artificial Sequence: Synthetic polypeptide
DDSEIASTNPVCTEGYGNVAADTLQSRVGQR

SEQ ID NO: 155073 - protein, 32 aa, Artificial Sequence
  Description of Artificial Sequence: Synthetic polypeptide
DEACIRTTNPVAYEQYSEEVTTTGDNHNGNSR

SEQ ID NO: 155074 - protein, 37 aa, Artificial Sequence
  Description of Artificial Sequence: Synthetic polypeptide
DEEEIRTTNPVATEQYGSVSVTVVNNNNDEQGTEEQD

SEQ ID NO: 155075 - protein, 38 aa, Artificial Sequence
  Description of Artificial Sequence: Synthetic polypeptide
DEEEIRTTNPVATEQYGSVSVTVVNNNNNTEQGTEEND

SEQ ID NO: 155076 - protein, 33 aa, Artificial Sequence
  Description of Artificial Sequence: Synthetic polypeptide
DDSEIASTNPVATEQYGTVCSANDGIVEFVGNR

SEQ ID NO: 155077 - protein, 32 aa, Artificial Sequence
  Description of Artificial Sequence: Synthetic polypeptide
DDSEIASTNPVATEQYGTVAANDTIQSRVGQD

SEQ ID NO: 155078 - protein, 36 aa, Artificial Sequence
  Description of Artificial Sequence: Synthetic polypeptide
DENEIRTTNPVATEQYGSVWSDTVDALVGEGEMQQF

SEQ ID NO: 155079 - protein, 38 aa, Artificial Sequence
  Description of Artificial Sequence: Synthetic polypeptide
DENEIRTTNPVATEQYGSVWSDTLNPDNQLEGGMQQER

SEQ ID NO: 155080 - protein, 34 aa, Artificial Sequence
  Description of Artificial Sequence: Synthetic polypeptide
DEAEIRTTNPVATEQYGSSCPAVNGTAEDEGSEM

SEQ ID NO: 155081 - protein, 34 aa, Artificial Sequence
  Description of Artificial Sequence: Synthetic polypeptide
DEAEIRTTNPVATEQYGSSCPAVHGNAEGEGQEM

SEQ ID NO: 155082 - protein, 35 aa, Artificial Sequence
  Description of Artificial Sequence: Synthetic polypeptide
DENEIRTTNPVATEQYGSVWELPQMEQRMDNEIGD

SEQ ID NO: 155083 - protein, 35 aa, Artificial Sequence
  Description of Artificial Sequence: Synthetic polypeptide
DENEIRTTNPVATEQYGSVVVMNGFNGEGGQDNTG

SEQ ID NO: 155084 - protein, 34 aa, Artificial Sequence
  Description of Artificial Sequence: Synthetic polypeptide
DDEEIRSTNPVATEQYGQCSCSTEHNQNFGSQQA

SEQ ID NO: 155085 - protein, 35 aa, Artificial Sequence
  Description of Artificial Sequence: Synthetic polypeptide
DEAEIRTTNPVATEQYGSSCPAVAGNAEREGQDEM

SEQ ID NO: 155086 - protein, 37 aa, Artificial Sequence
  Description of Artificial Sequence: Synthetic polypeptide
DENEIRTTNPVATEQYGSVVSSGIMLEELRNGNEEVG

SEQ ID NO: 155087 - protein, 36 aa, Artificial Sequence
  Description of Artificial Sequence: Synthetic polypeptide
DEAEIRTTNPVATEQYGSSCPAVAGNAEREGNQEDD

SEQ ID NO: 155088 - protein, 35 aa, Artificial Sequence
  Description of Artificial Sequence: Synthetic polypeptide
DEAEIRTTNPVATEQYGSSCPAVAGMAEREGQQER

SEQ ID NO: 155089 - protein, 36 aa, Artificial Sequence
  Description of Artificial Sequence: Synthetic polypeptide
DEGEIRTTNPVATEQYGSVWMVTDISLETREGQDDD

SEQ ID NO: 155090 - protein, 38 aa, Artificial Sequence
  Description of Artificial Sequence: Synthetic polypeptide
DEEEIRTTNPVATEQYGVVSTVVTTNQQAGNQQGTEDD

SEQ ID NO: 155091 - protein, 39 aa, Artificial Sequence
  Description of Artificial Sequence: Synthetic polypeptide
DEEEIRTTNPVATEQYGSVSVTVTNQQISTTEQGTNQSN

SEQ ID NO: 155092 - protein, 34 aa, Artificial Sequence
  Description of Artificial Sequence: Synthetic polypeptide
DENEIRTTNPVATEQYGSVYAANSNQESDQESMM

SEQ ID NO: 155093 - protein, 31 aa, Artificial Sequence
  Description of Artificial Sequence: Synthetic polypeptide
DDSEIASTNPVSTEGWGSVAANNEQDRVGQR

SEQ ID NO: 155094 - protein, 38 aa, Artificial Sequence
  Description of Artificial Sequence: Synthetic polypeptide
DEEEIRTTNPVATEQYGSVSVTVNNNNNEQGTNANTTD

SEQ ID NO: 155095 - protein, 31 aa, Artificial Sequence
  Description of Artificial Sequence: Synthetic polypeptide
DDSEIASTNPVSTEGWGNVAANTIQDRVGNR

SEQ ID NO: 155096 - protein, 31 aa, Artificial Sequence
  Description of Artificial Sequence: Synthetic polypeptide
DDSEIASTNPVSTEGWGNVAANTIQDREGNR

SEQ ID NO: 155097 - protein, 37 aa, Artificial Sequence
  Description of Artificial Sequence: Synthetic polypeptide
DEEEIRTTNPVATEQYGVVSTVVTTNNNQQSTEQGTE

SEQ ID NO: 155098 - protein, 30 aa, Artificial Sequence
  Description of Artificial Sequence: Synthetic polypeptide
CENEIATTNPVAYEPYGKVSSHLSQHETEE

SEQ ID NO: 155099 - protein, 36 aa, Artificial Sequence
  Description of Artificial Sequence: Synthetic polypeptide
DENEIRTTNPVATEQYGSVYSCTGLMEEFGGGSIIM

SEQ ID NO: 155100 - protein, 35 aa, Artificial Sequence
  Description of Artificial Sequence: Synthetic polypeptide
DENEIRTTNPVATEQYGSVYPTPYLQDIIEEQFEI

SEQ ID NO: 155101 - protein, 35 aa, Artificial Sequence
  Description of Artificial Sequence: Synthetic polypeptide
DEEEISTTNPVATEQYGVVCSMTNEHQENFPSDQA

SEQ ID NO: 155102 - protein, 36 aa, Artificial Sequence
  Description of Artificial Sequence: Synthetic polypeptide
DEEEIRTTNPVATEQYGSVSVTVQNDMANDILMELM

SEQ ID NO: 155103 - protein, 38 aa, Artificial Sequence
  Description of Artificial Sequence: Synthetic polypeptide
DEEEIRTTNPVATEQYGVVSTVVTTNNQAGNQQGVTDD

SEQ ID NO: 155104 - protein, 35 aa, Artificial Sequence
  Description of Artificial Sequence: Synthetic polypeptide
DENEIRTTNPVATEQYGSVYMWNYMIQTESSEERA

SEQ ID NO: 155105 - protein, 35 aa, Artificial Sequence
  Description of Artificial Sequence: Synthetic polypeptide
DENEIRTTNPVATEQYGSVYEFDNLENRIEVEQIM

SEQ ID NO: 155106 - protein, 35 aa, Artificial Sequence
  Description of Artificial Sequence: Synthetic polypeptide
DENEIRTTNPVATEQYGSVYEEDYLENRIEVNQIT

SEQ ID NO: 155107 - protein, 39 aa, Artificial Sequence
  Description of Artificial Sequence: Synthetic polypeptide
DEEEIRTTNPVATEQYGSVSVTVTNLQQSTTEQGTTQDN

SEQ ID NO: 155108 - protein, 38 aa, Artificial Sequence
  Description of Artificial Sequence: Synthetic polypeptide
DEEEIRTTNPVATEQYGSVSVTVTNNNNNNEQGTEGQD

SEQ ID NO: 155109 - protein, 39 aa, Artificial Sequence
  Description of Artificial Sequence: Synthetic polypeptide
DEEEIRTTNPVATEQYGSVSVTVTNNQISTTEQGNNNAN

SEQ ID NO: 155110 - protein, 39 aa, Artificial Sequence
  Description of Artificial Sequence: Synthetic polypeptide
DEEEIRTTNPVATEQYGSVSVTVTNNQQSTTEQGTNQES

SEQ ID NO: 155111 - protein, 34 aa, Artificial Sequence
  Description of Artificial Sequence: Synthetic polypeptide
DEAEIRTTNPVATEQYGSSCPAVNVNAESEGQEM

SEQ ID NO: 155112 - protein, 32 aa, Artificial Sequence
  Description of Artificial Sequence: Synthetic polypeptide
DENEIATTNPVATASYGCVAANNGLTQDAGGH

SEQ ID NO: 155113 - protein, 35 aa, Artificial Sequence
  Description of Artificial Sequence: Synthetic polypeptide
DEEEISTTNPVATEQYGVVCSNWEHQENFGSDNQI

SEQ ID NO: 155114 - protein, 34 aa, Artificial Sequence
  Description of Artificial Sequence: Synthetic polypeptide
DEAEIRTTNPVATEQYGSSCPAVAGMAEREGGEM

SEQ ID NO: 155115 - protein, 36 aa, Artificial Sequence
  Description of Artificial Sequence: Synthetic polypeptide
DEAEICTTNPVATECYGSVSTGNQVNQGDLGGNTED

SEQ ID NO: 155116 - protein, 35 aa, Artificial Sequence
  Description of Artificial Sequence: Synthetic polypeptide
DEAEIRTTNPVATEQYGSNVHVSQDANTEEDEEQR

SEQ ID NO: 155117 - protein, 35 aa, Artificial Sequence
  Description of Artificial Sequence: Synthetic polypeptide
DEAEIRTTNPVATEQYGSNIWVNEDETQPEGEDRF

SEQ ID NO: 155118 - protein, 35 aa, Artificial Sequence
  Description of Artificial Sequence: Synthetic polypeptide
DENEIRTTNPVATEQYGSVSVLDANEDPEMQNNQI

SEQ ID NO: 155119 - protein, 34 aa, Artificial Sequence
  Description of Artificial Sequence: Synthetic polypeptide
CEEEIRTTNPVATEQYGSVPPPLLEETMGELEQV

SEQ ID NO: 155120 - protein, 36 aa, Artificial Sequence
  Description of Artificial Sequence: Synthetic polypeptide
DEAEICTTNPVATECYGSVTTGNGLLQDQRGGDGED

SEQ ID NO: 155121 - protein, 31 aa, Artificial Sequence
  Description of Artificial Sequence: Synthetic polypeptide
DENEIATTNPVATECYGDVSCICEPQHEEEL

SEQ ID NO: 155122 - protein, 36 aa, Artificial Sequence
  Description of Artificial Sequence: Synthetic polypeptide
DEGEIRTTNPVATEQYGSVSWTDVVLVEGIQSLTTI

SEQ ID NO: 155123 - protein, 36 aa, Artificial Sequence
  Description of Artificial Sequence: Synthetic polypeptide
DEAEICTTNPVATECYGTVSTGNGLLDDDRGQNDMQ

SEQ ID NO: 155124 - protein, 37 aa, Artificial Sequence
  Description of Artificial Sequence: Synthetic polypeptide
DEAEIRTTNPVATEQYGSLVWSGIMLEELRNGNEDVF

SEQ ID NO: 155125 - protein, 36 aa, Artificial Sequence
  Description of Artificial Sequence: Synthetic polypeptide
DEAEIRTTNPVATEQYGSLVSDTYDVTVQDGEISED

SEQ ID NO: 155126 - protein, 35 aa, Artificial Sequence
  Description of Artificial Sequence: Synthetic polypeptide
DEEEIRTTNPVATEQYGSVSWGYDPMDGQSMEDFY

SEQ ID NO: 155127 - protein, 35 aa, Artificial Sequence
  Description of Artificial Sequence: Synthetic polypeptide
DEEEIRTTNPVATEQYGSVSWIIEEDDAAMNELMQ

SEQ ID NO: 155128 - protein, 35 aa, Artificial Sequence
  Description of Artificial Sequence: Synthetic polypeptide
DEEEIRTTNPVATEQYGSVSWMDEEDDAAMNELQQ

SEQ ID NO: 155129 - protein, 36 aa, Artificial Sequence
  Description of Artificial Sequence: Synthetic polypeptide
DEAEICTTNPVATECYGTVSTGNGLLDDDRGQNEDH

SEQ ID NO: 155130 - protein, 35 aa, Artificial Sequence
  Description of Artificial Sequence: Synthetic polypeptide
DEEEIRTTNPVATEQYGSVSWMIEGDDAAMNELGQ

SEQ ID NO: 155131 - protein, 38 aa, Artificial Sequence
  Description of Artificial Sequence: Synthetic polypeptide
DEEEIRTTNPVATEQYGVVSTVVTVNDQQGTNQEEEDE

SEQ ID NO: 155132 - protein, 35 aa, Artificial Sequence
  Description of Artificial Sequence: Synthetic polypeptide
DEGEIRTTNPVATEQYGSVTAENDHTQETGFEDGD

SEQ ID NO: 155133 - protein, 29 aa, Artificial Sequence
  Description of Artificial Sequence: Synthetic peptide
DENEIATTNPVATECYGDVAADWAHEEYL

SEQ ID NO: 155134 - protein, 31 aa, Artificial Sequence
  Description of Artificial Sequence: Synthetic polypeptide
DENEIATTNPVATECYGDISEECIQQQQGEH

SEQ ID NO: 155135 - protein, 35 aa, Artificial Sequence
  Description of Artificial Sequence: Synthetic polypeptide
DEEEIRTTNPVATEQYGSVSWDYDPMDLLSMEDKY

SEQ ID NO: 155136 - protein, 36 aa, Artificial Sequence
  Description of Artificial Sequence: Synthetic polypeptide
DENEIRTTNPVATEQYGSVTSTTCDMENRPEVSEED

SEQ ID NO: 155137 - protein, 35 aa, Artificial Sequence
  Description of Artificial Sequence: Synthetic polypeptide
DEEEISTTNPVATEQYGVVCSTGETQENFNSNTQA

SEQ ID NO: 155138 - protein, 35 aa, Artificial Sequence
  Description of Artificial Sequence: Synthetic polypeptide
DENEIRTTNPVATEQYGSVTNCVDITQMRDTDEGQ

SEQ ID NO: 155139 - protein, 35 aa, Artificial Sequence
  Description of Artificial Sequence: Synthetic polypeptide
DENEIRTTNPVATEQYGSVTITTMFQTESNQESGN

SEQ ID NO: 155140 - protein, 34 aa, Artificial Sequence
  Description of Artificial Sequence: Synthetic polypeptide
DENEIRTTNPVATEQYGSVTCVVDLNQPNSQIEQ

SEQ ID NO: 155141 - protein, 35 aa, Artificial Sequence
  Description of Artificial Sequence: Synthetic polypeptide
DEEEIRTTNPVATEQYGSVSVVVAALMSETSMEEV

SEQ ID NO: 155142 - protein, 37 aa, Artificial Sequence
  Description of Artificial Sequence: Synthetic polypeptide
DENEIRTTNPVATEQYGSVSYNDNNNTQMEVNQFDRN

SEQ ID NO: 155143 - protein, 39 aa, Artificial Sequence
  Description of Artificial Sequence: Synthetic polypeptide
DEEEIRTTNPVATEQYGSVSVVVATQQNGQQGTTNATNE

SEQ ID NO: 155144 - protein, 35 aa, Artificial Sequence
  Description of Artificial Sequence: Synthetic polypeptide
DENEIRTTNPVATEQYGSVTWTVDNIAETEFMNPM

SEQ ID NO: 155145 - protein, 36 aa, Artificial Sequence
  Description of Artificial Sequence: Synthetic polypeptide
DEAEIRTTNPVATEQYGSSCPAAVAGNAEREGQERV

SEQ ID NO: 155146 - protein, 37 aa, Artificial Sequence
  Description of Artificial Sequence: Synthetic polypeptide
DENEIRTTNPVATEQYGSVSWPENWNEEIPEGAQNRN

SEQ ID NO: 155147 - protein, 30 aa, Artificial Sequence
  Description of Artificial Sequence: Synthetic polypeptide
DENEIATTNPVATECWGDTTSACLQEHEEL

SEQ ID NO: 155148 - protein, 30 aa, Artificial Sequence
  Description of Artificial Sequence: Synthetic polypeptide
DENEIATTNPVATECWGDVSECLMNAAEDA

SEQ ID NO: 155149 - protein, 29 aa, Artificial Sequence
  Description of Artificial Sequence: Synthetic peptide
DENEIATTNPVATECWGDVSEIEMAAEDL

SEQ ID NO: 155150 - protein, 36 aa, Artificial Sequence
  Description of Artificial Sequence: Synthetic polypeptide
DEEEIRTTNPVATEQYGSVSWCYPPMQLQSMEDFYQ

SEQ ID NO: 155151 - protein, 35 aa, Artificial Sequence
  Description of Artificial Sequence: Synthetic polypeptide
DENEIRTTNPVATEQYGSVSVTDVEGTEFSENTSP

SEQ ID NO: 155152 - protein, 29 aa, Artificial Sequence
  Description of Artificial Sequence: Synthetic peptide
DENEIATTNPVATECWGDVSEIEMAAEEL

SEQ ID NO: 155153 - protein, 29 aa, Artificial Sequence
  Description of Artificial Sequence: Synthetic peptide
DENEIATTNPVATECWGDVSEIEMNHEEA

SEQ ID NO: 155154 - protein, 34 aa, Artificial Sequence
  Description of Artificial Sequence: Synthetic polypeptide
CEEEIRTTNPVATEQYGSVDTTTMDNGGGEDQGE

SEQ ID NO: 155155 - protein, 36 aa, Artificial Sequence
  Description of Artificial Sequence: Synthetic polypeptide
DEAEICTTNPVATECYGTVSTGNGLLDDDRGQNMED

SEQ ID NO: 155156 - protein, 34 aa, Artificial Sequence
  Description of Artificial Sequence: Synthetic polypeptide
DEGEIRTTNPVATEQYGSVWVVDYETQFEGVEDQ

SEQ ID NO: 155157 - protein, 35 aa, Artificial Sequence
  Description of Artificial Sequence: Synthetic polypeptide
DENEIRTTNPVATEQYGSVYTWNMGPTESSEEHRA

SEQ ID NO: 155158 - protein, 38 aa, Artificial Sequence
  Description of Artificial Sequence: Synthetic polypeptide
DEEEIRTTNPVATEQYGVVSTVVTNQQQQQGTNNTTTD

SEQ ID NO: 155159 - protein, 32 aa, Artificial Sequence
  Description of Artificial Sequence: Synthetic polypeptide
DDSEIASTNPVSTEGYGNVAATTLQSRVGQDR

SEQ ID NO: 155160 - protein, 30 aa, Artificial Sequence
  Description of Artificial Sequence: Synthetic polypeptide
DENEIRTTNPVATESWGDVSEIEMNAAEDA

SEQ ID NO: 155161 - protein, 30 aa, Artificial Sequence
  Description of Artificial Sequence: Synthetic polypeptide
DENEIRTTNPVATERWGDVSEIEMNAAEDA

SEQ ID NO: 155162 - protein, 31 aa, Artificial Sequence
  Description of Artificial Sequence: Synthetic polypeptide
DENEIRTTNPVATEQYWGDTSEIEMNAAVDA

SEQ ID NO: 155163 - protein, 31 aa, Artificial Sequence
  Description of Artificial Sequence: Synthetic polypeptide
DDSEIASTNPVSTEGYGNVAATTIQSRVGQR

SEQ ID NO: 155164 - protein, 34 aa, Artificial Sequence
  Description of Artificial Sequence: Synthetic polypeptide
DENEIRTTNPVATEQYGWCASVTHDLNTGEEQQY

SEQ ID NO: 155165 - protein, 38 aa, Artificial Sequence
  Description of Artificial Sequence: Synthetic polypeptide
DEEEIRTTNPVATEQYGVVSTVVTNTEQGNNNVEQGNE

SEQ ID NO: 155166 - protein, 30 aa, Artificial Sequence
  Description of Artificial Sequence: Synthetic polypeptide
DENEIATTNPIATECYGATWSACLQPEEYL

SEQ ID NO: 155167 - protein, 31 aa, Artificial Sequence
  Description of Artificial Sequence: Synthetic polypeptide
DDSEIASTNPVSTEGYGNVAANTNQSRVGQR

SEQ ID NO: 155168 - protein, 30 aa, Artificial Sequence
  Description of Artificial Sequence: Synthetic polypeptide
DENEIATTNPIATECYGATWSACLQPEPYI

SEQ ID NO: 155169 - protein, 30 aa, Artificial Sequence
  Description of Artificial Sequence: Synthetic polypeptide
DDSEIASTNPVSTEGYGNVAANTIQSSGQR

SEQ ID NO: 155170 - protein, 31 aa, Artificial Sequence
  Description of Artificial Sequence: Synthetic polypeptide
DDSEIASTNPVSTEGYGNVAANTIQSRVGQR

SEQ ID NO: 155171 - protein, 31 aa, Artificial Sequence
  Description of Artificial Sequence: Synthetic polypeptide
DDSEIASTNPVSTEGYGNVAANTIQSRVGNH

SEQ ID NO: 155172 - protein, 35 aa, Artificial Sequence
  Description of Artificial Sequence: Synthetic polypeptide
DENEIRTTNPVATEQYGVVVDDFNVGQGEGEENEE

SEQ ID NO: 155173 - protein, 39 aa, Artificial Sequence
  Description of Artificial Sequence: Synthetic polypeptide
DEEEIRTTNPVATEQYGSVSVTNTNNQISTTEQGTTNGM

SEQ ID NO: 155174 - protein, 31 aa, Artificial Sequence
  Description of Artificial Sequence: Synthetic polypeptide
DDSEIASTNPVSTEGYGNVAANTIQSRVGDR

SEQ ID NO: 155175 - protein, 29 aa, Artificial Sequence
  Description of Artificial Sequence: Synthetic peptide
DDSEIASTNPVSTEGYGNVANTIQRVEQR

SEQ ID NO: 155176 - protein, 38 aa, Artificial Sequence
  Description of Artificial Sequence: Synthetic polypeptide
DEEEIRTTNPVATEQYGVVSTVVTNQQQQQGNNTTNNT

SEQ ID NO: 155177 - protein, 36 aa, Artificial Sequence
  Description of Artificial Sequence: Synthetic polypeptide
CEEEIRTTNPVATEQYGQCVCSTGELEQEYFNSDQA

SEQ ID NO: 155178 - protein, 30 aa, Artificial Sequence
  Description of Artificial Sequence: Synthetic polypeptide
DDSEIASTNPVSTEGYGNVANTIQSRVGQR

SEQ ID NO: 155179 - protein, 34 aa, Artificial Sequence
  Description of Artificial Sequence: Synthetic polypeptide
DDSEIASTNPVSTEGYGSVSACINIPQSRVGENR

SEQ ID NO: 155180 - protein, 30 aa, Artificial Sequence
  Description of Artificial Sequence: Synthetic polypeptide
DENEIRTTNPVATEWWGDVSEIEMNAMEDA

SEQ ID NO: 155181 - protein, 31 aa, Artificial Sequence
  Description of Artificial Sequence: Synthetic polypeptide
DENEIRTTNPVATEWWGDVSEIEMNAAEDAP

SEQ ID NO: 155182 - protein, 30 aa, Artificial Sequence
  Description of Artificial Sequence: Synthetic polypeptide
DENEIRTTNPVATEWWGDVSEIEMNAAEDA

SEQ ID NO: 155183 - protein, 38 aa, Artificial Sequence
  Description of Artificial Sequence: Synthetic polypeptide
DEEEIRTTNPVATEQYGVVSTVVTNQQQGTEQGTNQGQ

SEQ ID NO: 155184 - protein, 32 aa, Artificial Sequence
  Description of Artificial Sequence: Synthetic polypeptide
DDSEIASTNPVSTEGYGSVAANITIQSRVGQR

SEQ ID NO: 155185 - protein, 37 aa, Artificial Sequence
  Description of Artificial Sequence: Synthetic polypeptide
DEEEIRTTNPVATEQYGVVSTVVTNQQQGTTTTEEED

SEQ ID NO: 155186 - protein, 38 aa, Artificial Sequence
  Description of Artificial Sequence: Synthetic polypeptide
DEEEIRTTNPVATEQYGVVSTVVTNQQQQQGNNNETND

SEQ ID NO: 155187 - protein, 29 aa, Artificial Sequence
  Description of Artificial Sequence: Synthetic peptide
DENEIATTNPIATECYGDVAAECLAPEEI

SEQ ID NO: 155188 - protein, 36 aa, Artificial Sequence
  Description of Artificial Sequence: Synthetic polypeptide
DENEIRTTNPVATEVYGSVSTNTDGEGQEEQGQEEQ

SEQ ID NO: 155189 - protein, 30 aa, Artificial Sequence
  Description of Artificial Sequence: Synthetic polypeptide
DENEIRTTNPVATEVWGIVSEIEMNAAEDA

SEQ ID NO: 155190 - protein, 31 aa, Artificial Sequence
  Description of Artificial Sequence: Synthetic polypeptide
DENEIRTTNPVATEVWGDVSETIEMNAAEDA

SEQ ID NO: 155191 - protein, 30 aa, Artificial Sequence
  Description of Artificial Sequence: Synthetic polypeptide
DENEIRTTNPVATEVWGDVSEIEMNAAEDA

SEQ ID NO: 155192 - protein, 30 aa, Artificial Sequence
  Description of Artificial Sequence: Synthetic polypeptide
DENEIRTTNPVATETWGWVSEIEMNAAEDA

SEQ ID NO: 155193 - protein, 30 aa, Artificial Sequence
  Description of Artificial Sequence: Synthetic polypeptide
DENEIRTTNPVATETWGDVSEIEMNAAEDT

SEQ ID NO: 155194 - protein, 31 aa, Artificial Sequence
  Description of Artificial Sequence: Synthetic polypeptide
DENEIRTTNPVATETWGDVSEIEMNAAEDQA

SEQ ID NO: 155195 - protein, 30 aa, Artificial Sequence
  Description of Artificial Sequence: Synthetic polypeptide
DENEIRTTNPVATETWGDVSEIEMNAAEDA

SEQ ID NO: 155196 - protein, 30 aa, Artificial Sequence
  Description of Artificial Sequence: Synthetic polypeptide
DDSEIASTNPVSTEGYGNVANTIQSRVGTR

SEQ ID NO: 155197 - protein, 31 aa, Artificial Sequence
  Description of Artificial Sequence: Synthetic polypeptide
DDSEIASTNPVSTEGYGNVSMTIQQQRVGQH

SEQ ID NO: 155198 - protein, 31 aa, Artificial Sequence
  Description of Artificial Sequence: Synthetic polypeptide
DDSEIASTNPVSTEGYGEVAANTIQSRVGQR

SEQ ID NO: 155199 - protein, 37 aa, Artificial Sequence
  Description of Artificial Sequence: Synthetic polypeptide
DEEEIRTTNPVATEQYGSYAEPTCLMEQTRDEVEGTA

SEQ ID NO: 155200 - protein, 33 aa, Artificial Sequence
  Description of Artificial Sequence: Synthetic polypeptide
DENEIRTTNPVATEQYGVCSPAVEWDIGSNQQN

SEQ ID NO: 155201 - protein, 31 aa, Artificial Sequence
  Description of Artificial Sequence: Synthetic polypeptide
DDSEIASTNPVSTEGYGNAAAENLQSRVGGR

SEQ ID NO: 155202 - protein, 31 aa, Artificial Sequence
  Description of Artificial Sequence: Synthetic polypeptide
DDSEIASTNPVSTEGYGIVAANTIQSRVGQR

SEQ ID NO: 155203 - protein, 34 aa, Artificial Sequence
  Description of Artificial Sequence: Synthetic polypeptide
DENEIRTTNPVATEQYGTISAMEDIQQQQEGNDL

SEQ ID NO: 155204 - protein, 35 aa, Artificial Sequence
  Description of Artificial Sequence: Synthetic polypeptide
DEGEIRTTNPVATEQYGSWCTYEENNQDESGDDHD

SEQ ID NO: 155205 - protein, 38 aa, Artificial Sequence
  Description of Artificial Sequence: Synthetic polypeptide
DEEEIRTTNPVATEQYGVVSTVVTTNNNQQGTNTEDEE

SEQ ID NO: 155206 - protein, 36 aa, Artificial Sequence
  Description of Artificial Sequence: Synthetic polypeptide
DENEIRTTNPVATEQYGSYVYETDNLENRIEVVQIT

SEQ ID NO: 155207 - protein, 37 aa, Artificial Sequence
  Description of Artificial Sequence: Synthetic polypeptide
DEEEIRTTNPVATEQYGVVSTVVTTNNNQQQNTNNEE

SEQ ID NO: 155208 - protein, 34 aa, Artificial Sequence
  Description of Artificial Sequence: Synthetic polypeptide
DENEIRTTNPVATEQYGSYSQVTALGILEIVQPF

SEQ ID NO: 155209 - protein, 35 aa, Artificial Sequence
  Description of Artificial Sequence: Synthetic polypeptide
DENEIRTTNPVATEQYGSYNWTNMDEQHENLNDKI

SEQ ID NO: 155210 - protein, 34 aa, Artificial Sequence
  Description of Artificial Sequence: Synthetic polypeptide
DENEIRTTNPVATEQYGSVYVWNFQDFESLEDFN

SEQ ID NO: 155211 - protein, 35 aa, Artificial Sequence
  Description of Artificial Sequence: Synthetic polypeptide
DENEIRTTNPVATEQYGSVYVTWPMIQDESSEERE

SEQ ID NO: 155212 - protein, 30 aa, Artificial Sequence
  Description of Artificial Sequence: Synthetic polypeptide
DDSEIASTNPVSTEGYGEVANTIQSRVGGR

SEQ ID NO: 155213 - protein, 34 aa, Artificial Sequence
  Description of Artificial Sequence: Synthetic polypeptide
DENEIRTTNPVATEQYGSVYVPVDKDERPNEQHM

SEQ ID NO: 155214 - protein, 36 aa, Artificial Sequence
  Description of Artificial Sequence: Synthetic polypeptide
DEAEIRTTNPVATEQYGSSCPIYVAGNAEREGNQEM

SEQ ID NO: 155215 - protein, 35 aa, Artificial Sequence
  Description of Artificial Sequence: Synthetic polypeptide
DENEIRTTNPVATEQYGSVYTWNPMILTESSEETA

SEQ ID NO: 155216 - protein, 34 aa, Artificial Sequence
  Description of Artificial Sequence: Synthetic polypeptide
DENEIRTTNPVATEQYGSVYTWNMITDESSEETA

SEQ ID NO: 155217 - protein, 35 aa, Artificial Sequence
  Description of Artificial Sequence: Synthetic polypeptide
DENEIRTTNPVATEQYGSVYTWNMIQFESSEEHTD

SEQ ID NO: 155218 - protein, 39 aa, Artificial Sequence
  Description of Artificial Sequence: Synthetic polypeptide
DEEEIRTTNPVATEQYGSVSVTTTNNQQSTTEQGTNQGN

SEQ ID NO: 155219 - protein, 36 aa, Artificial Sequence
  Description of Artificial Sequence: Synthetic polypeptide
DEEEIRTTNPVATEQYGSVSVTTMMIFTSSDDANDI

SEQ ID NO: 155220 - protein, 31 aa, Artificial Sequence
  Description of Artificial Sequence: Synthetic polypeptide
DDSEIASTNPVSTEGYGNAAAENLQSRVGQR

SEQ ID NO: 155221 - protein, 38 aa, Artificial Sequence
  Description of Artificial Sequence: Synthetic polypeptide
DEEEIRTTNPVATEQYGVVSTVVTTNNNQQGTNQDEDD

SEQ ID NO: 155222 - protein, 37 aa, Artificial Sequence
  Description of Artificial Sequence: Synthetic polypeptide
DEEEIRTTNPVATEQYGVVSTVVTTNLEAGTTTEETD

SEQ ID NO: 155223 - protein, 38 aa, Artificial Sequence
  Description of Artificial Sequence: Synthetic polypeptide
DEEEIRTTNPVATEQYGVVSTVVTTNLNEQGNTTEETE

SEQ ID NO: 155224 - protein, 30 aa, Artificial Sequence
  Description of Artificial Sequence: Synthetic polypeptide
DDSEIASTNPVSTEGYGNVAANNIQSSGQR

SEQ ID NO: 155225 - protein, 31 aa, Artificial Sequence
  Description of Artificial Sequence: Synthetic polypeptide
DDSEIASTNPVSTEGYGNVAANNIQSRVGQR

SEQ ID NO: 155226 - protein, 38 aa, Artificial Sequence
  Description of Artificial Sequence: Synthetic polypeptide
DEEEIRTTNPVATEQYGVVSTVVTTNNATEQYGNNQDD

SEQ ID NO: 155227 - protein, 30 aa, Artificial Sequence
  Description of Artificial Sequence: Synthetic polypeptide
DENEIATTNPVASEQWGDVSEIEMNAAEDR

SEQ ID NO: 155228 - protein, 33 aa, Artificial Sequence
  Description of Artificial Sequence: Synthetic polypeptide
DENEIATTNPVATAAWGSVSGINEPQDQGGENG

SEQ ID NO: 155229 - protein, 35 aa, Artificial Sequence
  Description of Artificial Sequence: Synthetic polypeptide
CEEEIRTTNPVATEQYGQCVCSWGELQNFNSDPQS

SEQ ID NO: 155230 - protein, 33 aa, Artificial Sequence
  Description of Artificial Sequence: Synthetic polypeptide
DDEEIRSTNPVATEQYGCVCSTEHIENSGSQQA

SEQ ID NO: 155231 - protein, 38 aa, Artificial Sequence
  Description of Artificial Sequence: Synthetic polypeptide
DEEEIRTTNPVATEQYGVVSTVVTTNNNGNQTGNNQED

SEQ ID NO: 155232 - protein, 36 aa, Artificial Sequence
  Description of Artificial Sequence: Synthetic polypeptide
DEEEIRTTNPVAYEPYGSVYACTDNAISQNKGSPRV

SEQ ID NO: 155233 - protein, 36 aa, Artificial Sequence
  Description of Artificial Sequence: Synthetic polypeptide
DENEIRTTNPVATEQYGTVSTVWLDDEGENPQIDEI

SEQ ID NO: 155234 - protein, 31 aa, Artificial Sequence
  Description of Artificial Sequence: Synthetic polypeptide
DDSEIASTNPVSTEGYGNVAAENIQSRVGQR

SEQ ID NO: 155235 - protein, 36 aa, Artificial Sequence
  Description of Artificial Sequence: Synthetic polypeptide
DEEEIRTTNPVATEQYGSVSVTQTGHEEASQLQETP

SEQ ID NO: 155236 - protein, 30 aa, Artificial Sequence
  Description of Artificial Sequence: Synthetic polypeptide
CENEIATTNPVAYEPYGQVSEHLSQHETDL

SEQ ID NO: 155237 - protein, 35 aa, Artificial Sequence
  Description of Artificial Sequence: Synthetic polypeptide
DEGEIRTTNPVATEQYGSWYSTNDNTQETDEEEQH

SEQ ID NO: 155238 - protein, 34 aa, Artificial Sequence
  Description of Artificial Sequence: Synthetic polypeptide
DEAEIRTTNPVATEQYGSSSDVYDPTVQDRESED

SEQ ID NO: 155239 - protein, 36 aa, Artificial Sequence
  Description of Artificial Sequence: Synthetic polypeptide
DEEEIRTTNPVATEQYGSVSVTTGQPQFEELVPSLL

SEQ ID NO: 155240 - protein, 38 aa, Artificial Sequence
  Description of Artificial Sequence: Synthetic polypeptide
DEEEIRTTNPVATEQYGVVSTVVTTNNNQNAGNDEQGQ

SEQ ID NO: 155241 - protein, 33 aa, Artificial Sequence
  Description of Artificial Sequence: Synthetic polypeptide
DDSEIASTNPVSTEGYGSVSACINIPQSRVGQR

SEQ ID NO: 155242 - protein, 35 aa, Artificial Sequence
  Description of Artificial Sequence: Synthetic polypeptide
CEEEIRTTNPVATEQYGSVSILQSNGEDEGEDQQI

SEQ ID NO: 155243 - protein, 35 aa, Artificial Sequence
  Description of Artificial Sequence: Synthetic polypeptide
CEEEIRTTNPVATEQYGSVSLPVNTEEHTLAAPYT

SEQ ID NO: 155244 - protein, 38 aa, Artificial Sequence
  Description of Artificial Sequence: Synthetic polypeptide
DEEEIRTTNPVATEQYGVVSTVVVTNLEQGNNNEDEDE

SEQ ID NO: 155245 - protein, 31 aa, Artificial Sequence
  Description of Artificial Sequence: Synthetic polypeptide
DENEIATTNPVATEPYGDVSMECIQQQHEEL

SEQ ID NO: 155246 - protein, 32 aa, Artificial Sequence
  Description of Artificial Sequence: Synthetic polypeptide
DENEIATTNPVATEPYGSISMEDIQQQQNGEL

SEQ ID NO: 155247 - protein, 37 aa, Artificial Sequence
  Description of Artificial Sequence: Synthetic polypeptide
DENEIRTTNPVATEQYGSVPYDNLVSQEGNEGGFESI

SEQ ID NO: 155248 - protein, 36 aa, Artificial Sequence
  Description of Artificial Sequence: Synthetic polypeptide
DEGEIRTTNPVATEQYGSVSTIVDWEQTFNGQDVEG

SEQ ID NO: 155249 - protein, 37 aa, Artificial Sequence
  Description of Artificial Sequence: Synthetic polypeptide
DENEIRTTNPVATEQYGSVMTVDALLEQTGGSQEPNI

SEQ ID NO: 155250 - protein, 36 aa, Artificial Sequence
  Description of Artificial Sequence: Synthetic polypeptide
DENEIRTTNPVATEQYGSVMSQNPDIFNIGNGNDDD

SEQ ID NO: 155251 - protein, 35 aa, Artificial Sequence
  Description of Artificial Sequence: Synthetic polypeptide
DENEIRTTNPVATEQYGSVMSQNNIFNEDEMNVGD

SEQ ID NO: 155252 - protein, 33 aa, Artificial Sequence
  Description of Artificial Sequence: Synthetic polypeptide
DEAEIRTTNPVATEQYGSAYTWLMVSESIEDQM

SEQ ID NO: 155253 - protein, 36 aa, Artificial Sequence
  Description of Artificial Sequence: Synthetic polypeptide
DEEEIRTTNPVATEQYGSVSYTENDDHADEASDLEH

SEQ ID NO: 155254 - protein, 33 aa, Artificial Sequence
  Description of Artificial Sequence: Synthetic polypeptide
DENEIATTNPVATEPYGSVAGSGPANPNPGAQY

SEQ ID NO: 155255 - protein, 33 aa, Artificial Sequence
  Description of Artificial Sequence: Synthetic polypeptide
DENEIATTNPVATEPYGSVAGSNPANPNPGAEP

SEQ ID NO: 155256 - protein, 33 aa, Artificial Sequence
  Description of Artificial Sequence: Synthetic polypeptide
DEAEICTTNPVAYEQWGSVCSTWEGEEDHDGND

SEQ ID NO: 155257 - protein, 32 aa, Artificial Sequence
  Description of Artificial Sequence: Synthetic polypeptide
DEAEICTTNPVAYEQWGSVCYNNDQDHGDTDQ

SEQ ID NO: 155258 - protein, 36 aa, Artificial Sequence
  Description of Artificial Sequence: Synthetic polypeptide
DENEIRTTNPVATEQYGSVMPTTNEPHVIEGSNEDV

SEQ ID NO: 155259 - protein, 35 aa, Artificial Sequence
  Description of Artificial Sequence: Synthetic polypeptide
DEAEICTTNPVAYEQWGTVCSTDNDGNNGQRGNAD

SEQ ID NO: 155260 - protein, 37 aa, Artificial Sequence
  Description of Artificial Sequence: Synthetic polypeptide
DENEIRTTNPVATEQYGSVLTPPACNLETGYMEDMND

SEQ ID NO: 155261 - protein, 34 aa, Artificial Sequence
  Description of Artificial Sequence: Synthetic polypeptide
DENEIRTTNPVATEQYGSVQIVTEEVDEYLEERI

SEQ ID NO: 155262 - protein, 34 aa, Artificial Sequence
  Description of Artificial Sequence: Synthetic polypeptide
DENEIRTTNPVATEQYGSVQPTYEVISAAQSDHI

SEQ ID NO: 155263 - protein, 34 aa, Artificial Sequence
  Description of Artificial Sequence: Synthetic polypeptide
DEAEIRTTNPVATEQYGSCRSDMVVLEDEASDNE

SEQ ID NO: 155264 - protein, 35 aa, Artificial Sequence
  Description of Artificial Sequence: Synthetic polypeptide
CEEEIRTTNPVCYEPYGSVSCDPNFSQNRQVGNND

SEQ ID NO: 155265 - protein, 37 aa, Artificial Sequence
  Description of Artificial Sequence: Synthetic polypeptide
DEEEIRTTNPVATEQYGSVSYEANMNQQEIVGSELIE

SEQ ID NO: 155266 - protein, 36 aa, Artificial Sequence
  Description of Artificial Sequence: Synthetic polypeptide
DEEEIRTTNPVATEQYGSVSYENNRIEETPDLINEL

SEQ ID NO: 155267 - protein, 34 aa, Artificial Sequence
  Description of Artificial Sequence: Synthetic polypeptide
DENEIRTTNPVATEQYGSVSDMDETQMETMQITM

SEQ ID NO: 155268 - protein, 35 aa, Artificial Sequence
  Description of Artificial Sequence: Synthetic polypeptide
DENEIRTTNPVATEQYGSVSCVVDDLNQPNSQIES

SEQ ID NO: 155269 - protein, 36 aa, Artificial Sequence
  Description of Artificial Sequence: Synthetic polypeptide
DEEEIRTTNPVATEQYGSVSYEYFMQQIVTEEAGGE

SEQ ID NO: 155270 - protein, 35 aa, Artificial Sequence
  Description of Artificial Sequence: Synthetic polypeptide
DENEIRTTNPVATEQYGSVSAWNATEYEGSEDMFI

SEQ ID NO: 155271 - protein, 35 aa, Artificial Sequence
  Description of Artificial Sequence: Synthetic polypeptide
DEAEIRTTNPVATEQYGSFSETPNDESPETNDPEN

SEQ ID NO: 155272 - protein, 34 aa, Artificial Sequence
  Description of Artificial Sequence: Synthetic polypeptide
DEAEIRTTNPVATEQYGSFSCDLNAGEGQIETIV

SEQ ID NO: 155273 - protein, 33 aa, Artificial Sequence
  Description of Artificial Sequence: Synthetic polypeptide
DENEIATTNPVATEPYGSVSATEDIEDHEGEDL

SEQ ID NO: 155274 - protein, 35 aa, Artificial Sequence
  Description of Artificial Sequence: Synthetic polypeptide
DEAEIRTTNPVATEQYGSFCSSSNLIPNNGIEDSY

SEQ ID NO: 155275 - protein, 33 aa, Artificial Sequence
  Description of Artificial Sequence: Synthetic polypeptide
DEAEIRTTNPVATEQYGSCYVWNFQDFTSLEDN

SEQ ID NO: 155276 - protein, 37 aa, Artificial Sequence
  Description of Artificial Sequence: Synthetic polypeptide
DEEEIRTTNPVATEQYGVVSTVVVTNLEAGTTEQGQD

SEQ ID NO: 155277 - protein, 35 aa, Artificial Sequence
  Description of Artificial Sequence: Synthetic polypeptide
DENEIRTTNPVATEQYGSVSAFDVENQEILCEERN

SEQ ID NO: 155278 - protein, 33 aa, Artificial Sequence
  Description of Artificial Sequence: Synthetic polypeptide
DDEEIRTTNPCATEHYGCVCSWEDNQRFNSNQS

SEQ ID NO: 155279 - protein, 35 aa, Artificial Sequence
  Description of Artificial Sequence: Synthetic polypeptide
DENEIRTTNPVATEQYGSVQWSEDVGLGIEEFNED

SEQ ID NO: 155280 - protein, 34 aa, Artificial Sequence
  Description of Artificial Sequence: Synthetic polypeptide
DEAEIRTTNPVATEQYGSCSTDMTDVTIESQNSI

SEQ ID NO: 155281 - protein, 36 aa, Artificial Sequence
  Description of Artificial Sequence: Synthetic polypeptide
DEAEIRTTNPVATEQYGSCSSTDTGLSDTGSSNDEE

SEQ ID NO: 155282 - protein, 35 aa, Artificial Sequence
  Description of Artificial Sequence: Synthetic polypeptide
DEAEIRTTNPVATEQYGSCSSPDTGLDTPSSNDEY

SEQ ID NO: 155283 - protein, 33 aa, Artificial Sequence
  Description of Artificial Sequence: Synthetic polypeptide
DEAEIRTTNPVATEQYGSFCEGTPDMLPESEEQ

SEQ ID NO: 155284 - protein, 35 aa, Artificial Sequence
  Description of Artificial Sequence: Synthetic polypeptide
DEEEIRTTNPVATEQYGSVSYDPVGLIEATMVQTN

SEQ ID NO: 155285 - protein, 35 aa, Artificial Sequence
  Description of Artificial Sequence: Synthetic polypeptide
DEAEIRTTNPVATEQYGQVCSLLNALETEGMEEGN

SEQ ID NO: 155286 - protein, 37 aa, Artificial Sequence
  Description of Artificial Sequence: Synthetic polypeptide
DENEIRTTNPVATEQYGSVISVTMHDLQTGFEEEQYE

SEQ ID NO: 155287 - protein, 36 aa, Artificial Sequence
  Description of Artificial Sequence: Synthetic polypeptide
DENEIRTTNPVATEQYGSVETTTYLTTEITGENQAV

SEQ ID NO: 155288 - protein, 37 aa, Artificial Sequence
  Description of Artificial Sequence: Synthetic polypeptide
DEGEIRTTNPVATEQYGSVSSTTPAMPNMENGMNDKM

SEQ ID NO: 155289 - protein, 36 aa, Artificial Sequence
  Description of Artificial Sequence: Synthetic polypeptide
DEGEIRTTNPVATEQYGSVSSTTPAGPNMRNGMQPV

SEQ ID NO: 155290 - protein, 37 aa, Artificial Sequence
  Description of Artificial Sequence: Synthetic polypeptide
DEGEIRTTNPVATEQYGSVSSTTPAGPNMRNGMNPVN

SEQ ID NO: 155291 - protein, 35 aa, Artificial Sequence
  Description of Artificial Sequence: Synthetic polypeptide
DENEIRTTNPVATEQYGSVCYVTWPFLNEDIGEEM

SEQ ID NO: 155292 - protein, 34 aa, Artificial Sequence
  Description of Artificial Sequence: Synthetic polypeptide
DENEIRTTNPVATEQYGSVCYVPWPLNEDIGGEM

SEQ ID NO: 155293 - protein, 37 aa, Artificial Sequence
  Description of Artificial Sequence: Synthetic polypeptide
DEGEIRTTNPVATEQYGSVSSTTPAGPNMRNGMNPVG

SEQ ID NO: 155294 - protein, 36 aa, Artificial Sequence
  Description of Artificial Sequence: Synthetic polypeptide
DEAEIRTTNPVATEQYGQCVCSTGELQENFNSNTQS

SEQ ID NO: 155295 - protein, 35 aa, Artificial Sequence
  Description of Artificial Sequence: Synthetic polypeptide
DEAEIRTTNPVATEQYGQCVCSTGEHQNFNSDFQS

SEQ ID NO: 155296 - protein, 31 aa, Artificial Sequence
  Description of Artificial Sequence: Synthetic polypeptide
DENEIATTNPVATEQWGCCSEGEMNAALDNM

SEQ ID NO: 155297 - protein, 35 aa, Artificial Sequence
  Description of Artificial Sequence: Synthetic polypeptide
DENEIRTTNPVATEQYGSVCTPPCQETDYMEDMND

SEQ ID NO: 155298 - protein, 35 aa, Artificial Sequence
  Description of Artificial Sequence: Synthetic polypeptide
DENEIRTTNPVATEQYGSVCTPPCLETGYMIDMTD

SEQ ID NO: 155299 - protein, 35 aa, Artificial Sequence
  Description of Artificial Sequence: Synthetic polypeptide
DENEIRTTNPVATEQYGSVCTPPCLETGYEEDMDC

SEQ ID NO: 155300 - protein, 36 aa, Artificial Sequence
  Description of Artificial Sequence: Synthetic polypeptide
DENEIRTTNPVATEQYGSVCTPPCKQETGYMEDMND

SEQ ID NO: 155301 - protein, 36 aa, Artificial Sequence
  Description of Artificial Sequence: Synthetic polypeptide
DENEIRTTNPVATEQYGSVCTPPACLETGYMEDMNV

SEQ ID NO: 155302 - protein, 35 aa, Artificial Sequence
  Description of Artificial Sequence: Synthetic polypeptide
DENEIRTTNPVATEQYGSVCTEGYAEQRIVQDMDV

SEQ ID NO: 155303 - protein, 37 aa, Artificial Sequence
  Description of Artificial Sequence: Synthetic polypeptide
DENEIRTTNPVATEQYGSVCSVTWPPLAEDRFVHEGN

SEQ ID NO: 155304 - protein, 37 aa, Artificial Sequence
  Description of Artificial Sequence: Synthetic polypeptide
DEGEIRTTNPVATEQYGSVSSTTPAMPNMENGMNPHN

SEQ ID NO: 155305 - protein, 35 aa, Artificial Sequence
  Description of Artificial Sequence: Synthetic polypeptide
DENEIRTTNPVATEQYGSVFSIMVPDEQPEGPQDD

SEQ ID NO: 155306 - protein, 31 aa, Artificial Sequence
  Description of Artificial Sequence: Synthetic polypeptide
DENEIATTNPVATEPYGTISMVIQQQHNENH

SEQ ID NO: 155307 - protein, 32 aa, Artificial Sequence
  Description of Artificial Sequence: Synthetic polypeptide
DENEIATTNPVATEPYGTISMEDIQQQRNGGH

SEQ ID NO: 155308 - protein, 37 aa, Artificial Sequence
  Description of Artificial Sequence: Synthetic polypeptide
DENEIRTTNPVATEQYGSVIMGNLNTGGNGQTGNGGN

SEQ ID NO: 155309 - protein, 33 aa, Artificial Sequence
  Description of Artificial Sequence: Synthetic polypeptide
DEAEICTTNPVAYEQWGVCSTENDGQHNGGGNN

SEQ ID NO: 155310 - protein, 34 aa, Artificial Sequence
  Description of Artificial Sequence: Synthetic polypeptide
DENEIATTNPVATEPYGSVSGPNPEPQHQDTERN

SEQ ID NO: 155311 - protein, 31 aa, Artificial Sequence
  Description of Artificial Sequence: Synthetic polypeptide
DENEIATTNPVATEPYGTASMEDIQQQNGEH

SEQ ID NO: 155312 - protein, 31 aa, Artificial Sequence
  Description of Artificial Sequence: Synthetic polypeptide
DENEIATTNPVATEPYGTASMEDIQQQQGEK

SEQ ID NO: 155313 - protein, 31 aa, Artificial Sequence
  Description of Artificial Sequence: Synthetic polypeptide
DENEIATTNPVATEPYGTASMEVIQQQQGEK

SEQ ID NO: 155314 - protein, 34 aa, Artificial Sequence
  Description of Artificial Sequence: Synthetic polypeptide
DDEEIRTTNPCATEHYGCVCSWELNQRFNSDNQS

SEQ ID NO: 155315 - protein, 34 aa, Artificial Sequence
  Description of Artificial Sequence: Synthetic polypeptide
DENEIRTTNPVATEQYGSVHPWDAVEHEIEQGQR

SEQ ID NO: 155316 - protein, 35 aa, Artificial Sequence
  Description of Artificial Sequence: Synthetic polypeptide
DENEIRTTNPVATEQYGSVIYAANSNSESGQESRM

SEQ ID NO: 155317 - protein, 33 aa, Artificial Sequence
  Description of Artificial Sequence: Synthetic polypeptide
DEAEICTTNPVAYEQWGVCSTTLNDQHHGGGNN

SEQ ID NO: 155318 - protein, 31 aa, Artificial Sequence
  Description of Artificial Sequence: Synthetic polypeptide
DENEIATTNPVATEPYGTISEEDCQQQNEEH

SEQ ID NO: 155319 - protein, 35 aa, Artificial Sequence
  Description of Artificial Sequence: Synthetic polypeptide
DENEIRTTNPVATEQYGSVFVPWVLLDERIGGMQQ

SEQ ID NO: 155320 - protein, 33 aa, Artificial Sequence
  Description of Artificial Sequence: Synthetic polypeptide
DDEEIRTTNPCATEHYGCVCSWELQEYFNSDQS

SEQ ID NO: 155321 - protein, 31 aa, Artificial Sequence
  Description of Artificial Sequence: Synthetic polypeptide
DENEIATTNPVATEPYGTISEEDCQQQNENH

SEQ ID NO: 155322 - protein, 30 aa, Artificial Sequence
  Description of Artificial Sequence: Synthetic polypeptide
DENEIATTNPVATEPYGTISEEVCQQQEEH

SEQ ID NO: 155323 - protein, 34 aa, Artificial Sequence
  Description of Artificial Sequence: Synthetic polypeptide
DEAEIRTTNPVATEQYGQCVCSWNHNANFNSNQA

SEQ ID NO: 155324 - protein, 31 aa, Artificial Sequence
  Description of Artificial Sequence: Synthetic polypeptide
DENEIATTNPVATEPYGTISEEVCQQQNGEH

SEQ ID NO: 155325 - protein, 31 aa, Artificial Sequence
  Description of Artificial Sequence: Synthetic polypeptide
DENEIATTNPVATEPYGTISMDIQQQHNENH

SEQ ID NO: 155326 - protein, 33 aa, Artificial Sequence
  Description of Artificial Sequence: Synthetic polypeptide
DEAEICTTNPVAYEQWGVVTGGNGNQGEGNDMR

SEQ ID NO: 155327 - protein, 35 aa, Artificial Sequence
  Description of Artificial Sequence: Synthetic polypeptide
DEAEICTTNPVATECYGVVATGNPMQGDRGGNKES

SEQ ID NO: 155328 - protein, 36 aa, Artificial Sequence
  Description of Artificial Sequence: Synthetic polypeptide
DENEIRTTNPVATEQYGSVSDYDNALNQPQPEDDSQ

SEQ ID NO: 155329 - protein, 37 aa, Artificial Sequence
  Description of Artificial Sequence: Synthetic polypeptide
DEEEIRTTNPVATEQYGVVSTVVVTDQGGNNEEEAEN

SEQ ID NO: 155330 - protein, 35 aa, Artificial Sequence
  Description of Artificial Sequence: Synthetic polypeptide
CEEEIRTTNPVATEQYGSVVLGIMTGGQTVEGEGE

SEQ ID NO: 155331 - protein, 35 aa, Artificial Sequence
  Description of Artificial Sequence: Synthetic polypeptide
DEAEIRTTNPVATEQYGSLCSSLDQTEIGQNEDHS

SEQ ID NO: 155332 - protein, 36 aa, Artificial Sequence
  Description of Artificial Sequence: Synthetic polypeptide
CEEEIRTTNPVATEQYGSVYLTENQHWPPQIQTIDR

SEQ ID NO: 155333 - protein, 37 aa, Artificial Sequence
  Description of Artificial Sequence: Synthetic polypeptide
DEAEIRTTNPVATEQYGSIVNWTLDPLTQRSDQNEGN

SEQ ID NO: 155334 - protein, 38 aa, Artificial Sequence
  Description of Artificial Sequence: Synthetic polypeptide
DEEEIRTTNPVATEQYGVVSTVVVNNQNLQQGTTEEED

SEQ ID NO: 155335 - protein, 36 aa, Artificial Sequence
  Description of Artificial Sequence: Synthetic polypeptide
CEEEIRTTNPVATEQYGVVDNFTVNEGQEDGQGNET

SEQ ID NO: 155336 - protein, 36 aa, Artificial Sequence
  Description of Artificial Sequence: Synthetic polypeptide
CEEEIRTTNPVATEQYGVVSIDDNMNDQGNGGQNSD

SEQ ID NO: 155337 - protein, 37 aa, Artificial Sequence
  Description of Artificial Sequence: Synthetic polypeptide
DEEEIRTTNPVATEQYGVVSTVVVNNQQGTEEEEDED

SEQ ID NO: 155338 - protein, 35 aa, Artificial Sequence
  Description of Artificial Sequence: Synthetic polypeptide
DEAEIRTTNPVATEQYGSIPWTPPLMENQHQSERI

SEQ ID NO: 155339 - protein, 36 aa, Artificial Sequence
  Description of Artificial Sequence: Synthetic polypeptide
DEEEIRTTNPVATEQYGSVYTWLPEAENTMNAPVLL

SEQ ID NO: 155340 - protein, 37 aa, Artificial Sequence
  Description of Artificial Sequence: Synthetic polypeptide
DEEEIRTTNPVATEQYGVVSTVVVNNQQGTTTEEDED

SEQ ID NO: 155341 - protein, 36 aa, Artificial Sequence
  Description of Artificial Sequence: Synthetic polypeptide
DEEEIRTTNPVATEQYGSVYTTWLGDAENTMNPVLL

SEQ ID NO: 155342 - protein, 30 aa, Artificial Sequence
  Description of Artificial Sequence: Synthetic polypeptide
CENEIATTNPVAYEPYGKVSEHLSQTETEL

SEQ ID NO: 155343 - protein, 36 aa, Artificial Sequence
  Description of Artificial Sequence: Synthetic polypeptide
DENEIRTTNPVATEQYGSVSTCPDMHNSRQEVSFED

SEQ ID NO: 155344 - protein, 33 aa, Artificial Sequence
  Description of Artificial Sequence: Synthetic polypeptide
DENEIATTNPVATECYGSVSEPAGNMHNEMNPL

SEQ ID NO: 155345 - protein, 36 aa, Artificial Sequence
  Description of Artificial Sequence: Synthetic polypeptide
DEGEIRTTNPVATEQYGSVSTNVDWETTSNGQIVEG

SEQ ID NO: 155346 - protein, 36 aa, Artificial Sequence
  Description of Artificial Sequence: Synthetic polypeptide
DENEIRTTNPVATEQYGSVSSTTPAGPQMRNEMEPV

SEQ ID NO: 155347 - protein, 35 aa, Artificial Sequence
  Description of Artificial Sequence: Synthetic polypeptide
CEEEIRTTNPVATEQYGSVVLGIMTGGNTVTGEGT

SEQ ID NO: 155348 - protein, 38 aa, Artificial Sequence
  Description of Artificial Sequence: Synthetic polypeptide
DEEEIRTTNPVATEQYGVVSTVVVNNNNQQGNQDEEED

SEQ ID NO: 155349 - protein, 36 aa, Artificial Sequence
  Description of Artificial Sequence: Synthetic polypeptide
CEEEIRTTNPVATEQYGSVTDTVNMGDIGEDGNNGT

SEQ ID NO: 155350 - protein, 37 aa, Artificial Sequence
  Description of Artificial Sequence: Synthetic polypeptide
CEEEIRTTNPVATEQYGSVTDTGDQNGQNEGNANGQT

SEQ ID NO: 155351 - protein, 35 aa, Artificial Sequence
  Description of Artificial Sequence: Synthetic polypeptide
DEAEICTTNPVATECYGVVSTGGLQQGDTGGNNTS

SEQ ID NO: 155352 - protein, 35 aa, Artificial Sequence
  Description of Artificial Sequence: Synthetic polypeptide
DEGEIRTTNPVATEQYGSVSWAEIDHTQELFEDGD

SEQ ID NO: 155353 - protein, 37 aa, Artificial Sequence
  Description of Artificial Sequence: Synthetic polypeptide
CEEEIRTTNPVATEQYGSVSPTNWSGLLIIQDQVDGI

SEQ ID NO: 155354 - protein, 37 aa, Artificial Sequence
  Description of Artificial Sequence: Synthetic polypeptide
DEGEIRTTNPVATEQYGSVSVTNVDWEQTFGGQIVEG

SEQ ID NO: 155355 - protein, 38 aa, Artificial Sequence
  Description of Artificial Sequence: Synthetic polypeptide
DEEEIRTTNPVATEQYGVVSTVVVNLQQGTEEGTEESE

SEQ ID NO: 155356 - protein, 38 aa, Artificial Sequence
  Description of Artificial Sequence: Synthetic polypeptide
DEEEIRTTNPVATEQYGVVSTVVVNNNNNNLQAGTEDE

SEQ ID NO: 155357 - protein, 36 aa, Artificial Sequence
  Description of Artificial Sequence: Synthetic polypeptide
DEEEIRTTNPVATEQYGSVYYTWLPDALNMMNPVTL

SEQ ID NO: 155358 - protein, 35 aa, Artificial Sequence
  Description of Artificial Sequence: Synthetic polypeptide
DEAEICTTNPVATECYGVVSTGNQQNQGDTGGNED

SEQ ID NO: 155359 - protein, 36 aa, Artificial Sequence
  Description of Artificial Sequence: Synthetic polypeptide
DENEIRTTNPVATEQYGSVSSTTPAGPNMRNGMDPA

SEQ ID NO: 155360 - protein, 35 aa, Artificial Sequence
  Description of Artificial Sequence: Synthetic polypeptide
DEEEIRTTNPVATEQYGSVYYPIPLKESDGEEEEM

SEQ ID NO: 155361 - protein, 37 aa, Artificial Sequence
  Description of Artificial Sequence: Synthetic polypeptide
CEEEIRTTNPVATEQYGSVSSTTMDGPNVGNGDNDDV

SEQ ID NO: 155362 - protein, 37 aa, Artificial Sequence
  Description of Artificial Sequence: Synthetic polypeptide
CEEEIRTTNPVATEQYGSVSSTTPADGPNMGNGNNQG

SEQ ID NO: 155363 - protein, 36 aa, Artificial Sequence
  Description of Artificial Sequence: Synthetic polypeptide
CEEEIRTTNPVATEQYGSVSSTTPAGPNMRNGMDPV

SEQ ID NO: 155364 - protein, 30 aa, Artificial Sequence
  Description of Artificial Sequence: Synthetic polypeptide
DENEIATTNPVATECYGDVSEIEMNAAEEA

SEQ ID NO: 155365 - protein, 35 aa, Artificial Sequence
  Description of Artificial Sequence: Synthetic polypeptide
DEEEIRTTNPVATEQYGSVYVPPLLDTQIEDDQDS

SEQ ID NO: 155366 - protein, 33 aa, Artificial Sequence
  Description of Artificial Sequence: Synthetic polypeptide
DEAEICTTNPVATEMWGVVSHTNNIDDRNNGDH

SEQ ID NO: 155367 - protein, 37 aa, Artificial Sequence
  Description of Artificial Sequence: Synthetic polypeptide
CEEEIRTTNPVATEQYGSVSTSTEGDNNDQGIQGGGE

SEQ ID NO: 155368 - protein, 35 aa, Artificial Sequence
  Description of Artificial Sequence: Synthetic polypeptide
DEGEIRTTNPVATEQYGSVSVLDANEDEDMQENQI

SEQ ID NO: 155369 - protein, 35 aa, Artificial Sequence
  Description of Artificial Sequence: Synthetic polypeptide
DEAEICTTNPVATECYGVVTTGNMNQGDRGGNKES

SEQ ID NO: 155370 - protein, 34 aa, Artificial Sequence
  Description of Artificial Sequence: Synthetic polypeptide
DEAEIRTTNPVATEQYGSFVTWLMESNESIEDQC

SEQ ID NO: 155371 - protein, 35 aa, Artificial Sequence
  Description of Artificial Sequence: Synthetic polypeptide
DENEIRTTNPVATEQYGSVSSTTPAGPNMHGMEPV

SEQ ID NO: 155372 - protein, 35 aa, Artificial Sequence
  Description of Artificial Sequence: Synthetic polypeptide
DDEEIRSTNPVATEQYGSVSSTTPTGPNMRNGQPV

SEQ ID NO: 155373 - protein, 34 aa, Artificial Sequence
  Description of Artificial Sequence: Synthetic polypeptide
DENEIRTTNPVATEQYGSVSMDPMTQMETMQILM

SEQ ID NO: 155374 - protein, 35 aa, Artificial Sequence
  Description of Artificial Sequence: Synthetic polypeptide
CEEEIRTTNPVAYEQWGQVSSCTNMQSADPDNYRA

SEQ ID NO: 155375 - protein, 35 aa, Artificial Sequence
  Description of Artificial Sequence: Synthetic polypeptide
CEEEIRTTNPVAYEQWGQVVSSCTGMQSADYGNRT

SEQ ID NO: 155376 - protein, 34 aa, Artificial Sequence
  Description of Artificial Sequence: Synthetic polypeptide
DENEIRTTNPVATEQYGSVSMDDMTLMETDQIDV

SEQ ID NO: 155377 - protein, 35 aa, Artificial Sequence
  Description of Artificial Sequence: Synthetic polypeptide
DENEIRTTNPVATEQYGSVSMDAMTQMETMQITMH

SEQ ID NO: 155378 - protein, 37 aa, Artificial Sequence
  Description of Artificial Sequence: Synthetic polypeptide
DEEEIRTTNPVATEQYGSVSWVMELMQEQDVELNLVQ

SEQ ID NO: 155379 - protein, 37 aa, Artificial Sequence
  Description of Artificial Sequence: Synthetic polypeptide
DEEEIRTTNPVATEQYGSVSWVMVSLQEQDEETNLVQ

SEQ ID NO: 155380 - protein, 36 aa, Artificial Sequence
  Description of Artificial Sequence: Synthetic polypeptide
DENEIRTTNPVATEQYGSVSFVDNNNTTEGNQPDHN

SEQ ID NO: 155381 - protein, 35 aa, Artificial Sequence
  Description of Artificial Sequence: Synthetic polypeptide
DENEIRTTNPVATEQYGSVSFVDMINYRQEVSFFD

SEQ ID NO: 155382 - protein, 36 aa, Artificial Sequence
  Description of Artificial Sequence: Synthetic polypeptide
DENEIRTTNPVATEQYGSVSFTWDMHNSRQEVSFED

SEQ ID NO: 155383 - protein, 36 aa, Artificial Sequence
  Description of Artificial Sequence: Synthetic polypeptide
DENEIRTTNPVATEQYGSVSFTPDMINSRQEVSQGD

SEQ ID NO: 155384 - protein, 35 aa, Artificial Sequence
  Description of Artificial Sequence: Synthetic polypeptide
DENEIRTTNPVATEQYGSVSFTDPMINRTEVSFFD

SEQ ID NO: 155385 - protein, 35 aa, Artificial Sequence
  Description of Artificial Sequence: Synthetic polypeptide
DENEIRTTNPVATEQYGSVSFTDMTNERNEVSFFD

SEQ ID NO: 155386 - protein, 36 aa, Artificial Sequence
  Description of Artificial Sequence: Synthetic polypeptide
DENEIRTTNPVATEQYGSVSFTDAMINSRQEVSFFD

SEQ ID NO: 155387 - protein, 36 aa, Artificial Sequence
  Description of Artificial Sequence: Synthetic polypeptide
DEEEIRTTNPVATEQYGSVSWWYDPMDLQSMEDFYD

SEQ ID NO: 155388 - protein, 35 aa, Artificial Sequence
  Description of Artificial Sequence: Synthetic polypeptide
DEAEIRTTNPVATEQYGSFYSDWNHQDERQSDIQQ

SEQ ID NO: 155389 - protein, 38 aa, Artificial Sequence
  Description of Artificial Sequence: Synthetic polypeptide
DEEEIRTTNPVATEQYGVVSTVVVSNLQQGTTTEDEDE

SEQ ID NO: 155390 - protein, 34 aa, Artificial Sequence
  Description of Artificial Sequence: Synthetic polypeptide
CEEEIRTTNPVAYEQWGCSYNVPNDLDGRGDRPR

SEQ ID NO: 155391 - protein, 35 aa, Artificial Sequence
  Description of Artificial Sequence: Synthetic polypeptide
DENEIRTTNPVATEQYGSVSPDYDTWIDKTEGSQK

SEQ ID NO: 155392 - protein, 36 aa, Artificial Sequence
  Description of Artificial Sequence: Synthetic polypeptide
DENEIRTTNPVATEQYGSVSPLTDMHNSRQEVSFED

SEQ ID NO: 155393 - protein, 30 aa, Artificial Sequence
  Description of Artificial Sequence: Synthetic polypeptide
DENEIATTNPVATEGWGVVSSTEMNAAEDA

SEQ ID NO: 155394 - protein, 35 aa, Artificial Sequence
  Description of Artificial Sequence: Synthetic polypeptide
DENEIRTTNPVATEQYGSVSSTTPAGPNMANEDPA

SEQ ID NO: 155395 - protein, 38 aa, Artificial Sequence
  Description of Artificial Sequence: Synthetic polypeptide
DEEEIRTTNPVATEQYGVVSTVVVNTNQQQGTNDEEQD

SEQ ID NO: 155396 - protein, 35 aa, Artificial Sequence
  Description of Artificial Sequence: Synthetic polypeptide
DEEEISTTNPVAYEQYGCVCSMTGELQNFGSDTQA

SEQ ID NO: 155397 - protein, 35 aa, Artificial Sequence
  Description of Artificial Sequence: Synthetic polypeptide
DEEEIRTTNPVATEQYGSVYTPPPDEDAEAFSNIE

SEQ ID NO: 155398 - protein, 34 aa, Artificial Sequence
  Description of Artificial Sequence: Synthetic polypeptide
DDEEIRSTNPVSTEQYGSVATTTIPNMRNGMNPV

SEQ ID NO: 155399 - protein, 33 aa, Artificial Sequence
  Description of Artificial Sequence: Synthetic polypeptide
DEAEICTTNPVAYEAYGHVSYSNSLSQVSGGEF

SEQ ID NO: 155400 - protein, 37 aa, Artificial Sequence
  Description of Artificial Sequence: Synthetic polypeptide
DEEEIRTTNPVATEQYGVVSTVVVNTNQQQGTTEEED

SEQ ID NO: 155401 - protein, 37 aa, Artificial Sequence
  Description of Artificial Sequence: Synthetic polypeptide
CEEEIRTTNPVATESYGSVVSIDGGNLDQEGGNITTT

SEQ ID NO: 155402 - protein, 35 aa, Artificial Sequence
  Description of Artificial Sequence: Synthetic polypeptide
DENEIRTTNPVATEQYGSVSSTTPAGPNMHGMEPL

SEQ ID NO: 155403 - protein, 36 aa, Artificial Sequence
  Description of Artificial Sequence: Synthetic polypeptide
DENEIRTTNPVATEQYGSVSPTPAAEQHISNNDAVM

SEQ ID NO: 155404 - protein, 34 aa, Artificial Sequence
  Description of Artificial Sequence: Synthetic polypeptide
DEAEIRTTNPVATEQYGSFYTWLMEYEGSQEDQI

SEQ ID NO: 155405 - protein, 36 aa, Artificial Sequence
  Description of Artificial Sequence: Synthetic polypeptide
DENEIRTTNPVATEQYGSVSPTFTMMEARQQNVEIG

SEQ ID NO: 155406 - protein, 36 aa, Artificial Sequence
  Description of Artificial Sequence: Synthetic polypeptide
DENEIRTTNPVATEQYGSVSPTFNMMQEMQQSVEIA

SEQ ID NO: 155407 - protein, 35 aa, Artificial Sequence
  Description of Artificial Sequence: Synthetic polypeptide
CEEEIRTTNPVAYEPYGSTVCHCTNISHNSGTNRA

SEQ ID NO: 155408 - protein, 33 aa, Artificial Sequence
  Description of Artificial Sequence: Synthetic polypeptide
DEAEIRTTNPVATEQYGSFYTWLMESESIEMQM

SEQ ID NO: 155409 - protein, 33 aa, Artificial Sequence
  Description of Artificial Sequence: Synthetic polypeptide
DEAEIRTTNPVATEQYGSFYTWLMESEMIEDPM

SEQ ID NO: 155410 - protein, 34 aa, Artificial Sequence
  Description of Artificial Sequence: Synthetic polypeptide
DEAEIRTTNPVATEQYGSFYTWLMESEGSIEDQM

SEQ ID NO: 155411 - protein, 35 aa, Artificial Sequence
  Description of Artificial Sequence: Synthetic polypeptide
DENEIRTTNPVATEQYGSVSPMDMTQMETMQIDTM

SEQ ID NO: 155412 - protein, 34 aa, Artificial Sequence
  Description of Artificial Sequence: Synthetic polypeptide
DEAEIRTTNPVATEQYGSFYTWLQMEYEDIEDQC

SEQ ID NO: 155413 - protein, 36 aa, Artificial Sequence
  Description of Artificial Sequence: Synthetic polypeptide
DEGEIRTTNPVATEQYGSVSSTTPAGPNMENTMNDN

SEQ ID NO: 155414 - protein, 34 aa, Artificial Sequence
  Description of Artificial Sequence: Synthetic polypeptide
CEEEIRTTNPVATEQYGQCVCSTEEPTGFISEQT

SEQ ID NO: 155415 - protein, 33 aa, Artificial Sequence
  Description of Artificial Sequence: Synthetic polypeptide
DDSEIASTNPVSTEGYGSVSACITIPQSRVGQR

SEQ ID NO: 155416 - protein, 33 aa, Artificial Sequence
  Description of Artificial Sequence: Synthetic polypeptide
DENEIRTTNPVSTEHYGTISWEDINQEQFGNQG

SEQ ID NO: 155417 - protein, 29 aa, Artificial Sequence
  Description of Artificial Sequence: Synthetic peptide
CEPEIACTNPVGTEGWGVSASTLQDGDIE

SEQ ID NO: 155418 - protein, 37 aa, Artificial Sequence
  Description of Artificial Sequence: Synthetic polypeptide
DEEEIRTTNPVATEQYGVVSTVVTNLTEQGTEEEEEE

SEQ ID NO: 155419 - protein, 32 aa, Artificial Sequence
  Description of Artificial Sequence: Synthetic polypeptide
DENEIRTTNPVSTEHYGTISMEDIQQQQNGNH

SEQ ID NO: 155420 - protein, 32 aa, Artificial Sequence
  Description of Artificial Sequence: Synthetic polypeptide
DENEIRTTNPVSTEHYGTISMEDIQQQQNGNG

SEQ ID NO: 155421 - protein, 32 aa, Artificial Sequence
  Description of Artificial Sequence: Synthetic polypeptide
DENEIRTTNPVSTEHYGTISMEDIQQQINGNH

SEQ ID NO: 155422 - protein, 32 aa, Artificial Sequence
  Description of Artificial Sequence: Synthetic polypeptide
DENEIRTTNPVSTEGYGVISDEDIQQQQNGNE

SEQ ID NO: 155423 - protein, 35 aa, Artificial Sequence
  Description of Artificial Sequence: Synthetic polypeptide
DEAEIRTTNPVATEQYGSVCEWVDTQEYRNENNQE

SEQ ID NO: 155424 - protein, 34 aa, Artificial Sequence
  Description of Artificial Sequence: Synthetic polypeptide
DEAEIRTTNPVATEQYGSVCEWVDTLEELEPNQE

SEQ ID NO: 155425 - protein, 33 aa, Artificial Sequence
  Description of Artificial Sequence: Synthetic polypeptide
DENEIRTTNPVSTEGYGTISWEEINQEQFGGNQ

SEQ ID NO: 155426 - protein, 32 aa, Artificial Sequence
  Description of Artificial Sequence: Synthetic polypeptide
DENEIRTTNPVSTEGYGTISWEDIQQDQFGNH

SEQ ID NO: 155427 - protein, 36 aa, Artificial Sequence
  Description of Artificial Sequence: Synthetic polypeptide
DENEIACTNPVATEQYGSCSTGNALGQDHQDGDNSW

SEQ ID NO: 155428 - protein, 34 aa, Artificial Sequence
  Description of Artificial Sequence: Synthetic polypeptide
DEGEIVTTNPVATEQYGTVCSCTDGPSEFEGTND

SEQ ID NO: 155429 - protein, 36 aa, Artificial Sequence
  Description of Artificial Sequence: Synthetic polypeptide
DEAEICTTNPVATECYGSVSTGNGVQQGDTGGNTTS

SEQ ID NO: 155430 - protein, 36 aa, Artificial Sequence
  Description of Artificial Sequence: Synthetic polypeptide
DEEEIRTTNPVATEQYGSYSPTLTMMMQEENEEEVN

SEQ ID NO: 155431 - protein, 35 aa, Artificial Sequence
  Description of Artificial Sequence: Synthetic polypeptide
DEEEIRTTNPVATEQYGSYSPNGNLVEVAALVEEE

SEQ ID NO: 155432 - protein, 38 aa, Artificial Sequence
  Description of Artificial Sequence: Synthetic polypeptide
DEEEIRTTNPVATEQYGVVSTVVTNNNNNQQTGNDEDE

SEQ ID NO: 155433 - protein, 32 aa, Artificial Sequence
  Description of Artificial Sequence: Synthetic polypeptide
DENEIRTTNPVSTEIYGTISMEDIQQQQNGNH

SEQ ID NO: 155434 - protein, 32 aa, Artificial Sequence
  Description of Artificial Sequence: Synthetic polypeptide
DENEIRTTNPVSTEIYGTISMLDIQQQQNGNH

SEQ ID NO: 155435 - protein, 32 aa, Artificial Sequence
  Description of Artificial Sequence: Synthetic polypeptide
DENEIRTTNPVSTEIYGTISSADIQQQQNGNH

SEQ ID NO: 155436 - protein, 32 aa, Artificial Sequence
  Description of Artificial Sequence: Synthetic polypeptide
DENEIRTTNPVSTEKYGTISMEDIQQQQNGNH

SEQ ID NO: 155437 - protein, 37 aa, Artificial Sequence
  Description of Artificial Sequence: Synthetic polypeptide
DEEEIRTTNPVATEQYGVVSTVVTNLQQNTTTEETTE

SEQ ID NO: 155438 - protein, 31 aa, Artificial Sequence
  Description of Artificial Sequence: Synthetic polypeptide
DENEIACTNPVATEQYGETTSEEDLAPKGGI

SEQ ID NO: 155439 - protein, 36 aa, Artificial Sequence
  Description of Artificial Sequence: Synthetic polypeptide
DEAEIRTTNPVATEQYGSVCFPPCNLETGYMEDMND

SEQ ID NO: 155440 - protein, 35 aa, Artificial Sequence
  Description of Artificial Sequence: Synthetic polypeptide
DEAEIRTTNPVATEQYGSVCFMVDNVETFDGKERT

SEQ ID NO: 155441 - protein, 31 aa, Artificial Sequence
  Description of Artificial Sequence: Synthetic polypeptide
DEGELATTNPVAYEQWGSISKTLEDRQNMQE

SEQ ID NO: 155442 - protein, 34 aa, Artificial Sequence
  Description of Artificial Sequence: Synthetic polypeptide
DEAEIRTTNPVATEQYGSVCEWVDTWERLEMNQE

SEQ ID NO: 155443 - protein, 32 aa, Artificial Sequence
  Description of Artificial Sequence: Synthetic polypeptide
DENEIRTTNPVSTEPWGSISMEDIQQQQNGNH

SEQ ID NO: 155444 - protein, 31 aa, Artificial Sequence
  Description of Artificial Sequence: Synthetic polypeptide
DENEIRTTNPVSTEPWGDISEDIQQQQNGNH

SEQ ID NO: 155445 - protein, 33 aa, Artificial Sequence
  Description of Artificial Sequence: Synthetic polypeptide
DENEIRTTNPVSTEGYGTISVQEDGQQQQNGNM

SEQ ID NO: 155446 - protein, 31 aa, Artificial Sequence
  Description of Artificial Sequence: Synthetic polypeptide
DENEIRTTNPVSTEPWGAISMEDIQQQNGNI

SEQ ID NO: 155447 - protein, 32 aa, Artificial Sequence
  Description of Artificial Sequence: Synthetic polypeptide
DENEIRTTNPVSTEPFGTISMADLQQQQNGNH

SEQ ID NO: 155448 - protein, 29 aa, Artificial Sequence
  Description of Artificial Sequence: Synthetic peptide
CEPEIACTNPVGTEGWGVSASTLQHGDEQ

SEQ ID NO: 155449 - protein, 32 aa, Artificial Sequence
  Description of Artificial Sequence: Synthetic polypeptide
DENEIRTTNPVSTENYGTISMEDIQQQQNGNH

SEQ ID NO: 155450 - protein, 31 aa, Artificial Sequence
  Description of Artificial Sequence: Synthetic polypeptide
DENEIRTTNPVSTENYGTISMEDIQQQQGEH

SEQ ID NO: 155451 - protein, 32 aa, Artificial Sequence
  Description of Artificial Sequence: Synthetic polypeptide
DENEIRTTNPVSTEMYGTISMEDIQQQQNGNH

SEQ ID NO: 155452 - protein, 32 aa, Artificial Sequence
  Description of Artificial Sequence: Synthetic polypeptide
DENEIRTTNPVSTEMYGTISMEDIQPQQNGNH

SEQ ID NO: 155453 - protein, 32 aa, Artificial Sequence
  Description of Artificial Sequence: Synthetic polypeptide
DENEIRTTNPVSTELYGTISMEDIQQQVNGNH

SEQ ID NO: 155454 - protein, 32 aa, Artificial Sequence
  Description of Artificial Sequence: Synthetic polypeptide
DENEIRTTNPVSTELYGTISMEDIQQQQNGNH

SEQ ID NO: 155455 - protein, 31 aa, Artificial Sequence
  Description of Artificial Sequence: Synthetic polypeptide
DENEIRTTNPVSTEPWGAISMEDIQQQNGNH

SEQ ID NO: 155456 - protein, 38 aa, Artificial Sequence
  Description of Artificial Sequence: Synthetic polypeptide
DEEEIRTTNPVATEQYGVVSTVVTNLQQNTEQGTTQED

SEQ ID NO: 155457 - protein, 32 aa, Artificial Sequence
  Description of Artificial Sequence: Synthetic polypeptide
DENEIRTTNPVSTEGYGTISSEDIQQQQNGNS

SEQ ID NO: 155458 - protein, 32 aa, Artificial Sequence
  Description of Artificial Sequence: Synthetic polypeptide
DENEIRTTNPVSTEGYGTISSEDIQQEQSGNI

SEQ ID NO: 155459 - protein, 32 aa, Artificial Sequence
  Description of Artificial Sequence: Synthetic polypeptide
DEGEIRTTNPVSTEPYGTISMEDIQQQQNGNH

SEQ ID NO: 155460 - protein, 34 aa, Artificial Sequence
  Description of Artificial Sequence: Synthetic polypeptide
CENEIRTTNPVATEQYGSVSVMSIDGESNQGSKP

SEQ ID NO: 155461 - protein, 36 aa, Artificial Sequence
  Description of Artificial Sequence: Synthetic polypeptide
DEEEIRTTNPVATEQYGSYSINLYNLQIQMQELTEE

SEQ ID NO: 155462 - protein, 35 aa, Artificial Sequence
  Description of Artificial Sequence: Synthetic polypeptide
DEEEISTTNPVATEQYGQCVCSWGEDQSFGSENQP

SEQ ID NO: 155463 - protein, 36 aa, Artificial Sequence
  Description of Artificial Sequence: Synthetic polypeptide
DEEEIRTTNPVATEQYGSYSDTGLNEHGTQEQEDEL

SEQ ID NO: 155464 - protein, 36 aa, Artificial Sequence
  Description of Artificial Sequence: Synthetic polypeptide
DEEEIRTTNPVATEQYGSYQVAIEESIENTEEDNDM

SEQ ID NO: 155465 - protein, 37 aa, Artificial Sequence
  Description of Artificial Sequence: Synthetic polypeptide
DEEEIRTTNPVATEQYGSYQEVTTTLQITELNANNTA

SEQ ID NO: 155466 - protein, 32 aa, Artificial Sequence
  Description of Artificial Sequence: Synthetic polypeptide
DEGEIRTTNPVSTEPYGTISMEDIQQQHNGNH

SEQ ID NO: 155467 - protein, 30 aa, Artificial Sequence
  Description of Artificial Sequence: Synthetic polypeptide
DENEIRTTNPVSTEGWGDVANIEQNRAEDA

SEQ ID NO: 155468 - protein, 32 aa, Artificial Sequence
  Description of Artificial Sequence: Synthetic polypeptide
DENEIRTTNPVSTEFYGTISMEDIQQQWNGNH

SEQ ID NO: 155469 - protein, 32 aa, Artificial Sequence
  Description of Artificial Sequence: Synthetic polypeptide
DENEIRTTNPVSTEFYGTISMEDIQQQQNGNH

SEQ ID NO: 155470 - protein, 32 aa, Artificial Sequence
  Description of Artificial Sequence: Synthetic polypeptide
DENEIRTTNPVSTEFYGTISEMDDQQQQNGNH

SEQ ID NO: 155471 - protein, 32 aa, Artificial Sequence
  Description of Artificial Sequence: Synthetic polypeptide
DENEIRTTNPVSTEFYGTISEEDQQQNQNGNH

SEQ ID NO: 155472 - protein, 32 aa, Artificial Sequence
  Description of Artificial Sequence: Synthetic polypeptide
DENEIRTTNPVSTEFYGTISEEDIQQQQDGNH

SEQ ID NO: 155473 - protein, 32 aa, Artificial Sequence
  Description of Artificial Sequence: Synthetic polypeptide
DENEIRTTNPVSTEEYGVISMEDIQQQQNGNH

SEQ ID NO: 155474 - protein, 32 aa, Artificial Sequence
  Description of Artificial Sequence: Synthetic polypeptide
DENEIRTTNPVSTEEYGTISYEDIQQEQIGNH

SEQ ID NO: 155475 - protein, 33 aa, Artificial Sequence
  Description of Artificial Sequence: Synthetic polypeptide
DEGEIRTTNPVSTEPYGTCSMEDIQQQQNGNHR

SEQ ID NO: 155476 - protein, 34 aa, Artificial Sequence
  Description of Artificial Sequence: Synthetic polypeptide
DEEEISTTNPVATEQYGQCVCSWEHNQYFNSEQQ

SEQ ID NO: 155477 - protein, 35 aa, Artificial Sequence
  Description of Artificial Sequence: Synthetic polypeptide
DEEEISTTNPVATEQYGQCVCSWEHNQGFGSNNQS

SEQ ID NO: 155478 - protein, 38 aa, Artificial Sequence
  Description of Artificial Sequence: Synthetic polypeptide
DEEEIRTTNPVATEQYGVVSTVVTNNNQQGTTNTDEEE

SEQ ID NO: 155479 - protein, 34 aa, Artificial Sequence
  Description of Artificial Sequence: Synthetic polypeptide
DEEEISTTNPVATEQYGQCVCSWEHFQNFGSDQV

SEQ ID NO: 155480 - protein, 32 aa, Artificial Sequence
  Description of Artificial Sequence: Synthetic polypeptide
DENEIRTTNPVSTEGYGTISQEDMQQQGNGND

SEQ ID NO: 155481 - protein, 32 aa, Artificial Sequence
  Description of Artificial Sequence: Synthetic polypeptide
DENEIRTTNPVSTEGYGTISQEDIQQQNNGNE

SEQ ID NO: 155482 - protein, 34 aa, Artificial Sequence
  Description of Artificial Sequence: Synthetic polypeptide
DEGEIVTTNPVATEQYGTVCSATDGPVEFEGYND

SEQ ID NO: 155483 - protein, 34 aa, Artificial Sequence
  Description of Artificial Sequence: Synthetic polypeptide
DEGEIVTTNPVATEQYGTVCSATDGPVEFEGNLD

SEQ ID NO: 155484 - protein, 32 aa, Artificial Sequence
  Description of Artificial Sequence: Synthetic polypeptide
DENEIRTTNPVSTEGYGTISQEDIQQMQNGNH

SEQ ID NO: 155485 - protein, 32 aa, Artificial Sequence
  Description of Artificial Sequence: Synthetic polypeptide
DENEIRTTNPVSTEGYGTISQEDIQGQQNGNV

SEQ ID NO: 155486 - protein, 32 aa, Artificial Sequence
  Description of Artificial Sequence: Synthetic polypeptide
DENEIRTTNPVSTEGYGTISQEDGGQQQNGNH

SEQ ID NO: 155487 - protein, 37 aa, Artificial Sequence
  Description of Artificial Sequence: Synthetic polypeptide
DEEEIRTTNPVATEQYGVVSTVVTNNNQAGTTTEEED

SEQ ID NO: 155488 - protein, 34 aa, Artificial Sequence
  Description of Artificial Sequence: Synthetic polypeptide
DEGEIVTTNPVATEQYGTVCSATDGPVEIFEGND

SEQ ID NO: 155489 - protein, 33 aa, Artificial Sequence
  Description of Artificial Sequence: Synthetic polypeptide
DENEIRTTNPVSTEGYGTISMSEDIQQEQFGNQ

SEQ ID NO: 155490 - protein, 37 aa, Artificial Sequence
  Description of Artificial Sequence: Synthetic polypeptide
DEEEIRTTNPVATEQYGVVSTVVTNNNQQGTEETEED

SEQ ID NO: 155491 - protein, 32 aa, Artificial Sequence
  Description of Artificial Sequence: Synthetic polypeptide
DENEIRTTNPVSTEGYGTISMEDIQQQQNGNI

SEQ ID NO: 155492 - protein, 32 aa, Artificial Sequence
  Description of Artificial Sequence: Synthetic polypeptide
DENEIRTTNPVSTEGYGTISMEDIQQQQNGNH

SEQ ID NO: 155493 - protein, 32 aa, Artificial Sequence
  Description of Artificial Sequence: Synthetic polypeptide
DENEIRTTNPVSTEGYGTISMEDIMQQQNGNH

SEQ ID NO: 155494 - protein, 38 aa, Artificial Sequence
  Description of Artificial Sequence: Synthetic polypeptide
DEEEIRTTNPVATEQYGVVSTVVTNNNQQGTENEEDEE

SEQ ID NO: 155495 - protein, 38 aa, Artificial Sequence
  Description of Artificial Sequence: Synthetic polypeptide
DEEEIRTTNPVATEQYGVVSTVVTNNNQQGTNNEEDED

SEQ ID NO: 155496 - protein, 38 aa, Artificial Sequence
  Description of Artificial Sequence: Synthetic polypeptide
DEEEIRTTNPVATEQYGVVSTVVTNNNQQGTNQEETED

SEQ ID NO: 155497 - protein, 34 aa, Artificial Sequence
  Description of Artificial Sequence: Synthetic polypeptide
DEGEISTTNPVATEQYGTVCSCTDGEPSEFEGND

SEQ ID NO: 155498 - protein, 32 aa, Artificial Sequence
  Description of Artificial Sequence: Synthetic polypeptide
DENEIRTTNPVSTEGYGTISMEDIQQQQNGQR

SEQ ID NO: 155499 - protein, 32 aa, Artificial Sequence
  Description of Artificial Sequence: Synthetic polypeptide
DENEIRTTNPVSTEEYGTISREDIQQQQNGNH

SEQ ID NO: 155500 - protein, 38 aa, Artificial Sequence
  Description of Artificial Sequence: Synthetic polypeptide
DEEEIRTTNPVATEQYGVVSTVVTNLQQNTEAGTTEGS

SEQ ID NO: 155501 - protein, 32 aa, Artificial Sequence
  Description of Artificial Sequence: Synthetic polypeptide
DENEIRTTNPVSTEPWGTISCENIPQQQNGNH

SEQ ID NO: 155502 - protein, 33 aa, Artificial Sequence
  Description of Artificial Sequence: Synthetic polypeptide
DENEIRTTNPVSTEPYGEVCSMEDIQQQQNGNH

SEQ ID NO: 155503 - protein, 34 aa, Artificial Sequence
  Description of Artificial Sequence: Synthetic polypeptide
DEGQIATTNPVATEQWGSVSTDHGPLANPGGNMT

SEQ ID NO: 155504 - protein, 31 aa, Artificial Sequence
  Description of Artificial Sequence: Synthetic polypeptide
DENEIRTTNPVSTEPYGEISMEVIQQQNENH

SEQ ID NO: 155505 - protein, 31 aa, Artificial Sequence
  Description of Artificial Sequence: Synthetic polypeptide
DENEIRTTNPVSTEPYGEISMEVIQQQNEEH

SEQ ID NO: 155506 - protein, 32 aa, Artificial Sequence
  Description of Artificial Sequence: Synthetic polypeptide
DENEIRTTNPVSTEPYGEISMEDIQQQQNGNH

SEQ ID NO: 155507 - protein, 35 aa, Artificial Sequence
  Description of Artificial Sequence: Synthetic polypeptide
DEAEIRTTNPVATEQYGSVCFSVDLEEEFQGSIYV

SEQ ID NO: 155508 - protein, 30 aa, Artificial Sequence
  Description of Artificial Sequence: Synthetic polypeptide
DENEIRTTNPVSTEPYGEIPMVIQQQNEEH

SEQ ID NO: 155509 - protein, 32 aa, Artificial Sequence
  Description of Artificial Sequence: Synthetic polypeptide
DENEIRTTNPVSTEPYGDVSMEDIQQQQNENH

SEQ ID NO: 155510 - protein, 32 aa, Artificial Sequence
  Description of Artificial Sequence: Synthetic polypeptide
DENEIRTTNPVSTEPYGDISMEDIQQSQNGNH

SEQ ID NO: 155511 - protein, 32 aa, Artificial Sequence
  Description of Artificial Sequence: Synthetic polypeptide
DENEIRTTNPVSTEPYGDISMEDIQQQQNGNH

SEQ ID NO: 155512 - protein, 32 aa, Artificial Sequence
  Description of Artificial Sequence: Synthetic polypeptide
DENEIRTTNPVSTEPYGDISMEDIQQQQNGNA

SEQ ID NO: 155513 - protein, 32 aa, Artificial Sequence
  Description of Artificial Sequence: Synthetic polypeptide
DENEIRTTNPVSTEPYGDISMEDIQMQQNGNA

SEQ ID NO: 155514 - protein, 32 aa, Artificial Sequence
  Description of Artificial Sequence: Synthetic polypeptide
DENEIRTTNPVSTEPYGCIVMEDIQQQQNGNH

SEQ ID NO: 155515 - protein, 32 aa, Artificial Sequence
  Description of Artificial Sequence: Synthetic polypeptide
DENEIRTTNPVSTEPYGCISWEDINQEQFNNQ

SEQ ID NO: 155516 - protein, 32 aa, Artificial Sequence
  Description of Artificial Sequence: Synthetic polypeptide
DENEIRTTNPVSTEPYGCISSEDKQQPQSGNH

SEQ ID NO: 155517 - protein, 32 aa, Artificial Sequence
  Description of Artificial Sequence: Synthetic polypeptide
DENEIACTNPVATEPYGTISMENIQQQRNGGH

SEQ ID NO: 155518 - protein, 35 aa, Artificial Sequence
  Description of Artificial Sequence: Synthetic polypeptide
DEEEISTTNPVATEQYGQCVCSTGEHNQHFGSDQS

SEQ ID NO: 155519 - protein, 32 aa, Artificial Sequence
  Description of Artificial Sequence: Synthetic polypeptide
DENEIRTTNPVSTEPYGFISMEDIQQQQNGNH

SEQ ID NO: 155520 - protein, 32 aa, Artificial Sequence
  Description of Artificial Sequence: Synthetic polypeptide
DENEIRTTNPVSTEPYGFISMEDIQQQQNGNY

SEQ ID NO: 155521 - protein, 33 aa, Artificial Sequence
  Description of Artificial Sequence: Synthetic polypeptide
DENEIRTTNPVSTEPYGFTISMEDITQQQNGNH

SEQ ID NO: 155522 - protein, 32 aa, Artificial Sequence
  Description of Artificial Sequence: Synthetic polypeptide
DENEIRTTNPVSTEPYGGISMEDIQQQLNGNH

SEQ ID NO: 155523 - protein, 32 aa, Artificial Sequence
  Description of Artificial Sequence: Synthetic polypeptide
DENEIRTTNPVSTEPYGLISMEDIQQQQNGNH

SEQ ID NO: 155524 - protein, 32 aa, Artificial Sequence
  Description of Artificial Sequence: Synthetic polypeptide
DENEIRTTNPVSTEPYGLISAEDIQQQLNGNH

SEQ ID NO: 155525 - protein, 36 aa, Artificial Sequence
  Description of Artificial Sequence: Synthetic polypeptide
DEAEICTTNPVATECWGVVSTGNGLLQDDRGQNGED

SEQ ID NO: 155526 - protein, 32 aa, Artificial Sequence
  Description of Artificial Sequence: Synthetic polypeptide
DENEIRTTNPVSTEPYGKISMEDIQQQQNGNH

SEQ ID NO: 155527 - protein, 36 aa, Artificial Sequence
  Description of Artificial Sequence: Synthetic polypeptide
DEAEIRTTNPVATEQYGSVCFSVYNQQEEFDGKQET

SEQ ID NO: 155528 - protein, 35 aa, Artificial Sequence
  Description of Artificial Sequence: Synthetic polypeptide
DEAEIRTTNPVATEQYGSVCFSVDNQEEFDGTIHM

SEQ ID NO: 155529 - protein, 32 aa, Artificial Sequence
  Description of Artificial Sequence: Synthetic polypeptide
DENEIRTTNPVSTEPYGITSMEDIQQQQNGNH

SEQ ID NO: 155530 - protein, 31 aa, Artificial Sequence
  Description of Artificial Sequence: Synthetic polypeptide
DENEIACTNPVATECYGETSNEEDWARGPYR

SEQ ID NO: 155531 - protein, 34 aa, Artificial Sequence
  Description of Artificial Sequence: Synthetic polypeptide
DEGQEIATTNPVAYEQWGTVVPTDNNDQRGGNDN

SEQ ID NO: 155532 - protein, 32 aa, Artificial Sequence
  Description of Artificial Sequence: Synthetic polypeptide
DENEIRTTNPVSTEPYGIISMEDIQQQQNGNH

SEQ ID NO: 155533 - protein, 32 aa, Artificial Sequence
  Description of Artificial Sequence: Synthetic polypeptide
DENEIRTTNPVSTEPYGHISMEDIQQQVNGNH

SEQ ID NO: 155534 - protein, 32 aa, Artificial Sequence
  Description of Artificial Sequence: Synthetic polypeptide
DENEIRTTNPVSTEPYGHISMEDIQQQQNGNH

SEQ ID NO: 155535 - protein, 32 aa, Artificial Sequence
  Description of Artificial Sequence: Synthetic polypeptide
DENEIRTTNPVSTEPYGHISMEDIQQQLNGNH

SEQ ID NO: 155536 - protein, 32 aa, Artificial Sequence
  Description of Artificial Sequence: Synthetic polypeptide
DENEIRTTNPVSTEPYGHISMEDIQIQQNGNH

SEQ ID NO: 155537 - protein, 32 aa, Artificial Sequence
  Description of Artificial Sequence: Synthetic polypeptide
DENEIRTTNPVSTEPYGHISDEDIQQQQNGNH

SEQ ID NO: 155538 - protein, 33 aa, Artificial Sequence
  Description of Artificial Sequence: Synthetic polypeptide
DENEIRTTNPVSTEPYGGISVLDIQQQQNGNHQ

SEQ ID NO: 155539 - protein, 32 aa, Artificial Sequence
  Description of Artificial Sequence: Synthetic polypeptide
DENEIRTTNPVSTEPYGGISMEEIQQQQNGNH

SEQ ID NO: 155540 - protein, 32 aa, Artificial Sequence
  Description of Artificial Sequence: Synthetic polypeptide
DENEIRTTNPVSTEPYGGISMEDIQQQQNGNH

SEQ ID NO: 155541 - protein, 33 aa, Artificial Sequence
  Description of Artificial Sequence: Synthetic polypeptide
DENEIRTTNPVSTEPYGHISMEDVIQQQQNGNH

SEQ ID NO: 155542 - protein, 30 aa, Artificial Sequence
  Description of Artificial Sequence: Synthetic polypeptide
DEGIIRTTNPVATEQWGDVSEIEMNAAEDA

SEQ ID NO: 155543 - protein, 32 aa, Artificial Sequence
  Description of Artificial Sequence: Synthetic polypeptide
DENEIRTTNPVSTEPYGCISMEDIQQYQFGNQ

SEQ ID NO: 155544 - protein, 32 aa, Artificial Sequence
  Description of Artificial Sequence: Synthetic polypeptide
DENEIRTTNPVSTEPYGCISMEDILQPQSGEH

SEQ ID NO: 155545 - protein, 28 aa, Artificial Sequence
  Description of Artificial Sequence: Synthetic peptide
CESEIASTNPVGTEGYGVMASALQHGDI

SEQ ID NO: 155546 - protein, 28 aa, Artificial Sequence
  Description of Artificial Sequence: Synthetic peptide
CESEIACTNPVGTEGWGVSASTLQTADI

SEQ ID NO: 155547 - protein, 37 aa, Artificial Sequence
  Description of Artificial Sequence: Synthetic polypeptide
DEAEIRTTNPVATEQYGSVCFPSVDLSQEEFGGSIRV

SEQ ID NO: 155548 - protein, 31 aa, Artificial Sequence
  Description of Artificial Sequence: Synthetic polypeptide
DENEIRTTNPVSTEPWGTVSEDIQMQQAENA

SEQ ID NO: 155549 - protein, 32 aa, Artificial Sequence
  Description of Artificial Sequence: Synthetic polypeptide
DENEIRTTNPVSTEPWGTISMVDIQVQQNGNH

SEQ ID NO: 155550 - protein, 32 aa, Artificial Sequence
  Description of Artificial Sequence: Synthetic polypeptide
DENEIRTTNPVSTEPWGTISMNDIQQQQNGNH

SEQ ID NO: 155551 - protein, 35 aa, Artificial Sequence
  Description of Artificial Sequence: Synthetic polypeptide
DEEEISTTNPVATEQYGQCVCSTMEHQNFGSQTQM

SEQ ID NO: 155552 - protein, 31 aa, Artificial Sequence
  Description of Artificial Sequence: Synthetic polypeptide
DENEIRTTNPVSTEPWGTISMIIQQNQNGNH

SEQ ID NO: 155553 - protein, 35 aa, Artificial Sequence
  Description of Artificial Sequence: Synthetic polypeptide
DEEEISTTNPVATEQYGQCVCSTMEHQSFGSDTQV

SEQ ID NO: 155554 - protein, 38 aa, Artificial Sequence
  Description of Artificial Sequence: Synthetic polypeptide
DEEEIRTTNPVATEQYGVVSTVVTNLQQLQQGTTEETE

SEQ ID NO: 155555 - protein, 32 aa, Artificial Sequence
  Description of Artificial Sequence: Synthetic polypeptide
DEACIRTTNPVATEQYGCVCQTGAHINFMSNQ

SEQ ID NO: 155556 - protein, 33 aa, Artificial Sequence
  Description of Artificial Sequence: Synthetic polypeptide
DDEEIRCTNPVATEQYGCVCSWELQENSISQQS

SEQ ID NO: 155557 - protein, 39 aa, Artificial Sequence
  Description of Artificial Sequence: Synthetic polypeptide
DEEEIRTTNPVATEQYGVVSTVVTNLQQLQQGTTNQEED

SEQ ID NO: 155558 - protein, 31 aa, Artificial Sequence
  Description of Artificial Sequence: Synthetic polypeptide
DENEIRTTNPVSTEPWGTISMEDIQQQNGNH

SEQ ID NO: 155559 - protein, 32 aa, Artificial Sequence
  Description of Artificial Sequence: Synthetic polypeptide
DENEIACTNPVATEQYGEASSEPAGPNRGNPV

SEQ ID NO: 155560 - protein, 31 aa, Artificial Sequence
  Description of Artificial Sequence: Synthetic polypeptide
DENEIRTTNPVSTEPWGTISEEDIQQQNGNH

SEQ ID NO: 155561 - protein, 33 aa, Artificial Sequence
  Description of Artificial Sequence: Synthetic polypeptide
DENEIACTNPVATEQYGEASSEPNGPQMRGGPV

SEQ ID NO: 155562 - protein, 29 aa, Artificial Sequence
  Description of Artificial Sequence: Synthetic peptide
CESEIASTNPVGTEGYGVMASTKEQHGDI

SEQ ID NO: 155563 - protein, 33 aa, Artificial Sequence
  Description of Artificial Sequence: Synthetic polypeptide
DENEIRTTNPVSTEPWGTVSMENEPQQQNGENH

SEQ ID NO: 155564 - protein, 33 aa, Artificial Sequence
  Description of Artificial Sequence: Synthetic polypeptide
DENEIRTTNPVSTEPWGTVSMIDEQQDREGENH

SEQ ID NO: 155565 - protein, 33 aa, Artificial Sequence
  Description of Artificial Sequence: Synthetic polypeptide
DENEIRTTNPVSTEPWGTVSMIDIQQDREGENH

SEQ ID NO: 155566 - protein, 32 aa, Artificial Sequence
  Description of Artificial Sequence: Synthetic polypeptide
DENEIRTTNPVSTEPYGCISMEDCQQPQSGNK

SEQ ID NO: 155567 - protein, 32 aa, Artificial Sequence
  Description of Artificial Sequence: Synthetic polypeptide
DENEIRTTNPVSTEPYGCISAEDIEQPQHGNH

SEQ ID NO: 155568 - protein, 34 aa, Artificial Sequence
  Description of Artificial Sequence: Synthetic polypeptide
DEGQEIATTNPVAYEQWGSVAWTENTGEQNGDHR

SEQ ID NO: 155569 - protein, 34 aa, Artificial Sequence
  Description of Artificial Sequence: Synthetic polypeptide
DEGQEIATTNPVAYEGWGSVATNLQGDAGNGSNN

SEQ ID NO: 155570 - protein, 36 aa, Artificial Sequence
  Description of Artificial Sequence: Synthetic polypeptide
DEAEICTTNPVATECYGNVSTGNGLLDDDRGQNDEA

SEQ ID NO: 155571 - protein, 39 aa, Artificial Sequence
  Description of Artificial Sequence: Synthetic polypeptide
DEEEIRTTNPVATEQYGVVSTVVTNLQQLQQGTNQQGTD

SEQ ID NO: 155572 - protein, 36 aa, Artificial Sequence
  Description of Artificial Sequence: Synthetic polypeptide
DEAEICTTNPVATECYGQVSTGNGLLDDDRGQNEEE

SEQ ID NO: 155573 - protein, 33 aa, Artificial Sequence
  Description of Artificial Sequence: Synthetic polypeptide
DENEIRTTNPVSTEPYGAISVEDCIQQPQSGNH

SEQ ID NO: 155574 - protein, 32 aa, Artificial Sequence
  Description of Artificial Sequence: Synthetic polypeptide
DENEIRTTNPVSTEPYGCISMEDIQQQQNGNH

SEQ ID NO: 155575 - protein, 32 aa, Artificial Sequence
  Description of Artificial Sequence: Synthetic polypeptide
DENEIRTTNPVSTEPYGAISMEDIQQQQNGNH

SEQ ID NO: 155576 - protein, 32 aa, Artificial Sequence
  Description of Artificial Sequence: Synthetic polypeptide
DENEIRTTNPVSTEPYGAISMEDIQQQPKGNH

SEQ ID NO: 155577 - protein, 32 aa, Artificial Sequence
  Description of Artificial Sequence: Synthetic polypeptide
DENEIRTTNPVSTEPYGAISMEDIQQQFNGNH

SEQ ID NO: 155578 - protein, 31 aa, Artificial Sequence
  Description of Artificial Sequence: Synthetic polypeptide
DENEIRTTNPVSTEPYGAIAMEDIQQQNGNH

SEQ ID NO: 155579 - protein, 31 aa, Artificial Sequence
  Description of Artificial Sequence: Synthetic polypeptide
DENEIRTTNPVSTEPYGAIAMEDIQEQNGNH

SEQ ID NO: 155580 - protein, 33 aa, Artificial Sequence
  Description of Artificial Sequence: Synthetic polypeptide
DENEIRTTNPVSTEPWGTVSMIDIQQQRNGENH

SEQ ID NO: 155581 - protein, 32 aa, Artificial Sequence
  Description of Artificial Sequence: Synthetic polypeptide
DENEIRTTNPVSTEPWGTVSMIDIQQQQNGNH

SEQ ID NO: 155582 - protein, 33 aa, Artificial Sequence
  Description of Artificial Sequence: Synthetic polypeptide
DENEIRTTNPVSTEPWGTVSMIDIQQDRNGENH

SEQ ID NO: 155583 - protein, 29 aa, Artificial Sequence
  Description of Artificial Sequence: Synthetic peptide
CESEIASTNPVGTEGYGVMASTLQYHGDI

SEQ ID NO: 155584 - protein, 32 aa, Artificial Sequence
  Description of Artificial Sequence: Synthetic polypeptide
DENEIRTTNPVSTEPYGAISMEDIQQQQKGNH

SEQ ID NO: 155585 - protein, 30 aa, Artificial Sequence
  Description of Artificial Sequence: Synthetic polypeptide
DENEIRTTNPVATEYWGDVSEIEMNAAEDA

SEQ ID NO: 155586 - protein, 32 aa, Artificial Sequence
  Description of Artificial Sequence: Synthetic polypeptide
DENEIRTTNPVSTEEYGTISMEDRQQQQNGNH

SEQ ID NO: 155587 - protein, 32 aa, Artificial Sequence
  Description of Artificial Sequence: Synthetic polypeptide
DEGEIRTTNPVSTEPYGMISMEDIQQQQNGNH

SEQ ID NO: 155588 - protein, 31 aa, Artificial Sequence
  Description of Artificial Sequence: Synthetic polypeptide
DDSEIRSTNPVSTEGWGNVAANIEQNRAGDR

SEQ ID NO: 155589 - protein, 31 aa, Artificial Sequence
  Description of Artificial Sequence: Synthetic polypeptide
DDSEIRSTNPVATEQYGNVSAEIIMNRVEQA

SEQ ID NO: 155590 - protein, 33 aa, Artificial Sequence
  Description of Artificial Sequence: Synthetic polypeptide
DENEIATTNPCAYGAHYGSVSTNLQHPDENAMH

SEQ ID NO: 155591 - protein, 30 aa, Artificial Sequence
  Description of Artificial Sequence: Synthetic polypeptide
DDSEIRSTNPVATEQWGDVSEIEMNAAGDA

SEQ ID NO: 155592 - protein, 36 aa, Artificial Sequence
  Description of Artificial Sequence: Synthetic polypeptide
DEEEISTTNPVATEQYGSCSSTTPAGPNMRNGMNPV

SEQ ID NO: 155593 - protein, 37 aa, Artificial Sequence
  Description of Artificial Sequence: Synthetic polypeptide
DEEEISTTNPVATEQYGSMVSSTTPAGPNMRNGMNPV

SEQ ID NO: 155594 - protein, 30 aa, Artificial Sequence
  Description of Artificial Sequence: Synthetic polypeptide
DENEIRTTNPVAYEQWGDVSWIEMNPAEDA

SEQ ID NO: 155595 - protein, 30 aa, Artificial Sequence
  Description of Artificial Sequence: Synthetic polypeptide
DENEIRTTNPVAYEQWGDVSEIEMNAAEDV

SEQ ID NO: 155596 - protein, 30 aa, Artificial Sequence
  Description of Artificial Sequence: Synthetic polypeptide
DENEIRTTNPVAYEQWGDVSEIEMNAAEDA

SEQ ID NO: 155597 - protein, 32 aa, Artificial Sequence
  Description of Artificial Sequence: Synthetic polypeptide
DDSEIRSTNPVATEGYGNVANATIQERVGQYR

SEQ ID NO: 155598 - protein, 30 aa, Artificial Sequence
  Description of Artificial Sequence: Synthetic polypeptide
DENEIRTTNPVAYEQWGCVSEGEMNAAEDA

SEQ ID NO: 155599 - protein, 35 aa, Artificial Sequence
  Description of Artificial Sequence: Synthetic polypeptide
DEEEIRTTNPVAYEQWGHNNVSYWEEQQHRPGGNE

SEQ ID NO: 155600 - protein, 35 aa, Artificial Sequence
  Description of Artificial Sequence: Synthetic polypeptide
DEEEIRTTNPVAYEQWGHNNVSYTIPEDQHRPGGF

SEQ ID NO: 155601 - protein, 35 aa, Artificial Sequence
  Description of Artificial Sequence: Synthetic polypeptide
CEEEIRTTNPVATEQYGDVVNGQSTLEQGGGGGEE

SEQ ID NO: 155602 - protein, 36 aa, Artificial Sequence
  Description of Artificial Sequence: Synthetic polypeptide
DEEEIRTTNPVAYEQWGHNNVSYTENEDQHRPGGDA

SEQ ID NO: 155603 - protein, 32 aa, Artificial Sequence
  Description of Artificial Sequence: Synthetic polypeptide
DDSEIATTNPVSTEQYGSVAANTLESHEGQDL

SEQ ID NO: 155604 - protein, 30 aa, Artificial Sequence
  Description of Artificial Sequence: Synthetic polypeptide
DDSEIATTNPVSTEQYGNVANTEMSRVEQA

SEQ ID NO: 155605 - protein, 31 aa, Artificial Sequence
  Description of Artificial Sequence: Synthetic polypeptide
DDSEIRSTNPVSTEGWGNVAANIEQNRVGDR

SEQ ID NO: 155606 - protein, 31 aa, Artificial Sequence
  Description of Artificial Sequence: Synthetic polypeptide
DDSEIRSTNPVSTEGWGNVAANIEQSRVGDR

SEQ ID NO: 155607 - protein, 30 aa, Artificial Sequence
  Description of Artificial Sequence: Synthetic polypeptide
DDSEIRSTNPVSTEGWGNVANIEQNRAGDR

SEQ ID NO: 155608 - protein, 33 aa, Artificial Sequence
  Description of Artificial Sequence: Synthetic polypeptide
DDSEIRSTNPVSTEGWGSVSCINEPQSREGENG

SEQ ID NO: 155609 - protein, 36 aa, Artificial Sequence
  Description of Artificial Sequence: Synthetic polypeptide
DEEEIRTTNPVAYEQWGHTNVSYWNELQHRPGHGGN

SEQ ID NO: 155610 - protein, 31 aa, Artificial Sequence
  Description of Artificial Sequence: Synthetic polypeptide
DENEIRTTNPVAYEQWGTVSKEIETKAGEDA

SEQ ID NO: 155611 - protein, 32 aa, Artificial Sequence
  Description of Artificial Sequence: Synthetic polypeptide
DENEIRTTNPVAYEQWGTVSKEIEMNTADGDA

SEQ ID NO: 155612 - protein, 30 aa, Artificial Sequence
  Description of Artificial Sequence: Synthetic polypeptide
DENEIATTNPCATEQWGDVSEIEQNAAETA

SEQ ID NO: 155613 - protein, 33 aa, Artificial Sequence
  Description of Artificial Sequence: Synthetic polypeptide
DDSEIRSTNPVSTEGYGSVSACINIPQSREGQG

SEQ ID NO: 155614 - protein, 32 aa, Artificial Sequence
  Description of Artificial Sequence: Synthetic polypeptide
DENEIRTTNPVAYEQWGTVSKEIEMNGTENDA

SEQ ID NO: 155615 - protein, 32 aa, Artificial Sequence
  Description of Artificial Sequence: Synthetic polypeptide
DENEIRTTNPVAYEQWGTVSKEIEMNALEGDA

SEQ ID NO: 155616 - protein, 34 aa, Artificial Sequence
  Description of Artificial Sequence: Synthetic polypeptide
DEEEIRTTNPVAYEQWGHTNVSYWEEQQHRPGGE

SEQ ID NO: 155617 - protein, 35 aa, Artificial Sequence
  Description of Artificial Sequence: Synthetic polypeptide
DEEEIRTTNPVAYEQWGEYCSNQRNDDLQRQDIRR

SEQ ID NO: 155618 - protein, 31 aa, Artificial Sequence
  Description of Artificial Sequence: Synthetic polypeptide
DENEIRTTNPVAYEQWGTVSKEIEDNGAIDA

SEQ ID NO: 155619 - protein, 30 aa, Artificial Sequence
  Description of Artificial Sequence: Synthetic polypeptide
CENEIATTNPVAYEPYGTVSLHLSQHETEL

SEQ ID NO: 155620 - protein, 31 aa, Artificial Sequence
  Description of Artificial Sequence: Synthetic polypeptide
DENEIRTTNPVAYEQWGTVSKEDEMNGSEDA

SEQ ID NO: 155621 - protein, 31 aa, Artificial Sequence
  Description of Artificial Sequence: Synthetic polypeptide
DEGEIRTTNPVAYEQWGTVSKEIEMNTGEDA

SEQ ID NO: 155622 - protein, 38 aa, Artificial Sequence
  Description of Artificial Sequence: Synthetic polypeptide
DEEEIRTTNPVATEQYGVVSTVVTNQQGNQQGNATEEN

SEQ ID NO: 155623 - protein, 38 aa, Artificial Sequence
  Description of Artificial Sequence: Synthetic polypeptide
DEEEIRTTNPVATEQYGVVSTVVTNQQGNQQGNIGEES

SEQ ID NO: 155624 - protein, 32 aa, Artificial Sequence
  Description of Artificial Sequence: Synthetic polypeptide
DDSEIRSTNPVSTEGYGNVAANNIPQSREGQR

SEQ ID NO: 155625 - protein, 38 aa, Artificial Sequence
  Description of Artificial Sequence: Synthetic polypeptide
DEEEIRTTNPVATEQYGVVSTVVTNQQGNQQGNINTTN

SEQ ID NO: 155626 - protein, 32 aa, Artificial Sequence
  Description of Artificial Sequence: Synthetic polypeptide
DDSEIRSTNPVSTEGWGSVSCINEPQSREGQG

SEQ ID NO: 155627 - protein, 31 aa, Artificial Sequence
  Description of Artificial Sequence: Synthetic polypeptide
DEGEIRTTNPVAYEQWGYCQEDLKRENDSKA

SEQ ID NO: 155628 - protein, 31 aa, Artificial Sequence
  Description of Artificial Sequence: Synthetic polypeptide
DENEIASVNPVSTEPYGVVSDENIQQSNGNH

SEQ ID NO: 155629 - protein, 32 aa, Artificial Sequence
  Description of Artificial Sequence: Synthetic polypeptide
DDSEIATTNPVSTEQYGNVAANTLQSHVGQDL

SEQ ID NO: 155630 - protein, 38 aa, Artificial Sequence
  Description of Artificial Sequence: Synthetic polypeptide
DEEEIRTTNPVATEQYGVVSTVVTNQQGNTEAGNTEGQ

SEQ ID NO: 155631 - protein, 31 aa, Artificial Sequence
  Description of Artificial Sequence: Synthetic polypeptide
DDSEIATTNPVATEGWGNVANITEQDREGNG

SEQ ID NO: 155632 - protein, 31 aa, Artificial Sequence
  Description of Artificial Sequence: Synthetic polypeptide
DDSEIASTNPVSTEQYGNVAANTIMSRVGQR

SEQ ID NO: 155633 - protein, 30 aa, Artificial Sequence
  Description of Artificial Sequence: Synthetic polypeptide
DENEIRTTNPVATYQWGDVSEIEHNAAEDA

SEQ ID NO: 155634 - protein, 30 aa, Artificial Sequence
  Description of Artificial Sequence: Synthetic polypeptide
DENEIATTNPCSTEQWGDVSEIEQNAAGTA

SEQ ID NO: 155635 - protein, 31 aa, Artificial Sequence
  Description of Artificial Sequence: Synthetic polypeptide
DDSEIASTNPVSTEPYGNVSMTIQQQRVGQH

SEQ ID NO: 155636 - protein, 34 aa, Artificial Sequence
  Description of Artificial Sequence: Synthetic polypeptide
CEEEIRTTNPVATEQYGQCVCSSEHQNFISDNQE

SEQ ID NO: 155637 - protein, 38 aa, Artificial Sequence
  Description of Artificial Sequence: Synthetic polypeptide
DEEEIRTTNPVATEQYGVVSTVVTNQQNQNGNNDEEED

SEQ ID NO: 155638 - protein, 34 aa, Artificial Sequence
  Description of Artificial Sequence: Synthetic polypeptide
DENEIRTTNPVATWHYGSVSTMNQEQVIQTEDDF

SEQ ID NO: 155639 - protein, 34 aa, Artificial Sequence
  Description of Artificial Sequence: Synthetic polypeptide
DENEIRTTNPVATWHYGSVSTMNQEQVDQTSEDF

SEQ ID NO: 155640 - protein, 34 aa, Artificial Sequence
  Description of Artificial Sequence: Synthetic polypeptide
DENEIRTTNPVATWHYGSVSTMNEQEVVETEEDF

SEQ ID NO: 155641 - protein, 38 aa, Artificial Sequence
  Description of Artificial Sequence: Synthetic polypeptide
DEEEIRTTNPVATEQYGVVSTVVTNQQNQQGTNTTTND

SEQ ID NO: 155642 - protein, 30 aa, Artificial Sequence
  Description of Artificial Sequence: Synthetic polypeptide
DENEIRTTNPVATSQWGVVSEIEMNAAEDA

SEQ ID NO: 155643 - protein, 30 aa, Artificial Sequence
  Description of Artificial Sequence: Synthetic polypeptide
DDSEIASTNPVSTEGYGVVSANTIQSSGQQ

SEQ ID NO: 155644 - protein, 30 aa, Artificial Sequence
  Description of Artificial Sequence: Synthetic polypeptide
DENEIRTTNPVATSQWGDVSEIEMNAAEDA

SEQ ID NO: 155645 - protein, 30 aa, Artificial Sequence
  Description of Artificial Sequence: Synthetic polypeptide
DENEIRTTNPVATLQWGDVSEGEMNAAEDA

SEQ ID NO: 155646 - protein, 34 aa, Artificial Sequence
  Description of Artificial Sequence: Synthetic polypeptide
CEEEIRTTNPVATEQYGQCVCSSMEHQYFGSEQS

SEQ ID NO: 155647 - protein, 32 aa, Artificial Sequence
  Description of Artificial Sequence: Synthetic polypeptide
DDSEIASTNPVSTEGYGSVSACITIQSRVGQR

SEQ ID NO: 155648 - protein, 32 aa, Artificial Sequence
  Description of Artificial Sequence: Synthetic polypeptide
DDSEIATTNPVATEGWGNVSNITEQDREGENG

SEQ ID NO: 155649 - protein, 32 aa, Artificial Sequence
  Description of Artificial Sequence: Synthetic polypeptide
DDSEIATTNPVATEGWGSVACINEQSRVGEQG

SEQ ID NO: 155650 - protein, 35 aa, Artificial Sequence
  Description of Artificial Sequence: Synthetic polypeptide
DEEEISTTNPVATEQYGSVLVCTRASSNNGGNNET

SEQ ID NO: 155651 - protein, 36 aa, Artificial Sequence
  Description of Artificial Sequence: Synthetic polypeptide
CEEEIRTTNPVATEQYGQCVCSNTEHNQNFGSQNQE

SEQ ID NO: 155652 - protein, 36 aa, Artificial Sequence
  Description of Artificial Sequence: Synthetic polypeptide
CEEEIRTTNPVATEQYGDVVTMTVGDNGQRFNANGQ

SEQ ID NO: 155653 - protein, 34 aa, Artificial Sequence
  Description of Artificial Sequence: Synthetic polypeptide
CEEEIRTTNPVATEQYGDVVVGLQQEQGGGGGEE

SEQ ID NO: 155654 - protein, 37 aa, Artificial Sequence
  Description of Artificial Sequence: Synthetic polypeptide
DEEEIRTTNPVATEQYGVVSTVVTNQQGNTEAGTTTE

SEQ ID NO: 155655 - protein, 32 aa, Artificial Sequence
  Description of Artificial Sequence: Synthetic polypeptide
DDSEIATTNPVSTEGYGSVACINEQSRVGEQG

SEQ ID NO: 155656 - protein, 33 aa, Artificial Sequence
  Description of Artificial Sequence: Synthetic polypeptide
DEGEIRTTNPVAYEQWGSTYHTLNDDFQQAGIH

SEQ ID NO: 155657 - protein, 32 aa, Artificial Sequence
  Description of Artificial Sequence: Synthetic polypeptide
DDSEIATTNPVSTEGYGNVAANPAIQSRVGQR

SEQ ID NO: 155658 - protein, 33 aa, Artificial Sequence
  Description of Artificial Sequence: Synthetic polypeptide
DEGEIRTTNPVAYEQWGSTYHTLNDDFQAMGAG

SEQ ID NO: 155659 - protein, 31 aa, Artificial Sequence
  Description of Artificial Sequence: Synthetic polypeptide
DENEIRTTNPVAWEQWGDVSEIEMNAAEDAP

SEQ ID NO: 155660 - protein, 32 aa, Artificial Sequence
  Description of Artificial Sequence: Synthetic polypeptide
DDSEIATTNPVSTEQYGNVAANTLQSHEGQDL

SEQ ID NO: 155661 - protein, 30 aa, Artificial Sequence
  Description of Artificial Sequence: Synthetic polypeptide
DENEIRTTNPVAWEQWGDVSEIEMNAAEDA

SEQ ID NO: 155662 - protein, 30 aa, Artificial Sequence
  Description of Artificial Sequence: Synthetic polypeptide
DDSEIATTNPVSTEGWGNVANTEQDREGNG

SEQ ID NO: 155663 - protein, 31 aa, Artificial Sequence
  Description of Artificial Sequence: Synthetic polypeptide
DDSEIATTNPVSTEGWGNVAANTIQDREGNG

SEQ ID NO: 155664 - protein, 36 aa, Artificial Sequence
  Description of Artificial Sequence: Synthetic polypeptide
DEEEIRTTNPVATEQYGVVSTVVTNQQGTTEEEEED

SEQ ID NO: 155665 - protein, 34 aa, Artificial Sequence
  Description of Artificial Sequence: Synthetic polypeptide
DDSEIATTNPVATEQYGSVSATPDLEDHIGEDLY

SEQ ID NO: 155666 - protein, 34 aa, Artificial Sequence
  Description of Artificial Sequence: Synthetic polypeptide
DEEEIRTTNPVAYEQWGCSYNVRNDRDGRGDRPA

SEQ ID NO: 155667 - protein, 30 aa, Artificial Sequence
  Description of Artificial Sequence: Synthetic polypeptide
DENEIATTNPCSSEQWGDVSCIEQNAAGTR

SEQ ID NO: 155668 - protein, 30 aa, Artificial Sequence
  Description of Artificial Sequence: Synthetic polypeptide
DENEIATTNPCSSEQWGDVSCIEQNSAGTR

SEQ ID NO: 155669 - protein, 35 aa, Artificial Sequence
  Description of Artificial Sequence: Synthetic polypeptide
DEEEIRTTNPVAYEQWGCSYNSINDGDQRGHMPTN

SEQ ID NO: 155670 - protein, 30 aa, Artificial Sequence
  Description of Artificial Sequence: Synthetic polypeptide
DDSEIATTNPVSTEGWGNVANTIQDREGNG

SEQ ID NO: 155671 - protein, 32 aa, Artificial Sequence
  Description of Artificial Sequence: Synthetic polypeptide
DENEIRTTNPVSTEEYGTISMEDIQQQQNGNH

SEQ ID NO: 155672 - protein, 31 aa, Artificial Sequence
  Description of Artificial Sequence: Synthetic polypeptide
DEGEIRTTNPVAYEQWGYCQEDTKRGMDNNG

SEQ ID NO: 155673 - protein, 38 aa, Artificial Sequence
  Description of Artificial Sequence: Synthetic polypeptide
DEEEIRTTNPVATEQYGVVSTVVTNQQGNQAGNNNEGQ

SEQ ID NO: 155674 - protein, 32 aa, Artificial Sequence
  Description of Artificial Sequence: Synthetic polypeptide
DENEIACTNPVSTEPYGTASEENLQQQQNGNH

SEQ ID NO: 155675 - protein, 33 aa, Artificial Sequence
  Description of Artificial Sequence: Synthetic polypeptide
DENEIRTTNPVSTECYGSISCIDEPQDQNGENG

SEQ ID NO: 155676 - protein, 33 aa, Artificial Sequence
  Description of Artificial Sequence: Synthetic polypeptide
DENEIRTTNPVSTECYGSISCIDEPQDQEGENG

SEQ ID NO: 155677 - protein, 32 aa, Artificial Sequence
  Description of Artificial Sequence: Synthetic polypeptide
DENEIRTTNPVSTECYGQISMEDIQQQQNGNH

SEQ ID NO: 155678 - protein, 33 aa, Artificial Sequence
  Description of Artificial Sequence: Synthetic polypeptide
DENEIRTTNPVSTECWGTVSMENEPQQQNGENH

SEQ ID NO: 155679 - protein, 33 aa, Artificial Sequence
  Description of Artificial Sequence: Synthetic polypeptide
DENEIRTTNPVSTECWGTVSCENIPQDQEGENG

SEQ ID NO: 155680 - protein, 32 aa, Artificial Sequence
  Description of Artificial Sequence: Synthetic polypeptide
DENEIRTTNPVSTECWGTISCENIPQQQNGNH

SEQ ID NO: 155681 - protein, 33 aa, Artificial Sequence
  Description of Artificial Sequence: Synthetic polypeptide
DENEIRTTNPVSTECWGSISCIDEPQDREGENG

SEQ ID NO: 155682 - protein, 33 aa, Artificial Sequence
  Description of Artificial Sequence: Synthetic polypeptide
DENEIRTTNPVSTEAYGTISWEDHNQEQFGNQS

SEQ ID NO: 155683 - protein, 32 aa, Artificial Sequence
  Description of Artificial Sequence: Synthetic polypeptide
DENEIRTTNPVSTEAYGTISMEDIQQQQNGNH

SEQ ID NO: 155684 - protein, 32 aa, Artificial Sequence
  Description of Artificial Sequence: Synthetic polypeptide
DENEIRTTNPVSTEAYGTISMEDIQMQQNGNH

SEQ ID NO: 155685 - protein, 32 aa, Artificial Sequence
  Description of Artificial Sequence: Synthetic polypeptide
DENEIRTTNPVSTEAYGTISIEDIQQQQNGNH

SEQ ID NO: 155686 - protein, 29 aa, Artificial Sequence
  Description of Artificial Sequence: Synthetic peptide
DENEIAPTNPCSSEPYGTISCNIQQQGTR

SEQ ID NO: 155687 - protein, 36 aa, Artificial Sequence
  Description of Artificial Sequence: Synthetic polypeptide
DEEEIRTTNPVATEQYGSYMENTNVQGNLVIEDLGE

SEQ ID NO: 155688 - protein, 32 aa, Artificial Sequence
  Description of Artificial Sequence: Synthetic polypeptide
DENEIRTTNPVSSEPYGTISMENIQQQQNGNH

SEQ ID NO: 155689 - protein, 36 aa, Artificial Sequence
  Description of Artificial Sequence: Synthetic polypeptide
DEEEIRTTNPVATEQYGSYMENTGVQGNLVHENLGE

SEQ ID NO: 155690 - protein, 32 aa, Artificial Sequence
  Description of Artificial Sequence: Synthetic polypeptide
DENEIRTTNPVSSEPYGTISMEDIQQQQNGNR

SEQ ID NO: 155691 - protein, 31 aa, Artificial Sequence
  Description of Artificial Sequence: Synthetic polypeptide
DENEIACTNPVSTEPYGTASEENIQQQQGGR

SEQ ID NO: 155692 - protein, 32 aa, Artificial Sequence
  Description of Artificial Sequence: Synthetic polypeptide
DENEIRTTNPVSTECYGTCSGEDIHQQQNGNH

SEQ ID NO: 155693 - protein, 32 aa, Artificial Sequence
  Description of Artificial Sequence: Synthetic polypeptide
DENEIRTTNPVSTECYGTCSHEDIQQQQNGNS

SEQ ID NO: 155694 - protein, 33 aa, Artificial Sequence
  Description of Artificial Sequence: Synthetic polypeptide
DENEIRTTNPVSTECYGTCSMEDNQQQQNGGNH

SEQ ID NO: 155695 - protein, 32 aa, Artificial Sequence
  Description of Artificial Sequence: Synthetic polypeptide
DENEIRTTNPVSTEEYGTISMEDIQQEQSGNL

SEQ ID NO: 155696 - protein, 34 aa, Artificial Sequence
  Description of Artificial Sequence: Synthetic polypeptide
DEAEIRTTNPVATEQYGSVCEGTPDSLPEPEEQG

SEQ ID NO: 155697 - protein, 33 aa, Artificial Sequence
  Description of Artificial Sequence: Synthetic polypeptide
DEAEIRTTNPVATEQYGSVCEGTPDGHPEPEEQ

SEQ ID NO: 155698 - protein, 34 aa, Artificial Sequence
  Description of Artificial Sequence: Synthetic polypeptide
DEAEIRTTNPVATEQYGSVCEGTAVALPEPEEQI

SEQ ID NO: 155699 - protein, 33 aa, Artificial Sequence
  Description of Artificial Sequence: Synthetic polypeptide
DENEIACTNPVATEQYGTVCSAEDNPVQFEGGD

SEQ ID NO: 155700 - protein, 33 aa, Artificial Sequence
  Description of Artificial Sequence: Synthetic polypeptide
DEEEIRTTNPVATEQYGSYQANGNEIMATQLVL

SEQ ID NO: 155701 - protein, 30 aa, Artificial Sequence
  Description of Artificial Sequence: Synthetic polypeptide
CENEIRTTNPVATEQWGDVSEIEMNAAEDA

SEQ ID NO: 155702 - protein, 37 aa, Artificial Sequence
  Description of Artificial Sequence: Synthetic polypeptide
DEEEIRTTNPVATEQYGVVSTVVTNNQQQGTTEETTE

SEQ ID NO: 155703 - protein, 33 aa, Artificial Sequence
  Description of Artificial Sequence: Synthetic polypeptide
DEEEIRTTNPVATEQYGSYHYTDPYGVEEEEWD

SEQ ID NO: 155704 - protein, 38 aa, Artificial Sequence
  Description of Artificial Sequence: Synthetic polypeptide
DEEEIRTTNPVATEQYGVVSTVVTNQGNLNQGNTEQGQ

SEQ ID NO: 155705 - protein, 32 aa, Artificial Sequence
  Description of Artificial Sequence: Synthetic polypeptide
DENEIRTTNPVSTECYGTISMRDIQQQQNGNH

SEQ ID NO: 155706 - protein, 32 aa, Artificial Sequence
  Description of Artificial Sequence: Synthetic polypeptide
DENEIRTTNPVSTECYGTISMEDIQQQQNGNH

SEQ ID NO: 155707 - protein, 31 aa, Artificial Sequence
  Description of Artificial Sequence: Synthetic polypeptide
DENEIRTTNPVSTECYGTISMEDIQQQQGEL

SEQ ID NO: 155708 - protein, 31 aa, Artificial Sequence
  Description of Artificial Sequence: Synthetic polypeptide
DENEIRTTNPVSTECYGTISMEDIQQQNGEH

SEQ ID NO: 155709 - protein, 31 aa, Artificial Sequence
  Description of Artificial Sequence: Synthetic polypeptide
DENEIRTTNPVSTECYGTISEEDIQQQNGEH

SEQ ID NO: 155710 - protein, 33 aa, Artificial Sequence
  Description of Artificial Sequence: Synthetic polypeptide
DENEIRTTNPVSTECYGTISCINIQQQQNGENG

SEQ ID NO: 155711 - protein, 32 aa, Artificial Sequence
  Description of Artificial Sequence: Synthetic polypeptide
DENEIRTTNPVSTECYGTISCEDIQQQQNGNG

SEQ ID NO: 155712 - protein, 32 aa, Artificial Sequence
  Description of Artificial Sequence: Synthetic polypeptide
DENEIRTTNPVSTECYGTISAEDIQQQQNGNP

SEQ ID NO: 155713 - protein, 38 aa, Artificial Sequence
  Description of Artificial Sequence: Synthetic polypeptide
DEEEIRTTNPVATEQYGVVSTVVTNQNGNQQGNDDEEE

SEQ ID NO: 155714 - protein, 38 aa, Artificial Sequence
  Description of Artificial Sequence: Synthetic polypeptide
DEEEIRTTNPVATEQYGVVSTVVTNQQGNQNGNINEGS

SEQ ID NO: 155715 - protein, 31 aa, Artificial Sequence
  Description of Artificial Sequence: Synthetic polypeptide
DENEIRTTNPVSSEPYGTISMEDIQQQNGNH

SEQ ID NO: 155716 - protein, 30 aa, Artificial Sequence
  Description of Artificial Sequence: Synthetic polypeptide
DENEIRTTNPVSSEPYGTISMDIQQQQGTH

SEQ ID NO: 155717 - protein, 32 aa, Artificial Sequence
  Description of Artificial Sequence: Synthetic polypeptide
DENEIRTTNPVGTEPYGTISMEDIQQQQNGNH

SEQ ID NO: 155718 - protein, 33 aa, Artificial Sequence
  Description of Artificial Sequence: Synthetic polypeptide
DENEIRTTNPVGTEPYGSHSMEDIQQQQNGNTH

SEQ ID NO: 155719 - protein, 38 aa, Artificial Sequence
  Description of Artificial Sequence: Synthetic polypeptide
DEEEIRTTNPVATEQYGVVSTVVTNQQAGNQNGNDEDE

SEQ ID NO: 155720 - protein, 30 aa, Artificial Sequence
  Description of Artificial Sequence: Synthetic polypeptide
DENEIRTTNPVCTEQWGDVSEKEMNAAEDA

SEQ ID NO: 155721 - protein, 38 aa, Artificial Sequence
  Description of Artificial Sequence: Synthetic polypeptide
DEEEIRTTNPVATEQYGVVSTVVTNQQAGTEQGTNQED

SEQ ID NO: 155722 - protein, 38 aa, Artificial Sequence
  Description of Artificial Sequence: Synthetic polypeptide
DEEEIRTTNPVATEQYGVVSTVVTNQQGNLNAGNNEGQ

SEQ ID NO: 155723 - protein, 31 aa, Artificial Sequence
  Description of Artificial Sequence: Synthetic polypeptide
DENEIRTTNPVCTEQWGDVSEIEMNAAEDAK

SEQ ID NO: 155724 - protein, 38 aa, Artificial Sequence
  Description of Artificial Sequence: Synthetic polypeptide
DEEEIRTTNPVATEQYGVVSTVVTNQQGNLQGNENEEA
